United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 3

SEQ ID NO: 71307 - RNA, 22 nt, Human
uguugucaugcagucaguggua

SEQ ID NO: 71308 - RNA, 22 nt, Human
uugguuaccuucagaaaugagu

SEQ ID NO: 71309 - RNA, 18 nt, Human
uguugguguucacucacu

SEQ ID NO: 71310 - RNA, 22 nt, Human
uguugaaacagcuauugacuuu

SEQ ID NO: 71311 - RNA, 22 nt, Human
uguugaagcaccucugucuuuc

SEQ ID NO: 71312 - RNA, 22 nt, Human
uguucuuacuaaguaccugaaa

SEQ ID NO: 71313 - RNA, 22 nt, Human
uuggggaaaaagaccuaaugac

SEQ ID NO: 71314 - RNA, 22 nt, Human
uugggauucugucagugugugu

SEQ ID NO: 71315 - RNA, 22 nt, Human
uugggagaggcagcagagucau

SEQ ID NO: 71316 - RNA, 22 nt, Human
uuggcuuuucaguuuuaaguua

SEQ ID NO: 71317 - RNA, 22 nt, Human
uuggcuucuugcuaggaagcug

SEQ ID NO: 71318 - RNA, 22 nt, Human
uugggaaauuugaaaauaaaag

SEQ ID NO: 71319 - RNA, 22 nt, Human
uguuaaaaagucccuguuuugu

SEQ ID NO: 71320 - RNA, 19 nt, Human
uuggagcaucccaaaggcu

SEQ ID NO: 71321 - RNA, 22 nt, Human
uuggauguccucuguggaguau

SEQ ID NO: 71322 - RNA, 22 nt, Human
uuggaggucucugugguggugg

SEQ ID NO: 71323 - RNA, 22 nt, Human
uuggaggccacagucaucuuua

SEQ ID NO: 71324 - RNA, 22 nt, Human
uugcuuugcuucuuuaugguca

SEQ ID NO: 71325 - RNA, 22 nt, Human
uugcuuucuuuguagguuuucc

SEQ ID NO: 71326 - RNA, 22 nt, Human
uuggaaaagaaauacucauaua

SEQ ID NO: 71327 - RNA, 22 nt, Human
uugcuuuuuuggguuuacuggg

SEQ ID NO: 71328 - RNA, 22 nt, Human
uuggaaaugcauuuguuauuau

SEQ ID NO: 71329 - RNA, 21 nt, Human
uugcuggagcaauguaaauca

SEQ ID NO: 71330 - RNA, 22 nt, Human
uugcugaggcuggggagaggug

SEQ ID NO: 71331 - RNA, 22 nt, Human
ugugcuauuuuugcauaugugu

SEQ ID NO: 71332 - RNA, 22 nt, Human
ugugcgucuguguacagaugug

SEQ ID NO: 71333 - RNA, 22 nt, Human
ugugcuugucuguuuugauugu

SEQ ID NO: 71334 - RNA, 18 nt, Human
uugcucucucugggggca

SEQ ID NO: 71335 - RNA, 22 nt, Human
uuucucagcauauugccuuuga

SEQ ID NO: 71336 - RNA, 22 nt, Human
uuucuauuuacagugcuaggua

SEQ ID NO: 71337 - RNA, 19 nt, Human
uuucucacugagucguuug

SEQ ID NO: 71338 - RNA, 22 nt, Human
uuucuaguagcuacagcaccau

SEQ ID NO: 71339 - RNA, 22 nt, Human
uuucuaguauauaacuagaucu

SEQ ID NO: 71340 - RNA, 22 nt, Human
uuucuauauucaguuucauaaa

SEQ ID NO: 71341 - RNA, 22 nt, Human
uuucuaaguuugaggcgaagca

SEQ ID NO: 71342 - RNA, 22 nt, Human
uuauuguuuggguauaauuuga

SEQ ID NO: 71343 - RNA, 22 nt, Human
uuuccuuuguuuugguauaugu

SEQ ID NO: 71344 - RNA, 22 nt, Human
uuuccuuacuuauaaaaugggg

SEQ ID NO: 71345 - RNA, 22 nt, Human
uuucuaaaauuacugcagucgg

SEQ ID NO: 71346 - RNA, 22 nt, Human
uuucuaaaaccagaguuuauaa

SEQ ID NO: 71347 - RNA, 22 nt, Human
uuaugugcuacacauaauuugu

SEQ ID NO: 71348 - RNA, 22 nt, Human
uuuccugacuucaccuuuuacc

SEQ ID NO: 71349 - RNA, 22 nt, Human
uuucccuugcgcuugcucuccg

SEQ ID NO: 71350 - RNA, 22 nt, Human
uuauucuuagccucgguauuuc

SEQ ID NO: 71351 - RNA, 22 nt, Human
uuauguugauaggaaucugauu

SEQ ID NO: 71352 - RNA, 22 nt, Human
uuuccuguuuugguuuggagag

SEQ ID NO: 71353 - RNA, 22 nt, Human
uuucagagaaagcccaaagacu

SEQ ID NO: 71354 - RNA, 22 nt, Human
uuuccuaggaaaugauugaagu

SEQ ID NO: 71355 - RNA, 22 nt, Human
uuuccugcagacaguuuaagca

SEQ ID NO: 71356 - RNA, 22 nt, Human
uuuccuuaauuguaaaauggag

SEQ ID NO: 71357 - RNA, 22 nt, Human
uuauauuuuauuuaauuaaaua

SEQ ID NO: 71358 - RNA, 22 nt, Human
uuucacuucgaucagaguuuuu

SEQ ID NO: 71359 - RNA, 22 nt, Human
uuauacuucugccagaggacaa

SEQ ID NO: 71360 - RNA, 21 nt, Human
uuucauaggguuaaaggguua

SEQ ID NO: 71361 - RNA, 22 nt, Human
uuucagugaaugaauggcuaac

SEQ ID NO: 71362 - RNA, 22 nt, Human
uuuccagacaugguuuuucaaa

SEQ ID NO: 71363 - RNA, 22 nt, Human
uuucauggaggccaggacagag

SEQ ID NO: 71364 - RNA, 22 nt, Human
uuaucaaaaaauaguacuuuga

SEQ ID NO: 71365 - RNA, 22 nt, Human
uuaucuuuuaaaaacacuugug

SEQ ID NO: 71366 - RNA, 22 nt, Human
uuaucugcccauuguagaauug

SEQ ID NO: 71367 - RNA, 22 nt, Human
uuaugccuguuaggcagcaucu

SEQ ID NO: 71368 - RNA, 22 nt, Human
uuuaggaauuugcugggcauga

SEQ ID NO: 71369 - RNA, 22 nt, Human
uuuagcugugugugucgcucca

SEQ ID NO: 71370 - RNA, 22 nt, Human
uuuagcaguuuauuuaaggggg

SEQ ID NO: 71371 - RNA, 22 nt, Human
uuagacagagcuccuugagggc

SEQ ID NO: 71372 - RNA, 22 nt, Human
uuagacaucaagaagccaaugu

SEQ ID NO: 71373 - RNA, 22 nt, Human
uuagagaagcacuguaggugaa

SEQ ID NO: 71374 - RNA, 20 nt, Human
uuacucaaccaggcuucuac

SEQ ID NO: 71375 - RNA, 20 nt, Human
uuacugagguauuuuuauca

SEQ ID NO: 71376 - RNA, 22 nt, Human
uuaccugccucaaacacgaaug

SEQ ID NO: 71377 - RNA, 23 nt, Human
uguuugggcuaucuuuuguucuc

SEQ ID NO: 71378 - RNA, 22 nt, Human
uguuuguaugauggcacaucca

SEQ ID NO: 71379 - RNA, 22 nt, Human
uuguaugcugggaagcgggagg

SEQ ID NO: 71380 - RNA, 22 nt, Human
uuacaugcuugugcagguuuug

SEQ ID NO: 71381 - RNA, 22 nt, Human
uuaccauaguacuaucaguuua

SEQ ID NO: 71382 - RNA, 22 nt, Human
uuaccugagcggauuuguugca

SEQ ID NO: 71383 - RNA, 22 nt, Human
uuagcacugucugguuaucuug

SEQ ID NO: 71384 - RNA, 22 nt, Human
uuagcagacagauggagagaga

SEQ ID NO: 71385 - RNA, 22 nt, Human
uuagcccaggacuuuuuauagc

SEQ ID NO: 71386 - RNA, 22 nt, Human
uuaggacucuauuuggguaucu

SEQ ID NO: 71387 - RNA, 22 nt, Human
uuaggagugccaucuuguggac

SEQ ID NO: 71388 - RNA, 22 nt, Human
uuuaucucugcauagaagugau

SEQ ID NO: 71389 - RNA, 22 nt, Human
uuaguuauaggugaaucagaga

SEQ ID NO: 71390 - RNA, 22 nt, Human
uuuauuuagguaaacaugaguu

SEQ ID NO: 71391 - RNA, 22 nt, Human
uuuauugaccugaguaucagca

SEQ ID NO: 71392 - RNA, 22 nt, Human
uuuaugauguagccuagagcug

SEQ ID NO: 71393 - RNA, 22 nt, Human
uuucacugaguaggagagcacu

SEQ ID NO: 71394 - RNA, 22 nt, Human
uuuauuugggauuucucaucug

SEQ ID NO: 71395 - RNA, 22 nt, Human
uuucuggacuaaagggagagau

SEQ ID NO: 71396 - RNA, 22 nt, Human
uuucuuaaaagcuuuuaaaguu

SEQ ID NO: 71397 - RNA, 22 nt, Human
uuucuguucuguuggauucuuu

SEQ ID NO: 71398 - RNA, 22 nt, Human
uuucuugugauuuugaugaacu

SEQ ID NO: 71399 - RNA, 22 nt, Human
uuucuugggaaaugucagaagu

SEQ ID NO: 71400 - RNA, 22 nt, Human
uuauuuuauaaagagaagacuu

SEQ ID NO: 71401 - RNA, 22 nt, Human
uuauuugguuuuggcuuuagcu

SEQ ID NO: 71402 - RNA, 22 nt, Human
uuucuuugggcccuggcagucu

SEQ ID NO: 71403 - RNA, 22 nt, Human
uuucugcauuuguauuggaaaa

SEQ ID NO: 71404 - RNA, 22 nt, Human
uuucugcuuucuaguugguguu

SEQ ID NO: 71405 - RNA, 22 nt, Human
uuucugaugaaguagaaagacc

SEQ ID NO: 71406 - RNA, 23 nt, Human
uuucugaguuuuuuaaaagucca

SEQ ID NO: 71407 - RNA, 22 nt, Human
uuucucuuuuugggguggggug

SEQ ID NO: 71408 - RNA, 22 nt, Human
uuucugagccacauauaauuug

SEQ ID NO: 71409 - RNA, 22 nt, Human
uuauuuaaguauuuauugaagu

SEQ ID NO: 71410 - RNA, 22 nt, Human
uuauuucuucucgaagcuuggg

SEQ ID NO: 71411 - RNA, 22 nt, Human
uuucucuccucgaaauucuuau

SEQ ID NO: 71412 - RNA, 22 nt, Human
uuauuuaaaauguagguuggga

SEQ ID NO: 71413 - RNA, 22 nt, Human
uuauuuaagaucuuaauauaua

SEQ ID NO: 71414 - RNA, 22 nt, Human
uuugaagaaacagucuuaagag

SEQ ID NO: 71415 - RNA, 22 nt, Human
uuugaaaggagcuuuauccaga

SEQ ID NO: 71416 - RNA, 22 nt, Human
uuugaagauaaauauggagaaa

SEQ ID NO: 71417 - RNA, 22 nt, Human
uucaaaaugcagaauaguuugg

SEQ ID NO: 71418 - RNA, 22 nt, Human
uucaaacacugugcaauugggu

SEQ ID NO: 71419 - RNA, 22 nt, Human
uuauuuuuaggaauguagaggu

SEQ ID NO: 71420 - RNA, 22 nt, Human
uuauuuuguagcucugaucuuu

SEQ ID NO: 71421 - RNA, 18 nt, Human
uuucuuuuauuccagguc

SEQ ID NO: 71422 - RNA, 22 nt, Human
uuauuuuuguaacacuguauag

SEQ ID NO: 71423 - RNA, 23 nt, Human
uuugaaucauuguggggcuuuug

SEQ ID NO: 71424 - RNA, 21 nt, Human
uuugacagaccagguauaguu

SEQ ID NO: 71425 - RNA, 22 nt, Human
uuugagaagauaggggaauacu

SEQ ID NO: 71426 - RNA, 22 nt, Human
uuugagugccucgaguguggga

SEQ ID NO: 71427 - RNA, 22 nt, Human
uuugaguacagcugccuuuuug

SEQ ID NO: 71428 - RNA, 22 nt, Human
uuucugguuuuauucugggguu

SEQ ID NO: 71429 - RNA, 22 nt, Human
uucagguacuaagugcugauuc

SEQ ID NO: 71430 - RNA, 18 nt, Human
uucaggcucuugcaugaa

SEQ ID NO: 71431 - RNA, 22 nt, Human
uucaggaucuaggaguauuuuu

SEQ ID NO: 71432 - RNA, 22 nt, Human
uuugauuaccuggggcccucug

SEQ ID NO: 71433 - RNA, 22 nt, Human
uuugauauaaaggcuugggcug

SEQ ID NO: 71434 - RNA, 23 nt, Human
uuugcaaauuggacacaaccaca

SEQ ID NO: 71435 - RNA, 22 nt, Human
uuugcaaaguccauugaaguua

SEQ ID NO: 71436 - RNA, 22 nt, Human
uuugcaggaaauguacugaaug

SEQ ID NO: 71437 - RNA, 18 nt, Human
uuugggauccucuuuucu

SEQ ID NO: 71438 - RNA, 22 nt, Human
uucauacuguuuaaguucuguu

SEQ ID NO: 71439 - RNA, 22 nt, Human
uucaguagagguggaaauaaca

SEQ ID NO: 71440 - RNA, 22 nt, Human
uuuggugacuguaggaaaggau

SEQ ID NO: 71441 - RNA, 19 nt, Human
uuugguaggcuugagggaa

SEQ ID NO: 71442 - RNA, 22 nt, Human
uuuguuaugguuggaagcagga

SEQ ID NO: 71443 - RNA, 22 nt, Human
uuuguuaggguuucagcuagcc

SEQ ID NO: 71444 - RNA, 22 nt, Human
uuccccaccagagacagagcug

SEQ ID NO: 71445 - RNA, 22 nt, Human
uuugugguuuugagagaguugc

SEQ ID NO: 71446 - RNA, 22 nt, Human
uuccaugccccucuuuggguac

SEQ ID NO: 71447 - RNA, 22 nt, Human
uuuguauuguuuauuucauuuu

SEQ ID NO: 71448 - RNA, 22 nt, Human
uuccaaaugacaaugggcugua

SEQ ID NO: 71449 - RNA, 20 nt, Human
uuugguuggcuaggggaagc

SEQ ID NO: 71450 - RNA, 22 nt, Human
uuugguguuuucaggaauauac

SEQ ID NO: 71451 - RNA, 22 nt, Human
uuuguacuuucuaauguauuua

SEQ ID NO: 71452 - RNA, 22 nt, Human
uucauuuccauuuuauagauaa

SEQ ID NO: 71453 - RNA, 20 nt, Human
uugcucucuuguguugaugu

SEQ ID NO: 71454 - RNA, 22 nt, Human
uugcucaugucaccaaagcaca

SEQ ID NO: 71455 - RNA, 22 nt, Human
uugccucuaauuagcucuguga

SEQ ID NO: 71456 - RNA, 23 nt, Human
uugcauuaauguggaggcacagg

SEQ ID NO: 71457 - RNA, 22 nt, Human
uugcagauuucuuguccccauu

SEQ ID NO: 71458 - RNA, 22 nt, Human
uugcaucaaauauguaccacag

SEQ ID NO: 71459 - RNA, 20 nt, Human
uugcaaagugaauagcaauu

SEQ ID NO: 71460 - RNA, 22 nt, Human
uugauuuggcguuuuccuccug

SEQ ID NO: 71461 - RNA, 22 nt, Human
uugcagaauucuucccacucag

SEQ ID NO: 71462 - RNA, 22 nt, Human
uuggaagacagccgucuuuauu

SEQ ID NO: 71463 - RNA, 22 nt, Human
uuggaaauguagaaaagcagau

SEQ ID NO: 71464 - RNA, 23 nt, Human
uugcuuuugccccaaaagaguua

SEQ ID NO: 71465 - RNA, 22 nt, Human
uugcuuuuugggguuuacuggg

SEQ ID NO: 71466 - RNA, 22 nt, Human
uuggagagggugggcuuugaag

SEQ ID NO: 71467 - RNA, 22 nt, Human
uuggacugguuuacauuucaag

SEQ ID NO: 71468 - RNA, 22 nt, Human
uugcuuaggccaaauggcgcau

SEQ ID NO: 71469 - RNA, 22 nt, Human
uugcuggaguagaaaacuuaac

SEQ ID NO: 71470 - RNA, 22 nt, Human
uugcucuuaccauuauguguga

SEQ ID NO: 71471 - RNA, 22 nt, Human
uugguauuuguuuaaauuacac

SEQ ID NO: 71472 - RNA, 22 nt, Human
uuggucaagacugauaucaaga

SEQ ID NO: 71473 - RNA, 22 nt, Human
uuggcaaaagauuggguacuua

SEQ ID NO: 71474 - RNA, 22 nt, Human
uuggcaaaaauacuguaggccu

SEQ ID NO: 71475 - RNA, 22 nt, Human
uuggcaaagagaugcauaagga

SEQ ID NO: 71476 - RNA, 22 nt, Human
uuggcacagagcugcagccugg

SEQ ID NO: 71477 - RNA, 22 nt, Human
uuggcagagaacagaaugauuu

SEQ ID NO: 71478 - RNA, 22 nt, Human
uuggacuucauuuaccucucuc

SEQ ID NO: 71479 - RNA, 20 nt, Human
uuguacuuaugugagaagga

SEQ ID NO: 71480 - RNA, 22 nt, Human
uuguacuuguucuguuuccuug

SEQ ID NO: 71481 - RNA, 22 nt, Human
uuggugaugcccaccuuuucau

SEQ ID NO: 71482 - RNA, 22 nt, Human
uuggugaugcuaggaauguagu

SEQ ID NO: 71483 - RNA, 22 nt, Human
uugucuuucguauggaacacua

SEQ ID NO: 71484 - RNA, 19 nt, Human
uugucuuagcugcauaaga

SEQ ID NO: 71485 - RNA, 22 nt, Human
uugucucuacagagaguaguag

SEQ ID NO: 71486 - RNA, 22 nt, Human
uuguccacuaagaaagugcccu

SEQ ID NO: 71487 - RNA, 22 nt, Human
uugucccuaugagugguaauca

SEQ ID NO: 71488 - RNA, 22 nt, Human
uuguauguuucugugcacauga

SEQ ID NO: 71489 - RNA, 22 nt, Human
uuguagaucagauggccaguag

SEQ ID NO: 71490 - RNA, 22 nt, Human
uuguauaaagauggcuagaucc

SEQ ID NO: 71491 - RNA, 22 nt, Human
uuuaaucaguugguaauauuga

SEQ ID NO: 71492 - RNA, 22 nt, Human
uuuaaguuaguauggguuaggu

SEQ ID NO: 71493 - RNA, 22 nt, Human
uuuaagguacagcuagcagcau

SEQ ID NO: 71494 - RNA, 20 nt, Human
uuuaacuggccuucuggcuc

SEQ ID NO: 71495 - RNA, 22 nt, Human
uuuaaauuucugaaucuugagg

SEQ ID NO: 71496 - RNA, 22 nt, Human
uuuaacauaugaaagaauauuu

SEQ ID NO: 71497 - RNA, 22 nt, Human
uuuaaaccuuggaagccacaua

SEQ ID NO: 71498 - RNA, 22 nt, Human
uuuaaacuaacaguacacguug

SEQ ID NO: 71499 - RNA, 22 nt, Human
uuuaaagucaggcuguaguggu

SEQ ID NO: 71500 - RNA, 21 nt, Human
uugugaaaguccaggaacaac

SEQ ID NO: 71501 - RNA, 22 nt, Human
uugugacaauacagcauggaga

SEQ ID NO: 71502 - RNA, 22 nt, Human
uuguuucauggggacgacuggc

SEQ ID NO: 71503 - RNA, 22 nt, Human
uuguuuucuugaugaaauuauu

SEQ ID NO: 71504 - RNA, 22 nt, Human
uuguuuucuaguguuuugaaua

SEQ ID NO: 71505 - RNA, 22 nt, Human
uucuggagucuauuuugaaaag

SEQ ID NO: 71506 - RNA, 22 nt, Human
uuuuuaaaagaugauuuaauga

SEQ ID NO: 71507 - RNA, 22 nt, Human
uuuuguuuacauuaaauuuuga

SEQ ID NO: 71508 - RNA, 22 nt, Human
uuuuguuacugauuauuaaaau

SEQ ID NO: 71509 - RNA, 22 nt, Human
uucuuacuaaguagaguacuca

SEQ ID NO: 71510 - RNA, 22 nt, Human
uuuugucagggcaggaggaaga

SEQ ID NO: 71511 - RNA, 22 nt, Human
uuuuguagauuggaaaaucugg

SEQ ID NO: 71512 - RNA, 22 nt, Human
uucuguucuuuguccccuuggu

SEQ ID NO: 71513 - RNA, 22 nt, Human
uuuugggugcaaauuguuuguu

SEQ ID NO: 71514 - RNA, 22 nt, Human
uucuguguauggaagaaugucc

SEQ ID NO: 71515 - RNA, 19 nt, Human
uucuguggucccaggccuu

SEQ ID NO: 71516 - RNA, 22 nt, Human
uucuugagaacaaauuccugga

SEQ ID NO: 71517 - RNA, 23 nt, Human
uucuuuccuuaucccauuuacuu

SEQ ID NO: 71518 - RNA, 22 nt, Human
uuuuuauaagauuuaaaaugua

SEQ ID NO: 71519 - RNA, 22 nt, Human
uuuuucacacuccuuuccaguu

SEQ ID NO: 71520 - RNA, 22 nt, Human
uugaaaaaugcccagcagacaa

SEQ ID NO: 71521 - RNA, 20 nt, Human
uugaaagucagggcuccagu

SEQ ID NO: 71522 - RNA, 22 nt, Human
uugaaaauuaauagguguacaa

SEQ ID NO: 71523 - RNA, 22 nt, Human
uugaaaacugucaccuuuauuc

SEQ ID NO: 71524 - RNA, 22 nt, Human
uugaaagucuaagaauagguau

SEQ ID NO: 71525 - RNA, 22 nt, Human
uugaaggugggaggauuuauau

SEQ ID NO: 71526 - RNA, 22 nt, Human
uuuuuucuggaguuugggguuu

SEQ ID NO: 71527 - RNA, 20 nt, Human
uugaggagauauugaauacu

SEQ ID NO: 71528 - RNA, 22 nt, Human
uugaggcugaucacuccuauaa

SEQ ID NO: 71529 - RNA, 22 nt, Human
uugacucuuucauuuauuauuu

SEQ ID NO: 71530 - RNA, 22 nt, Human
uugacuauacucuggcggaaaa

SEQ ID NO: 71531 - RNA, 22 nt, Human
uuuuuuuaaguuuugauuuuag

SEQ ID NO: 71532 - RNA, 22 nt, Human
uuuuuuuagaaagaucauaguu

SEQ ID NO: 71533 - RNA, 22 nt, Human
uuuuuuguuccuugguuuuugu

SEQ ID NO: 71534 - RNA, 22 nt, Human
uugaauuuagguuuaugugaaa

SEQ ID NO: 71535 - RNA, 22 nt, Human
uuuuuugguuuggggauuauuu

SEQ ID NO: 71536 - RNA, 20 nt, Human
uucuguggcccguuuaagug

SEQ ID NO: 71537 - RNA, 22 nt, Human
uuuuggagaaaugggacuuaau

SEQ ID NO: 71538 - RNA, 22 nt, Human
uucuggagacccagcaacaggg

SEQ ID NO: 71539 - RNA, 22 nt, Human
uuuugaugaccauucuucuuuu

SEQ ID NO: 71540 - RNA, 21 nt, Human
uucugcuguucaccaccaccc

SEQ ID NO: 71541 - RNA, 22 nt, Human
uuuucaaucaaguuuauuuaua

SEQ ID NO: 71542 - RNA, 22 nt, Human
uuuucaauuuucauuugcaaga

SEQ ID NO: 71543 - RNA, 22 nt, Human
uuuucacugacuuggucuggaa

SEQ ID NO: 71544 - RNA, 22 nt, Human
uucugaaccauugagcacugcc

SEQ ID NO: 71545 - RNA, 18 nt, Human
uucugcggugacagauau

SEQ ID NO: 71546 - RNA, 22 nt, Human
uucugcuagugguauauguuga

SEQ ID NO: 71547 - RNA, 20 nt, Human
uucugcagcagguguugaag

SEQ ID NO: 71548 - RNA, 22 nt, Human
uucccugugcaguauguuccaa

SEQ ID NO: 71549 - RNA, 22 nt, Human
uuccgcuuucaauggcuuggcu

SEQ ID NO: 71550 - RNA, 22 nt, Human
uuccuaauguccaccuaguccu

SEQ ID NO: 71551 - RNA, 22 nt, Human
uuuguugaauggcaggauuuua

SEQ ID NO: 71552 - RNA, 22 nt, Human
uuuguucuucucaugcacacaa

SEQ ID NO: 71553 - RNA, 22 nt, Human
uuccuaauugccaugaaguuau

SEQ ID NO: 71554 - RNA, 22 nt, Human
uuuuaggauuugaguugcugga

SEQ ID NO: 71555 - RNA, 22 nt, Human
uuuuauuuguauguugaaugua

SEQ ID NO: 71556 - RNA, 22 nt, Human
uucuaggagucugguuccugcc

SEQ ID NO: 71557 - RNA, 22 nt, Human
uuuuauaauacccuugacuaau

SEQ ID NO: 71558 - RNA, 22 nt, Human
uucuagauagucugauauuccu

SEQ ID NO: 71559 - RNA, 22 nt, Human
uucuccucaaaccaucagacau

SEQ ID NO: 71560 - RNA, 22 nt, Human
uucucucacucuuagaucccgc

SEQ ID NO: 71561 - RNA, 22 nt, Human
uucucgaacaaccuacagggug

SEQ ID NO: 71562 - RNA, 22 nt, Human
uucuccugacuggccauucagu

SEQ ID NO: 71563 - RNA, 22 nt, Human
aaaaccugcaagaugaaaucag

SEQ ID NO: 71564 - RNA, 22 nt, Human
aaaacauuuuacugccaucuca

SEQ ID NO: 71565 - RNA, 22 nt, Human
aaaaauuucuggugaaaugccu

SEQ ID NO: 71566 - RNA, 22 nt, Human
aaaacauuuaggguuuuuuuua

SEQ ID NO: 71567 - RNA, 22 nt, Human
aaaagaaugaugggagcugggu

SEQ ID NO: 71568 - RNA, 22 nt, Human
aaaacuuucagggauacagaaa

SEQ ID NO: 71569 - RNA, 22 nt, Human
aaaagacaaggaucuggaguga

SEQ ID NO: 71570 - RNA, 22 nt, Human
aaaaggaagaguuuucagagac

SEQ ID NO: 71571 - RNA, 22 nt, Human
aaaaggucacuguaaaaugacg

SEQ ID NO: 71572 - RNA, 22 nt, Human
aaaagguuauagcuuugccuug

SEQ ID NO: 71573 - RNA, 22 nt, Human
aaaagguauuuagcgauugcau

SEQ ID NO: 71574 - RNA, 22 nt, Human
aaaagggucugacacugcuuga

SEQ ID NO: 71575 - RNA, 22 nt, Human
aaaaguuguaauauuuccuuua

SEQ ID NO: 71576 - RNA, 22 nt, Human
aaaauaauauuauaccacugcu

SEQ ID NO: 71577 - RNA, 22 nt, Human
aaaauauucuauaucaaagaua

SEQ ID NO: 71578 - RNA, 22 nt, Human
aaaaguauaagugucuccugau

SEQ ID NO: 71579 - RNA, 22 nt, Human
aaacaaauccaauaauaaaauu

SEQ ID NO: 71580 - RNA, 22 nt, Human
aaaaucucagaaaaguuuaggu

SEQ ID NO: 71581 - RNA, 17 nt, Human
aaaaucaaaggaggugc

SEQ ID NO: 71582 - RNA, 22 nt, Human
aaaauauuuaucuagcucuuaa

SEQ ID NO: 71583 - RNA, 22 nt, Human
aaaaugggaaaauuuuagauua

SEQ ID NO: 71584 - RNA, 23 nt, Human
aaacuacauuuauaguuuuucuc

SEQ ID NO: 71585 - RNA, 22 nt, Human
aaacgcaauuucuugcauguca

SEQ ID NO: 71586 - RNA, 22 nt, Human
aaacaagagcuuacauggcugc

SEQ ID NO: 71587 - RNA, 22 nt, Human
aaaauuuccuuggaccauuuuu

SEQ ID NO: 71588 - RNA, 22 nt, Human
aaacaccaagagcuagcuauua

SEQ ID NO: 71589 - RNA, 22 nt, Human
aaaggcaugugcaacuacaaau

SEQ ID NO: 71590 - RNA, 22 nt, Human
aaagccaagucugauuuuguug

SEQ ID NO: 71591 - RNA, 22 nt, Human
aaagggagauaaaguaauuuua

SEQ ID NO: 71592 - RNA, 22 nt, Human
aaagccaagguccauguacuuu

SEQ ID NO: 71593 - RNA, 22 nt, Human
aaagccauaucuauucuauucu

SEQ ID NO: 71594 - RNA, 22 nt, Human
aaaggagugaaaugagaggaaa

SEQ ID NO: 71595 - RNA, 22 nt, Human
aaaggaaacuaugaaucucugg

SEQ ID NO: 71596 - RNA, 22 nt, Human
aaagcccuccaggguauacauu

SEQ ID NO: 71597 - RNA, 22 nt, Human
aaagcaaauaguugcuuaauau

SEQ ID NO: 71598 - RNA, 17 nt, Human
aaagccgaucagauguu

SEQ ID NO: 71599 - RNA, 22 nt, Human
aaagcgagccggcuuggaggga

SEQ ID NO: 71600 - RNA, 22 nt, Human
aaagaguuaagagucuuaagcu

SEQ ID NO: 71601 - RNA, 22 nt, Human
aaagaguuguauucuuuuugag

SEQ ID NO: 71602 - RNA, 22 nt, Human
aaagacaauaauucucucuagc

SEQ ID NO: 71603 - RNA, 22 nt, Human
aaagaagugucuuacucccucu

SEQ ID NO: 71604 - RNA, 22 nt, Human
aaacuuuaucaaguacucuuca

SEQ ID NO: 71605 - RNA, 22 nt, Human
aaacuuuugaaggaggaaaaag

SEQ ID NO: 71606 - RNA, 22 nt, Human
aaagcauucuaaccgaucgacg

SEQ ID NO: 71607 - RNA, 22 nt, Human
aaagagugugcauguaccugug

SEQ ID NO: 71608 - RNA, 22 nt, Human
aaagaugucauacacauuaaga

SEQ ID NO: 71609 - RNA, 22 nt, Human
aaagaauuucaagauucccaca

SEQ ID NO: 71610 - RNA, 22 nt, Human
aaagacagccuguuggcuuucu

SEQ ID NO: 71611 - RNA, 22 nt, Human
aaauauauauaauauauauauu

SEQ ID NO: 71612 - RNA, 22 nt, Human
aaaucuuucacauauuuuuuau

SEQ ID NO: 71613 - RNA, 22 nt, Human
aaaucuuccugaaauuuguuca

SEQ ID NO: 71614 - RNA, 22 nt, Human
aaaucauagccaugaacauuug

SEQ ID NO: 71615 - RNA, 22 nt, Human
aaauguauuagccuaugugaga

SEQ ID NO: 71616 - RNA, 22 nt, Human
aaauguaaacuguauuuauaaa

SEQ ID NO: 71617 - RNA, 22 nt, Human
aaaucugaauuaaaaucugguu

SEQ ID NO: 71618 - RNA, 21 nt, Human
aaauccagugaucuccucuaa

SEQ ID NO: 71619 - RNA, 22 nt, Human
aaauuuauaacuuaaagugaau

SEQ ID NO: 71620 - RNA, 22 nt, Human
aaaugucugagacuucugaacu

SEQ ID NO: 71621 - RNA, 22 nt, Human
aaauguguagaggggagagccg

SEQ ID NO: 71622 - RNA, 22 nt, Human
aaauuaaaguuuuauuuagagc

SEQ ID NO: 71623 - RNA, 22 nt, Human
aaauuaggcccugauuuuaugu

SEQ ID NO: 71624 - RNA, 22 nt, Human
aaauuagucacaccagugucuu

SEQ ID NO: 71625 - RNA, 19 nt, Human
aacaaaauaguucuaguua

SEQ ID NO: 71626 - RNA, 22 nt, Human
aacaaagaaaagcuugagguuu

SEQ ID NO: 71627 - RNA, 22 nt, Human
aacaaaacauuuuacgaauaua

SEQ ID NO: 71628 - RNA, 22 nt, Human
aacaaagaacuuucuuccuuug

SEQ ID NO: 71629 - RNA, 22 nt, Human
aacaaccuaguaguaucuuuca

SEQ ID NO: 71630 - RNA, 20 nt, Human
aacagcucucgacuuaucuu

SEQ ID NO: 71631 - RNA, 22 nt, Human
aacaugggcaacuucuuuucag

SEQ ID NO: 71632 - RNA, 22 nt, Human
aacauuguuuaaguuaaauugu

SEQ ID NO: 71633 - RNA, 22 nt, Human
aacauuuauguuuugaccaagu

SEQ ID NO: 71634 - RNA, 22 nt, Human
aacauuuccggccuuuuguucu

SEQ ID NO: 71635 - RNA, 22 nt, Human
aacaggcuaaauuguccauuuc

SEQ ID NO: 71636 - RNA, 22 nt, Human
aaauauuugaaugguguaagau

SEQ ID NO: 71637 - RNA, 22 nt, Human
aaauauugaauuugaggaugua

SEQ ID NO: 71638 - RNA, 22 nt, Human
aaauauuaaugaugaagguagu

SEQ ID NO: 71639 - RNA, 22 nt, Human
aaauauuagacauaccuggaga

SEQ ID NO: 71640 - RNA, 22 nt, Human
aaauauauccuucuguccugcc

SEQ ID NO: 71641 - RNA, 22 nt, Human
aaaguagaugagaauuuuguug

SEQ ID NO: 71642 - RNA, 22 nt, Human
aaaguguuaacacuggcuacuu

SEQ ID NO: 71643 - RNA, 22 nt, Human
aaaguuacacgacuauuuaugu

SEQ ID NO: 71644 - RNA, 22 nt, Human
aaaucgcuugaacccaggaagu

SEQ ID NO: 71645 - RNA, 22 nt, Human
aaauaggaguagugauguauua

SEQ ID NO: 71646 - RNA, 23 nt, Human
aaauaauaauuucucuguuggga

SEQ ID NO: 71647 - RNA, 22 nt, Human
aaaucaaaagugguuauuuuau

SEQ ID NO: 71648 - RNA, 22 nt, Human
aaaucaagucagcugaauucca

SEQ ID NO: 71649 - RNA, 22 nt, Human
aaauagucagaaaucaacgugc

SEQ ID NO: 71650 - RNA, 22 nt, Human
aaauauagugacacuuauaguc

SEQ ID NO: 71651 - RNA, 22 nt, Human
aaauagauuugacuacuuggug

SEQ ID NO: 71652 - RNA, 22 nt, Human
aaaguuuguacugggaguuacu

SEQ ID NO: 71653 - RNA, 22 nt, Human
aaaguuguccuuugugccuuua

SEQ ID NO: 71654 - RNA, 22 nt, Human
aaaguugcauccuaugaccuca

SEQ ID NO: 71655 - RNA, 22 nt, Human
aaaguuacccaaucucuaugaa

SEQ ID NO: 71656 - RNA, 22 nt, Human
aaaguaaagccuauuuaauaau

SEQ ID NO: 71657 - RNA, 22 nt, Human
aaagggcugaaguagucucugu

SEQ ID NO: 71658 - RNA, 22 nt, Human
aaaguguuuaacaaauugcuuu

SEQ ID NO: 71659 - RNA, 21 nt, Human
aaagugguaaggauuauuuug

SEQ ID NO: 71660 - RNA, 22 nt, Human
aaagggaugauuucugaagaua

SEQ ID NO: 71661 - RNA, 22 nt, Human
aaaguagaauaauaaacccuug

SEQ ID NO: 71662 - RNA, 22 nt, Human
aaagcugaaacgaaaugacaac

SEQ ID NO: 71663 - RNA, 22 nt, Human
aaagccuacagucaugguuaga

SEQ ID NO: 71664 - RNA, 22 nt, Human
aaagcuccaaauggguggaagu

SEQ ID NO: 71665 - RNA, 22 nt, Human
aagcaaagucaucuagaguagu

SEQ ID NO: 71666 - RNA, 22 nt, Human
aagcaaaaucgcaucuggggcc

SEQ ID NO: 71667 - RNA, 22 nt, Human
aagcaaaagguuacacuucugg

SEQ ID NO: 71668 - RNA, 22 nt, Human
aagagugugagguugugcuuuu

SEQ ID NO: 71669 - RNA, 22 nt, Human
aagaggcuacagcccugugucu

SEQ ID NO: 71670 - RNA, 22 nt, Human
aagaugcaagcauuuugaacug

SEQ ID NO: 71671 - RNA, 22 nt, Human
aagaugaguuacaaaggaguaa

SEQ ID NO: 71672 - RNA, 22 nt, Human
aagaugaucagagggcaagagg

SEQ ID NO: 71673 - RNA, 22 nt, Human
aagaguuaggagugggcuuuga

SEQ ID NO: 71674 - RNA, 22 nt, Human
aagauauauaacccuuucacuu

SEQ ID NO: 71675 - RNA, 22 nt, Human
aagcagacugggccauaaggaa

SEQ ID NO: 71676 - RNA, 21 nt, Human
aagcagcugcagaauuucagu

SEQ ID NO: 71677 - RNA, 22 nt, Human
aagcaacccagugcuuguauag

SEQ ID NO: 71678 - RNA, 22 nt, Human
aagaucugaccgugauggcggc

SEQ ID NO: 71679 - RNA, 22 nt, Human
aagauagaaugauguuggcuca

SEQ ID NO: 71680 - RNA, 23 nt, Human
aagcaacagacuucaucagauau

SEQ ID NO: 71681 - RNA, 22 nt, Human
aagacagaaaagcagagagagg

SEQ ID NO: 71682 - RNA, 22 nt, Human
aagaaugaaaugaaagaacuaa

SEQ ID NO: 71683 - RNA, 22 nt, Human
aagaggauuuuaguuugccaga

SEQ ID NO: 71684 - RNA, 22 nt, Human
aagaaguccuugaggcgcaccc

SEQ ID NO: 71685 - RNA, 22 nt, Human
aagagaaagggaaaaugguaaa

SEQ ID NO: 71686 - RNA, 22 nt, Human
aagagaaacauauggccagauu

SEQ ID NO: 71687 - RNA, 22 nt, Human
aagaagcuacugucacuaucag

SEQ ID NO: 71688 - RNA, 22 nt, Human
aagaaauagauagaggaauacu

SEQ ID NO: 71689 - RNA, 22 nt, Human
aagaaauacagaaauggcagua

SEQ ID NO: 71690 - RNA, 22 nt, Human
aagaaaggcacaagaaagaaaa

SEQ ID NO: 71691 - RNA, 22 nt, Human
aagacagugacagucacaauug

SEQ ID NO: 71692 - RNA, 22 nt, Human
aagaacaacugcuuuaaaagca

SEQ ID NO: 71693 - RNA, 22 nt, Human
aagaaaagguaaccgcuuaucu

SEQ ID NO: 71694 - RNA, 22 nt, Human
aaccaaaguugguauuuaauaa

SEQ ID NO: 71695 - RNA, 22 nt, Human
aagaaagaucugaaagaagcga

SEQ ID NO: 71696 - RNA, 22 nt, Human
aagcucuauaggagauacagua

SEQ ID NO: 71697 - RNA, 22 nt, Human
aagcucagcugguggugauugc

SEQ ID NO: 71698 - RNA, 22 nt, Human
aaggcgauuuaaagauguuagg

SEQ ID NO: 71699 - RNA, 22 nt, Human
aagcugcagacccccugucuca

SEQ ID NO: 71700 - RNA, 22 nt, Human
aagcucugggacugaggcuccu

SEQ ID NO: 71701 - RNA, 22 nt, Human
aagcucuuuccacuaaaccacu

SEQ ID NO: 71702 - RNA, 22 nt, Human
aagcuuugaauauuagaccuug

SEQ ID NO: 71703 - RNA, 22 nt, Human
aaggaggaugaauugucugcaa

SEQ ID NO: 71704 - RNA, 18 nt, Human
aaggaggaaugaauagca

SEQ ID NO: 71705 - RNA, 22 nt, Human
aaggacaaaacagcuguucuaa

SEQ ID NO: 71706 - RNA, 22 nt, Human
aaggagcuuucauuacagccuu

SEQ ID NO: 71707 - RNA, 22 nt, Human
aaggauuuccaggccugcgccu

SEQ ID NO: 71708 - RNA, 22 nt, Human
aaggaugguaacaguuucauuu

SEQ ID NO: 71709 - RNA, 22 nt, Human
aagcugaguaggaaugguaggu

SEQ ID NO: 71710 - RNA, 22 nt, Human
aagccugguuauuugaggaugu

SEQ ID NO: 71711 - RNA, 22 nt, Human
aagcccuuugaaaauguguguc

SEQ ID NO: 71712 - RNA, 22 nt, Human
aagccuccgugcugcuggaucu

SEQ ID NO: 71713 - RNA, 22 nt, Human
aagcuguuauuucacagguuca

SEQ ID NO: 71714 - RNA, 22 nt, Human
aaggaaaaccugacugaagaac

SEQ ID NO: 71715 - RNA, 22 nt, Human
aagcaugagguggugagugaca

SEQ ID NO: 71716 - RNA, 22 nt, Human
aagcaaaugguauugguauuau

SEQ ID NO: 71717 - RNA, 22 nt, Human
aagcaaguucuaaaguaauucu

SEQ ID NO: 71718 - RNA, 22 nt, Human
aauaugucacacuccuuaauag

SEQ ID NO: 71719 - RNA, 22 nt, Human
aauaugccaaauccugucacau

SEQ ID NO: 71720 - RNA, 22 nt, Human
aaucaugagguguuucuuugca

SEQ ID NO: 71721 - RNA, 22 nt, Human
aaucaucuguuguucccuugga

SEQ ID NO: 71722 - RNA, 22 nt, Human
aaucacuuagaacccaggaagu

SEQ ID NO: 71723 - RNA, 22 nt, Human
aaucacuucuuugucuucuuca

SEQ ID NO: 71724 - RNA, 22 nt, Human
aauauuuugggacugaggaauu

SEQ ID NO: 71725 - RNA, 22 nt, Human
aauauuuaccuaccugucaucu

SEQ ID NO: 71726 - RNA, 23 nt, Human
aaucacuggauuugagcaugagg

SEQ ID NO: 71727 - RNA, 22 nt, Human
aauauuuaaauagaauuacauc

SEQ ID NO: 71728 - RNA, 20 nt, Human
aauagcacagcucaaacauu

SEQ ID NO: 71729 - RNA, 22 nt, Human
aauaugaugccaaauugcuaca

SEQ ID NO: 71730 - RNA, 22 nt, Human
aauagcaauuacccuucaacuc

SEQ ID NO: 71731 - RNA, 22 nt, Human
aauacagcacucacaccucccu

SEQ ID NO: 71732 - RNA, 22 nt, Human
aauagcuuuuuguuugguguau

SEQ ID NO: 71733 - RNA, 22 nt, Human
aauagagacaguuuaacaauau

SEQ ID NO: 71734 - RNA, 22 nt, Human
aaguuuaagguagugaugauga

SEQ ID NO: 71735 - RNA, 22 nt, Human
aaguucuugguuaauuagggaa

SEQ ID NO: 71736 - RNA, 22 nt, Human
aaguuccuaaagucagggguca

SEQ ID NO: 71737 - RNA, 23 nt, Human
aagugcucaguggacagcauugc

SEQ ID NO: 71738 - RNA, 20 nt, Human
aagugcuguuagcugccuga

SEQ ID NO: 71739 - RNA, 22 nt, Human
aagugauuuuccuacuugcuaa

SEQ ID NO: 71740 - RNA, 22 nt, Human
aauaagaguuaagaaguauauu

SEQ ID NO: 71741 - RNA, 21 nt, Human
aaguuuuggcuguacaguugu

SEQ ID NO: 71742 - RNA, 22 nt, Human
aauaacuuaaugacuguguaca

SEQ ID NO: 71743 - RNA, 22 nt, Human
aauaaagcuugaaagcagggaa

SEQ ID NO: 71744 - RNA, 16 nt, Human
aaguuuuaucuucuca

SEQ ID NO: 71745 - RNA, 20 nt, Human
aauaaauauaacccauaauu

SEQ ID NO: 71746 - RNA, 22 nt, Human
aagucuuugagaucggacauag

SEQ ID NO: 71747 - RNA, 22 nt, Human
aagugaaaaaagucaguacuga

SEQ ID NO: 71748 - RNA, 22 nt, Human
aagugagaugggagucagagga

SEQ ID NO: 71749 - RNA, 22 nt, Human
aagugauauaaaucgagaggga

SEQ ID NO: 71750 - RNA, 22 nt, Human
aagugaggagaccucuucuuca

SEQ ID NO: 71751 - RNA, 22 nt, Human
aagugauuuucccaccaucuac

SEQ ID NO: 71752 - RNA, 22 nt, Human
aagugauuuagagagcucuuag

SEQ ID NO: 71753 - RNA, 19 nt, Human
aaguauagucagccuucua

SEQ ID NO: 71754 - RNA, 20 nt, Human
aagucuauuuagaguugcuu

SEQ ID NO: 71755 - RNA, 22 nt, Human
aaguccaaaacauuucucugcu

SEQ ID NO: 71756 - RNA, 22 nt, Human
aaguccgggcagcaggaauucu

SEQ ID NO: 71757 - RNA, 22 nt, Human
aaggugcugaggguccuggcuu

SEQ ID NO: 71758 - RNA, 22 nt, Human
aaguacugauucuguuccucaa

SEQ ID NO: 71759 - RNA, 22 nt, Human
aaggucucucgggcuuugcuga

SEQ ID NO: 71760 - RNA, 22 nt, Human
aagguccuguagccacagagcc

SEQ ID NO: 71761 - RNA, 22 nt, Human
aaggggauuuaagguaagaaga

SEQ ID NO: 71762 - RNA, 22 nt, Human
aagggagagggagaagguggga

SEQ ID NO: 71763 - RNA, 22 nt, Human
aagggagaguauccagaaacag

SEQ ID NO: 71764 - RNA, 22 nt, Human
aaggcugaccaguuuacacuuu

SEQ ID NO: 71765 - RNA, 22 nt, Human
aagcuuugggcagaagaggauu

SEQ ID NO: 71766 - RNA, 22 nt, Human
aaggaaaaaauggcuugugaua

SEQ ID NO: 71767 - RNA, 22 nt, Human
aaggaacuucagggcgaaugga

SEQ ID NO: 71768 - RNA, 22 nt, Human
aaggaaaguuaagguaaacucu

SEQ ID NO: 71769 - RNA, 22 nt, Human
aaggagaggagucauugggaua

SEQ ID NO: 71770 - RNA, 22 nt, Human
acauagcuuaaaugagaagaua

SEQ ID NO: 71771 - RNA, 22 nt, Human
acauaaauagcacugugaauuu

SEQ ID NO: 71772 - RNA, 22 nt, Human
acauaaacaugcagccugccaa

SEQ ID NO: 71773 - RNA, 22 nt, Human
acagguuggagguguggaguca

SEQ ID NO: 71774 - RNA, 22 nt, Human
acaggggauaggcaggaaggca

SEQ ID NO: 71775 - RNA, 22 nt, Human
acauauggcagguugaucaaug

SEQ ID NO: 71776 - RNA, 22 nt, Human
acaggaaugaagaugagagagu

SEQ ID NO: 71777 - RNA, 22 nt, Human
acaggccuggguucaaauuugg

SEQ ID NO: 71778 - RNA, 22 nt, Human
acaggauuuucagggaagguga

SEQ ID NO: 71779 - RNA, 21 nt, Human
acaguaugaucaaaugugcca

SEQ ID NO: 71780 - RNA, 22 nt, Human
acagucuuggauuccaggaguc

SEQ ID NO: 71781 - RNA, 22 nt, Human
acagguaucccuuucuaccuga

SEQ ID NO: 71782 - RNA, 22 nt, Human
acagguuucuccccugguuauu

SEQ ID NO: 71783 - RNA, 19 nt, Human
acaggaaggaaaauuucaa

SEQ ID NO: 71784 - RNA, 22 nt, Human
acaggaaaugaaaugguaucua

SEQ ID NO: 71785 - RNA, 22 nt, Human
acagcugagaugcuacuugugg

SEQ ID NO: 71786 - RNA, 22 nt, Human
acagcaauccuggcagaggguu

SEQ ID NO: 71787 - RNA, 20 nt, Human
acagagauccucucuuuauc

SEQ ID NO: 71788 - RNA, 22 nt, Human
acagcucaggcccaucaacccc

SEQ ID NO: 71789 - RNA, 22 nt, Human
acagcuauuuaaaggcuuuagg

SEQ ID NO: 71790 - RNA, 22 nt, Human
acagcagguuauuguuauggca

SEQ ID NO: 71791 - RNA, 22 nt, Human
acagacuugaccuuggagaggc

SEQ ID NO: 71792 - RNA, 22 nt, Human
acagacaucaucaacaucuucc

SEQ ID NO: 71793 - RNA, 22 nt, Human
acacucaugcucagcuggugcu

SEQ ID NO: 71794 - RNA, 22 nt, Human
acagaucugcacagugaacaau

SEQ ID NO: 71795 - RNA, 22 nt, Human
acagagcucccagccaucuccu

SEQ ID NO: 71796 - RNA, 22 nt, Human
acagacuuuuagacuuaugagu

SEQ ID NO: 71797 - RNA, 22 nt, Human
acagacuuaguauccugcugcu

SEQ ID NO: 71798 - RNA, 22 nt, Human
acagaauugggguucuugggga

SEQ ID NO: 71799 - RNA, 22 nt, Human
acagaucuauauuauauauaca

SEQ ID NO: 71800 - RNA, 23 nt, Human
acagcaagaggaccagaugugag

SEQ ID NO: 71801 - RNA, 22 nt, Human
acacucagaaaggcagagguuc

SEQ ID NO: 71802 - RNA, 22 nt, Human
acacuuuugcgagagcaugcag

SEQ ID NO: 71803 - RNA, 22 nt, Human
acacuagcgcaaauacgcccau

SEQ ID NO: 71804 - RNA, 21 nt, Human
acagaaguggcuuggucucag

SEQ ID NO: 71805 - RNA, 22 nt, Human
acacccuugcagacgguuccuu

SEQ ID NO: 71806 - RNA, 22 nt, Human
acacagugaccuacauuccaaa

SEQ ID NO: 71807 - RNA, 22 nt, Human
acacaggacacaaaagucacca

SEQ ID NO: 71808 - RNA, 21 nt, Human
acacagcuggagcaucccggu

SEQ ID NO: 71809 - RNA, 22 nt, Human
acaaucagcacugaguuuaucu

SEQ ID NO: 71810 - RNA, 22 nt, Human
acaaucuuauuaguaguauaga

SEQ ID NO: 71811 - RNA, 17 nt, Human
acaaugggcaacaauau

SEQ ID NO: 71812 - RNA, 22 nt, Human
acacaacuuuauuaauuuauac

SEQ ID NO: 71813 - RNA, 22 nt, Human
acaaguuucauuguuuagaacc

SEQ ID NO: 71814 - RNA, 22 nt, Human
acaauaauguuuuuagguuauu

SEQ ID NO: 71815 - RNA, 22 nt, Human
acaagaaaggucugggaacaau

SEQ ID NO: 71816 - RNA, 22 nt, Human
acaagguugauucuggcaucug

SEQ ID NO: 71817 - RNA, 20 nt, Human
acaacuuaguugagagacua

SEQ ID NO: 71818 - RNA, 22 nt, Human
acaacuuuaauggguuucagcu

SEQ ID NO: 71819 - RNA, 22 nt, Human
acaaggaagaaaacauuacuuu

SEQ ID NO: 71820 - RNA, 22 nt, Human
acaaccaugucaguucaaacca

SEQ ID NO: 71821 - RNA, 22 nt, Human
acaaauuuaaauguugucuguu

SEQ ID NO: 71822 - RNA, 22 nt, Human
acaaaucccuguaaacacagcu

SEQ ID NO: 71823 - RNA, 22 nt, Human
acaacagaacuccugggauuuu

SEQ ID NO: 71824 - RNA, 20 nt, Human
acaaccacugcucacaguuu

SEQ ID NO: 71825 - RNA, 22 nt, Human
acaaacugggauaggauccugu

SEQ ID NO: 71826 - RNA, 18 nt, Human
acaaaaauagugcuuugg

SEQ ID NO: 71827 - RNA, 21 nt, Human
acaaaaccuaacuuggcugcu

SEQ ID NO: 71828 - RNA, 22 nt, Human
acaaagugaaaagcaucgaauu

SEQ ID NO: 71829 - RNA, 22 nt, Human
aauuucuuucagcugcuuuaag

SEQ ID NO: 71830 - RNA, 22 nt, Human
aauuucuuuagagguacugauc

SEQ ID NO: 71831 - RNA, 22 nt, Human
aauuucuccuuuucaguuagau

SEQ ID NO: 71832 - RNA, 22 nt, Human
aauuuuauuagacaggcauaau

SEQ ID NO: 71833 - RNA, 22 nt, Human
aauuuuagcuaaagauccaugg

SEQ ID NO: 71834 - RNA, 22 nt, Human
aauuuuauuuuuuccccuagau

SEQ ID NO: 71835 - RNA, 22 nt, Human
acaaaaauauuguagaagugcu

SEQ ID NO: 71836 - RNA, 22 nt, Human
aauucuguugguuagaguugga

SEQ ID NO: 71837 - RNA, 21 nt, Human
aauugccuaauauaugggaag

SEQ ID NO: 71838 - RNA, 22 nt, Human
aauuauucucucaacugagaug

SEQ ID NO: 71839 - RNA, 22 nt, Human
aauuauugucuuuuuuaaaagc

SEQ ID NO: 71840 - RNA, 22 nt, Human
aauugcauucauuuguauauuu

SEQ ID NO: 71841 - RNA, 22 nt, Human
aauugccaagaauuagugauac

SEQ ID NO: 71842 - RNA, 22 nt, Human
aauugcuuucacaaguguuaua

SEQ ID NO: 71843 - RNA, 22 nt, Human
aauuucagaccaacgagucagg

SEQ ID NO: 71844 - RNA, 22 nt, Human
aauuuauccuuuugcuaaagca

SEQ ID NO: 71845 - RNA, 22 nt, Human
aauuuaauugguuuuuacuugu

SEQ ID NO: 71846 - RNA, 20 nt, Human
aauuuagaguuuuaccaagg

SEQ ID NO: 71847 - RNA, 22 nt, Human
aauugguuugaauaaauaaaga

SEQ ID NO: 71848 - RNA, 22 nt, Human
aauuuaaguuauugcuaaugug

SEQ ID NO: 71849 - RNA, 22 nt, Human
aauguggaguugguuuccuucc

SEQ ID NO: 71850 - RNA, 22 nt, Human
aaugugcugguaacugcuuugc

SEQ ID NO: 71851 - RNA, 22 nt, Human
aaugguaauauuucauaguugu

SEQ ID NO: 71852 - RNA, 22 nt, Human
aauuauucaugucugggcagcc

SEQ ID NO: 71853 - RNA, 22 nt, Human
aauuauuauguggaagacgacg

SEQ ID NO: 71854 - RNA, 22 nt, Human
aauuauuaucauuaucuuccug

SEQ ID NO: 71855 - RNA, 22 nt, Human
aauuauuaagcuuucuccagug

SEQ ID NO: 71856 - RNA, 22 nt, Human
aauuauguugaaauaugagaac

SEQ ID NO: 71857 - RNA, 22 nt, Human
aauuaaauguuugguuugagcu

SEQ ID NO: 71858 - RNA, 22 nt, Human
aauuaaggccuuuaaaugucuu

SEQ ID NO: 71859 - RNA, 22 nt, Human
aauguuuuucaaguguggagca

SEQ ID NO: 71860 - RNA, 22 nt, Human
aauguuaguauuuaagagcuug

SEQ ID NO: 71861 - RNA, 22 nt, Human
aauguucauauggguagcagau

SEQ ID NO: 71862 - RNA, 22 nt, Human
aauggcaauagugcauuaugua

SEQ ID NO: 71863 - RNA, 22 nt, Human
aauggaugauuaaauggaugaa

SEQ ID NO: 71864 - RNA, 22 nt, Human
aauggauaacaccgguucuguc

SEQ ID NO: 71865 - RNA, 22 nt, Human
aauggaaaaauccacagggaac

SEQ ID NO: 71866 - RNA, 22 nt, Human
aauggaaaaagaacuguuuaaa

SEQ ID NO: 71867 - RNA, 22 nt, Human
aaugcugugggauagggcuccu

SEQ ID NO: 71868 - RNA, 22 nt, Human
aaugcuuuuugcgaaaugugca

SEQ ID NO: 71869 - RNA, 22 nt, Human
aaucauaacaaaagcaauuaua

SEQ ID NO: 71870 - RNA, 22 nt, Human
aaucaugguacaaguaagcacg

SEQ ID NO: 71871 - RNA, 22 nt, Human
aauccaaacaggauuaccuauc

SEQ ID NO: 71872 - RNA, 22 nt, Human
aaucccaguugacagaacuguu

SEQ ID NO: 71873 - RNA, 22 nt, Human
aaugcugugauuuauuaaguau

SEQ ID NO: 71874 - RNA, 22 nt, Human
aaugcugaaugcauguuuccau

SEQ ID NO: 71875 - RNA, 22 nt, Human
acugcugauuauugaaguagag

SEQ ID NO: 71876 - RNA, 22 nt, Human
acugcuguugugauggguauuu

SEQ ID NO: 71877 - RNA, 22 nt, Human
acuuccuuuuuuggggauagca

SEQ ID NO: 71878 - RNA, 22 nt, Human
acuucccacugcagugacugag

SEQ ID NO: 71879 - RNA, 21 nt, Human
acuuccacaucacugaguaga

SEQ ID NO: 71880 - RNA, 22 nt, Human
acuucauuugaaaugguugaau

SEQ ID NO: 71881 - RNA, 22 nt, Human
acuucucuuuucauuaauuuug

SEQ ID NO: 71882 - RNA, 22 nt, Human
acugccuugcaccauggcuuuu

SEQ ID NO: 71883 - RNA, 22 nt, Human
acuucugcccuggcgagggcgu

SEQ ID NO: 71884 - RNA, 22 nt, Human
acuucuuuugcaugauucuuua

SEQ ID NO: 71885 - RNA, 22 nt, Human
acuuagaacagccuaugggaag

SEQ ID NO: 71886 - RNA, 22 nt, Human
acuuacuuucuauucuuguagg

SEQ ID NO: 71887 - RNA, 22 nt, Human
acuguugugaauaaugaaaugc

SEQ ID NO: 71888 - RNA, 22 nt, Human
acuugagcuugaaagguaugcu

SEQ ID NO: 71889 - RNA, 19 nt, Human
acuugcuuucauuuaagau

SEQ ID NO: 71890 - RNA, 22 nt, Human
acuugggaaaugaaaauacaga

SEQ ID NO: 71891 - RNA, 22 nt, Human
acuucaggagcagucucuggaa

SEQ ID NO: 71892 - RNA, 22 nt, Human
acuuccuuccagcaaauggcau

SEQ ID NO: 71893 - RNA, 22 nt, Human
acuucagugugguauaaaacgu

SEQ ID NO: 71894 - RNA, 22 nt, Human
acuuuaaauaucauuugguagg

SEQ ID NO: 71895 - RNA, 22 nt, Human
acuuugaauuagaauuuugcug

SEQ ID NO: 71896 - RNA, 22 nt, Human
acuugaugcauauggaagagca

SEQ ID NO: 71897 - RNA, 22 nt, Human
acuuguaaaauagagauaggga

SEQ ID NO: 71898 - RNA, 22 nt, Human
acuuuaaaucuguugcuuagcu

SEQ ID NO: 71899 - RNA, 22 nt, Human
acuuuauacuagugauaguuug

SEQ ID NO: 71900 - RNA, 22 nt, Human
acuuguuuacaagcaguucuga

SEQ ID NO: 71901 - RNA, 22 nt, Human
acuuuccuggcuuugcaaggua

SEQ ID NO: 71902 - RNA, 22 nt, Human
agaaaagagacaauguuuuugg

SEQ ID NO: 71903 - RNA, 22 nt, Human
agaaaauagguaguagacgggc

SEQ ID NO: 71904 - RNA, 19 nt, Human
agaaacaacauucuggaga

SEQ ID NO: 71905 - RNA, 20 nt, Human
acuuucacaugaacauuuaa

SEQ ID NO: 71906 - RNA, 22 nt, Human
agaaacaagcccuagaaguccu

SEQ ID NO: 71907 - RNA, 22 nt, Human
agaaacacaaguaaagcuccca

SEQ ID NO: 71908 - RNA, 22 nt, Human
agaaauggccagacuugccccu

SEQ ID NO: 71909 - RNA, 22 nt, Human
agaaauuguaauaaaucugguc

SEQ ID NO: 71910 - RNA, 19 nt, Human
agaaauagccuuccuuguc

SEQ ID NO: 71911 - RNA, 22 nt, Human
agacaaucaacuguugaugccu

SEQ ID NO: 71912 - RNA, 22 nt, Human
agaauuuguaucuacggugugc

SEQ ID NO: 71913 - RNA, 22 nt, Human
agaccccugcuggggcugcugu

SEQ ID NO: 71914 - RNA, 22 nt, Human
agacaauuccauccuacguggg

SEQ ID NO: 71915 - RNA, 22 nt, Human
agacaagagcugaggacauauu

SEQ ID NO: 71916 - RNA, 22 nt, Human
agaaugucaagucaagaacaau

SEQ ID NO: 71917 - RNA, 22 nt, Human
agaauacaauuguucaguaaua

SEQ ID NO: 71918 - RNA, 22 nt, Human
agaaguguacuuagagaacaua

SEQ ID NO: 71919 - RNA, 22 nt, Human
agaaguagacaguuggauauaa

SEQ ID NO: 71920 - RNA, 22 nt, Human
agaauccucuagggauggcagg

SEQ ID NO: 71921 - RNA, 22 nt, Human
agaaucaggaagacagccuggc

SEQ ID NO: 71922 - RNA, 22 nt, Human
agaaucugcauuuuaacaagau

SEQ ID NO: 71923 - RNA, 22 nt, Human
agaaggcaucugcucgcuucca

SEQ ID NO: 71924 - RNA, 22 nt, Human
agaauauaguaaauauuuucua

SEQ ID NO: 71925 - RNA, 22 nt, Human
agaaucagagcagaaucuucau

SEQ ID NO: 71926 - RNA, 22 nt, Human
agaauacuaauaagggauuugc

SEQ ID NO: 71927 - RNA, 22 nt, Human
agaaguuuguuauguaaacaaa

SEQ ID NO: 71928 - RNA, 22 nt, Human
agaauaagucuaauauauuggu

SEQ ID NO: 71929 - RNA, 22 nt, Human
agaagcaauuggaaaguacagg

SEQ ID NO: 71930 - RNA, 21 nt, Human
agaaguuauuccauggguguu

SEQ ID NO: 71931 - RNA, 22 nt, Human
agaagguggaguagaacaagcu

SEQ ID NO: 71932 - RNA, 16 nt, Human
agaaggcuaguaacag

SEQ ID NO: 71933 - RNA, 22 nt, Human
agaagaaugguuugaaagauuu

SEQ ID NO: 71934 - RNA, 22 nt, Human
agaagaagacccuaaggaaagg

SEQ ID NO: 71935 - RNA, 22 nt, Human
agaagauucagcaguagggugg

SEQ ID NO: 71936 - RNA, 22 nt, Human
agaaccaauacuacagcaagua

SEQ ID NO: 71937 - RNA, 22 nt, Human
agaacccaaggcccagggaugu

SEQ ID NO: 71938 - RNA, 19 nt, Human
agaacccccuuccucugcu

SEQ ID NO: 71939 - RNA, 22 nt, Human
agaaaaggaagcuuagacugua

SEQ ID NO: 71940 - RNA, 22 nt, Human
acugcucugugguuggaagccu

SEQ ID NO: 71941 - RNA, 22 nt, Human
acuggagcccguggaggcgcag

SEQ ID NO: 71942 - RNA, 21 nt, Human
acugccaugcaggagccucca

SEQ ID NO: 71943 - RNA, 22 nt, Human
acugcauuucauaaauuacaau

SEQ ID NO: 71944 - RNA, 22 nt, Human
acugccauauuaggagcuucag

SEQ ID NO: 71945 - RNA, 22 nt, Human
acugcauuaucaccaagaugua

SEQ ID NO: 71946 - RNA, 22 nt, Human
acugcagauccucugagaaacc

SEQ ID NO: 71947 - RNA, 22 nt, Human
acugcaggucccaucaccugcg

SEQ ID NO: 71948 - RNA, 22 nt, Human
acugaugacaaugugaguguuc

SEQ ID NO: 71949 - RNA, 22 nt, Human
acucuugacuaaugcuaauguc

SEQ ID NO: 71950 - RNA, 22 nt, Human
acucuuauuuugaaguaauaau

SEQ ID NO: 71951 - RNA, 22 nt, Human
acucuguaauucugaagcaccu

SEQ ID NO: 71952 - RNA, 22 nt, Human
acugaacuaaagaaaugggcaa

SEQ ID NO: 71953 - RNA, 22 nt, Human
acugaaggcuggaccaugcauc

SEQ ID NO: 71954 - RNA, 22 nt, Human
acugagaacuuggggacagagg

SEQ ID NO: 71955 - RNA, 22 nt, Human
acuccuuuuaugugugcuaaaa

SEQ ID NO: 71956 - RNA, 22 nt, Human
acucugaggauuucaguuuuac

SEQ ID NO: 71957 - RNA, 18 nt, Human
acucugaagcuaagucac

SEQ ID NO: 71958 - RNA, 22 nt, Human
acucucugcugcugagcuuggg

SEQ ID NO: 71959 - RNA, 22 nt, Human
acucugagaugugucuugauuc

SEQ ID NO: 71960 - RNA, 23 nt, Human
acucucuguuuggaggcacuggu

SEQ ID NO: 71961 - RNA, 22 nt, Human
acucugaaaggcuacaaaugcu

SEQ ID NO: 71962 - RNA, 21 nt, Human
acucaucuuuuuggagaccag

SEQ ID NO: 71963 - RNA, 22 nt, Human
acuccuauuugguagauggaag

SEQ ID NO: 71964 - RNA, 22 nt, Human
acucagucauuuggggaacagu

SEQ ID NO: 71965 - RNA, 22 nt, Human
acucagaguuugcguuccauac

SEQ ID NO: 71966 - RNA, 22 nt, Human
acuauugcuuuagggggaaacc

SEQ ID NO: 71967 - RNA, 22 nt, Human
acuauuguccgauuucuuuacu

SEQ ID NO: 71968 - RNA, 22 nt, Human
acuaucuauugucuucuucaug

SEQ ID NO: 71969 - RNA, 22 nt, Human
acuauacaguauguacgugcac

SEQ ID NO: 71970 - RNA, 20 nt, Human
acuagaaagucacugggggg

SEQ ID NO: 71971 - RNA, 22 nt, Human
acuacccugaccaaguauuuua

SEQ ID NO: 71972 - RNA, 22 nt, Human
acucaaccaucugcauuuuuga

SEQ ID NO: 71973 - RNA, 22 nt, Human
acuauggaguucagaucuugag

SEQ ID NO: 71974 - RNA, 22 nt, Human
acgucuacaugcaauucuuaua

SEQ ID NO: 71975 - RNA, 22 nt, Human
acgguguuucucguucaggguu

SEQ ID NO: 71976 - RNA, 22 nt, Human
acuauauaaugcacacaguaua

SEQ ID NO: 71977 - RNA, 22 nt, Human
acgcauguacuuguaugcaaug

SEQ ID NO: 71978 - RNA, 20 nt, Human
acgcauguauaugcaucacc

SEQ ID NO: 71979 - RNA, 21 nt, Human
acggaucucgcaccucuccug

SEQ ID NO: 71980 - RNA, 22 nt, Human
acagucucucaagcauauccug

SEQ ID NO: 71981 - RNA, 22 nt, Human
acgccugccuguacuugugggg

SEQ ID NO: 71982 - RNA, 22 nt, Human
agaguucuauccagacucaugu

SEQ ID NO: 71983 - RNA, 22 nt, Human
agauaacauguugcagauucug

SEQ ID NO: 71984 - RNA, 22 nt, Human
agaugacuaacauaguauugcu

SEQ ID NO: 71985 - RNA, 22 nt, Human
agaugacuuuguccugagcuga

SEQ ID NO: 71986 - RNA, 22 nt, Human
agauauucugccuaacagguuu

SEQ ID NO: 71987 - RNA, 22 nt, Human
agauaaucacaaucuagacuuu

SEQ ID NO: 71988 - RNA, 22 nt, Human
agaguacagaagcauuucagau

SEQ ID NO: 71989 - RNA, 22 nt, Human
agaguuaguggccucagcaggg

SEQ ID NO: 71990 - RNA, 22 nt, Human
agaguucaccccacugaugagu

SEQ ID NO: 71991 - RNA, 21 nt, Human
agaguuuucuccauuucaggc

SEQ ID NO: 71992 - RNA, 22 nt, Human
agauaucuuguuggcauaaaug

SEQ ID NO: 71993 - RNA, 22 nt, Human
agauaaacaacucuuagcuguu

SEQ ID NO: 71994 - RNA, 22 nt, Human
agauaaaucauuuauuaagcgg

SEQ ID NO: 71995 - RNA, 22 nt, Human
agagggagagaccuccgugccu

SEQ ID NO: 71996 - RNA, 22 nt, Human
agaggcagagcugggguuugac

SEQ ID NO: 71997 - RNA, 22 nt, Human
agagggagcuccaagaucaagg

SEQ ID NO: 71998 - RNA, 22 nt, Human
agagggagagauuggcaaucag

SEQ ID NO: 71999 - RNA, 22 nt, Human
agagggagccugcacagcuuuc

SEQ ID NO: 72000 - RNA, 22 nt, Human
agagcuagaaggaagcauuucu

SEQ ID NO: 72001 - RNA, 22 nt, Human
agagcucguggcucauugagga

SEQ ID NO: 72002 - RNA, 22 nt, Human
agagcuauuucuuaaaagcugu

SEQ ID NO: 72003 - RNA, 22 nt, Human
agagcuccaggguuuuguagug

SEQ ID NO: 72004 - RNA, 22 nt, Human
agagcauagggcauuaggaagg

SEQ ID NO: 72005 - RNA, 22 nt, Human
agacacagcaauaacuacuguu

SEQ ID NO: 72006 - RNA, 22 nt, Human
agacacauuuucagcucugcca

SEQ ID NO: 72007 - RNA, 17 nt, Human
agacucuagccacuagc

SEQ ID NO: 72008 - RNA, 22 nt, Human
agacucuaguggaggugcuagg

SEQ ID NO: 72009 - RNA, 19 nt, Human
agagauuuucuguuuuagu

SEQ ID NO: 72010 - RNA, 22 nt, Human
agacacugacaggguccaugga

SEQ ID NO: 72011 - RNA, 22 nt, Human
agauguuaauaaccuuagggca

SEQ ID NO: 72012 - RNA, 22 nt, Human
agaugucauguguugcuccaag

SEQ ID NO: 72013 - RNA, 22 nt, Human
agcaacauggaguuugugcgca

SEQ ID NO: 72014 - RNA, 22 nt, Human
agcaaagccucuuugaaaaaaa

SEQ ID NO: 72015 - RNA, 22 nt, Human
agaugggacauuugucccuagg

SEQ ID NO: 72016 - RNA, 22 nt, Human
agauugaugugaccauuggaag

SEQ ID NO: 72017 - RNA, 22 nt, Human
agauucgucuuuaauucaccau

SEQ ID NO: 72018 - RNA, 22 nt, Human
agcaaggguugguuuucugaca

SEQ ID NO: 72019 - RNA, 22 nt, Human
agauguugucucuuacguuuga

SEQ ID NO: 72020 - RNA, 19 nt, Human
agauggcaaaaugcaaaga

SEQ ID NO: 72021 - RNA, 22 nt, Human
agcaaaacuaaagacacagaca

SEQ ID NO: 72022 - RNA, 22 nt, Human
agaugguucagaauuauaaaga

SEQ ID NO: 72023 - RNA, 22 nt, Human
agauugaacgagcuggcaugga

SEQ ID NO: 72024 - RNA, 22 nt, Human
agauuucaauggauauugcaag

SEQ ID NO: 72025 - RNA, 22 nt, Human
agauucucccuccuggcgcugu

SEQ ID NO: 72026 - RNA, 22 nt, Human
agauuuuacggaguauuagggu

SEQ ID NO: 72027 - RNA, 22 nt, Human
agauuauuuaagacaggaacca

SEQ ID NO: 72028 - RNA, 23 nt, Human
agaugaugaauaaagagugagga

SEQ ID NO: 72029 - RNA, 22 nt, Human
agaucauuaaccaccuguucug

SEQ ID NO: 72030 - RNA, 17 nt, Human
agaucugaaggagaaca

SEQ ID NO: 72031 - RNA, 22 nt, Human
agauggaguccugaagccagaa

SEQ ID NO: 72032 - RNA, 19 nt, Human
agaucaggauguauuuuug

SEQ ID NO: 72033 - RNA, 22 nt, Human
agauccuagaugugaauagcua

SEQ ID NO: 72034 - RNA, 22 nt, Human
agaugaugugugucuucagcua

SEQ ID NO: 72035 - RNA, 22 nt, Human
agauggaggaaagcaguuagaa

SEQ ID NO: 72036 - RNA, 22 nt, Human
agauauguuaggcuuguucccu

SEQ ID NO: 72037 - RNA, 22 nt, Human
agauagccagauauaaauaguc

SEQ ID NO: 72038 - RNA, 22 nt, Human
agauacuaagccucaagagacg

SEQ ID NO: 72039 - RNA, 22 nt, Human
agaugaguaaauggagucuucc

SEQ ID NO: 72040 - RNA, 22 nt, Human
agauauuauuuucuauuuauca

SEQ ID NO: 72041 - RNA, 22 nt, Human
agcaauguuggccuauauaccu

SEQ ID NO: 72042 - RNA, 22 nt, Human
agcaaggagcugaaaccgggcu

SEQ ID NO: 72043 - RNA, 22 nt, Human
agcaaaguacugagcucaaagg

SEQ ID NO: 72044 - RNA, 22 nt, Human
agcaaauaauugucuuugaggg

SEQ ID NO: 72045 - RNA, 22 nt, Human
agcacuuuagaauuuagaguug

SEQ ID NO: 72046 - RNA, 22 nt, Human
agcagagaacauucauucaugu

SEQ ID NO: 72047 - RNA, 22 nt, Human
agauuuguauagaugugguuga

SEQ ID NO: 72048 - RNA, 22 nt, Human
agcaaaauuccaaaaugcuaau

SEQ ID NO: 72049 - RNA, 22 nt, Human
agauuuucuuuuccaucuuugu

SEQ ID NO: 72050 - RNA, 22 nt, Human
agcacauguuucuuuugcaauu

SEQ ID NO: 72051 - RNA, 22 nt, Human
agcaccuuguucagaucuuaca

SEQ ID NO: 72052 - RNA, 22 nt, Human
agcacagugccugacauauaug

SEQ ID NO: 72053 - RNA, 22 nt, Human
agcaauucugaaauuacuugac

SEQ ID NO: 72054 - RNA, 22 nt, Human
agcaauucagagcauggacuuu

SEQ ID NO: 72055 - RNA, 22 nt, Human
agcagauuguacagugcauuag

SEQ ID NO: 72056 - RNA, 22 nt, Human
agcagauaaagguugcauuucu

SEQ ID NO: 72057 - RNA, 17 nt, Human
agcagcuggguugaucu

SEQ ID NO: 72058 - RNA, 22 nt, Human
agcacuugggugauaguacuuu

SEQ ID NO: 72059 - RNA, 22 nt, Human
agcacuagcugcuugucucaag

SEQ ID NO: 72060 - RNA, 22 nt, Human
agcagcaaugacaauucaacca

SEQ ID NO: 72061 - RNA, 22 nt, Human
agcaaagguagcagcucccagg

SEQ ID NO: 72062 - RNA, 22 nt, Human
agcaggauggaguaacgugaaa

SEQ ID NO: 72063 - RNA, 22 nt, Human
agcaggagaaagaguaugggcu

SEQ ID NO: 72064 - RNA, 22 nt, Human
agcaggaaggcuagaagcagga

SEQ ID NO: 72065 - RNA, 22 nt, Human
agcaggacuugcugagcccucc

SEQ ID NO: 72066 - RNA, 22 nt, Human
agcauacuaggauguuuucugg

SEQ ID NO: 72067 - RNA, 19 nt, Human
agcgccucuacugcaugga

SEQ ID NO: 72068 - RNA, 22 nt, Human
agccuauucaucugaucuugaa

SEQ ID NO: 72069 - RNA, 22 nt, Human
agccugugacucugugaaacca

SEQ ID NO: 72070 - RNA, 22 nt, Human
agccuacauuugacuauagucu

SEQ ID NO: 72071 - RNA, 22 nt, Human
agcgaaaagaauggaguggagu

SEQ ID NO: 72072 - RNA, 22 nt, Human
agccacacuuagucacaaagau

SEQ ID NO: 72073 - RNA, 22 nt, Human
agccauggaggaugugcagcau

SEQ ID NO: 72074 - RNA, 22 nt, Human
agccgauaaauuguuuucuugg

SEQ ID NO: 72075 - RNA, 22 nt, Human
agcagggagaccaucucuuccu

SEQ ID NO: 72076 - RNA, 22 nt, Human
agccagugcagcuggaaauuca

SEQ ID NO: 72077 - RNA, 22 nt, Human
agccauggagaacagacuugaa

SEQ ID NO: 72078 - RNA, 22 nt, Human
agccaucuggugucaaugauuc

SEQ ID NO: 72079 - RNA, 22 nt, Human
agcccagguggagugugugggg

SEQ ID NO: 72080 - RNA, 22 nt, Human
agccccuucuuuggggagcuga

SEQ ID NO: 72081 - RNA, 22 nt, Human
agccccuaaaguagcuguucuu

SEQ ID NO: 72082 - RNA, 22 nt, Human
aggcauuuaaagauguaagacu

SEQ ID NO: 72083 - RNA, 22 nt, Human
aggcauuuucuuguuauuuuua

SEQ ID NO: 72084 - RNA, 22 nt, Human
aggcagugccuggaccccagcu

SEQ ID NO: 72085 - RNA, 22 nt, Human
aggcauuuaucaggaaauguuc

SEQ ID NO: 72086 - RNA, 22 nt, Human
aggcagugguguuugcuggugg

SEQ ID NO: 72087 - RNA, 22 nt, Human
aggcaguguguagcuggaagag

SEQ ID NO: 72088 - RNA, 22 nt, Human
aggcauauaguguuuaaaaaaa

SEQ ID NO: 72089 - RNA, 21 nt, Human
aggcauuuucuuggagauucu

SEQ ID NO: 72090 - RNA, 22 nt, Human
aggccacucagggggccaagau

SEQ ID NO: 72091 - RNA, 22 nt, Human
aggcugggaaguguguccugag

SEQ ID NO: 72092 - RNA, 22 nt, Human
aggcuccucugggggccccgga

SEQ ID NO: 72093 - RNA, 22 nt, Human
aggcaggauuugcgaugugguu

SEQ ID NO: 72094 - RNA, 22 nt, Human
aggcagaugggagcuggaaguu

SEQ ID NO: 72095 - RNA, 22 nt, Human
aggcaguggcuuuuguuguguu

SEQ ID NO: 72096 - RNA, 22 nt, Human
aggcagagauggcugcagggcc

SEQ ID NO: 72097 - RNA, 20 nt, Human
aggcagacaaggagucuguu

SEQ ID NO: 72098 - RNA, 22 nt, Human
aggcacagaauccagucugcug

SEQ ID NO: 72099 - RNA, 22 nt, Human
aggcaauuuuuaggguuguugu

SEQ ID NO: 72100 - RNA, 19 nt, Human
aggcagccccaacuugcau

SEQ ID NO: 72101 - RNA, 21 nt, Human
aggcagcgauuuucauauugc

SEQ ID NO: 72102 - RNA, 22 nt, Human
aggcaacagacaggcuugguuc

SEQ ID NO: 72103 - RNA, 22 nt, Human
aggauuuauuccagaaaugcaa

SEQ ID NO: 72104 - RNA, 22 nt, Human
aggauuuagcaugaaaugugaa

SEQ ID NO: 72105 - RNA, 22 nt, Human
aggauugaaaaaacacauauau

SEQ ID NO: 72106 - RNA, 16 nt, Human
aggauauauucucuuc

SEQ ID NO: 72107 - RNA, 22 nt, Human
aggauugucuccugugaugugc

SEQ ID NO: 72108 - RNA, 22 nt, Human
aggcagagaggucuuccuggaa

SEQ ID NO: 72109 - RNA, 22 nt, Human
aggauuagucaccauuauuauu

SEQ ID NO: 72110 - RNA, 23 nt, Human
aggcaagaacggguuguucaccc

SEQ ID NO: 72111 - RNA, 22 nt, Human
aggcaagauuaggaccagaaga

SEQ ID NO: 72112 - RNA, 22 nt, Human
aggauucuccuguuucccaccc

SEQ ID NO: 72113 - RNA, 22 nt, Human
aggauugauggcauguuuacug

SEQ ID NO: 72114 - RNA, 20 nt, Human
aggauuauguacauggaugc

SEQ ID NO: 72115 - RNA, 22 nt, Human
aggagguagggugugaaacagc

SEQ ID NO: 72116 - RNA, 22 nt, Human
aggauaaaugggucauuaggca

SEQ ID NO: 72117 - RNA, 22 nt, Human
aggagggucauguugaagugua

SEQ ID NO: 72118 - RNA, 22 nt, Human
aggauagacuucagaaggcaua

SEQ ID NO: 72119 - RNA, 22 nt, Human
aggauuuaauugcauuuuucuc

SEQ ID NO: 72120 - RNA, 22 nt, Human
aggaggcaaaugagagggcuca

SEQ ID NO: 72121 - RNA, 17 nt, Human
aggagcuagaaaggaga

SEQ ID NO: 72122 - RNA, 22 nt, Human
aggaauuugggguuacaugaug

SEQ ID NO: 72123 - RNA, 22 nt, Human
aggacaaaggaccagaucugga

SEQ ID NO: 72124 - RNA, 16 nt, Human
aggagcagaaagcagu

SEQ ID NO: 72125 - RNA, 22 nt, Human
aggacaagacaaggaccagaga

SEQ ID NO: 72126 - RNA, 22 nt, Human
aggaacaacagccuuuauaucc

SEQ ID NO: 72127 - RNA, 22 nt, Human
aggaacaguuucaaagagugaa

SEQ ID NO: 72128 - RNA, 22 nt, Human
aggaagaagggacagaauuuug

SEQ ID NO: 72129 - RNA, 22 nt, Human
aggaauuucacugcguuuuuua

SEQ ID NO: 72130 - RNA, 22 nt, Human
aggaauuuuaauaugcuugucu

SEQ ID NO: 72131 - RNA, 22 nt, Human
aggaaguucuggaauuacuagg

SEQ ID NO: 72132 - RNA, 22 nt, Human
aggaauugucgucauguauaau

SEQ ID NO: 72133 - RNA, 22 nt, Human
agcgcugugaaggcugggccac

SEQ ID NO: 72134 - RNA, 22 nt, Human
aguaauaaacaacucauuuugg

SEQ ID NO: 72135 - RNA, 22 nt, Human
agguuuuugucauuuucuggua

SEQ ID NO: 72136 - RNA, 22 nt, Human
agguuuggguucauugcuggcu

SEQ ID NO: 72137 - RNA, 22 nt, Human
agguuuaggaaaacugagaguc

SEQ ID NO: 72138 - RNA, 22 nt, Human
agguuuggccuuggggggaguu

SEQ ID NO: 72139 - RNA, 22 nt, Human
agguggcuaugaggaugcaguc

SEQ ID NO: 72140 - RNA, 20 nt, Human
agguugguuuacuagucugu

SEQ ID NO: 72141 - RNA, 22 nt, Human
agguuguaagcuuuauauaaau

SEQ ID NO: 72142 - RNA, 22 nt, Human
agguucaucaauaacucagaga

SEQ ID NO: 72143 - RNA, 22 nt, Human
agguuuggaaguggcgauccau

SEQ ID NO: 72144 - RNA, 22 nt, Human
agguuuuacuuuuuuuggaggu

SEQ ID NO: 72145 - RNA, 22 nt, Human
aggugcuuaaagaauguguggu

SEQ ID NO: 72146 - RNA, 22 nt, Human
aggugauaugggcuucucugag

SEQ ID NO: 72147 - RNA, 22 nt, Human
aggucuuuaguggcagagucua

SEQ ID NO: 72148 - RNA, 22 nt, Human
aggucuugcggaagauauggcu

SEQ ID NO: 72149 - RNA, 19 nt, Human
aggugaugugacucuagaa

SEQ ID NO: 72150 - RNA, 22 nt, Human
aggugauauuauguauuucuau

SEQ ID NO: 72151 - RNA, 22 nt, Human
aggucgugggugagagagagac

SEQ ID NO: 72152 - RNA, 22 nt, Human
aggguauguuuuuaucuacugu

SEQ ID NO: 72153 - RNA, 22 nt, Human
aggguuucucuccaguguggac

SEQ ID NO: 72154 - RNA, 22 nt, Human
agguauuuuaugucgugugaug

SEQ ID NO: 72155 - RNA, 22 nt, Human
aggucagacagggugucuuucu

SEQ ID NO: 72156 - RNA, 20 nt, Human
agggucucuccuggcucugc

SEQ ID NO: 72157 - RNA, 22 nt, Human
aggguuaugcuccuucaucuug

SEQ ID NO: 72158 - RNA, 22 nt, Human
agggggaaaauguggauuaugg

SEQ ID NO: 72159 - RNA, 22 nt, Human
aggggcuuguggaguugcuggu

SEQ ID NO: 72160 - RNA, 22 nt, Human
agggcuguuggugcccucgagg

SEQ ID NO: 72161 - RNA, 22 nt, Human
agggaugugcagggcuugccau

SEQ ID NO: 72162 - RNA, 20 nt, Human
agggauuugguugguauugu

SEQ ID NO: 72163 - RNA, 22 nt, Human
agggaugcaguaaaaacuguag

SEQ ID NO: 72164 - RNA, 22 nt, Human
aggcuucauuacagugguucaa

SEQ ID NO: 72165 - RNA, 22 nt, Human
aggcugucucaccucaggaggg

SEQ ID NO: 72166 - RNA, 22 nt, Human
aggcuguagaucuagacaugua

SEQ ID NO: 72167 - RNA, 22 nt, Human
aggcuuaacuacaauuuuugcc

SEQ ID NO: 72168 - RNA, 22 nt, Human
agugagaguauuaaugugaacu

SEQ ID NO: 72169 - RNA, 22 nt, Human
agugaggggagaaugaggugga

SEQ ID NO: 72170 - RNA, 20 nt, Human
agugauuuguuaguacauug

SEQ ID NO: 72171 - RNA, 22 nt, Human
agugauguaauggugaauguga

SEQ ID NO: 72172 - RNA, 22 nt, Human
aguagcaguuccauuugaugug

SEQ ID NO: 72173 - RNA, 22 nt, Human
aguacuuggaaaaaugcccacu

SEQ ID NO: 72174 - RNA, 20 nt, Human
aguacugacaauauucugug

SEQ ID NO: 72175 - RNA, 18 nt, Human
agucugagugaaauguag

SEQ ID NO: 72176 - RNA, 20 nt, Human
agucuucaggugugaggauu

SEQ ID NO: 72177 - RNA, 22 nt, Human
agugaaagaaaacuguuagaac

SEQ ID NO: 72178 - RNA, 19 nt, Human
agugaacuccauaucaggu

SEQ ID NO: 72179 - RNA, 22 nt, Human
aguggcuagaucaugagugagc

SEQ ID NO: 72180 - RNA, 19 nt, Human
agugggcaaggaagaugac

SEQ ID NO: 72181 - RNA, 22 nt, Human
aguggagguuacagcuguacau

SEQ ID NO: 72182 - RNA, 22 nt, Human
agugcuuuauguuguugugcaa

SEQ ID NO: 72183 - RNA, 22 nt, Human
agugccuuaaaggucuugcagc

SEQ ID NO: 72184 - RNA, 23 nt, Human
aguggaggucgggguggggagac

SEQ ID NO: 72185 - RNA, 23 nt, Human
agugaucuguguuugaagaaugc

SEQ ID NO: 72186 - RNA, 22 nt, Human
agugaugauccaaaugaauuga

SEQ ID NO: 72187 - RNA, 20 nt, Human
agugaguuaucagcuacagu

SEQ ID NO: 72188 - RNA, 22 nt, Human
agugaugcuuuggagaagaucc

SEQ ID NO: 72189 - RNA, 23 nt, Human
agugaugcaguaucugggucugu

SEQ ID NO: 72190 - RNA, 22 nt, Human
aguuauuaagaaaauuuugcca

SEQ ID NO: 72191 - RNA, 22 nt, Human
aguucaugcuuagaucucauuu

SEQ ID NO: 72192 - RNA, 20 nt, Human
aguucagguuauuuuccucc

SEQ ID NO: 72193 - RNA, 22 nt, Human
aguuaguagacuuuuccauuua

SEQ ID NO: 72194 - RNA, 22 nt, Human
aguuauuuuucacuauuaggcu

SEQ ID NO: 72195 - RNA, 22 nt, Human
aguuaggaaauaaguugaguuu

SEQ ID NO: 72196 - RNA, 22 nt, Human
aguuaucuauaaaucccugagg

SEQ ID NO: 72197 - RNA, 22 nt, Human
aguuauggguauguauuauaau

SEQ ID NO: 72198 - RNA, 23 nt, Human
aguuaucuaaugaaguucuucca

SEQ ID NO: 72199 - RNA, 22 nt, Human
aguuaaagggggcuacagugug

SEQ ID NO: 72200 - RNA, 20 nt, Human
aguguugaacuacacuuccc

SEQ ID NO: 72201 - RNA, 22 nt, Human
agugucuuuagucgcugagcaa

SEQ ID NO: 72202 - RNA, 22 nt, Human
aguguauuugccuauaaaaaug

SEQ ID NO: 72203 - RNA, 22 nt, Human
aguguuuuaagaaaguaauuuu

SEQ ID NO: 72204 - RNA, 22 nt, Human
aguguuaggaauuaauguaggg

SEQ ID NO: 72205 - RNA, 22 nt, Human
aguguucaauuugagcucaaag

SEQ ID NO: 72206 - RNA, 23 nt, Human
aguguucagcauguaguaaauac

SEQ ID NO: 72207 - RNA, 19 nt, Human
agugggauggcuuuuuccc

SEQ ID NO: 72208 - RNA, 22 nt, Human
agugucagcagcuucauugucu

SEQ ID NO: 72209 - RNA, 23 nt, Human
auaaugauaaugcuauuuuuugu

SEQ ID NO: 72210 - RNA, 22 nt, Human
auaaaguaaugcauauaaugug

SEQ ID NO: 72211 - RNA, 22 nt, Human
auaagccugccuuaucuccaga

SEQ ID NO: 72212 - RNA, 22 nt, Human
auaacgaaagcaauuauuuuca

SEQ ID NO: 72213 - RNA, 22 nt, Human
auaaguuauuuuaguaaaucag

SEQ ID NO: 72214 - RNA, 22 nt, Human
auaaggcauagugagucaucau

SEQ ID NO: 72215 - RNA, 22 nt, Human
auaaggaaagugagugcuuaaa

SEQ ID NO: 72216 - RNA, 22 nt, Human
aguuuuugagaauucuucugaa

SEQ ID NO: 72217 - RNA, 22 nt, Human
aguuuuuaacgccauguuugaa

SEQ ID NO: 72218 - RNA, 22 nt, Human
auaaaaauguuuuuguguggua

SEQ ID NO: 72219 - RNA, 22 nt, Human
auaaaacagaucaggagaauga

SEQ ID NO: 72220 - RNA, 22 nt, Human
auaaaagcacaauagaguuaug

SEQ ID NO: 72221 - RNA, 22 nt, Human
auaaaaucugaagcaagaauaa

SEQ ID NO: 72222 - RNA, 22 nt, Human
auaaaaaguggcugcuauugga

SEQ ID NO: 72223 - RNA, 20 nt, Human
auaaauaggauuuucugaca

SEQ ID NO: 72224 - RNA, 22 nt, Human
auaaauuugccagcauauguuc

SEQ ID NO: 72225 - RNA, 22 nt, Human
auacagacacuguagguuauuu

SEQ ID NO: 72226 - RNA, 22 nt, Human
auaaaucaagggcaguauuucc

SEQ ID NO: 72227 - RNA, 22 nt, Human
auacaauugcaauggaagauga

SEQ ID NO: 72228 - RNA, 22 nt, Human
auacacauguuauuguggaagc

SEQ ID NO: 72229 - RNA, 22 nt, Human
auaaauuugacagcucuucaug

SEQ ID NO: 72230 - RNA, 22 nt, Human
auaaauucuaugauggauuggg

SEQ ID NO: 72231 - RNA, 22 nt, Human
auaagcuucucugcaguucagu

SEQ ID NO: 72232 - RNA, 22 nt, Human
auacaaaaaguggugaguguau

SEQ ID NO: 72233 - RNA, 22 nt, Human
auaauugaauaagagcugcagg

SEQ ID NO: 72234 - RNA, 22 nt, Human
auaccuauagcagacugagacu

SEQ ID NO: 72235 - RNA, 21 nt, Human
auaccaaaagaacaccuuguu

SEQ ID NO: 72236 - RNA, 22 nt, Human
auaaucuuuccagucaguuucc

SEQ ID NO: 72237 - RNA, 22 nt, Human
auacauauaugcacauuaauau

SEQ ID NO: 72238 - RNA, 21 nt, Human
auacaguucagcuuuuacuau

SEQ ID NO: 72239 - RNA, 22 nt, Human
auaaucuuugaguagaguugag

SEQ ID NO: 72240 - RNA, 22 nt, Human
aguuuaaauuguucuaucagaa

SEQ ID NO: 72241 - RNA, 22 nt, Human
aguuguuuuucuuagauuuuag

SEQ ID NO: 72242 - RNA, 22 nt, Human
aguugugagaaugaacacugaa

SEQ ID NO: 72243 - RNA, 22 nt, Human
aguuguucucagcagaagaacu

SEQ ID NO: 72244 - RNA, 22 nt, Human
aguuuggauccugcuaaaccag

SEQ ID NO: 72245 - RNA, 22 nt, Human
aguuuguagguuaggaucagca

SEQ ID NO: 72246 - RNA, 22 nt, Human
aguuucaguuaguugggugaca

SEQ ID NO: 72247 - RNA, 22 nt, Human
aguuugauuugucuaucuucau

SEQ ID NO: 72248 - RNA, 22 nt, Human
aguugguucgucucgccuugag

SEQ ID NO: 72249 - RNA, 22 nt, Human
aguuuucugccucuggaugcgu

SEQ ID NO: 72250 - RNA, 22 nt, Human
aguuuuguuuguuuguuuguua

SEQ ID NO: 72251 - RNA, 22 nt, Human
aguuucccucacaggucugcau

SEQ ID NO: 72252 - RNA, 22 nt, Human
aguuuuugccucgaauucugcg

SEQ ID NO: 72253 - RNA, 22 nt, Human
aguuucuugaagacugauguuu

SEQ ID NO: 72254 - RNA, 22 nt, Human
aguuuggaggagaaagugcggg

SEQ ID NO: 72255 - RNA, 22 nt, Human
aguugguggaagcuaagcuucu

SEQ ID NO: 72256 - RNA, 22 nt, Human
aguugguauuuacugcaguugg

SEQ ID NO: 72257 - RNA, 22 nt, Human
aguugcuucccuauucuuagca

SEQ ID NO: 72258 - RNA, 22 nt, Human
aguuggaagacacccugaaauc

SEQ ID NO: 72259 - RNA, 22 nt, Human
aguugaggguuaguaaauagcu

SEQ ID NO: 72260 - RNA, 22 nt, Human
aguugcuaauacaaaaaguccc

SEQ ID NO: 72261 - RNA, 22 nt, Human
aguugcugccagguccugggag

SEQ ID NO: 72262 - RNA, 22 nt, Human
aguucuguucccccaguuacau

SEQ ID NO: 72263 - RNA, 22 nt, Human
aguucuuugcucccugcuuuuu

SEQ ID NO: 72264 - RNA, 22 nt, Human
aguucucaagguuaggaaaagu

SEQ ID NO: 72265 - RNA, 22 nt, Human
aguucauucuagcugggagcag

SEQ ID NO: 72266 - RNA, 22 nt, Human
aguuccaaauuugcaagaaaau

SEQ ID NO: 72267 - RNA, 22 nt, Human
auucugagaucucuucuaggcc

SEQ ID NO: 72268 - RNA, 21 nt, Human
auucugaguugucagucuuca

SEQ ID NO: 72269 - RNA, 22 nt, Human
auucugcugccuaguuuaugaa

SEQ ID NO: 72270 - RNA, 22 nt, Human
auuauucuuugggaaaguugaa

SEQ ID NO: 72271 - RNA, 22 nt, Human
auuauuugcuuaagcuggucuc

SEQ ID NO: 72272 - RNA, 21 nt, Human
auucaaagaagaggaaggccc

SEQ ID NO: 72273 - RNA, 22 nt, Human
auucaagauaagggucugggag

SEQ ID NO: 72274 - RNA, 22 nt, Human
auucaagauagaaggauuuuca

SEQ ID NO: 72275 - RNA, 22 nt, Human
auucuuauaaaaaguguugacu

SEQ ID NO: 72276 - RNA, 22 nt, Human
auucuuacaaagcagagucugu

SEQ ID NO: 72277 - RNA, 22 nt, Human
auucuguuuaauacacgaaagg

SEQ ID NO: 72278 - RNA, 22 nt, Human
auucaccaucuugauccccucu

SEQ ID NO: 72279 - RNA, 19 nt, Human
auucaagugcuuagagauc

SEQ ID NO: 72280 - RNA, 22 nt, Human
auucaucuguacuucaauaucu

SEQ ID NO: 72281 - RNA, 22 nt, Human
auucaggacucuuccuugaaga

SEQ ID NO: 72282 - RNA, 22 nt, Human
auucaaugcacauguuuuggau

SEQ ID NO: 72283 - RNA, 22 nt, Human
auucaguucuaaggucagugcc

SEQ ID NO: 72284 - RNA, 22 nt, Human
auucauucugaccucaagagaa

SEQ ID NO: 72285 - RNA, 22 nt, Human
auucuacucuccuacaggucua

SEQ ID NO: 72286 - RNA, 22 nt, Human
auuaaauagcagaagaaagaug

SEQ ID NO: 72287 - RNA, 22 nt, Human
auguuguuuauggguuaucaag

SEQ ID NO: 72288 - RNA, 22 nt, Human
auguugcugauccuguggcugu

SEQ ID NO: 72289 - RNA, 22 nt, Human
auuauggacuuucuuguuuggg

SEQ ID NO: 72290 - RNA, 22 nt, Human
auuaugugagggacuuaaucau

SEQ ID NO: 72291 - RNA, 22 nt, Human
auuaugcagcugccuccaaggu

SEQ ID NO: 72292 - RNA, 22 nt, Human
auuauucaaggugaggguaaaa

SEQ ID NO: 72293 - RNA, 22 nt, Human
auucuacucuuuaaauaugaaa

SEQ ID NO: 72294 - RNA, 22 nt, Human
auucucuauugguaaauuugac

SEQ ID NO: 72295 - RNA, 22 nt, Human
auucuagaguuucaauccaagg

SEQ ID NO: 72296 - RNA, 22 nt, Human
auucuaugaaugacuguuagau

SEQ ID NO: 72297 - RNA, 17 nt, Human
auucuaguuggcuuuuu

SEQ ID NO: 72298 - RNA, 20 nt, Human
auucucaccaugugacaugg

SEQ ID NO: 72299 - RNA, 22 nt, Human
auucuaauaagcguuuugucgc

SEQ ID NO: 72300 - RNA, 22 nt, Human
auucuacgcuccgucucuauca

SEQ ID NO: 72301 - RNA, 22 nt, Human
auuccuguggcuggguaaagua

SEQ ID NO: 72302 - RNA, 22 nt, Human
auuccagggaaauggggaugga

SEQ ID NO: 72303 - RNA, 22 nt, Human
auucuuuucucuaaaugaugaa

SEQ ID NO: 72304 - RNA, 19 nt, Human
auucuucucuuccugcugu

SEQ ID NO: 72305 - RNA, 22 nt, Human
auucuugauauagauaguuaau

SEQ ID NO: 72306 - RNA, 22 nt, Human
auucuccucaaaacaucugcug

SEQ ID NO: 72307 - RNA, 22 nt, Human
auugaaguguacguuugaucua

SEQ ID NO: 72308 - RNA, 22 nt, Human
auucucauguuuuaaaaaaguu

SEQ ID NO: 72309 - RNA, 22 nt, Human
auucucauguuaccaaauucua

SEQ ID NO: 72310 - RNA, 22 nt, Human
auucuguaggcuuuuguuaaaa

SEQ ID NO: 72311 - RNA, 20 nt, Human
auucuguguaaauguccugu

SEQ ID NO: 72312 - RNA, 22 nt, Human
auugagaugcuuaaaucuucac

SEQ ID NO: 72313 - RNA, 22 nt, Human
auugagcuguugaagucccaca

SEQ ID NO: 72314 - RNA, 22 nt, Human
auucugcauuucuaaccagguc

SEQ ID NO: 72315 - RNA, 21 nt, Human
auucugauguuucuauuguuu

SEQ ID NO: 72316 - RNA, 22 nt, Human
auucugcaauaaucaguccuua

SEQ ID NO: 72317 - RNA, 22 nt, Human
auucugaagcagaaaaggcaga

SEQ ID NO: 72318 - RNA, 22 nt, Human
auucucuguacagaagguaccg

SEQ ID NO: 72319 - RNA, 22 nt, Human
auucucugaugcagguggaaga

SEQ ID NO: 72320 - RNA, 22 nt, Human
auucuucauguugaagcuguca

SEQ ID NO: 72321 - RNA, 17 nt, Human
auucuuauacucuguga

SEQ ID NO: 72322 - RNA, 22 nt, Human
auuggaagacgcuggaggcacu

SEQ ID NO: 72323 - RNA, 22 nt, Human
auugccauaauagagccaugua

SEQ ID NO: 72324 - RNA, 22 nt, Human
auugaugaaaauaguuauuuua

SEQ ID NO: 72325 - RNA, 22 nt, Human
auugaguucaccucuuucagaa

SEQ ID NO: 72326 - RNA, 22 nt, Human
auugcaggucguguggaaguga

SEQ ID NO: 72327 - RNA, 22 nt, Human
auuuuuauuugccuaugauaua

SEQ ID NO: 72328 - RNA, 22 nt, Human
auuuuuaucuaaaauccacuuu

SEQ ID NO: 72329 - RNA, 22 nt, Human
caaaguaggcuaagaccuucca

SEQ ID NO: 72330 - RNA, 22 nt, Human
caaaugaugcauggcuagugag

SEQ ID NO: 72331 - RNA, 22 nt, Human
caaaugcaguggucgugcugga

SEQ ID NO: 72332 - RNA, 22 nt, Human
auuuuguugaaacccuuguugu

SEQ ID NO: 72333 - RNA, 22 nt, Human
caaagaaccuucgagacagggc

SEQ ID NO: 72334 - RNA, 22 nt, Human
caaauuuuuauuuaccaucugc

SEQ ID NO: 72335 - RNA, 22 nt, Human
auuuuugugcuuuauuggggua

SEQ ID NO: 72336 - RNA, 22 nt, Human
auuuuugguuucaccugcacgc

SEQ ID NO: 72337 - RNA, 22 nt, Human
auuuuuuuaggcugucagccgc

SEQ ID NO: 72338 - RNA, 22 nt, Human
auuuuuuuuccugucucuuuca

SEQ ID NO: 72339 - RNA, 22 nt, Human
auuuuuucaugugugguugaga

SEQ ID NO: 72340 - RNA, 22 nt, Human
auuuuacuaugauaguugagaa

SEQ ID NO: 72341 - RNA, 22 nt, Human
auuuucauauggguuauuugua

SEQ ID NO: 72342 - RNA, 22 nt, Human
auuuuucacauuuugggggaca

SEQ ID NO: 72343 - RNA, 21 nt, Human
auuuuucagaaggaugugaua

SEQ ID NO: 72344 - RNA, 22 nt, Human
auuuuuagucuugcugcaauca

SEQ ID NO: 72345 - RNA, 23 nt, Human
auuuccuaaaagauaaucauuac

SEQ ID NO: 72346 - RNA, 19 nt, Human
auuuccuggcauauaucac

SEQ ID NO: 72347 - RNA, 22 nt, Human
auuuccugugaacuuuucugau

SEQ ID NO: 72348 - RNA, 22 nt, Human
auuuuauuuugggaucuuuuua

SEQ ID NO: 72349 - RNA, 22 nt, Human
auuuucuugucucuguuguagg

SEQ ID NO: 72350 - RNA, 17 nt, Human
auuuccgaguuucuuuc

SEQ ID NO: 72351 - RNA, 22 nt, Human
auuuugcuuuucuaguggguuu

SEQ ID NO: 72352 - RNA, 22 nt, Human
auuuuggguguuaacaaugaaa

SEQ ID NO: 72353 - RNA, 22 nt, Human
auuuuuagagugaaagaauuaa

SEQ ID NO: 72354 - RNA, 22 nt, Human
auuguauugcguuugcgaaugu

SEQ ID NO: 72355 - RNA, 22 nt, Human
auuguagucuggacuuuuggga

SEQ ID NO: 72356 - RNA, 22 nt, Human
auuggagacauuaagucuaaga

SEQ ID NO: 72357 - RNA, 22 nt, Human
auuggccaguggacagcgccgu

SEQ ID NO: 72358 - RNA, 22 nt, Human
auuguuuccccggaauuauuca

SEQ ID NO: 72359 - RNA, 22 nt, Human
auuguucuagaauuuuuuuucc

SEQ ID NO: 72360 - RNA, 22 nt, Human
auuguuuugugaaacauaguga

SEQ ID NO: 72361 - RNA, 22 nt, Human
auuugccaguuacucacaccac

SEQ ID NO: 72362 - RNA, 22 nt, Human
auuugcaucagugagcgaugug

SEQ ID NO: 72363 - RNA, 22 nt, Human
auuugacuugguaagacuuaag

SEQ ID NO: 72364 - RNA, 22 nt, Human
auuugcuuguucaccaguacuu

SEQ ID NO: 72365 - RNA, 22 nt, Human
auuuagagaaguagcaaggucc

SEQ ID NO: 72366 - RNA, 22 nt, Human
auuuauauauuuuguucuggua

SEQ ID NO: 72367 - RNA, 22 nt, Human
auuuaggacagugucugaauug

SEQ ID NO: 72368 - RNA, 22 nt, Human
auuuaucugcucuucgcguuga

SEQ ID NO: 72369 - RNA, 22 nt, Human
auuucccugcagugcuuaggaa

SEQ ID NO: 72370 - RNA, 22 nt, Human
auuuggucuacauuuuccaaau

SEQ ID NO: 72371 - RNA, 22 nt, Human
auuuggucuguaauuacaugga

SEQ ID NO: 72372 - RNA, 22 nt, Human
auuucagcagcccauguuugga

SEQ ID NO: 72373 - RNA, 22 nt, Human
auuucauccauuaagaguacuc

SEQ ID NO: 72374 - RNA, 22 nt, Human
auuucauuuuagaaauaagugu

SEQ ID NO: 72375 - RNA, 22 nt, Human
auugaugccugaaaaauaugua

SEQ ID NO: 72376 - RNA, 22 nt, Human
auugauuuugugcuuuccuacg

SEQ ID NO: 72377 - RNA, 22 nt, Human
auugagaaaauucgagcaaguu

SEQ ID NO: 72378 - RNA, 22 nt, Human
auugacagagguguaguugaga

SEQ ID NO: 72379 - RNA, 18 nt, Human
auugagcaugacagaccu

SEQ ID NO: 72380 - RNA, 22 nt, Human
auucuuuagaguccuucaaaua

SEQ ID NO: 72381 - RNA, 20 nt, Human
auucuuguuccauuucccag

SEQ ID NO: 72382 - RNA, 22 nt, Human
auucuuuauuuucuguacuugc

SEQ ID NO: 72383 - RNA, 22 nt, Human
auugaauuagauguuguagucc

SEQ ID NO: 72384 - RNA, 22 nt, Human
auguuuucauuuagaagcuaau

SEQ ID NO: 72385 - RNA, 22 nt, Human
augugccuuaauauaggcgcug

SEQ ID NO: 72386 - RNA, 22 nt, Human
auguuuaauuugaaauuuuauu

SEQ ID NO: 72387 - RNA, 22 nt, Human
auguuugugauugcugaaaaga

SEQ ID NO: 72388 - RNA, 19 nt, Human
auguuuccauuucuggaua

SEQ ID NO: 72389 - RNA, 22 nt, Human
auuaaagcaugaauaauaugua

SEQ ID NO: 72390 - RNA, 22 nt, Human
auuaaaaaugagaguagggauu

SEQ ID NO: 72391 - RNA, 22 nt, Human
auguuuugaguuuuuuuacacc

SEQ ID NO: 72392 - RNA, 22 nt, Human
auguuuucuugucuggagaagu

SEQ ID NO: 72393 - RNA, 21 nt, Human
auguguucugauagugcuugc

SEQ ID NO: 72394 - RNA, 22 nt, Human
augugcauguauguaucauauu

SEQ ID NO: 72395 - RNA, 22 nt, Human
auguuguugaacucuuugcaug

SEQ ID NO: 72396 - RNA, 22 nt, Human
auguaugagagauucuuuuauu

SEQ ID NO: 72397 - RNA, 22 nt, Human
auguacugacuguacuuuuaaa

SEQ ID NO: 72398 - RNA, 22 nt, Human
augguguaggugaagagaacau

SEQ ID NO: 72399 - RNA, 22 nt, Human
augguaaguuuuuaaaaagcgu

SEQ ID NO: 72400 - RNA, 19 nt, Human
augguauugcuggguuuuu

SEQ ID NO: 72401 - RNA, 22 nt, Human
augggaggguagagugaacaga

SEQ ID NO: 72402 - RNA, 22 nt, Human
augggagggugaggaggcagcu

SEQ ID NO: 72403 - RNA, 22 nt, Human
augggagggagcagugaguguu

SEQ ID NO: 72404 - RNA, 22 nt, Human
augggaauggauugagugggug

SEQ ID NO: 72405 - RNA, 22 nt, Human
auggugaaaugauuugauguca

SEQ ID NO: 72406 - RNA, 22 nt, Human
auggugaugaugaugaugauaa

SEQ ID NO: 72407 - RNA, 22 nt, Human
auggaggaugugcagcaugggc

SEQ ID NO: 72408 - RNA, 22 nt, Human
auggggaggcggauggagugcu

SEQ ID NO: 72409 - RNA, 22 nt, Human
auggacagcucuuaugugggca

SEQ ID NO: 72410 - RNA, 22 nt, Human
auggggaauugaccguggaucu

SEQ ID NO: 72411 - RNA, 22 nt, Human
auggggaucugcaguguugauc

SEQ ID NO: 72412 - RNA, 22 nt, Human
auggcaucuucgguuggacugc

SEQ ID NO: 72413 - RNA, 22 nt, Human
auggauuggguugauggcauac

SEQ ID NO: 72414 - RNA, 22 nt, Human
augggauuugaaaaguggaaau

SEQ ID NO: 72415 - RNA, 22 nt, Human
auggaacauuaaucuucaaaug

SEQ ID NO: 72416 - RNA, 22 nt, Human
auggaacccgggcgucugcucu

SEQ ID NO: 72417 - RNA, 22 nt, Human
auggagguuugucugguuuugu

SEQ ID NO: 72418 - RNA, 22 nt, Human
auggagugggaggacaugaagg

SEQ ID NO: 72419 - RNA, 22 nt, Human
auggauggaagcagccugaacu

SEQ ID NO: 72420 - RNA, 22 nt, Human
auggaaggggagguagggagga

SEQ ID NO: 72421 - RNA, 22 nt, Human
auggaauuuaaauuuugguguc

SEQ ID NO: 72422 - RNA, 22 nt, Human
auggaagagacaaugcuaucug

SEQ ID NO: 72423 - RNA, 22 nt, Human
augcccugggagugcuguacca

SEQ ID NO: 72424 - RNA, 17 nt, Human
augcccagggcucccug

SEQ ID NO: 72425 - RNA, 22 nt, Human
augcaugaucccgguaugugaa

SEQ ID NO: 72426 - RNA, 22 nt, Human
augccacuguuuaugucacuua

SEQ ID NO: 72427 - RNA, 22 nt, Human
augauuuguuaacagacuuaau

SEQ ID NO: 72428 - RNA, 22 nt, Human
augcaaaaucuuauuuuuucua

SEQ ID NO: 72429 - RNA, 22 nt, Human
augauucuaccaaugccaucuu

SEQ ID NO: 72430 - RNA, 22 nt, Human
augcccagaacccccuggaugg

SEQ ID NO: 72431 - RNA, 22 nt, Human
augauguuggaauuuuaacuua

SEQ ID NO: 72432 - RNA, 22 nt, Human
augcaguuagguaauagucuca

SEQ ID NO: 72433 - RNA, 22 nt, Human
augcauaucuccuaucuccuca

SEQ ID NO: 72434 - RNA, 22 nt, Human
augcacaagguagauuauuauu

SEQ ID NO: 72435 - RNA, 19 nt, Human
augcaauguuaucaauaac

SEQ ID NO: 72436 - RNA, 19 nt, Human
augcacgugaaaugcauuu

SEQ ID NO: 72437 - RNA, 22 nt, Human
augaggagucaaggagucggag

SEQ ID NO: 72438 - RNA, 22 nt, Human
augaggauuagcaucugcaaau

SEQ ID NO: 72439 - RNA, 21 nt, Human
augagguggcuacuaaagagu

SEQ ID NO: 72440 - RNA, 23 nt, Human
augcaacauugccaguaugggca

SEQ ID NO: 72441 - RNA, 22 nt, Human
augaacugcaguauaaacuugg

SEQ ID NO: 72442 - RNA, 22 nt, Human
augaaggauagggcaaaauuuu

SEQ ID NO: 72443 - RNA, 18 nt, Human
augauaauguuugcauca

SEQ ID NO: 72444 - RNA, 23 nt, Human
augaaaugauacuuuauucacug

SEQ ID NO: 72445 - RNA, 22 nt, Human
aucuuuuuucacaauuuauuuu

SEQ ID NO: 72446 - RNA, 22 nt, Human
aucuuuguaaguaaucaaagcu

SEQ ID NO: 72447 - RNA, 22 nt, Human
augagugugugguucuaaauga

SEQ ID NO: 72448 - RNA, 22 nt, Human
augaggguggggaaugggccau

SEQ ID NO: 72449 - RNA, 22 nt, Human
augaccuucuuuccuuaaauuu

SEQ ID NO: 72450 - RNA, 22 nt, Human
aucuuggccuucuccuggagug

SEQ ID NO: 72451 - RNA, 22 nt, Human
augaaaacggaccagagcuauu

SEQ ID NO: 72452 - RNA, 22 nt, Human
aucuuugauuuuggcuuuuagg

SEQ ID NO: 72453 - RNA, 22 nt, Human
aucuguucuucaaaauauuaca

SEQ ID NO: 72454 - RNA, 20 nt, Human
augaaugcuccccacguuuc

SEQ ID NO: 72455 - RNA, 22 nt, Human
augaauuugaacaccagguugg

SEQ ID NO: 72456 - RNA, 22 nt, Human
aucuuggauccuuugccagcuu

SEQ ID NO: 72457 - RNA, 22 nt, Human
aucucccaaauuagccucuuga

SEQ ID NO: 72458 - RNA, 22 nt, Human
aucuuguuagaaggcaguaggu

SEQ ID NO: 72459 - RNA, 23 nt, Human
aucugagccuggucccacccgcu

SEQ ID NO: 72460 - RNA, 19 nt, Human
aucuuucagcagcuccccu

SEQ ID NO: 72461 - RNA, 22 nt, Human
aucuuugccuuuaugccucuag

SEQ ID NO: 72462 - RNA, 22 nt, Human
aucuucucucucaucaggauca

SEQ ID NO: 72463 - RNA, 22 nt, Human
aucuugaaacauauaugcauuu

SEQ ID NO: 72464 - RNA, 22 nt, Human
aucucaaagauaugcugguaaa

SEQ ID NO: 72465 - RNA, 22 nt, Human
aucuauguaucucagaagcuag

SEQ ID NO: 72466 - RNA, 22 nt, Human
aucuccaguuagcaguacugau

SEQ ID NO: 72467 - RNA, 22 nt, Human
aucuuaguuauuuggagaaacc

SEQ ID NO: 72468 - RNA, 22 nt, Human
aucuucaaagcacaucguuugu

SEQ ID NO: 72469 - RNA, 22 nt, Human
aucuagguuuggaagauagagu

SEQ ID NO: 72470 - RNA, 22 nt, Human
aucuacuaagugccaagcacag

SEQ ID NO: 72471 - RNA, 22 nt, Human
aucguuaugauagagaaagaga

SEQ ID NO: 72472 - RNA, 22 nt, Human
aucuaaaacuacgaauacuacc

SEQ ID NO: 72473 - RNA, 22 nt, Human
aucggucuccuauaauucaaac

SEQ ID NO: 72474 - RNA, 22 nt, Human
aucuuagcucaacucucaccaa

SEQ ID NO: 72475 - RNA, 22 nt, Human
aucuguuccccuaugcucucua

SEQ ID NO: 72476 - RNA, 22 nt, Human
aucuuagagagucguguuuugu

SEQ ID NO: 72477 - RNA, 22 nt, Human
auacacuucauguuuucaucug

SEQ ID NO: 72478 - RNA, 22 nt, Human
auacuaguuacuuuccuugggg

SEQ ID NO: 72479 - RNA, 22 nt, Human
aucuccagcagugcuuuugagc

SEQ ID NO: 72480 - RNA, 22 nt, Human
aucuggaacuucucugcauuga

SEQ ID NO: 72481 - RNA, 22 nt, Human
aucugcuguaguuggugccagu

SEQ ID NO: 72482 - RNA, 22 nt, Human
aucugugauuuuggcaagauuu

SEQ ID NO: 72483 - RNA, 20 nt, Human
aucugguggggaauaacuuc

SEQ ID NO: 72484 - RNA, 20 nt, Human
aucugugaugagaacgguuu

SEQ ID NO: 72485 - RNA, 18 nt, Human
auccuucggccuagugga

SEQ ID NO: 72486 - RNA, 19 nt, Human
auccuugcucacucacuga

SEQ ID NO: 72487 - RNA, 22 nt, Human
aucucuguaaaccauaaauuga

SEQ ID NO: 72488 - RNA, 22 nt, Human
aucugcauguggcagguggauu

SEQ ID NO: 72489 - RNA, 22 nt, Human
aucugcugccuaggguuugucu

SEQ ID NO: 72490 - RNA, 22 nt, Human
cagcuucacuuaaaacaugcaa

SEQ ID NO: 72491 - RNA, 22 nt, Human
cagcuucaugacaaacaguuuu

SEQ ID NO: 72492 - RNA, 22 nt, Human
cagcuugcccugauguggaaga

SEQ ID NO: 72493 - RNA, 22 nt, Human
cagcuguauuucucugguuaga

SEQ ID NO: 72494 - RNA, 22 nt, Human
caggguuuuaguugcagguuau

SEQ ID NO: 72495 - RNA, 20 nt, Human
caggccuucaggauggcugg

SEQ ID NO: 72496 - RNA, 22 nt, Human
cagggaaguauuacauguuucc

SEQ ID NO: 72497 - RNA, 22 nt, Human
cagcuacuaccuguagacaaag

SEQ ID NO: 72498 - RNA, 22 nt, Human
caggaggaggccgggaggaagc

SEQ ID NO: 72499 - RNA, 19 nt, Human
caggauuguuuaaagcuuu

SEQ ID NO: 72500 - RNA, 22 nt, Human
caggauauguucaagguuuucu

SEQ ID NO: 72501 - RNA, 22 nt, Human
caggauuuaauaagauaguguu

SEQ ID NO: 72502 - RNA, 22 nt, Human
caggaacagcaccaggagcuag

SEQ ID NO: 72503 - RNA, 22 nt, Human
caggaacucggagcccaucucu

SEQ ID NO: 72504 - RNA, 22 nt, Human
cagcaugguggagcugcucuuu

SEQ ID NO: 72505 - RNA, 22 nt, Human
cagagaugaggcuggcgugguu

SEQ ID NO: 72506 - RNA, 22 nt, Human
cagagccagcuguccuuggcau

SEQ ID NO: 72507 - RNA, 20 nt, Human
cagagccaggguuuuguuuu

SEQ ID NO: 72508 - RNA, 21 nt, Human
cagagcuuuggagacggagga

SEQ ID NO: 72509 - RNA, 22 nt, Human
cauaaauuuuaccuuguaagug

SEQ ID NO: 72510 - RNA, 22 nt, Human
cauaacuugguguuggaaacug

SEQ ID NO: 72511 - RNA, 22 nt, Human
cauaggaaauugcuguuaugga

SEQ ID NO: 72512 - RNA, 22 nt, Human
cauauuaugcauguuguucuuu

SEQ ID NO: 72513 - RNA, 22 nt, Human
cauaucuccagguucugcugga

SEQ ID NO: 72514 - RNA, 22 nt, Human
caguucacggcugguaugaauu

SEQ ID NO: 72515 - RNA, 21 nt, Human
caguucuaagugucaucuuuu

SEQ ID NO: 72516 - RNA, 22 nt, Human
caguuuccagacauuauugaua

SEQ ID NO: 72517 - RNA, 22 nt, Human
caggguuuuauuuggcuuuaaa

SEQ ID NO: 72518 - RNA, 22 nt, Human
caguguugcuaaugaauucauu

SEQ ID NO: 72519 - RNA, 22 nt, Human
cagugguaaaugucguuccugu

SEQ ID NO: 72520 - RNA, 22 nt, Human
cagugcucauagcuguuccucc

SEQ ID NO: 72521 - RNA, 22 nt, Human
cagugcuggaggggugcuugca

SEQ ID NO: 72522 - RNA, 22 nt, Human
cagugcaacguugugcauucaa

SEQ ID NO: 72523 - RNA, 22 nt, Human
caggaggaaaguuccacucaac

SEQ ID NO: 72524 - RNA, 22 nt, Human
cagguuuuccuuuuaaaaggaa

SEQ ID NO: 72525 - RNA, 22 nt, Human
caggagaaauucacauuaguga

SEQ ID NO: 72526 - RNA, 22 nt, Human
caggacuuccucuaugguggcg

SEQ ID NO: 72527 - RNA, 22 nt, Human
cagagaggagcacaaagugaag

SEQ ID NO: 72528 - RNA, 22 nt, Human
cagagagcguccauccggugcc

SEQ ID NO: 72529 - RNA, 22 nt, Human
cagaaguugcuugagagagagc

SEQ ID NO: 72530 - RNA, 22 nt, Human
cagacaaauccuuaugagacug

SEQ ID NO: 72531 - RNA, 22 nt, Human
cagcauugagcacagaaggaaa

SEQ ID NO: 72532 - RNA, 22 nt, Human
cagaccucuaugggguaaaucu

SEQ ID NO: 72533 - RNA, 22 nt, Human
cagccauucuaacacugccagu

SEQ ID NO: 72534 - RNA, 22 nt, Human
cagcagaugacuauuggagcug

SEQ ID NO: 72535 - RNA, 22 nt, Human
cacuuauuuuuccuuugugauu

SEQ ID NO: 72536 - RNA, 22 nt, Human
cacuucaguacuagaggaugaa

SEQ ID NO: 72537 - RNA, 22 nt, Human
cacuugagagcugaagaagucu

SEQ ID NO: 72538 - RNA, 22 nt, Human
cacuuaaaauucagggcuuaua

SEQ ID NO: 72539 - RNA, 22 nt, Human
cagaaaguauguucuaguaguu

SEQ ID NO: 72540 - RNA, 22 nt, Human
cacuguugaagauacuuccucu

SEQ ID NO: 72541 - RNA, 21 nt, Human
cacuguauagcaggagaaaac

SEQ ID NO: 72542 - RNA, 23 nt, Human
cagagaaaauagaauaugcugug

SEQ ID NO: 72543 - RNA, 22 nt, Human
cagaccucucaggcuguucuug

SEQ ID NO: 72544 - RNA, 22 nt, Human
cagagacuuuugcuccgauucu

SEQ ID NO: 72545 - RNA, 22 nt, Human
caccaucugaauauucuccaag

SEQ ID NO: 72546 - RNA, 22 nt, Human
caccacauguccgaaauucagc

SEQ ID NO: 72547 - RNA, 18 nt, Human
cacgcaacuguaaaaccc

SEQ ID NO: 72548 - RNA, 22 nt, Human
cacuauguacauaauagcugcu

SEQ ID NO: 72549 - RNA, 22 nt, Human
cagaaauuggcagagaagaccu

SEQ ID NO: 72550 - RNA, 22 nt, Human
cagaaagugauuugcuauucca

SEQ ID NO: 72551 - RNA, 22 nt, Human
cacauuuuccagaagaaucaga

SEQ ID NO: 72552 - RNA, 22 nt, Human
cagaaagaaguggggauagagg

SEQ ID NO: 72553 - RNA, 22 nt, Human
cacuuuuucccccuggugucau

SEQ ID NO: 72554 - RNA, 22 nt, Human
cagaaaaaaaugcagacuagca

SEQ ID NO: 72555 - RNA, 22 nt, Human
cacagucugagcccagccuugu

SEQ ID NO: 72556 - RNA, 22 nt, Human
cacuaaccauguucccaacagc

SEQ ID NO: 72557 - RNA, 22 nt, Human
cacaguccugcauuuacugccu

SEQ ID NO: 72558 - RNA, 22 nt, Human
cacaggacuuggcuucucacag

SEQ ID NO: 72559 - RNA, 22 nt, Human
cacuguugagcaauguacagug

SEQ ID NO: 72560 - RNA, 22 nt, Human
cacugcugaggcccguguuacu

SEQ ID NO: 72561 - RNA, 22 nt, Human
cacucuucucucauuuuccuuu

SEQ ID NO: 72562 - RNA, 20 nt, Human
caauguuggcaguauagagc

SEQ ID NO: 72563 - RNA, 22 nt, Human
caaugggagaugcagaacagcu

SEQ ID NO: 72564 - RNA, 22 nt, Human
caaaagcaaagaucuuugauug

SEQ ID NO: 72565 - RNA, 22 nt, Human
caagcagauauuuuagucaaga

SEQ ID NO: 72566 - RNA, 22 nt, Human
cauuuacauaacaguaacgcug

SEQ ID NO: 72567 - RNA, 22 nt, Human
cauuuaucacuugcuaaacaua

SEQ ID NO: 72568 - RNA, 22 nt, Human
cauuucaaacaguuacagcugc

SEQ ID NO: 72569 - RNA, 22 nt, Human
caucuuuguuuuggauauaauc

SEQ ID NO: 72570 - RNA, 22 nt, Human
caucuccaagucuguaagcagu

SEQ ID NO: 72571 - RNA, 22 nt, Human
caucgagaauuggcagcuaaag

SEQ ID NO: 72572 - RNA, 22 nt, Human
caucugcagccucugcauuccc

SEQ ID NO: 72573 - RNA, 22 nt, Human
caucucagguuuguucugagac

SEQ ID NO: 72574 - RNA, 22 nt, Human
cauugcuguuaauugucucuag

SEQ ID NO: 72575 - RNA, 22 nt, Human
caucccaacaggugaucuggua

SEQ ID NO: 72576 - RNA, 22 nt, Human
cauuuugguaauguucguuugc

SEQ ID NO: 72577 - RNA, 22 nt, Human
cauuuuccucugcugguguuca

SEQ ID NO: 72578 - RNA, 22 nt, Human
cauuuucugcaagucugcucaa

SEQ ID NO: 72579 - RNA, 22 nt, Human
cauuuuaucagcacacgucacu

SEQ ID NO: 72580 - RNA, 22 nt, Human
caugaugacagcauuccuuuua

SEQ ID NO: 72581 - RNA, 22 nt, Human
caugaagugaaaagguuaauuu

SEQ ID NO: 72582 - RNA, 22 nt, Human
cauuucuggccuggggagcggg

SEQ ID NO: 72583 - RNA, 22 nt, Human
caugagaguaaccuagagaaga

SEQ ID NO: 72584 - RNA, 22 nt, Human
caucaacagucuacuuuuugcc

SEQ ID NO: 72585 - RNA, 21 nt, Human
caucaagaucaauggagggcu

SEQ ID NO: 72586 - RNA, 22 nt, Human
cauuccaagaaguaguucugca

SEQ ID NO: 72587 - RNA, 22 nt, Human
cauucauaagacuuugcucuug

SEQ ID NO: 72588 - RNA, 22 nt, Human
cauugcaaccauuccaaauggc

SEQ ID NO: 72589 - RNA, 22 nt, Human
caucaauagguauuugagagac

SEQ ID NO: 72590 - RNA, 22 nt, Human
cagguguugcaguugaagacug

SEQ ID NO: 72591 - RNA, 22 nt, Human
cauaucuuaaacaucaucucug

SEQ ID NO: 72592 - RNA, 22 nt, Human
cagguuuuuauuacaacuuuga

SEQ ID NO: 72593 - RNA, 22 nt, Human
cauuauacaugaagacucaccc

SEQ ID NO: 72594 - RNA, 22 nt, Human
cauucauagaaucaguuuggga

SEQ ID NO: 72595 - RNA, 20 nt, Human
cauuccaugcaucuuggucc

SEQ ID NO: 72596 - RNA, 22 nt, Human
cauuccaaguauauacaugaua

SEQ ID NO: 72597 - RNA, 22 nt, Human
ccacucagaagaaacaagagag

SEQ ID NO: 72598 - RNA, 22 nt, Human
ccacagugauucacuuuugaag

SEQ ID NO: 72599 - RNA, 22 nt, Human
ccaccacauuugccuagacuuu

SEQ ID NO: 72600 - RNA, 22 nt, Human
cauguggaaaugcaugcuuuuu

SEQ ID NO: 72601 - RNA, 22 nt, Human
ccaaggcugcagccgugacgcg

SEQ ID NO: 72602 - RNA, 22 nt, Human
caugcuaacacguugcucaccg

SEQ ID NO: 72603 - RNA, 22 nt, Human
caugcuggcacugaccagccua

SEQ ID NO: 72604 - RNA, 22 nt, Human
cauuuugguccucauguguagc

SEQ ID NO: 72605 - RNA, 22 nt, Human
caugauguuaucaagcacaaag

SEQ ID NO: 72606 - RNA, 22 nt, Human
cauuuuuuuuccccuccuggua

SEQ ID NO: 72607 - RNA, 22 nt, Human
ccaaagaagcaaugagaauagu

SEQ ID NO: 72608 - RNA, 22 nt, Human
ccaaagaauuuggaaaaucuga

SEQ ID NO: 72609 - RNA, 22 nt, Human
ccaaaguauuaaaucuuagcaa

SEQ ID NO: 72610 - RNA, 22 nt, Human
cccagaaugauucagcgacagu

SEQ ID NO: 72611 - RNA, 19 nt, Human
ccagaagggcaagcaaagg

SEQ ID NO: 72612 - RNA, 22 nt, Human
ccaugggugucuggagcacccu

SEQ ID NO: 72613 - RNA, 22 nt, Human
ccauggaugcucagauguuagc

SEQ ID NO: 72614 - RNA, 22 nt, Human
ccacuacauugagugcuuucuc

SEQ ID NO: 72615 - RNA, 22 nt, Human
ccaucuuugcucuuuuauugca

SEQ ID NO: 72616 - RNA, 22 nt, Human
ccaguuuuuccagugcuuucug

SEQ ID NO: 72617 - RNA, 19 nt, Human
ccaguuuuuuaauauucaa

SEQ ID NO: 72618 - RNA, 22 nt, Human
ccauaaaagagaaucuaaauga

SEQ ID NO: 72619 - RNA, 22 nt, Human
ccacagcauugaaaucuauaau

SEQ ID NO: 72620 - RNA, 22 nt, Human
ccaaggcuguggggcugugcag

SEQ ID NO: 72621 - RNA, 22 nt, Human
ccaaggcuggagggcuuaugua

SEQ ID NO: 72622 - RNA, 22 nt, Human
ccaaucaacuguguggcuuucu

SEQ ID NO: 72623 - RNA, 22 nt, Human
ccaaauuaccuucuuggauuca

SEQ ID NO: 72624 - RNA, 22 nt, Human
ccaggacuuauuacaguauaac

SEQ ID NO: 72625 - RNA, 23 nt, Human
cauuugauccucacaauaaaugg

SEQ ID NO: 72626 - RNA, 22 nt, Human
cauuugcuuaucacucuucuuu

SEQ ID NO: 72627 - RNA, 22 nt, Human
cauuucuugugagccgcauccu

SEQ ID NO: 72628 - RNA, 22 nt, Human
ccagcaaguaagucagugucag

SEQ ID NO: 72629 - RNA, 22 nt, Human
cauugguacaaaauguacuuug

SEQ ID NO: 72630 - RNA, 18 nt, Human
cauuguacaaugcuuuau

SEQ ID NO: 72631 - RNA, 22 nt, Human
cauuuagagaagauuacaagga

SEQ ID NO: 72632 - RNA, 22 nt, Human
cauuuaaccccuugguacugaa

SEQ ID NO: 72633 - RNA, 22 nt, Human
ccagauaaacauuccuuggccu

SEQ ID NO: 72634 - RNA, 22 nt, Human
cauuggcacauguauucugggc

SEQ ID NO: 72635 - RNA, 22 nt, Human
ccagagcacaccguuugccuuc

SEQ ID NO: 72636 - RNA, 22 nt, Human
cauugcugccaaggugagcugg

SEQ ID NO: 72637 - RNA, 22 nt, Human
cauugcugugggcauuugcugc

SEQ ID NO: 72638 - RNA, 20 nt, Human
ccagaagagaagaaaaggaa

SEQ ID NO: 72639 - RNA, 22 nt, Human
ccagaauuugaacccacaaaug

SEQ ID NO: 72640 - RNA, 22 nt, Human
cauugcaaccccaaaaagaaca

SEQ ID NO: 72641 - RNA, 22 nt, Human
cauuccuucucagguacuggca

SEQ ID NO: 72642 - RNA, 22 nt, Human
ccacuuugagaagcugaugaaa

SEQ ID NO: 72643 - RNA, 22 nt, Human
cauuccuaccauaucugcucuu

SEQ ID NO: 72644 - RNA, 17 nt, Human
ccuuucugaucaucuga

SEQ ID NO: 72645 - RNA, 22 nt, Human
ccuugugauugaucuaaguugc

SEQ ID NO: 72646 - RNA, 22 nt, Human
ccuuuccucuucaugacuuucu

SEQ ID NO: 72647 - RNA, 22 nt, Human
ccuugguuuagcaauuuuucuu

SEQ ID NO: 72648 - RNA, 18 nt, Human
ccuucaucucugcuucuu

SEQ ID NO: 72649 - RNA, 22 nt, Human
ccuuagcuggguaacuuugggc

SEQ ID NO: 72650 - RNA, 22 nt, Human
ccuugagacacagccaaagaug

SEQ ID NO: 72651 - RNA, 22 nt, Human
ccuuuuaagggagacuagagau

SEQ ID NO: 72652 - RNA, 21 nt, Human
ccuuuggagacugcagcaaug

SEQ ID NO: 72653 - RNA, 22 nt, Human
ccggauuugggagccaccaggg

SEQ ID NO: 72654 - RNA, 22 nt, Human
ccuuugcccugagaaauguucc

SEQ ID NO: 72655 - RNA, 22 nt, Human
ccggaggaaauugcauugguug

SEQ ID NO: 72656 - RNA, 22 nt, Human
ccuuaauaguguucuaauguuu

SEQ ID NO: 72657 - RNA, 22 nt, Human
ccugugacucugucugaugguc

SEQ ID NO: 72658 - RNA, 23 nt, Human
ccuggcugaccugaagguguagu

SEQ ID NO: 72659 - RNA, 22 nt, Human
ccagacucucucauuuuccugu

SEQ ID NO: 72660 - RNA, 22 nt, Human
ccagagaugcagugggugcagu

SEQ ID NO: 72661 - RNA, 22 nt, Human
cggagcauacugccuggagaug

SEQ ID NO: 72662 - RNA, 22 nt, Human
cggaggcugcuuucuguugcua

SEQ ID NO: 72663 - RNA, 22 nt, Human
cgggagagacagaggaggcgcc

SEQ ID NO: 72664 - RNA, 19 nt, Human
cgcugcucccgcuguggcu

SEQ ID NO: 72665 - RNA, 22 nt, Human
cgaguagagaugugguuucuga

SEQ ID NO: 72666 - RNA, 22 nt, Human
ccuccuuuccuguuuuccugag

SEQ ID NO: 72667 - RNA, 22 nt, Human
ccucccuucccggcauggcucu

SEQ ID NO: 72668 - RNA, 22 nt, Human
cgaaggaaucacuuaacacuuu

SEQ ID NO: 72669 - RNA, 22 nt, Human
cgaagcuuuuguuggcgugucg

SEQ ID NO: 72670 - RNA, 21 nt, Human
ccuaugucucaaagguucucc

SEQ ID NO: 72671 - RNA, 22 nt, Human
ccuccccugccugugcuguugg

SEQ ID NO: 72672 - RNA, 22 nt, Human
ccuaauuuuagacccacuccua

SEQ ID NO: 72673 - RNA, 19 nt, Human
ccggucaugcauuccuuug

SEQ ID NO: 72674 - RNA, 20 nt, Human
ccucaaccuccuuucucucc

SEQ ID NO: 72675 - RNA, 22 nt, Human
ccuauuuucaaaauuguuuauc

SEQ ID NO: 72676 - RNA, 22 nt, Human
ccuauauuacaggcuugcucua

SEQ ID NO: 72677 - RNA, 22 nt, Human
ccuuggaucugcauaucagcua

SEQ ID NO: 72678 - RNA, 22 nt, Human
ccuuggcuuaccuucugugugg

SEQ ID NO: 72679 - RNA, 22 nt, Human
ccuucucuucuuggaaggaacu

SEQ ID NO: 72680 - RNA, 22 nt, Human
ccuucugcuggucaucccagug

SEQ ID NO: 72681 - RNA, 22 nt, Human
ccuugcgaggaugcugugagcu

SEQ ID NO: 72682 - RNA, 22 nt, Human
cgggagaugaggagagcuucgg

SEQ ID NO: 72683 - RNA, 21 nt, Human
ccuggagacaaagacagggug

SEQ ID NO: 72684 - RNA, 22 nt, Human
ccuuucuaacagauuguggauc

SEQ ID NO: 72685 - RNA, 22 nt, Human
ccuuuccuggaaaugguaaguu

SEQ ID NO: 72686 - RNA, 22 nt, Human
ccuuugcugggccucuccaucu

SEQ ID NO: 72687 - RNA, 22 nt, Human
ccuuucuggucucugagagacu

SEQ ID NO: 72688 - RNA, 21 nt, Human
ccuuugaguguguuugaagua

SEQ ID NO: 72689 - RNA, 22 nt, Human
cgugaucuguuauauagugagc

SEQ ID NO: 72690 - RNA, 22 nt, Human
ccuuuuuagaugugcgaauguu

SEQ ID NO: 72691 - RNA, 22 nt, Human
cuagaggaacaguuucagguuu

SEQ ID NO: 72692 - RNA, 22 nt, Human
cuacuuucuucuucagaauugu

SEQ ID NO: 72693 - RNA, 22 nt, Human
cuacuucucccuagaucagaaa

SEQ ID NO: 72694 - RNA, 22 nt, Human
cuacuguaguuaaaguuuugua

SEQ ID NO: 72695 - RNA, 22 nt, Human
cgauuccugauaagugaauaag

SEQ ID NO: 72696 - RNA, 22 nt, Human
cuaaagucauacaaggugggag

SEQ ID NO: 72697 - RNA, 22 nt, Human
cgagugauuauucuggcugaga

SEQ ID NO: 72698 - RNA, 22 nt, Human
cgaggagguccaggagcaguag

SEQ ID NO: 72699 - RNA, 18 nt, Human
cuacauucauaggaaagg

SEQ ID NO: 72700 - RNA, 22 nt, Human
cuaaauucuauauccuugcuuc

SEQ ID NO: 72701 - RNA, 22 nt, Human
cuaaacuucauauguugcuuua

SEQ ID NO: 72702 - RNA, 22 nt, Human
cuaaacacuauucuggaaauag

SEQ ID NO: 72703 - RNA, 22 nt, Human
cucucugcugucuuucgggaaa

SEQ ID NO: 72704 - RNA, 22 nt, Human
cucugagcucgugcaguacuuc

SEQ ID NO: 72705 - RNA, 22 nt, Human
cucugaguuuacaguauguuuu

SEQ ID NO: 72706 - RNA, 22 nt, Human
cuccuagagcacaaaaggccau

SEQ ID NO: 72707 - RNA, 22 nt, Human
cuccucguccucuucauccucu

SEQ ID NO: 72708 - RNA, 22 nt, Human
cucuaagcuuugguguuucacu

SEQ ID NO: 72709 - RNA, 22 nt, Human
cucuaccugcacaugccugacu

SEQ ID NO: 72710 - RNA, 22 nt, Human
cuccaccucagugucaucuucu

SEQ ID NO: 72711 - RNA, 22 nt, Human
cucccucauaugguugcuuauc

SEQ ID NO: 72712 - RNA, 22 nt, Human
cuccaggacugaggacagagcu

SEQ ID NO: 72713 - RNA, 22 nt, Human
cucaugaauggcucuuugugcu

SEQ ID NO: 72714 - RNA, 22 nt, Human
cucagugacuuccugcucaauu

SEQ ID NO: 72715 - RNA, 22 nt, Human
cucaucuucuuccuucuuuucc

SEQ ID NO: 72716 - RNA, 22 nt, Human
cucaauuuuuauugcuuuuuug

SEQ ID NO: 72717 - RNA, 22 nt, Human
cucaguauugacgaaagagauu

SEQ ID NO: 72718 - RNA, 22 nt, Human
cucagcacauuccuaagggaug

SEQ ID NO: 72719 - RNA, 22 nt, Human
cucaauuguuuggucucugguu

SEQ ID NO: 72720 - RNA, 22 nt, Human
cucaaugagcuauuuguuucau

SEQ ID NO: 72721 - RNA, 22 nt, Human
cucaaauggguuuguagaauau

SEQ ID NO: 72722 - RNA, 22 nt, Human
cucaaaauccauaaaaucaggu

SEQ ID NO: 72723 - RNA, 22 nt, Human
cucaaagcagacuuuucccuuu

SEQ ID NO: 72724 - RNA, 22 nt, Human
cuaguagcccauuuuggauacc

SEQ ID NO: 72725 - RNA, 22 nt, Human
cuaguucugccauucaguguca

SEQ ID NO: 72726 - RNA, 22 nt, Human
cuauguuucagauauauauaua

SEQ ID NO: 72727 - RNA, 22 nt, Human
cuaggcuuucugugugacuaga

SEQ ID NO: 72728 - RNA, 22 nt, Human
cuagcacagugcuuggcacaca

SEQ ID NO: 72729 - RNA, 22 nt, Human
cugauaauaaccauuuuaaaau

SEQ ID NO: 72730 - RNA, 22 nt, Human
cugauagagcauuagugugaga

SEQ ID NO: 72731 - RNA, 20 nt, Human
cugauagauucuuccccaga

SEQ ID NO: 72732 - RNA, 22 nt, Human
cugaugcucuggauguagucaa

SEQ ID NO: 72733 - RNA, 22 nt, Human
cugauggagagugugauuuggg

SEQ ID NO: 72734 - RNA, 21 nt, Human
cugauguaccucaagccuagu

SEQ ID NO: 72735 - RNA, 17 nt, Human
cgugaggaccaggcagc

SEQ ID NO: 72736 - RNA, 22 nt, Human
cguggaggucgcauauuccucu

SEQ ID NO: 72737 - RNA, 21 nt, Human
cgucccggcgugagagagcug

SEQ ID NO: 72738 - RNA, 22 nt, Human
cgguuuuuaaaagucucuucua

SEQ ID NO: 72739 - RNA, 22 nt, Human
cugcagauguagcugcuuuccu

SEQ ID NO: 72740 - RNA, 22 nt, Human
cuaaaaauguucuaguaguuca

SEQ ID NO: 72741 - RNA, 22 nt, Human
cuaaauguuuuaucuuccuggc

SEQ ID NO: 72742 - RNA, 22 nt, Human
cuaaagacagcaagacaucauc

SEQ ID NO: 72743 - RNA, 22 nt, Human
cugauuguagccacugugauga

SEQ ID NO: 72744 - RNA, 22 nt, Human
cugauuucaaauggugcuagau

SEQ ID NO: 72745 - RNA, 22 nt, Human
cugcagagaccuaggucagguu

SEQ ID NO: 72746 - RNA, 22 nt, Human
cguuugagggaguuggaacugc

SEQ ID NO: 72747 - RNA, 22 nt, Human
cugcuguuuucugggcuucuua

SEQ ID NO: 72748 - RNA, 22 nt, Human
cugcuguuuuccccaccaucuc

SEQ ID NO: 72749 - RNA, 22 nt, Human
cugcuguugagguuccaggcca

SEQ ID NO: 72750 - RNA, 22 nt, Human
cuauuaauggccaggagucaug

SEQ ID NO: 72751 - RNA, 22 nt, Human
cugcugucuuuauuucacugcu

SEQ ID NO: 72752 - RNA, 22 nt, Human
cuauaucuguggauaguguaug

SEQ ID NO: 72753 - RNA, 22 nt, Human
cuaugguaguggcacaggagga

SEQ ID NO: 72754 - RNA, 18 nt, Human
cuaguuuguuuucuacau

SEQ ID NO: 72755 - RNA, 21 nt, Human
cugcugaaggaaccccaugga

SEQ ID NO: 72756 - RNA, 21 nt, Human
cuauaaaaaugguucuuugcg

SEQ ID NO: 72757 - RNA, 22 nt, Human
cugcucuucccaucccuuaaau

SEQ ID NO: 72758 - RNA, 22 nt, Human
cuaggaugcuguaauggugucu

SEQ ID NO: 72759 - RNA, 22 nt, Human
cuagcaggacucagcagauauu

SEQ ID NO: 72760 - RNA, 22 nt, Human
cuagaucuuuaaaaaucuggaa

SEQ ID NO: 72761 - RNA, 22 nt, Human
cuagaucuggcaggcacaaggu

SEQ ID NO: 72762 - RNA, 22 nt, Human
cuagagaaaaagcuuagguacg

SEQ ID NO: 72763 - RNA, 22 nt, Human
cuagaaguuuggguccauuaag

SEQ ID NO: 72764 - RNA, 22 nt, Human
cuagaaaguaugcuuuuauaau

SEQ ID NO: 72765 - RNA, 22 nt, Human
cuacuucuguggcucuaagaga

SEQ ID NO: 72766 - RNA, 22 nt, Human
cuacauuuacacaguuaggcuu

SEQ ID NO: 72767 - RNA, 19 nt, Human
cuacaguguuuuucuuucc

SEQ ID NO: 72768 - RNA, 22 nt, Human
cuacugaagcaugcuuauaugu

SEQ ID NO: 72769 - RNA, 22 nt, Human
cuacugaugccccgcugugccu

SEQ ID NO: 72770 - RNA, 22 nt, Human
cugcccgcaugcaggaaugcug

SEQ ID NO: 72771 - RNA, 22 nt, Human
cuacacgauaaauuuuaguggu

SEQ ID NO: 72772 - RNA, 22 nt, Human
cuaaauuuuuuagugaaauagg

SEQ ID NO: 72773 - RNA, 22 nt, Human
cuaagaaggaggaaaagugcca

SEQ ID NO: 72774 - RNA, 22 nt, Human
cuuauucuucuggacuuggagu

SEQ ID NO: 72775 - RNA, 22 nt, Human
cugagguagaggaaauguagcu

SEQ ID NO: 72776 - RNA, 22 nt, Human
cuuaggaaauccuguacucccc

SEQ ID NO: 72777 - RNA, 22 nt, Human
cuguuuuugccugugacaaaaa

SEQ ID NO: 72778 - RNA, 22 nt, Human
cugucucugauaagcucgaggg

SEQ ID NO: 72779 - RNA, 22 nt, Human
cuguuguauuuauuucccuuuc

SEQ ID NO: 72780 - RNA, 22 nt, Human
cuguuuggaugccauggucaag

SEQ ID NO: 72781 - RNA, 22 nt, Human
cuguuucucugccugcacacau

SEQ ID NO: 72782 - RNA, 22 nt, Human
cugaaagacagccaggcaaagc

SEQ ID NO: 72783 - RNA, 22 nt, Human
cugaagaaagaaaauggccauc

SEQ ID NO: 72784 - RNA, 22 nt, Human
cuguucagugcauauguauuga

SEQ ID NO: 72785 - RNA, 22 nt, Human
cuguucuccacuccugacuucu

SEQ ID NO: 72786 - RNA, 20 nt, Human
cuguucucuugccacaugag

SEQ ID NO: 72787 - RNA, 20 nt, Human
cugaaaggaaagaaauuuuu

SEQ ID NO: 72788 - RNA, 23 nt, Human
cugaaauucagaugcuaaagaua

SEQ ID NO: 72789 - RNA, 22 nt, Human
cucuuuguauucuagaagcucu

SEQ ID NO: 72790 - RNA, 22 nt, Human
cugugcauguucucuagcugau

SEQ ID NO: 72791 - RNA, 22 nt, Human
cugugcuguuaagaaauuuagu

SEQ ID NO: 72792 - RNA, 22 nt, Human
cucuuucauucuuagguugccg

SEQ ID NO: 72793 - RNA, 20 nt, Human
cucuuucugcuuuaugccuc

SEQ ID NO: 72794 - RNA, 22 nt, Human
cugaaacucaagauaggaggaa

SEQ ID NO: 72795 - RNA, 21 nt, Human
cugugggaaggccugaggucu

SEQ ID NO: 72796 - RNA, 22 nt, Human
cugguuuuccaauguuuugacu

SEQ ID NO: 72797 - RNA, 22 nt, Human
cuguaaguggugaaauuaguuu

SEQ ID NO: 72798 - RNA, 22 nt, Human
cucugugggcauauuuguaaaa

SEQ ID NO: 72799 - RNA, 22 nt, Human
cucugugucugauucugggaag

SEQ ID NO: 72800 - RNA, 22 nt, Human
cucuuauaaagaugucucuguu

SEQ ID NO: 72801 - RNA, 22 nt, Human
cugguuacuucagaucaguagu

SEQ ID NO: 72802 - RNA, 22 nt, Human
cugggaguugacgaggcuugua

SEQ ID NO: 72803 - RNA, 22 nt, Human
cuggguuuggcugugcuugaau

SEQ ID NO: 72804 - RNA, 22 nt, Human
cugggugggcacccagccuggg

SEQ ID NO: 72805 - RNA, 22 nt, Human
cucccuucaggggaggacuagg

SEQ ID NO: 72806 - RNA, 22 nt, Human
cuggcuaaugugcugauagcca

SEQ ID NO: 72807 - RNA, 22 nt, Human
cugggagaugacucagagcagg

SEQ ID NO: 72808 - RNA, 20 nt, Human
cucauugcuuucauuuucuu

SEQ ID NO: 72809 - RNA, 22 nt, Human
cucaugagucugucagagucau

SEQ ID NO: 72810 - RNA, 22 nt, Human
cucaucagagcccuccucuggc

SEQ ID NO: 72811 - RNA, 22 nt, Human
cucagaauugucaccucaaaaa

SEQ ID NO: 72812 - RNA, 22 nt, Human
cucagcaauuaccugugucucu

SEQ ID NO: 72813 - RNA, 22 nt, Human
cucaagagaaaucggaaucaga

SEQ ID NO: 72814 - RNA, 22 nt, Human
cugcuuguguugcucagaguca

SEQ ID NO: 72815 - RNA, 22 nt, Human
cucacauacaagagauggugga

SEQ ID NO: 72816 - RNA, 22 nt, Human
cucacugucagcugcagggcuu

SEQ ID NO: 72817 - RNA, 22 nt, Human
gaaaaucaugaaaguguguugu

SEQ ID NO: 72818 - RNA, 22 nt, Human
gaaaaucaggauggaugugagg

SEQ ID NO: 72819 - RNA, 22 nt, Human
gaaaaguuuaaccuuguacauu

SEQ ID NO: 72820 - RNA, 22 nt, Human
cuggugagaccgacuuccacuu

SEQ ID NO: 72821 - RNA, 22 nt, Human
gaaaauaguucaucacaaugau

SEQ ID NO: 72822 - RNA, 19 nt, Human
cuguccacacacucgcuuc

SEQ ID NO: 72823 - RNA, 21 nt, Human
gaaaaucuaaugugacaaugc

SEQ ID NO: 72824 - RNA, 22 nt, Human
cuguacuuguuuuaggaugaug

SEQ ID NO: 72825 - RNA, 22 nt, Human
cuguagaugucagguuaaugag

SEQ ID NO: 72826 - RNA, 22 nt, Human
gaaaaggaggggaggcagaugg

SEQ ID NO: 72827 - RNA, 22 nt, Human
cuggugaagccuucggagaccc

SEQ ID NO: 72828 - RNA, 22 nt, Human
gaaaagaaggcaggagcccaag

SEQ ID NO: 72829 - RNA, 22 nt, Human
cuggucuugguauucgcagaag

SEQ ID NO: 72830 - RNA, 22 nt, Human
gaagaagagauaauggggagca

SEQ ID NO: 72831 - RNA, 22 nt, Human
gaagaggaagaggagccagagc

SEQ ID NO: 72832 - RNA, 22 nt, Human
gaagaaggaagaucaugcuuga

SEQ ID NO: 72833 - RNA, 22 nt, Human
cuguuguucacuuugcugguga

SEQ ID NO: 72834 - RNA, 22 nt, Human
gaacuuaauauacaaucaguuc

SEQ ID NO: 72835 - RNA, 22 nt, Human
cuguuacggaggcuuucuaguu

SEQ ID NO: 72836 - RNA, 22 nt, Human
gaacaaggauucccaaagaaga

SEQ ID NO: 72837 - RNA, 20 nt, Human
gaacauaaauaacucuuuac

SEQ ID NO: 72838 - RNA, 22 nt, Human
gaacaguuucccuguagaaaau

SEQ ID NO: 72839 - RNA, 22 nt, Human
gaaaccauggcaaccagguccu

SEQ ID NO: 72840 - RNA, 22 nt, Human
gaaacauuuguugaguacuugc

SEQ ID NO: 72841 - RNA, 22 nt, Human
cugucucugucucuguuuaucc

SEQ ID NO: 72842 - RNA, 22 nt, Human
gaaacguuguggaaaauccucu

SEQ ID NO: 72843 - RNA, 22 nt, Human
gaaaucuggugauuuucuguug

SEQ ID NO: 72844 - RNA, 22 nt, Human
cuuuuuuucuccauauuucugg

SEQ ID NO: 72845 - RNA, 22 nt, Human
gaaaaacucagugggggucuuu

SEQ ID NO: 72846 - RNA, 22 nt, Human
gaaaaaccacaauugguauuuu

SEQ ID NO: 72847 - RNA, 22 nt, Human
gaaaaagagaaggaguucagua

SEQ ID NO: 72848 - RNA, 22 nt, Human
cuuuuuaaaguaaauggcuaga

SEQ ID NO: 72849 - RNA, 22 nt, Human
cuuuuucaugggugaugagugg

SEQ ID NO: 72850 - RNA, 22 nt, Human
cuuuuucuuaucuuuuucuaug

SEQ ID NO: 72851 - RNA, 22 nt, Human
cuuuuugcccuugggcuuccug

SEQ ID NO: 72852 - RNA, 22 nt, Human
cugggcaugggaacuucaaggc

SEQ ID NO: 72853 - RNA, 22 nt, Human
cuuuugcaauagugacacugau

SEQ ID NO: 72854 - RNA, 21 nt, Human
cuuuucuagucccagccccgc

SEQ ID NO: 72855 - RNA, 22 nt, Human
cuuuucaaacaggacagguccu

SEQ ID NO: 72856 - RNA, 22 nt, Human
cugaucuuaaguaacauuauuu

SEQ ID NO: 72857 - RNA, 22 nt, Human
gacaagaagaacggagguuuca

SEQ ID NO: 72858 - RNA, 18 nt, Human
cuuuagcugucaucuuug

SEQ ID NO: 72859 - RNA, 19 nt, Human
cuuguggcuaugcagauac

SEQ ID NO: 72860 - RNA, 22 nt, Human
cuuucauuuuugggcaucugag

SEQ ID NO: 72861 - RNA, 22 nt, Human
cuuuagugaguguggagcuaga

SEQ ID NO: 72862 - RNA, 22 nt, Human
gacaauuucucaauauagaaac

SEQ ID NO: 72863 - RNA, 22 nt, Human
gaauguuaaugcacuucuagcu

SEQ ID NO: 72864 - RNA, 19 nt, Human
gaauggguucuguagggag

SEQ ID NO: 72865 - RNA, 22 nt, Human
cuugccaguguugcagaagcuc

SEQ ID NO: 72866 - RNA, 22 nt, Human
gaauggcagaaugaagcagugu

SEQ ID NO: 72867 - RNA, 22 nt, Human
gaauaagaauccacuucuggca

SEQ ID NO: 72868 - RNA, 22 nt, Human
gaaguggggaggagaagacuga

SEQ ID NO: 72869 - RNA, 22 nt, Human
cuugcaaugaaggcacacuuau

SEQ ID NO: 72870 - RNA, 22 nt, Human
cuucuuuuggggaugaaaaugg

SEQ ID NO: 72871 - RNA, 20 nt, Human
cuugaguucagagcugucau

SEQ ID NO: 72872 - RNA, 22 nt, Human
cuugcagagcccauggauguca

SEQ ID NO: 72873 - RNA, 22 nt, Human
gaagucuuuucuuccacccaaa

SEQ ID NO: 72874 - RNA, 22 nt, Human
cuucucugcugccugccucuuu

SEQ ID NO: 72875 - RNA, 22 nt, Human
cuuccugcaacaccuguguugc

SEQ ID NO: 72876 - RNA, 22 nt, Human
cuucuaauucuuauguaagcuu

SEQ ID NO: 72877 - RNA, 22 nt, Human
gaagcaagagggaucaggaucu

SEQ ID NO: 72878 - RNA, 22 nt, Human
cuuauuagaaagaaaagacaug

SEQ ID NO: 72879 - RNA, 18 nt, Human
gaagcaacaguucugagu

SEQ ID NO: 72880 - RNA, 22 nt, Human
gaagauucugacccugacucag

SEQ ID NO: 72881 - RNA, 22 nt, Human
gaagauuauuacucauugcagg

SEQ ID NO: 72882 - RNA, 22 nt, Human
gaacucuugguggucauuagau

SEQ ID NO: 72883 - RNA, 22 nt, Human
gaaaaauggguuguuugaagau

SEQ ID NO: 72884 - RNA, 22 nt, Human
gagaccaagcgugggugauaau

SEQ ID NO: 72885 - RNA, 22 nt, Human
gagagagacugggaaaucauca

SEQ ID NO: 72886 - RNA, 22 nt, Human
gagacuguaagcuccuugagga

SEQ ID NO: 72887 - RNA, 22 nt, Human
gagacucagccccugcucucaa

SEQ ID NO: 72888 - RNA, 22 nt, Human
gagaacaaggaagagucggcag

SEQ ID NO: 72889 - RNA, 22 nt, Human
gagaacagauaugaugacuuca

SEQ ID NO: 72890 - RNA, 22 nt, Human
gagaaggagcagaaaaucuccu

SEQ ID NO: 72891 - RNA, 22 nt, Human
gacuuaaaugcuccccucaggg

SEQ ID NO: 72892 - RNA, 20 nt, Human
gacuucaauuucuaucuuuu

SEQ ID NO: 72893 - RNA, 22 nt, Human
gacuugauugguuugucaaguu

SEQ ID NO: 72894 - RNA, 22 nt, Human
gacuugcucaaaucagauuuua

SEQ ID NO: 72895 - RNA, 22 nt, Human
gacccucucagacuuccaggca

SEQ ID NO: 72896 - RNA, 19 nt, Human
cuuugugguuuucagaacu

SEQ ID NO: 72897 - RNA, 22 nt, Human
cuuugugcagcagaaaugugug

SEQ ID NO: 72898 - RNA, 21 nt, Human
cuuuggcaagggagaagucac

SEQ ID NO: 72899 - RNA, 22 nt, Human
gacaguggagccacguugggag

SEQ ID NO: 72900 - RNA, 22 nt, Human
cuuugcaaagagagaaaguggg

SEQ ID NO: 72901 - RNA, 22 nt, Human
cuuuggauuuuuugcuuuugua

SEQ ID NO: 72902 - RNA, 22 nt, Human
cuuucuuuuugguuucccccca

SEQ ID NO: 72903 - RNA, 22 nt, Human
cuuuccugaaaucucuucugca

SEQ ID NO: 72904 - RNA, 22 nt, Human
cuuucugauguaaggaacuagg

SEQ ID NO: 72905 - RNA, 22 nt, Human
cuuucuuucaaguucugcuuua

SEQ ID NO: 72906 - RNA, 22 nt, Human
cuuuccaugucuucuuucucca

SEQ ID NO: 72907 - RNA, 22 nt, Human
gaucacuuugauuagauguccu

SEQ ID NO: 72908 - RNA, 22 nt, Human
gauauuuugugaaaaaacaacu

SEQ ID NO: 72909 - RNA, 22 nt, Human
gagaagugaauaacgaagcagg

SEQ ID NO: 72910 - RNA, 22 nt, Human
gagaaugagucagagcuggcug

SEQ ID NO: 72911 - RNA, 22 nt, Human
gagaagguggaccugaaggagc

SEQ ID NO: 72912 - RNA, 22 nt, Human
gauauggaaacuugauguugug

SEQ ID NO: 72913 - RNA, 22 nt, Human
gauauauuucaaauucuuuugc

SEQ ID NO: 72914 - RNA, 20 nt, Human
gauagcacaaagagaauggg

SEQ ID NO: 72915 - RNA, 22 nt, Human
gauacuuuguggaauccuggau

SEQ ID NO: 72916 - RNA, 22 nt, Human
gagaaaaauuucuuugcugcac

SEQ ID NO: 72917 - RNA, 22 nt, Human
gacuuguguagcuucagaauuu

SEQ ID NO: 72918 - RNA, 22 nt, Human
gauauuaguuuuggaaggaggg

SEQ ID NO: 72919 - RNA, 22 nt, Human
gagaaaacauacuuaguguccu

SEQ ID NO: 72920 - RNA, 22 nt, Human
gagaaagauuguccuucagggg

SEQ ID NO: 72921 - RNA, 22 nt, Human
gagaaauagauucaugguagau

SEQ ID NO: 72922 - RNA, 22 nt, Human
gagaaagggagaaaaagaucuu

SEQ ID NO: 72923 - RNA, 22 nt, Human
gauacaugucacaaguugugca

SEQ ID NO: 72924 - RNA, 22 nt, Human
gauaagugauucugauucacau

SEQ ID NO: 72925 - RNA, 22 nt, Human
gacuuaaccacggucacauggu

SEQ ID NO: 72926 - RNA, 22 nt, Human
gauaaauaguguuuggggacau

SEQ ID NO: 72927 - RNA, 22 nt, Human
gacuucaagaugaaucuuuggg

SEQ ID NO: 72928 - RNA, 22 nt, Human
gaguuauuuuuccuguuuuuua

SEQ ID NO: 72929 - RNA, 22 nt, Human
gacuccugccucucuacuucug

SEQ ID NO: 72930 - RNA, 22 nt, Human
gacuaaauaaaagccaaacuuc

SEQ ID NO: 72931 - RNA, 22 nt, Human
gacuggucuuuugugauggaug

SEQ ID NO: 72932 - RNA, 22 nt, Human
gaguucuagauguauuauuaau

SEQ ID NO: 72933 - RNA, 22 nt, Human
gaguuucacguagaucaggguc

SEQ ID NO: 72934 - RNA, 22 nt, Human
gacggagugcgcuugcuguuca

SEQ ID NO: 72935 - RNA, 22 nt, Human
gagucuuuuaagaugucuuacu

SEQ ID NO: 72936 - RNA, 22 nt, Human
gaguauuuaccacuaaaugguu

SEQ ID NO: 72937 - RNA, 22 nt, Human
gaccuuucccuaucucacucuc

SEQ ID NO: 72938 - RNA, 20 nt, Human
gacgaacuagaacaguggua

SEQ ID NO: 72939 - RNA, 22 nt, Human
gaccugaccucauuagcaaguu

SEQ ID NO: 72940 - RNA, 19 nt, Human
gaguacuuuacaaguuuuc

SEQ ID NO: 72941 - RNA, 22 nt, Human
gaguauuacuaaaauucgccua

SEQ ID NO: 72942 - RNA, 22 nt, Human
gaccagaacuucuagucuaagu

SEQ ID NO: 72943 - RNA, 22 nt, Human
gacaucuguccauggcacugga

SEQ ID NO: 72944 - RNA, 22 nt, Human
gaccaggagauuugagcuaggc

SEQ ID NO: 72945 - RNA, 22 nt, Human
gacaaguagguuauuuuuagca

SEQ ID NO: 72946 - RNA, 22 nt, Human
gaggguaagcugggacuccucg

SEQ ID NO: 72947 - RNA, 22 nt, Human
gacaagaugacaucauggcuuc

SEQ ID NO: 72948 - RNA, 22 nt, Human
gacaccuucuacugacuaugga

SEQ ID NO: 72949 - RNA, 22 nt, Human
gacacucauauuaagccuauuu

SEQ ID NO: 72950 - RNA, 22 nt, Human
gacacucuuaauccuaucccug

SEQ ID NO: 72951 - RNA, 22 nt, Human
gagguagaggaaaagauuauca

SEQ ID NO: 72952 - RNA, 22 nt, Human
gaggguuagauuuuaagaaaga

SEQ ID NO: 72953 - RNA, 22 nt, Human
gaggucaugcagcucugaguuc

SEQ ID NO: 72954 - RNA, 22 nt, Human
gaguaaaagaugaggcaguaga

SEQ ID NO: 72955 - RNA, 22 nt, Human
gacaggcagagaggaagagaga

SEQ ID NO: 72956 - RNA, 22 nt, Human
gacagggacacagccagugagg

SEQ ID NO: 72957 - RNA, 22 nt, Human
gacagguagacaugaauauuaa

SEQ ID NO: 72958 - RNA, 22 nt, Human
gacagcuauggaguucacuucu

SEQ ID NO: 72959 - RNA, 22 nt, Human
gaggggcuccagguguugagga

SEQ ID NO: 72960 - RNA, 22 nt, Human
gaggggcucuugggcaugaagg

SEQ ID NO: 72961 - RNA, 22 nt, Human
gacaacuucaguaaaguagauu

SEQ ID NO: 72962 - RNA, 16 nt, Human
gaauuccauugcucug

SEQ ID NO: 72963 - RNA, 22 nt, Human
gaauuccaggugagagaaggua

SEQ ID NO: 72964 - RNA, 22 nt, Human
gagggauuuuagugcagcaacu

SEQ ID NO: 72965 - RNA, 22 nt, Human
gagggcucaacuacuacuaggc

SEQ ID NO: 72966 - RNA, 22 nt, Human
gaauguuugagugccaugugac

SEQ ID NO: 72967 - RNA, 22 nt, Human
gaauuacagaguuguuaaguca

SEQ ID NO: 72968 - RNA, 22 nt, Human
gaggggaagaacaauuuaauuu

SEQ ID NO: 72969 - RNA, 22 nt, Human
gaggggaacaggcauucuuaag

SEQ ID NO: 72970 - RNA, 22 nt, Human
gaauuagacggcaucacauggg

SEQ ID NO: 72971 - RNA, 22 nt, Human
gagggcugccacguugggcgag

SEQ ID NO: 72972 - RNA, 22 nt, Human
gaauggaacauagcaacaucuu

SEQ ID NO: 72973 - RNA, 22 nt, Human
gaauggaugcuggucaguuugg

SEQ ID NO: 72974 - RNA, 22 nt, Human
gaggcuaugucuacgcucagcg

SEQ ID NO: 72975 - RNA, 22 nt, Human
gaggcaggaagggaggguugug

SEQ ID NO: 72976 - RNA, 22 nt, Human
gaaugcacacgugugugcaugc

SEQ ID NO: 72977 - RNA, 20 nt, Human
gaaucuggucaaaugucuau

SEQ ID NO: 72978 - RNA, 22 nt, Human
gaagucagaucuuuugacuccc

SEQ ID NO: 72979 - RNA, 21 nt, Human
gaaguagcucugagaaaagug

SEQ ID NO: 72980 - RNA, 22 nt, Human
gaaguucuuagucucauuugca

SEQ ID NO: 72981 - RNA, 22 nt, Human
gaagugagcauccuaguuaacc

SEQ ID NO: 72982 - RNA, 22 nt, Human
gaauaauuuugaucagaaggga

SEQ ID NO: 72983 - RNA, 22 nt, Human
gaggcagaggaugggacuguau

SEQ ID NO: 72984 - RNA, 22 nt, Human
gaauccccugucggaacagugg

SEQ ID NO: 72985 - RNA, 22 nt, Human
gaauacaagccugccaccugga

SEQ ID NO: 72986 - RNA, 22 nt, Human
gaauauuuaucucagcugcaga

SEQ ID NO: 72987 - RNA, 22 nt, Human
gaggaggagacggaggccuggg

SEQ ID NO: 72988 - RNA, 22 nt, Human
gaggaggucaccuggugagcaa

SEQ ID NO: 72989 - RNA, 22 nt, Human
gaaggugcugaaacagaaauuu

SEQ ID NO: 72990 - RNA, 22 nt, Human
gaaggggacuccauggaaugau

SEQ ID NO: 72991 - RNA, 22 nt, Human
gaagguuuuguuugcaaaucau

SEQ ID NO: 72992 - RNA, 22 nt, Human
gaggagcugggucagggagaca

SEQ ID NO: 72993 - RNA, 22 nt, Human
gaggagcuucagaggaaucuua

SEQ ID NO: 72994 - RNA, 22 nt, Human
gaggagagaaauguuuucugug

SEQ ID NO: 72995 - RNA, 22 nt, Human
gaggagaaacagccgugauagu

SEQ ID NO: 72996 - RNA, 22 nt, Human
gaaggcuguggcuggucucagu

SEQ ID NO: 72997 - RNA, 22 nt, Human
gaggaagucuuaucuggaugca

SEQ ID NO: 72998 - RNA, 22 nt, Human
gaaggauaauuuugcuggaugu

SEQ ID NO: 72999 - RNA, 22 nt, Human
gaagcuucucaacugguggaau

SEQ ID NO: 73000 - RNA, 22 nt, Human
gagcuggacauacaggaaacca

SEQ ID NO: 73001 - RNA, 22 nt, Human
gagcuggagaaacacauaagaa

SEQ ID NO: 73002 - RNA, 22 nt, Human
gagcuuuagcugagaccugcuu

SEQ ID NO: 73003 - RNA, 22 nt, Human
gagcuaauagacagcaacauca

SEQ ID NO: 73004 - RNA, 18 nt, Human
gagcucuucccuuuucuc

SEQ ID NO: 73005 - RNA, 22 nt, Human
gaagcuccaggaugccugcacu

SEQ ID NO: 73006 - RNA, 21 nt, Human
gaagcugcuaugaagggggac

SEQ ID NO: 73007 - RNA, 22 nt, Human
gaagcuucgaaagagugauuuc

SEQ ID NO: 73008 - RNA, 22 nt, Human
gagccucaggguuuuguugaca

SEQ ID NO: 73009 - RNA, 22 nt, Human
gagccuaccugcugcucuuuca

SEQ ID NO: 73010 - RNA, 22 nt, Human
gagagaggggaagagaagcucu

SEQ ID NO: 73011 - RNA, 22 nt, Human
gaaaaugcacacauacacaccc

SEQ ID NO: 73012 - RNA, 17 nt, Human
uuugugauggcagaugc

SEQ ID NO: 73013 - RNA, 22 nt, Human
uuuguggaaaagagcccaggag

SEQ ID NO: 73014 - RNA, 22 nt, Human
gcaucacacgcacauacacaca

SEQ ID NO: 73015 - RNA, 22 nt, Human
gcuaguguuccacgaugugugu

SEQ ID NO: 73016 - RNA, 22 nt, Human
gcucagagaaaacuggggcuug

SEQ ID NO: 73017 - RNA, 22 nt, Human
gcuagagaccagaggccuugaa

SEQ ID NO: 73018 - RNA, 22 nt, Human
gcuaguaagugauagagcugag

SEQ ID NO: 73019 - RNA, 22 nt, Human
gcuagauugucacuugaguguc

SEQ ID NO: 73020 - RNA, 22 nt, Human
gcagugcugcgacagucgggug

SEQ ID NO: 73021 - RNA, 23 nt, Human
gcucauguugcuucuguucuguc

SEQ ID NO: 73022 - RNA, 22 nt, Human
gcauccaaggagcagaagugau

SEQ ID NO: 73023 - RNA, 22 nt, Human
gcauccugacuauggugguggu

SEQ ID NO: 73024 - RNA, 23 nt, Human
gcaucgcaggucuaagauuagcu

SEQ ID NO: 73025 - RNA, 22 nt, Human
gcucaugggcccagagcagccc

SEQ ID NO: 73026 - RNA, 22 nt, Human
gcaucuccugagucagauuuug

SEQ ID NO: 73027 - RNA, 20 nt, Human
gcucuucuccgggucugccu

SEQ ID NO: 73028 - RNA, 22 nt, Human
gcauggaaaagggaugcuaacu

SEQ ID NO: 73029 - RNA, 22 nt, Human
gcaguaaauugagagucauguu

SEQ ID NO: 73030 - RNA, 22 nt, Human
gcaggccuccccugcuggagcu

SEQ ID NO: 73031 - RNA, 22 nt, Human
gcaggaaugguacauaccuguu

SEQ ID NO: 73032 - RNA, 22 nt, Human
gcgcucuccugcagacagccuc

SEQ ID NO: 73033 - RNA, 22 nt, Human
gcagauccaaauauaguucuug

SEQ ID NO: 73034 - RNA, 22 nt, Human
gcagcaauaaaacugaaggugu

SEQ ID NO: 73035 - RNA, 23 nt, Human
gcagccaacccacgugagagaag

SEQ ID NO: 73036 - RNA, 22 nt, Human
gcagcauuaccaagacauggca

SEQ ID NO: 73037 - RNA, 20 nt, Human
gcagcagacagacaggggac

SEQ ID NO: 73038 - RNA, 22 nt, Human
gcagaugagagugugaucuggg

SEQ ID NO: 73039 - RNA, 22 nt, Human
gcagauaaaauuuuugauggga

SEQ ID NO: 73040 - RNA, 22 nt, Human
gcagagaaugucagauuuuguu

SEQ ID NO: 73041 - RNA, 21 nt, Human
gcagaacuaggacuugaacau

SEQ ID NO: 73042 - RNA, 22 nt, Human
gcagaaguauuguacgguggga

SEQ ID NO: 73043 - RNA, 22 nt, Human
gcaccacccaaaggcggggcuc

SEQ ID NO: 73044 - RNA, 22 nt, Human
gcacuaccaguaauuaaaucug

SEQ ID NO: 73045 - RNA, 21 nt, Human
gcacaacucucacauucuucu

SEQ ID NO: 73046 - RNA, 22 nt, Human
gcacaaaagguacuucauguag

SEQ ID NO: 73047 - RNA, 22 nt, Human
gccugcacucaaacacucucuu

SEQ ID NO: 73048 - RNA, 22 nt, Human
gcaauaaguuuucucuucuguc

SEQ ID NO: 73049 - RNA, 22 nt, Human
gcaauagccuacaugcgucaga

SEQ ID NO: 73050 - RNA, 22 nt, Human
gauuuugaaccuuauuuggaaa

SEQ ID NO: 73051 - RNA, 22 nt, Human
gcaaaaacaguguagucuucug

SEQ ID NO: 73052 - RNA, 22 nt, Human
gcaaggaagcagaguugcuauc

SEQ ID NO: 73053 - RNA, 22 nt, Human
gauuuugcuuuagugaaggaag

SEQ ID NO: 73054 - RNA, 22 nt, Human
gauuuuuaaaaguaguuuugaa

SEQ ID NO: 73055 - RNA, 22 nt, Human
gauuaagaaagauagaugugga

SEQ ID NO: 73056 - RNA, 22 nt, Human
gauuaaaggucuugauuauaag

SEQ ID NO: 73057 - RNA, 22 nt, Human
gauuaagugaauuggagaaaag

SEQ ID NO: 73058 - RNA, 22 nt, Human
gauuccugcuauucacagggcu

SEQ ID NO: 73059 - RNA, 20 nt, Human
gcccuucccccuccgcgagc

SEQ ID NO: 73060 - RNA, 22 nt, Human
gaugucauguuggcagacaguu

SEQ ID NO: 73061 - RNA, 22 nt, Human
gaugggaggaugaauuggaccu

SEQ ID NO: 73062 - RNA, 22 nt, Human
gaugggaaggugguaaaguuua

SEQ ID NO: 73063 - RNA, 22 nt, Human
gauggggaaaaaauggaucuuu

SEQ ID NO: 73064 - RNA, 22 nt, Human
gauggguuugagauguuugggu

SEQ ID NO: 73065 - RNA, 22 nt, Human
gaugguaucugcuggcuuucag

SEQ ID NO: 73066 - RNA, 22 nt, Human
gccauauucaugcaggugcuaa

SEQ ID NO: 73067 - RNA, 22 nt, Human
gaugaagaaacucaaccaagaa

SEQ ID NO: 73068 - RNA, 18 nt, Human
gaugaagaggaagaggag

SEQ ID NO: 73069 - RNA, 22 nt, Human
gccaaucaggaggcuguacauc

SEQ ID NO: 73070 - RNA, 22 nt, Human
gcaucccagaagauucugauuu

SEQ ID NO: 73071 - RNA, 22 nt, Human
gcaugaauggaacccccugagu

SEQ ID NO: 73072 - RNA, 22 nt, Human
gcaucuguuguguuaauuuaca

SEQ ID NO: 73073 - RNA, 19 nt, Human
gagugaggagcaucguuua

SEQ ID NO: 73074 - RNA, 21 nt, Human
gcauccucguacucuucaggu

SEQ ID NO: 73075 - RNA, 22 nt, Human
gaguuaaauagcuuaggauuca

SEQ ID NO: 73076 - RNA, 22 nt, Human
gaguguuugcuguauaauugga

SEQ ID NO: 73077 - RNA, 22 nt, Human
gaguauucuauguauauuauug

SEQ ID NO: 73078 - RNA, 22 nt, Human
gcaguuugugauguggcaguca

SEQ ID NO: 73079 - RNA, 22 nt, Human
gcaguugugguuucguuuccuu

SEQ ID NO: 73080 - RNA, 22 nt, Human
gcagugucacuaguaauagucu

SEQ ID NO: 73081 - RNA, 22 nt, Human
gcaguuaccuauuuuguagaaa

SEQ ID NO: 73082 - RNA, 19 nt, Human
gcaguuauggcccacuucc

SEQ ID NO: 73083 - RNA, 22 nt, Human
gcaguuguagcuguuucuacuc

SEQ ID NO: 73084 - RNA, 22 nt, Human
gcaguauuguguguggucaugg

SEQ ID NO: 73085 - RNA, 22 nt, Human
gcaguagauccagcagccugca

SEQ ID NO: 73086 - RNA, 22 nt, Human
gcaguccuguagcgacuuuuuu

SEQ ID NO: 73087 - RNA, 22 nt, Human
gagaauuauacaugagcuauuu

SEQ ID NO: 73088 - RNA, 22 nt, Human
gauccucagacccuccucuggu

SEQ ID NO: 73089 - RNA, 22 nt, Human
gaugaaguaguccacuggaagg

SEQ ID NO: 73090 - RNA, 22 nt, Human
gaucuuacucacuucagcuggc

SEQ ID NO: 73091 - RNA, 22 nt, Human
ggaaaagccauauuauaggcaa

SEQ ID NO: 73092 - RNA, 22 nt, Human
ggaaaagaauuguuaguuagug

SEQ ID NO: 73093 - RNA, 22 nt, Human
ggaaaaauggguggugauauga

SEQ ID NO: 73094 - RNA, 22 nt, Human
gcuuuugagaaaguguuuuccc

SEQ ID NO: 73095 - RNA, 22 nt, Human
gcuuuguucauuuaguuuuuuu

SEQ ID NO: 73096 - RNA, 22 nt, Human
gcuuuguugauggugagucugu

SEQ ID NO: 73097 - RNA, 23 nt, Human
gcuuugaaaaugcuuucuuccag

SEQ ID NO: 73098 - RNA, 22 nt, Human
gcuuguauguguauauauacau

SEQ ID NO: 73099 - RNA, 22 nt, Human
gcuuucagggucacugucaaca

SEQ ID NO: 73100 - RNA, 22 nt, Human
gcuuucccaaccuucuugguau

SEQ ID NO: 73101 - RNA, 22 nt, Human
gcuugcugaacaggaaccuggc

SEQ ID NO: 73102 - RNA, 22 nt, Human
gcccuuuuaucaacuccuagaa

SEQ ID NO: 73103 - RNA, 22 nt, Human
ggaaaggaagggaaggagaugc

SEQ ID NO: 73104 - RNA, 22 nt, Human
gccugaaaugaaccagaggacu

SEQ ID NO: 73105 - RNA, 22 nt, Human
ggaaauguguguaagaaaguau

SEQ ID NO: 73106 - RNA, 22 nt, Human
gccugcaggaaggugugccugu

SEQ ID NO: 73107 - RNA, 22 nt, Human
gccugcagccagggaguucucu

SEQ ID NO: 73108 - RNA, 22 nt, Human
gccugcaaagacuuccuucucu

SEQ ID NO: 73109 - RNA, 22 nt, Human
gccugcugggcucuuccugcug

SEQ ID NO: 73110 - RNA, 22 nt, Human
gcuucucauguuuauuuuuaca

SEQ ID NO: 73111 - RNA, 22 nt, Human
gcuucacucugagacuuggagc

SEQ ID NO: 73112 - RNA, 22 nt, Human
gcuucucacccuuacuaucucu

SEQ ID NO: 73113 - RNA, 22 nt, Human
gcuguggagaagcugccuaugg

SEQ ID NO: 73114 - RNA, 22 nt, Human
gcuguguucauccugcccaggu

SEQ ID NO: 73115 - RNA, 22 nt, Human
gcuguguaugaugcaggcaccu

SEQ ID NO: 73116 - RNA, 22 nt, Human
gcuguggacacagcucucuuca

SEQ ID NO: 73117 - RNA, 22 nt, Human
gcuguugagucagacaaguuuu

SEQ ID NO: 73118 - RNA, 22 nt, Human
gcuguugcaaucaaggccaugg

SEQ ID NO: 73119 - RNA, 22 nt, Human
gcuuacagauaaugaggagacu

SEQ ID NO: 73120 - RNA, 22 nt, Human
gcuguuguugcacggaaggugg

SEQ ID NO: 73121 - RNA, 22 nt, Human
gcuguuuaaguggaauuuguuu

SEQ ID NO: 73122 - RNA, 22 nt, Human
gcugguggcagagcuccgcggc

SEQ ID NO: 73123 - RNA, 21 nt, Human
gcuguagauucacaaagaggu

SEQ ID NO: 73124 - RNA, 22 nt, Human
gcccuguuuucuggguuccuug

SEQ ID NO: 73125 - RNA, 22 nt, Human
gcauugcuauuucuguuagugu

SEQ ID NO: 73126 - RNA, 22 nt, Human
gcugagaguguaggauguuuac

SEQ ID NO: 73127 - RNA, 22 nt, Human
gcauguucaaguuaguauauuu

SEQ ID NO: 73128 - RNA, 22 nt, Human
gcauuagacuaguacacggcag

SEQ ID NO: 73129 - RNA, 22 nt, Human
gcucuugcuuuuucuagaaaga

SEQ ID NO: 73130 - RNA, 22 nt, Human
ggcauuccucucuguucaugga

SEQ ID NO: 73131 - RNA, 22 nt, Human
ggcauuccgggguccccuucuc

SEQ ID NO: 73132 - RNA, 23 nt, Human
gcugagcaccagccauaucuuuu

SEQ ID NO: 73133 - RNA, 22 nt, Human
gcucucuggccugggaggagga

SEQ ID NO: 73134 - RNA, 23 nt, Human
gcucugauaccagcuacaucuag

SEQ ID NO: 73135 - RNA, 22 nt, Human
gcucaacuucuaggacuucagg

SEQ ID NO: 73136 - RNA, 22 nt, Human
gcucuccuugcuagagguucua

SEQ ID NO: 73137 - RNA, 22 nt, Human
gcucggcuggcucaucucaugu

SEQ ID NO: 73138 - RNA, 22 nt, Human
gcucuagcuggcgcugaccugg

SEQ ID NO: 73139 - RNA, 17 nt, Human
gcuaguuguuuccagua

SEQ ID NO: 73140 - RNA, 22 nt, Human
gcuagagaagagcccacaccgg

SEQ ID NO: 73141 - RNA, 22 nt, Human
gcuagaaacuguuuaaucucuu

SEQ ID NO: 73142 - RNA, 22 nt, Human
ggcagcuuucaauaggguuaug

SEQ ID NO: 73143 - RNA, 22 nt, Human
ggcagcagaaccaacuguggcu

SEQ ID NO: 73144 - RNA, 21 nt, Human
ggcagccuggcaggggcacug

SEQ ID NO: 73145 - RNA, 22 nt, Human
ggcagcagaacuggcccuguau

SEQ ID NO: 73146 - RNA, 22 nt, Human
ggcagaaaacaauaaccauuuc

SEQ ID NO: 73147 - RNA, 22 nt, Human
gcgugcauguguguaugcgugu

SEQ ID NO: 73148 - RNA, 22 nt, Human
ggauaauguauuuuaaaauggg

SEQ ID NO: 73149 - RNA, 22 nt, Human
ggaguguuagacuaaauuggga

SEQ ID NO: 73150 - RNA, 22 nt, Human
ggaguguuaggaaguuguguuu

SEQ ID NO: 73151 - RNA, 22 nt, Human
ggaguucaaaucuuuuggaucu

SEQ ID NO: 73152 - RNA, 22 nt, Human
ggagggcuggacguacuagggc

SEQ ID NO: 73153 - RNA, 22 nt, Human
ggaggaugaggguggugguguu

SEQ ID NO: 73154 - RNA, 22 nt, Human
ggagacagauggcgucucaguu

SEQ ID NO: 73155 - RNA, 23 nt, Human
ggagaaggaugucaucaaaagac

SEQ ID NO: 73156 - RNA, 22 nt, Human
ggagaccaauuaaugaaggaau

SEQ ID NO: 73157 - RNA, 22 nt, Human
ggagcuaagagaauggacaagg

SEQ ID NO: 73158 - RNA, 22 nt, Human
ggagagcuagugagcuggaggu

SEQ ID NO: 73159 - RNA, 22 nt, Human
ggagcucaggaguugauuauuu

SEQ ID NO: 73160 - RNA, 22 nt, Human
ggacuucuggggacuguagauu

SEQ ID NO: 73161 - RNA, 22 nt, Human
ggacuuucuccugcacaaagug

SEQ ID NO: 73162 - RNA, 22 nt, Human
ggagaaacuaguuagauccaau

SEQ ID NO: 73163 - RNA, 22 nt, Human
ggacuuuggauuuuauucuaaa

SEQ ID NO: 73164 - RNA, 22 nt, Human
gccuuuugcaaugguguuggug

SEQ ID NO: 73165 - RNA, 22 nt, Human
gccuuuuaaggcagagggagau

SEQ ID NO: 73166 - RNA, 22 nt, Human
gccuucauuggaaucuagcuuc

SEQ ID NO: 73167 - RNA, 18 nt, Human
ggacaguuguagaggacu

SEQ ID NO: 73168 - RNA, 22 nt, Human
ggaauccugguguuuucugccu

SEQ ID NO: 73169 - RNA, 22 nt, Human
ggaauuauuuuaaauagacauu

SEQ ID NO: 73170 - RNA, 22 nt, Human
ggaauauaaaucagaugcuccg

SEQ ID NO: 73171 - RNA, 20 nt, Human
gccugggagaagaucaggga

SEQ ID NO: 73172 - RNA, 22 nt, Human
ggaagaagagggagcuguggga

SEQ ID NO: 73173 - RNA, 22 nt, Human
ggaagacuuagaguagcaucag

SEQ ID NO: 73174 - RNA, 22 nt, Human
ggagcaucuaccauuucuagau

SEQ ID NO: 73175 - RNA, 22 nt, Human
ggagccucuaaacaguuaucaa

SEQ ID NO: 73176 - RNA, 22 nt, Human
ggaggaaauccuuaguaaggca

SEQ ID NO: 73177 - RNA, 22 nt, Human
ggagcucacuacgaaauaagcu

SEQ ID NO: 73178 - RNA, 22 nt, Human
ggaggaggggcggggaggggag

SEQ ID NO: 73179 - RNA, 22 nt, Human
ggagcuaaggauuuuuauaugu

SEQ ID NO: 73180 - RNA, 22 nt, Human
ggaggagggaguucaggaguau

SEQ ID NO: 73181 - RNA, 22 nt, Human
gggggacaggaugaauaucugu

SEQ ID NO: 73182 - RNA, 22 nt, Human
ggagaugucugugccacgucuc

SEQ ID NO: 73183 - RNA, 22 nt, Human
ggaucuaaagccagaauauaug

SEQ ID NO: 73184 - RNA, 22 nt, Human
ggauccuuccuggugaagacug

SEQ ID NO: 73185 - RNA, 22 nt, Human
ggaucgauuccaaauguagauc

SEQ ID NO: 73186 - RNA, 22 nt, Human
ggaucaccagguuuguuguugg

SEQ ID NO: 73187 - RNA, 22 nt, Human
ggguuuguuccuacuucuacuc

SEQ ID NO: 73188 - RNA, 22 nt, Human
ggguuuuggggaggaagugagc

SEQ ID NO: 73189 - RNA, 22 nt, Human
ggguuuuaccagauguguggug

SEQ ID NO: 73190 - RNA, 22 nt, Human
ggguuggaggcauugaaacaga

SEQ ID NO: 73191 - RNA, 22 nt, Human
gggugcuucauaggugaugcug

SEQ ID NO: 73192 - RNA, 22 nt, Human
ggguggaaugugagugugugug

SEQ ID NO: 73193 - RNA, 19 nt, Human
ggaggguguccucaguguc

SEQ ID NO: 73194 - RNA, 23 nt, Human
gguuggcuguacccaggcucccu

SEQ ID NO: 73195 - RNA, 22 nt, Human
ggccaaagagcacaaugaauag

SEQ ID NO: 73196 - RNA, 20 nt, Human
ggcauuuuuuaguugagcuu

SEQ ID NO: 73197 - RNA, 22 nt, Human
ggugucuuugauguugggcuga

SEQ ID NO: 73198 - RNA, 22 nt, Human
gguguuaaccagcuaaaguuug

SEQ ID NO: 73199 - RNA, 22 nt, Human
gguggcauguaccucacagacu

SEQ ID NO: 73200 - RNA, 22 nt, Human
ggugaucucagucuagaugguu

SEQ ID NO: 73201 - RNA, 20 nt, Human
ggcaucugacaacuaguugc

SEQ ID NO: 73202 - RNA, 22 nt, Human
gguggcauucaguaaguauaua

SEQ ID NO: 73203 - RNA, 22 nt, Human
ggcaucuuuaaugaacaugaau

SEQ ID NO: 73204 - RNA, 21 nt, Human
ggcagagaagcuggaaguugg

SEQ ID NO: 73205 - RNA, 22 nt, Human
ggcagauaaacaauguuguaua

SEQ ID NO: 73206 - RNA, 22 nt, Human
ggcaaggaagaaagcagaaguu

SEQ ID NO: 73207 - RNA, 22 nt, Human
ggcaauuacguauuagucaugu

SEQ ID NO: 73208 - RNA, 22 nt, Human
ggucgacuaauguuucauuuca

SEQ ID NO: 73209 - RNA, 22 nt, Human
gguauccaaauaaagcagguaa

SEQ ID NO: 73210 - RNA, 22 nt, Human
ggaugcugcuccacaucccaca

SEQ ID NO: 73211 - RNA, 22 nt, Human
gguaaucuccucauugacguua

SEQ ID NO: 73212 - RNA, 22 nt, Human
ggacucucaggcugucggcuuc

SEQ ID NO: 73213 - RNA, 19 nt, Human
ggacuuaggcagacuaauu

SEQ ID NO: 73214 - RNA, 22 nt, Human
ggacuggugaagccuucggaga

SEQ ID NO: 73215 - RNA, 22 nt, Human
ggacccagggcuuauucauguu

SEQ ID NO: 73216 - RNA, 22 nt, Human
gggcuguuugcauauguuuaua

SEQ ID NO: 73217 - RNA, 22 nt, Human
ggaauugagcaagggguggggc

SEQ ID NO: 73218 - RNA, 22 nt, Human
ggaauuaagaggcuggacaggg

SEQ ID NO: 73219 - RNA, 22 nt, Human
ggaaugcagugagcauuagaua

SEQ ID NO: 73220 - RNA, 22 nt, Human
ggaaugcuuggcaugagaaccu

SEQ ID NO: 73221 - RNA, 22 nt, Human
ggaaucuucagccaugccaaga

SEQ ID NO: 73222 - RNA, 18 nt, Human
ggaauagcuuguuuccca

SEQ ID NO: 73223 - RNA, 21 nt, Human
ggaauagcuuaaagugagggg

SEQ ID NO: 73224 - RNA, 22 nt, Human
ggaaguuugagcaucuguuucc

SEQ ID NO: 73225 - RNA, 22 nt, Human
ggaauaauauuacagauacagu

SEQ ID NO: 73226 - RNA, 22 nt, Human
gggccuguccccccaggagaac

SEQ ID NO: 73227 - RNA, 22 nt, Human
ggaagcucaauacuuuccucuu

SEQ ID NO: 73228 - RNA, 22 nt, Human
ggaaguuaguucuuggcaaagg

SEQ ID NO: 73229 - RNA, 22 nt, Human
ggaagaggaagaugaggcagca

SEQ ID NO: 73230 - RNA, 22 nt, Human
gggagcugagcuggaagagaau

SEQ ID NO: 73231 - RNA, 22 nt, Human
gggagcucaccaugcucugcau

SEQ ID NO: 73232 - RNA, 22 nt, Human
gcuuuugaauacuacaggaguu

SEQ ID NO: 73233 - RNA, 22 nt, Human
gcuuuuuaauuugcuucccugg

SEQ ID NO: 73234 - RNA, 22 nt, Human
gggagaaccagccagugcaagg

SEQ ID NO: 73235 - RNA, 22 nt, Human
gcuuuccuggcccugucccugc

SEQ ID NO: 73236 - RNA, 22 nt, Human
gcuuucauuauguuguguuuuu

SEQ ID NO: 73237 - RNA, 22 nt, Human
gcuuucacugcaauagaugaau

SEQ ID NO: 73238 - RNA, 22 nt, Human
gcuuguuagcaaugcagaaucu

SEQ ID NO: 73239 - RNA, 22 nt, Human
gcuuggagaacguuuucuagaa

SEQ ID NO: 73240 - RNA, 22 nt, Human
gggacugcgagauucucaaggg

SEQ ID NO: 73241 - RNA, 22 nt, Human
gcuugcuuuguaaauaucugug

SEQ ID NO: 73242 - RNA, 22 nt, Human
gcuugaggaacucagacuugag

SEQ ID NO: 73243 - RNA, 20 nt, Human
gcuugaauuugauggccaga

SEQ ID NO: 73244 - RNA, 22 nt, Human
gggaagagggagcuggaaugau

SEQ ID NO: 73245 - RNA, 21 nt, Human
gggaagagaagagaaaggagg

SEQ ID NO: 73246 - RNA, 22 nt, Human
gggaagaaccucugcuaccaau

SEQ ID NO: 73247 - RNA, 22 nt, Human
gggaagccugggugauccuaaa

SEQ ID NO: 73248 - RNA, 18 nt, Human
gggaagaugccacaguga

SEQ ID NO: 73249 - RNA, 22 nt, Human
gggaagugagcuggaaucaagg

SEQ ID NO: 73250 - RNA, 21 nt, Human
gcuucaauucauccaccucuc

SEQ ID NO: 73251 - RNA, 22 nt, Human
gcuuauugcuuauagauaggaa

SEQ ID NO: 73252 - RNA, 22 nt, Human
gggaacgacuguuaguacuugg

SEQ ID NO: 73253 - RNA, 22 nt, Human
gcuuccuuagcuuaccaaguau

SEQ ID NO: 73254 - RNA, 22 nt, Human
gcuguugugaggaucagcauau

SEQ ID NO: 73255 - RNA, 22 nt, Human
gcuguuggaggaguucagugcu

SEQ ID NO: 73256 - RNA, 22 nt, Human
gggaaaucugcuuccuagggcu

SEQ ID NO: 73257 - RNA, 22 nt, Human
gcuuagaaucagaccuggguca

SEQ ID NO: 73258 - RNA, 22 nt, Human
ggcuuugggaggaugaggcggu

SEQ ID NO: 73259 - RNA, 22 nt, Human
gggaaaaaggaaccuuauuacu

SEQ ID NO: 73260 - RNA, 22 nt, Human
ggcuuuuucccuaggguaagag

SEQ ID NO: 73261 - RNA, 22 nt, Human
ggcuuguaggugauggagaacu

SEQ ID NO: 73262 - RNA, 22 nt, Human
ggccaauuuccuagacauuagu

SEQ ID NO: 73263 - RNA, 22 nt, Human
ggcuuacgcgcuaacagugaau

SEQ ID NO: 73264 - RNA, 22 nt, Human
gucuugugaagacggcagaaag

SEQ ID NO: 73265 - RNA, 22 nt, Human
gucuuugagccucaguuuccuc

SEQ ID NO: 73266 - RNA, 22 nt, Human
gugaaaaauggccaucaggaca

SEQ ID NO: 73267 - RNA, 22 nt, Human
ggcuguggcagcuggaaguggu

SEQ ID NO: 73268 - RNA, 22 nt, Human
gucuucuauuuggcaugacaga

SEQ ID NO: 73269 - RNA, 22 nt, Human
gugaagaugccucaggugaccc

SEQ ID NO: 73270 - RNA, 22 nt, Human
ggcuucuuaacauuuggacacc

SEQ ID NO: 73271 - RNA, 22 nt, Human
ggcuuuuguuauaaucaggccu

SEQ ID NO: 73272 - RNA, 19 nt, Human
ggcuuugcccuucgcuccg

SEQ ID NO: 73273 - RNA, 22 nt, Human
ggcuuguccuucugguugucuu

SEQ ID NO: 73274 - RNA, 22 nt, Human
gugaaauuguacacucaguacc

SEQ ID NO: 73275 - RNA, 22 nt, Human
ggcuuccuggugcagaguuaua

SEQ ID NO: 73276 - RNA, 22 nt, Human
ggcuuaugaucugacccaucga

SEQ ID NO: 73277 - RNA, 22 nt, Human
gugagagugguuuauguccaug

SEQ ID NO: 73278 - RNA, 22 nt, Human
gggaacuuugugagacuggaga

SEQ ID NO: 73279 - RNA, 22 nt, Human
gggaagaacugauuucacacca

SEQ ID NO: 73280 - RNA, 22 nt, Human
gucuguacugccguuauucaga

SEQ ID NO: 73281 - RNA, 22 nt, Human
gggaacuuggcaggaaaauuau

SEQ ID NO: 73282 - RNA, 22 nt, Human
gugaguuuucgugacacuauuu

SEQ ID NO: 73283 - RNA, 22 nt, Human
gggaagaagaaaagagguggga

SEQ ID NO: 73284 - RNA, 22 nt, Human
gugaagguccugauuugugacc

SEQ ID NO: 73285 - RNA, 22 nt, Human
gggaaaauguuucugagacaaa

SEQ ID NO: 73286 - RNA, 22 nt, Human
gggaaaaaggaguuagagauaa

SEQ ID NO: 73287 - RNA, 22 nt, Human
gugacucuacuuaagauuaagc

SEQ ID NO: 73288 - RNA, 22 nt, Human
gugacugagcuggcaaaguaug

SEQ ID NO: 73289 - RNA, 22 nt, Human
gggaaaugugucuuggcauucu

SEQ ID NO: 73290 - RNA, 23 nt, Human
gggaaaucaaaagauauuucuuc

SEQ ID NO: 73291 - RNA, 22 nt, Human
gggcaagaagcuggaagcauuc

SEQ ID NO: 73292 - RNA, 19 nt, Human
gggauuccuggcuuuagaa

SEQ ID NO: 73293 - RNA, 22 nt, Human
gugcugcaugagcaucacguag

SEQ ID NO: 73294 - RNA, 22 nt, Human
gggauguauguuuguguggaga

SEQ ID NO: 73295 - RNA, 22 nt, Human
gugcuacacaaauguuaguugu

SEQ ID NO: 73296 - RNA, 22 nt, Human
gugcucaucuucuguaacuguu

SEQ ID NO: 73297 - RNA, 21 nt, Human
gggagugucuguugcaaggug

SEQ ID NO: 73298 - RNA, 22 nt, Human
gugccgcuggagcuggaauuga

SEQ ID NO: 73299 - RNA, 22 nt, Human
gugcccaguugaggccaggacu

SEQ ID NO: 73300 - RNA, 22 nt, Human
gggagccucccacugggggaag

SEQ ID NO: 73301 - RNA, 21 nt, Human
gggaggagcuucccuuugccc

SEQ ID NO: 73302 - RNA, 22 nt, Human
gggaggaagaguaggaauuuga

SEQ ID NO: 73303 - RNA, 22 nt, Human
gggagcuggagcuggaagacuc

SEQ ID NO: 73304 - RNA, 22 nt, Human
gugcaucuguaauuacaauggu

SEQ ID NO: 73305 - RNA, 22 nt, Human
gugccaaauagcuugauuaaga

SEQ ID NO: 73306 - RNA, 22 nt, Human
gggagauuuguguaggaaaacu

SEQ ID NO: 73307 - RNA, 22 nt, Human
gugcagcugguggagucugggg

SEQ ID NO: 73308 - RNA, 21 nt, Human
gggagaguagcgguagggagg

SEQ ID NO: 73309 - RNA, 22 nt, Human
gugauuucaaauauagagugag

SEQ ID NO: 73310 - RNA, 19 nt, Human
gggagaaaaucuuuauccu

SEQ ID NO: 73311 - RNA, 22 nt, Human
gggacucugaaucuagauuccu

SEQ ID NO: 73312 - RNA, 22 nt, Human
gggaauuuuaggaugacuccua

SEQ ID NO: 73313 - RNA, 22 nt, Human
gggaaguugguaagaggcuguu

SEQ ID NO: 73314 - RNA, 22 nt, Human
gugauggucgagcgcuuguugu

SEQ ID NO: 73315 - RNA, 22 nt, Human
gggaauguuaaccuuucuauuu

SEQ ID NO: 73316 - RNA, 22 nt, Human
gucugcuuuuaucacaugucau

SEQ ID NO: 73317 - RNA, 22 nt, Human
gucuggagccacugcugcugcu

SEQ ID NO: 73318 - RNA, 22 nt, Human
gucugcucauguuugguuugug

SEQ ID NO: 73319 - RNA, 22 nt, Human
gucugguggaguuguauauacu

SEQ ID NO: 73320 - RNA, 22 nt, Human
gucuccugcccacccugguccc

SEQ ID NO: 73321 - RNA, 22 nt, Human
gucuauuuauagacagauccua

SEQ ID NO: 73322 - RNA, 22 nt, Human
gucguuugucaauuuugaugug

SEQ ID NO: 73323 - RNA, 22 nt, Human
guccuuuauuugaacaugacau

SEQ ID NO: 73324 - RNA, 22 nt, Human
guccuuaaauacgaugaacaug

SEQ ID NO: 73325 - RNA, 22 nt, Human
guccuuuuuuuauacccaggcc

SEQ ID NO: 73326 - RNA, 17 nt, Human
ggcugccaggcaacaua

SEQ ID NO: 73327 - RNA, 22 nt, Human
guccugaaaaaaaucccugagu

SEQ ID NO: 73328 - RNA, 22 nt, Human
guccugauggccauuuuucacu

SEQ ID NO: 73329 - RNA, 22 nt, Human
ggcucuccacuauggaugagaa

SEQ ID NO: 73330 - RNA, 22 nt, Human
ggcuccucaggcugggguaagg

SEQ ID NO: 73331 - RNA, 22 nt, Human
guccccuauaugaggaagccau

SEQ ID NO: 73332 - RNA, 22 nt, Human
gucccagaggacagggucacau

SEQ ID NO: 73333 - RNA, 22 nt, Human
guccauauuuauccuuaaagua

SEQ ID NO: 73334 - RNA, 23 nt, Human
gucauuacuguuaccuuauucuu

SEQ ID NO: 73335 - RNA, 22 nt, Human
gucaugaugauacagguggagg

SEQ ID NO: 73336 - RNA, 22 nt, Human
ggcuccccagagcuccuuacuc

SEQ ID NO: 73337 - RNA, 22 nt, Human
gucaucugagggacgagauuuc

SEQ ID NO: 73338 - RNA, 19 nt, Human
gucagucuuaaguuucagc

SEQ ID NO: 73339 - RNA, 22 nt, Human
gucagauucuuucauuugcuga

SEQ ID NO: 73340 - RNA, 23 nt, Human
gucagcuugaccaguggagaguc

SEQ ID NO: 73341 - RNA, 22 nt, Human
gucagugaaccuucaccaaacc

SEQ ID NO: 73342 - RNA, 22 nt, Human
gucaggugcaccuccaccaaca

SEQ ID NO: 73343 - RNA, 22 nt, Human
gucacuccuucccagagggagc

SEQ ID NO: 73344 - RNA, 22 nt, Human
guauuauauaaccauugguucu

SEQ ID NO: 73345 - RNA, 22 nt, Human
guauuugcaaucacaaacaaaa

SEQ ID NO: 73346 - RNA, 22 nt, Human
gucaaaggcggugcaggaggag

SEQ ID NO: 73347 - RNA, 22 nt, Human
gucaagaugcuacauaauggga

SEQ ID NO: 73348 - RNA, 22 nt, Human
guaugaguggauagauguaucu

SEQ ID NO: 73349 - RNA, 21 nt, Human
guaucuuucuuuuaaaauauc

SEQ ID NO: 73350 - RNA, 22 nt, Human
ggcgaugaggucuuagaaucua

SEQ ID NO: 73351 - RNA, 22 nt, Human
ggcgauuggccgggaggaggca

SEQ ID NO: 73352 - RNA, 22 nt, Human
guaucaggacuaaauuauggau

SEQ ID NO: 73353 - RNA, 22 nt, Human
guauccuccccgcuggccuuca

SEQ ID NO: 73354 - RNA, 22 nt, Human
guauaaagaugccauacuuacu

SEQ ID NO: 73355 - RNA, 22 nt, Human
gguuuucagaaugcaguccugu

SEQ ID NO: 73356 - RNA, 22 nt, Human
gguuuaucuuuacaaaugaaau

SEQ ID NO: 73357 - RNA, 21 nt, Human
gguuucugcaaaccuuguaca

SEQ ID NO: 73358 - RNA, 22 nt, Human
gguuucuuuccucucugugccu

SEQ ID NO: 73359 - RNA, 22 nt, Human
guuuacaacaucuuguccuuca

SEQ ID NO: 73360 - RNA, 22 nt, Human
guuuaagcagauugcuguggug

SEQ ID NO: 73361 - RNA, 22 nt, Human
guuuauucuuuuauuugugaga

SEQ ID NO: 73362 - RNA, 22 nt, Human
guuuauuucuuaucaucacuau

SEQ ID NO: 73363 - RNA, 22 nt, Human
ggucuuauaauuaauuuaggcu

SEQ ID NO: 73364 - RNA, 22 nt, Human
guuguuuuuguuaaaacaguga

SEQ ID NO: 73365 - RNA, 22 nt, Human
guuugcagacuauguaaacuuc

SEQ ID NO: 73366 - RNA, 22 nt, Human
ggugaucucuggcucugcuugu

SEQ ID NO: 73367 - RNA, 22 nt, Human
ggugaaggaucccucuuggccu

SEQ ID NO: 73368 - RNA, 22 nt, Human
guuggugagaguuagggauuua

SEQ ID NO: 73369 - RNA, 22 nt, Human
guugucguucccccugcuuaaa

SEQ ID NO: 73370 - RNA, 22 nt, Human
gugcuggcaaagagaacaucuu

SEQ ID NO: 73371 - RNA, 22 nt, Human
gugcugucguggaacugggcug

SEQ ID NO: 73372 - RNA, 22 nt, Human
gugcucuauguugauuccuuga

SEQ ID NO: 73373 - RNA, 22 nt, Human
gugcuguuagcgguuuauaaca

SEQ ID NO: 73374 - RNA, 22 nt, Human
guugcuucuuggcuuuuccaac

SEQ ID NO: 73375 - RNA, 22 nt, Human
gguuugauauguuugugauucu

SEQ ID NO: 73376 - RNA, 22 nt, Human
gguuugggaagaacuauucccu

SEQ ID NO: 73377 - RNA, 22 nt, Human
uaaaggcaaacucuccaaggau

SEQ ID NO: 73378 - RNA, 22 nt, Human
gguuuuuggcucaauauuuugg

SEQ ID NO: 73379 - RNA, 22 nt, Human
uaaaguauucaaguagcuuucu

SEQ ID NO: 73380 - RNA, 22 nt, Human
uaaacgaagcuucaugcuugaa

SEQ ID NO: 73381 - RNA, 22 nt, Human
gguugauuuuuaugaagccaug

SEQ ID NO: 73382 - RNA, 22 nt, Human
uaaacugacagugagggagagu

SEQ ID NO: 73383 - RNA, 22 nt, Human
uaaaccuuauuugaauaccaac

SEQ ID NO: 73384 - RNA, 22 nt, Human
uaaauuccuagucacaaacuuc

SEQ ID NO: 73385 - RNA, 22 nt, Human
uaaauuagauucccagcgcuau

SEQ ID NO: 73386 - RNA, 22 nt, Human
guacauauggcacaugcuauuu

SEQ ID NO: 73387 - RNA, 22 nt, Human
guaccuuucuaucuagaaggua

SEQ ID NO: 73388 - RNA, 22 nt, Human
uaaauaugcaugugguauucau

SEQ ID NO: 73389 - RNA, 22 nt, Human
uaaaguguacaagucauaagua

SEQ ID NO: 73390 - RNA, 22 nt, Human
ggugucagccacuuugucggag

SEQ ID NO: 73391 - RNA, 22 nt, Human
uaaaaauuagauauguauuuag

SEQ ID NO: 73392 - RNA, 22 nt, Human
uaaaaguuagcuaggacaaagu

SEQ ID NO: 73393 - RNA, 22 nt, Human
gguugaagcuacuuucuggaug

SEQ ID NO: 73394 - RNA, 22 nt, Human
uaaaaccauucauugaccuaug

SEQ ID NO: 73395 - RNA, 22 nt, Human
ggugguucagugguuagggcca

SEQ ID NO: 73396 - RNA, 22 nt, Human
guuugguucucauuguuuuucu

SEQ ID NO: 73397 - RNA, 22 nt, Human
ggugcuggggaaauuaggguag

SEQ ID NO: 73398 - RNA, 22 nt, Human
uacuuccuucugcccccucuga

SEQ ID NO: 73399 - RNA, 22 nt, Human
gugaaggcaugugugcugugcu

SEQ ID NO: 73400 - RNA, 20 nt, Human
gugaaguuuucugaagacag

SEQ ID NO: 73401 - RNA, 22 nt, Human
uacuugcaaggcucuuggaaua

SEQ ID NO: 73402 - RNA, 22 nt, Human
uacuuuggugaaauuggaaaua

SEQ ID NO: 73403 - RNA, 22 nt, Human
uacgugucacugaugaaguuua

SEQ ID NO: 73404 - RNA, 22 nt, Human
uacuucuuuuguaaaguauuga

SEQ ID NO: 73405 - RNA, 22 nt, Human
uacuucauucaaguucgcuaua

SEQ ID NO: 73406 - RNA, 22 nt, Human
uacauuguguuaaaacagaaga

SEQ ID NO: 73407 - RNA, 22 nt, Human
uacauccuuuugaaaucccaga

SEQ ID NO: 73408 - RNA, 22 nt, Human
uacauaauucauuagcuccucu

SEQ ID NO: 73409 - RNA, 18 nt, Human
gucuguuccuuuaauguc

SEQ ID NO: 73410 - RNA, 22 nt, Human
gucuuucuuuuacauauuugug

SEQ ID NO: 73411 - RNA, 22 nt, Human
gucuuuguaguuuuaauuugag

SEQ ID NO: 73412 - RNA, 22 nt, Human
gugaaaauaguaaccuggcuag

SEQ ID NO: 73413 - RNA, 22 nt, Human
uaauuugauuucucccuggaaa

SEQ ID NO: 73414 - RNA, 22 nt, Human
gucuggugguggguguagggca

SEQ ID NO: 73415 - RNA, 22 nt, Human
gucgagaacauucauuaugcaa

SEQ ID NO: 73416 - RNA, 22 nt, Human
uaauuucauuuugcaaugaucu

SEQ ID NO: 73417 - RNA, 22 nt, Human
gucgguacuaguacugguguug

SEQ ID NO: 73418 - RNA, 22 nt, Human
gucguucugcuauucuaugagg

SEQ ID NO: 73419 - RNA, 22 nt, Human
uaauucuucaauccaguguuca

SEQ ID NO: 73420 - RNA, 22 nt, Human
uaaugcucauuuggcucugcaa

SEQ ID NO: 73421 - RNA, 22 nt, Human
uaauggagggucugagucuggg

SEQ ID NO: 73422 - RNA, 22 nt, Human
uaauaucuuuacacauuuucaa

SEQ ID NO: 73423 - RNA, 22 nt, Human
guccucgugucuuuuucucuaa

SEQ ID NO: 73424 - RNA, 22 nt, Human
uaauccaaaacugaaucugugg

SEQ ID NO: 73425 - RNA, 22 nt, Human
uaaugaugaacacuuggaagaa

SEQ ID NO: 73426 - RNA, 22 nt, Human
uaauauauuuuuuaagggaugu

SEQ ID NO: 73427 - RNA, 22 nt, Human
guccguaauuuuugcuugcaga

SEQ ID NO: 73428 - RNA, 22 nt, Human
gucccagaaugguuucccagaa

SEQ ID NO: 73429 - RNA, 22 nt, Human
guagaucaugaaaauucacugc

SEQ ID NO: 73430 - RNA, 22 nt, Human
guagagccaccaccaccauagc

SEQ ID NO: 73431 - RNA, 22 nt, Human
guagagcagaaacauggagaaa

SEQ ID NO: 73432 - RNA, 22 nt, Human
guagauaauuuuggaaagcugg

SEQ ID NO: 73433 - RNA, 22 nt, Human
guacuugauucauuauugcauu

SEQ ID NO: 73434 - RNA, 22 nt, Human
guaugucuuaggguucaguaac

SEQ ID NO: 73435 - RNA, 22 nt, Human
guauggaguuuuguugcacuuc

SEQ ID NO: 73436 - RNA, 22 nt, Human
uaagaauguuuguugaguaaau

SEQ ID NO: 73437 - RNA, 21 nt, Human
uaagaacauuaucuucuuccu

SEQ ID NO: 73438 - RNA, 22 nt, Human
guauucugugugaucaagugau

SEQ ID NO: 73439 - RNA, 22 nt, Human
guauuggcaguauacauagcac

SEQ ID NO: 73440 - RNA, 22 nt, Human
ucaaagaucuuugcuuuugggg

SEQ ID NO: 73441 - RNA, 22 nt, Human
ucaacagaagugauagcuauua

SEQ ID NO: 73442 - RNA, 22 nt, Human
guugguggaggcgagagaagaa

SEQ ID NO: 73443 - RNA, 22 nt, Human
ucaagaagauaaugucuagggu

SEQ ID NO: 73444 - RNA, 22 nt, Human
uauuuucucugccacacuucca

SEQ ID NO: 73445 - RNA, 22 nt, Human
uauuuuauuuagguuuaguugu

SEQ ID NO: 73446 - RNA, 22 nt, Human
uauuuuagccaacagaaugaug

SEQ ID NO: 73447 - RNA, 22 nt, Human
uauuuuuuuaacauuuauugua

SEQ ID NO: 73448 - RNA, 23 nt, Human
uauuuuccccuguaauauguauu

SEQ ID NO: 73449 - RNA, 22 nt, Human
guugcuaugaaauuaaaauuua

SEQ ID NO: 73450 - RNA, 22 nt, Human
guucucauugugaugcuuaguu

SEQ ID NO: 73451 - RNA, 22 nt, Human
guucuguauauauccuagcaaa

SEQ ID NO: 73452 - RNA, 22 nt, Human
uauuuuagaagauuuggagaaa

SEQ ID NO: 73453 - RNA, 21 nt, Human
guucuuaguuauauucucaau

SEQ ID NO: 73454 - RNA, 22 nt, Human
uauuucuagggcaugaaaauaa

SEQ ID NO: 73455 - RNA, 22 nt, Human
guucuuuacuucgcaucugcua

SEQ ID NO: 73456 - RNA, 22 nt, Human
guucuuagcacuucugcccauu

SEQ ID NO: 73457 - RNA, 22 nt, Human
guucuucucuuguaauggaauc

SEQ ID NO: 73458 - RNA, 22 nt, Human
uauuauggguuuuuguguaaau

SEQ ID NO: 73459 - RNA, 22 nt, Human
guuauuaaauauuuuggugauu

SEQ ID NO: 73460 - RNA, 16 nt, Human
guuccuguguguacaa

SEQ ID NO: 73461 - RNA, 22 nt, Human
guucuacaacuucgcuugcaga

SEQ ID NO: 73462 - RNA, 22 nt, Human
guucgucuguggugugaggugc

SEQ ID NO: 73463 - RNA, 22 nt, Human
guguugaugugucuguauucua

SEQ ID NO: 73464 - RNA, 23 nt, Human
guguuguugauuuucgaaucuuu

SEQ ID NO: 73465 - RNA, 22 nt, Human
guguuucccuggcacaagaacc

SEQ ID NO: 73466 - RNA, 22 nt, Human
guguuuugagaggaugguuuua

SEQ ID NO: 73467 - RNA, 22 nt, Human
guuagacuugcguggaucauga

SEQ ID NO: 73468 - RNA, 22 nt, Human
guuacagagcugcuaugugugc

SEQ ID NO: 73469 - RNA, 22 nt, Human
uaugucuauugacuuaggauuu

SEQ ID NO: 73470 - RNA, 22 nt, Human
uaugugaaauggaauauagaaa

SEQ ID NO: 73471 - RNA, 20 nt, Human
uaugcgaagccuuucuggac

SEQ ID NO: 73472 - RNA, 22 nt, Human
uaugcauaauuggauaaguaga

SEQ ID NO: 73473 - RNA, 22 nt, Human
guguucucagcacccacuucau

SEQ ID NO: 73474 - RNA, 22 nt, Human
uaugcuagauggaaaaauauug

SEQ ID NO: 73475 - RNA, 22 nt, Human
uauggacagcuuucuuuguguu

SEQ ID NO: 73476 - RNA, 19 nt, Human
uaugaaguugauaaaaguu

SEQ ID NO: 73477 - RNA, 22 nt, Human
uaugaaggauacaccucugauu

SEQ ID NO: 73478 - RNA, 22 nt, Human
uaucuuugccuuggguuuuguu

SEQ ID NO: 73479 - RNA, 22 nt, Human
uauccaaaggaacaaucacagc

SEQ ID NO: 73480 - RNA, 22 nt, Human
uaucauuuuacugugacauuuu

SEQ ID NO: 73481 - RNA, 22 nt, Human
gugggugucaguaucuuuaacg

SEQ ID NO: 73482 - RNA, 22 nt, Human
guggugaacauuugcaucugcu

SEQ ID NO: 73483 - RNA, 22 nt, Human
gugguccugguugucugagaga

SEQ ID NO: 73484 - RNA, 22 nt, Human
guggugauuugggucuagcuuu

SEQ ID NO: 73485 - RNA, 22 nt, Human
guggugggcgugguguaugccu

SEQ ID NO: 73486 - RNA, 22 nt, Human
uaguggaaccuucuaaaugacg

SEQ ID NO: 73487 - RNA, 22 nt, Human
uagugucuuccaggacauggua

SEQ ID NO: 73488 - RNA, 23 nt, Human
uaguguuauuaauuaguaaggau

SEQ ID NO: 73489 - RNA, 22 nt, Human
uagucuuuguggucuuuagcua

SEQ ID NO: 73490 - RNA, 22 nt, Human
uagucucagaauauuugcugau

SEQ ID NO: 73491 - RNA, 22 nt, Human
uagugauuuaagaaaggugacu

SEQ ID NO: 73492 - RNA, 22 nt, Human
uaguauuguguuguuugacagu

SEQ ID NO: 73493 - RNA, 22 nt, Human
uaguaugugccuguugucucug

SEQ ID NO: 73494 - RNA, 22 nt, Human
uaguauuuguaauuaucaaagc

SEQ ID NO: 73495 - RNA, 22 nt, Human
gugggagaaugggaggaguaau

SEQ ID NO: 73496 - RNA, 22 nt, Human
gugggaguggagcucagcaugu

SEQ ID NO: 73497 - RNA, 22 nt, Human
gugggcagauuaauuucucaau

SEQ ID NO: 73498 - RNA, 22 nt, Human
guggcuuaauauuuauagcaga

SEQ ID NO: 73499 - RNA, 22 nt, Human
guggcuuucuaccauuaaauug

SEQ ID NO: 73500 - RNA, 22 nt, Human
guggcuuuguuuccaaaugaaa

SEQ ID NO: 73501 - RNA, 22 nt, Human
guggccugacagaucggaacag

SEQ ID NO: 73502 - RNA, 22 nt, Human
uaggucuuggagguggggcugg

SEQ ID NO: 73503 - RNA, 22 nt, Human
uaguacuugauuuuaaauguua

SEQ ID NO: 73504 - RNA, 22 nt, Human
guggcagguguacagcucagcu

SEQ ID NO: 73505 - RNA, 22 nt, Human
uaggggaagcauagguuuagaa

SEQ ID NO: 73506 - RNA, 22 nt, Human
uaggggcccgugggauggacag

SEQ ID NO: 73507 - RNA, 22 nt, Human
uaggcauguaaaagugaguucg

SEQ ID NO: 73508 - RNA, 22 nt, Human
uaggcuuuguuacuuucccuuu

SEQ ID NO: 73509 - RNA, 22 nt, Human
uaggcaguagcuuuggauguca

SEQ ID NO: 73510 - RNA, 22 nt, Human
uaggcagauuccauauuuuggc

SEQ ID NO: 73511 - RNA, 22 nt, Human
uaggaucaugaugguaaggcaa

SEQ ID NO: 73512 - RNA, 22 nt, Human
uaggagccagaauugcauuagu

SEQ ID NO: 73513 - RNA, 22 nt, Human
uaggagcagauggcagcaggug

SEQ ID NO: 73514 - RNA, 22 nt, Human
guggauuucaggcuccccucag

SEQ ID NO: 73515 - RNA, 22 nt, Human
guggagaucuggugcccccugg

SEQ ID NO: 73516 - RNA, 22 nt, Human
guggagauauuugugauagggg

SEQ ID NO: 73517 - RNA, 22 nt, Human
uagcuucccagcuaaccauguc

SEQ ID NO: 73518 - RNA, 22 nt, Human
guggacagacauaauccuaauu

SEQ ID NO: 73519 - RNA, 22 nt, Human
guggaaauuuuaggaucaucuu

SEQ ID NO: 73520 - RNA, 22 nt, Human
guggaaauaugggcaacaaaga

SEQ ID NO: 73521 - RNA, 21 nt, Human
uagaagagggaauuugucuuu

SEQ ID NO: 73522 - RNA, 22 nt, Human
uagaagaugccuuaaaguugaa

SEQ ID NO: 73523 - RNA, 22 nt, Human
uacugucuuuuccuaaaugggu

SEQ ID NO: 73524 - RNA, 22 nt, Human
uagaacuguaaauuaucucucc

SEQ ID NO: 73525 - RNA, 22 nt, Human
uagaagagcuuccaccuggggc

SEQ ID NO: 73526 - RNA, 17 nt, Human
gugagcugagucaggac

SEQ ID NO: 73527 - RNA, 17 nt, Human
uagccagcuugugauuu

SEQ ID NO: 73528 - RNA, 22 nt, Human
uagccucauuauuuacucauga

SEQ ID NO: 73529 - RNA, 22 nt, Human
uagccucaagagauucagggac

SEQ ID NO: 73530 - RNA, 22 nt, Human
uagccuguuuuuaugagaauuu

SEQ ID NO: 73531 - RNA, 22 nt, Human
gugcugcaaggauggagaggca

SEQ ID NO: 73532 - RNA, 22 nt, Human
gugcucgagcugugcgcgcugc

SEQ ID NO: 73533 - RNA, 22 nt, Human
gugcucuagaaauugucagugg

SEQ ID NO: 73534 - RNA, 21 nt, Human
uaggaacuguucugagugguc

SEQ ID NO: 73535 - RNA, 22 nt, Human
uagcuagacacucagggccuca

SEQ ID NO: 73536 - RNA, 22 nt, Human
uagccucuggaauccuuucucu

SEQ ID NO: 73537 - RNA, 19 nt, Human
uagcuguucuugaguguga

SEQ ID NO: 73538 - RNA, 22 nt, Human
uaacagugcuacaguuacuuuc

SEQ ID NO: 73539 - RNA, 22 nt, Human
uaacaguauacuacaucauauu

SEQ ID NO: 73540 - RNA, 22 nt, Human
uaacauuuaguuuuaagauggu

SEQ ID NO: 73541 - RNA, 22 nt, Human
uaaccuugaagacugagcugac

SEQ ID NO: 73542 - RNA, 22 nt, Human
uaacgcaucuggaaacaggaca

SEQ ID NO: 73543 - RNA, 22 nt, Human
uaacucuagggacucgcccaga

SEQ ID NO: 73544 - RNA, 22 nt, Human
uaacuuuucuguucaauuuucc

SEQ ID NO: 73545 - RNA, 22 nt, Human
ucagugugacccuucuauuuuu

SEQ ID NO: 73546 - RNA, 23 nt, Human
uaacacaguccuggucuuuggcc

SEQ ID NO: 73547 - RNA, 23 nt, Human
uaaauuuuauucugauaacacag

SEQ ID NO: 73548 - RNA, 22 nt, Human
ucagugauccagauauuugagc

SEQ ID NO: 73549 - RNA, 22 nt, Human
ucagucuucaggacuaugaaaa

SEQ ID NO: 73550 - RNA, 22 nt, Human
uaaauuggaauaaugagaagug

SEQ ID NO: 73551 - RNA, 22 nt, Human
uaaauuugugaauuagcuauca

SEQ ID NO: 73552 - RNA, 22 nt, Human
ucagucauguuuaccagacgua

SEQ ID NO: 73553 - RNA, 22 nt, Human
uaaauguugcuugugcugcuca

SEQ ID NO: 73554 - RNA, 22 nt, Human
ucaguauaugaauuugggggua

SEQ ID NO: 73555 - RNA, 23 nt, Human
ucagggaucgucagaaaaugaaa

SEQ ID NO: 73556 - RNA, 22 nt, Human
ucagguuuuuaaggagcuagga

SEQ ID NO: 73557 - RNA, 22 nt, Human
uaaagugaaguucagaauggcu

SEQ ID NO: 73558 - RNA, 22 nt, Human
uaaaugagcaccucuaguuuug

SEQ ID NO: 73559 - RNA, 22 nt, Human
uaaaggaguguauaauuguagu

SEQ ID NO: 73560 - RNA, 22 nt, Human
ucaagcaaggaauccuuuugua

SEQ ID NO: 73561 - RNA, 22 nt, Human
ucaagagauauaugcugguuua

SEQ ID NO: 73562 - RNA, 22 nt, Human
ucaggagaguguucaguggagg

SEQ ID NO: 73563 - RNA, 20 nt, Human
ucaggguuucccauucuugg

SEQ ID NO: 73564 - RNA, 22 nt, Human
ucaggcuagcccagugcuuggg

SEQ ID NO: 73565 - RNA, 21 nt, Human
uccaaaggagacugagugugu

SEQ ID NO: 73566 - RNA, 22 nt, Human
uccaaauagcuggaugauggug

SEQ ID NO: 73567 - RNA, 18 nt, Human
uacagauguaugucuaca

SEQ ID NO: 73568 - RNA, 22 nt, Human
uccaagacagauaccuagaaga

SEQ ID NO: 73569 - RNA, 17 nt, Human
ucauuuauccucuuugg

SEQ ID NO: 73570 - RNA, 22 nt, Human
ucauuuaauuuggaacucagag

SEQ ID NO: 73571 - RNA, 22 nt, Human
ucauuuuaucaggaauggaauc

SEQ ID NO: 73572 - RNA, 22 nt, Human
uaauuuagugcauuuccuagua

SEQ ID NO: 73573 - RNA, 22 nt, Human
uaauuuugucacagugacaugc

SEQ ID NO: 73574 - RNA, 22 nt, Human
uacaaaauucaaauaauguuug

SEQ ID NO: 73575 - RNA, 22 nt, Human
uacaaaugaucaucucuuugaa

SEQ ID NO: 73576 - RNA, 22 nt, Human
uaagugcuagaauuccagguuu

SEQ ID NO: 73577 - RNA, 22 nt, Human
uaauaguugaaggucaucacua

SEQ ID NO: 73578 - RNA, 22 nt, Human
uaauauaacugccaguuaaggu

SEQ ID NO: 73579 - RNA, 22 nt, Human
ucaugggcaaacuuggggauca

SEQ ID NO: 73580 - RNA, 22 nt, Human
ucaugcagauaagaauaaguaa

SEQ ID NO: 73581 - RNA, 22 nt, Human
uaaggagagaauuuagagguuu

SEQ ID NO: 73582 - RNA, 22 nt, Human
ucauuauuuggaauaugggacu

SEQ ID NO: 73583 - RNA, 19 nt, Human
uaaguagaugacugaugcu

SEQ ID NO: 73584 - RNA, 22 nt, Human
uaagucaagagcuagaaaaagc

SEQ ID NO: 73585 - RNA, 22 nt, Human
ucauggucucccagcccccucu

SEQ ID NO: 73586 - RNA, 22 nt, Human
ucauguauucugggcaggagau

SEQ ID NO: 73587 - RNA, 22 nt, Human
uaagagauuuauugaggacuuc

SEQ ID NO: 73588 - RNA, 22 nt, Human
ucaguuguuggaaguagaugua

SEQ ID NO: 73589 - RNA, 22 nt, Human
ucaucuauaaguagcaucuggg

SEQ ID NO: 73590 - RNA, 21 nt, Human
uaagcuaaacauucaguuaac

SEQ ID NO: 73591 - RNA, 22 nt, Human
uaagcuauuccugaagaagguu

SEQ ID NO: 73592 - RNA, 22 nt, Human
uccuugaccuccugacaguaac

SEQ ID NO: 73593 - RNA, 22 nt, Human
uagcucuaaggagaaucccucu

SEQ ID NO: 73594 - RNA, 22 nt, Human
uagcguaugcugugugaugaau

SEQ ID NO: 73595 - RNA, 22 nt, Human
uagcucuuaccagugaaguuug

SEQ ID NO: 73596 - RNA, 22 nt, Human
uccugcucucuccauuccuucc

SEQ ID NO: 73597 - RNA, 22 nt, Human
uccuggccuuggggagagaagu

SEQ ID NO: 73598 - RNA, 22 nt, Human
uccuggaagggaugguugagga

SEQ ID NO: 73599 - RNA, 22 nt, Human
uccuggccucugagucaagaac

SEQ ID NO: 73600 - RNA, 22 nt, Human
uagcagcacuauuuguuguagu

SEQ ID NO: 73601 - RNA, 22 nt, Human
uccugaaggccugaguuccacc

SEQ ID NO: 73602 - RNA, 20 nt, Human
uccugaaauuacgugauuca

SEQ ID NO: 73603 - RNA, 22 nt, Human
uccuccuggagacuuucucucu

SEQ ID NO: 73604 - RNA, 22 nt, Human
uccuccuuccugccccuaacuu

SEQ ID NO: 73605 - RNA, 22 nt, Human
ucccuuuuuccugaucugugaa

SEQ ID NO: 73606 - RNA, 23 nt, Human
ucccuuuguucuugcuaggaugu

SEQ ID NO: 73607 - RNA, 22 nt, Human
ucccuuaacucaaguggugcuc

SEQ ID NO: 73608 - RNA, 22 nt, Human
ucccuuuggagguguccagcac

SEQ ID NO: 73609 - RNA, 22 nt, Human
uagaagagcaugucaaacuaua

SEQ ID NO: 73610 - RNA, 22 nt, Human
uacuuuuuucacuucuagcccc

SEQ ID NO: 73611 - RNA, 22 nt, Human
uacuuugucauucuaaccuucc

SEQ ID NO: 73612 - RNA, 22 nt, Human
ucccuucccaccccugccuuuu

SEQ ID NO: 73613 - RNA, 22 nt, Human
ucccuucagcuccagcucugcu

SEQ ID NO: 73614 - RNA, 22 nt, Human
ucccuguuuccugcgcuccuuc

SEQ ID NO: 73615 - RNA, 22 nt, Human
uagaaauaaacacugcuaccuu

SEQ ID NO: 73616 - RNA, 22 nt, Human
uagaagaacaugucaaacuaua

SEQ ID NO: 73617 - RNA, 23 nt, Human
uagauccuuccaacuacucuuac

SEQ ID NO: 73618 - RNA, 22 nt, Human
uagagugcugucaaagacuugu

SEQ ID NO: 73619 - RNA, 22 nt, Human
uagaguaagugugugcugagcu

SEQ ID NO: 73620 - RNA, 22 nt, Human
uccucagcaagacgcuggcagc

SEQ ID NO: 73621 - RNA, 22 nt, Human
uccucaucuuaucaucccaaga

SEQ ID NO: 73622 - RNA, 21 nt, Human
uccuaaaggaaauacucaauu

SEQ ID NO: 73623 - RNA, 22 nt, Human
uagaccuccagcggaggagauu

SEQ ID NO: 73624 - RNA, 22 nt, Human
ucccugagcucacauggcagga

SEQ ID NO: 73625 - RNA, 22 nt, Human
ucccucguuucgaucuuuagaa

SEQ ID NO: 73626 - RNA, 22 nt, Human
ucccucacacagcugggagaac

SEQ ID NO: 73627 - RNA, 22 nt, Human
uacuuuaauugcaaaaauaaau

SEQ ID NO: 73628 - RNA, 22 nt, Human
uacuugucuuuauuuuaaugcu

SEQ ID NO: 73629 - RNA, 23 nt, Human
uacuuuggcuagaguugucucuu

SEQ ID NO: 73630 - RNA, 22 nt, Human
uacugaagaugccaucacaagc

SEQ ID NO: 73631 - RNA, 22 nt, Human
uacugaauuacugcugguaaau

SEQ ID NO: 73632 - RNA, 19 nt, Human
uccccuacuccuuucccuc

SEQ ID NO: 73633 - RNA, 20 nt, Human
uacguguccgaugaucacag

SEQ ID NO: 73634 - RNA, 22 nt, Human
uacguggcucguuaauuuccug

SEQ ID NO: 73635 - RNA, 22 nt, Human
uccaugaguuuuuuaguuucac

SEQ ID NO: 73636 - RNA, 22 nt, Human
uccaggcagcugcuugaugaua

SEQ ID NO: 73637 - RNA, 21 nt, Human
uccaggagcacgggacuagga

SEQ ID NO: 73638 - RNA, 22 nt, Human
uacaggaggaugugcagccagg

SEQ ID NO: 73639 - RNA, 22 nt, Human
uccacagcagagcacgguaccu

SEQ ID NO: 73640 - RNA, 22 nt, Human
uccaaggacucuugucagcugu

SEQ ID NO: 73641 - RNA, 22 nt, Human
uaugaucuuaggauggaacuuc

SEQ ID NO: 73642 - RNA, 21 nt, Human
ucugccaguuucucuuacuuu

SEQ ID NO: 73643 - RNA, 22 nt, Human
uaugccaaaaauaaguuuuaug

SEQ ID NO: 73644 - RNA, 22 nt, Human
ucugcgggccuggcucccagcg

SEQ ID NO: 73645 - RNA, 22 nt, Human
uaugagguuaucuaugucguau

SEQ ID NO: 73646 - RNA, 22 nt, Human
ucugaguuaaaauuccagaggu

SEQ ID NO: 73647 - RNA, 22 nt, Human
ucugauucucuuguugaccuag

SEQ ID NO: 73648 - RNA, 22 nt, Human
ucugaugaccacaugugggacu

SEQ ID NO: 73649 - RNA, 22 nt, Human
ucugauucauucugguaaaugg

SEQ ID NO: 73650 - RNA, 22 nt, Human
uaugaggagaacauuccugaac

SEQ ID NO: 73651 - RNA, 22 nt, Human
ucugagugacguccugacagga

SEQ ID NO: 73652 - RNA, 22 nt, Human
uauguauaacuugauaggauga

SEQ ID NO: 73653 - RNA, 22 nt, Human
uauguauguauguauguauaug

SEQ ID NO: 73654 - RNA, 20 nt, Human
uaugugcaguuugguuuauc

SEQ ID NO: 73655 - RNA, 22 nt, Human
ucugcuuuucuuaaggggauca

SEQ ID NO: 73656 - RNA, 22 nt, Human
ucugcuuaguuuucuugaacag

SEQ ID NO: 73657 - RNA, 22 nt, Human
uauggcuaguguguuuguaaca

SEQ ID NO: 73658 - RNA, 22 nt, Human
uaugcuguauucuguauguuag

SEQ ID NO: 73659 - RNA, 22 nt, Human
uauggcuucucagucaugaaaa

SEQ ID NO: 73660 - RNA, 22 nt, Human
uaugggcaagagauaggugguc

SEQ ID NO: 73661 - RNA, 22 nt, Human
uaugguuagugcuguagauuau

SEQ ID NO: 73662 - RNA, 22 nt, Human
ucuguguguguggcuaaacaag

SEQ ID NO: 73663 - RNA, 22 nt, Human
uauucccacuccucagcaauuu

SEQ ID NO: 73664 - RNA, 22 nt, Human
uauucauuuuuauuugugacug

SEQ ID NO: 73665 - RNA, 22 nt, Human
uauuaugguuguagguuaacaa

SEQ ID NO: 73666 - RNA, 22 nt, Human
uauucagugcugguucuuuuuc

SEQ ID NO: 73667 - RNA, 22 nt, Human
ucuguuauaaaucacacugcau

SEQ ID NO: 73668 - RNA, 22 nt, Human
ucuguucucuuguucugacggu

SEQ ID NO: 73669 - RNA, 22 nt, Human
ucuguuuuccaggaaucucaua

SEQ ID NO: 73670 - RNA, 22 nt, Human
ucuguuuugugcuuuguuuucu

SEQ ID NO: 73671 - RNA, 22 nt, Human
ucuguuucaggggucuggaaug

SEQ ID NO: 73672 - RNA, 22 nt, Human
ucuuaaguuccaggugugcuca

SEQ ID NO: 73673 - RNA, 22 nt, Human
ucuuaaucauucuucacuuccu

SEQ ID NO: 73674 - RNA, 22 nt, Human
ucuuauugugaugaugaagaac

SEQ ID NO: 73675 - RNA, 22 nt, Human
ucuucacagaugcauauacuuc

SEQ ID NO: 73676 - RNA, 20 nt, Human
ucuucagcuccaagucuggc

SEQ ID NO: 73677 - RNA, 22 nt, Human
ucuucagacuguuguucuuuug

SEQ ID NO: 73678 - RNA, 22 nt, Human
uauuacugccacaucauuaggu

SEQ ID NO: 73679 - RNA, 22 nt, Human
uauguuugcaguucuaggucuu

SEQ ID NO: 73680 - RNA, 19 nt, Human
uauuagccucaucccagcc

SEQ ID NO: 73681 - RNA, 22 nt, Human
uauuaaaagagaaaaagccacc

SEQ ID NO: 73682 - RNA, 22 nt, Human
uauuaauugugguuauuguauu

SEQ ID NO: 73683 - RNA, 22 nt, Human
uauguuuugcaaauaucaaaca

SEQ ID NO: 73684 - RNA, 22 nt, Human
ucugucuaaccauauuuuccua

SEQ ID NO: 73685 - RNA, 22 nt, Human
ucuguagucuuggagccgcaca

SEQ ID NO: 73686 - RNA, 20 nt, Human
ucugugugccaucaccuaac

SEQ ID NO: 73687 - RNA, 22 nt, Human
uauuagggaacugcaagacuaa

SEQ ID NO: 73688 - RNA, 22 nt, Human
ucugugcuggacugauuucaua

SEQ ID NO: 73689 - RNA, 19 nt, Human
ucuguggagcucagaguag

SEQ ID NO: 73690 - RNA, 20 nt, Human
ucuguggcagguggcgcuug

SEQ ID NO: 73691 - RNA, 22 nt, Human
ucugguuccugcauucauucaa

SEQ ID NO: 73692 - RNA, 22 nt, Human
ucuguaacaucaguguaauuuu

SEQ ID NO: 73693 - RNA, 22 nt, Human
ucuguauuuuuuacacacaugc

SEQ ID NO: 73694 - RNA, 22 nt, Human
ucuguagcuuuagaggacagga

SEQ ID NO: 73695 - RNA, 21 nt, Human
ucuggggacaagguccaggaa

SEQ ID NO: 73696 - RNA, 22 nt, Human
ucuggucugccgagauccauuu

SEQ ID NO: 73697 - RNA, 22 nt, Human
uauguucaauaccagguucuuu

SEQ ID NO: 73698 - RNA, 21 nt, Human
ucugaggagaaacucuuggug

SEQ ID NO: 73699 - RNA, 22 nt, Human
ucugagucgcucccuggaucca

SEQ ID NO: 73700 - RNA, 22 nt, Human
ucugagcaggaaagagcagaga

SEQ ID NO: 73701 - RNA, 22 nt, Human
uaucuuagaagaaaugggucca

SEQ ID NO: 73702 - RNA, 22 nt, Human
ucugagagcuguagaagccuau

SEQ ID NO: 73703 - RNA, 22 nt, Human
uaugaaagguuuuuucuugaaa

SEQ ID NO: 73704 - RNA, 22 nt, Human
uaucuucaauagcccagaugug

SEQ ID NO: 73705 - RNA, 22 nt, Human
uaucugcuggagguaauuacuc

SEQ ID NO: 73706 - RNA, 22 nt, Human
ucugacugucccguagaggaac

SEQ ID NO: 73707 - RNA, 22 nt, Human
uaucuccauucuagccccuugu

SEQ ID NO: 73708 - RNA, 22 nt, Human
uauccauaccuucaaguuugcu

SEQ ID NO: 73709 - RNA, 22 nt, Human
ucucugugaauggcgucaccug

SEQ ID NO: 73710 - RNA, 22 nt, Human
ucucuucacuuguaugcuauca

SEQ ID NO: 73711 - RNA, 22 nt, Human
ucugaaauuuuaguuauagaaa

SEQ ID NO: 73712 - RNA, 22 nt, Human
ucugaagagaacucuuaguguu

SEQ ID NO: 73713 - RNA, 22 nt, Human
ucucucugcuguccagcguuau

SEQ ID NO: 73714 - RNA, 22 nt, Human
ucucucguuuuuugcagauaaa

SEQ ID NO: 73715 - RNA, 22 nt, Human
ucucuagaggaauuguucuagg

SEQ ID NO: 73716 - RNA, 21 nt, Human
ucucuaucguauaccagccgg

SEQ ID NO: 73717 - RNA, 20 nt, Human
ucucucacccuugcugugca

SEQ ID NO: 73718 - RNA, 22 nt, Human
uauauacacgcacauauacaua

SEQ ID NO: 73719 - RNA, 22 nt, Human
uauauaauacacaaauauguac

SEQ ID NO: 73720 - RNA, 22 nt, Human
uauauauacauauagaauaugu

SEQ ID NO: 73721 - RNA, 22 nt, Human
uauauauaugcaccacaugugu

SEQ ID NO: 73722 - RNA, 22 nt, Human
ucucugagggugaucaugagaa

SEQ ID NO: 73723 - RNA, 22 nt, Human
uaucauuaggagugcugcucgg

SEQ ID NO: 73724 - RNA, 22 nt, Human
uauauuaaagugcuuugcagug

SEQ ID NO: 73725 - RNA, 22 nt, Human
uauauuuguccuagcuccuagc

SEQ ID NO: 73726 - RNA, 22 nt, Human
uaucaguagaacaauggacauu

SEQ ID NO: 73727 - RNA, 19 nt, Human
ucucugguggcuccaucag

SEQ ID NO: 73728 - RNA, 22 nt, Human
uauaugaggauauuuuaaagcu

SEQ ID NO: 73729 - RNA, 22 nt, Human
ucucugaggacagaaaguuugu

SEQ ID NO: 73730 - RNA, 22 nt, Human
uaguuuucaagugaguuggaag

SEQ ID NO: 73731 - RNA, 22 nt, Human
uaguuuuaagcugacauuguuc

SEQ ID NO: 73732 - RNA, 18 nt, Human
uauaaacacacuuagguu

SEQ ID NO: 73733 - RNA, 22 nt, Human
uaguuucuaauguugaaauuau

SEQ ID NO: 73734 - RNA, 22 nt, Human
uaguugguggagcgauuugucu

SEQ ID NO: 73735 - RNA, 22 nt, Human
ucucauacguuuccagguguca

SEQ ID NO: 73736 - RNA, 21 nt, Human
ucucauuuuaacacagaguug

SEQ ID NO: 73737 - RNA, 20 nt, Human
ucucauuuugauuucgcauu

SEQ ID NO: 73738 - RNA, 22 nt, Human
ucuccaccccugggaggcagaa

SEQ ID NO: 73739 - RNA, 22 nt, Human
ucucauugugcuuuuuguacug

SEQ ID NO: 73740 - RNA, 22 nt, Human
ucucccuggccagcccuuuccc

SEQ ID NO: 73741 - RNA, 22 nt, Human
uauaggaugaugucauguugcu

SEQ ID NO: 73742 - RNA, 22 nt, Human
ucuccuaauuacauacuugauu

SEQ ID NO: 73743 - RNA, 22 nt, Human
ucuccuuugaaaguuaggacug

SEQ ID NO: 73744 - RNA, 22 nt, Human
uauagccuuacaagauauuaua

SEQ ID NO: 73745 - RNA, 22 nt, Human
uauaagaaaagucauuaucaaa

SEQ ID NO: 73746 - RNA, 22 nt, Human
uauaagaaacaaggcaaauuuu

SEQ ID NO: 73747 - RNA, 22 nt, Human
ucuaggcugugugugggcaggg

SEQ ID NO: 73748 - RNA, 20 nt, Human
ucuaggacaggcaaaguaca

SEQ ID NO: 73749 - RNA, 22 nt, Human
uaggauauuuuagaaugguaca

SEQ ID NO: 73750 - RNA, 22 nt, Human
uaggaagagauuuucacauggc

SEQ ID NO: 73751 - RNA, 22 nt, Human
uagcugucauuggaucagaagg

SEQ ID NO: 73752 - RNA, 20 nt, Human
uagcuucaccuagagauagc

SEQ ID NO: 73753 - RNA, 22 nt, Human
uagcuucacuuuuguugaugcg

SEQ ID NO: 73754 - RNA, 22 nt, Human
ucuagguuguaauuuguaguaa

SEQ ID NO: 73755 - RNA, 22 nt, Human
ucuaugcuacguuccucugaaa

SEQ ID NO: 73756 - RNA, 22 nt, Human
ucuagggcaguacaaauucaag

SEQ ID NO: 73757 - RNA, 22 nt, Human
ucucagaagaaacaucugcugg

SEQ ID NO: 73758 - RNA, 22 nt, Human
ucucagaaaugacaggagguac

SEQ ID NO: 73759 - RNA, 22 nt, Human
ucucaaagguuuuccucuuuuu

SEQ ID NO: 73760 - RNA, 22 nt, Human
ucucaaagagcuacuggucuau

SEQ ID NO: 73761 - RNA, 22 nt, Human
ugauugcucagcuagccucuuu

SEQ ID NO: 73762 - RNA, 22 nt, Human
ugauugcucgacacucugcuug

SEQ ID NO: 73763 - RNA, 22 nt, Human
ugauugaauaauguuaugugaa

SEQ ID NO: 73764 - RNA, 22 nt, Human
ugauuccugugcuuauuccagu

SEQ ID NO: 73765 - RNA, 22 nt, Human
ugauucacgcuucucuuuaaac

SEQ ID NO: 73766 - RNA, 22 nt, Human
uccaaggacuaaauucuagauu

SEQ ID NO: 73767 - RNA, 22 nt, Human
ugauguauaaaaagagugaaau

SEQ ID NO: 73768 - RNA, 22 nt, Human
ucauuagaccucucugguucag

SEQ ID NO: 73769 - RNA, 22 nt, Human
ugaugugugaauucuuaaaugu

SEQ ID NO: 73770 - RNA, 22 nt, Human
ugauguaggacauuauuauuuc

SEQ ID NO: 73771 - RNA, 19 nt, Human
uccaaaauacuuguuacug

SEQ ID NO: 73772 - RNA, 22 nt, Human
ugaugccauaguaaaauuugcu

SEQ ID NO: 73773 - RNA, 22 nt, Human
ugaugaugccaaaauuuggcau

SEQ ID NO: 73774 - RNA, 22 nt, Human
ugaugaugauacauuucuucag

SEQ ID NO: 73775 - RNA, 22 nt, Human
ugaucauugaacaucgaguuaa

SEQ ID NO: 73776 - RNA, 20 nt, Human
ugauaugcgguacagagagg

SEQ ID NO: 73777 - RNA, 22 nt, Human
ucaugucagugucugugugugg

SEQ ID NO: 73778 - RNA, 22 nt, Human
ucaugagagaaaacgugcuucu

SEQ ID NO: 73779 - RNA, 22 nt, Human
ucaucuuuauaaugcaaguuuu

SEQ ID NO: 73780 - RNA, 22 nt, Human
ucaugcagaguagaaagggcaa

SEQ ID NO: 73781 - RNA, 21 nt, Human
ucauccagguccugcuucuuc

SEQ ID NO: 73782 - RNA, 22 nt, Human
ucauaaaggugccacucaguuu

SEQ ID NO: 73783 - RNA, 22 nt, Human
ucauaaaaucaguguccauugu

SEQ ID NO: 73784 - RNA, 22 nt, Human
ugagcuuugguaccuucauuug

SEQ ID NO: 73785 - RNA, 22 nt, Human
ugaggaagugguuguaugguuu

SEQ ID NO: 73786 - RNA, 22 nt, Human
ugaggaaugugacaaaaccaag

SEQ ID NO: 73787 - RNA, 22 nt, Human
ugaggaugagaaggaagagaag

SEQ ID NO: 73788 - RNA, 22 nt, Human
ucaguugagguggucuauugcg

SEQ ID NO: 73789 - RNA, 22 nt, Human
ucaguugauggcaguuaauguc

SEQ ID NO: 73790 - RNA, 22 nt, Human
ucaguuuaauuggaucuuuuuc

SEQ ID NO: 73791 - RNA, 22 nt, Human
ucagugagauuuuuagcaguag

SEQ ID NO: 73792 - RNA, 22 nt, Human
ucagucugguggaugcucauug

SEQ ID NO: 73793 - RNA, 22 nt, Human
ugagagggagacagcucuagca

SEQ ID NO: 73794 - RNA, 22 nt, Human
ucagucugcuauagguauuugu

SEQ ID NO: 73795 - RNA, 22 nt, Human
ucaguggaacacacagaguggg

SEQ ID NO: 73796 - RNA, 19 nt, Human
ugagauuguaugaggagau

SEQ ID NO: 73797 - RNA, 22 nt, Human
ucagguagugguuaaguucugu

SEQ ID NO: 73798 - RNA, 22 nt, Human
ugagaauuuaacuugauuagga

SEQ ID NO: 73799 - RNA, 18 nt, Human
ucagggaaacuuugccug

SEQ ID NO: 73800 - RNA, 22 nt, Human
ucuucaguaaucgacauuccac

SEQ ID NO: 73801 - RNA, 22 nt, Human
ucuucaugaaauugauugcuua

SEQ ID NO: 73802 - RNA, 22 nt, Human
ucaguaagauugauauuucccc

SEQ ID NO: 73803 - RNA, 22 nt, Human
ugagacugaguuugguuuuguu

SEQ ID NO: 73804 - RNA, 22 nt, Human
ugagacuuggggggcugagggc

SEQ ID NO: 73805 - RNA, 22 nt, Human
ucagucauacuuuaugauugaa

SEQ ID NO: 73806 - RNA, 22 nt, Human
ugagagguagaacuuguagugu

SEQ ID NO: 73807 - RNA, 22 nt, Human
ugauuugaaaccuuuggcaaga

SEQ ID NO: 73808 - RNA, 22 nt, Human
ugauuugauuuguuuaugccug

SEQ ID NO: 73809 - RNA, 22 nt, Human
uccaggagucagacagauggug

SEQ ID NO: 73810 - RNA, 22 nt, Human
uccagcugugcuccaggaggug

SEQ ID NO: 73811 - RNA, 22 nt, Human
uccagccauaucuuguagcccu

SEQ ID NO: 73812 - RNA, 22 nt, Human
ucccucuccugucugcuucuuu

SEQ ID NO: 73813 - RNA, 21 nt, Human
uccccugugccuggcauacag

SEQ ID NO: 73814 - RNA, 22 nt, Human
ugcacacaguucucaggaaaga

SEQ ID NO: 73815 - RNA, 22 nt, Human
ugcaggaacucgaaaacuauag

SEQ ID NO: 73816 - RNA, 22 nt, Human
ugcaggagaaaguacggagcgu

SEQ ID NO: 73817 - RNA, 22 nt, Human
ucccugagagacuucuuuggcu

SEQ ID NO: 73818 - RNA, 21 nt, Human
ucccugcagccccaggccccc

SEQ ID NO: 73819 - RNA, 22 nt, Human
ucccugcaggcauguacucuga

SEQ ID NO: 73820 - RNA, 22 nt, Human
ucccugcugggcgaucuucucu

SEQ ID NO: 73821 - RNA, 22 nt, Human
ugcauuuucuaccacacccacu

SEQ ID NO: 73822 - RNA, 22 nt, Human
ugcauuuugaaggaaaaaaaug

SEQ ID NO: 73823 - RNA, 22 nt, Human
ugcauuuuuaauuuggaaaaaa

SEQ ID NO: 73824 - RNA, 22 nt, Human
ugcaugguuauauacuacuagu

SEQ ID NO: 73825 - RNA, 22 nt, Human
uccucagagacaaguugagagg

SEQ ID NO: 73826 - RNA, 22 nt, Human
uccucacaugcaaaaugguauu

SEQ ID NO: 73827 - RNA, 22 nt, Human
uccuagaccuacugaaucagac

SEQ ID NO: 73828 - RNA, 20 nt, Human
uccuacauugacccucuucc

SEQ ID NO: 73829 - RNA, 22 nt, Human
ugcaucccugaggcauuauccu

SEQ ID NO: 73830 - RNA, 22 nt, Human
uccucuccaggugagccgaaau

SEQ ID NO: 73831 - RNA, 22 nt, Human
ugcauuugcaauggguacacaa

SEQ ID NO: 73832 - RNA, 22 nt, Human
uccuuuauuuaugggcagugua

SEQ ID NO: 73833 - RNA, 21 nt, Human
ugccuggccuuugcuuuuccu

SEQ ID NO: 73834 - RNA, 22 nt, Human
uccuuguucugauuuuucuggg

SEQ ID NO: 73835 - RNA, 22 nt, Human
ugccuucugccaaggacggugc

SEQ ID NO: 73836 - RNA, 22 nt, Human
ugccucuccaagcuuccuaagg

SEQ ID NO: 73837 - RNA, 22 nt, Human
ucgagcacaccagacuugcaga

SEQ ID NO: 73838 - RNA, 22 nt, Human
uccuuguaccauuugcucacag

SEQ ID NO: 73839 - RNA, 19 nt, Human
uccuugacuguauucagag

SEQ ID NO: 73840 - RNA, 22 nt, Human
uccuugaauugcguccacaaga

SEQ ID NO: 73841 - RNA, 22 nt, Human
ugccucucucugucauuaugcu

SEQ ID NO: 73842 - RNA, 22 nt, Human
ugccuaaaccauuccccuuccu

SEQ ID NO: 73843 - RNA, 22 nt, Human
ucuauauucuauguucuucuuu

SEQ ID NO: 73844 - RNA, 22 nt, Human
ucuaggaguugauaaaagggcu

SEQ ID NO: 73845 - RNA, 22 nt, Human
ugcugcuguuuccuacaucuca

SEQ ID NO: 73846 - RNA, 22 nt, Human
ugcugcuguuaucauuuuacca

SEQ ID NO: 73847 - RNA, 22 nt, Human
ugcugcggauauacaggaucug

SEQ ID NO: 73848 - RNA, 21 nt, Human
ucucaagguaacauuuaagau

SEQ ID NO: 73849 - RNA, 23 nt, Human
ucucaccaggauaugacugucac

SEQ ID NO: 73850 - RNA, 22 nt, Human
ucucaccuagucuuggaggucu

SEQ ID NO: 73851 - RNA, 23 nt, Human
ucucacucauucuccucugucca

SEQ ID NO: 73852 - RNA, 22 nt, Human
ucuaguguuaaggcaaaguaaa

SEQ ID NO: 73853 - RNA, 22 nt, Human
ucucacucuuccccaugucaga

SEQ ID NO: 73854 - RNA, 22 nt, Human
ucuauuauauuuacacgagagu

SEQ ID NO: 73855 - RNA, 22 nt, Human
ucuauuguuauccuuuccauuu

SEQ ID NO: 73856 - RNA, 22 nt, Human
ucuccucuuaaugcacguuucc

SEQ ID NO: 73857 - RNA, 22 nt, Human
ucuccugacaccucuugugggg

SEQ ID NO: 73858 - RNA, 22 nt, Human
ucuccucucugaucuugcuccg

SEQ ID NO: 73859 - RNA, 22 nt, Human
ucuccucuauuucuguauguau

SEQ ID NO: 73860 - RNA, 20 nt, Human
ugcugugugucuacuguggg

SEQ ID NO: 73861 - RNA, 20 nt, Human
ugcuguggguaagcuuuaua

SEQ ID NO: 73862 - RNA, 22 nt, Human
ugcugugcuggcggcagaggcc

SEQ ID NO: 73863 - RNA, 22 nt, Human
ucuccccucuggucugggcucu

SEQ ID NO: 73864 - RNA, 22 nt, Human
ucucccaaaucuuucuagcaca

SEQ ID NO: 73865 - RNA, 22 nt, Human
ugcuguacaagacccucuguuu

SEQ ID NO: 73866 - RNA, 22 nt, Human
ugcuggagucucuugacccugg

SEQ ID NO: 73867 - RNA, 22 nt, Human
ugcuggaguggcacuguguggc

SEQ ID NO: 73868 - RNA, 22 nt, Human
ugcugggagcugggccucgaca

SEQ ID NO: 73869 - RNA, 22 nt, Human
ugcugcucuucaccauggccuc

SEQ ID NO: 73870 - RNA, 22 nt, Human
ucugagugggaacucucaugac

SEQ ID NO: 73871 - RNA, 22 nt, Human
uggaaaagaugucuuccugaau

SEQ ID NO: 73872 - RNA, 22 nt, Human
ucugaccccccuugccuccacu

SEQ ID NO: 73873 - RNA, 22 nt, Human
ugcuuuuggcagcaguguuuau

SEQ ID NO: 73874 - RNA, 22 nt, Human
ugcuuuuguaucagaguauuca

SEQ ID NO: 73875 - RNA, 21 nt, Human
ugcuuucugugcuuuuucugc

SEQ ID NO: 73876 - RNA, 22 nt, Human
ucucuuuuuuuaaaacucuaug

SEQ ID NO: 73877 - RNA, 22 nt, Human
ucugaaaggagaguagggcaga

SEQ ID NO: 73878 - RNA, 18 nt, Human
ucugaaggaaugauucca

SEQ ID NO: 73879 - RNA, 22 nt, Human
ucugaauauguuuaucaucucu

SEQ ID NO: 73880 - RNA, 22 nt, Human
ugcuuucaaugaauuguauacu

SEQ ID NO: 73881 - RNA, 20 nt, Human
ucucuuuuucuucuuuucuc

SEQ ID NO: 73882 - RNA, 22 nt, Human
ucucuugcuauugcgaacaggu

SEQ ID NO: 73883 - RNA, 22 nt, Human
ucucugaggaagcgaucuuuag

SEQ ID NO: 73884 - RNA, 22 nt, Human
ucucuggcuuuuuuuccauuuu

SEQ ID NO: 73885 - RNA, 22 nt, Human
ugcuuguuuguuuucuuccauu

SEQ ID NO: 73886 - RNA, 22 nt, Human
ucucuggacggacauuuaaggu

SEQ ID NO: 73887 - RNA, 22 nt, Human
ucucucucucuuccagcauguu

SEQ ID NO: 73888 - RNA, 22 nt, Human
ucucuacuuggcuuguguucac

SEQ ID NO: 73889 - RNA, 22 nt, Human
ucucuacugcuucugugaguga

SEQ ID NO: 73890 - RNA, 22 nt, Human
ucuccuuuggggccucaggguu

SEQ ID NO: 73891 - RNA, 20 nt, Human
ucucuaacaugaaugcuauc

SEQ ID NO: 73892 - RNA, 17 nt, Human
ucuccuggcucuaucag

SEQ ID NO: 73893 - RNA, 22 nt, Human
ucuccuuuacuggcuccuuuug

SEQ ID NO: 73894 - RNA, 22 nt, Human
ugcuucuuugggggugaagaga

SEQ ID NO: 73895 - RNA, 22 nt, Human
ucucuagcuuccuuaggaacac

SEQ ID NO: 73896 - RNA, 22 nt, Human
ucucucagauuguuuccauuuu

SEQ ID NO: 73897 - RNA, 22 nt, Human
ucucuccauguuuucuguccag

SEQ ID NO: 73898 - RNA, 22 nt, Human
ugcuucuuuaggauguaguuau

SEQ ID NO: 73899 - RNA, 22 nt, Human
ugcuucucucuaggaagacgcu

SEQ ID NO: 73900 - RNA, 22 nt, Human
ucuucaaauacagucauauuga

SEQ ID NO: 73901 - RNA, 22 nt, Human
ucuucaggaaaaccaaaguugu

SEQ ID NO: 73902 - RNA, 20 nt, Human
uggaugacuucaggcagccu

SEQ ID NO: 73903 - RNA, 22 nt, Human
uggaucaugcgaggccuccccu

SEQ ID NO: 73904 - RNA, 22 nt, Human
uggcaacucaauuucuacaaga

SEQ ID NO: 73905 - RNA, 22 nt, Human
uggcaaaaccugcaauuacuuu

SEQ ID NO: 73906 - RNA, 22 nt, Human
ucuuccuuacucuggauguuau

SEQ ID NO: 73907 - RNA, 22 nt, Human
ucuuccucuccuggggcauuug

SEQ ID NO: 73908 - RNA, 22 nt, Human
ucuucuauaucuacauaugcaa

SEQ ID NO: 73909 - RNA, 22 nt, Human
ucuucuuacauuaaguugaaac

SEQ ID NO: 73910 - RNA, 22 nt, Human
uggcaaggccacaggugcaguu

SEQ ID NO: 73911 - RNA, 22 nt, Human
ucuucauuucuggggaauuggc

SEQ ID NO: 73912 - RNA, 22 nt, Human
ucuuccaaacaaaaaucugugu

SEQ ID NO: 73913 - RNA, 19 nt, Human
ucuuccaucuauccuccuc

SEQ ID NO: 73914 - RNA, 22 nt, Human
ucuuccacuugaaccuucuguc

SEQ ID NO: 73915 - RNA, 22 nt, Human
uggcuacauuuauacucucauu

SEQ ID NO: 73916 - RNA, 22 nt, Human
ucuuugcagaauuuaacuuugc

SEQ ID NO: 73917 - RNA, 22 nt, Human
ucuuuaucugugagcagucucc

SEQ ID NO: 73918 - RNA, 22 nt, Human
uggccgaugagcaugcgcugau

SEQ ID NO: 73919 - RNA, 22 nt, Human
uggcauuugagcuggaaggaug

SEQ ID NO: 73920 - RNA, 22 nt, Human
ucuugcucuguucuaaaggauu

SEQ ID NO: 73921 - RNA, 22 nt, Human
ucuucuuauuuuaugaucgcuu

SEQ ID NO: 73922 - RNA, 22 nt, Human
uggagucagaaugcgacaggcc

SEQ ID NO: 73923 - RNA, 23 nt, Human
uggaaguugagagucugcuuugu

SEQ ID NO: 73924 - RNA, 22 nt, Human
ucuguaauccacacagguggau

SEQ ID NO: 73925 - RNA, 22 nt, Human
ucuguagcuaauucucuuuaaa

SEQ ID NO: 73926 - RNA, 22 nt, Human
ucuguaguaugguacuuauuua

SEQ ID NO: 73927 - RNA, 22 nt, Human
uggagaaauaacauuuggauuc

SEQ ID NO: 73928 - RNA, 22 nt, Human
ucugucaguguccucguguggu

SEQ ID NO: 73929 - RNA, 22 nt, Human
ucuguuuuucagaccuuuuugg

SEQ ID NO: 73930 - RNA, 22 nt, Human
ucuguuuuuaucuauucuguua

SEQ ID NO: 73931 - RNA, 22 nt, Human
ucuguuuacaugucagcagcaa

SEQ ID NO: 73932 - RNA, 22 nt, Human
ucuguucacaauuacacacacu

SEQ ID NO: 73933 - RNA, 21 nt, Human
uggauauugaguaguuucuga

SEQ ID NO: 73934 - RNA, 22 nt, Human
ucuggugcacucugauauuuga

SEQ ID NO: 73935 - RNA, 19 nt, Human
uggaagugauaguauagua

SEQ ID NO: 73936 - RNA, 22 nt, Human
ucugcuggugucauuuuugcua

SEQ ID NO: 73937 - RNA, 22 nt, Human
ucugcuguugaucaugacuagc

SEQ ID NO: 73938 - RNA, 22 nt, Human
uggaagcuagggguuucuguug

SEQ ID NO: 73939 - RNA, 20 nt, Human
uggaaggaaagguguaucuu

SEQ ID NO: 73940 - RNA, 22 nt, Human
ucugauaaggaaggauuaaaag

SEQ ID NO: 73941 - RNA, 17 nt, Human
ucugcagaggcaaaccu

SEQ ID NO: 73942 - RNA, 23 nt, Human
uggaagaaaaugguuuggcugug

SEQ ID NO: 73943 - RNA, 22 nt, Human
ucugaucuuucauccuaaaugg

SEQ ID NO: 73944 - RNA, 22 nt, Human
ugcaucuaaguggcuaacaacc

SEQ ID NO: 73945 - RNA, 22 nt, Human
ugcaucccaaacaugguuuccu

SEQ ID NO: 73946 - RNA, 17 nt, Human
ugcaugcgucugugaua

SEQ ID NO: 73947 - RNA, 23 nt, Human
ugcaugagcaucuccaccucagu

SEQ ID NO: 73948 - RNA, 22 nt, Human
ugcagcuuuugguuucuagaug

SEQ ID NO: 73949 - RNA, 22 nt, Human
ugugauaauauuauuagagcuc

SEQ ID NO: 73950 - RNA, 22 nt, Human
ugcagccuuuguccuugggcua

SEQ ID NO: 73951 - RNA, 22 nt, Human
uguguggaaaugcuguauaugu

SEQ ID NO: 73952 - RNA, 22 nt, Human
ugugugcuaguuuugucaguau

SEQ ID NO: 73953 - RNA, 22 nt, Human
ugccagcuccgaggagcugcag

SEQ ID NO: 73954 - RNA, 22 nt, Human
ugcauuacuuugauaagcgucu

SEQ ID NO: 73955 - RNA, 22 nt, Human
ugcauguuauuguggcaagaau

SEQ ID NO: 73956 - RNA, 22 nt, Human
ugcauguuucuguauguuaaug

SEQ ID NO: 73957 - RNA, 23 nt, Human
ugccaggaagaaugaccucugcu

SEQ ID NO: 73958 - RNA, 22 nt, Human
ugugauaaaggcccgcagaucc

SEQ ID NO: 73959 - RNA, 22 nt, Human
ugcagcaucuccuugugccaug

SEQ ID NO: 73960 - RNA, 22 nt, Human
ugugaaugacuguguucuuugc

SEQ ID NO: 73961 - RNA, 22 nt, Human
ugucuuuagagugaacagaaga

SEQ ID NO: 73962 - RNA, 19 nt, Human
ugcagcacuaaaaacuuuc

SEQ ID NO: 73963 - RNA, 22 nt, Human
ugucuuugaccuuaagaaguuu

SEQ ID NO: 73964 - RNA, 22 nt, Human
ugucuuucuuucucuugacaga

SEQ ID NO: 73965 - RNA, 22 nt, Human
ugcagaauauucuggugacaau

SEQ ID NO: 73966 - RNA, 22 nt, Human
ugucucuagggcagauagagug

SEQ ID NO: 73967 - RNA, 20 nt, Human
ugucccuggagagcugcaga

SEQ ID NO: 73968 - RNA, 22 nt, Human
ugucccuggacuccaggagcca

SEQ ID NO: 73969 - RNA, 22 nt, Human
ugcaagugccauggauucaggu

SEQ ID NO: 73970 - RNA, 22 nt, Human
ugucauggacuggauuucugcu

SEQ ID NO: 73971 - RNA, 21 nt, Human
ugucagaaagccugugacuuu

SEQ ID NO: 73972 - RNA, 22 nt, Human
ugcaaauuuuuuuauuuuuccu

SEQ ID NO: 73973 - RNA, 21 nt, Human
ugucaucucuaaaaagauugu

SEQ ID NO: 73974 - RNA, 22 nt, Human
ugauuuagguauuuucuuuugu

SEQ ID NO: 73975 - RNA, 22 nt, Human
ugauuucauaugacagcuuuuu

SEQ ID NO: 73976 - RNA, 22 nt, Human
uguagacaugcuuuucugauga

SEQ ID NO: 73977 - RNA, 22 nt, Human
ugaugcuagaacuuccaagaua

SEQ ID NO: 73978 - RNA, 22 nt, Human
ugauuuguuuaaauugcucguu

SEQ ID NO: 73979 - RNA, 22 nt, Human
ugucacagagcgugcaacagaa

SEQ ID NO: 73980 - RNA, 22 nt, Human
ugucacagugcacagcuaagaa

SEQ ID NO: 73981 - RNA, 22 nt, Human
ugaucuuugcuuuuggcuuagu

SEQ ID NO: 73982 - RNA, 22 nt, Human
ugauaugguaauaagauauucu

SEQ ID NO: 73983 - RNA, 22 nt, Human
ugguuuuuuguaggauaaacau

SEQ ID NO: 73984 - RNA, 21 nt, Human
ugguuuuaucuugguggcugc

SEQ ID NO: 73985 - RNA, 21 nt, Human
ugagucuuagagaacuucagg

SEQ ID NO: 73986 - RNA, 22 nt, Human
ugagucuguugcuagggggaau

SEQ ID NO: 73987 - RNA, 22 nt, Human
ugaggaugaggaagaagaagaa

SEQ ID NO: 73988 - RNA, 22 nt, Human
ugguuauauaaggauuaaauac

SEQ ID NO: 73989 - RNA, 22 nt, Human
ugguuauggaacuggcuauggc

SEQ ID NO: 73990 - RNA, 22 nt, Human
ugguucuagaugagaugaugag

SEQ ID NO: 73991 - RNA, 22 nt, Human
uggugcuuuuguggaugcuaac

SEQ ID NO: 73992 - RNA, 22 nt, Human
uggucucuacggaggaaagcug

SEQ ID NO: 73993 - RNA, 22 nt, Human
uggugcucucgauauauaaggc

SEQ ID NO: 73994 - RNA, 22 nt, Human
uggucucaaagcaaggaaggaa

SEQ ID NO: 73995 - RNA, 22 nt, Human
uggucuccucuuaauugccuac

SEQ ID NO: 73996 - RNA, 20 nt, Human
uggucucuugaaagaggcuc

SEQ ID NO: 73997 - RNA, 22 nt, Human
ugagcaaacacagauaggcuua

SEQ ID NO: 73998 - RNA, 22 nt, Human
ugagauucuguucagaaaaaug

SEQ ID NO: 73999 - RNA, 22 nt, Human
ugagauguaauguaguacuuug

SEQ ID NO: 74000 - RNA, 22 nt, Human
ugagauuuagaacuggauuuca

SEQ ID NO: 74001 - RNA, 22 nt, Human
ugagagaggugaaaugacuuuc

SEQ ID NO: 74002 - RNA, 22 nt, Human
ugagagaauuacuaaagggcuu

SEQ ID NO: 74003 - RNA, 22 nt, Human
ugagaggaagggaaagaugauu

SEQ ID NO: 74004 - RNA, 22 nt, Human
ugguauaaaaauuugugaaugu

SEQ ID NO: 74005 - RNA, 23 nt, Human
ugagacacuggaaggcaagaaaa

SEQ ID NO: 74006 - RNA, 22 nt, Human
uggucaaauccuagauccuuug

SEQ ID NO: 74007 - RNA, 22 nt, Human
ugagaacacuuuucucuuugcu

SEQ ID NO: 74008 - RNA, 22 nt, Human
ugagaagaggucuuuugggaug

SEQ ID NO: 74009 - RNA, 22 nt, Human
ugagaaauauacaccagacaca

SEQ ID NO: 74010 - RNA, 20 nt, Human
ugagaaacaagggcuggucu

SEQ ID NO: 74011 - RNA, 22 nt, Human
ugagaagucagucuauugugaa

SEQ ID NO: 74012 - RNA, 22 nt, Human
ugguauaaaaaaaugaguauaa

SEQ ID NO: 74013 - RNA, 22 nt, Human
ugagaaaacaguuuguaauaau

SEQ ID NO: 74014 - RNA, 22 nt, Human
ugacuuauuaaaaguuuuuauu

SEQ ID NO: 74015 - RNA, 22 nt, Human
ugggugccgcaucuugcuguuc

SEQ ID NO: 74016 - RNA, 22 nt, Human
uggguagggagcuggaauccua

SEQ ID NO: 74017 - RNA, 22 nt, Human
ucuuuugugauuuucugaagca

SEQ ID NO: 74018 - RNA, 22 nt, Human
ucuuuuuaugucaaaaucgaug

SEQ ID NO: 74019 - RNA, 22 nt, Human
ugaaaaaugcuuuaaugcaugu

SEQ ID NO: 74020 - RNA, 22 nt, Human
ucuuuuucccugguuccuuuuu

SEQ ID NO: 74021 - RNA, 22 nt, Human
uuacuguguguaaaauaucuuu

SEQ ID NO: 74022 - RNA, 22 nt, Human
uuacuggaauauaaagauaaga

SEQ ID NO: 74023 - RNA, 22 nt, Human
uggaaaacgcaguuuaauuuuu

SEQ ID NO: 74024 - RNA, 21 nt, Human
ugcuuuuguugucagcugcug

SEQ ID NO: 74025 - RNA, 22 nt, Human
uuacucucugaggcacucaaaa

SEQ ID NO: 74026 - RNA, 22 nt, Human
ugcuuuggcccaacauugaugc

SEQ ID NO: 74027 - RNA, 22 nt, Human
uuaccuuuucuuguuuacaagu

SEQ ID NO: 74028 - RNA, 22 nt, Human
uuaccuuggaccggguaucaga

SEQ ID NO: 74029 - RNA, 21 nt, Human
uuacuaagagagcagagggac

SEQ ID NO: 74030 - RNA, 22 nt, Human
uuaccgagaacaugacuggaau

SEQ ID NO: 74031 - RNA, 19 nt, Human
uuacaugacauaugaagga

SEQ ID NO: 74032 - RNA, 22 nt, Human
uuacaagaucuuugaaggcaag

SEQ ID NO: 74033 - RNA, 22 nt, Human
ugcuuuauucgacaucugguag

SEQ ID NO: 74034 - RNA, 22 nt, Human
ugcuuuaccuuccauuuaagga

SEQ ID NO: 74035 - RNA, 22 nt, Human
uuaccuaagaaacucauuucgu

SEQ ID NO: 74036 - RNA, 22 nt, Human
ugcuuucagauaucuguuucaa

SEQ ID NO: 74037 - RNA, 22 nt, Human
uuagaugaaaaucggaacaugu

SEQ ID NO: 74038 - RNA, 22 nt, Human
uggaagaaaacuuggaaggcau

SEQ ID NO: 74039 - RNA, 22 nt, Human
uuagauaaaucagcccugagua

SEQ ID NO: 74040 - RNA, 22 nt, Human
uuagauaguaaauagcacuaag

SEQ ID NO: 74041 - RNA, 22 nt, Human
uggaacugauuaaaagggcaga

SEQ ID NO: 74042 - RNA, 22 nt, Human
uggaaauaguugugagucaggc

SEQ ID NO: 74043 - RNA, 22 nt, Human
uuagagagguuggagugguaga

SEQ ID NO: 74044 - RNA, 22 nt, Human
uuagagauuuuauguuaaugua

SEQ ID NO: 74045 - RNA, 17 nt, Human
uuagagcuacauguuga

SEQ ID NO: 74046 - RNA, 22 nt, Human
uuacuuaucugaugugauuuuu

SEQ ID NO: 74047 - RNA, 22 nt, Human
uuacuguaggugggugaauuug

SEQ ID NO: 74048 - RNA, 22 nt, Human
uuacuuuuuucccccuuagaug

SEQ ID NO: 74049 - RNA, 22 nt, Human
uuacuuucugggauaucaaaug

SEQ ID NO: 74050 - RNA, 22 nt, Human
uuagaaauguccuacuaauaug

SEQ ID NO: 74051 - RNA, 22 nt, Human
uggaaagaagacugugguugag

SEQ ID NO: 74052 - RNA, 22 nt, Human
uggaaaauuuagaaagauuuau

SEQ ID NO: 74053 - RNA, 22 nt, Human
uuagagaauagacuuuacccug

SEQ ID NO: 74054 - RNA, 22 nt, Human
uuagagagaggagagagagaga

SEQ ID NO: 74055 - RNA, 22 nt, Human
uuagaauggaaucauuugcauu

SEQ ID NO: 74056 - RNA, 22 nt, Human
uggaaauacaagaaguauguca

SEQ ID NO: 74057 - RNA, 22 nt, Human
uggagagaaguucuauaaauca

SEQ ID NO: 74058 - RNA, 22 nt, Human
uggagagauagucauucuagag

SEQ ID NO: 74059 - RNA, 22 nt, Human
uggacuguucauugauacugga

SEQ ID NO: 74060 - RNA, 22 nt, Human
uggagaugcacgagcaggugga

SEQ ID NO: 74061 - RNA, 22 nt, Human
uuaucugugcuuuacugacaga

SEQ ID NO: 74062 - RNA, 22 nt, Human
uuaucuguuuuaaugaauaauu

SEQ ID NO: 74063 - RNA, 22 nt, Human
uuauaaguaagggucucuggca

SEQ ID NO: 74064 - RNA, 22 nt, Human
uggacacugguggauauggaau

SEQ ID NO: 74065 - RNA, 22 nt, Human
uuauaucagaaggugagauuga

SEQ ID NO: 74066 - RNA, 22 nt, Human
uuauauuaaaaaucgcuaacag

SEQ ID NO: 74067 - RNA, 22 nt, Human
uggaauuaucugaagugauuug

SEQ ID NO: 74068 - RNA, 22 nt, Human
uuauaagugccucuuuauuuuc

SEQ ID NO: 74069 - RNA, 22 nt, Human
uuagugaagaagcaucuuuagu

SEQ ID NO: 74070 - RNA, 22 nt, Human
uuaguccuaaauuuagauuuuc

SEQ ID NO: 74071 - RNA, 22 nt, Human
uggaagucuucucucccaugga

SEQ ID NO: 74072 - RNA, 22 nt, Human
uggaaggaaauguguaucauaa

SEQ ID NO: 74073 - RNA, 22 nt, Human
uggaagcccagaaggaagcaga

SEQ ID NO: 74074 - RNA, 22 nt, Human
uuagucauucccucuugauauu

SEQ ID NO: 74075 - RNA, 22 nt, Human
uggaagaaaugguugagccaug

SEQ ID NO: 74076 - RNA, 22 nt, Human
uuaguauuuuuugaaugaugaa

SEQ ID NO: 74077 - RNA, 22 nt, Human
uuaggcuaauagagauggaaug

SEQ ID NO: 74078 - RNA, 22 nt, Human
uuaggcuuuauugaaaacaaua

SEQ ID NO: 74079 - RNA, 22 nt, Human
uuaguauuuucaccauaugagg

SEQ ID NO: 74080 - RNA, 22 nt, Human
uuaggaauugcuucauguuugg

SEQ ID NO: 74081 - RNA, 22 nt, Human
uuagccuccaguuuucucauuu

SEQ ID NO: 74082 - RNA, 22 nt, Human
ugcuuaucuccuuaguuuuugc

SEQ ID NO: 74083 - RNA, 22 nt, Human
ugcuucucacuucuugguuucc

SEQ ID NO: 74084 - RNA, 22 nt, Human
ugcuuacgcaaccuguguuugg

SEQ ID NO: 74085 - RNA, 22 nt, Human
ugcuuagcggugggggcuccau

SEQ ID NO: 74086 - RNA, 22 nt, Human
uuaacauuguccuuagcagauu

SEQ ID NO: 74087 - RNA, 22 nt, Human
uuaauguugacacacuagcaca

SEQ ID NO: 74088 - RNA, 22 nt, Human
uuaaugcauguaaaugugcaaa

SEQ ID NO: 74089 - RNA, 22 nt, Human
ugcuucuuuccuuggugacuuc

SEQ ID NO: 74090 - RNA, 22 nt, Human
ugcuuggagaaucagucccagc

SEQ ID NO: 74091 - RNA, 22 nt, Human
ugcuugcuaucuaaguguuuca

SEQ ID NO: 74092 - RNA, 22 nt, Human
ugcuugaacccaggaaguggag

SEQ ID NO: 74093 - RNA, 22 nt, Human
uuaaggcauagcuuguguugac

SEQ ID NO: 74094 - RNA, 22 nt, Human
uuaaggcuguggggauuacugc

SEQ ID NO: 74095 - RNA, 23 nt, Human
uuaaggugccguguaauucaugc

SEQ ID NO: 74096 - RNA, 22 nt, Human
ugcugugagaccauuuguugag

SEQ ID NO: 74097 - RNA, 23 nt, Human
uuaagacuggcugaacuuaguag

SEQ ID NO: 74098 - RNA, 22 nt, Human
ugcuggagccauguuuucucua

SEQ ID NO: 74099 - RNA, 22 nt, Human
uuaaagaguuuauuacuuguaa

SEQ ID NO: 74100 - RNA, 22 nt, Human
ugcuggaaggguaguauuaacu

SEQ ID NO: 74101 - RNA, 22 nt, Human
ugcugcggcgcaggcacuccag

SEQ ID NO: 74102 - RNA, 22 nt, Human
ugcugcucaagcugcagcaaaa

SEQ ID NO: 74103 - RNA, 23 nt, Human
ugcugcuggaguaucuacaaugc

SEQ ID NO: 74104 - RNA, 22 nt, Human
uuaaaagaauccuguuauccuc

SEQ ID NO: 74105 - RNA, 21 nt, Human
uguuugcuuuuggagcaacug

SEQ ID NO: 74106 - RNA, 22 nt, Human
uguuuuuagcuguuuuuuggau

SEQ ID NO: 74107 - RNA, 22 nt, Human
uguuuucccacugguuuguaca

SEQ ID NO: 74108 - RNA, 21 nt, Human
uguuuuguaauagauacuaug

SEQ ID NO: 74109 - RNA, 22 nt, Human
uguuuuucaagcauuuauuaau

SEQ ID NO: 74110 - RNA, 22 nt, Human
uguuuuuuagagugauacuuuu

SEQ ID NO: 74111 - RNA, 22 nt, Human
ugcucuuuguagcugcuuugcu

SEQ ID NO: 74112 - RNA, 22 nt, Human
uguuucguugguggagagcuac

SEQ ID NO: 74113 - RNA, 22 nt, Human
uguuugagaauuugcugauguu

SEQ ID NO: 74114 - RNA, 22 nt, Human
ugcucuuucaggcauagaccuu

SEQ ID NO: 74115 - RNA, 23 nt, Human
uguuguccaacugaucuccaggc

SEQ ID NO: 74116 - RNA, 22 nt, Human
ugcucugcuaggagaagaauga

SEQ ID NO: 74117 - RNA, 22 nt, Human
ugcucuguuuuaacucuuucaa

SEQ ID NO: 74118 - RNA, 22 nt, Human
ugcucuguucaguguaucuugu

SEQ ID NO: 74119 - RNA, 22 nt, Human
ugcucgauuauuucauuuugca

SEQ ID NO: 74120 - RNA, 21 nt, Human
uguuggccuucauucucuguc

SEQ ID NO: 74121 - RNA, 22 nt, Human
uguuggugcacugaaaggcagg

SEQ ID NO: 74122 - RNA, 22 nt, Human
ugcuccguucuucugcuucuug

SEQ ID NO: 74123 - RNA, 22 nt, Human
uguuggaaucuucuagucuucc

SEQ ID NO: 74124 - RNA, 22 nt, Human
uguguguguguguguaauauau

SEQ ID NO: 74125 - RNA, 22 nt, Human
uucgcucuucacacagugcuga

SEQ ID NO: 74126 - RNA, 22 nt, Human
uucgucaauaugcagccuguga

SEQ ID NO: 74127 - RNA, 22 nt, Human
uuccuuuucuucuaccacaugu

SEQ ID NO: 74128 - RNA, 22 nt, Human
uuccuuuuuaauuaaucuaauu

SEQ ID NO: 74129 - RNA, 21 nt, Human
uuccuggaggcagaaacguga

SEQ ID NO: 74130 - RNA, 22 nt, Human
uucccuacuagccuuaauguuu

SEQ ID NO: 74131 - RNA, 21 nt, Human
uuccuaaaaugcuuuugugcc

SEQ ID NO: 74132 - RNA, 22 nt, Human
uucccuagagagauuuuuauuc

SEQ ID NO: 74133 - RNA, 22 nt, Human
uuccucauucuggggcauguug

SEQ ID NO: 74134 - RNA, 22 nt, Human
ugggagagauaggcuucuggac

SEQ ID NO: 74135 - RNA, 22 nt, Human
uuccucauuuauaggaaagaga

SEQ ID NO: 74136 - RNA, 22 nt, Human
uuccucauuuggcacaucugag

SEQ ID NO: 74137 - RNA, 22 nt, Human
ugggaacuggaaaaaaugaagu

SEQ ID NO: 74138 - RNA, 22 nt, Human
ugggaaacucuaaacuugagua

SEQ ID NO: 74139 - RNA, 22 nt, Human
uggcuuuuuucuccccuuggau

SEQ ID NO: 74140 - RNA, 22 nt, Human
uggcuuuuuauuccuaugugau

SEQ ID NO: 74141 - RNA, 22 nt, Human
uuccaaggcugcuauuuguuuc

SEQ ID NO: 74142 - RNA, 22 nt, Human
uuccaacaugugcuuguguuga

SEQ ID NO: 74143 - RNA, 22 nt, Human
uuccacauucggaauuuucuga

SEQ ID NO: 74144 - RNA, 22 nt, Human
uucauuuuauauuagagcuguu

SEQ ID NO: 74145 - RNA, 22 nt, Human
uuaugguuuaauauccagcaca

SEQ ID NO: 74146 - RNA, 22 nt, Human
uuauggauuagaguuugauucu

SEQ ID NO: 74147 - RNA, 22 nt, Human
uuaugcaaaggggccucuuccu

SEQ ID NO: 74148 - RNA, 22 nt, Human
uggagcugaaguacucucacua

SEQ ID NO: 74149 - RNA, 19 nt, Human
uucugguacauacugccug

SEQ ID NO: 74150 - RNA, 22 nt, Human
uucuggugauuugccucuuuag

SEQ ID NO: 74151 - RNA, 22 nt, Human
ugguauauuugaccauaugugu

SEQ ID NO: 74152 - RNA, 22 nt, Human
uucuguacuagaucuuaucagu

SEQ ID NO: 74153 - RNA, 22 nt, Human
ugguaaaugucuaacaaucacu

SEQ ID NO: 74154 - RNA, 19 nt, Human
uucugcucaguaacacccu

SEQ ID NO: 74155 - RNA, 23 nt, Human
uucugcuucccauagcacuuugu

SEQ ID NO: 74156 - RNA, 17 nt, Human
uucugcucaggaacaga

SEQ ID NO: 74157 - RNA, 22 nt, Human
ugguaaaguguacugaauauga

SEQ ID NO: 74158 - RNA, 22 nt, Human
ugguacaaaaaagauuuuggac

SEQ ID NO: 74159 - RNA, 22 nt, Human
ugguaauuuaacaaaauuguca

SEQ ID NO: 74160 - RNA, 22 nt, Human
uucucuauuugcugcaccucuc

SEQ ID NO: 74161 - RNA, 22 nt, Human
ugggugggcagagucuaagaua

SEQ ID NO: 74162 - RNA, 22 nt, Human
uggguguggaagcagcgugggg

SEQ ID NO: 74163 - RNA, 20 nt, Human
uggguucaguuguuucuggc

SEQ ID NO: 74164 - RNA, 22 nt, Human
uucuaguuacagaagccuugcu

SEQ ID NO: 74165 - RNA, 22 nt, Human
uucuaguuacucuuaaaugcug

SEQ ID NO: 74166 - RNA, 22 nt, Human
uggggcuggccaggaggagucu

SEQ ID NO: 74167 - RNA, 22 nt, Human
uggggcuauggcccgaccacgu

SEQ ID NO: 74168 - RNA, 22 nt, Human
uggguagcucaauagagccaca

SEQ ID NO: 74169 - RNA, 22 nt, Human
uucuccugcccuuggacuucca

SEQ ID NO: 74170 - RNA, 22 nt, Human
uucuccucuuugucacugcuuu

SEQ ID NO: 74171 - RNA, 22 nt, Human
uucuccucagcaaggcagcuuu

SEQ ID NO: 74172 - RNA, 22 nt, Human
uucuucuuuccuauaauuaauu

SEQ ID NO: 74173 - RNA, 22 nt, Human
uucuugcuucucugucugccuc

SEQ ID NO: 74174 - RNA, 22 nt, Human
uucuugcuuccggugcuccagg

SEQ ID NO: 74175 - RNA, 22 nt, Human
uucuuggcacagaugagauucu

SEQ ID NO: 74176 - RNA, 21 nt, Human
uucuuugcugcuguuuuugua

SEQ ID NO: 74177 - RNA, 23 nt, Human
uggugugaggaaggaagacuuua

SEQ ID NO: 74178 - RNA, 22 nt, Human
uucuccccagcuuucaaaauaa

SEQ ID NO: 74179 - RNA, 22 nt, Human
uggugccuuccgagagcuguga

SEQ ID NO: 74180 - RNA, 22 nt, Human
uucuuaaugcauccuguguuca

SEQ ID NO: 74181 - RNA, 22 nt, Human
uggugcucuugauauauaaggc

SEQ ID NO: 74182 - RNA, 22 nt, Human
uucugugacuccucagagauuu

SEQ ID NO: 74183 - RNA, 22 nt, Human
ugguucugccacuuuccccuug

SEQ ID NO: 74184 - RNA, 22 nt, Human
uguaagaagaaaaccguaugga

SEQ ID NO: 74185 - RNA, 22 nt, Human
uguagaaguuaauugaugagua

SEQ ID NO: 74186 - RNA, 22 nt, Human
uguacuuguaauaucagugaaa

SEQ ID NO: 74187 - RNA, 22 nt, Human
uguaauguuagaaacaauugcu

SEQ ID NO: 74188 - RNA, 22 nt, Human
uguagucucagggagcugcuuc

SEQ ID NO: 74189 - RNA, 22 nt, Human
uguaggcacauguauauauccc

SEQ ID NO: 74190 - RNA, 22 nt, Human
uugaaaucuucccuccugucug

SEQ ID NO: 74191 - RNA, 22 nt, Human
uugaagccaccacuguaaguca

SEQ ID NO: 74192 - RNA, 22 nt, Human
ugugauuucaaagggugucuuu

SEQ ID NO: 74193 - RNA, 22 nt, Human
uugcaugugugaaaugcacaga

SEQ ID NO: 74194 - RNA, 22 nt, Human
uugccaggggacaucuggagcc

SEQ ID NO: 74195 - RNA, 22 nt, Human
uugccaggagacaucuggagcc

SEQ ID NO: 74196 - RNA, 22 nt, Human
uugccuacaaacgaaucuaucu

SEQ ID NO: 74197 - RNA, 22 nt, Human
ugugccuucuucauuuaauuua

SEQ ID NO: 74198 - RNA, 22 nt, Human
uugcccuaccccaggccuuuuu

SEQ ID NO: 74199 - RNA, 22 nt, Human
uugcaucagcaggcauaauugg

SEQ ID NO: 74200 - RNA, 22 nt, Human
uugcaugauuuaagaauaucug

SEQ ID NO: 74201 - RNA, 22 nt, Human
uugcaagauaguguauuuuuca

SEQ ID NO: 74202 - RNA, 20 nt, Human
ugucugguaagacgcccauc

SEQ ID NO: 74203 - RNA, 22 nt, Human
ugucuuaugcugcauagacuau

SEQ ID NO: 74204 - RNA, 22 nt, Human
uugauuccagcguuccaucagc

SEQ ID NO: 74205 - RNA, 22 nt, Human
ugucucuuccuccucuugguac

SEQ ID NO: 74206 - RNA, 22 nt, Human
ugucugaauuguaauguugcgu

SEQ ID NO: 74207 - RNA, 23 nt, Human
uugaucuggaaaauacuuguuug

SEQ ID NO: 74208 - RNA, 22 nt, Human
uugaugagucacuuucuguaaa

SEQ ID NO: 74209 - RNA, 22 nt, Human
uugaugacauuuagcauaauug

SEQ ID NO: 74210 - RNA, 22 nt, Human
uugaggaagggaggcaaaacug

SEQ ID NO: 74211 - RNA, 22 nt, Human
uugaguuuacauuguauuagcc

SEQ ID NO: 74212 - RNA, 22 nt, Human
uugagauggccuuuuuuauacu

SEQ ID NO: 74213 - RNA, 19 nt, Human
uugaauguuugauagucuc

SEQ ID NO: 74214 - RNA, 22 nt, Human
uugaauaguuuuggauagcaua

SEQ ID NO: 74215 - RNA, 22 nt, Human
uuaauucuugagcugucuuucc

SEQ ID NO: 74216 - RNA, 22 nt, Human
uuaauguuuuagaaugagagug

SEQ ID NO: 74217 - RNA, 21 nt, Human
uuaaugcuaugcagaaaaucu

SEQ ID NO: 74218 - RNA, 22 nt, Human
uuaaugcagguacuguuacaau

SEQ ID NO: 74219 - RNA, 22 nt, Human
uuuaaauaguugguuuuuuugc

SEQ ID NO: 74220 - RNA, 23 nt, Human
uuuaaacaauguggucguggugg

SEQ ID NO: 74221 - RNA, 22 nt, Human
uuuaaaauguuuuauuuauuua

SEQ ID NO: 74222 - RNA, 22 nt, Human
uuuaaaacaguacguuuucuua

SEQ ID NO: 74223 - RNA, 22 nt, Human
uuaauauuuauugguaaucacu

SEQ ID NO: 74224 - RNA, 22 nt, Human
uuaauauuaagauauugagugg

SEQ ID NO: 74225 - RNA, 22 nt, Human
uuguuuguaaggcucuuagaau

SEQ ID NO: 74226 - RNA, 22 nt, Human
uuguuuuaaaaagaauaacuac

SEQ ID NO: 74227 - RNA, 22 nt, Human
uuguuuuaguagaaguuacaug

SEQ ID NO: 74228 - RNA, 22 nt, Human
uuuaaaacagcauuuaaaaggu

SEQ ID NO: 74229 - RNA, 22 nt, Human
uuguugcuguugaacccugcug

SEQ ID NO: 74230 - RNA, 22 nt, Human
uuguuucagcuuccuccuccau

SEQ ID NO: 74231 - RNA, 22 nt, Human
uuguuccuuucuucuguagucg

SEQ ID NO: 74232 - RNA, 22 nt, Human
uuaagguggcauacaacacagc

SEQ ID NO: 74233 - RNA, 22 nt, Human
uuaauaaauugugguaccagag

SEQ ID NO: 74234 - RNA, 22 nt, Human
uuguuauuauuauuuucguucu

SEQ ID NO: 74235 - RNA, 20 nt, Human
uuguuagguucaguguuucc

SEQ ID NO: 74236 - RNA, 22 nt, Human
uuguuauaggaucagugucacu

SEQ ID NO: 74237 - RNA, 22 nt, Human
uuaaaauuguuaacuuugguga

SEQ ID NO: 74238 - RNA, 22 nt, Human
uuaacgaauugugcauaauucc

SEQ ID NO: 74239 - RNA, 22 nt, Human
uuaagggauugagauggaauga

SEQ ID NO: 74240 - RNA, 22 nt, Human
uuaagagaagaguaucuagaac

SEQ ID NO: 74241 - RNA, 22 nt, Human
uuuaugucaaaaguaaaaugaa

SEQ ID NO: 74242 - RNA, 22 nt, Human
uuuauguuuguuuuugaaauaa

SEQ ID NO: 74243 - RNA, 22 nt, Human
uuuaguugcuuuaguugagcug

SEQ ID NO: 74244 - RNA, 22 nt, Human
uuuagugagugugaaucaaaug

SEQ ID NO: 74245 - RNA, 22 nt, Human
uuuaguauaguaugugcucaaa

SEQ ID NO: 74246 - RNA, 22 nt, Human
uuuagguuguguucuggcaugu

SEQ ID NO: 74247 - RNA, 22 nt, Human
uuagaguguguguaguagggug

SEQ ID NO: 74248 - RNA, 22 nt, Human
uuagaguucaagcuuuaggaaa

SEQ ID NO: 74249 - RNA, 22 nt, Human
uuagagguuuuuuuccucauuc

SEQ ID NO: 74250 - RNA, 22 nt, Human
uuagaaaaaggcuguggucuua

SEQ ID NO: 74251 - RNA, 22 nt, Human
uuuagcaaaaaagcucugcgua

SEQ ID NO: 74252 - RNA, 22 nt, Human
uuuagagguacaguaggcauga

SEQ ID NO: 74253 - RNA, 22 nt, Human
uuuaaugaugucuaugccuguu

SEQ ID NO: 74254 - RNA, 22 nt, Human
uuacaguuuacauaagaauugu

SEQ ID NO: 74255 - RNA, 22 nt, Human
uuaauuguuagauagauuauag

SEQ ID NO: 74256 - RNA, 22 nt, Human
uuacaacgcacacagauuucac

SEQ ID NO: 74257 - RNA, 18 nt, Human
uuuaauaagccuguuaug

SEQ ID NO: 74258 - RNA, 22 nt, Human
uuuaauauuacacuuaccuugu

SEQ ID NO: 74259 - RNA, 22 nt, Human
uuuaaucaauaaccuccugggu

SEQ ID NO: 74260 - RNA, 22 nt, Human
uuuagaaugaaugcaagagaau

SEQ ID NO: 74261 - RNA, 22 nt, Human
uuuacuauuaguauuucauuuu

SEQ ID NO: 74262 - RNA, 22 nt, Human
uuuaccuuauguaaauaagagu

SEQ ID NO: 74263 - RNA, 18 nt, Human
uugugccugagaaggugg

SEQ ID NO: 74264 - RNA, 22 nt, Human
uguuuuuauucuuaauguuuca

SEQ ID NO: 74265 - RNA, 22 nt, Human
uugugauuaauaacuuuucucu

SEQ ID NO: 74266 - RNA, 22 nt, Human
uugugacuauuuuucauugaag

SEQ ID NO: 74267 - RNA, 22 nt, Human
uguuuuuucccccccuucuaaa

SEQ ID NO: 74268 - RNA, 22 nt, Human
uugucuuggcauaccguuauau

SEQ ID NO: 74269 - RNA, 22 nt, Human
uguuuucuauuaccugagauug

SEQ ID NO: 74270 - RNA, 22 nt, Human
uguuuucuuuccccuucuuuuc

SEQ ID NO: 74271 - RNA, 22 nt, Human
uugucauuuucuuaauguuccu

SEQ ID NO: 74272 - RNA, 22 nt, Human
uugguauucaguuggauuugga

SEQ ID NO: 74273 - RNA, 22 nt, Human
uugggagaaauaguugauccgc

SEQ ID NO: 74274 - RNA, 22 nt, Human
uugggugcugcacccuucaaca

SEQ ID NO: 74275 - RNA, 22 nt, Human
uguuucaguaugauuuucccuc

SEQ ID NO: 74276 - RNA, 22 nt, Human
uguuuagcucugacuaugugau

SEQ ID NO: 74277 - RNA, 22 nt, Human
uguuuaaauagaacauacugca

SEQ ID NO: 74278 - RNA, 22 nt, Human
uguuuaagugguuaaaggauuc

SEQ ID NO: 74279 - RNA, 22 nt, Human
uguuguucuuuuucuucuuguu

SEQ ID NO: 74280 - RNA, 22 nt, Human
uugucaggaacuaugauuaugc

SEQ ID NO: 74281 - RNA, 22 nt, Human
uugucaagauauuuuaggaggc

SEQ ID NO: 74282 - RNA, 22 nt, Human
uguucugaggaggguuucaagg

SEQ ID NO: 74283 - RNA, 22 nt, Human
uguuccuggggaccugccuucc

SEQ ID NO: 74284 - RNA, 22 nt, Human
uguucuuaacuuuuguguauau

SEQ ID NO: 74285 - RNA, 22 nt, Human
uguuccaacuacugaauuggca

SEQ ID NO: 74286 - RNA, 22 nt, Human
uguuauugccucaugagacucc

SEQ ID NO: 74287 - RNA, 22 nt, Human
uguuaguauuggcaaauuuguu

SEQ ID NO: 74288 - RNA, 21 nt, Human
uuggcuacugcuucagaggga

SEQ ID NO: 74289 - RNA, 22 nt, Human
uguguuuuucauuuuaaguccu

SEQ ID NO: 74290 - RNA, 21 nt, Human
uguguuuauauguguuuauau

SEQ ID NO: 74291 - RNA, 22 nt, Human
uguguuucggauagcagauucu

SEQ ID NO: 74292 - RNA, 22 nt, Human
uuggauguggggauggaguggg

SEQ ID NO: 74293 - RNA, 22 nt, Human
uuggagaaagcugcaggcucug

SEQ ID NO: 74294 - RNA, 22 nt, Human
uuggaauuugagaccaagaaaa

SEQ ID NO: 74295 - RNA, 22 nt, Human
uuggaaguggcaaaggcuaaag

SEQ ID NO: 74296 - RNA, 22 nt, Human
uugcuaagguuuaacuauugga

SEQ ID NO: 74297 - RNA, 22 nt, Human
uuggaagagagauggggagaga

SEQ ID NO: 74298 - RNA, 22 nt, Human
uguguguguauacauguauaua

SEQ ID NO: 74299 - RNA, 22 nt, Human
ugugugcacguacauacuguau

SEQ ID NO: 74300 - RNA, 22 nt, Human
ugugucuuuggcgaugucugga

SEQ ID NO: 74301 - RNA, 22 nt, Human
ugugucauuugagaggagacga

SEQ ID NO: 74302 - RNA, 17 nt, Human
uguguauucuccaggug

SEQ ID NO: 74303 - RNA, 22 nt, Human
uguguguuguuuugccagaaua

SEQ ID NO: 74304 - RNA, 22 nt, Human
uuggauugugaaaguauucucu

SEQ ID NO: 74305 - RNA, 22 nt, Human
uuuuaauaguauaucuagacac

SEQ ID NO: 74306 - RNA, 23 nt, Human
uuuuaauaguaugacaugagcug

SEQ ID NO: 74307 - RNA, 22 nt, Human
uuuuaaauggcuuuuacuuuuc

SEQ ID NO: 74308 - RNA, 22 nt, Human
uuuuaaauaaacuacacugauu

SEQ ID NO: 74309 - RNA, 22 nt, Human
uuuuaacuuuggguucucuuua

SEQ ID NO: 74310 - RNA, 22 nt, Human
uuuuaacuuuaccauuucuuca

SEQ ID NO: 74311 - RNA, 22 nt, Human
uuuuaaguauuuucuuuuuuua

SEQ ID NO: 74312 - RNA, 20 nt, Human
uuccuuucuuucuuuuuuuu

SEQ ID NO: 74313 - RNA, 22 nt, Human
uuccuuuaaccaagagcaguac

SEQ ID NO: 74314 - RNA, 20 nt, Human
uuccuuaucuguaaagugga

SEQ ID NO: 74315 - RNA, 22 nt, Human
uuccuguggggugucaucauag

SEQ ID NO: 74316 - RNA, 22 nt, Human
uuuguuuauuuacuuugggccu

SEQ ID NO: 74317 - RNA, 22 nt, Human
uuuguugucuucauaauacuuu

SEQ ID NO: 74318 - RNA, 21 nt, Human
uuccuccucuggagaagaaga

SEQ ID NO: 74319 - RNA, 22 nt, Human
uuccucauuuuguuaauuuuac

SEQ ID NO: 74320 - RNA, 22 nt, Human
uuccucuugaaucugucugacu

SEQ ID NO: 74321 - RNA, 22 nt, Human
uuccugaucuuuucccagaguu

SEQ ID NO: 74322 - RNA, 22 nt, Human
uuuuaaaacaugucaaaaugug

SEQ ID NO: 74323 - RNA, 22 nt, Human
uuccugcuggucaaaguugccu

SEQ ID NO: 74324 - RNA, 22 nt, Human
uuuguuugcuaguauuuuguuu

SEQ ID NO: 74325 - RNA, 22 nt, Human
uuccagcaaagguaguguguua

SEQ ID NO: 74326 - RNA, 22 nt, Human
uuccagauguuuaaguucugcu

SEQ ID NO: 74327 - RNA, 22 nt, Human
uuugugauaaguggauucaagg

SEQ ID NO: 74328 - RNA, 20 nt, Human
uuugugaggccagagaacag

SEQ ID NO: 74329 - RNA, 22 nt, Human
uucauggauuugugaaauuuag

SEQ ID NO: 74330 - RNA, 22 nt, Human
uucauuagcacauuuccuuggu

SEQ ID NO: 74331 - RNA, 21 nt, Human
uucauucauggcauaauauag

SEQ ID NO: 74332 - RNA, 22 nt, Human
uucauuagcguaggauguguac

SEQ ID NO: 74333 - RNA, 22 nt, Human
uuugggaaacuuaggggucaga

SEQ ID NO: 74334 - RNA, 23 nt, Human
uuugggaaauagccuauaggcac

SEQ ID NO: 74335 - RNA, 22 nt, Human
uucaugcaagagugugaggucc

SEQ ID NO: 74336 - RNA, 22 nt, Human
uuccauuccauaucagguacag

SEQ ID NO: 74337 - RNA, 22 nt, Human
uucccuauaauauggcucuucu

SEQ ID NO: 74338 - RNA, 22 nt, Human
uuuggcuacucuucauugguga

SEQ ID NO: 74339 - RNA, 22 nt, Human
uucaggacacauuauuuaugaa

SEQ ID NO: 74340 - RNA, 22 nt, Human
uucaggaaacaaauuugcaguu

SEQ ID NO: 74341 - RNA, 22 nt, Human
uucauagggagcaucuaccuau

SEQ ID NO: 74342 - RNA, 22 nt, Human
uucaggugguuuaagaauugga

SEQ ID NO: 74343 - RNA, 22 nt, Human
uucagguuauugaagagcuuuc

SEQ ID NO: 74344 - RNA, 22 nt, Human
uucauccucuaguacugaagug

SEQ ID NO: 74345 - RNA, 23 nt, Human
uuugccuaaugaagacuauguca

SEQ ID NO: 74346 - RNA, 22 nt, Human
uuugcuuugacuuugggaguau

SEQ ID NO: 74347 - RNA, 22 nt, Human
uuuggaggaaugaguuuaauau

SEQ ID NO: 74348 - RNA, 22 nt, Human
uuugcuguaaugcaugucagag

SEQ ID NO: 74349 - RNA, 22 nt, Human
uuugcuguccaauauucagggu

SEQ ID NO: 74350 - RNA, 22 nt, Human
uucagcauaggcugcucuucaa

SEQ ID NO: 74351 - RNA, 23 nt, Human
uucagcucuccugaagcaucugu

SEQ ID NO: 74352 - RNA, 22 nt, Human
uucagaugcuugauuauggcaa

SEQ ID NO: 74353 - RNA, 22 nt, Human
uucagcaagugucucuacuguc

SEQ ID NO: 74354 - RNA, 22 nt, Human
uucacugacaguauugaggagg

SEQ ID NO: 74355 - RNA, 22 nt, Human
uuugaauauacuucaaacaaag

SEQ ID NO: 74356 - RNA, 22 nt, Human
uuugauuuuuugagcaguguau

SEQ ID NO: 74357 - RNA, 22 nt, Human
uucagaauuaucauaauuuuga

SEQ ID NO: 74358 - RNA, 22 nt, Human
uuaguuaauaaauauugagugu

SEQ ID NO: 74359 - RNA, 22 nt, Human
uuagugucugacgcaggcgcca

SEQ ID NO: 74360 - RNA, 22 nt, Human
uuaggggcuuaggcagaguuug

SEQ ID NO: 74361 - RNA, 22 nt, Human
uuuauucacuuaucaggaacga

SEQ ID NO: 74362 - RNA, 21 nt, Human
uucaaguucacacucaaaggu

SEQ ID NO: 74363 - RNA, 22 nt, Human
uugaugacuaaagaaagcugcu

SEQ ID NO: 74364 - RNA, 22 nt, Human
uugauagauuuuagaggcaggc

SEQ ID NO: 74365 - RNA, 22 nt, Human
uuuuuuuccaguuauucauuuu

SEQ ID NO: 74366 - RNA, 20 nt, Human
uugagccucauggauugucu

SEQ ID NO: 74367 - RNA, 21 nt, Human
uugagcuuuuaguacagacag

SEQ ID NO: 74368 - RNA, 22 nt, Human
uugagauuuggagguaauuccc

SEQ ID NO: 74369 - RNA, 22 nt, Human
uuuuuuguggcuggaagaaaaa

SEQ ID NO: 74370 - RNA, 22 nt, Human
uugagaugacuuaaaucacugu

SEQ ID NO: 74371 - RNA, 22 nt, Human
uuuuuugucuugaagaaauggu

SEQ ID NO: 74372 - RNA, 22 nt, Human
uuuuuguaaaugaaguuuuauu

SEQ ID NO: 74373 - RNA, 22 nt, Human
uuuuugggccaaauauauuuac

SEQ ID NO: 74374 - RNA, 22 nt, Human
uugaaaaaauguguuuaaggag

SEQ ID NO: 74375 - RNA, 22 nt, Human
uugaacauuagaauaaguaauu

SEQ ID NO: 74376 - RNA, 22 nt, Human
uuuuuuaaucaaguaggaaaca

SEQ ID NO: 74377 - RNA, 20 nt, Human
uuuuuuaaauagagcuguug

SEQ ID NO: 74378 - RNA, 22 nt, Human
uuuugguaguccagaguuuagu

SEQ ID NO: 74379 - RNA, 22 nt, Human
uucuuccagugaaacgugcauc

SEQ ID NO: 74380 - RNA, 22 nt, Human
uuuugucuguggaaagcugcua

SEQ ID NO: 74381 - RNA, 22 nt, Human
uucuucuucuuccucauccuca

SEQ ID NO: 74382 - RNA, 22 nt, Human
uucuugcgaaagaaugagcuga

SEQ ID NO: 74383 - RNA, 22 nt, Human
uucuuguccacagaagagcuca

SEQ ID NO: 74384 - RNA, 22 nt, Human
uuuuuaagguuuguuuauauau

SEQ ID NO: 74385 - RNA, 22 nt, Human
uucuugucuuuguuauguagga

SEQ ID NO: 74386 - RNA, 22 nt, Human
uuuuugaauaagugcaucauca

SEQ ID NO: 74387 - RNA, 22 nt, Human
uucuuuuaauagagauccugug

SEQ ID NO: 74388 - RNA, 22 nt, Human
uucuuuguccuagcauucuaca

SEQ ID NO: 74389 - RNA, 22 nt, Human
uucuuugcucaccugccgcucc

SEQ ID NO: 74390 - RNA, 22 nt, Human
uucuuugcccauguuuccuaag

SEQ ID NO: 74391 - RNA, 22 nt, Human
uuuuugcccuaaagaagucauu

SEQ ID NO: 74392 - RNA, 22 nt, Human
uucuuuuaauuucugucugcag

SEQ ID NO: 74393 - RNA, 22 nt, Human
uucuuuucuucccuguuuauua

SEQ ID NO: 74394 - RNA, 22 nt, Human
uuuugguuugaguauuuuuuuu

SEQ ID NO: 74395 - RNA, 22 nt, Human
uuuugguauaauuuaaaauuaa

SEQ ID NO: 74396 - RNA, 22 nt, Human
uucuguuuuuauucuaucucug

SEQ ID NO: 74397 - RNA, 22 nt, Human
uucuguuuaaccuggaaagugu

SEQ ID NO: 74398 - RNA, 22 nt, Human
uuuugcaaauuacuaaauuucu

SEQ ID NO: 74399 - RNA, 22 nt, Human
uuuugaauaauucagaaacagc

SEQ ID NO: 74400 - RNA, 22 nt, Human
uuuuccuucuuccugccuugcc

SEQ ID NO: 74401 - RNA, 22 nt, Human
uuuuccuugagucggggcacag

SEQ ID NO: 74402 - RNA, 20 nt, Human
uucucugcagcaggcggccc

SEQ ID NO: 74403 - RNA, 22 nt, Human
uuuucuacaaaucuggacuuuu

SEQ ID NO: 74404 - RNA, 22 nt, Human
uuuucuaggcccuggauuaugu

SEQ ID NO: 74405 - RNA, 22 nt, Human
uuuucucacugagagccuugau

SEQ ID NO: 74406 - RNA, 22 nt, Human
uuuucuacaaucacucuggaag

SEQ ID NO: 74407 - RNA, 22 nt, Human
uucugagccacaguaaggaucu

SEQ ID NO: 74408 - RNA, 22 nt, Human
uucuggaguuugaagaucaggu

SEQ ID NO: 74409 - RNA, 22 nt, Human
uuuucucuuugcuucucuaaaa

SEQ ID NO: 74410 - RNA, 22 nt, Human
uuuucuugagucacuccaguga

SEQ ID NO: 74411 - RNA, 22 nt, Human
uuuucuucggugcuggguugau

SEQ ID NO: 74412 - RNA, 22 nt, Human
uuuuaucuuacauggaaucucc

SEQ ID NO: 74413 - RNA, 22 nt, Human
uuuuaucagagcuugcagugug

SEQ ID NO: 74414 - RNA, 22 nt, Human
uuuucaguuccaucucugcucu

SEQ ID NO: 74415 - RNA, 22 nt, Human
uucuauaagagaugaauacagu

SEQ ID NO: 74416 - RNA, 21 nt, Human
uucuauauugagaauuggcua

SEQ ID NO: 74417 - RNA, 22 nt, Human
uucucaagccuuccuuucccaa

SEQ ID NO: 74418 - RNA, 22 nt, Human
uuuucauuguuaguuucuccuu

SEQ ID NO: 74419 - RNA, 23 nt, Human
uuuuccaaaucgacucucuaguu

SEQ ID NO: 74420 - RNA, 22 nt, Human
uucucucaguuaaacuuuguga

SEQ ID NO: 74421 - RNA, 22 nt, Human
uucucugaagagccagcccuua

SEQ ID NO: 74422 - RNA, 22 nt, Human
uuuuagagacagcauggagaaa

SEQ ID NO: 74423 - RNA, 22 nt, Human
uuuuacuuuucccacuuacagc

SEQ ID NO: 74424 - RNA, 22 nt, Human
uuuuacaaugcaaauucuugcu

SEQ ID NO: 74425 - RNA, 22 nt, Human
uuuuacauuuuauucguuuauu

SEQ ID NO: 74426 - RNA, 22 nt, Human
uucuagaagggccuaggcauaa

SEQ ID NO: 74427 - RNA, 22 nt, Human
uuggugauugggaauggauggg

SEQ ID NO: 74428 - RNA, 22 nt, Human
uugguguaauacaagcaauuug

SEQ ID NO: 74429 - RNA, 22 nt, Human
uuggggaggaagauagggugaa

SEQ ID NO: 74430 - RNA, 22 nt, Human
uuggggauugggugcaagggac

SEQ ID NO: 74431 - RNA, 19 nt, Human
uugguuuguugcuuaggug

SEQ ID NO: 74432 - RNA, 22 nt, Human
uugguuuuauucguauuuguau

SEQ ID NO: 74433 - RNA, 22 nt, Human
uugguugcugaugagcuuugag

SEQ ID NO: 74434 - RNA, 22 nt, Human
uugguuuacucuggggauaucu

SEQ ID NO: 74435 - RNA, 22 nt, Human
uugguuuuuugguguaucuuau

SEQ ID NO: 74436 - RNA, 22 nt, Human
uuguaagacuguagaaugcaaa

SEQ ID NO: 74437 - RNA, 22 nt, Human
uuguaaguuuuagguguuucaa

SEQ ID NO: 74438 - RNA, 22 nt, Human
uuguaauaguguuuuacguugu

SEQ ID NO: 74439 - RNA, 22 nt, Human
uugugaggaugugcuuuuuagu

SEQ ID NO: 74440 - RNA, 22 nt, Human
uuguggacgcaauucaaggaua

SEQ ID NO: 74441 - RNA, 22 nt, Human
uuguggagaggaagcaaggagg

SEQ ID NO: 74442 - RNA, 22 nt, Human
uuguauuaauacacuccuuuuc

SEQ ID NO: 74443 - RNA, 22 nt, Human
uuguauuguuugcgucuguguu

SEQ ID NO: 74444 - RNA, 22 nt, Human
uugggaguaauacugaagagag

SEQ ID NO: 74445 - RNA, 22 nt, Human
uugucaugauccuucuguuagg

SEQ ID NO: 74446 - RNA, 22 nt, Human
uugucagcuagugaugcuguuc

SEQ ID NO: 74447 - RNA, 22 nt, Human
uuggggaauuuggggccguccg

SEQ ID NO: 74448 - RNA, 22 nt, Human
uugggagagaaaccuaaugccu

SEQ ID NO: 74449 - RNA, 22 nt, Human
uugggcauuucuuauguauuuu

SEQ ID NO: 74450 - RNA, 22 nt, Human
uugggaacaggcuucccacugg

SEQ ID NO: 74451 - RNA, 22 nt, Human
uuggcguuuccuguucugggug

SEQ ID NO: 74452 - RNA, 22 nt, Human
uuggcuguguugaaaacgugga

SEQ ID NO: 74453 - RNA, 22 nt, Human
uugauuuggaauuuuuagagcu

SEQ ID NO: 74454 - RNA, 20 nt, Human
uuggagaucacguguccagg

SEQ ID NO: 74455 - RNA, 22 nt, Human
uuggaguucuucaugcucugua

SEQ ID NO: 74456 - RNA, 22 nt, Human
uuggaggcagagucuugcugag

SEQ ID NO: 74457 - RNA, 20 nt, Human
uugauucacaaaaagcuuag

SEQ ID NO: 74458 - RNA, 21 nt, Human
uugauuuagcagaucuagcug

SEQ ID NO: 74459 - RNA, 22 nt, Human
uuuagcaaggagaaauaauccu

SEQ ID NO: 74460 - RNA, 19 nt, Human
uuuagcuacugugguauua

SEQ ID NO: 74461 - RNA, 22 nt, Human
uuuagauguucccucuacccug

SEQ ID NO: 74462 - RNA, 18 nt, Human
uuuacgaacucacuugag

SEQ ID NO: 74463 - RNA, 22 nt, Human
uuuacuaauuaguuuuggaaca

SEQ ID NO: 74464 - RNA, 22 nt, Human
uuuagguccguguugcaguugg

SEQ ID NO: 74465 - RNA, 22 nt, Human
uuuaggauaacuccaguuuucc

SEQ ID NO: 74466 - RNA, 22 nt, Human
uuuaggaagaucugaaggaaga

SEQ ID NO: 74467 - RNA, 22 nt, Human
uuuagugaagcuuugcauuuca

SEQ ID NO: 74468 - RNA, 22 nt, Human
uuguuccuaguuguccaucaca

SEQ ID NO: 74469 - RNA, 23 nt, Human
uugugguuauauuugcccauuuu

SEQ ID NO: 74470 - RNA, 22 nt, Human
uuguguuuaaucuguuccacua

SEQ ID NO: 74471 - RNA, 22 nt, Human
uuguguugaagugguuagggcg

SEQ ID NO: 74472 - RNA, 22 nt, Human
uuuacaaggcaguuauuuuccu

SEQ ID NO: 74473 - RNA, 22 nt, Human
uuuaccucguuguguccuuguu

SEQ ID NO: 74474 - RNA, 22 nt, Human
uuguugcaagccuggaaucugg

SEQ ID NO: 74475 - RNA, 22 nt, Human
uuguuguuguuguuauuuaguu

SEQ ID NO: 74476 - RNA, 22 nt, Human
uuguuuaaagaacuucugacuu

SEQ ID NO: 74477 - RNA, 22 nt, Human
uuuaugguacaggaaugcuguu

SEQ ID NO: 74478 - RNA, 22 nt, Human
uuuauguugagcaaaauaccac

SEQ ID NO: 74479 - RNA, 22 nt, Human
uuuaucaucuucugaauuugga

SEQ ID NO: 74480 - RNA, 22 nt, Human
uuuauauauauguaggagcaca

SEQ ID NO: 74481 - RNA, 22 nt, Human
uuuaucaggccaucuuaugucu

SEQ ID NO: 74482 - RNA, 22 nt, Human
uuuauaauuacguaaaauauuu

SEQ ID NO: 74483 - RNA, 22 nt, Human
uuuauaauuguuauguuaccca

SEQ ID NO: 74484 - RNA, 22 nt, Human
uuuauaagccagacacugcguu

SEQ ID NO: 74485 - RNA, 22 nt, Human
uuucagaaauggcacugaaauc

SEQ ID NO: 74486 - RNA, 22 nt, Human
uuucaaguagagggaucgcuag

SEQ ID NO: 74487 - RNA, 19 nt, Human
uuucacaaagagagcguga

SEQ ID NO: 74488 - RNA, 22 nt, Human
uuuauuugugguaguguaaucu

SEQ ID NO: 74489 - RNA, 22 nt, Human
uuuauuuuccaugucucuaggu

SEQ ID NO: 74490 - RNA, 22 nt, Human
uuuauucuuugcuagguuccau

SEQ ID NO: 74491 - RNA, 22 nt, Human
uuuauuuggugguguuacuguu

SEQ ID NO: 74492 - RNA, 19 nt, Human
uuuauuugagacaugccuu

SEQ ID NO: 74493 - RNA, 22 nt, Human
uuuggcgucucucaggagcuca

SEQ ID NO: 74494 - RNA, 22 nt, Human
uuuggcaagcagaugaagguag

SEQ ID NO: 74495 - RNA, 22 nt, Human
uuuggaugcugucauaugcugc

SEQ ID NO: 74496 - RNA, 22 nt, Human
uuuggcugucauuugaaaaugu

SEQ ID NO: 74497 - RNA, 22 nt, Human
uuuggcuuugauccuaggauuc

SEQ ID NO: 74498 - RNA, 22 nt, Human
uuugggcauuuuuaaggaucuu

SEQ ID NO: 74499 - RNA, 22 nt, Human
uuugggaaguaauuaauugcag

SEQ ID NO: 74500 - RNA, 22 nt, Human
uuuggucaucaaagacaaguaa

SEQ ID NO: 74501 - RNA, 22 nt, Human
uuuggucuggaaucuucagggu

SEQ ID NO: 74502 - RNA, 22 nt, Human
uuuguaaguuuguucuccuggg

SEQ ID NO: 74503 - RNA, 22 nt, Human
uuuggugauuuuuaaucccccu

SEQ ID NO: 74504 - RNA, 22 nt, Human
uuugucaucuuccauauuugca

SEQ ID NO: 74505 - RNA, 23 nt, Human
uuugucaucccucucacuuucug

SEQ ID NO: 74506 - RNA, 22 nt, Human
uuuguauuucaaggcacucuca

SEQ ID NO: 74507 - RNA, 20 nt, Human
uuugucaacugcauccagca

SEQ ID NO: 74508 - RNA, 22 nt, Human
uuugcugggaagccuucacucu

SEQ ID NO: 74509 - RNA, 22 nt, Human
uuugcugaaaaaccacuugagu

SEQ ID NO: 74510 - RNA, 22 nt, Human
uuugauuuuguuuauagugccg

SEQ ID NO: 74511 - RNA, 20 nt, Human
uuugauugccccucugacuu

SEQ ID NO: 74512 - RNA, 22 nt, Human
uuugcauuaguuuagauuucaa

SEQ ID NO: 74513 - RNA, 22 nt, Human
uuucuuaguuaaguagguaggc

SEQ ID NO: 74514 - RNA, 22 nt, Human
uuugaagaccuuaucucuaaau

SEQ ID NO: 74515 - RNA, 22 nt, Human
uuugaguaagauguugauacug

SEQ ID NO: 74516 - RNA, 22 nt, Human
uuugagaaugucaaucacaaga

SEQ ID NO: 74517 - RNA, 22 nt, Human
uuugaugauuuucuagagugua

SEQ ID NO: 74518 - RNA, 22 nt, Human
uuugaugagaaaugacuuaagu

SEQ ID NO: 74519 - RNA, 17 nt, Human
uuucugcaugauuggac

SEQ ID NO: 74520 - RNA, 22 nt, Human
uuucuggaaacuguaaagagga

SEQ ID NO: 74521 - RNA, 22 nt, Human
uuucuggauaagcagggucucu

SEQ ID NO: 74522 - RNA, 22 nt, Human
uuucucuuucaaucugcaguac

SEQ ID NO: 74523 - RNA, 22 nt, Human
uuucucugggugaugagguggc

SEQ ID NO: 74524 - RNA, 22 nt, Human
uuucucuuguauuugaaucacu

SEQ ID NO: 74525 - RNA, 22 nt, Human
uuucucagccuccuugcuggag

SEQ ID NO: 74526 - RNA, 22 nt, Human
uuucuguugugaccugacucuu

SEQ ID NO: 74527 - RNA, 22 nt, Human
uuucuuccaucuggcuuuauuu

SEQ ID NO: 74528 - RNA, 22 nt, Human
uuucuuccuucuugaucauuug

SEQ ID NO: 74529 - RNA, 22 nt, Human
uuucugugguggguaguucaga

SEQ ID NO: 74530 - RNA, 22 nt, Human
uuucuuugcugguuggcucucc

SEQ ID NO: 74531 - RNA, 22 nt, Human
uuucuuuuucuacaccuuagcu

SEQ ID NO: 74532 - RNA, 22 nt, Human
uuucaugauuaacuuagugaau

SEQ ID NO: 74533 - RNA, 22 nt, Human
uuucacagcgucuuucucuugc

SEQ ID NO: 74534 - RNA, 22 nt, Human
uuucagauuauguucauggguu

SEQ ID NO: 74535 - RNA, 22 nt, Human
uuucagcaugacuguuaucuuu

SEQ ID NO: 74536 - RNA, 22 nt, Human
uuucagguggaaguuuuagaug

SEQ ID NO: 74537 - RNA, 22 nt, Human
uuucauguuggauacuguuuca

SEQ ID NO: 74538 - RNA, 22 nt, Human
uuuccacacucacugcacucau

SEQ ID NO: 74539 - RNA, 21 nt, Human
uuucauuaguacaucaauuug

SEQ ID NO: 74540 - RNA, 22 nt, Human
uuucuacacuucgugguguuuu

SEQ ID NO: 74541 - RNA, 22 nt, Human
uuucuacauuuguaaccagauu

SEQ ID NO: 74542 - RNA, 22 nt, Human
uuucguugcacucauaugguug

SEQ ID NO: 74543 - RNA, 18 nt, Human
uuuccucauuugcagacu

SEQ ID NO: 74544 - RNA, 22 nt, Human
uuucgcuuguucggagugcuuu

SEQ ID NO: 74545 - RNA, 22 nt, Human
uuucgggauuucaaagagcaaa

SEQ ID NO: 74546 - RNA, 22 nt, Human
augaaaacggaccagagcuauu

SEQ ID NO: 74547 - RNA, 22 nt, Human
agggcugggcuuggcaggcugg

SEQ ID NO: 74548 - RNA, 22 nt, Human
gaauuccaggugagagaaggua

SEQ ID NO: 74549 - RNA, 22 nt, Human
cacugguugccucuuucuguuc

SEQ ID NO: 74550 - RNA, 22 nt, Human
ggagccucuaaacaguuaucaa

SEQ ID NO: 74551 - RNA, 22 nt, Human
aaaauaauauuauaccacugcu

SEQ ID NO: 74552 - RNA, 22 nt, Human
gggggagcuacaggucccuugg

SEQ ID NO: 74553 - RNA, 22 nt, Human
uauaaagaccuuauccuucaua

SEQ ID NO: 74554 - RNA, 22 nt, Human
aauucuguugguuagaguugga

SEQ ID NO: 74555 - RNA, 22 nt, Human
auccugugggguauugcugcau

SEQ ID NO: 74556 - RNA, 22 nt, Human
cugggggacagagagaggcggu

SEQ ID NO: 74557 - RNA, 22 nt, Human
uuuuuaaaauuaggacggcacg

SEQ ID NO: 74558 - RNA, 22 nt, Human
gcuggggaucgaaggcagagcc

SEQ ID NO: 74559 - RNA, 22 nt, Human
uauuucaugagugaauaucuag

SEQ ID NO: 74560 - RNA, 22 nt, Human
gaggcucagagggacuuucaag

SEQ ID NO: 74561 - RNA, 22 nt, Human
uuauuucaggcauuuguaaaug

SEQ ID NO: 74562 - RNA, 22 nt, Human
uugcuuuuuuggguuuacuggg

SEQ ID NO: 74563 - RNA, 22 nt, Human
agcaaggguugguuuucugaca

SEQ ID NO: 74564 - RNA, 22 nt, Human
aaugaaaaucugucaguucaag

SEQ ID NO: 74565 - RNA, 22 nt, Human
acugucuuguuguaugugagcu

SEQ ID NO: 74566 - RNA, 22 nt, Human
gugauggucgagcgcuuguugu

SEQ ID NO: 74567 - RNA, 22 nt, Human
auauuuuacagcucucguugaa

SEQ ID NO: 74568 - RNA, 23 nt, Human
aaguggugacugugcuacugaga

SEQ ID NO: 74569 - RNA, 22 nt, Human
gugugucucaguugcuccgaag

SEQ ID NO: 74570 - RNA, 22 nt, Human
ugaggaagugguuguaugguuu

SEQ ID NO: 74571 - RNA, 22 nt, Human
uuguuauaggaucagugucacu

SEQ ID NO: 74572 - RNA, 22 nt, Human
uuggugaugcccaccuuuucau

SEQ ID NO: 74573 - RNA, 22 nt, Human
uaaaaucaugacagauugacau

SEQ ID NO: 74574 - RNA, 22 nt, Human
agggcaggguuggugcuggugc

SEQ ID NO: 74575 - RNA, 22 nt, Human
agugccaucuuuaacuguccca

SEQ ID NO: 74576 - RNA, 22 nt, Human
ucccaaguguuuggcgaggaga

SEQ ID NO: 74577 - RNA, 22 nt, Human
uuaucuuuuaaaaacacuugug

SEQ ID NO: 74578 - RNA, 22 nt, Human
cucucugcugucuuucgggaaa

SEQ ID NO: 74579 - RNA, 22 nt, Human
gcccagccucagggcaucagcu

SEQ ID NO: 74580 - RNA, 22 nt, Human
aauuauguugaaauaugagaac

SEQ ID NO: 74581 - RNA, 22 nt, Human
ccuuuuaucgcgaagaacucca

SEQ ID NO: 74582 - RNA, 22 nt, Human
uggaagcccagaaggaagcaga

SEQ ID NO: 74583 - RNA, 22 nt, Human
uguguuguuggggauguuuuca

SEQ ID NO: 74584 - RNA, 22 nt, Human
ccuaggcuggcugucuucaggu

SEQ ID NO: 74585 - RNA, 22 nt, Human
uggaguuuuaaucuguacagaa

SEQ ID NO: 74586 - RNA, 22 nt, Human
acgugugugugcacguguguau

SEQ ID NO: 74587 - RNA, 22 nt, Human
aaugagaauguaagugaagaga

SEQ ID NO: 74588 - RNA, 22 nt, Human
cucuugugucaccauggauaaa

SEQ ID NO: 74589 - RNA, 22 nt, Human
guucaaucucucaugcauuuuc

SEQ ID NO: 74590 - RNA, 22 nt, Human
ugagagggagacagcucuagca

SEQ ID NO: 74591 - RNA, 19 nt, Human
ucaggaggucgaccuggca

SEQ ID NO: 74592 - RNA, 22 nt, Human
aaugcuuuuugcgaaaugugca

SEQ ID NO: 74593 - RNA, 22 nt, Human
uguaaauucuauacacuuaaaa

SEQ ID NO: 74594 - RNA, 22 nt, Human
ugggggagggagaguugauggg

SEQ ID NO: 74595 - RNA, 22 nt, Human
uuuguauuguuuauuucauuuu

SEQ ID NO: 74596 - RNA, 22 nt, Human
auguaugagagauucuuuuauu

SEQ ID NO: 74597 - RNA, 22 nt, Human
ggagacagauggcgucucaguu

SEQ ID NO: 74598 - RNA, 22 nt, Human
uucauggauuugugaaauuuag

SEQ ID NO: 74599 - RNA, 22 nt, Human
uaguauuuguaauuaucaaagc

SEQ ID NO: 74600 - RNA, 22 nt, Human
uguguuguuuggggauguccau

SEQ ID NO: 74601 - RNA, 22 nt, Human
uuuuuuuaaguuuugauuuuag

SEQ ID NO: 74602 - RNA, 22 nt, Human
ucagcucucucuuggugaucuc

SEQ ID NO: 74603 - RNA, 22 nt, Human
aaaauauucuauaucaaagaua

SEQ ID NO: 74604 - RNA, 22 nt, Human
uguuuucuuuccccuucuuuuc

SEQ ID NO: 74605 - RNA, 22 nt, Human
cuugcucugggaauaugaguuu

SEQ ID NO: 74606 - RNA, 22 nt, Human
aucuucuuucaucagccccuca

SEQ ID NO: 74607 - RNA, 22 nt, Human
auuuccagcagcauauuugucu

SEQ ID NO: 74608 - RNA, 22 nt, Human
gagggcugccacguugggcgag

SEQ ID NO: 74609 - RNA, 22 nt, Human
aagaacuagauagugguguaaa

SEQ ID NO: 74610 - RNA, 22 nt, Human
ccuucugcuggucaucccagug

SEQ ID NO: 74611 - RNA, 20 nt, Human
uugauucacaaaaagcuuag

SEQ ID NO: 74612 - RNA, 22 nt, Human
aacccugaacuuaguucuagga

SEQ ID NO: 74613 - RNA, 22 nt, Human
auuaauaucaauauauuauaug

SEQ ID NO: 74614 - RNA, 22 nt, Human
aauaucuugaguuauaaauuca

SEQ ID NO: 74615 - RNA, 22 nt, Human
uugcuuuuugggguuuacuggg

SEQ ID NO: 74616 - RNA, 22 nt, Human
uucuccaccugcuccucccacc

SEQ ID NO: 74617 - RNA, 22 nt, Human
ccauuuggccauucaguuguuc

SEQ ID NO: 74618 - RNA, 22 nt, Human
gaaggagaggauugugaggcug

SEQ ID NO: 74619 - RNA, 22 nt, Human
uggagccugauggauaggaacg

SEQ ID NO: 74620 - RNA, 22 nt, Human
agggaguuccgaucugugcacc

SEQ ID NO: 74621 - RNA, 22 nt, Human
ccucaggaauuuauucuucugu

SEQ ID NO: 74622 - RNA, 22 nt, Human
uaauuccacacucccgcaagcg

SEQ ID NO: 74623 - RNA, 22 nt, Human
aaauauuugaaugguguaagau

SEQ ID NO: 74624 - RNA, 22 nt, Human
ucuuuauuucccuaacuugcua

SEQ ID NO: 74625 - RNA, 22 nt, Human
aggggcugagaguuugaugugg

SEQ ID NO: 74626 - RNA, 19 nt, Human
uccuacaugagacagagag

SEQ ID NO: 74627 - RNA, 22 nt, Human
uuuuuuaaucaaguaggaaaca

SEQ ID NO: 74628 - RNA, 22 nt, Human
guuuucuccugcuauacagugc

SEQ ID NO: 74629 - RNA, 22 nt, Human
uaauaaaaauuuaauucacauu

SEQ ID NO: 74630 - RNA, 22 nt, Human
uggcaaggccacaggugcaguu

SEQ ID NO: 74631 - RNA, 20 nt, Human
acuagaaagucacugggggg

SEQ ID NO: 74632 - RNA, 22 nt, Human
uugccaggggacaucuggagcc

SEQ ID NO: 74633 - RNA, 22 nt, Human
ccagcaggagacuagcaacaua

SEQ ID NO: 74634 - RNA, 22 nt, Human
ucauuguuucugcuuuucauga

SEQ ID NO: 74635 - RNA, 22 nt, Human
aauguaaauaauuguaaaauuu

SEQ ID NO: 74636 - RNA, 22 nt, Human
agggagucuggccgucggcugg

SEQ ID NO: 74637 - RNA, 22 nt, Human
uauuguuuuaagguguauuaau

SEQ ID NO: 74638 - RNA, 19 nt, Human
ggaggguguccucaguguc

SEQ ID NO: 74639 - RNA, 22 nt, Human
uuucauguuggauacuguuuca

SEQ ID NO: 74640 - RNA, 22 nt, Human
auuuuguugaaacccuuguugu

SEQ ID NO: 74641 - RNA, 22 nt, Human
auauaguacauguauauauaua

SEQ ID NO: 74642 - RNA, 19 nt, Human
caggucuucuuggaggacu

SEQ ID NO: 74643 - RNA, 22 nt, Human
uugugugugcccaccuguggcc

SEQ ID NO: 74644 - RNA, 22 nt, Human
gaggagcuucagaggaaucuua

SEQ ID NO: 74645 - RNA, 22 nt, Human
caagggcagaggcagggccccg

SEQ ID NO: 74646 - RNA, 22 nt, Human
cagggggacuuguuagguuuua

SEQ ID NO: 74647 - RNA, 22 nt, Human
agagacaggguuuugucguguu

SEQ ID NO: 74648 - RNA, 21 nt, Human
gggagaguagcgguagggagg

SEQ ID NO: 74649 - RNA, 22 nt, Human
uucuagcucauggugacagauc

SEQ ID NO: 74650 - RNA, 22 nt, Human
uucuucuuuccuauaauuaauu

SEQ ID NO: 74651 - RNA, 22 nt, Human
gagaaaaauuucuuugcugcac

SEQ ID NO: 74652 - RNA, 23 nt, Human
cuuauauaaucauuagaaaccau

SEQ ID NO: 74653 - RNA, 22 nt, Human
uuuucacugacuuggucuggaa

SEQ ID NO: 74654 - RNA, 22 nt, Human
auauucaaugaggucauauaag

SEQ ID NO: 74655 - RNA, 22 nt, Human
auguuccaugacuaugcaugaa

SEQ ID NO: 74656 - RNA, 19 nt, Human
ccaguuuuuuaauauucaa

SEQ ID NO: 74657 - RNA, 22 nt, Human
aggggcugugucauuuguccua

SEQ ID NO: 74658 - RNA, 22 nt, Human
auaguugcugucauuauuugag

SEQ ID NO: 74659 - RNA, 21 nt, Human
agaugaggauacugaggccua

SEQ ID NO: 74660 - RNA, 22 nt, Human
gugugugucuacuuucaucucu

SEQ ID NO: 74661 - RNA, 22 nt, Human
guguucuuuguagaggaucuug

SEQ ID NO: 74662 - RNA, 22 nt, Human
ggcucccccauggcugacagac

SEQ ID NO: 74663 - RNA, 22 nt, Human
cacagcuggggaagcugaggcc

SEQ ID NO: 74664 - RNA, 22 nt, Human
auaaaucaagggcaguauuucc

SEQ ID NO: 74665 - RNA, 22 nt, Human
guuuauuucuuaucaucacuau

SEQ ID NO: 74666 - RNA, 22 nt, Human
aggggaggcugcgggcugccgu

SEQ ID NO: 74667 - RNA, 22 nt, Human
uuuuaaauaaacuacacugauu

SEQ ID NO: 74668 - RNA, 22 nt, Human
uauuucuagggcaugaaaauaa

SEQ ID NO: 74669 - RNA, 22 nt, Human
ucccuguggauuaaggagaugu

SEQ ID NO: 74670 - RNA, 22 nt, Human
agggcugcugcuccgggcccag

SEQ ID NO: 74671 - RNA, 22 nt, Human
aguugggaaaugcugcaguagu

SEQ ID NO: 74672 - RNA, 22 nt, Human
agauggaggaaagcaguuagaa

SEQ ID NO: 74673 - RNA, 22 nt, Human
ggcagagguagcuggaaccagg

SEQ ID NO: 74674 - RNA, 22 nt, Human
aacgagcugggggggccggggg

SEQ ID NO: 74675 - RNA, 22 nt, Human
gggagggucugagagcugcacc

SEQ ID NO: 74676 - RNA, 22 nt, Human
ucuccucucugaucuugcuccg

SEQ ID NO: 74677 - RNA, 22 nt, Human
cagcuguggagauggggugcau

SEQ ID NO: 74678 - RNA, 20 nt, Human
cauuccaugcaucuuggucc

SEQ ID NO: 74679 - RNA, 22 nt, Human
uuuuaaaguaauugaagcuugu

SEQ ID NO: 74680 - RNA, 22 nt, Human
augaaaacgugugugugugugu

SEQ ID NO: 74681 - RNA, 22 nt, Human
cccagaggcugaguugggagca

SEQ ID NO: 74682 - RNA, 22 nt, Human
auagggaggcggagggagcugg

SEQ ID NO: 74683 - RNA, 22 nt, Human
uccuuucaaauuuauuugacau

SEQ ID NO: 74684 - RNA, 22 nt, Human
uugucuuucguauggaacacua

SEQ ID NO: 74685 - RNA, 22 nt, Human
auggaguguggccaggcaguaa

SEQ ID NO: 74686 - RNA, 23 nt, Human
caggggacaggugaccugggcuc

SEQ ID NO: 74687 - RNA, 22 nt, Human
ggcucccgugggaugguggagc

SEQ ID NO: 74688 - RNA, 22 nt, Human
agauucucccuccuggcgcugu

SEQ ID NO: 74689 - RNA, 22 nt, Human
cuccccuuauuccucaacauga

SEQ ID NO: 74690 - RNA, 22 nt, Human
gaauauuuaucucagcugcaga

SEQ ID NO: 74691 - RNA, 22 nt, Human
ggagcucacuacgaaauaagcu

SEQ ID NO: 74692 - RNA, 20 nt, Human
aggggcuguaguuagaugac

SEQ ID NO: 74693 - RNA, 22 nt, Human
ccagcugggucccugcuggggc

SEQ ID NO: 74694 - RNA, 22 nt, Human
cugguacuggaggaguucagag

SEQ ID NO: 74695 - RNA, 22 nt, Human
ggcucagaggagcuggaacggu

SEQ ID NO: 74696 - RNA, 22 nt, Human
uuacuuuuuucccccuuagaug

SEQ ID NO: 74697 - RNA, 22 nt, Human
gaggggacugucuggcuccgag

SEQ ID NO: 74698 - RNA, 22 nt, Human
uggcucagcgcggccuggucuu

SEQ ID NO: 74699 - RNA, 22 nt, Human
uuauuuaaguauuuauugaagu

SEQ ID NO: 74700 - RNA, 22 nt, Human
cugcaucacagcaggaggcaca

SEQ ID NO: 74701 - RNA, 22 nt, Human
ggcuagggagacagagggcaug

SEQ ID NO: 74702 - RNA, 22 nt, Human
uuuguuuccagccuuuugucuu

SEQ ID NO: 74703 - RNA, 22 nt, Human
uggucuuuccuucauuguccag

SEQ ID NO: 74704 - RNA, 22 nt, Human
aagaaggaaggcaagagauggg

SEQ ID NO: 74705 - RNA, 22 nt, Human
guccccugcguguucauccugg

SEQ ID NO: 74706 - RNA, 22 nt, Human
gcagagcugucuaagucacuuc

SEQ ID NO: 74707 - RNA, 22 nt, Human
caagaaaaaacaugaugagugu

SEQ ID NO: 74708 - RNA, 22 nt, Human
gagggugguggcggccggcacc

SEQ ID NO: 74709 - RNA, 22 nt, Human
acagagcucccagccaucuccu

SEQ ID NO: 74710 - RNA, 22 nt, Human
uugaaaauuaauagguguacaa

SEQ ID NO: 74711 - RNA, 22 nt, Human
uuauuuaagaucuuaauauaua

SEQ ID NO: 74712 - RNA, 22 nt, Human
uaguggaaccuucuaaaugacg

SEQ ID NO: 74713 - RNA, 20 nt, Human
uucacagaucucuaacugag

SEQ ID NO: 74714 - RNA, 22 nt, Human
uuuucaauuuucauuugcaaga

SEQ ID NO: 74715 - RNA, 22 nt, Human
uguuaguauuggcaaauuuguu

SEQ ID NO: 74716 - RNA, 18 nt, Human
ggagaagaacagaugugg

SEQ ID NO: 74717 - RNA, 22 nt, Human
gaauucuaguucuguaucucug

SEQ ID NO: 74718 - RNA, 20 nt, Human
ugcugugugucuacuguggg

SEQ ID NO: 74719 - RNA, 22 nt, Human
uggggcuccuccuggcaggagg

SEQ ID NO: 74720 - RNA, 22 nt, Human
gcagggcucagccgcucccacc

SEQ ID NO: 74721 - RNA, 22 nt, Human
agugagaguauuaaugugaacu

SEQ ID NO: 74722 - RNA, 22 nt, Human
guuuuaucuauguaauuauaaa

SEQ ID NO: 74723 - RNA, 22 nt, Human
ccaaggcuguggggcugugcag

SEQ ID NO: 74724 - RNA, 22 nt, Human
ccauuucacaucccugacaugu

SEQ ID NO: 74725 - RNA, 22 nt, Human
uacaagcucuuguagggggaaa

SEQ ID NO: 74726 - RNA, 22 nt, Human
caauaccucuuggugauugggc

SEQ ID NO: 74727 - RNA, 22 nt, Human
cucugugucugauucugggaag

SEQ ID NO: 74728 - RNA, 22 nt, Human
gaguagaacagauagucaagaa

SEQ ID NO: 74729 - RNA, 22 nt, Human
uuccugcuggucaaaguugccu

SEQ ID NO: 74730 - RNA, 22 nt, Human
uuggugauguagcagcaauugu

SEQ ID NO: 74731 - RNA, 22 nt, Human
uguuuuuauucuuaauguuuca

SEQ ID NO: 74732 - RNA, 22 nt, Human
cuucuuuuggggaugaaaaugg

SEQ ID NO: 74733 - RNA, 22 nt, Human
gcuucucacccuuacuaucucu

SEQ ID NO: 74734 - RNA, 22 nt, Human
gucuuuguaguuuuaauuugag

SEQ ID NO: 74735 - RNA, 22 nt, Human
uucacugugauugggguggauu

SEQ ID NO: 74736 - RNA, 22 nt, Human
ugaaguuuagaaaaagugccuu

SEQ ID NO: 74737 - RNA, 22 nt, Human
guuuuucuuugauuuagaacca

SEQ ID NO: 74738 - RNA, 22 nt, Human
ggcagagcugugcgcccaccca

SEQ ID NO: 74739 - RNA, 22 nt, Human
uuuucauuguuaguuucuccuu

SEQ ID NO: 74740 - RNA, 22 nt, Human
ugggcagggagcuggaaccaca

SEQ ID NO: 74741 - RNA, 22 nt, Human
gggcugagagcuggaaucugag

SEQ ID NO: 74742 - RNA, 22 nt, Human
ggagagcuagugagcuggaggu

SEQ ID NO: 74743 - RNA, 22 nt, Human
cugcugugcagacagacucucu

SEQ ID NO: 74744 - RNA, 20 nt, Human
ucucuuuuucuucuuuucuc

SEQ ID NO: 74745 - RNA, 22 nt, Human
ggugaguagaaguaguuggcuu

SEQ ID NO: 74746 - RNA, 22 nt, Human
aacugcauaagcuucgggaccu

SEQ ID NO: 74747 - RNA, 22 nt, Human
ucccuugacauuacuugggagg

SEQ ID NO: 74748 - RNA, 22 nt, Human
uuuuaaaagguugcuguuauaa

SEQ ID NO: 74749 - RNA, 22 nt, Human
uccauuuacuauucucauaucg

SEQ ID NO: 74750 - RNA, 22 nt, Human
ucgcccagguuggagugcagug

SEQ ID NO: 74751 - RNA, 17 nt, Human
auucaugaacauguccu

SEQ ID NO: 74752 - RNA, 18 nt, Human
guucaagcauuuugcucu

SEQ ID NO: 74753 - RNA, 22 nt, Human
cauggcggcgcucucccugccu

SEQ ID NO: 74754 - RNA, 20 nt, Human
agaaggagagaugaggcaaa

SEQ ID NO: 74755 - RNA, 22 nt, Human
cacugcaaccuccaccucccgg

SEQ ID NO: 74756 - RNA, 22 nt, Human
uuuauguuuguuuuugaaauaa

SEQ ID NO: 74757 - RNA, 22 nt, Human
aggcuccucugggggccccgga

SEQ ID NO: 74758 - RNA, 22 nt, Human
uaauauaacugccaguuaaggu

SEQ ID NO: 74759 - RNA, 21 nt, Human
uccccugugccuggcauacag

SEQ ID NO: 74760 - RNA, 22 nt, Human
cucugcuuguaucacauuugcu

SEQ ID NO: 74761 - RNA, 22 nt, Human
uuugcaggaaauguacugaaug

SEQ ID NO: 74762 - RNA, 22 nt, Human
uuuaauauuacacuuaccuugu

SEQ ID NO: 74763 - RNA, 17 nt, Human
uuagagcuacauguuga

SEQ ID NO: 74764 - RNA, 22 nt, Human
uaaaacuaugcaaccuacuacc

SEQ ID NO: 74765 - RNA, 22 nt, Human
uuuucucuuugcuucucuaaaa

SEQ ID NO: 74766 - RNA, 22 nt, Human
ccagggaggucauagugcuggu

SEQ ID NO: 74767 - RNA, 22 nt, Human
uguccuuuauauguuuuuuagu

SEQ ID NO: 74768 - RNA, 22 nt, Human
cagagagcguccauccggugcc

SEQ ID NO: 74769 - RNA, 22 nt, Human
uuuugaauaauucagaaacagc

SEQ ID NO: 74770 - RNA, 17 nt, Human
auuguuuuuaauuugca

SEQ ID NO: 74771 - RNA, 22 nt, Human
agauggaguccugaagccagaa

SEQ ID NO: 74772 - RNA, 22 nt, Human
agucccugauggacuggaugag

SEQ ID NO: 74773 - RNA, 22 nt, Human
gccugggguuugcggggcugca

SEQ ID NO: 74774 - RNA, 22 nt, Human
aggauagacuucagaaggcaua

SEQ ID NO: 74775 - RNA, 22 nt, Human
uggcucaggccuacgacgccuu

SEQ ID NO: 74776 - RNA, 22 nt, Human
gagggaggugacaaggacauag

SEQ ID NO: 74777 - RNA, 22 nt, Human
acauuuuaaaaacaguaccugg

SEQ ID NO: 74778 - RNA, 22 nt, Human
gggcuguggggccugcagaagg

SEQ ID NO: 74779 - RNA, 22 nt, Human
acucacuguuuugaaauugaac

SEQ ID NO: 74780 - RNA, 22 nt, Human
agggcaguuuuacugaaaggug

SEQ ID NO: 74781 - RNA, 22 nt, Human
ggagugaguauguucugaugca

SEQ ID NO: 74782 - RNA, 19 nt, Human
acuggggcaggcugggcuu

SEQ ID NO: 74783 - RNA, 22 nt, Human
gcuguguaugaugcaggcaccu

SEQ ID NO: 74784 - RNA, 22 nt, Human
auuagugguguauuuggcacua

SEQ ID NO: 74785 - RNA, 22 nt, Human
caaauguuugguggcauuuugu

SEQ ID NO: 74786 - RNA, 22 nt, Human
cucagcgagggaaagaggccgc

SEQ ID NO: 74787 - RNA, 22 nt, Human
ugcauucugaacguaaauguga

SEQ ID NO: 74788 - RNA, 22 nt, Human
aaucauaacaaaagcaauuaua

SEQ ID NO: 74789 - RNA, 22 nt, Human
gcugcuuagaaccauauuuaaa

SEQ ID NO: 74790 - RNA, 23 nt, Human
ucucacucauucuccucugucca

SEQ ID NO: 74791 - RNA, 22 nt, Human
ucucugaccuccaccccaggag

SEQ ID NO: 74792 - RNA, 22 nt, Human
ucuuuuucccugguuccuuuuu

SEQ ID NO: 74793 - RNA, 22 nt, Human
uuuaaaacagcauuuaaaaggu

SEQ ID NO: 74794 - RNA, 22 nt, Human
ugaaauuuuuuggagauaauuu

SEQ ID NO: 74795 - RNA, 22 nt, Human
uggggagacauggaguaaaaga

SEQ ID NO: 74796 - RNA, 22 nt, Human
gaggaggcuggagaggccagga

SEQ ID NO: 74797 - RNA, 21 nt, Human
auauuguugggguuuucuuuu

SEQ ID NO: 74798 - RNA, 21 nt, Human
ugcuuucugugcuuuuucugc

SEQ ID NO: 74799 - RNA, 22 nt, Human
ucuuucugaugggaagggucaa

SEQ ID NO: 74800 - RNA, 22 nt, Human
gcuuucagggucacugucaaca

SEQ ID NO: 74801 - RNA, 22 nt, Human
uuucucuuguauuugaaucacu

SEQ ID NO: 74802 - RNA, 22 nt, Human
aagaaauacagaaauggcagua

SEQ ID NO: 74803 - RNA, 22 nt, Human
gcauaauauugagaaauuauua

SEQ ID NO: 74804 - RNA, 22 nt, Human
uuuguacuuucuaauguauuua

SEQ ID NO: 74805 - RNA, 22 nt, Human
ucauuguuuacugucuuuuuuc

SEQ ID NO: 74806 - RNA, 22 nt, Human
auuguuuugugaaacauaguga

SEQ ID NO: 74807 - RNA, 22 nt, Human
agauggggccugaggacacugu

SEQ ID NO: 74808 - RNA, 20 nt, Human
aauaaauauaacccauaauu

SEQ ID NO: 74809 - RNA, 22 nt, Human
ugcuuucagauaucuguuucaa

SEQ ID NO: 74810 - RNA, 22 nt, Human
uuuuuaaaagaugauuuaauga

SEQ ID NO: 74811 - RNA, 22 nt, Human
uccuuuauuuaugggcagugua

SEQ ID NO: 74812 - RNA, 22 nt, Human
auuuucauauggguuauuugua

SEQ ID NO: 74813 - RNA, 18 nt, Human
cccagaggaaugccugga

SEQ ID NO: 74814 - RNA, 22 nt, Human
uucacugugauguuuaagagaa

SEQ ID NO: 74815 - RNA, 22 nt, Human
uccagcugugcuccaggaggug

SEQ ID NO: 74816 - RNA, 22 nt, Human
cccuguccugcuaggcccuggu

SEQ ID NO: 74817 - RNA, 22 nt, Human
guuaaaaugauuugugauuuau

SEQ ID NO: 74818 - RNA, 22 nt, Human
auuuuuauuugccuaugauaua

SEQ ID NO: 74819 - RNA, 22 nt, Human
ugcuuuauucgacaucugguag

SEQ ID NO: 74820 - RNA, 22 nt, Human
uugccaggagacaucuggagcc

SEQ ID NO: 74821 - RNA, 22 nt, Human
ugcuuggagaaucagucccagc

SEQ ID NO: 74822 - RNA, 22 nt, Human
cugcagagaccuaggucagguu

SEQ ID NO: 74823 - RNA, 22 nt, Human
cagggcagaguuaagaugcugg

SEQ ID NO: 74824 - RNA, 22 nt, Human
gccaguggucagugggagggug

SEQ ID NO: 74825 - RNA, 22 nt, Human
ugcucacugcuuguguucaguu

SEQ ID NO: 74826 - RNA, 22 nt, Human
aaauuaaaguuuuauuuagagc

SEQ ID NO: 74827 - RNA, 22 nt, Human
agggcaguuaugaaugucucca

SEQ ID NO: 74828 - RNA, 22 nt, Human
agaucugucaccauccuggagc

SEQ ID NO: 74829 - RNA, 22 nt, Human
uuuucucaguuuuuuucaaaag

SEQ ID NO: 74830 - RNA, 22 nt, Human
guggguauauauaugugugcug

SEQ ID NO: 74831 - RNA, 22 nt, Human
uuuuuuccuguuugucuuuggg

SEQ ID NO: 74832 - RNA, 22 nt, Human
uuaucaaaaaauaguacuuuga

SEQ ID NO: 74833 - RNA, 22 nt, Human
agagggagagaccuccgugccu

SEQ ID NO: 74834 - RNA, 22 nt, Human
gaggcaggaagggaggguugug

SEQ ID NO: 74835 - RNA, 22 nt, Human
cuuuaaaaauguauuuuugugg

SEQ ID NO: 74836 - RNA, 22 nt, Human
uauuuuauuuagguuuaguugu

SEQ ID NO: 74837 - RNA, 22 nt, Human
uacagaccaguaguucucagcg

SEQ ID NO: 74838 - RNA, 22 nt, Human
gaggagggagcuggaagcucuu

SEQ ID NO: 74839 - RNA, 22 nt, Human
uacaaaugaucaucucuuugaa

SEQ ID NO: 74840 - RNA, 22 nt, Human
cagguggauggcgagcccugca

SEQ ID NO: 74841 - RNA, 22 nt, Human
auaucuuguuuuugauuucuug

SEQ ID NO: 74842 - RNA, 22 nt, Human
uuugaagaaacagucuuaagag

SEQ ID NO: 74843 - RNA, 22 nt, Human
gguuuucacgauccucccuuuu

SEQ ID NO: 74844 - RNA, 18 nt, Human
auucauuugcguuuggcu

SEQ ID NO: 74845 - RNA, 22 nt, Human
uauuuuuuuaacauuuauugua

SEQ ID NO: 74846 - RNA, 22 nt, Human
gucuugugaagacggcagaaag

SEQ ID NO: 74847 - RNA, 22 nt, Human
uucaaaaugcagaauaguuugg

SEQ ID NO: 74848 - RNA, 22 nt, Human
ucccuucccaccccugccuuuu

SEQ ID NO: 74849 - RNA, 22 nt, Human
gaaccauuuaauggagaugcuc

SEQ ID NO: 74850 - RNA, 22 nt, Human
auuuauauauuuuguucuggua

SEQ ID NO: 74851 - RNA, 22 nt, Human
uuuuccuuagaaauacauugau

SEQ ID NO: 74852 - RNA, 22 nt, Human
ccuuuggaugucauucuuggca

SEQ ID NO: 74853 - RNA, 22 nt, Human
cccuguccuucccuccaucuga

SEQ ID NO: 74854 - RNA, 17 nt, Human
ucuguguccgcucaguc

SEQ ID NO: 74855 - RNA, 22 nt, Human
uccucccugcacucagugaagu

SEQ ID NO: 74856 - RNA, 22 nt, Human
ugcccacuucaaaaucuucauu

SEQ ID NO: 74857 - RNA, 22 nt, Human
caguagcuuuuugcagacaaga

SEQ ID NO: 74858 - RNA, 22 nt, Human
uucauuuccauuuuauagauaa

SEQ ID NO: 74859 - RNA, 22 nt, Human
uggacacugguggauauggaau

SEQ ID NO: 74860 - RNA, 22 nt, Human
uugcuuucuuuguagguuuucc

SEQ ID NO: 74861 - RNA, 22 nt, Human
accuccauggcccacaucuagu

SEQ ID NO: 74862 - RNA, 22 nt, Human
uucauuagcacauuuccuuggu

SEQ ID NO: 74863 - RNA, 22 nt, Human
cucuuucauucuguccuuguuu

SEQ ID NO: 74864 - RNA, 22 nt, Human
aaauguuugguggauaaaagga

SEQ ID NO: 74865 - RNA, 22 nt, Human
ggcuguggcagcuggaaguggu

SEQ ID NO: 74866 - RNA, 22 nt, Human
ucuucaaauacagucauauuga

SEQ ID NO: 74867 - RNA, 22 nt, Human
uucuuuuaauuucugucugcag

SEQ ID NO: 74868 - RNA, 22 nt, Human
uuuacaaggcaguuauuuuccu

SEQ ID NO: 74869 - RNA, 22 nt, Human
cuaaauucuauauccuugcuuc

SEQ ID NO: 74870 - RNA, 20 nt, Human
uaguggaccuugaaggccuc

SEQ ID NO: 74871 - RNA, 22 nt, Human
cugucucugauaagcucgaggg

SEQ ID NO: 74872 - RNA, 22 nt, Human
gagcagcugagcuggaaugaga

SEQ ID NO: 74873 - RNA, 22 nt, Human
ggccugcuaccagcugugaccu

SEQ ID NO: 74874 - RNA, 22 nt, Human
aaauguauuagccuaugugaga

SEQ ID NO: 74875 - RNA, 22 nt, Human
auuuuagagaaacaaacguagg

SEQ ID NO: 74876 - RNA, 22 nt, Human
gaguucuagauguauuauuaau

SEQ ID NO: 74877 - RNA, 22 nt, Human
aguuuccacuggagacacugug

SEQ ID NO: 74878 - RNA, 22 nt, Human
uauuuuuaccuaauuuaugaga

SEQ ID NO: 74879 - RNA, 22 nt, Human
uagcugucauuggaucagaagg

SEQ ID NO: 74880 - RNA, 22 nt, Human
cagcuccaucuugcuuauacca

SEQ ID NO: 74881 - RNA, 22 nt, Human
ggggcucauuugcaggggggag

SEQ ID NO: 74882 - RNA, 22 nt, Human
auauuuuugcagaauuuuucgu

SEQ ID NO: 74883 - RNA, 22 nt, Human
aaucacuucuuugucuucuuca

SEQ ID NO: 74884 - RNA, 22 nt, Human
uuaacauuguccuuagcagauu

SEQ ID NO: 74885 - RNA, 22 nt, Human
ccucccuucccggcauggcucu

SEQ ID NO: 74886 - RNA, 22 nt, Human
gcucucuggccugggaggagga

SEQ ID NO: 74887 - RNA, 22 nt, Human
uggggcuggccaggaggagucu

SEQ ID NO: 74888 - RNA, 22 nt, Human
cagcucugcugggaggaugcag

SEQ ID NO: 74889 - RNA, 22 nt, Human
uuuauaauuacguaaaauauuu

SEQ ID NO: 74890 - RNA, 22 nt, Human
ugcagcuuuugguuucuagaug

SEQ ID NO: 74891 - RNA, 22 nt, Human
uagggaggguuugggguggagg

SEQ ID NO: 74892 - RNA, 22 nt, Human
uuuauuuuccaugucucuaggu

SEQ ID NO: 74893 - RNA, 22 nt, Human
gcucagcuggagagggacgggu

SEQ ID NO: 74894 - RNA, 22 nt, Human
gauuuuuaaaaguaguuuugaa

SEQ ID NO: 74895 - RNA, 22 nt, Human
ggacggggagcuggaaagggga

SEQ ID NO: 74896 - RNA, 22 nt, Human
auuaaaaaaagauaaugaguua

SEQ ID NO: 74897 - RNA, 22 nt, Human
uuuuauuuguauguugaaugua

SEQ ID NO: 74898 - RNA, 22 nt, Human
cuuggggauuuuaaagaccucu

SEQ ID NO: 74899 - RNA, 20 nt, Human
uucucugcagcaggcggccc

SEQ ID NO: 74900 - RNA, 22 nt, Human
cuuucuuucaaguucugcuuua

SEQ ID NO: 74901 - RNA, 20 nt, Human
ucugugugccaucaccuaac

SEQ ID NO: 74902 - RNA, 20 nt, Human
uuguacuuaugugagaagga

SEQ ID NO: 74903 - RNA, 22 nt, Human
ccaggcuccccaggaggcccuu

SEQ ID NO: 74904 - RNA, 22 nt, Human
aucuaaaacuacgaauacuacc

SEQ ID NO: 74905 - RNA, 22 nt, Human
uaggauugguguauguagguuu

SEQ ID NO: 74906 - RNA, 22 nt, Human
uguacauacauagauauacaca

SEQ ID NO: 74907 - RNA, 22 nt, Human
auuuucuugucucuguuguagg

SEQ ID NO: 74908 - RNA, 22 nt, Human
uuguuuuaguagaaguuacaug

SEQ ID NO: 74909 - RNA, 22 nt, Human
cuccucccagcccaggcgccac

SEQ ID NO: 74910 - RNA, 20 nt, Human
ucacuguaauugccuacauu

SEQ ID NO: 74911 - RNA, 22 nt, Human
agcaaaauuccaaaaugcuaau

SEQ ID NO: 74912 - RNA, 22 nt, Human
cggcugcagcggagcaggcugg

SEQ ID NO: 74913 - RNA, 22 nt, Human
ugucuuuuaaaaauguguaaaa

SEQ ID NO: 74914 - RNA, 22 nt, Human
aagccucaugccagauccaggu

SEQ ID NO: 74915 - RNA, 22 nt, Human
ugagauguaauguaguacuuug

SEQ ID NO: 74916 - RNA, 22 nt, Human
agucaccuacagcucaugcuuc

SEQ ID NO: 74917 - RNA, 22 nt, Human
ggaggccagagaagagccaggc

SEQ ID NO: 74918 - RNA, 22 nt, Human
aagaggcuacagcccugugucu

SEQ ID NO: 74919 - RNA, 22 nt, Human
ggacauaguugcuauggagagu

SEQ ID NO: 74920 - RNA, 22 nt, Human
uguuggaaucuucuagucuucc

SEQ ID NO: 74921 - RNA, 22 nt, Human
uauuuuuacuguuugaugauuc

SEQ ID NO: 74922 - RNA, 22 nt, Human
uuuugcuucuaguauauuuuuu

SEQ ID NO: 74923 - RNA, 22 nt, Human
ucucucugcuguccagcguuau

SEQ ID NO: 74924 - RNA, 22 nt, Human
uucauauuguggucuugcauuc

SEQ ID NO: 74925 - RNA, 22 nt, Human
acucugcaguaaggaauuguuu

SEQ ID NO: 74926 - RNA, 22 nt, Human
uuaggggcuuaggcagaguuug

SEQ ID NO: 74927 - RNA, 20 nt, Human
ggcagagcuaugucuguugc

SEQ ID NO: 74928 - RNA, 22 nt, Human
uuguuguuguuguuauuuaguu

SEQ ID NO: 74929 - RNA, 22 nt, Human
ggcagaggagcuggaaacaugg

SEQ ID NO: 74930 - RNA, 22 nt, Human
gggggacagugugccuggugug

SEQ ID NO: 74931 - RNA, 22 nt, Human
ugagguauuuggauuuauauuu

SEQ ID NO: 74932 - RNA, 22 nt, Human
uuuacuauuaguauuucauuuu

SEQ ID NO: 74933 - RNA, 20 nt, Human
ucagugggaaagugagagug

SEQ ID NO: 74934 - RNA, 22 nt, Human
uuccgcuuucaauggcuuggcu

SEQ ID NO: 74935 - RNA, 22 nt, Human
ugagggaggggaaugugugcag

SEQ ID NO: 74936 - RNA, 22 nt, Human
ggcagggagagcgccgccaugc

SEQ ID NO: 74937 - RNA, 22 nt, Human
uuucuaaaaccagaguuuauaa

SEQ ID NO: 74938 - RNA, 22 nt, Human
uuuuccuucuuccugccuugcc

SEQ ID NO: 74939 - RNA, 21 nt, Human
cuauaaaaaugguucuuugcg

SEQ ID NO: 74940 - RNA, 22 nt, Human
gcagaggcugccgugggcagga

SEQ ID NO: 74941 - RNA, 22 nt, Human
gggggcugugugcccgcucccc

SEQ ID NO: 74942 - RNA, 22 nt, Human
aggcgaagggaccagacgguag

SEQ ID NO: 74943 - RNA, 22 nt, Human
uuaaaagaauccuguuauccuc

SEQ ID NO: 74944 - RNA, 22 nt, Human
gccucucuggcaaagcggugau

SEQ ID NO: 74945 - RNA, 22 nt, Human
uuuuacaaugcaaauucuugcu

SEQ ID NO: 74946 - RNA, 21 nt, Human
aggugaaggcgagggggacag

SEQ ID NO: 74947 - RNA, 22 nt, Human
uacuauuuugacaugaaauuga

SEQ ID NO: 74948 - RNA, 22 nt, Human
ccagucuuggugucuguagcac

SEQ ID NO: 74949 - RNA, 22 nt, Human
auuuuacuaugauaguugagaa

SEQ ID NO: 74950 - RNA, 22 nt, Human
uuauuucauguaaaauuuaugu

SEQ ID NO: 74951 - RNA, 22 nt, Human
cauuuugguaauguucguuugc

SEQ ID NO: 74952 - RNA, 22 nt, Human
auauauguauauaugugugugu

SEQ ID NO: 74953 - RNA, 22 nt, Human
aaugauuuucugcaaacaguga

SEQ ID NO: 74954 - RNA, 22 nt, Human
cuaaaccaauauauuuucuucc

SEQ ID NO: 74955 - RNA, 22 nt, Human
auuucacucuuaauugcuuccu

SEQ ID NO: 74956 - RNA, 22 nt, Human
guccuguguaaguacuugcuca

SEQ ID NO: 74957 - RNA, 22 nt, Human
aaggcuguuugagcacuggagc

SEQ ID NO: 74958 - RNA, 22 nt, Human
ucgagcucagcagggaggugcg

SEQ ID NO: 74959 - RNA, 23 nt, Human
agagggaagagcuuagaugggga

SEQ ID NO: 74960 - RNA, 22 nt, Human
uuaaacauuuccacuugccagu

SEQ ID NO: 74961 - RNA, 22 nt, Human
ugugucuuuggcgaugucugga

SEQ ID NO: 74962 - RNA, 22 nt, Human
augaggaacagcaagaauauuu

SEQ ID NO: 74963 - RNA, 22 nt, Human
uauauaauacacaaauauguac

SEQ ID NO: 74964 - RNA, 22 nt, Human
cuggaagcgucggaggaagggc

SEQ ID NO: 74965 - RNA, 22 nt, Human
aguuaggaaauaaguugaguuu

SEQ ID NO: 74966 - RNA, 22 nt, Human
ucuuugcugacacuuacacugu

SEQ ID NO: 74967 - RNA, 23 nt, Human
uggaaguugagagucugcuuugu

SEQ ID NO: 74968 - RNA, 22 nt, Human
aauguugaaccuuuuuggccug

SEQ ID NO: 74969 - RNA, 22 nt, Human
gaaacauuuguugaguacuugc

SEQ ID NO: 74970 - RNA, 22 nt, Human
uaccuggauaaauguacaaccg

SEQ ID NO: 74971 - RNA, 22 nt, Human
gcuguugugaggaucagcauau

SEQ ID NO: 74972 - RNA, 22 nt, Human
gugucacuuucaggagcucuaa

SEQ ID NO: 74973 - RNA, 22 nt, Human
uaugggcaagagauaggugguc

SEQ ID NO: 74974 - RNA, 22 nt, Human
guuguuuucagcccagcauuag

SEQ ID NO: 74975 - RNA, 22 nt, Human
uuuuuaagguuuguuuauauau

SEQ ID NO: 74976 - RNA, 22 nt, Human
uggaugccuugggggaggagga

SEQ ID NO: 74977 - RNA, 22 nt, Human
gaggggaacaggcauucuuaag

SEQ ID NO: 74978 - RNA, 22 nt, Human
ccagggcuggaggaggucagga

SEQ ID NO: 74979 - RNA, 22 nt, Human
uuauuuucgugugugugugugu

SEQ ID NO: 74980 - RNA, 22 nt, Human
ugggggaggaggagacagacug

SEQ ID NO: 74981 - RNA, 22 nt, Human
uguugaagcaccucugucuuuc

SEQ ID NO: 74982 - RNA, 22 nt, Human
agcgcucauuuuccuccugcuc

SEQ ID NO: 74983 - RNA, 22 nt, Human
cuucuuucuuuucuucuucucu

SEQ ID NO: 74984 - RNA, 22 nt, Human
ucccugcugggcgaucuucucu

SEQ ID NO: 74985 - RNA, 22 nt, Human
aagcucagcugguggugauugc

SEQ ID NO: 74986 - RNA, 20 nt, Human
ccuuguggaugucuuuuuug

SEQ ID NO: 74987 - RNA, 22 nt, Human
guucuucagauuccauuucagu

SEQ ID NO: 74988 - RNA, 22 nt, Human
augugugugcgagcgugugugu

SEQ ID NO: 74989 - RNA, 22 nt, Human
aaauucuuccaggaggaaauac

SEQ ID NO: 74990 - RNA, 22 nt, Human
gcucagagaaaacuggggcuug

SEQ ID NO: 74991 - RNA, 22 nt, Human
ucuugugguggaucccucauuu

SEQ ID NO: 74992 - RNA, 22 nt, Human
uucauagaagggaguuuuuccu

SEQ ID NO: 74993 - RNA, 22 nt, Human
acucauuuggauuuuggaguuu

SEQ ID NO: 74994 - RNA, 22 nt, Human
auucuuuauuuucuguacuugc

SEQ ID NO: 74995 - RNA, 22 nt, Human
guuuccaggcuuugguaugguu

SEQ ID NO: 74996 - RNA, 22 nt, Human
uuucuugugauuuugaugaacu

SEQ ID NO: 74997 - RNA, 22 nt, Human
cuguguguauaauguuugauaa

SEQ ID NO: 74998 - RNA, 22 nt, Human
gccagggcucgagcaggccagc

SEQ ID NO: 74999 - RNA, 22 nt, Human
augcuuucucuucuauuucuca

SEQ ID NO: 75000 - RNA, 20 nt, Human
agugauuuguuaguacauug

SEQ ID NO: 75001 - RNA, 22 nt, Human
ggggcaucguugauugcauggu

SEQ ID NO: 75002 - RNA, 22 nt, Human
uucuugugugaauauaauuaca

SEQ ID NO: 75003 - RNA, 22 nt, Human
uuucuggacuaaagggagagau

SEQ ID NO: 75004 - RNA, 22 nt, Human
uugucaggaacuaugauuaugc

SEQ ID NO: 75005 - RNA, 22 nt, Human
ggggaggguuuggaugagaguc

SEQ ID NO: 75006 - RNA, 23 nt, Human
cagagaaaauagaauaugcugug

SEQ ID NO: 75007 - RNA, 22 nt, Human
guuuggguggcuagagaaagaa

SEQ ID NO: 75008 - RNA, 22 nt, Human
uggggggacagauggagaggac

SEQ ID NO: 75009 - RNA, 22 nt, Human
ggcugugguggacgcgggaaac

SEQ ID NO: 75010 - RNA, 22 nt, Human
ucacuuccuugcagcuguagaa

SEQ ID NO: 75011 - RNA, 23 nt, Human
aggcugcagaagaauagggucau

SEQ ID NO: 75012 - RNA, 22 nt, Human
augcagauguagauucugaaau

SEQ ID NO: 75013 - RNA, 22 nt, Human
ggcugggagguggcgaggaggc

SEQ ID NO: 75014 - RNA, 22 nt, Human
cuucuucaucuuuuggaggaac

SEQ ID NO: 75015 - RNA, 22 nt, Human
ugucccaucacagaggagacua

SEQ ID NO: 75016 - RNA, 22 nt, Human
auuuuucuuucacauuuucuua

SEQ ID NO: 75017 - RNA, 22 nt, Human
ggaggaugaggguggugguguu

SEQ ID NO: 75018 - RNA, 22 nt, Human
cagagcugucauuugccaguga

SEQ ID NO: 75019 - RNA, 22 nt, Human
gcugcaggaggugguagggucu

SEQ ID NO: 75020 - RNA, 22 nt, Human
ucauacuuuuuugacccuugug

SEQ ID NO: 75021 - RNA, 22 nt, Human
uuuuaaaacaugucaaaaugug

SEQ ID NO: 75022 - RNA, 22 nt, Human
uuuacuguuuacagcuaaugca

SEQ ID NO: 75023 - RNA, 22 nt, Human
uggggcauacgugaaauaauuu

SEQ ID NO: 75024 - RNA, 22 nt, Human
aggcaguggagcuggaauaggc

SEQ ID NO: 75025 - RNA, 21 nt, Human
uuccuggaggcagaaacguga

SEQ ID NO: 75026 - RNA, 22 nt, Human
gcuggccugcgagggcaggcug

SEQ ID NO: 75027 - RNA, 22 nt, Human
auucuuuagaguccuucaaaua

SEQ ID NO: 75028 - RNA, 22 nt, Human
aggauggauagcaaggaagccg

SEQ ID NO: 75029 - RNA, 22 nt, Human
uuuucauagccagaaacugaaa

SEQ ID NO: 75030 - RNA, 22 nt, Human
ucacaucugugugauugucauu

SEQ ID NO: 75031 - RNA, 22 nt, Human
uggccccauuuuucuggagccu

SEQ ID NO: 75032 - RNA, 22 nt, Human
agucacuguucugucaugucaa

SEQ ID NO: 75033 - RNA, 22 nt, Human
ggcagucuuucccuugagcucu

SEQ ID NO: 75034 - RNA, 22 nt, Human
uugaauaguuuuggauagcaua

SEQ ID NO: 75035 - RNA, 20 nt, Human
cuggaguguagcaguggcug

SEQ ID NO: 75036 - RNA, 22 nt, Human
uuuguuugcugagugaauucaa

SEQ ID NO: 75037 - RNA, 22 nt, Human
uucuucuucuuccucauccuca

SEQ ID NO: 75038 - RNA, 22 nt, Human
agcugaggccccgcagcagggu

SEQ ID NO: 75039 - RNA, 22 nt, Human
uuauuugcccauguuuagcaga

SEQ ID NO: 75040 - RNA, 22 nt, Human
ccaggcucaccuggagccccug

SEQ ID NO: 75041 - RNA, 22 nt, Human
agcaagggucucucauggcuug

SEQ ID NO: 75042 - RNA, 19 nt, Human
uagaggagaauggcaaaga

SEQ ID NO: 75043 - RNA, 23 nt, Human
uuuuccaaaucgacucucuaguu

SEQ ID NO: 75044 - RNA, 22 nt, Human
agagauacugcaggccauaaau

SEQ ID NO: 75045 - RNA, 22 nt, Human
auacauauaugcacauuaauau

SEQ ID NO: 75046 - RNA, 22 nt, Human
cacuguugagcaauguacagug

SEQ ID NO: 75047 - RNA, 22 nt, Human
ucucucucucuuccagcauguu

SEQ ID NO: 75048 - RNA, 22 nt, Human
gcuuucacugcaauagaugaau

SEQ ID NO: 75049 - RNA, 22 nt, Human
guuuaaaagcaaccaacaggcu

SEQ ID NO: 75050 - RNA, 22 nt, Human
uuauaucagaaggugagauuga

SEQ ID NO: 75051 - RNA, 22 nt, Human
ugaaaaauauuuuuagaaauaa

SEQ ID NO: 75052 - RNA, 22 nt, Human
uuuuccuuccugucucuuuauu

SEQ ID NO: 75053 - RNA, 22 nt, Human
cagaccagaaggaagccgacaa

SEQ ID NO: 75054 - RNA, 22 nt, Human
uuuuauaauacccuugacuaau

SEQ ID NO: 75055 - RNA, 22 nt, Human
aauauuuugggacugaggaauu

SEQ ID NO: 75056 - RNA, 22 nt, Human
uuauauuuuauuuaauuaaaua

SEQ ID NO: 75057 - RNA, 22 nt, Human
cacauuuuccagaagaaucaga

SEQ ID NO: 75058 - RNA, 22 nt, Human
cuguggcugcgcccugggggag

SEQ ID NO: 75059 - RNA, 22 nt, Human
gugaucagaagaaccugccgaa

SEQ ID NO: 75060 - RNA, 22 nt, Human
uguuuagcucugacuaugugau

SEQ ID NO: 75061 - RNA, 21 nt, Human
uuucauuaguacaucaauuug

SEQ ID NO: 75062 - RNA, 22 nt, Human
uauuuucucugccacacuucca

SEQ ID NO: 75063 - RNA, 22 nt, Human
uauuuuaaaagcauuaauucuu

SEQ ID NO: 75064 - RNA, 22 nt, Human
uucuuuuaauagagauccugug

SEQ ID NO: 75065 - RNA, 22 nt, Human
uuuaacauaugaaagaauauuu

SEQ ID NO: 75066 - RNA, 22 nt, Human
uucuugucuuuguuauguagga

SEQ ID NO: 75067 - RNA, 22 nt, Human
gcuguggacacagcucucuuca

SEQ ID NO: 75068 - RNA, 22 nt, Human
uuuuaaauggcuuuuacuuuuc

SEQ ID NO: 75069 - RNA, 22 nt, Human
gcuggaaauaacuuguguagaa

SEQ ID NO: 75070 - RNA, 22 nt, Human
agagacuguaaugagagguaca

SEQ ID NO: 75071 - RNA, 22 nt, Human
auuuuauuuugggaucuuuuua

SEQ ID NO: 75072 - RNA, 22 nt, Human
gagcagcucgagaaggaagcag

SEQ ID NO: 75073 - RNA, 22 nt, Human
guacauauccuuuacguuuugu

SEQ ID NO: 75074 - RNA, 22 nt, Human
uuucacugaguaggagagcacu

SEQ ID NO: 75075 - RNA, 22 nt, Human
ggggaaggaaggggagggcacg

SEQ ID NO: 75076 - RNA, 22 nt, Human
uuguuuucuaguguuuugaaua

SEQ ID NO: 75077 - RNA, 22 nt, Human
agauuuucuuuuccaucuuugu

SEQ ID NO: 75078 - RNA, 22 nt, Human
caaaucuguuaauuucaaguug

SEQ ID NO: 75079 - RNA, 21 nt, Human
uggcaggcagcuggaagcuug

SEQ ID NO: 75080 - RNA, 22 nt, Human
ggcuccaggguaccccuggaug

SEQ ID NO: 75081 - RNA, 22 nt, Human
ugugugcuaguuuugucaguau

SEQ ID NO: 75082 - RNA, 22 nt, Human
aaauguaaacuguauuuauaaa

SEQ ID NO: 75083 - RNA, 22 nt, Human
ugccagcuccgaggagcugcag

SEQ ID NO: 75084 - RNA, 22 nt, Human
aggcaguguguagcuggaagag

SEQ ID NO: 75085 - RNA, 22 nt, Human
uucaugucuuugauucugauaa

SEQ ID NO: 75086 - RNA, 22 nt, Human
agggggaauccugcuuauggau

SEQ ID NO: 75087 - RNA, 22 nt, Human
auguacugacuguacuuuuaaa

SEQ ID NO: 75088 - RNA, 22 nt, Human
aagagaggaaagggugugaggu

SEQ ID NO: 75089 - RNA, 22 nt, Human
guuuucuuguuaauuuugaacg

SEQ ID NO: 75090 - RNA, 22 nt, Human
guuauuguuauugcguugucga

SEQ ID NO: 75091 - RNA, 22 nt, Human
aaauauuaaugaugaagguagu

SEQ ID NO: 75092 - RNA, 22 nt, Human
aggcaggggagcuggaagggua

SEQ ID NO: 75093 - RNA, 22 nt, Human
cccagagggcugaggauaugaa

SEQ ID NO: 75094 - RNA, 22 nt, Human
cagaccuggaaaacaggcuugc

SEQ ID NO: 75095 - RNA, 22 nt, Human
ggcucacuguaccugccgccgc

SEQ ID NO: 75096 - RNA, 22 nt, Human
aagugugugugcgcaugugcau

SEQ ID NO: 75097 - RNA, 22 nt, Human
aagugaggagaccucuucuuca

SEQ ID NO: 75098 - RNA, 22 nt, Human
aaaacauuuaggguuuuuuuua

SEQ ID NO: 75099 - RNA, 22 nt, Human
ugauucacagacuucacaaggc

SEQ ID NO: 75100 - RNA, 22 nt, Human
ucauuauuuugauguauuuccu

SEQ ID NO: 75101 - RNA, 22 nt, Human
cggggcuggcguuagggaggca

SEQ ID NO: 75102 - RNA, 18 nt, Human
ggccucagccuggccgga

SEQ ID NO: 75103 - RNA, 22 nt, Human
uaaaugauaguauugaagguag

SEQ ID NO: 75104 - RNA, 22 nt, Human
uuagaaauguccuacuaauaug

SEQ ID NO: 75105 - RNA, 22 nt, Human
uguuuuuuagagugauacuuuu

SEQ ID NO: 75106 - RNA, 23 nt, Human
ucagaccaaccucuugcuggaac

SEQ ID NO: 75107 - RNA, 22 nt, Human
ugaguucugacugagcaugggg

SEQ ID NO: 75108 - RNA, 17 nt, Human
ucuuuuacuuucucucc

SEQ ID NO: 75109 - RNA, 22 nt, Human
uggggcugguaccguaauauau

SEQ ID NO: 75110 - RNA, 22 nt, Human
ucuuuuaucuguuguguaacaa

SEQ ID NO: 75111 - RNA, 22 nt, Human
ggugucuuugauguugggcuga

SEQ ID NO: 75112 - RNA, 22 nt, Human
uuguuauuauuauuuucguucu

SEQ ID NO: 75113 - RNA, 22 nt, Human
auacaucuuaacgcgcucuugg

SEQ ID NO: 75114 - RNA, 22 nt, Human
acuguugagggaagcagaugaa

SEQ ID NO: 75115 - RNA, 22 nt, Human
uugauagauuuuagaggcaggc

SEQ ID NO: 75116 - RNA, 22 nt, Human
uaucauuuuacugugacauuuu

SEQ ID NO: 75117 - RNA, 22 nt, Human
uucugcuuuaaagcucauguuu

SEQ ID NO: 75118 - RNA, 22 nt, Human
cagcuuguucugaccugugauu

SEQ ID NO: 75119 - RNA, 22 nt, Human
uuuucaaucaaguuuauuuaua

SEQ ID NO: 75120 - RNA, 22 nt, Human
uauaagaaaagucauuaucaaa

SEQ ID NO: 75121 - RNA, 22 nt, Human
cacugcacuccagccugggcaa

SEQ ID NO: 75122 - RNA, 22 nt, Human
gcagguggaagcagcagacuca

SEQ ID NO: 75123 - RNA, 22 nt, Human
uuuaaucaguugguaauauuga

SEQ ID NO: 75124 - RNA, 22 nt, Human
uugcaagcccugaagggcugga

SEQ ID NO: 75125 - RNA, 22 nt, Human
gauuuuaaaagauguauaaggu

SEQ ID NO: 75126 - RNA, 22 nt, Human
uuauuuuuguuuguuaagccua

SEQ ID NO: 75127 - RNA, 22 nt, Human
uggguauauauguugcuacaga

SEQ ID NO: 75128 - RNA, 16 nt, Human
gaauuccauugcucug

SEQ ID NO: 75129 - RNA, 22 nt, Human
aggauggaaguaacuggauaau

SEQ ID NO: 75130 - RNA, 22 nt, Human
ccugccagaaaagagggaguuc

SEQ ID NO: 75131 - RNA, 22 nt, Human
ggaaggggagcuggaaagggua

SEQ ID NO: 75132 - RNA, 22 nt, Human
cuuuuuuucuccauauuucugg

SEQ ID NO: 75133 - RNA, 22 nt, Human
aguaaaugaaagcaauuuuaga

SEQ ID NO: 75134 - RNA, 22 nt, Human
gugguuuagccuucauuaaccu

SEQ ID NO: 75135 - RNA, 23 nt, Human
aaggugaagccaccaggugagga

SEQ ID NO: 75136 - RNA, 22 nt, Human
uuguuuguaaggcucuuagaau

SEQ ID NO: 75137 - RNA, 22 nt, Human
acuggagcccguggaggcgcag

SEQ ID NO: 75138 - RNA, 22 nt, Human
uuuuucuccucucucuuucauu

SEQ ID NO: 75139 - RNA, 22 nt, Human
ugggcagggauuuggggaaacu

SEQ ID NO: 75140 - RNA, 22 nt, Human
uucucuugccuucucuuuuauc

SEQ ID NO: 75141 - RNA, 22 nt, Human
auagagcuggggaagaagcugg

SEQ ID NO: 75142 - RNA, 22 nt, Human
agcggccucgcugccugcucag

SEQ ID NO: 75143 - RNA, 22 nt, Human
auucuucauguugaagcuguca

SEQ ID NO: 75144 - RNA, 18 nt, Human
uucaggcucuugcaugaa

SEQ ID NO: 75145 - RNA, 22 nt, Human
agccccaauuacagcugugcug

SEQ ID NO: 75146 - RNA, 22 nt, Human
agggaggagggacagaaagagg

SEQ ID NO: 75147 - RNA, 22 nt, Human
gagggagugggcccgugggcac

SEQ ID NO: 75148 - RNA, 22 nt, Human
ucagccuugguuuugguguugg

SEQ ID NO: 75149 - RNA, 22 nt, Human
caggccccagggacugggcgcu

SEQ ID NO: 75150 - RNA, 21 nt, Human
aaguuucucccuaauuguugc

SEQ ID NO: 75151 - RNA, 20 nt, Human
uucacagaggacucagguca

SEQ ID NO: 75152 - RNA, 22 nt, Human
cuccacagccccuccaguggca

SEQ ID NO: 75153 - RNA, 22 nt, Human
gcucagccuuuuguucuauuca

SEQ ID NO: 75154 - RNA, 22 nt, Human
auuuaaaaacugguacaacagg

SEQ ID NO: 75155 - RNA, 22 nt, Human
ggaggaagagaccagggggcuu

SEQ ID NO: 75156 - RNA, 22 nt, Human
uuuuaauaguauaucuagacac

SEQ ID NO: 75157 - RNA, 22 nt, Human
guauauuuaugagcauuagccu

SEQ ID NO: 75158 - RNA, 22 nt, Human
gcugucccccaaagaugcuccu

SEQ ID NO: 75159 - RNA, 20 nt, Human
uuuuuuaaauagagcuguug

SEQ ID NO: 75160 - RNA, 22 nt, Human
uggagcugguucuggggaagcu

SEQ ID NO: 75161 - RNA, 22 nt, Human
guggaaggaauuaacagacuag

SEQ ID NO: 75162 - RNA, 22 nt, Human
gaggcaggcggggcccaggugg

SEQ ID NO: 75163 - RNA, 22 nt, Human
cauuucaaacaguuacagcugc

SEQ ID NO: 75164 - RNA, 22 nt, Human
aaggugggacugagaggggaca

SEQ ID NO: 75165 - RNA, 22 nt, Human
acauaaaccccccuuccccagg

SEQ ID NO: 75166 - RNA, 22 nt, Human
uucucugcgcuccggcccaguu

SEQ ID NO: 75167 - RNA, 22 nt, Human
uuuaaauuucugaaucuugagg

SEQ ID NO: 75168 - RNA, 22 nt, Human
gaauuagguaauagaacuagua

SEQ ID NO: 75169 - RNA, 22 nt, Human
ggcugugaaguacguugaaggu

SEQ ID NO: 75170 - RNA, 22 nt, Human
aagaugcuucaugagaguuggg

SEQ ID NO: 75171 - RNA, 22 nt, Human
cugguuuauuucauaguuuguu

SEQ ID NO: 75172 - RNA, 22 nt, Human
uuuuguuuacauuaaauuuuga

SEQ ID NO: 75173 - RNA, 23 nt, Human
ccagcugugccuggcccaggagc

SEQ ID NO: 75174 - RNA, 22 nt, Human
aaauauagugacacuuauaguc

SEQ ID NO: 75175 - RNA, 22 nt, Human
ucacuguuucaccgucugaagg

SEQ ID NO: 75176 - RNA, 22 nt, Human
uuuuguuacugauuauuaaaau

SEQ ID NO: 75177 - RNA, 20 nt, Human
ugccagagagcucauacccu

SEQ ID NO: 75178 - RNA, 22 nt, Human
ggaggcccagaaggaagcccag

SEQ ID NO: 75179 - RNA, 22 nt, Human
uggagccuugugagaccacaau

SEQ ID NO: 75180 - RNA, 23 nt, Human
uucuuuccuuaucccauuuacuu

SEQ ID NO: 75181 - RNA, 22 nt, Human
ucuucacagaugcauauacuuc

SEQ ID NO: 75182 - RNA, 22 nt, Human
uauauuaaagugcuuugcagug

SEQ ID NO: 75183 - RNA, 22 nt, Human
uauuuuagccaacagaaugaug

SEQ ID NO: 75184 - RNA, 22 nt, Human
aaaauauaaaggauguggguuu

SEQ ID NO: 75185 - RNA, 22 nt, Human
uuauuuaaaauguagguuggga

SEQ ID NO: 75186 - RNA, 20 nt, Human
ugauuauuccaacaagaaug

SEQ ID NO: 75187 - RNA, 22 nt, Human
cuagcacagugcuuggcacaca

SEQ ID NO: 75188 - RNA, 22 nt, Human
uuuaucaggccaucuuaugucu

SEQ ID NO: 75189 - RNA, 23 nt, Human
ucugccuccuaauuguugguguc

SEQ ID NO: 75190 - RNA, 22 nt, Human
uuuuaggauuugaguugcugga

SEQ ID NO: 75191 - RNA, 22 nt, Human
uuauuuuuguaacacuguauag

SEQ ID NO: 75192 - RNA, 22 nt, Human
ggaggccgugcugugcugccag

SEQ ID NO: 75193 - RNA, 22 nt, Human
gggcagagagcuggaacuccuu

SEQ ID NO: 75194 - RNA, 23 nt, Human
uccuccccaccuuuguccccucc

SEQ ID NO: 75195 - RNA, 20 nt, Human
gacaugagggagcaaagagc

SEQ ID NO: 75196 - RNA, 22 nt, Human
acuuuauacuagugauaguuug

SEQ ID NO: 75197 - RNA, 22 nt, Human
cuguggcuaggaagcuguggga

SEQ ID NO: 75198 - RNA, 22 nt, Human
ggcugcagggaacaggaugggu

SEQ ID NO: 75199 - RNA, 20 nt, Human
uuggagaucacguguccagg

SEQ ID NO: 75200 - RNA, 22 nt, Human
ucagucucuggggcuucuguuu

SEQ ID NO: 75201 - RNA, 22 nt, Human
auggauggaagcagccugaacu

SEQ ID NO: 75202 - RNA, 22 nt, Human
gugucccaaagauuagaaauca

SEQ ID NO: 75203 - RNA, 22 nt, Human
aagagaggcccaaguggcuggc

SEQ ID NO: 75204 - RNA, 22 nt, Human
agucugugguccucuguaucuc

SEQ ID NO: 75205 - RNA, 22 nt, Human
uacugcaguuccugcugucucc

SEQ ID NO: 75206 - RNA, 22 nt, Human
cauaggcucuucagagaacuga

SEQ ID NO: 75207 - RNA, 22 nt, Human
cucuguguguuugugugugugu

SEQ ID NO: 75208 - RNA, 23 nt, Human
uugcuuuugccccaaaagaguua

SEQ ID NO: 75209 - RNA, 22 nt, Human
auguguguaugacugaaucuau

SEQ ID NO: 75210 - RNA, 22 nt, Human
aaagggagauaaaguaauuuua

SEQ ID NO: 75211 - RNA, 22 nt, Human
cagcuccagcccaggcagcucc

SEQ ID NO: 75212 - RNA, 22 nt, Human
aggguggaggacaggccaguga

SEQ ID NO: 75213 - RNA, 22 nt, Human
uuauuguuuggguauaauuuga

SEQ ID NO: 75214 - RNA, 22 nt, Human
gcuucuguuaggauguggcuua

SEQ ID NO: 75215 - RNA, 20 nt, Human
cuuauuuuggagaacuuuuc

SEQ ID NO: 75216 - RNA, 21 nt, Human
ugagcccaaagcuguauuggu

SEQ ID NO: 75217 - RNA, 22 nt, Human
ccccauggaaaacccaccuagg

SEQ ID NO: 75218 - RNA, 22 nt, Human
gcuguggaaaaugggucuccaa

SEQ ID NO: 75219 - RNA, 22 nt, Human
gcuuauuagguuauuucaagga

SEQ ID NO: 75220 - RNA, 22 nt, Human
uauuuaaagucagcaacuuuuc

SEQ ID NO: 75221 - RNA, 22 nt, Human
cuucuuaaaguugucacagcug

SEQ ID NO: 75222 - RNA, 22 nt, Human
uauuuguauugucuuaucacuu

SEQ ID NO: 75223 - RNA, 22 nt, Human
agcuuucuauauaugaguugcu

SEQ ID NO: 75224 - RNA, 22 nt, Human
ucaaauaugggccagaggaaau

SEQ ID NO: 75225 - RNA, 22 nt, Human
augcaaaaucuuauuuuuucua

SEQ ID NO: 75226 - RNA, 22 nt, Human
aggcucagcaucugauucauau

SEQ ID NO: 75227 - RNA, 17 nt, Human
ugucuuuuuccuccucc

SEQ ID NO: 75228 - RNA, 22 nt, Human
cucacugucagcugcagggcuu

SEQ ID NO: 75229 - RNA, 22 nt, Human
cuguuaauugugaauuuuacau

SEQ ID NO: 75230 - RNA, 22 nt, Human
uacuuacacugaagcaaagaua

SEQ ID NO: 75231 - RNA, 23 nt, Human
aaauaauaauuucucuguuggga

SEQ ID NO: 75232 - RNA, 22 nt, Human
uuucagaaauggcacugaaauc

SEQ ID NO: 75233 - RNA, 22 nt, Human
aguaggauguuuagcccuucuu

SEQ ID NO: 75234 - RNA, 22 nt, Human
uucccugugcaguauguuccaa

SEQ ID NO: 75235 - RNA, 22 nt, Human
ggcuggggccuguugaagaugc

SEQ ID NO: 75236 - RNA, 22 nt, Human
uucuuuucuucccuguuuauua

SEQ ID NO: 75237 - RNA, 21 nt, Human
guucuuaguuauauucucaau

SEQ ID NO: 75238 - RNA, 22 nt, Human
ucugaggacagugcugugccug

SEQ ID NO: 75239 - RNA, 22 nt, Human
cugccucucaugccugcuugcu

SEQ ID NO: 75240 - RNA, 22 nt, Human
ccuccuuuccuguuuuccugag

SEQ ID NO: 75241 - RNA, 22 nt, Human
cuacuucucccuagaucagaaa

SEQ ID NO: 75242 - RNA, 22 nt, Human
uguugaaacagcuauugacuuu

SEQ ID NO: 75243 - RNA, 22 nt, Human
gucucacuucauuuucuuagcc

SEQ ID NO: 75244 - RNA, 22 nt, Human
uucaaacaguguagaauauaug

SEQ ID NO: 75245 - RNA, 22 nt, Human
uugcucuuaccauuauguguga

SEQ ID NO: 75246 - RNA, 22 nt, Human
ucugagugacguccugacagga

SEQ ID NO: 75247 - RNA, 20 nt, Human
cuccuccccucggccccacc

SEQ ID NO: 75248 - RNA, 22 nt, Human
agcagggagacagugcagcauu

SEQ ID NO: 75249 - RNA, 22 nt, Human
agugaggggagaaugaggugga

SEQ ID NO: 75250 - RNA, 22 nt, Human
aggugagaacguggaggggcgg

SEQ ID NO: 75251 - RNA, 22 nt, Human
uuccuuuaaccaagagcaguac

SEQ ID NO: 75252 - RNA, 22 nt, Human
caauggagccaagaggaggaaa

SEQ ID NO: 75253 - RNA, 22 nt, Human
gagggggaaaagggcagcagag

SEQ ID NO: 75254 - RNA, 19 nt, Human
gauauugagcugagaauuc

SEQ ID NO: 75255 - RNA, 22 nt, Human
aacacuaaaggucaguuagaag

SEQ ID NO: 75256 - RNA, 22 nt, Human
uauauacacgcacauauacaua

SEQ ID NO: 75257 - RNA, 22 nt, Human
auauguuaugccauuuucaagg

SEQ ID NO: 75258 - RNA, 22 nt, Human
gugaaauuguacacucaguacc

SEQ ID NO: 75259 - RNA, 22 nt, Human
guugcuaugaaauuaaaauuua

SEQ ID NO: 75260 - RNA, 22 nt, Human
cuggagaacucugugcuucacu

SEQ ID NO: 75261 - RNA, 22 nt, Human
uacauaauagcaaggugcuguc

SEQ ID NO: 75262 - RNA, 22 nt, Human
aggccccacaaacucgccuuug

SEQ ID NO: 75263 - RNA, 22 nt, Human
auaaaaauguuuuuguguggua

SEQ ID NO: 75264 - RNA, 22 nt, Human
aucucacuucugucauguggca

SEQ ID NO: 75265 - RNA, 22 nt, Human
augcggcugugggggaauggga

SEQ ID NO: 75266 - RNA, 22 nt, Human
cuccuugguuccggcguuggag

SEQ ID NO: 75267 - RNA, 22 nt, Human
augggagggugaggaggcagcu

SEQ ID NO: 75268 - RNA, 22 nt, Human
cuucuuuucuacuggccuagaa

SEQ ID NO: 75269 - RNA, 22 nt, Human
auguuuaauuugaaauuuuauu

SEQ ID NO: 75270 - RNA, 22 nt, Human
auucuuuucucuaaaugaugaa

SEQ ID NO: 75271 - RNA, 22 nt, Human
aguuauuuuucacuauuaggcu

SEQ ID NO: 75272 - RNA, 22 nt, Human
gcagaaguauuguacgguggga

SEQ ID NO: 75273 - RNA, 22 nt, Human
cauggcaggugcagauucugug

SEQ ID NO: 75274 - RNA, 22 nt, Human
uaguuucuucaacugucccagc

SEQ ID NO: 75275 - RNA, 22 nt, Human
guucuucagcccucagguccua

SEQ ID NO: 75276 - RNA, 22 nt, Human
auagaaauagacaaugcaaaga

SEQ ID NO: 75277 - RNA, 22 nt, Human
gcccugucagcucucauggaca

SEQ ID NO: 75278 - RNA, 22 nt, Human
auggagugggaggacaugaagg

SEQ ID NO: 75279 - RNA, 22 nt, Human
gggcaagaagcuggaagcauuc

SEQ ID NO: 75280 - RNA, 22 nt, Human
auuuuuuuuccugucucuuuca

SEQ ID NO: 75281 - RNA, 22 nt, Human
ugagggaguguggauacaguag

SEQ ID NO: 75282 - RNA, 22 nt, Human
uggguucaaauccugguuccac

SEQ ID NO: 75283 - RNA, 18 nt, Human
acaaaaauagugcuuugg

SEQ ID NO: 75284 - RNA, 22 nt, Human
aggggaggggaguaucaggauu

SEQ ID NO: 75285 - RNA, 22 nt, Human
ucugcaugccucaggaggccug

SEQ ID NO: 75286 - RNA, 22 nt, Human
ggagaggaaguuuaaagaauug

SEQ ID NO: 75287 - RNA, 22 nt, Human
aaaucauagccaugaacauuug

SEQ ID NO: 75288 - RNA, 22 nt, Human
uauuaaaagagaaaaagccacc

SEQ ID NO: 75289 - RNA, 22 nt, Human
gaggcuugccacuguccauggc

SEQ ID NO: 75290 - RNA, 22 nt, Human
caguggacacuuccucuacaau

SEQ ID NO: 75291 - RNA, 21 nt, Human
acugggcuagccugacuucug

SEQ ID NO: 75292 - RNA, 23 nt, Human
uuucugaguuuuuuaaaagucca

SEQ ID NO: 75293 - RNA, 22 nt, Human
caauccccaggucccagaacag

SEQ ID NO: 75294 - RNA, 19 nt, Human
agcaucuccacagaaaaag

SEQ ID NO: 75295 - RNA, 22 nt, Human
auuuuuuuggucauaugagaua

SEQ ID NO: 75296 - RNA, 22 nt, Human
agagggagagauuggcaaucag

SEQ ID NO: 75297 - RNA, 21 nt, Human
gcagcucaggauauagacuug

SEQ ID NO: 75298 - RNA, 22 nt, Human
gcaggggguaaggggcagggcu

SEQ ID NO: 75299 - RNA, 22 nt, Human
auuuuugguuucaccugcacgc

SEQ ID NO: 75300 - RNA, 22 nt, Human
uucacauucauuucuuauguuu

SEQ ID NO: 75301 - RNA, 22 nt, Human
uuuuuuuuacuccggacagcuc

SEQ ID NO: 75302 - RNA, 22 nt, Human
guuuauucuuuuauuugugaga

SEQ ID NO: 75303 - RNA, 22 nt, Human
cuccuuugagcaaaucuuugau

SEQ ID NO: 75304 - RNA, 22 nt, Human
aagggagagggagaagguggga

SEQ ID NO: 75305 - RNA, 22 nt, Human
uucacuuuuucucugcuugaga

SEQ ID NO: 75306 - RNA, 22 nt, Human
gcuugcuuuguaaauaucugug

SEQ ID NO: 75307 - RNA, 20 nt, Human
ccugggcuccaggagccccg

SEQ ID NO: 75308 - RNA, 22 nt, Human
aaauuuuguugaaaaauauuuu

SEQ ID NO: 75309 - RNA, 19 nt, Human
agugaacuccauaucaggu

SEQ ID NO: 75310 - RNA, 22 nt, Human
aucuguuccccuaugcucucua

SEQ ID NO: 75311 - RNA, 22 nt, Human
gugcugggaggcccaggaugga

SEQ ID NO: 75312 - RNA, 19 nt, Human
uagcuguucuugaguguga

SEQ ID NO: 75313 - RNA, 22 nt, Human
guuguugucauuagcuguuuaa

SEQ ID NO: 75314 - RNA, 22 nt, Human
guuguuuuuguuaaaacaguga

SEQ ID NO: 75315 - RNA, 22 nt, Human
aaugaauaaauuuuaaagacag

SEQ ID NO: 75316 - RNA, 22 nt, Human
gacuggggcauuagaguagcuu

SEQ ID NO: 75317 - RNA, 22 nt, Human
gaggugauuccucccauguaau

SEQ ID NO: 75318 - RNA, 22 nt, Human
acauauaugugcauacaacuau

SEQ ID NO: 75319 - RNA, 22 nt, Human
acauuccugaagguaaugagaa

SEQ ID NO: 75320 - RNA, 20 nt, Human
uggguucaguuguuucuggc

SEQ ID NO: 75321 - RNA, 22 nt, Human
ugguucuagaugagaugaugag

SEQ ID NO: 75322 - RNA, 22 nt, Human
uuauuuuuaggaauguagaggu

SEQ ID NO: 75323 - RNA, 22 nt, Human
ggggaggugugcaggacaccuc

SEQ ID NO: 75324 - RNA, 22 nt, Human
agguggucccaauggcugggca

SEQ ID NO: 75325 - RNA, 22 nt, Human
gucugcagcacugugcacgguc

SEQ ID NO: 75326 - RNA, 22 nt, Human
uagacugugagcuccuugaggg

SEQ ID NO: 75327 - RNA, 22 nt, Human
agggcucacuacaacccuggga

SEQ ID NO: 75328 - RNA, 22 nt, Human
uugguuuacucuggggauaucu

SEQ ID NO: 75329 - RNA, 20 nt, Human
gaacauaaauaacucuuuac

SEQ ID NO: 75330 - RNA, 22 nt, Human
cauaaauuuuaccuuguaagug

SEQ ID NO: 75331 - RNA, 18 nt, Human
aggcuggggaucacaggg

SEQ ID NO: 75332 - RNA, 22 nt, Human
ugguugauuaauuuugccaagc

SEQ ID NO: 75333 - RNA, 22 nt, Human
uuuuucuuugcuuuccacuggc

SEQ ID NO: 75334 - RNA, 22 nt, Human
cuccugcuuuuucuucuuccga

SEQ ID NO: 75335 - RNA, 22 nt, Human
caguggagaccugccugcugga

SEQ ID NO: 75336 - RNA, 22 nt, Human
ggcaaggaagaaagcagaaguu

SEQ ID NO: 75337 - RNA, 22 nt, Human
cuuuuuaaaguaaauggcuaga

SEQ ID NO: 75338 - RNA, 22 nt, Human
gggagccucccacugggggaag

SEQ ID NO: 75339 - RNA, 22 nt, Human
auuuucuucauuuugauuguau

SEQ ID NO: 75340 - RNA, 22 nt, Human
guuuuauaacuauagugagaau

SEQ ID NO: 75341 - RNA, 22 nt, Human
ugcuuucaaugaauuguauacu

SEQ ID NO: 75342 - RNA, 22 nt, Human
aucauguauauuuuugcuauua

SEQ ID NO: 75343 - RNA, 22 nt, Human
gaggccagcacccagaugcaug

SEQ ID NO: 75344 - RNA, 22 nt, Human
uucuaauauuaugauuucuaag

SEQ ID NO: 75345 - RNA, 22 nt, Human
aagcucuuuccacuaaaccacu

SEQ ID NO: 75346 - RNA, 22 nt, Human
uguauuuuuucccugaaauaaa

SEQ ID NO: 75347 - RNA, 22 nt, Human
guguugaugugucuguauucua

SEQ ID NO: 75348 - RNA, 22 nt, Human
uuucacuucgaucagaguuuuu

SEQ ID NO: 75349 - RNA, 22 nt, Human
uaucugcuggagguaauuacuc

SEQ ID NO: 75350 - RNA, 22 nt, Human
ugaauucaaacuuuuuaacaag

SEQ ID NO: 75351 - RNA, 22 nt, Human
augggagggagcagugaguguu

SEQ ID NO: 75352 - RNA, 22 nt, Human
aucacuagaguuacauugccag

SEQ ID NO: 75353 - RNA, 22 nt, Human
augaagguggacagauuuuuuu

SEQ ID NO: 75354 - RNA, 22 nt, Human
cuguuucucugccugcacacau

SEQ ID NO: 75355 - RNA, 22 nt, Human
gcacaaaagguacuucauguag

SEQ ID NO: 75356 - RNA, 22 nt, Human
gucuuucuuuuacauauuugug

SEQ ID NO: 75357 - RNA, 22 nt, Human
guaaauaucucacgaaugauuc

SEQ ID NO: 75358 - RNA, 22 nt, Human
ggcuagggaucuagaccaggac

SEQ ID NO: 75359 - RNA, 22 nt, Human
augcugugccuggaaagcggcu

SEQ ID NO: 75360 - RNA, 22 nt, Human
uggcucaguaaucgagucuccu

SEQ ID NO: 75361 - RNA, 22 nt, Human
gguagacugagcuccuugagga

SEQ ID NO: 75362 - RNA, 22 nt, Human
auucauucugaccucaagagaa

SEQ ID NO: 75363 - RNA, 22 nt, Human
acuuuuccuggguagcuccugg

SEQ ID NO: 75364 - RNA, 22 nt, Human
uggagucuugcuuugggagugc

SEQ ID NO: 75365 - RNA, 22 nt, Human
ugcuuucaaaacucagaggaau

SEQ ID NO: 75366 - RNA, 22 nt, Human
uuuccuaggaaaugauugaagu

SEQ ID NO: 75367 - RNA, 22 nt, Human
ugcuuggauuuccaaaugguuu

SEQ ID NO: 75368 - RNA, 22 nt, Human
aucguuaugauagagaaagaga

SEQ ID NO: 75369 - RNA, 22 nt, Human
auauugcuuuauucuugaauau

SEQ ID NO: 75370 - RNA, 22 nt, Human
uccaugaguuuuuuaguuucac

SEQ ID NO: 75371 - RNA, 22 nt, Human
uggaggcccagcugggggccgg

SEQ ID NO: 75372 - RNA, 22 nt, Human
cuccaugagccaggagggcuac

SEQ ID NO: 75373 - RNA, 22 nt, Human
auggugaugaugaugaugauaa

SEQ ID NO: 75374 - RNA, 22 nt, Human
gaagaaggaagaucaugcuuga

SEQ ID NO: 75375 - RNA, 22 nt, Human
aaggucuucgaaccuuauguua

SEQ ID NO: 75376 - RNA, 22 nt, Human
uuuguugucuucauaauacuuu

SEQ ID NO: 75377 - RNA, 22 nt, Human
aguaggaauucaaagagacaaa

SEQ ID NO: 75378 - RNA, 22 nt, Human
agagcuccaggguuuuguagug

SEQ ID NO: 75379 - RNA, 22 nt, Human
ugugaagaauuaaugugaauca

SEQ ID NO: 75380 - RNA, 22 nt, Human
aggaaauaggaccagacaaagc

SEQ ID NO: 75381 - RNA, 17 nt, Human
aaagccgaucagauguu

SEQ ID NO: 75382 - RNA, 22 nt, Human
cuguccauuuucgugccuccuu

SEQ ID NO: 75383 - RNA, 22 nt, Human
uccauguauugcuaacaaauag

SEQ ID NO: 75384 - RNA, 22 nt, Human
auuugcuuguucaccaguacuu

SEQ ID NO: 75385 - RNA, 22 nt, Human
gggagguaaugggggugcaggg

SEQ ID NO: 75386 - RNA, 22 nt, Human
cuauguuucagauauauauaua

SEQ ID NO: 75387 - RNA, 22 nt, Human
guuauuuugucuuguucaugaa

SEQ ID NO: 75388 - RNA, 19 nt, Human
augaaauagcauuuucuga

SEQ ID NO: 75389 - RNA, 22 nt, Human
ugcuguugacuuuguuguucuu

SEQ ID NO: 75390 - RNA, 21 nt, Human
gggagugaguaaugauggggg

SEQ ID NO: 75391 - RNA, 22 nt, Human
guuuuguagucuggagacuguc

SEQ ID NO: 75392 - RNA, 22 nt, Human
guucuacaugacacucaacauu

SEQ ID NO: 75393 - RNA, 22 nt, Human
aggcagagaggucuuccuggaa

SEQ ID NO: 75394 - RNA, 18 nt, Human
uucucucuggauaguagu

SEQ ID NO: 75395 - RNA, 22 nt, Human
uguuuguuuuguauuuuuaauu

SEQ ID NO: 75396 - RNA, 22 nt, Human
uggaaaauuuagaaagauuuau

SEQ ID NO: 75397 - RNA, 22 nt, Human
uggaagugggcaucaccaucca

SEQ ID NO: 75398 - RNA, 22 nt, Human
uuuaaaauguuuuauuuauuua

SEQ ID NO: 75399 - RNA, 22 nt, Human
aggcauauaguguuuaaaaaaa

SEQ ID NO: 75400 - RNA, 22 nt, Human
ccagaugggggcugugggaggg

SEQ ID NO: 75401 - RNA, 22 nt, Human
uaagggagcagaagcugugaaa

SEQ ID NO: 75402 - RNA, 22 nt, Human
cguuuugaguagauagccauau

SEQ ID NO: 75403 - RNA, 22 nt, Human
ucuucaugaaauugauugcuua

SEQ ID NO: 75404 - RNA, 22 nt, Human
gggauggggagcuggaaagggg

SEQ ID NO: 75405 - RNA, 22 nt, Human
uacauuugauuuuugcuucuuu

SEQ ID NO: 75406 - RNA, 22 nt, Human
uuucuauuuacagugcuaggua

SEQ ID NO: 75407 - RNA, 22 nt, Human
gagccucaggguuuuguugaca

SEQ ID NO: 75408 - RNA, 22 nt, Human
agcacagugccugacauauaug

SEQ ID NO: 75409 - RNA, 22 nt, Human
uucacuguucuuagagaagacc

SEQ ID NO: 75410 - RNA, 22 nt, Human
gcagggcucuggagucaggcug

SEQ ID NO: 75411 - RNA, 22 nt, Human
aggggaggcugggcuggggggc

SEQ ID NO: 75412 - RNA, 22 nt, Human
caaaaaauccauagaaagaggu

SEQ ID NO: 75413 - RNA, 22 nt, Human
uucauaugaauuggguuuuuuu

SEQ ID NO: 75414 - RNA, 22 nt, Human
uucacccuucucuggcuuucag

SEQ ID NO: 75415 - RNA, 22 nt, Human
ucacucuuuaucuuuuaugucu

SEQ ID NO: 75416 - RNA, 19 nt, Human
agcucaggcccaucguccc

SEQ ID NO: 75417 - RNA, 22 nt, Human
ugucuuugaccuuaagaaguuu

SEQ ID NO: 75418 - RNA, 22 nt, Human
aagugauuuucccaccaucuac

SEQ ID NO: 75419 - RNA, 17 nt, Human
ccacuagauagguugug

SEQ ID NO: 75420 - RNA, 22 nt, Human
aaaugcuuuaauugaguucaug

SEQ ID NO: 75421 - RNA, 22 nt, Human
uuuuagaagcauuuaugagauu

SEQ ID NO: 75422 - RNA, 22 nt, Human
uuauuuuauaaagagaagacuu

SEQ ID NO: 75423 - RNA, 19 nt, Human
agagucuccacuccacuug

SEQ ID NO: 75424 - RNA, 22 nt, Human
gggggcagguuccaggccagcu

SEQ ID NO: 75425 - RNA, 22 nt, Human
gcuguggagaagcugccuaugg

SEQ ID NO: 75426 - RNA, 22 nt, Human
ggcuggagcaggcugcacagug

SEQ ID NO: 75427 - RNA, 22 nt, Human
aggcaguguggagggcuguugc

SEQ ID NO: 75428 - RNA, 21 nt, Human
caguucuaagugucaucuuuu

SEQ ID NO: 75429 - RNA, 22 nt, Human
aaaauacuaggaaaauaaauca

SEQ ID NO: 75430 - RNA, 22 nt, Human
uggcagccugcgugaaggagcu

SEQ ID NO: 75431 - RNA, 22 nt, Human
ucaguggaacacacagaguggg

SEQ ID NO: 75432 - RNA, 22 nt, Human
gaggagcugggucagggagaca

SEQ ID NO: 75433 - RNA, 22 nt, Human
ucuucaucucuaaaaugggaac

SEQ ID NO: 75434 - RNA, 22 nt, Human
guugagaaucucuagcuuagga

SEQ ID NO: 75435 - RNA, 22 nt, Human
uagcacauaguaggcacaggcu

SEQ ID NO: 75436 - RNA, 22 nt, Human
cagcuggggagagacauggcag

SEQ ID NO: 75437 - RNA, 22 nt, Human
uacuuuaauugcaaaaauaaau

SEQ ID NO: 75438 - RNA, 22 nt, Human
aaauguuucauucuauuuuuag

SEQ ID NO: 75439 - RNA, 22 nt, Human
gucacuuugcuugcgaugcucc

SEQ ID NO: 75440 - RNA, 22 nt, Chlamydophila pneumoniae J138
gcucuggcuuuuucaacucaaa

SEQ ID NO: 75441 - RNA, 22 nt, Chlamydophila pneumoniae J138
ugaagcauuugcucuuugggaa

SEQ ID NO: 75442 - RNA, 22 nt, Chlamydophila pneumoniae J138
uucuuuuucuaugaugaugagu

SEQ ID NO: 75443 - RNA, 22 nt, Chlamydophila pneumoniae J138
aacucgggcagacguacugcau

SEQ ID NO: 75444 - RNA, 22 nt, Chlamydophila pneumoniae J138
ucuaaaggugaugguaagcacg

SEQ ID NO: 75445 - RNA, 22 nt, Chlamydophila pneumoniae J138
auuuuaucuauagcacuuugcu

SEQ ID NO: 75446 - RNA, 22 nt, Chlamydophila pneumoniae J138
uauuucagcuuaugucaaaggu

SEQ ID NO: 75447 - RNA, 22 nt, Chlamydophila pneumoniae J138
auucugaaggagaauaaaauau

SEQ ID NO: 75448 - RNA, 22 nt, Chlamydophila pneumoniae J138
gagaagaguuaaaauaaugacg

SEQ ID NO: 75449 - RNA, 22 nt, Chlamydophila pneumoniae J138
uauguuuagagaagacgauagg

SEQ ID NO: 75450 - RNA, 22 nt, Chlamydophila pneumoniae J138
agcagcuucgggaccaagcagu

SEQ ID NO: 75451 - RNA, 22 nt, Chlamydophila pneumoniae J138
uuucccuauguauggauucuca

SEQ ID NO: 75452 - RNA, 22 nt, Chlamydophila pneumoniae J138
ggcuuuguuuuucagaaauaga

SEQ ID NO: 75453 - RNA, 22 nt, Chlamydophila pneumoniae J138
ucccuuuggauccagaagcuaa

SEQ ID NO: 75454 - RNA, 22 nt, Chlamydophila pneumoniae J138
cuguaucuucgacaacaugguu

SEQ ID NO: 75455 - RNA, 22 nt, Chlamydophila pneumoniae J138
gauucuguggaguaugcaucca

SEQ ID NO: 75456 - RNA, 22 nt, Chlamydophila pneumoniae J138
aaggauggccaggauuuucagg

SEQ ID NO: 75457 - RNA, 23 nt, Chlamydophila pneumoniae J138
uaugucugggcuggagagcuggg

SEQ ID NO: 75458 - RNA, 22 nt, Chlamydophila pneumoniae J138
auguauggcacuaaagaguuua

SEQ ID NO: 75459 - RNA, 22 nt, Chlamydophila pneumoniae J138
uuguaggguuauuguccucugu

SEQ ID NO: 75460 - RNA, 22 nt, Chlamydophila pneumoniae J138
ucuaugauuuuaguggguagag

SEQ ID NO: 75461 - RNA, 22 nt, Chlamydophila pneumoniae J138
aagaucaugucuccucugugcg

SEQ ID NO: 75462 - RNA, 22 nt, Chlamydophila pneumoniae J138
uuacaacucagggauuuguucu

SEQ ID NO: 75463 - RNA, 22 nt, Chlamydophila pneumoniae J138
uccugagcauugacuugggauu

SEQ ID NO: 75464 - RNA, 22 nt, Chlamydophila pneumoniae J138
uuuguuauuacuaguugucuga

SEQ ID NO: 75465 - RNA, 22 nt, Chlamydophila pneumoniae J138
agcucaauuggauagaguaccu

SEQ ID NO: 75466 - RNA, 22 nt, Chlamydophila pneumoniae J138
uggcuauucucuuugguauagg

SEQ ID NO: 75467 - RNA, 19 nt, Chlamydophila pneumoniae J138
uaauuuagacgacguagau

SEQ ID NO: 75468 - RNA, 22 nt, Chlamydophila pneumoniae J138
cuaguucuuauucaugucuuac

SEQ ID NO: 75469 - RNA, 22 nt, Chlamydophila pneumoniae J138
uguuuggagaauguucagaagg

SEQ ID NO: 75470 - RNA, 22 nt, Chlamydophila pneumoniae J138
guuaaagucuacguugccucua

SEQ ID NO: 75471 - RNA, 22 nt, Chlamydophila pneumoniae J138
aguauagcgaaauaugcaaucu

SEQ ID NO: 75472 - RNA, 22 nt, Chlamydophila pneumoniae J138
ugaggaugcgaucauuaucucu

SEQ ID NO: 75473 - RNA, 22 nt, Chlamydophila pneumoniae J138
uuccuacagaucguauuuuccg

SEQ ID NO: 75474 - RNA, 22 nt, Chlamydophila pneumoniae J138
gcgauucuaagauuccuacgau

SEQ ID NO: 75475 - RNA, 22 nt, Chlamydophila pneumoniae J138
acaagaaaguagcucacgcaau

SEQ ID NO: 75476 - RNA, 22 nt, Chlamydophila pneumoniae J138
ugaggauaacgauacgcaaugu

SEQ ID NO: 75477 - RNA, 22 nt, Chlamydophila pneumoniae J138
aauucguggagccguuuuuuua

SEQ ID NO: 75478 - RNA, 22 nt, Chlamydophila pneumoniae J138
uuguccguauguuagagcaaga

SEQ ID NO: 75479 - RNA, 22 nt, Chlamydophila pneumoniae J138
uagagcuuccguaguucccgau

SEQ ID NO: 75480 - RNA, 22 nt, Chlamydophila pneumoniae J138
acgauaaaguguguguaggauu

SEQ ID NO: 75481 - RNA, 22 nt, Chlamydophila pneumoniae J138
ucuaaagauucccugugucuuu

SEQ ID NO: 75482 - RNA, 22 nt, Chlamydophila pneumoniae J138
gaggaauuuuugcguaauguuc

SEQ ID NO: 75483 - RNA, 19 nt, Chlamydophila pneumoniae J138
guucuaguaggacucgaga

SEQ ID NO: 75484 - RNA, 22 nt, Chlamydophila pneumoniae J138
ggauuuaaauugggauucccag

SEQ ID NO: 75485 - RNA, 22 nt, Chlamydophila pneumoniae J138
aagauuuuggguagagcuacac

SEQ ID NO: 75486 - RNA, 21 nt, Chlamydophila pneumoniae J138
acucauuguucuauuggcugc

SEQ ID NO: 75487 - RNA, 22 nt, Chlamydophila pneumoniae J138
cugcgagaauaaauuuugucuu

SEQ ID NO: 75488 - RNA, 22 nt, Chlamydophila pneumoniae J138
uuaggaucggcagaauuaccaa

SEQ ID NO: 75489 - RNA, 22 nt, Chlamydophila pneumoniae J138
uccuuauuuguucuuucugugu

SEQ ID NO: 75490 - RNA, 22 nt, Chlamydophila pneumoniae J138
gagaguauagggguguuucgga

SEQ ID NO: 75491 - RNA, 22 nt, Chlamydophila pneumoniae J138
ucuuugauaaugauagauuucg

SEQ ID NO: 75492 - RNA, 22 nt, Chlamydophila pneumoniae J138
acuauacaccaagaacaauaag

SEQ ID NO: 75493 - RNA, 22 nt, Chlamydophila pneumoniae J138
uaaugacaacuuaguuucuuuu

SEQ ID NO: 75494 - RNA, 22 nt, Chlamydophila pneumoniae J138
agaaucuugauggguagcggca

SEQ ID NO: 75495 - RNA, 22 nt, Chlamydophila pneumoniae J138
guuaggauauuucggagauuca

SEQ ID NO: 75496 - RNA, 22 nt, Chlamydophila pneumoniae J138
auuucgggacuacuauguuuuu

SEQ ID NO: 75497 - RNA, 22 nt, Chlamydophila pneumoniae J138
ugagacccgcgaguaaagauuc

SEQ ID NO: 75498 - RNA, 22 nt, Chlamydophila pneumoniae J138
uagagcucuuaagcaggagauc

SEQ ID NO: 75499 - RNA, 22 nt, Chlamydophila pneumoniae J138
auaauucaaugauuugauugug

SEQ ID NO: 75500 - RNA, 21 nt, Chlamydophila pneumoniae J138
caaaggcaaaggaaucucuau

SEQ ID NO: 75501 - RNA, 22 nt, Chlamydophila pneumoniae J138
uuguccaugccgacucugggaa

SEQ ID NO: 75502 - RNA, 20 nt, Chlamydophila pneumoniae J138
auuuucugaucacgaaguuu

SEQ ID NO: 75503 - RNA, 22 nt, Chlamydophila pneumoniae J138
cccguauacgauuaaucacaga

SEQ ID NO: 75504 - RNA, 22 nt, Chlamydophila pneumoniae J138
uuuagaaaacgcgaacaccuuu

SEQ ID NO: 75505 - RNA, 18 nt, Chlamydophila pneumoniae J138
acaggaaucggaaugggc

SEQ ID NO: 75506 - RNA, 22 nt, Chlamydophila pneumoniae J138
auaguccaagaugaaaucauug

SEQ ID NO: 75507 - RNA, 22 nt, Chlamydophila pneumoniae J138
uauugauuuaagaguuucaggg

SEQ ID NO: 75508 - RNA, 22 nt, Chlamydophila pneumoniae J138
auagauuugcugauuuucccag

SEQ ID NO: 75509 - RNA, 22 nt, Chlamydophila pneumoniae J138
aucugcaauguguucuuuauuu

SEQ ID NO: 75510 - RNA, 22 nt, Chlamydophila pneumoniae J138
uuccauucagaacggaagccua

SEQ ID NO: 75511 - RNA, 19 nt, Chlamydophila pneumoniae J138
uccuauuaccaaagcggcu

SEQ ID NO: 75512 - RNA, 22 nt, Chlamydophila pneumoniae J138
uaguaccugcucuuuuguacga

SEQ ID NO: 75513 - RNA, 22 nt, Chlamydophila pneumoniae J138
cauuuuuaaauacgauggucgu

SEQ ID NO: 75514 - RNA, 22 nt, Chlamydophila pneumoniae J138
uucuucaugcaucaaucuagag

SEQ ID NO: 75515 - RNA, 23 nt, Chlamydophila pneumoniae J138
uggcuuugguuauuguuaaagag

SEQ ID NO: 75516 - RNA, 22 nt, Chlamydophila pneumoniae J138
cuucuagagacucgcgaaguaa

SEQ ID NO: 75517 - RNA, 19 nt, Chlamydophila pneumoniae J138
aggagaaccaagaacauuu

SEQ ID NO: 75518 - RNA, 22 nt, Chlamydophila pneumoniae J138
auucuucuuuagaaggaaaaug

SEQ ID NO: 75519 - RNA, 22 nt, Chlamydophila pneumoniae J138
acaagaaaaguuuaaggcucag

SEQ ID NO: 75520 - RNA, 22 nt, Chlamydophila pneumoniae J138
ggucucaugucuccuaaguuaa

SEQ ID NO: 75521 - RNA, 22 nt, Chlamydophila pneumoniae J138
acgacaaacuucaagcaaucug

SEQ ID NO: 75522 - RNA, 22 nt, Chlamydophila pneumoniae J138
aucuuucaagcucagauggaac

SEQ ID NO: 75523 - RNA, 22 nt, Chlamydophila pneumoniae J138
aauuuucuguucuuuaccgcug

SEQ ID NO: 75524 - RNA, 22 nt, Chlamydophila pneumoniae J138
guuuugugaucaggagaguauu

SEQ ID NO: 75525 - RNA, 23 nt, Chlamydophila pneumoniae J138
uuuuuaaaccuauaggagacauc

SEQ ID NO: 75526 - RNA, 22 nt, Chlamydophila pneumoniae J138
agguguagagggaugacauuca

SEQ ID NO: 75527 - RNA, 22 nt, Chlamydophila pneumoniae J138
uuauuguucuuggugaaucugu

SEQ ID NO: 75528 - RNA, 22 nt, Chlamydophila pneumoniae J138
agauucucuaugauauacuaug

SEQ ID NO: 75529 - RNA, 22 nt, Chlamydophila pneumoniae J138
auuuggaucagcuguuguaugg

SEQ ID NO: 75530 - RNA, 22 nt, Chlamydophila pneumoniae J138
uugguuuugagacucuccuaca

SEQ ID NO: 75531 - RNA, 22 nt, Chlamydophila pneumoniae J138
uucggaagaucuugagauagcu

SEQ ID NO: 75532 - RNA, 22 nt, Chlamydophila pneumoniae J138
ucuguauugucccagacaacca

SEQ ID NO: 75533 - RNA, 23 nt, Chlamydophila pneumoniae J138
uuucaucaacugcguaguucaug

SEQ ID NO: 75534 - RNA, 22 nt, Chlamydophila pneumoniae J138
uacccugaaacucuuaaaucaa

SEQ ID NO: 75535 - RNA, 22 nt, Chlamydophila pneumoniae J138
uauacgauacgaucgaaacucu

SEQ ID NO: 75536 - RNA, 22 nt, Chlamydophila pneumoniae J138
aagaagaagaauccguggauga

SEQ ID NO: 75537 - RNA, 22 nt, Chlamydophila pneumoniae J138
aaggugaacaagaucuucuggu

SEQ ID NO: 75538 - RNA, 22 nt, Chlamydophila pneumoniae J138
ucugaaguccuagcauugaaag

SEQ ID NO: 75539 - RNA, 22 nt, Chlamydophila pneumoniae J138
uccaggauuuuucguccuuaca

SEQ ID NO: 75540 - RNA, 22 nt, Chlamydophila pneumoniae J138
uuagaguugacuguaguuacag

SEQ ID NO: 75541 - RNA, 22 nt, Chlamydophila pneumoniae J138
ggaaaccaucuucucucuuuga

SEQ ID NO: 75542 - RNA, 22 nt, Chlamydophila pneumoniae J138
aaguucuagaauuacgggaaga

SEQ ID NO: 75543 - RNA, 22 nt, Chlamydophila pneumoniae J138
auuaaauaaacuuggaguaucu

SEQ ID NO: 75544 - RNA, 22 nt, Chlamydophila pneumoniae J138
gauucaauuucagaagaacgcu

SEQ ID NO: 75545 - RNA, 22 nt, Chlamydophila pneumoniae J138
uuuugaagaaggcugcuugcua

SEQ ID NO: 75546 - RNA, 22 nt, Chlamydophila pneumoniae J138
ucugcuguuuauaggggucuag

SEQ ID NO: 75547 - RNA, 23 nt, Chlamydophila pneumoniae J138
cucaggaaaaacgacaacagcgg

SEQ ID NO: 75548 - RNA, 22 nt, Chlamydophila pneumoniae J138
guagguuugaggaucggauuag

SEQ ID NO: 75549 - RNA, 23 nt, Chlamydophila pneumoniae J138
gcuagcaauuucaaugagaagua

SEQ ID NO: 75550 - RNA, 22 nt, Chlamydophila pneumoniae J138
uguguucuuugcagaacucaac

SEQ ID NO: 75551 - RNA, 22 nt, Chlamydophila pneumoniae J138
aaucucugaacuuuugcuguug

SEQ ID NO: 75552 - RNA, 17 nt, Chlamydophila pneumoniae J138
ucuugagcaucuuuuaa

SEQ ID NO: 75553 - RNA, 22 nt, Chlamydophila pneumoniae J138
gaggauauuuucuugguaaguu

SEQ ID NO: 75554 - RNA, 20 nt, Chlamydophila pneumoniae J138
gaggaaaaggguccugaauu

SEQ ID NO: 75555 - RNA, 17 nt, Chlamydophila pneumoniae J138
gucuccucuuggaagga

SEQ ID NO: 75556 - RNA, 22 nt, Chlamydophila pneumoniae J138
uccuguagagccuauuuaugau

SEQ ID NO: 75557 - RNA, 22 nt, Chlamydophila pneumoniae J138
uaucguuaaaagaucgcaacca

SEQ ID NO: 75558 - RNA, 20 nt, Chlamydophila pneumoniae J138
agccaucuggagauacuagg

SEQ ID NO: 75559 - RNA, 22 nt, Chlamydophila pneumoniae J138
aacauuuuccacugagaaguug

SEQ ID NO: 75560 - RNA, 22 nt, Chlamydophila pneumoniae J138
uugcuugaaggagauguuuuua

SEQ ID NO: 75561 - RNA, 22 nt, Chlamydophila pneumoniae J138
acuuaauaaucucuuagauagu

SEQ ID NO: 75562 - RNA, 22 nt, Chlamydophila pneumoniae J138
acuuugcucuucuuguuggaag

SEQ ID NO: 75563 - RNA, 22 nt, Chlamydophila pneumoniae J138
aucaucuuauauaauggagugg

SEQ ID NO: 75564 - RNA, 22 nt, Chlamydophila pneumoniae J138
agcaaggcuuuguaaaacguuc

SEQ ID NO: 75565 - RNA, 22 nt, Chlamydophila pneumoniae J138
gaguauaggugccuguguuagu

SEQ ID NO: 75566 - RNA, 22 nt, Chlamydophila pneumoniae J138
ggauuauucgugcauuuggugg

SEQ ID NO: 75567 - RNA, 22 nt, Chlamydophila pneumoniae J138
gaaccauauacugagcuuccuc

SEQ ID NO: 75568 - RNA, 22 nt, Chlamydophila pneumoniae J138
aaagagaaucgcuacagauccc

SEQ ID NO: 75569 - RNA, 22 nt, Chlamydophila pneumoniae J138
ccuggauuuucaagucuuuuga

SEQ ID NO: 75570 - RNA, 22 nt, Chlamydophila pneumoniae J138
uucuuuagagcacucggggaga

SEQ ID NO: 75571 - RNA, 22 nt, Chlamydophila pneumoniae J138
aaaaauuguggguucuugagca

SEQ ID NO: 75572 - RNA, 22 nt, Chlamydophila pneumoniae J138
uuccggaugauccuuuugcuau

SEQ ID NO: 75573 - RNA, 22 nt, Chlamydophila pneumoniae J138
ugcaggaagaaagauuucuucu

SEQ ID NO: 75574 - RNA, 23 nt, Chlamydophila pneumoniae J138
uucucaaagcaacgcgacucccu

SEQ ID NO: 75575 - RNA, 22 nt, Chlamydophila pneumoniae J138
uaaaguuuugcugcgggcuccc

SEQ ID NO: 75576 - RNA, 22 nt, Chlamydophila pneumoniae J138
aagcuucgugaucagaaauuga

SEQ ID NO: 75577 - RNA, 22 nt, Chlamydophila pneumoniae J138
aagucucuggauaguaauaccc

SEQ ID NO: 75578 - RNA, 22 nt, Chlamydophila pneumoniae J138
cugugcucuugaagauuguguc

SEQ ID NO: 75579 - RNA, 22 nt, Chlamydophila pneumoniae J138
uauuuuuuauugaagugguagc

SEQ ID NO: 75580 - RNA, 22 nt, Chlamydophila pneumoniae J138
auugaguuuaacaaugcaggga

SEQ ID NO: 75581 - RNA, 22 nt, Chlamydophila pneumoniae J138
aucuuuucuuaggcgggaauag

SEQ ID NO: 75582 - RNA, 22 nt, Chlamydophila pneumoniae J138
cugguaaaagucucauuccugg

SEQ ID NO: 75583 - RNA, 22 nt, Chlamydophila pneumoniae J138
cuguuuuuucauaguauccuua

SEQ ID NO: 75584 - RNA, 21 nt, Chlamydophila pneumoniae J138
uaacucucgucgacuuuuccu

SEQ ID NO: 75585 - RNA, 21 nt, Chlamydophila pneumoniae J138
cuaucagaggggccuauauuu

SEQ ID NO: 75586 - RNA, 22 nt, Chlamydophila pneumoniae J138
agagaagaugccuauaccucua

SEQ ID NO: 75587 - RNA, 22 nt, Chlamydophila pneumoniae J138
auuccuuauuugauuggagggu

SEQ ID NO: 75588 - RNA, 21 nt, Chlamydophila pneumoniae J138
cuuacgaguuuccuggaguuu

SEQ ID NO: 75589 - RNA, 22 nt, Chlamydophila pneumoniae J138
aaauuuggaggagaaucuauag

SEQ ID NO: 75590 - RNA, 22 nt, Chlamydophila pneumoniae J138
uaguugaaacagauggaagagu

SEQ ID NO: 75591 - RNA, 22 nt, Chlamydophila pneumoniae J138
ucuccucccagcaauuucucgu

SEQ ID NO: 75592 - RNA, 22 nt, Chlamydophila pneumoniae J138
gcucuauaauagggugcguaua

SEQ ID NO: 75593 - RNA, 22 nt, Chlamydophila pneumoniae J138
gaaggacaacuacguuaucauu

SEQ ID NO: 75594 - RNA, 22 nt, Chlamydophila pneumoniae J138
gcauuccauuuccaagcuuaua

SEQ ID NO: 75595 - RNA, 22 nt, Chlamydophila pneumoniae J138
uucuggaguggcuuuaacgaua

SEQ ID NO: 75596 - RNA, 22 nt, Chlamydophila pneumoniae J138
aaaaucagcaacuaacauagcu

SEQ ID NO: 75597 - RNA, 22 nt, Chlamydophila pneumoniae J138
cagcuuugggauguagauuucu

SEQ ID NO: 75598 - RNA, 22 nt, Chlamydophila pneumoniae J138
cuaaauauugaccuuuagcugc

SEQ ID NO: 75599 - RNA, 22 nt, Chlamydophila pneumoniae J138
gaggaauuacaaauucaugaga

SEQ ID NO: 75600 - RNA, 22 nt, Chlamydophila pneumoniae J138
ucucagcauuauggaggcuccu

SEQ ID NO: 75601 - RNA, 22 nt, Chlamydophila pneumoniae J138
uuugugaucggaaguuauaauu

SEQ ID NO: 75602 - RNA, 20 nt, Chlamydophila pneumoniae J138
uuguggacuccuaaauaucu

SEQ ID NO: 75603 - RNA, 22 nt, Chlamydophila pneumoniae J138
cauuuuagaugggucuauuucu

SEQ ID NO: 75604 - RNA, 22 nt, Chlamydophila pneumoniae J138
augcuugcuuaggaucguuguu

SEQ ID NO: 75605 - RNA, 22 nt, Chlamydophila pneumoniae J138
cuaaaagcuuuucugcauacac

SEQ ID NO: 75606 - RNA, 22 nt, Chlamydophila pneumoniae J138
gcacuauuggagaaucuggagg

SEQ ID NO: 75607 - RNA, 22 nt, Chlamydophila pneumoniae J138
uacagauucaccaagaacaaua

SEQ ID NO: 75608 - RNA, 22 nt, Chlamydophila pneumoniae J138
gauuuggaucaccaaagaaaau

SEQ ID NO: 75609 - RNA, 19 nt, Chlamydophila pneumoniae J138
uuauugauacgauuuuaga

SEQ ID NO: 75610 - RNA, 22 nt, Chlamydophila pneumoniae J138
gguguucaucagagaugugagg

SEQ ID NO: 75611 - RNA, 22 nt, Chlamydophila pneumoniae J138
aggcuucuugguuauuuaggua

SEQ ID NO: 75612 - RNA, 22 nt, Chlamydophila pneumoniae J138
uguaggaaagccuuauuuacau

SEQ ID NO: 75613 - RNA, 22 nt, Chlamydophila pneumoniae J138
gaagcucaggaucugucaguuc

SEQ ID NO: 75614 - RNA, 22 nt, Chlamydophila pneumoniae J138
gagugcccuuaagaagcuuucu

SEQ ID NO: 75615 - RNA, 22 nt, Chlamydophila pneumoniae J138
gugaaguuugagagauuuucag

SEQ ID NO: 75616 - RNA, 22 nt, Chlamydophila pneumoniae J138
ugcaugauucucccuacguggc

SEQ ID NO: 75617 - RNA, 22 nt, Chlamydophila pneumoniae J138
auauagauagaauuuuacagga

SEQ ID NO: 75618 - RNA, 22 nt, Chlamydophila pneumoniae J138
aggacggaucuuuuuacuuagc

SEQ ID NO: 75619 - RNA, 21 nt, Chlamydophila pneumoniae J138
aggcuccuacuugccauucau

SEQ ID NO: 75620 - RNA, 22 nt, Chlamydophila pneumoniae J138
aacgucuaggacauuauuguua

SEQ ID NO: 75621 - RNA, 22 nt, Chlamydophila pneumoniae J138
aagcucuacccacuaaaaucau

SEQ ID NO: 75622 - RNA, 22 nt, Chlamydophila pneumoniae J138
ucaaaugcacaggucuuugaga

SEQ ID NO: 75623 - RNA, 22 nt, Chlamydophila pneumoniae J138
caugcaagcaaggcagauucaa

SEQ ID NO: 75624 - RNA, 22 nt, Chlamydophila pneumoniae J138
cccugcauuguuaaacucaauu

SEQ ID NO: 75625 - RNA, 21 nt, Chlamydophila pneumoniae J138
ugugggugcguugcuaaaguu

SEQ ID NO: 75626 - RNA, 22 nt, Chlamydophila pneumoniae J138
gaauuguaggagcuucgggagc

SEQ ID NO: 75627 - RNA, 22 nt, Chlamydophila pneumoniae J138
cuuguucugguuuaauuaugau

SEQ ID NO: 75628 - RNA, 22 nt, Chlamydophila pneumoniae J138
ccuguaacuacauuuucuuuag

SEQ ID NO: 75629 - RNA, 22 nt, Chlamydophila pneumoniae J138
uagaaguauuaagccaagauuu

SEQ ID NO: 75630 - RNA, 22 nt, Chlamydophila pneumoniae J138
aucuugccuacgauccuguaug

SEQ ID NO: 75631 - RNA, 22 nt, Chlamydophila pneumoniae J138
guucuuuauuauacuccugaca

SEQ ID NO: 75632 - RNA, 22 nt, Chlamydophila pneumoniae J138
agcgaugcauugaaauuuucuu

SEQ ID NO: 75633 - RNA, 23 nt, Chlamydophila pneumoniae J138
uugauuacacucaaggaugcugc

SEQ ID NO: 75634 - RNA, 22 nt, Chlamydophila pneumoniae J138
ucgucuacaggguucuucgcuu

SEQ ID NO: 75635 - RNA, 23 nt, Chlamydophila pneumoniae J138
caaagcuggggauuucuuucuag

SEQ ID NO: 75636 - RNA, 22 nt, Chlamydophila pneumoniae J138
aggaguguagccuaaagaguau

SEQ ID NO: 75637 - RNA, 22 nt, Chlamydophila pneumoniae J138
aucugccuuguaaauaaguaug

SEQ ID NO: 75638 - RNA, 22 nt, Chlamydophila pneumoniae J138
uacaggaaaaacuuuaagaauu

SEQ ID NO: 75639 - RNA, 22 nt, Chlamydophila pneumoniae J138
aagagucgugucuucucuuuag

SEQ ID NO: 75640 - RNA, 22 nt, Chlamydophila pneumoniae J138
gaggaaaucauugcuaugggug

SEQ ID NO: 75641 - RNA, 22 nt, Chlamydophila pneumoniae J138
acaggcgugucuuugugccuau

SEQ ID NO: 75642 - RNA, 22 nt, Chlamydophila pneumoniae J138
ucaccuccagggaugauucgua

SEQ ID NO: 75643 - RNA, 22 nt, Chlamydophila pneumoniae J138
ugccgcuacccaucaagauucu

SEQ ID NO: 75644 - RNA, 22 nt, Chlamydophila pneumoniae J138
cucuucaggaucggcauuauuu

SEQ ID NO: 75645 - RNA, 21 nt, Chlamydophila pneumoniae J138
auugaucucaucacuaguuuc

SEQ ID NO: 75646 - RNA, 22 nt, Chlamydophila pneumoniae J138
uaucuuggacuaucuuauugua

SEQ ID NO: 75647 - RNA, 21 nt, Chlamydophila pneumoniae J138
acguaaguaaaaucuuuagga

SEQ ID NO: 75648 - RNA, 22 nt, Chlamydophila pneumoniae J138
auccugaagauauucaggcaau

SEQ ID NO: 75649 - RNA, 22 nt, Chlamydophila pneumoniae J138
cggagagauauucugaucuaca

SEQ ID NO: 75650 - RNA, 22 nt, Chlamydophila pneumoniae J138
uggucuugauuuuuauagaaaa

SEQ ID NO: 75651 - RNA, 22 nt, Chlamydophila pneumoniae J138
uggaugaagaagcuggaaaucc

SEQ ID NO: 75652 - RNA, 22 nt, Chlamydophila pneumoniae J138
gaugguaaaauuguuauaggaa

SEQ ID NO: 75653 - RNA, 22 nt, Chlamydophila pneumoniae J138
agagauccccgguucuaagaaa

SEQ ID NO: 75654 - RNA, 21 nt, Chlamydophila pneumoniae J138
uccugaguuuccuaaggaacu

SEQ ID NO: 75655 - RNA, 22 nt, Chlamydophila pneumoniae J138
cuaagauuccucuauuuccugc

SEQ ID NO: 75656 - RNA, 22 nt, Chlamydophila pneumoniae J138
aagaaagauucuugguagaaau

SEQ ID NO: 75657 - RNA, 22 nt, Chlamydophila pneumoniae J138
aggcucuucuaaaagacauagu

SEQ ID NO: 75658 - RNA, 22 nt, Chlamydophila pneumoniae J138
uagcucuacccaaaaucuuaga

SEQ ID NO: 75659 - RNA, 22 nt, Chlamydophila pneumoniae J138
uccuuucucuuauugaaagauu

SEQ ID NO: 75660 - RNA, 21 nt, Chlamydophila pneumoniae J138
agaagcugcugaugccuaugc

SEQ ID NO: 75661 - RNA, 22 nt, Chlamydophila pneumoniae J138
ucuagauguaaaaaaagaucgu

SEQ ID NO: 75662 - RNA, 22 nt, Chlamydophila pneumoniae J138
aguuccuguagaugaagaagca

SEQ ID NO: 75663 - RNA, 22 nt, Chlamydophila pneumoniae J138
uacuucaacucguugauuguga

SEQ ID NO: 75664 - RNA, 22 nt, Chlamydophila pneumoniae J138
uaucgguguggauaaguuucuc

SEQ ID NO: 75665 - RNA, 22 nt, Chlamydophila pneumoniae J138
uagauauucaugguauuuuagc

SEQ ID NO: 75666 - RNA, 22 nt, Chlamydophila pneumoniae J138
aagguguuucuuuaggaaaaau

SEQ ID NO: 75667 - RNA, 19 nt, Chlamydophila pneumoniae J138
cuagcguaaagcaauuuug

SEQ ID NO: 75668 - RNA, 22 nt, Chlamydophila pneumoniae J138
aaggcaaaaccauauucugguu

SEQ ID NO: 75669 - RNA, 22 nt, Chlamydophila pneumoniae J138
uaggauaguauagugaggagau

SEQ ID NO: 75670 - RNA, 21 nt, Chlamydophila pneumoniae J138
cccuauggauaugauuccuuc

SEQ ID NO: 75671 - RNA, 22 nt, Chlamydophila pneumoniae J138
cgacuuagaucuuuucuacuuc

SEQ ID NO: 75672 - RNA, 22 nt, Chlamydophila pneumoniae J138
agaggaacgcccuguuuucuuc

SEQ ID NO: 75673 - RNA, 22 nt, Chlamydophila pneumoniae J138
agaagguuugaugacaacaguu

SEQ ID NO: 75674 - RNA, 19 nt, Chlamydophila pneumoniae J138
ggaguuucgggaucaggaa

SEQ ID NO: 75675 - RNA, 22 nt, Chlamydophila pneumoniae J138
auccaagauaucggaaugaagg

SEQ ID NO: 75676 - RNA, 22 nt, Chlamydophila pneumoniae J138
gcaaguagugaaaucuacugcg

SEQ ID NO: 75677 - RNA, 22 nt, Chlamydophila pneumoniae J138
uauuuucuuuguagcuaccaau

SEQ ID NO: 75678 - RNA, 20 nt, Chlamydophila pneumoniae J138
ugucucugaaaaagagagcc

SEQ ID NO: 75679 - RNA, 22 nt, Chlamydophila pneumoniae J138
aaauagucucuagguucuauag

SEQ ID NO: 75680 - RNA, 22 nt, Chlamydophila pneumoniae J138
cacauuaucuaggucguugugu

SEQ ID NO: 75681 - RNA, 20 nt, Chlamydophila pneumoniae J138
uuucucuacaaacaggaauu

SEQ ID NO: 75682 - RNA, 23 nt, Chlamydophila pneumoniae J138
cuaaagacuccacaaugauuaca

SEQ ID NO: 75683 - RNA, 22 nt, Chlamydophila pneumoniae J138
gccuuuuuugaugcucuugucc

SEQ ID NO: 75684 - RNA, 22 nt, Chlamydophila pneumoniae J138
ugaguuuaggaauuaagagcac

SEQ ID NO: 75685 - RNA, 22 nt, Chlamydophila pneumoniae J138
acuucuugcuugggcccacgcu

SEQ ID NO: 75686 - RNA, 22 nt, Chlamydophila pneumoniae J138
agaguucugcugcugcuagacc

SEQ ID NO: 75687 - RNA, 22 nt, Chlamydophila pneumoniae J138
aucacgguuccuggaguaugga

SEQ ID NO: 75688 - RNA, 22 nt, Chlamydophila pneumoniae J138
uucuccagcaggagcccagaaa

SEQ ID NO: 75689 - RNA, 22 nt, Chlamydophila pneumoniae J138
aaagggaaguucuaaaucaaau

SEQ ID NO: 75690 - RNA, 16 nt, Chlamydophila pneumoniae J138
ugggauugaaguuagg

SEQ ID NO: 75691 - RNA, 23 nt, Chlamydophila pneumoniae J138
gcuuaugcauuaggaaggagagc

SEQ ID NO: 75692 - RNA, 22 nt, Chlamydophila pneumoniae J138
gaaauauuguugggacuuuggu

SEQ ID NO: 75693 - RNA, 22 nt, Chlamydophila pneumoniae J138
cgcaugaggaauaagauaguaa

SEQ ID NO: 75694 - RNA, 22 nt, Chlamydophila pneumoniae J138
uagaauaucugagggauaggua

SEQ ID NO: 75695 - RNA, 22 nt, Chlamydophila pneumoniae J138
uaaacuuagagcaaguagcaua

SEQ ID NO: 75696 - RNA, 22 nt, Chlamydophila pneumoniae J138
gcucuaaacgcgagaacgaugc

SEQ ID NO: 75697 - RNA, 22 nt, Chlamydophila pneumoniae J138
gaauuauuggaaagggaggcau

SEQ ID NO: 75698 - RNA, 22 nt, Chlamydophila pneumoniae J138
ugaaaauaugagcaacuucuau

SEQ ID NO: 75699 - RNA, 22 nt, Chlamydophila pneumoniae J138
aaggaggagcuccugguggagg

SEQ ID NO: 75700 - RNA, 22 nt, Chlamydophila pneumoniae J138
aaucugugauugaugaguuuuu

SEQ ID NO: 75701 - RNA, 22 nt, Chlamydophila pneumoniae J138
cucuggguucugcuggggauug

SEQ ID NO: 75702 - RNA, 22 nt, Chlamydophila pneumoniae J138
uagaaaagaucuaagucguugu

SEQ ID NO: 75703 - RNA, 22 nt, Chlamydophila pneumoniae J138
aggguuugaaucuuuagaagau

SEQ ID NO: 75704 - RNA, 22 nt, Chlamydophila pneumoniae J138
uuuuguggccaccaggcaaacu

SEQ ID NO: 75705 - RNA, 22 nt, Chlamydophila pneumoniae J138
aggagauccuacaauugccauu

SEQ ID NO: 75706 - RNA, 22 nt, Chlamydophila pneumoniae J138
agcuucucgaauuucuaauguu

SEQ ID NO: 75707 - RNA, 22 nt, Chlamydophila pneumoniae J138
uuccauuaaccaaacauuugau

SEQ ID NO: 75708 - RNA, 22 nt, Chlamydophila pneumoniae J138
ggagacaguuugcuuuaucucu

SEQ ID NO: 75709 - RNA, 22 nt, Chlamydophila pneumoniae J138
uccuauuuucaugagaaagggg

SEQ ID NO: 75710 - RNA, 22 nt, Chlamydophila pneumoniae J138
ggacuucuugaaagaauacccu

SEQ ID NO: 75711 - RNA, 23 nt, Chlamydophila pneumoniae J138
uccucagucuucccuagggaacu

SEQ ID NO: 75712 - RNA, 22 nt, Chlamydophila pneumoniae J138
aaauucgugcguuuaaaagagg

SEQ ID NO: 75713 - RNA, 21 nt, Chlamydophila pneumoniae J138
aucaaacuauagaggaugcug

SEQ ID NO: 75714 - RNA, 22 nt, Chlamydophila pneumoniae J138
aguaagaacuucguuucagcac

SEQ ID NO: 75715 - RNA, 22 nt, Chlamydophila pneumoniae J138
uguuucuggaagagcuucuuau

SEQ ID NO: 75716 - RNA, 22 nt, Chlamydophila pneumoniae J138
cuacugauacagacugcgagca

SEQ ID NO: 75717 - RNA, 22 nt, Chlamydophila pneumoniae J138
cucuauacaaauccaacagugc

SEQ ID NO: 75718 - RNA, 22 nt, Chlamydophila pneumoniae J138
ucaucgaacuccaaguauuguu

SEQ ID NO: 75719 - RNA, 22 nt, Chlamydophila pneumoniae J138
uuucuaauuauuguuuuggaag

SEQ ID NO: 75720 - RNA, 22 nt, Chlamydophila pneumoniae J138
auucgacuuagaucuuuuucua

SEQ ID NO: 75721 - RNA, 22 nt, Chlamydophila pneumoniae J138
gugaaucauucgaugaaggaag

SEQ ID NO: 75722 - RNA, 22 nt, Chlamydophila pneumoniae J138
aaagaggagaaagccgccuaug

SEQ ID NO: 75723 - RNA, 18 nt, Chlamydophila pneumoniae J138
uuuuccaugguguaaaug

SEQ ID NO: 75724 - RNA, 22 nt, Chlamydophila pneumoniae J138
ggcauuuuggaaagaguuuacc

SEQ ID NO: 75725 - RNA, 22 nt, Chlamydophila pneumoniae J138
guucuagugaucuaaguacgaa

SEQ ID NO: 75726 - RNA, 22 nt, Chlamydophila pneumoniae J138
uugcuuccaaucgaaguuuggu

SEQ ID NO: 75727 - RNA, 22 nt, Chlamydophila pneumoniae J138
caugucuuuuuuacagaaagau

SEQ ID NO: 75728 - RNA, 22 nt, Chlamydophila pneumoniae J138
ggucuucaagccaaaugaucag

SEQ ID NO: 75729 - RNA, 20 nt, Chlamydophila pneumoniae J138
uggcgugcuuccuaugagua

SEQ ID NO: 75730 - RNA, 22 nt, Chlamydophila pneumoniae J138
ugagaaaagaggucuuuacaga

SEQ ID NO: 75731 - RNA, 22 nt, Chlamydophila pneumoniae J138
uugucuuguguuggauaagcuu

SEQ ID NO: 75732 - RNA, 22 nt, Chlamydophila pneumoniae J138
uagaaaauuuuaguggucagcu

SEQ ID NO: 75733 - RNA, 22 nt, Chlamydophila pneumoniae J138
uuacgagaaaaguuagaauuua

SEQ ID NO: 75734 - RNA, 22 nt, Chlamydophila pneumoniae J138
aaacuaaggagugucaaugaag

SEQ ID NO: 75735 - RNA, 22 nt, Chlamydophila pneumoniae J138
augaugagggacccucccuagg

SEQ ID NO: 75736 - RNA, 20 nt, Chlamydophila pneumoniae J138
auguaauacagaagaacauu

SEQ ID NO: 75737 - RNA, 22 nt, Chlamydophila pneumoniae J138
gaaggauaguuucucuaugaua

SEQ ID NO: 75738 - RNA, 22 nt, Chlamydophila pneumoniae J138
aaggcuaucgauuugauagaug

SEQ ID NO: 75739 - RNA, 22 nt, Chlamydophila pneumoniae J138
aaagaacucuccuauaauggca

SEQ ID NO: 75740 - RNA, 22 nt, Chlamydophila pneumoniae J138
ccucuugguaacgaucgcaacg

SEQ ID NO: 75741 - RNA, 22 nt, Chlamydophila pneumoniae J138
aggagauuuucucacuuacagc

SEQ ID NO: 75742 - RNA, 22 nt, Chlamydophila pneumoniae J138
agaacgcacguucuauacaaga

SEQ ID NO: 75743 - RNA, 22 nt, Chlamydophila pneumoniae J138
uuggagaguuuuuuaccaucug

SEQ ID NO: 75744 - RNA, 22 nt, Chlamydophila pneumoniae J138
uucugguuuuucgauuuggaag

SEQ ID NO: 75745 - RNA, 22 nt, Chlamydophila pneumoniae J138
auuuuccucacaguaaucuugu

SEQ ID NO: 75746 - RNA, 22 nt, Chlamydophila pneumoniae J138
ucuguaguugcuaugcgcggug

SEQ ID NO: 75747 - RNA, 22 nt, Chlamydophila pneumoniae J138
uccgagggaacuaaaggagcga

SEQ ID NO: 75748 - RNA, 22 nt, Chlamydophila pneumoniae J138
auaggaauccuuagcuucuuga

SEQ ID NO: 75749 - RNA, 22 nt, Chlamydophila pneumoniae J138
ugagacuguuaaagauuuuauc

SEQ ID NO: 75750 - RNA, 22 nt, Chlamydophila pneumoniae J138
gaaggcaaacuccccgcuuuug

SEQ ID NO: 75751 - RNA, 22 nt, Chlamydophila pneumoniae J138
ugcuuuuagguaggacgucacu

SEQ ID NO: 75752 - RNA, 21 nt, Chlamydophila pneumoniae J138
aauuccucacuuccuuuaccu

SEQ ID NO: 75753 - RNA, 22 nt, Chlamydophila pneumoniae J138
auaacgcaaaugaggucgacuu

SEQ ID NO: 75754 - RNA, 22 nt, Chlamydophila pneumoniae J138
aagcuuuucgcagauacuucuu

SEQ ID NO: 75755 - RNA, 22 nt, Chlamydophila pneumoniae J138
gauuuuccaaaagcauauaacu

SEQ ID NO: 75756 - RNA, 22 nt, Chlamydophila pneumoniae J138
agcaaaggaacuuauauucgca

SEQ ID NO: 75757 - RNA, 22 nt, Chlamydophila pneumoniae J138
auguuccaagagaagaaagagu

SEQ ID NO: 75758 - RNA, 22 nt, Chlamydophila pneumoniae J138
agugucuuuuguaucgcguaac

SEQ ID NO: 75759 - RNA, 22 nt, Chlamydophila pneumoniae J138
gugcuaugagaucuuuugggcu

SEQ ID NO: 75760 - RNA, 22 nt, Chlamydophila pneumoniae J138
gaaacgacgagcagccugaggg

SEQ ID NO: 75761 - RNA, 22 nt, Chlamydophila pneumoniae J138
aaguuguauauaugcgcuaauu

SEQ ID NO: 75762 - RNA, 22 nt, Chlamydophila pneumoniae J138
guaaauaccgauuuuaauaggg

SEQ ID NO: 75763 - RNA, 22 nt, Chlamydophila pneumoniae J138
uagcaaguaugcgauacgcaau

SEQ ID NO: 75764 - RNA, 22 nt, Chlamydophila pneumoniae J138
ccauaccaaagaagugguuccu

SEQ ID NO: 75765 - RNA, 22 nt, Chlamydophila pneumoniae J138
uuaggcaugggccuuuccgaau

SEQ ID NO: 75766 - RNA, 22 nt, Chlamydophila pneumoniae J138
ucuugggcaaugauggagaggu

SEQ ID NO: 75767 - RNA, 22 nt, Chlamydophila pneumoniae J138
uugagcaaucaacuagggguaa

SEQ ID NO: 75768 - RNA, 22 nt, Chlamydophila pneumoniae J138
uucccagaaguacguggagcua

SEQ ID NO: 75769 - RNA, 23 nt, Chlamydophila pneumoniae J138
cugaagcagagacgaucuuuuuu

SEQ ID NO: 75770 - RNA, 22 nt, Chlamydophila pneumoniae J138
aaccaggaugcgucucugucca

SEQ ID NO: 75771 - RNA, 22 nt, Chlamydophila pneumoniae J138
ugcaugcuaaccuuccagagga

SEQ ID NO: 75772 - RNA, 22 nt, Chlamydophila pneumoniae J138
ugugauuaucuguggagaccag

SEQ ID NO: 75773 - RNA, 22 nt, Chlamydophila pneumoniae J138
auaccaaaaugugauuuugagg

SEQ ID NO: 75774 - RNA, 22 nt, Chlamydophila pneumoniae J138
gaagauucuuuuaguggauugg

SEQ ID NO: 75775 - RNA, 22 nt, Chlamydophila pneumoniae J138
ucuuaucugcugggggagcuag

SEQ ID NO: 75776 - RNA, 22 nt, Chlamydophila pneumoniae J138
cgaaagcuuuaggagccuaugu

SEQ ID NO: 75777 - RNA, 20 nt, Chlamydophila pneumoniae J138
ccuuaucuaggaagagcuug

SEQ ID NO: 75778 - RNA, 22 nt, Chlamydophila pneumoniae J138
uuucucuuaagaugcgugguau

SEQ ID NO: 75779 - RNA, 22 nt, Chlamydophila pneumoniae J138
aggaaggauuaugagcuguggu

SEQ ID NO: 75780 - RNA, 22 nt, Chlamydophila pneumoniae J138
aaucuucugaagagacggcaaa

SEQ ID NO: 75781 - RNA, 22 nt, Chlamydophila pneumoniae J138
aaucuuaucuugauccaagaag

SEQ ID NO: 75782 - RNA, 22 nt, Chlamydophila pneumoniae J138
aacaauaccuugaguuacaaac

SEQ ID NO: 75783 - RNA, 22 nt, Chlamydophila pneumoniae J138
auacauuucugcgauguugugg

SEQ ID NO: 75784 - RNA, 22 nt, Chlamydophila pneumoniae J138
uggaggagcagguucaucuuuu

SEQ ID NO: 75785 - RNA, 22 nt, Chlamydophila pneumoniae J138
uucuacaauuccuauagcucaa

SEQ ID NO: 75786 - RNA, 22 nt, Chlamydophila pneumoniae J138
uuagaauuauacgugccuguca

SEQ ID NO: 75787 - RNA, 22 nt, Chlamydophila pneumoniae J138
ugauuuugcuucgcagcuugaa

SEQ ID NO: 75788 - RNA, 22 nt, Chlamydophila pneumoniae J138
uuuuaaugucggaagguacguu

SEQ ID NO: 75789 - RNA, 22 nt, Chlamydophila pneumoniae J138
gggggaaagccaagaagaugua

SEQ ID NO: 75790 - RNA, 22 nt, Chlamydophila pneumoniae J138
uagagcuuaaauuuacgaaaug

SEQ ID NO: 75791 - RNA, 22 nt, Chlamydophila pneumoniae J138
auguuuguaguguugaauaaga

SEQ ID NO: 75792 - RNA, 22 nt, Chlamydophila pneumoniae J138
aaacuucaggaacuuucugagu

SEQ ID NO: 75793 - RNA, 21 nt, Chlamydophila pneumoniae J138
auaguaaguucaugcuuguua

SEQ ID NO: 75794 - RNA, 22 nt, Chlamydophila pneumoniae J138
auuuuauuuuguggccaccagg

SEQ ID NO: 75795 - RNA, 22 nt, Chlamydophila pneumoniae J138
ggucgcaccccggaaggguaga

SEQ ID NO: 75796 - RNA, 22 nt, Chlamydophila pneumoniae J138
aguuuuaccuuuaagugugauu

SEQ ID NO: 75797 - RNA, 22 nt, Chlamydophila pneumoniae J138
uuaaaaaugcucaagauuugcg

SEQ ID NO: 75798 - RNA, 22 nt, Chlamydophila pneumoniae J138
uuuuuaaaucaucuucagcaag

SEQ ID NO: 75799 - RNA, 22 nt, Chlamydophila pneumoniae J138
gauauguauguaaaggcucuuc

SEQ ID NO: 75800 - RNA, 22 nt, Chlamydophila pneumoniae J138
auuguguuuauagaaggccaga

SEQ ID NO: 75801 - RNA, 22 nt, Chlamydophila pneumoniae J138
aggauguuguuauugaaccgua

SEQ ID NO: 75802 - RNA, 22 nt, Chlamydophila pneumoniae J138
uaaugagggggaguguuuugga

SEQ ID NO: 75803 - RNA, 22 nt, Chlamydophila pneumoniae J138
gcugccgauagaacuugauuug

SEQ ID NO: 75804 - RNA, 22 nt, Chlamydophila pneumoniae J138
auucuucacaauaggagaaagu

SEQ ID NO: 75805 - RNA, 22 nt, Chlamydophila pneumoniae J138
ugagggagaugcagauuuagau

SEQ ID NO: 75806 - RNA, 22 nt, Chlamydophila pneumoniae J138
auauaguucuucagcaaagaua

SEQ ID NO: 75807 - RNA, 22 nt, Chlamydophila pneumoniae J138
uuguuuaagagccucgcuuguu

SEQ ID NO: 75808 - RNA, 22 nt, Chlamydophila pneumoniae J138
agauuuuuagggacuauaauuu

SEQ ID NO: 75809 - RNA, 22 nt, Chlamydophila pneumoniae J138
agcaggauuuuacuguauuucu

SEQ ID NO: 75810 - RNA, 22 nt, Chlamydophila pneumoniae J138
aucugcgaaggagauagucgcu

SEQ ID NO: 75811 - RNA, 22 nt, Chlamydophila pneumoniae J138
agaaaucugcugcauagauauc

SEQ ID NO: 75812 - RNA, 22 nt, Chlamydophila pneumoniae J138
uuguaggggcuuguaucggauu

SEQ ID NO: 75813 - RNA, 22 nt, Chlamydophila pneumoniae J138
gaaagaugacgaccgcccuuua

SEQ ID NO: 75814 - RNA, 22 nt, Chlamydophila pneumoniae J138
accagcuucccaagcugaaaga

SEQ ID NO: 75815 - RNA, 22 nt, Chlamydophila pneumoniae J138
cauuguuccuuuaagauuucug

SEQ ID NO: 75816 - RNA, 22 nt, Chlamydophila pneumoniae J138
uuugcgagauguuguugaucag

SEQ ID NO: 75817 - RNA, 22 nt, Chlamydophila pneumoniae J138
agcgaagaucuucagccuuuac

SEQ ID NO: 75818 - RNA, 22 nt, Chlamydophila pneumoniae J138
agugaugccuuugauuacgaaa

SEQ ID NO: 75819 - RNA, 22 nt, Chlamydophila pneumoniae J138
caaacuaaagagcuugaguuug

SEQ ID NO: 75820 - RNA, 22 nt, Chlamydophila pneumoniae J138
cgagaucuugauuuugguuaug

SEQ ID NO: 75821 - RNA, 22 nt, Chlamydophila pneumoniae J138
ugccugcuucucaagauacucg

SEQ ID NO: 75822 - RNA, 22 nt, Chlamydophila pneumoniae J138
guuagaggaagaaggauuugcu

SEQ ID NO: 75823 - RNA, 22 nt, Chlamydophila pneumoniae J138
gagugugcauaacgagccuuug

SEQ ID NO: 75824 - RNA, 22 nt, Chlamydophila pneumoniae J138
augggaaucuugaagaguuguu

SEQ ID NO: 75825 - RNA, 22 nt, Chlamydophila pneumoniae J138
uucgugaucaagggaaaacugu

SEQ ID NO: 75826 - RNA, 22 nt, Chlamydophila pneumoniae J138
aggaaaagucgcgaagcguuau

SEQ ID NO: 75827 - RNA, 22 nt, Chlamydophila pneumoniae J138
agaguagcacaaaaugccuagu

SEQ ID NO: 75828 - RNA, 22 nt, Chlamydophila pneumoniae J138
auucaucauuugacuauugaua

SEQ ID NO: 75829 - RNA, 22 nt, Chlamydophila pneumoniae J138
cauuuaaaccaaucggaagaga

SEQ ID NO: 75830 - RNA, 22 nt, Chlamydophila pneumoniae J138
auucugaucauaucuccgggau

SEQ ID NO: 75831 - RNA, 22 nt, Chlamydophila pneumoniae J138
agcuuuuggauauccuuccuua

SEQ ID NO: 75832 - RNA, 22 nt, Chlamydophila pneumoniae J138
cuccauauagccgcauuggaau

SEQ ID NO: 75833 - RNA, 22 nt, Chlamydophila pneumoniae J138
uagaggcucuuccagcaaaaca

SEQ ID NO: 75834 - RNA, 22 nt, Chlamydophila pneumoniae J138
uugcauuuaaacuaagaauacc

SEQ ID NO: 75835 - RNA, 22 nt, Chlamydophila pneumoniae J138
cuuuuaaagauaaggaccaggu

SEQ ID NO: 75836 - RNA, 22 nt, Chlamydophila pneumoniae J138
ccgacgcucucgacggaucaua

SEQ ID NO: 75837 - RNA, 22 nt, Chlamydophila pneumoniae J138
gaacuuugugaagcuugagaag

SEQ ID NO: 75838 - RNA, 23 nt, Chlamydophila pneumoniae J138
ucagucucuagaggagcucuuug

SEQ ID NO: 75839 - RNA, 22 nt, Chlamydophila pneumoniae J138
uguagagauaugaauguuuccc

SEQ ID NO: 75840 - RNA, 22 nt, Chlamydophila pneumoniae J138
uuucaaagauaagccugugagu

SEQ ID NO: 75841 - RNA, 22 nt, Chlamydophila pneumoniae J138
aaaucaagaauacaucgcagau

SEQ ID NO: 75842 - RNA, 22 nt, Chlamydophila pneumoniae J138
uauucgacuguugcugcucuaa

SEQ ID NO: 75843 - RNA, 22 nt, Chlamydophila pneumoniae J138
aagcucuuccagaaacaagauc

SEQ ID NO: 75844 - RNA, 22 nt, Chlamydophila pneumoniae J138
aaauuaucggucaaaagcuaag

SEQ ID NO: 75845 - RNA, 22 nt, Chlamydophila pneumoniae J138
gagucuucacuucccgcaguuu

SEQ ID NO: 75846 - RNA, 21 nt, Chlamydophila pneumoniae J138
ucacugcugggggcaaaguua

SEQ ID NO: 75847 - RNA, 22 nt, Chlamydophila pneumoniae J138
cauuuaucucggaguucuugcg

SEQ ID NO: 75848 - RNA, 22 nt, Chlamydophila pneumoniae J138
aacgaugcuuggaguucgauuu

SEQ ID NO: 75849 - RNA, 22 nt, Chlamydophila pneumoniae J138
ucccuauacaaugagagaugug

SEQ ID NO: 75850 - RNA, 22 nt, Chlamydophila pneumoniae J138
uugcggauagcuauguagagug

SEQ ID NO: 75851 - RNA, 22 nt, Chlamydophila pneumoniae J138
gaggaugucguccugucggucu

SEQ ID NO: 75852 - RNA, 22 nt, Chlamydophila pneumoniae J138
uuggaauuaggcaugggccuuu

SEQ ID NO: 75853 - RNA, 22 nt, Chlamydophila pneumoniae J138
ugauaggaauuuuucaaucuga

SEQ ID NO: 75854 - RNA, 22 nt, Chlamydophila pneumoniae J138
uuuucgcuucucuugaagaaau

SEQ ID NO: 75855 - RNA, 22 nt, Chlamydophila pneumoniae J138
uacuugauagaacugugauucu

SEQ ID NO: 75856 - RNA, 22 nt, Chlamydophila pneumoniae J138
guucccuagggaagacugagga

SEQ ID NO: 75857 - RNA, 22 nt, Chlamydophila pneumoniae J138
cgaaauaugaguacccuuuauu

SEQ ID NO: 75858 - RNA, 22 nt, Chlamydophila pneumoniae J138
aguucagacuauuuuccuuuga

SEQ ID NO: 75859 - RNA, 22 nt, Chlamydophila pneumoniae J138
agguaagggauaugugacuucu

SEQ ID NO: 75860 - RNA, 22 nt, Chlamydophila pneumoniae J138
aauguguauggaauugugaggu

SEQ ID NO: 75861 - RNA, 17 nt, Chlamydophila pneumoniae J138
uuggaguuccguguauc

SEQ ID NO: 75862 - RNA, 22 nt, Chlamydophila pneumoniae J138
uuauauugcucguauccgucaa

SEQ ID NO: 75863 - RNA, 17 nt, Chlamydophila pneumoniae J138
gaucuccaaagaguaga

SEQ ID NO: 75864 - RNA, 19 nt, Chlamydophila pneumoniae J138
uagaaaaagaucuaagucg

SEQ ID NO: 75865 - RNA, 23 nt, Chlamydophila pneumoniae J138
gcaaucuuaaugacgaucuccuu

SEQ ID NO: 75866 - RNA, 22 nt, Chlamydophila pneumoniae J138
auugugaaugcuauuuuguaaa

SEQ ID NO: 75867 - RNA, 22 nt, Chlamydophila pneumoniae J138
uagguucuucucugauccuuug

SEQ ID NO: 75868 - RNA, 22 nt, Chlamydophila pneumoniae J138
uacaagauucaagcaagaucca

SEQ ID NO: 75869 - RNA, 22 nt, Chlamydophila pneumoniae J138
agauauucuuaaaguuucggau

SEQ ID NO: 75870 - RNA, 22 nt, Chlamydophila pneumoniae J138
agcacccaaaccugcaggagau

SEQ ID NO: 75871 - RNA, 22 nt, Chlamydophila pneumoniae J138
uguguagcaaaggcgugucgua

SEQ ID NO: 75872 - RNA, 22 nt, Chlamydophila pneumoniae J138
ggcaaaucuuugacucuaccgc

SEQ ID NO: 75873 - RNA, 22 nt, Chlamydophila pneumoniae J138
ugcuuacaguaugacgaggucu

SEQ ID NO: 75874 - RNA, 22 nt, Chlamydophila pneumoniae J138
ccuagaauuuaauccuaaugau

SEQ ID NO: 75875 - RNA, 22 nt, Chlamydophila pneumoniae J138
cgcuuucuucagacaguucaag

SEQ ID NO: 75876 - RNA, 22 nt, Chlamydophila pneumoniae J138
aaaucgaacuccaagcaucguu

SEQ ID NO: 75877 - RNA, 22 nt, Chlamydophila pneumoniae J138
uugaaagauacccggaugauuc

SEQ ID NO: 75878 - RNA, 22 nt, Chlamydophila pneumoniae J138
uuauuguucuugguguauagua

SEQ ID NO: 75879 - RNA, 22 nt, Chlamydophila pneumoniae J138
uggucugaagcucaugcaauuu

SEQ ID NO: 75880 - RNA, 22 nt, Chlamydophila pneumoniae J138
ucucuuguaggaauugacgggc

SEQ ID NO: 75881 - RNA, 22 nt, Chlamydophila pneumoniae J138
auagcagcuacuaagagaagug

SEQ ID NO: 75882 - RNA, 22 nt, Chlamydophila pneumoniae J138
uugcugagacuauaucgguaac

SEQ ID NO: 75883 - RNA, 22 nt, Chlamydophila pneumoniae J138
uagcaagcuuccgcagcuuuuu

SEQ ID NO: 75884 - RNA, 22 nt, Chlamydophila pneumoniae J138
ucuggagacaucuuuugaagcu

SEQ ID NO: 75885 - RNA, 22 nt, Chlamydophila pneumoniae J138
ucuggaauucuuuaugcuguaa

SEQ ID NO: 75886 - RNA, 22 nt, Chlamydophila pneumoniae J138
gcguucuugauauuuuguuaau

SEQ ID NO: 75887 - RNA, 22 nt, Chlamydophila pneumoniae J138
aaugacgcguaggucugccuua

SEQ ID NO: 75888 - RNA, 22 nt, Chlamydophila pneumoniae J138
cuuuaugaauuaggccuugugu

SEQ ID NO: 75889 - RNA, 22 nt, Chlamydophila pneumoniae J138
cuauguaguugccuggauugau

SEQ ID NO: 75890 - RNA, 22 nt, Chlamydophila pneumoniae J138
cuccagaucaagcuucacgucc

SEQ ID NO: 75891 - RNA, 22 nt, Chlamydophila pneumoniae J138
cgcuagcaguaccagcagcuuu

SEQ ID NO: 75892 - RNA, 22 nt, Chlamydophila pneumoniae J138
uuguauuuuuugcauccuagaa

SEQ ID NO: 75893 - RNA, 22 nt, Chlamydophila pneumoniae J138
uuucuggagaaucccgugaucu

SEQ ID NO: 75894 - RNA, 22 nt, Chlamydophila pneumoniae J138
auagccaauaaggagaucguca

SEQ ID NO: 75895 - RNA, 22 nt, Chlamydophila pneumoniae J138
aagaguuuuuuaugacucaugc

SEQ ID NO: 75896 - RNA, 22 nt, Chlamydophila pneumoniae J138
uggguuauuaucuuaugaagaa

SEQ ID NO: 75897 - RNA, 22 nt, Chlamydophila pneumoniae J138
ugagugucgacagacaauagca

SEQ ID NO: 75898 - RNA, 22 nt, Chlamydophila pneumoniae J138
aucugucuguuucuugcaggac

SEQ ID NO: 75899 - RNA, 22 nt, Chlamydophila pneumoniae J138
ucugaaacgacuuguuuccaug

SEQ ID NO: 75900 - RNA, 22 nt, Chlamydophila pneumoniae J138
uccuugauuugugaagaaauug

SEQ ID NO: 75901 - RNA, 22 nt, Chlamydophila pneumoniae J138
guuugcucuuaagauguauugc

SEQ ID NO: 75902 - RNA, 22 nt, Chlamydophila pneumoniae J138
guuuugcuggaagagccucuaa

SEQ ID NO: 75903 - RNA, 22 nt, Chlamydophila pneumoniae J138
uguuucaggacguuuguauuua

SEQ ID NO: 75904 - RNA, 22 nt, Chlamydophila pneumoniae J138
aaugucucucagguuuauuccu

SEQ ID NO: 75905 - RNA, 22 nt, Chlamydophila pneumoniae J138
gugagagcgaucucuggaacaa

SEQ ID NO: 75906 - RNA, 22 nt, Chlamydophila pneumoniae J138
acuccucuaucguauuggggau

SEQ ID NO: 75907 - RNA, 22 nt, Chlamydophila pneumoniae J138
accagcuguagagggauugggg

SEQ ID NO: 75908 - RNA, 22 nt, Chlamydophila pneumoniae J138
aaggaggagcuccugguggagg

SEQ ID NO: 75909 - RNA, 22 nt, Chlamydophila pneumoniae J138
aaggauggccaggauuuucagg

SEQ ID NO: 75910 - RNA, 21 nt, Chlamydophila pneumoniae J138
aggcuccuacuugccauucau

SEQ ID NO: 75911 - RNA, 22 nt, Chlamydophila pneumoniae J138
aggguucaauacuauggauuua

SEQ ID NO: 75912 - RNA, 21 nt, Chlamydophila pneumoniae J138
auaguaaguucaugcuuguua

SEQ ID NO: 75913 - RNA, 22 nt, Chlamydophila pneumoniae J138
aucugccuuguaaauaaguaug

SEQ ID NO: 75914 - RNA, 22 nt, Chlamydophila pneumoniae J138
cugugcucuugaagauuguguc

SEQ ID NO: 75915 - RNA, 22 nt, Chlamydophila pneumoniae J138
gaagcucaggaucugucaguuc

SEQ ID NO: 75916 - RNA, 22 nt, Chlamydophila pneumoniae J138
gcagggcuugauagagcgucuc

SEQ ID NO: 75917 - RNA, 22 nt, Chlamydophila pneumoniae J138
gcccaagucggagaaagcuuau

SEQ ID NO: 75918 - RNA, 22 nt, Chlamydophila pneumoniae J138
gugcaggucaugagcuugccgg

SEQ ID NO: 75919 - RNA, 23 nt, Chlamydophila pneumoniae J138
uaugucugggcuggagagcuggg

SEQ ID NO: 75920 - RNA, 22 nt, Chlamydophila pneumoniae J138
ucugaaguccuagcauugaaag

SEQ ID NO: 75921 - RNA, 22 nt, Chlamydophila pneumoniae J138
ucucagcauuauggaggcuccu

SEQ ID NO: 75922 - RNA, 22 nt, Chlamydophila pneumoniae J138
ucccuuuggauccagaagcuaa

SEQ ID NO: 75923 - RNA, 23 nt, Chlamydophila pneumoniae J138
ucagucucuagaggagcucuuug

SEQ ID NO: 75924 - RNA, 22 nt, Chlamydophila pneumoniae J138
ugugauuaucuguggagaccag

SEQ ID NO: 75925 - RNA, 22 nt, Chlamydophila pneumoniae J138
aagaagaagaauccguggauga

SEQ ID NO: 75926 - RNA, 22 nt, Chlamydophila pneumoniae J138
aaguucuagaauuacgggaaga

SEQ ID NO: 75927 - RNA, 22 nt, Chlamydophila pneumoniae J138
agaguucugcugcugcuagacc

SEQ ID NO: 75928 - RNA, 22 nt, Chlamydophila pneumoniae J138
aaucucugaacuuuugcuguug

SEQ ID NO: 75929 - RNA, 22 nt, Chlamydophila pneumoniae J138
agcccgagguacuacaaggcga

SEQ ID NO: 75930 - RNA, 22 nt, Chlamydophila pneumoniae J138
agcaggauuuuacuguauuucu

SEQ ID NO: 75931 - RNA, 22 nt, Chlamydophila pneumoniae J138
agcuuuuggauauccuuccuua

SEQ ID NO: 75932 - RNA, 22 nt, Chlamydophila pneumoniae J138
uuuguuauuacuaguugucuga

SEQ ID NO: 75933 - RNA, 22 nt, Chlamydophila pneumoniae J138
uugaccagaugcaugagaauag

SEQ ID NO: 75934 - RNA, 22 nt, Chlamydophila pneumoniae J138
cgcuuucuucagacaguucaag

SEQ ID NO: 75935 - RNA, 21 nt, Chlamydophila pneumoniae J138
cccuauggauaugauuccuuc

SEQ ID NO: 75936 - RNA, 22 nt, Chlamydophila pneumoniae J138
cauuuuuaaauacgauggucgu

SEQ ID NO: 75937 - RNA, 22 nt, Chlamydophila pneumoniae J138
gcagaacuuagagcuucaauau

SEQ ID NO: 75938 - RNA, 22 nt, Chlamydophila pneumoniae J138
gagaggggaagaaaaauagcca

SEQ ID NO: 75939 - RNA, 22 nt, Chlamydophila pneumoniae J138
gaguauaggugccuguguuagu

SEQ ID NO: 75940 - RNA, 22 nt, Chlamydophila pneumoniae J138
ggagacaguuugcuuuaucucu

SEQ ID NO: 75941 - RNA, 22 nt, Chlamydophila pneumoniae J138
uagaaguauuaagccaagauuu

SEQ ID NO: 75942 - RNA, 19 nt, Chlamydophila pneumoniae J138
guucuaguaggacucgaga

SEQ ID NO: 75943 - RNA, 22 nt, Chlamydophila pneumoniae J138
ugaagcauuugcucuuugggaa

SEQ ID NO: 75944 - RNA, 22 nt, Human
aaaaaaacuaauuuuaaaugug

SEQ ID NO: 75945 - RNA, 20 nt, Human
aaaaacaguaaugcugaaga

SEQ ID NO: 75946 - RNA, 22 nt, Human
aaaaacuuaccccagggcaagg

SEQ ID NO: 75947 - RNA, 22 nt, Human
aaaaaggagaaagagagggaga

SEQ ID NO: 75948 - RNA, 22 nt, Human
aaaaaauugcuggcagagcugu

SEQ ID NO: 75949 - RNA, 22 nt, Human
aaaaaguaccacuuggacacuu

SEQ ID NO: 75950 - RNA, 20 nt, Human
aaaaauguguuuauggagau

SEQ ID NO: 75951 - RNA, 22 nt, Human
aaaacauuuaggguuuuuuuua

SEQ ID NO: 75952 - RNA, 22 nt, Human
aaaagacaaggaucuggaguga

SEQ ID NO: 75953 - RNA, 22 nt, Human
aaaacauuuuacugccaucuca

SEQ ID NO: 75954 - RNA, 22 nt, Human
aaaacuuucagggauacagaaa

SEQ ID NO: 75955 - RNA, 22 nt, Human
aaaauacuaggaaaauaaauca

SEQ ID NO: 75956 - RNA, 22 nt, Human
aaacaccaagagcuagcuauua

SEQ ID NO: 75957 - RNA, 21 nt, Human
aaacaugcagccugccaauuc

SEQ ID NO: 75958 - RNA, 22 nt, Human
aaaauauguugagauacugaaa

SEQ ID NO: 75959 - RNA, 22 nt, Human
aaaccagaguucauaguauuca

SEQ ID NO: 75960 - RNA, 18 nt, Human
aaacauggcuuaaaggcu

SEQ ID NO: 75961 - RNA, 22 nt, Human
aaacaagagcuuacauggcugc

SEQ ID NO: 75962 - RNA, 22 nt, Human
aaaaguuguaauauuuccuuua

SEQ ID NO: 75963 - RNA, 22 nt, Human
aaaagcgaagagaacugaaguu

SEQ ID NO: 75964 - RNA, 22 nt, Human
aaaagcucucuucuucggcuuu

SEQ ID NO: 75965 - RNA, 22 nt, Human
aaaaggaacaauaugguauuuu

SEQ ID NO: 75966 - RNA, 22 nt, Human
aaacuuuaggcacauggaucua

SEQ ID NO: 75967 - RNA, 22 nt, Human
aaacugcuuucucugccuuucc

SEQ ID NO: 75968 - RNA, 22 nt, Human
aaacucaugccagagaacuuaa

SEQ ID NO: 75969 - RNA, 22 nt, Human
aaagaauuucaagauucccaca

SEQ ID NO: 75970 - RNA, 20 nt, Human
aaacucuuuucuuacauuuu

SEQ ID NO: 75971 - RNA, 22 nt, Human
aaacucuaagacuaaaauugaa

SEQ ID NO: 75972 - RNA, 22 nt, Human
aaacucaucaguuuagaaaccu

SEQ ID NO: 75973 - RNA, 20 nt, Human
aaacucucugaucuuacagu

SEQ ID NO: 75974 - RNA, 22 nt, Human
aaagagcugccaagguuacagu

SEQ ID NO: 75975 - RNA, 21 nt, Human
aaagaaguuaguucagugguu

SEQ ID NO: 75976 - RNA, 22 nt, Human
aaagaagugucuuacucccucu

SEQ ID NO: 75977 - RNA, 22 nt, Human
aaacuuuugaaggaggaaaaag

SEQ ID NO: 75978 - RNA, 22 nt, Human
aaacugugcagucacauaagga

SEQ ID NO: 75979 - RNA, 22 nt, Human
aaagacucaauuguucccuaau

SEQ ID NO: 75980 - RNA, 23 nt, Human
aaagacuagaagccguggcugca

SEQ ID NO: 75981 - RNA, 22 nt, Human
aaagagacaacaacaacuucua

SEQ ID NO: 75982 - RNA, 22 nt, Human
aaagaccaagagccccaaguuu

SEQ ID NO: 75983 - RNA, 22 nt, Human
aaagacagccuguuggcuuucu

SEQ ID NO: 75984 - RNA, 22 nt, Human
aaagacaauaauucucucuagc

SEQ ID NO: 75985 - RNA, 22 nt, Human
aaaucugaaggaaacagcuuca

SEQ ID NO: 75986 - RNA, 22 nt, Human
aaauguaaacuguauuuauaaa

SEQ ID NO: 75987 - RNA, 22 nt, Human
aaaugcuuuaauugaguucaug

SEQ ID NO: 75988 - RNA, 22 nt, Human
aaagaucaguuaacgccaucaa

SEQ ID NO: 75989 - RNA, 22 nt, Human
aaagaggacgugcuauuuuuua

SEQ ID NO: 75990 - RNA, 22 nt, Human
aaagacuaaccaguugucaaaa

SEQ ID NO: 75991 - RNA, 22 nt, Human
aaagaccuucacuuucuggcug

SEQ ID NO: 75992 - RNA, 22 nt, Human
aaauguuugguggauaaaagga

SEQ ID NO: 75993 - RNA, 22 nt, Human
aaauucagcagguuucaaaagc

SEQ ID NO: 75994 - RNA, 20 nt, Human
aaauucgacuaaaaccagaa

SEQ ID NO: 75995 - RNA, 22 nt, Human
aaauucuuccaggaggaaauac

SEQ ID NO: 75996 - RNA, 22 nt, Human
aaauucagauggcuuucuuuuc

SEQ ID NO: 75997 - RNA, 22 nt, Human
aaaugucugagacuucugaacu

SEQ ID NO: 75998 - RNA, 22 nt, Human
aaauuaaaguuuuauuuagagc

SEQ ID NO: 75999 - RNA, 22 nt, Human
aaauguuucauucuauuuuuag

SEQ ID NO: 76000 - RNA, 22 nt, Human
aaauguguagaggggagagccg

SEQ ID NO: 76001 - RNA, 22 nt, Human
aacacuguaucagucuucaaua

SEQ ID NO: 76002 - RNA, 22 nt, Human
aaauuuuguugaaaaauauuuu

SEQ ID NO: 76003 - RNA, 21 nt, Human
aaauuucauauggccaaccua

SEQ ID NO: 76004 - RNA, 21 nt, Human
aacaaaagggaagaacagcug

SEQ ID NO: 76005 - RNA, 22 nt, Human
aacaaaacauuuuacgaauaua

SEQ ID NO: 76006 - RNA, 22 nt, Human
aacagaauaucaaaagauuaug

SEQ ID NO: 76007 - RNA, 22 nt, Human
aacaguacaucaugaggucauc

SEQ ID NO: 76008 - RNA, 22 nt, Human
aacaggaagaauccagauggug

SEQ ID NO: 76009 - RNA, 22 nt, Human
aaccagaagucaucagagcuga

SEQ ID NO: 76010 - RNA, 22 nt, Human
aacacuaaaggucaguuagaag

SEQ ID NO: 76011 - RNA, 22 nt, Human
aacagaaaucauuuagggcucu

SEQ ID NO: 76012 - RNA, 22 nt, Human
aacccugaacuuaguucuagga

SEQ ID NO: 76013 - RNA, 22 nt, Human
aacauuguggacaagggcaggu

SEQ ID NO: 76014 - RNA, 22 nt, Human
aacccacuaugauuguccucau

SEQ ID NO: 76015 - RNA, 22 nt, Human
aacagguucaucuuggaagcag

SEQ ID NO: 76016 - RNA, 22 nt, Human
aacaucaaaggaagaaugauau

SEQ ID NO: 76017 - RNA, 22 nt, Human
aaccaaucaaauuggaauugaa

SEQ ID NO: 76018 - RNA, 22 nt, Human
aaccaaaguugguauuuaauaa

SEQ ID NO: 76019 - RNA, 22 nt, Human
aacauuuccggccuuuuguucu

SEQ ID NO: 76020 - RNA, 22 nt, Human
aacauuguuuaaguuaaauugu

SEQ ID NO: 76021 - RNA, 22 nt, Human
aaccauauugauuauguuuuau

SEQ ID NO: 76022 - RNA, 22 nt, Human
aaccuggguguacauuaugguc

SEQ ID NO: 76023 - RNA, 22 nt, Human
aaccucuuugugaaugucauga

SEQ ID NO: 76024 - RNA, 22 nt, Human
aaccuagaggaagaugggucag

SEQ ID NO: 76025 - RNA, 20 nt, Human
aaccuauuguaauauucuaa

SEQ ID NO: 76026 - RNA, 22 nt, Human
aacgauuugaguuaguuuuuag

SEQ ID NO: 76027 - RNA, 22 nt, Human
aaccuuauuguguaucaccaua

SEQ ID NO: 76028 - RNA, 21 nt, Human
aacuauuaauaccauuagcaa

SEQ ID NO: 76029 - RNA, 21 nt, Human
aacuaaugacugcagcaggaa

SEQ ID NO: 76030 - RNA, 22 nt, Human
aacucgaugcaauucacuuugu

SEQ ID NO: 76031 - RNA, 22 nt, Human
aaccuggaggaccuuaugcuaa

SEQ ID NO: 76032 - RNA, 19 nt, Human
aacuacagcgcacuguccu

SEQ ID NO: 76033 - RNA, 22 nt, Human
aacgcagagaguaaugcugaac

SEQ ID NO: 76034 - RNA, 22 nt, Human
aacgcaacaacuggagcuguag

SEQ ID NO: 76035 - RNA, 23 nt, Human
aacucuggcuagcauagaauaga

SEQ ID NO: 76036 - RNA, 22 nt, Human
aacucugacgcugucaaauaca

SEQ ID NO: 76037 - RNA, 22 nt, Human
aacucugagaaacuugcaguug

SEQ ID NO: 76038 - RNA, 22 nt, Human
aacuacucugggguggcagguu

SEQ ID NO: 76039 - RNA, 22 nt, Human
aacgugcuuuacaaaugaccuu

SEQ ID NO: 76040 - RNA, 19 nt, Human
aacucugccgaggcaagcc

SEQ ID NO: 76041 - RNA, 22 nt, Human
aacugggugauucaggcuguuu

SEQ ID NO: 76042 - RNA, 22 nt, Human
aacucccucaacuuccuucucu

SEQ ID NO: 76043 - RNA, 22 nt, Human
aacuuguaaugaaaggcaauag

SEQ ID NO: 76044 - RNA, 22 nt, Human
aacuuuacagacuagagcuuuc

SEQ ID NO: 76045 - RNA, 22 nt, Human
aacucugcaaugaaaucauguu

SEQ ID NO: 76046 - RNA, 22 nt, Human
aacucaggagagaguaacaggg

SEQ ID NO: 76047 - RNA, 22 nt, Human
aacuuaaacaagcucccaaguu

SEQ ID NO: 76048 - RNA, 22 nt, Human
aagaaaagcaucuuuguaguag

SEQ ID NO: 76049 - RNA, 22 nt, Human
aagaaaagguaaccgcuuaucu

SEQ ID NO: 76050 - RNA, 22 nt, Human
aacugagugcuacauugugauu

SEQ ID NO: 76051 - RNA, 22 nt, Human
aacuguugucacgaauguggcu

SEQ ID NO: 76052 - RNA, 22 nt, Human
aacuuucuuugcaucuaaguuu

SEQ ID NO: 76053 - RNA, 22 nt, Human
aacuuucugaaaagcuugauca

SEQ ID NO: 76054 - RNA, 22 nt, Human
aacuuuuucuuaggggaaagca

SEQ ID NO: 76055 - RNA, 20 nt, Human
aacuuugagugcaugacuuu

SEQ ID NO: 76056 - RNA, 22 nt, Human
aacuuuuaugaaggaaaucaua

SEQ ID NO: 76057 - RNA, 22 nt, Human
aacuuucagaauccuaugcauu

SEQ ID NO: 76058 - RNA, 21 nt, Human
aacuuucccaauccagauuug

SEQ ID NO: 76059 - RNA, 19 nt, Human
aagaacaguucuaauuuca

SEQ ID NO: 76060 - RNA, 22 nt, Human
aagaacaacugcuuuaaaagca

SEQ ID NO: 76061 - RNA, 22 nt, Human
aagaaaggcacaagaaagaaaa

SEQ ID NO: 76062 - RNA, 22 nt, Human
aacuucuggaaacuuccaugug

SEQ ID NO: 76063 - RNA, 22 nt, Human
aacuuauacccagggcagaaau

SEQ ID NO: 76064 - RNA, 22 nt, Human
aagaaauacagaaauggcagua

SEQ ID NO: 76065 - RNA, 22 nt, Human
aagaagguugaaugacuacuuu

SEQ ID NO: 76066 - RNA, 22 nt, Human
aagaaguccuugaggcgcaccc

SEQ ID NO: 76067 - RNA, 22 nt, Human
aagaaugaaaugaaagaacuaa

SEQ ID NO: 76068 - RNA, 22 nt, Human
aagaagagaauauauuuacguc

SEQ ID NO: 76069 - RNA, 23 nt, Human
aagaaugcuucugaagagcugcc

SEQ ID NO: 76070 - RNA, 22 nt, Human
aagaaaagaaacauggguaugc

SEQ ID NO: 76071 - RNA, 22 nt, Human
aagagaaaugcuuuaacuuuau

SEQ ID NO: 76072 - RNA, 22 nt, Human
aagaccacaggaaucaaacagg

SEQ ID NO: 76073 - RNA, 22 nt, Human
aagaggaggacgguucccagaa

SEQ ID NO: 76074 - RNA, 22 nt, Human
aagagugaguagcuugguuggu

SEQ ID NO: 76075 - RNA, 22 nt, Human
aagauguuguagauuagugaga

SEQ ID NO: 76076 - RNA, 22 nt, Human
aagagaaagggaaaaugguaaa

SEQ ID NO: 76077 - RNA, 22 nt, Human
aagagaggaaagggugugaggu

SEQ ID NO: 76078 - RNA, 22 nt, Human
aagagcuuguuaugcugcucuu

SEQ ID NO: 76079 - RNA, 22 nt, Human
aagaggaauaauaaaaauugca

SEQ ID NO: 76080 - RNA, 22 nt, Human
aagagaaacauauggccagauu

SEQ ID NO: 76081 - RNA, 22 nt, Human
aagcagaaaaacugagcuccaa

SEQ ID NO: 76082 - RNA, 22 nt, Human
aagcaauucacaguucacuuaa

SEQ ID NO: 76083 - RNA, 22 nt, Human
aagcaaguucuaaaguaauucu

SEQ ID NO: 76084 - RNA, 22 nt, Human
aagcagcauaugacagcaucca

SEQ ID NO: 76085 - RNA, 21 nt, Human
aagcagcugcagaauuucagu

SEQ ID NO: 76086 - RNA, 22 nt, Human
aagcccucagagccucuuugac

SEQ ID NO: 76087 - RNA, 22 nt, Human
aagcauuuuagauaaagcauca

SEQ ID NO: 76088 - RNA, 22 nt, Human
aagauuugaaaguggugcauuu

SEQ ID NO: 76089 - RNA, 22 nt, Human
aagcaaaagguuacacuucugg

SEQ ID NO: 76090 - RNA, 22 nt, Human
aagauuuaccacuuuauucaag

SEQ ID NO: 76091 - RNA, 22 nt, Human
aagcaaaaucgcaucuggggcc

SEQ ID NO: 76092 - RNA, 22 nt, Human
aagcagaacuguuuuguuuucu

SEQ ID NO: 76093 - RNA, 22 nt, Human
aagcaguuuagucaucgggauu

SEQ ID NO: 76094 - RNA, 22 nt, Human
aagcauaucaaguuuuaugugc

SEQ ID NO: 76095 - RNA, 22 nt, Human
aagcagacugggccauaaggaa

SEQ ID NO: 76096 - RNA, 22 nt, Human
aagccugguuauuugaggaugu

SEQ ID NO: 76097 - RNA, 22 nt, Human
aagccucaugccagauccaggu

SEQ ID NO: 76098 - RNA, 22 nt, Human
aagccuccgugcugcuggaucu

SEQ ID NO: 76099 - RNA, 22 nt, Human
aaggagcuuucauuacagccuu

SEQ ID NO: 76100 - RNA, 18 nt, Human
aaggaggaaugaauagca

SEQ ID NO: 76101 - RNA, 22 nt, Human
aaggaucuuucuuuuuaccauu

SEQ ID NO: 76102 - RNA, 22 nt, Human
aaggaugguaacaguuucauuu

SEQ ID NO: 76103 - RNA, 22 nt, Human
aaggaguggugaagucagaugu

SEQ ID NO: 76104 - RNA, 22 nt, Human
aaggauguuuaaacuacuuucc

SEQ ID NO: 76105 - RNA, 19 nt, Human
aaggcuuucugagugaaaa

SEQ ID NO: 76106 - RNA, 22 nt, Human
aaggcugaccaguuuacacuuu

SEQ ID NO: 76107 - RNA, 22 nt, Human
aaggcgauuuaaagauguuagg

SEQ ID NO: 76108 - RNA, 22 nt, Human
aagggaccucagcaaucaggga

SEQ ID NO: 76109 - RNA, 22 nt, Human
aagggaauagagcagcaaaaau

SEQ ID NO: 76110 - RNA, 22 nt, Human
aagggaaacagccaggcccugu

SEQ ID NO: 76111 - RNA, 22 nt, Human
aagguauaaauaacucgggagg

SEQ ID NO: 76112 - RNA, 22 nt, Human
aaguaacuggggagggagggug

SEQ ID NO: 76113 - RNA, 22 nt, Human
aaguaauuugugaaggcauguu

SEQ ID NO: 76114 - RNA, 22 nt, Human
aaguacugauucuguuccucaa

SEQ ID NO: 76115 - RNA, 22 nt, Human
aaggucuucgaaccuuauguua

SEQ ID NO: 76116 - RNA, 22 nt, Human
aagguccuguagccacagagcc

SEQ ID NO: 76117 - RNA, 22 nt, Human
aaggugcugaggguccuggcuu

SEQ ID NO: 76118 - RNA, 22 nt, Human
aaguguucucuguuuuaucuac

SEQ ID NO: 76119 - RNA, 22 nt, Human
aagugugugugcgcaugugcau

SEQ ID NO: 76120 - RNA, 22 nt, Human
aagugguuuauuguaugguuuu

SEQ ID NO: 76121 - RNA, 22 nt, Human
aaguuaauugcuucuaguuaau

SEQ ID NO: 76122 - RNA, 22 nt, Human
aaguuccuaaagucagggguca

SEQ ID NO: 76123 - RNA, 19 nt, Human
aaguauagucagccuucua

SEQ ID NO: 76124 - RNA, 22 nt, Human
aagucauuaucucuucuaaucu

SEQ ID NO: 76125 - RNA, 22 nt, Human
aaguccaaaacauuucucugcu

SEQ ID NO: 76126 - RNA, 22 nt, Human
aauagguaaaugaguaagaaau

SEQ ID NO: 76127 - RNA, 22 nt, Human
aauaucuagccuuuagcagcuu

SEQ ID NO: 76128 - RNA, 22 nt, Human
aauaucuugaguuauaaauuca

SEQ ID NO: 76129 - RNA, 22 nt, Human
aauaugcaaagcguguuaucug

SEQ ID NO: 76130 - RNA, 22 nt, Human
aauaugaugccaaauugcuaca

SEQ ID NO: 76131 - RNA, 22 nt, Human
aauauagagcagaucuggcucu

SEQ ID NO: 76132 - RNA, 22 nt, Human
aauaggaaggaaauguuuaccu

SEQ ID NO: 76133 - RNA, 22 nt, Human
aauaacuuaaugacuguguaca

SEQ ID NO: 76134 - RNA, 22 nt, Human
aauacagcacucacaccucccu

SEQ ID NO: 76135 - RNA, 22 nt, Human
aauacagauggcaugugaagau

SEQ ID NO: 76136 - RNA, 22 nt, Human
aauaagaguuaagaaguauauu

SEQ ID NO: 76137 - RNA, 22 nt, Human
aaugguaauauuucauaguugu

SEQ ID NO: 76138 - RNA, 22 nt, Human
aauggcuagcauguaaaauauc

SEQ ID NO: 76139 - RNA, 22 nt, Human
aaugggauaggucuucaggaau

SEQ ID NO: 76140 - RNA, 22 nt, Human
aauguacucuguguuucucaug

SEQ ID NO: 76141 - RNA, 22 nt, Human
aauguacucgaaugauguuaag

SEQ ID NO: 76142 - RNA, 22 nt, Human
aauggcaagccacaugcuuuuc

SEQ ID NO: 76143 - RNA, 22 nt, Human
aauggauaacaccgguucuguc

SEQ ID NO: 76144 - RNA, 22 nt, Human
aauggcaaaaguuucggaaauu

SEQ ID NO: 76145 - RNA, 22 nt, Human
aauggagaaaagacaauguuga

SEQ ID NO: 76146 - RNA, 22 nt, Human
aaugcugaaugcauguuuccau

SEQ ID NO: 76147 - RNA, 22 nt, Human
aauggacuucucugagccuguu

SEQ ID NO: 76148 - RNA, 22 nt, Human
aauggaccuuaaauugcuucag

SEQ ID NO: 76149 - RNA, 22 nt, Human
aauggaaaggagccugacuaua

SEQ ID NO: 76150 - RNA, 22 nt, Human
aaugcauacguguuuguggcaa

SEQ ID NO: 76151 - RNA, 22 nt, Human
aauucaggacaaauguuuucaa

SEQ ID NO: 76152 - RNA, 22 nt, Human
aauuagaagcuguuagcaaaau

SEQ ID NO: 76153 - RNA, 22 nt, Human
aauuaaggccuuuaaaugucuu

SEQ ID NO: 76154 - RNA, 22 nt, Human
aauuauucucucaacugagaug

SEQ ID NO: 76155 - RNA, 22 nt, Human
aauguuuaguuuuauuuuagua

SEQ ID NO: 76156 - RNA, 22 nt, Human
aauguuuaagcuuuuauuuaca

SEQ ID NO: 76157 - RNA, 22 nt, Human
aauguugaaccuuuuuggccug

SEQ ID NO: 76158 - RNA, 23 nt, Human
aauguugaggguggguuuuuaac

SEQ ID NO: 76159 - RNA, 22 nt, Human
aauguucucuaaucuuucucuu

SEQ ID NO: 76160 - RNA, 22 nt, Human
aauguaguuuacugugagugca

SEQ ID NO: 76161 - RNA, 22 nt, Human
aauguauuuuuaggcagaauau

SEQ ID NO: 76162 - RNA, 22 nt, Human
aaucuagagaacuguggggcag

SEQ ID NO: 76163 - RNA, 22 nt, Human
aaucuacaaugaaaaaauguuu

SEQ ID NO: 76164 - RNA, 22 nt, Human
aaucucuugggaagagugagug

SEQ ID NO: 76165 - RNA, 22 nt, Human
aauccaaacaggauuaccuauc

SEQ ID NO: 76166 - RNA, 22 nt, Human
aaucaaagccugcaaguugacu

SEQ ID NO: 76167 - RNA, 22 nt, Human
aauauuuaccuaccugucaucu

SEQ ID NO: 76168 - RNA, 22 nt, Human
aaucaugguacaaguaagcacg

SEQ ID NO: 76169 - RNA, 22 nt, Human
aaucuguugucaggaauccaca

SEQ ID NO: 76170 - RNA, 22 nt, Human
aaucuuguucaacauuaucugu

SEQ ID NO: 76171 - RNA, 22 nt, Human
aaucucguuaugaagaugguug

SEQ ID NO: 76172 - RNA, 22 nt, Human
aaucugugaggaauaaugaguu

SEQ ID NO: 76173 - RNA, 22 nt, Human
aaucuuuuugaaggaggagaga

SEQ ID NO: 76174 - RNA, 22 nt, Human
aaugacagccuauacugucugc

SEQ ID NO: 76175 - RNA, 22 nt, Human
aaugacaguggcacagucacuu

SEQ ID NO: 76176 - RNA, 22 nt, Human
aaugaacuuugaagauggugaa

SEQ ID NO: 76177 - RNA, 22 nt, Human
aaugaaaaucugucaguucaag

SEQ ID NO: 76178 - RNA, 22 nt, Human
aaugaacuuucaguucagagag

SEQ ID NO: 76179 - RNA, 22 nt, Human
aaugauuuucugcaaacaguga

SEQ ID NO: 76180 - RNA, 22 nt, Human
aaugaguuuguucuauuauuug

SEQ ID NO: 76181 - RNA, 22 nt, Human
aaugcagaugugucuuuaauuu

SEQ ID NO: 76182 - RNA, 22 nt, Human
aaugagauggaggacucuuaau

SEQ ID NO: 76183 - RNA, 22 nt, Human
aaugaguucaucugaauucugg

SEQ ID NO: 76184 - RNA, 23 nt, Human
aaugaguugggcagcauacaggc

SEQ ID NO: 76185 - RNA, 22 nt, Human
aaugagaauguaagugaagaga

SEQ ID NO: 76186 - RNA, 22 nt, Human
aguauggaauuuuuaaugacag

SEQ ID NO: 76187 - RNA, 22 nt, Human
aguauuggauauaaucuaggaa

SEQ ID NO: 76188 - RNA, 22 nt, Human
aguaucgcuuuguaucaugagg

SEQ ID NO: 76189 - RNA, 22 nt, Human
aguauccauccugcuguuucua

SEQ ID NO: 76190 - RNA, 23 nt, Human
aguaucuugguguggugcagaga

SEQ ID NO: 76191 - RNA, 22 nt, Human
aguaucuuccucaugaacacgu

SEQ ID NO: 76192 - RNA, 22 nt, Human
aguaugcuggcaccuuugagug

SEQ ID NO: 76193 - RNA, 22 nt, Human
aguauucaguuagugagcuaag

SEQ ID NO: 76194 - RNA, 22 nt, Human
aguaucuauaucaaaaauggcu

SEQ ID NO: 76195 - RNA, 22 nt, Human
aguaagaaagaaugauaggccu

SEQ ID NO: 76196 - RNA, 22 nt, Human
aguaacuuaagcaauuguguau

SEQ ID NO: 76197 - RNA, 22 nt, Human
aguaaucgugaucgagagauca

SEQ ID NO: 76198 - RNA, 22 nt, Human
aguacuuuuuguucaauugugc

SEQ ID NO: 76199 - RNA, 22 nt, Human
aguagaauuacagguuuucucu

SEQ ID NO: 76200 - RNA, 22 nt, Human
aguaggaauucaaagagacaaa

SEQ ID NO: 76201 - RNA, 22 nt, Human
aguauagacaucaaacugaaga

SEQ ID NO: 76202 - RNA, 21 nt, Human
aguagucgauucaggagaagu

SEQ ID NO: 76203 - RNA, 22 nt, Human
aggugcuugcauacugcuugac

SEQ ID NO: 76204 - RNA, 22 nt, Human
aggucuuuaguggcagagucua

SEQ ID NO: 76205 - RNA, 21 nt, Human
aggugguuccaauaaguaggu

SEQ ID NO: 76206 - RNA, 22 nt, Human
agguuguaagcuuuauauaaau

SEQ ID NO: 76207 - RNA, 22 nt, Human
agucaaaaaaccuagaaacacc

SEQ ID NO: 76208 - RNA, 22 nt, Human
aguauuuucuuuaguuuguuag

SEQ ID NO: 76209 - RNA, 22 nt, Human
agucaacauuugagaugcaaug

SEQ ID NO: 76210 - RNA, 22 nt, Human
aguauuuuaaaauacauuaucc

SEQ ID NO: 76211 - RNA, 22 nt, Human
aguauuuaguauucuauauuag

SEQ ID NO: 76212 - RNA, 22 nt, Human
aguauugguaaguguagcaaau

SEQ ID NO: 76213 - RNA, 23 nt, Human
aguauuguucaucuucaagacag

SEQ ID NO: 76214 - RNA, 22 nt, Human
agucaggacagauuuucugggg

SEQ ID NO: 76215 - RNA, 22 nt, Human
agucaccuacagcucaugcuuc

SEQ ID NO: 76216 - RNA, 20 nt, Human
agucacagacccucagguag

SEQ ID NO: 76217 - RNA, 22 nt, Human
agucagaaggugucagaucuug

SEQ ID NO: 76218 - RNA, 22 nt, Human
agucauuugucauuuuuuugag

SEQ ID NO: 76219 - RNA, 22 nt, Human
agucauuguguucaguaaaauc

SEQ ID NO: 76220 - RNA, 22 nt, Human
agucauuugaggcaugauuaug

SEQ ID NO: 76221 - RNA, 22 nt, Human
agucuagagcuuuuaucaggcc

SEQ ID NO: 76222 - RNA, 22 nt, Human
agucuaaguuuuguaugcuaac

SEQ ID NO: 76223 - RNA, 22 nt, Human
aguccucagauauggagaucug

SEQ ID NO: 76224 - RNA, 22 nt, Human
agucggauuucccagguuauug

SEQ ID NO: 76225 - RNA, 22 nt, Human
agucuauguuuuuguucuuauu

SEQ ID NO: 76226 - RNA, 22 nt, Human
agucuauacuucccaguugaca

SEQ ID NO: 76227 - RNA, 22 nt, Human
agucugaaccagauggcaaggu

SEQ ID NO: 76228 - RNA, 22 nt, Human
agucucuagagucugucccucu

SEQ ID NO: 76229 - RNA, 18 nt, Human
agucugagugaaauguag

SEQ ID NO: 76230 - RNA, 22 nt, Human
agucucccauaggcuaaguauu

SEQ ID NO: 76231 - RNA, 19 nt, Human
agugaacuccauaucaggu

SEQ ID NO: 76232 - RNA, 22 nt, Human
agugaagauagagccaggucug

SEQ ID NO: 76233 - RNA, 22 nt, Human
agggaagcaggaaguaugggaa

SEQ ID NO: 76234 - RNA, 22 nt, Human
agggaagccggagcgacggggg

SEQ ID NO: 76235 - RNA, 22 nt, Human
agggaugugcagggcuugccau

SEQ ID NO: 76236 - RNA, 22 nt, Human
agggcugggcuuggcaggcugg

SEQ ID NO: 76237 - RNA, 20 nt, Human
agggauuugguugguauugu

SEQ ID NO: 76238 - RNA, 22 nt, Human
agggaggagggacagaaagagg

SEQ ID NO: 76239 - RNA, 22 nt, Human
aggggaagagugagguuuuggu

SEQ ID NO: 76240 - RNA, 22 nt, Human
aggggauggagcuggaaggcag

SEQ ID NO: 76241 - RNA, 22 nt, Human
aggggagaguuaaugugaaugu

SEQ ID NO: 76242 - RNA, 22 nt, Human
aggggcuuguggaguugcuggu

SEQ ID NO: 76243 - RNA, 22 nt, Human
aggggagggcuggccuuuggau

SEQ ID NO: 76244 - RNA, 22 nt, Human
aggggcaagucuggccauuucu

SEQ ID NO: 76245 - RNA, 22 nt, Human
aggguuugugaagacuuggcca

SEQ ID NO: 76246 - RNA, 22 nt, Human
agguagaaggaccagaauuuau

SEQ ID NO: 76247 - RNA, 22 nt, Human
agguaagaagugagcaaguuua

SEQ ID NO: 76248 - RNA, 21 nt, Human
agguagauagccccaggaagg

SEQ ID NO: 76249 - RNA, 22 nt, Human
agguccugucuuaucucuguaa

SEQ ID NO: 76250 - RNA, 22 nt, Human
agggaagagaaacaaagauuca

SEQ ID NO: 76251 - RNA, 22 nt, Human
aggcgguuggcuuugucugggu

SEQ ID NO: 76252 - RNA, 22 nt, Human
agggaagaggaccagagucucu

SEQ ID NO: 76253 - RNA, 22 nt, Human
aggcuucauuacagugguucaa

SEQ ID NO: 76254 - RNA, 22 nt, Human
aggcugucucaccucaggaggg

SEQ ID NO: 76255 - RNA, 22 nt, Human
agggaucccaaggggucucugc

SEQ ID NO: 76256 - RNA, 22 nt, Human
agggaugcaguaaaaacuguag

SEQ ID NO: 76257 - RNA, 22 nt, Human
agggaguuccgaucugugcacc

SEQ ID NO: 76258 - RNA, 22 nt, Human
agggagcugcucugcuuccgug

SEQ ID NO: 76259 - RNA, 22 nt, Human
agggaaauuaaugugagcaaug

SEQ ID NO: 76260 - RNA, 22 nt, Human
agggaccacauccccucugugg

SEQ ID NO: 76261 - RNA, 19 nt, Human
agggagagucccaagagaa

SEQ ID NO: 76262 - RNA, 22 nt, Human
agggacuugugucuguguuuuu

SEQ ID NO: 76263 - RNA, 22 nt, Human
aggcuaagugauuagugacaua

SEQ ID NO: 76264 - RNA, 22 nt, Human
aggcguggcuucugcuggguug

SEQ ID NO: 76265 - RNA, 22 nt, Human
aggcuccucugggggccccgga

SEQ ID NO: 76266 - RNA, 20 nt, Human
aggcuccuccaggaugugug

SEQ ID NO: 76267 - RNA, 22 nt, Human
aggauggaaguaacuggauaau

SEQ ID NO: 76268 - RNA, 22 nt, Human
aggagcugccggauggggcaug

SEQ ID NO: 76269 - RNA, 22 nt, Human
aggagcauuuugguggguuuug

SEQ ID NO: 76270 - RNA, 22 nt, Human
aggagagaacaagaguauccug

SEQ ID NO: 76271 - RNA, 22 nt, Human
aggagguagggugugaaacagc

SEQ ID NO: 76272 - RNA, 17 nt, Human
aggagcuagaaaggaga

SEQ ID NO: 76273 - RNA, 22 nt, Human
agcaggacuugcugagcccucc

SEQ ID NO: 76274 - RNA, 22 nt, Human
agcaggaaggcuagaagcagga

SEQ ID NO: 76275 - RNA, 22 nt, Human
agcaggaggagagccuggcggu

SEQ ID NO: 76276 - RNA, 22 nt, Human
agcagcugagccccagcuguga

SEQ ID NO: 76277 - RNA, 22 nt, Human
agcagcaggugaccucgaugcc

SEQ ID NO: 76278 - RNA, 22 nt, Human
agcagcaggcugggaugagucu

SEQ ID NO: 76279 - RNA, 22 nt, Human
agauagaaggauugugacacau

SEQ ID NO: 76280 - RNA, 22 nt, Human
agauaagaacauuaguaagccg

SEQ ID NO: 76281 - RNA, 22 nt, Human
agauacuaagccucaagagacg

SEQ ID NO: 76282 - RNA, 22 nt, Human
agcaggaggguuuuguagaguc

SEQ ID NO: 76283 - RNA, 22 nt, Human
agcauucuguggucuucuaugg

SEQ ID NO: 76284 - RNA, 22 nt, Human
agcauuuuaaaacuaguuacca

SEQ ID NO: 76285 - RNA, 22 nt, Human
agcauuugcuguucuagaaagu

SEQ ID NO: 76286 - RNA, 22 nt, Human
agcauucccuuugcagugucau

SEQ ID NO: 76287 - RNA, 22 nt, Human
agcaguuuauccucauaaugga

SEQ ID NO: 76288 - RNA, 19 nt, Human
agcaucuccacagaaaaag

SEQ ID NO: 76289 - RNA, 21 nt, Human
agcaucugaggcaguuuccua

SEQ ID NO: 76290 - RNA, 21 nt, Human
agcagucugcggccggugcgg

SEQ ID NO: 76291 - RNA, 22 nt, Human
agcaguugcuuuguauauuaaa

SEQ ID NO: 76292 - RNA, 22 nt, Human
agcauuucuacugugucagaaa

SEQ ID NO: 76293 - RNA, 20 nt, Human
agcauucaacuuucuauguu

SEQ ID NO: 76294 - RNA, 22 nt, Human
agccauggaggaugugcagcau

SEQ ID NO: 76295 - RNA, 22 nt, Human
agcaucuaucuucaaugugugu

SEQ ID NO: 76296 - RNA, 22 nt, Human
agccugggucgagagacgagaa

SEQ ID NO: 76297 - RNA, 22 nt, Human
agccuggagcaggcucugcucu

SEQ ID NO: 76298 - RNA, 22 nt, Human
agcccuauacuuagauuuauuc

SEQ ID NO: 76299 - RNA, 22 nt, Human
agccccuucuuuggggagcuga

SEQ ID NO: 76300 - RNA, 22 nt, Human
agccccuaaaguagcuguucuu

SEQ ID NO: 76301 - RNA, 22 nt, Human
agccgcugaauuugaaacaagc

SEQ ID NO: 76302 - RNA, 22 nt, Human
agccugugacucugugaaacca

SEQ ID NO: 76303 - RNA, 22 nt, Human
agccugugcuguguuugcucca

SEQ ID NO: 76304 - RNA, 22 nt, Human
agcgcaguuaccgcgcggggcu

SEQ ID NO: 76305 - RNA, 22 nt, Human
agcgcucauuuuccuccugcuc

SEQ ID NO: 76306 - RNA, 22 nt, Human
agcgagccugugcacuucuaac

SEQ ID NO: 76307 - RNA, 22 nt, Human
agcuccucagauuuggguggcg

SEQ ID NO: 76308 - RNA, 22 nt, Human
agcuccugcgcacggugcacac

SEQ ID NO: 76309 - RNA, 19 nt, Human
agcucaggcccaucguccc

SEQ ID NO: 76310 - RNA, 22 nt, Human
agcguucuguuccaugcuaaca

SEQ ID NO: 76311 - RNA, 22 nt, Human
agcguaugaauauuugaagaga

SEQ ID NO: 76312 - RNA, 22 nt, Human
agcuaaauauuuuuccugacac

SEQ ID NO: 76313 - RNA, 22 nt, Human
agcucucaccauagugcuuaaa

SEQ ID NO: 76314 - RNA, 22 nt, Human
agcucuguugcggucacaggag

SEQ ID NO: 76315 - RNA, 22 nt, Human
agcucugcuucuugggaagaug

SEQ ID NO: 76316 - RNA, 22 nt, Human
agcugagccagacagguaagca

SEQ ID NO: 76317 - RNA, 22 nt, Human
agcucccaauugacuugaacua

SEQ ID NO: 76318 - RNA, 22 nt, Human
agcucagugugucuaugaggua

SEQ ID NO: 76319 - RNA, 22 nt, Human
agcuccauauggcacaccauuu

SEQ ID NO: 76320 - RNA, 22 nt, Human
agcucugauccuuuaaaggaga

SEQ ID NO: 76321 - RNA, 22 nt, Human
agcucugugcaggcagaggcau

SEQ ID NO: 76322 - RNA, 19 nt, Human
agcuccucaccucucgcgg

SEQ ID NO: 76323 - RNA, 22 nt, Human
agcucuccuacucucuuucuag

SEQ ID NO: 76324 - RNA, 20 nt, Human
agcugaauaguuuugugaaa

SEQ ID NO: 76325 - RNA, 22 nt, Human
agcucuucugacucuaggcuca

SEQ ID NO: 76326 - RNA, 22 nt, Human
agcucuuccuccauucuggcca

SEQ ID NO: 76327 - RNA, 22 nt, Human
agcugcuggcggauguuggacu

SEQ ID NO: 76328 - RNA, 22 nt, Human
agcugaccugauugcuuuucag

SEQ ID NO: 76329 - RNA, 22 nt, Human
agcugcuuuacuggucggcugg

SEQ ID NO: 76330 - RNA, 22 nt, Human
agcuggaaucucggcaaagcgu

SEQ ID NO: 76331 - RNA, 22 nt, Human
agcugcuaagcugcauaacuua

SEQ ID NO: 76332 - RNA, 22 nt, Human
agcugugaccaguuacgaaauu

SEQ ID NO: 76333 - RNA, 22 nt, Human
agcuugaugaaagugggugcuc

SEQ ID NO: 76334 - RNA, 19 nt, Human
agcuuauuuacugcaggac

SEQ ID NO: 76335 - RNA, 22 nt, Human
agcuucuucugccuugucccug

SEQ ID NO: 76336 - RNA, 22 nt, Human
aggaaaauggaccagaguuguu

SEQ ID NO: 76337 - RNA, 20 nt, Human
agcuuucaccaguacuucca

SEQ ID NO: 76338 - RNA, 22 nt, Human
agcuuucuauauaugaguugcu

SEQ ID NO: 76339 - RNA, 22 nt, Human
agcugaugucucaccuguuaga

SEQ ID NO: 76340 - RNA, 19 nt, Human
agcugcugauugguggagg

SEQ ID NO: 76341 - RNA, 22 nt, Human
agcugcugcaaguggugcuaac

SEQ ID NO: 76342 - RNA, 22 nt, Human
agcuguaacagguuaauaugga

SEQ ID NO: 76343 - RNA, 22 nt, Human
aggacuguauacucuaggugaa

SEQ ID NO: 76344 - RNA, 22 nt, Human
aggagaaagaccagccugccga

SEQ ID NO: 76345 - RNA, 22 nt, Human
aggacacuuccugaguggacaa

SEQ ID NO: 76346 - RNA, 19 nt, Human
aggagacuacuucuugcug

SEQ ID NO: 76347 - RNA, 22 nt, Human
aggauagacuucagaaggcaua

SEQ ID NO: 76348 - RNA, 22 nt, Human
aggagaccugguugugugugug

SEQ ID NO: 76349 - RNA, 22 nt, Human
aggagacaguuuggacguguag

SEQ ID NO: 76350 - RNA, 22 nt, Human
aggauaaaggucauuauuccca

SEQ ID NO: 76351 - RNA, 22 nt, Human
aggaaaguugcuuguagugcug

SEQ ID NO: 76352 - RNA, 22 nt, Human
aggaaagacgcauuucuguagg

SEQ ID NO: 76353 - RNA, 23 nt, Human
aggaagucugacacuacagcguu

SEQ ID NO: 76354 - RNA, 20 nt, Human
aggaaggagaaucugagcaa

SEQ ID NO: 76355 - RNA, 22 nt, Human
aggacguaacccaggacagccu

SEQ ID NO: 76356 - RNA, 22 nt, Human
aggacagagggaccagagccca

SEQ ID NO: 76357 - RNA, 22 nt, Human
aggacauuugcuuuuuuucuuu

SEQ ID NO: 76358 - RNA, 22 nt, Human
aggaaauaguuuagucccaaaa

SEQ ID NO: 76359 - RNA, 22 nt, Human
aggaacaguuucaaagagugaa

SEQ ID NO: 76360 - RNA, 22 nt, Human
aggaaaguugagcugucuguag

SEQ ID NO: 76361 - RNA, 22 nt, Human
agcugugaccuucaagagcuac

SEQ ID NO: 76362 - RNA, 22 nt, Human
aggaacaacagccuuuauaucc

SEQ ID NO: 76363 - RNA, 22 nt, Human
agcuguugaccuucccuuucag

SEQ ID NO: 76364 - RNA, 22 nt, Human
agcuuccaaagaccaggauuga

SEQ ID NO: 76365 - RNA, 22 nt, Human
agcuuugcccaaugaguuaugu

SEQ ID NO: 76366 - RNA, 22 nt, Human
agcuugauggauugcugaggca

SEQ ID NO: 76367 - RNA, 22 nt, Human
agcuugaaccuaaaacaauaau

SEQ ID NO: 76368 - RNA, 20 nt, Human
aggaagauccuuucuuuuaa

SEQ ID NO: 76369 - RNA, 22 nt, Human
aggaagagcuggaccagaggac

SEQ ID NO: 76370 - RNA, 22 nt, Human
aggaagaagggacagaauuuug

SEQ ID NO: 76371 - RNA, 22 nt, Human
aggaaaaagaagaaaagaauca

SEQ ID NO: 76372 - RNA, 21 nt, Human
acugccaugcaggagccucca

SEQ ID NO: 76373 - RNA, 22 nt, Human
acugccuugcaccauggcuuuu

SEQ ID NO: 76374 - RNA, 22 nt, Human
acuacccugaccaaguauuuua

SEQ ID NO: 76375 - RNA, 22 nt, Human
acugagaacuuggggacagagg

SEQ ID NO: 76376 - RNA, 22 nt, Human
acuaaguagaggagugaugauu

SEQ ID NO: 76377 - RNA, 22 nt, Human
acuaauuguuuaaggauaggaa

SEQ ID NO: 76378 - RNA, 20 nt, Human
acugcaagagacagaugaaa

SEQ ID NO: 76379 - RNA, 22 nt, Human
acugugauguaaagaaauaggc

SEQ ID NO: 76380 - RNA, 22 nt, Human
acugugauuuguuuuuguguuu

SEQ ID NO: 76381 - RNA, 22 nt, Human
acuggguuguuugucucaugag

SEQ ID NO: 76382 - RNA, 19 nt, Human
acuggggcaggcugggcuu

SEQ ID NO: 76383 - RNA, 22 nt, Human
acuggggauugguucuucaaca

SEQ ID NO: 76384 - RNA, 22 nt, Human
acuggcuuggaaauggguauuu

SEQ ID NO: 76385 - RNA, 22 nt, Human
acuggggcaggaaaguaugcug

SEQ ID NO: 76386 - RNA, 22 nt, Human
acugucaggauugagucucugg

SEQ ID NO: 76387 - RNA, 22 nt, Human
acugucauuaaugaauguaaua

SEQ ID NO: 76388 - RNA, 22 nt, Human
acuuccuuuuuuggggauagca

SEQ ID NO: 76389 - RNA, 22 nt, Human
acuucucuuuucauuaauuuug

SEQ ID NO: 76390 - RNA, 22 nt, Human
acuuacuuucuauucuuguagg

SEQ ID NO: 76391 - RNA, 22 nt, Human
acuguuauugguguauguggca

SEQ ID NO: 76392 - RNA, 22 nt, Human
acuguccucgaaguaccugugc

SEQ ID NO: 76393 - RNA, 22 nt, Human
acugucuuguuguaugugagcu

SEQ ID NO: 76394 - RNA, 22 nt, Human
acuuuuagccuucccacaacag

SEQ ID NO: 76395 - RNA, 19 nt, Human
acuugcuuucauuuaagau

SEQ ID NO: 76396 - RNA, 22 nt, Human
acuugaagcaugaaaauaagcc

SEQ ID NO: 76397 - RNA, 22 nt, Human
acuucuuuugcaugauucuuua

SEQ ID NO: 76398 - RNA, 22 nt, Human
acuuagacaucuuuagugguua

SEQ ID NO: 76399 - RNA, 20 nt, Human
acuuucacaugaacauuuaa

SEQ ID NO: 76400 - RNA, 22 nt, Human
agaaaagaggcuuucuaagcau

SEQ ID NO: 76401 - RNA, 22 nt, Human
acuuuuuugccaucccuccagc

SEQ ID NO: 76402 - RNA, 22 nt, Human
agaaaagagacaauguuuuugg

SEQ ID NO: 76403 - RNA, 22 nt, Human
acuuuuaauaguagauuuuuaa

SEQ ID NO: 76404 - RNA, 22 nt, Human
acuuuuccuggguagcuccugg

SEQ ID NO: 76405 - RNA, 22 nt, Human
acuuugccuucuuacuguguug

SEQ ID NO: 76406 - RNA, 23 nt, Human
acuuugaggagaagaaugucagu

SEQ ID NO: 76407 - RNA, 22 nt, Human
acuuugagaauuuuacuugugu

SEQ ID NO: 76408 - RNA, 22 nt, Human
acuuuugaguuacauaccugaa

SEQ ID NO: 76409 - RNA, 22 nt, Human
acuuuuaaggggccuugauuua

SEQ ID NO: 76410 - RNA, 22 nt, Human
agaagcaaagcaaacacauucu

SEQ ID NO: 76411 - RNA, 22 nt, Human
agaagauucagcaguagggugg

SEQ ID NO: 76412 - RNA, 22 nt, Human
agaaauggggugaagcaaaugg

SEQ ID NO: 76413 - RNA, 22 nt, Human
agaaacacaaguaaagcuccca

SEQ ID NO: 76414 - RNA, 22 nt, Human
agaagcaauuggaaaguacagg

SEQ ID NO: 76415 - RNA, 22 nt, Human
agaagaucccugugguuacgac

SEQ ID NO: 76416 - RNA, 19 nt, Human
agaaacaacauucuggaga

SEQ ID NO: 76417 - RNA, 22 nt, Human
agaaacaagcccuagaaguccu

SEQ ID NO: 76418 - RNA, 20 nt, Human
agaaaggaguaaagaagaga

SEQ ID NO: 76419 - RNA, 22 nt, Human
agaaggcagaaaagcuuuacaa

SEQ ID NO: 76420 - RNA, 22 nt, Human
agaaucucuagaaaugggucuc

SEQ ID NO: 76421 - RNA, 22 nt, Human
agaauccucuagggauggcagg

SEQ ID NO: 76422 - RNA, 22 nt, Human
agaaucaggaagacagccuggc

SEQ ID NO: 76423 - RNA, 22 nt, Human
agaaucagagcagaaucuucau

SEQ ID NO: 76424 - RNA, 22 nt, Human
agaacaggaggaagccagcucc

SEQ ID NO: 76425 - RNA, 20 nt, Human
agaaggagagaugaggcaaa

SEQ ID NO: 76426 - RNA, 22 nt, Human
agaacaagaaacccgaaaagug

SEQ ID NO: 76427 - RNA, 21 nt, Human
agaaugaagaagaggucuuug

SEQ ID NO: 76428 - RNA, 22 nt, Human
agaaugucaagucaagaacaau

SEQ ID NO: 76429 - RNA, 22 nt, Human
agacauauuggcuugcuuuaau

SEQ ID NO: 76430 - RNA, 22 nt, Human
agacagaacauaauuaguacug

SEQ ID NO: 76431 - RNA, 22 nt, Human
agacuguuccgucagacucagu

SEQ ID NO: 76432 - RNA, 22 nt, Human
agacucuggcaugcuaacuagu

SEQ ID NO: 76433 - RNA, 22 nt, Human
agacauuuggugugaagggagg

SEQ ID NO: 76434 - RNA, 22 nt, Human
agaccguguguggguugcggug

SEQ ID NO: 76435 - RNA, 22 nt, Human
agacuguuuucccaucucuugg

SEQ ID NO: 76436 - RNA, 22 nt, Human
agacuucucuaacuugaggacc

SEQ ID NO: 76437 - RNA, 22 nt, Human
agacuucucuuggcuauauuau

SEQ ID NO: 76438 - RNA, 22 nt, Human
agacgggacagacuuuugagug

SEQ ID NO: 76439 - RNA, 22 nt, Human
agagaaacauuaauugaugagg

SEQ ID NO: 76440 - RNA, 22 nt, Human
agacuuuggcagggccaguggu

SEQ ID NO: 76441 - RNA, 22 nt, Human
agagaagaauccccugguggag

SEQ ID NO: 76442 - RNA, 22 nt, Human
agagaauuugggaauauaaauc

SEQ ID NO: 76443 - RNA, 21 nt, Human
agacuucuacuaucuuaugac

SEQ ID NO: 76444 - RNA, 22 nt, Human
agagacauagcacaguuuuucg

SEQ ID NO: 76445 - RNA, 21 nt, Human
agagaccuaagcugagauucc

SEQ ID NO: 76446 - RNA, 22 nt, Human
agagaccugaaugaguugaaca

SEQ ID NO: 76447 - RNA, 22 nt, Human
agagacuguaaugagagguaca

SEQ ID NO: 76448 - RNA, 22 nt, Human
agacuccuucuaagaccucauu

SEQ ID NO: 76449 - RNA, 17 nt, Human
agacucuagccacuagc

SEQ ID NO: 76450 - RNA, 22 nt, Human
agacucuaguggaggugcuagg

SEQ ID NO: 76451 - RNA, 21 nt, Human
agacugaugggaagacucugu

SEQ ID NO: 76452 - RNA, 20 nt, Human
agagaacaguuuggucacag

SEQ ID NO: 76453 - RNA, 22 nt, Human
agagaacauuuucaggguuuca

SEQ ID NO: 76454 - RNA, 22 nt, Human
agagaaccauggcauccaggua

SEQ ID NO: 76455 - RNA, 22 nt, Human
agagagggaugguguccagaga

SEQ ID NO: 76456 - RNA, 22 nt, Human
agagacugauggaucaccaaau

SEQ ID NO: 76457 - RNA, 22 nt, Human
agagacaggguuuugucguguu

SEQ ID NO: 76458 - RNA, 22 nt, Human
agagacaagggaccucuggaga

SEQ ID NO: 76459 - RNA, 22 nt, Human
agagcagcaaucuuugaaauua

SEQ ID NO: 76460 - RNA, 22 nt, Human
agagccuaguauggacucuuag

SEQ ID NO: 76461 - RNA, 22 nt, Human
agagcuagaaggaagcauuucu

SEQ ID NO: 76462 - RNA, 23 nt, Human
agagccuaauaucuaaucuuugu

SEQ ID NO: 76463 - RNA, 19 nt, Human
agagauuuucuguuuuagu

SEQ ID NO: 76464 - RNA, 22 nt, Human
agagauggugaugaggaaaaau

SEQ ID NO: 76465 - RNA, 22 nt, Human
agagaacaggcagcuggugccg

SEQ ID NO: 76466 - RNA, 22 nt, Human
agagauugagcucagaagaccu

SEQ ID NO: 76467 - RNA, 22 nt, Human
agagauuagagaagaugauaaa

SEQ ID NO: 76468 - RNA, 22 nt, Human
agacuugguaacuagugaagaa

SEQ ID NO: 76469 - RNA, 22 nt, Human
agagaaauguacuagucuaacu

SEQ ID NO: 76470 - RNA, 22 nt, Human
agaggaauuauugaguuagauu

SEQ ID NO: 76471 - RNA, 22 nt, Human
agagcuuagaggaccuucgugc

SEQ ID NO: 76472 - RNA, 22 nt, Human
agagcuccaggguuuuguagug

SEQ ID NO: 76473 - RNA, 22 nt, Human
agagcuuuggaguaaguuuuga

SEQ ID NO: 76474 - RNA, 22 nt, Human
agaggagaauguaaauuuguca

SEQ ID NO: 76475 - RNA, 21 nt, Human
agaguaacucagugaaaaaua

SEQ ID NO: 76476 - RNA, 22 nt, Human
agaggcaggcagcagagaagau

SEQ ID NO: 76477 - RNA, 22 nt, Human
agaggcuuuccuaagauugguu

SEQ ID NO: 76478 - RNA, 23 nt, Human
agagggaagagcuuagaugggga

SEQ ID NO: 76479 - RNA, 22 nt, Human
agagggagagaccuccgugccu

SEQ ID NO: 76480 - RNA, 22 nt, Human
agagggagccugcacagcuuuc

SEQ ID NO: 76481 - RNA, 22 nt, Human
agagggagagauuggcaaucag

SEQ ID NO: 76482 - RNA, 22 nt, Human
agaguaauguggaguuugugcu

SEQ ID NO: 76483 - RNA, 22 nt, Human
agagggagcuccaagaucaagg

SEQ ID NO: 76484 - RNA, 22 nt, Human
agaguguggaaauguucagagu

SEQ ID NO: 76485 - RNA, 19 nt, Human
agagucuccacuccacuug

SEQ ID NO: 76486 - RNA, 22 nt, Human
agaguguaauuaguauuuauau

SEQ ID NO: 76487 - RNA, 23 nt, Human
agauaaggaagcauuugagccag

SEQ ID NO: 76488 - RNA, 22 nt, Human
agauaaucacaaucuagacuuu

SEQ ID NO: 76489 - RNA, 22 nt, Human
accauaguuauaacaaaguguu

SEQ ID NO: 76490 - RNA, 21 nt, Human
acccagaauggagccaagccu

SEQ ID NO: 76491 - RNA, 22 nt, Human
accccuauugcuugugauuaug

SEQ ID NO: 76492 - RNA, 22 nt, Human
accuaucugcuggauuuguugu

SEQ ID NO: 76493 - RNA, 22 nt, Human
accucauucugcauagaacuuu

SEQ ID NO: 76494 - RNA, 22 nt, Human
accgauguggaaaauuucauuu

SEQ ID NO: 76495 - RNA, 22 nt, Human
accuccauggcccacaucuagu

SEQ ID NO: 76496 - RNA, 22 nt, Human
accuccauggcucagguuccaa

SEQ ID NO: 76497 - RNA, 22 nt, Human
accucuuucuauggauuuuuug

SEQ ID NO: 76498 - RNA, 22 nt, Human
accucuuuuugaauauagcauu

SEQ ID NO: 76499 - RNA, 22 nt, Human
accucccugaaaaagacagugc

SEQ ID NO: 76500 - RNA, 22 nt, Human
accuggacucugaucacuuuug

SEQ ID NO: 76501 - RNA, 22 nt, Human
acgaggauuuccuuagaugaaa

SEQ ID NO: 76502 - RNA, 22 nt, Human
accuuaagugauuaugacauau

SEQ ID NO: 76503 - RNA, 19 nt, Human
accuguucaaccucgugcu

SEQ ID NO: 76504 - RNA, 22 nt, Human
accuuaaacagauggcggcugg

SEQ ID NO: 76505 - RNA, 20 nt, Human
accuucuuugguagacggaa

SEQ ID NO: 76506 - RNA, 22 nt, Human
accuucugaccucucggacuuc

SEQ ID NO: 76507 - RNA, 22 nt, Human
accuuggauauucuuacucggu

SEQ ID NO: 76508 - RNA, 22 nt, Human
acgauaacaauaguagcaugua

SEQ ID NO: 76509 - RNA, 22 nt, Human
acgggggagucuuuuacaucau

SEQ ID NO: 76510 - RNA, 22 nt, Human
acgucaucguugucaucgucau

SEQ ID NO: 76511 - RNA, 22 nt, Human
acuaaacauaucacugcuuuac

SEQ ID NO: 76512 - RNA, 22 nt, Human
aauucuaaugaguucuuaucua

SEQ ID NO: 76513 - RNA, 22 nt, Human
aauucagguuauauuugcaacu

SEQ ID NO: 76514 - RNA, 22 nt, Human
aauucgcugcauuccaucuagg

SEQ ID NO: 76515 - RNA, 22 nt, Human
aauucugaggccauuuauuucc

SEQ ID NO: 76516 - RNA, 21 nt, Human
aauucccagaaacagcacaag

SEQ ID NO: 76517 - RNA, 22 nt, Human
acaguuagguccuaaaauucug

SEQ ID NO: 76518 - RNA, 22 nt, Human
acaugcacagcaagggugagag

SEQ ID NO: 76519 - RNA, 22 nt, Human
acaugaguuacuuccgauuccc

SEQ ID NO: 76520 - RNA, 22 nt, Human
aauucuuuguuccucugccaag

SEQ ID NO: 76521 - RNA, 22 nt, Human
aauugccaagaauuagugauac

SEQ ID NO: 76522 - RNA, 22 nt, Human
acaugggcaaucgcuuuauuca

SEQ ID NO: 76523 - RNA, 22 nt, Human
acaguuuuccuugguauagaac

SEQ ID NO: 76524 - RNA, 22 nt, Human
acauggacugguccauuaugac

SEQ ID NO: 76525 - RNA, 22 nt, Human
acaucccccuacuuguguccug

SEQ ID NO: 76526 - RNA, 23 nt, Human
acauuacacgcaguaauugcccc

SEQ ID NO: 76527 - RNA, 22 nt, Human
acauucucuuuuagaaagcugu

SEQ ID NO: 76528 - RNA, 22 nt, Human
acaugcuuucuagguccuucug

SEQ ID NO: 76529 - RNA, 22 nt, Human
acauuucuccuacuuguuauuu

SEQ ID NO: 76530 - RNA, 22 nt, Human
acauuuccaaagaugccaguca

SEQ ID NO: 76531 - RNA, 22 nt, Human
acauuguuauuccucaggaguu

SEQ ID NO: 76532 - RNA, 22 nt, Human
acauggcaugaauaauguguac

SEQ ID NO: 76533 - RNA, 22 nt, Human
acauuugauauggaguugugua

SEQ ID NO: 76534 - RNA, 22 nt, Human
acauuuguuucucuagaguagg

SEQ ID NO: 76535 - RNA, 22 nt, Human
acauuuuaaaaacaguaccugg

SEQ ID NO: 76536 - RNA, 22 nt, Human
acauuuuaccaucuguggauga

SEQ ID NO: 76537 - RNA, 22 nt, Human
accaccacauaguaggcacuua

SEQ ID NO: 76538 - RNA, 22 nt, Human
accccuacugaaauuuccuggu

SEQ ID NO: 76539 - RNA, 22 nt, Human
accaguuaaagaauaugaggcc

SEQ ID NO: 76540 - RNA, 22 nt, Human
accaccacugacaccagcucgg

SEQ ID NO: 76541 - RNA, 22 nt, Human
acauuuuguuuauggaaaagau

SEQ ID NO: 76542 - RNA, 22 nt, Human
accauaugaagaucacacuauc

SEQ ID NO: 76543 - RNA, 22 nt, Human
accauccaaaagcuuuucauca

SEQ ID NO: 76544 - RNA, 22 nt, Human
accaauaaaagcaauucacagu

SEQ ID NO: 76545 - RNA, 22 nt, Human
acauuccugaagguaaugagaa

SEQ ID NO: 76546 - RNA, 22 nt, Human
acauuagaugacucuuucuuuc

SEQ ID NO: 76547 - RNA, 22 nt, Human
accaagaguccaagugagguug

SEQ ID NO: 76548 - RNA, 16 nt, Human
acauggcacacaguuu

SEQ ID NO: 76549 - RNA, 22 nt, Human
accaauguucaaccuugacugc

SEQ ID NO: 76550 - RNA, 22 nt, Human
acauguuuacaaaccucaagcc

SEQ ID NO: 76551 - RNA, 22 nt, Human
acauuuuuggguugaugucuga

SEQ ID NO: 76552 - RNA, 22 nt, Human
accaacuuuccaaagugccugg

SEQ ID NO: 76553 - RNA, 22 nt, Human
acauuguuuuugugacuucuau

SEQ ID NO: 76554 - RNA, 22 nt, Human
acauuuugggagaaaguuguua

SEQ ID NO: 76555 - RNA, 22 nt, Human
cauuagugaggggcugccugcu

SEQ ID NO: 76556 - RNA, 22 nt, Human
cauuacaagaaauagcauaaug

SEQ ID NO: 76557 - RNA, 23 nt, Human
cauauucagaaacaccuaguggu

SEQ ID NO: 76558 - RNA, 22 nt, Human
ccagauaaacauuccuuggccu

SEQ ID NO: 76559 - RNA, 22 nt, Human
ccagcagaagcucccgcugggu

SEQ ID NO: 76560 - RNA, 22 nt, Human
ccagcaaguaagucagugucag

SEQ ID NO: 76561 - RNA, 21 nt, Human
ccccuguggagcacauguggc

SEQ ID NO: 76562 - RNA, 23 nt, Human
cccgggaagugcugcuuaucugg

SEQ ID NO: 76563 - RNA, 22 nt, Human
ccccuuuguagcccagcaguug

SEQ ID NO: 76564 - RNA, 22 nt, Human
ccaggacuuauuacaguauaac

SEQ ID NO: 76565 - RNA, 22 nt, Human
cccuaaucuuggaaaugccauu

SEQ ID NO: 76566 - RNA, 22 nt, Human
cccucucaaucuuuaaaauaca

SEQ ID NO: 76567 - RNA, 22 nt, Human
ccagucuuggugucuguagcac

SEQ ID NO: 76568 - RNA, 22 nt, Human
cccuggucucugacuugauccu

SEQ ID NO: 76569 - RNA, 22 nt, Human
ccaguuuuuccagugcuuucug

SEQ ID NO: 76570 - RNA, 19 nt, Human
ccaguuuuuuaauauucaa

SEQ ID NO: 76571 - RNA, 22 nt, Human
cccuucuguaucuucugaguuu

SEQ ID NO: 76572 - RNA, 22 nt, Human
ccauaaaguaggaaacacuaca

SEQ ID NO: 76573 - RNA, 22 nt, Human
cccuugagccuggaggagcucu

SEQ ID NO: 76574 - RNA, 22 nt, Human
ccaugaggcaaagacugauaua

SEQ ID NO: 76575 - RNA, 22 nt, Human
ccaucuuugcucuuuuauugca

SEQ ID NO: 76576 - RNA, 22 nt, Human
ccgauuuaugucucugacuuga

SEQ ID NO: 76577 - RNA, 22 nt, Human
ccaugggugucuggagcacccu

SEQ ID NO: 76578 - RNA, 22 nt, Human
ccgggcuuccuuagagcaagau

SEQ ID NO: 76579 - RNA, 19 nt, Human
ccggucaugcauuccuuug

SEQ ID NO: 76580 - RNA, 22 nt, Human
ccggaggaaauugcauugguug

SEQ ID NO: 76581 - RNA, 22 nt, Human
cccagaaugauucagcgacagu

SEQ ID NO: 76582 - RNA, 22 nt, Human
ccuaggcuggcugucuucaggu

SEQ ID NO: 76583 - RNA, 20 nt, Human
ccucaaccuccuuucucucc

SEQ ID NO: 76584 - RNA, 22 nt, Human
ccucaggaauuuauucuucugu

SEQ ID NO: 76585 - RNA, 22 nt, Human
ccucacuucuuucucuucacuu

SEQ ID NO: 76586 - RNA, 22 nt, Human
ccuauauaaaugacauauagga

SEQ ID NO: 76587 - RNA, 22 nt, Human
ccuauuuucaaaauuguuuauc

SEQ ID NO: 76588 - RNA, 22 nt, Human
ccuaauuuuagacccacuccua

SEQ ID NO: 76589 - RNA, 22 nt, Human
cccauuaguuguuaaucaucaa

SEQ ID NO: 76590 - RNA, 22 nt, Human
cccauggacuagcuaugagcag

SEQ ID NO: 76591 - RNA, 22 nt, Human
ccccuauaugccugcagugauu

SEQ ID NO: 76592 - RNA, 22 nt, Human
ccgugccuuuaguuucuucugu

SEQ ID NO: 76593 - RNA, 19 nt, Human
cccgauggagacuuagcag

SEQ ID NO: 76594 - RNA, 22 nt, Human
ccucccuucccggcauggcucu

SEQ ID NO: 76595 - RNA, 22 nt, Human
ccucauagccuuuccuacuuua

SEQ ID NO: 76596 - RNA, 22 nt, Human
ccuccccugccugugcuguugg

SEQ ID NO: 76597 - RNA, 19 nt, Human
ccuccgcauccucaucugu

SEQ ID NO: 76598 - RNA, 22 nt, Human
ccuccuuuccuguuuuccugag

SEQ ID NO: 76599 - RNA, 22 nt, Human
ccuccugggccuugcucuguga

SEQ ID NO: 76600 - RNA, 22 nt, Human
cccuccuuggccccagacccgc

SEQ ID NO: 76601 - RNA, 22 nt, Human
ccucuccucugugcagacugcc

SEQ ID NO: 76602 - RNA, 22 nt, Human
ccugaagaugguugauccccuu

SEQ ID NO: 76603 - RNA, 22 nt, Human
ccucuuuugaaccaguucuuca

SEQ ID NO: 76604 - RNA, 22 nt, Human
cccugauaaaucagcaccucag

SEQ ID NO: 76605 - RNA, 22 nt, Human
ccugcacuaccuggggcugcug

SEQ ID NO: 76606 - RNA, 22 nt, Human
ccugaguucuuauuuccaguca

SEQ ID NO: 76607 - RNA, 21 nt, Human
ccugcacuucccuccucaagu

SEQ ID NO: 76608 - RNA, 22 nt, Human
ccugcaguuuuuccaugauaca

SEQ ID NO: 76609 - RNA, 22 nt, Human
ccugcccaucccaccccagcau

SEQ ID NO: 76610 - RNA, 19 nt, Human
ccugcugaagugaugcagc

SEQ ID NO: 76611 - RNA, 22 nt, Human
ccugcaguagagguugguaggg

SEQ ID NO: 76612 - RNA, 22 nt, Human
ccucacaaagaaugucuagaca

SEQ ID NO: 76613 - RNA, 22 nt, Human
ccucuagaauuaucacuuuuaa

SEQ ID NO: 76614 - RNA, 22 nt, Human
ccucucacucccucauggguuc

SEQ ID NO: 76615 - RNA, 22 nt, Human
cgaccccugaaaauggcagcca

SEQ ID NO: 76616 - RNA, 22 nt, Human
ccucuaugcccuucuggggguc

SEQ ID NO: 76617 - RNA, 22 nt, Human
ccucaguguguggauguuagag

SEQ ID NO: 76618 - RNA, 22 nt, Human
ccugauauggugucauuuaaac

SEQ ID NO: 76619 - RNA, 22 nt, Human
cgcucugccugcccuaacuucc

SEQ ID NO: 76620 - RNA, 22 nt, Human
ccugaaaugaguucugcucacu

SEQ ID NO: 76621 - RNA, 22 nt, Human
ccucuuugcccucuuuccuucc

SEQ ID NO: 76622 - RNA, 22 nt, Human
ccugaauuuaucugaauggugg

SEQ ID NO: 76623 - RNA, 22 nt, Human
ccugcucuaauucauucaugcu

SEQ ID NO: 76624 - RNA, 22 nt, Human
ccugcuggagucuaguuggucu

SEQ ID NO: 76625 - RNA, 22 nt, Human
ccuguguucguccucaccuugc

SEQ ID NO: 76626 - RNA, 22 nt, Human
cggggcuggcguuagggaggca

SEQ ID NO: 76627 - RNA, 22 nt, Human
ccuuaauaguguucuaauguuu

SEQ ID NO: 76628 - RNA, 22 nt, Human
ccuuagcuggguaacuuugggc

SEQ ID NO: 76629 - RNA, 22 nt, Human
ccuuccaguucuugguuguaau

SEQ ID NO: 76630 - RNA, 19 nt, Human
cgguaugaauguacuaugg

SEQ ID NO: 76631 - RNA, 23 nt, Human
ccuggcugaccugaagguguagu

SEQ ID NO: 76632 - RNA, 22 nt, Human
ccuuuuaucgcgaagaacucca

SEQ ID NO: 76633 - RNA, 22 nt, Human
cgacaagagaaaugcuuuguuu

SEQ ID NO: 76634 - RNA, 22 nt, Human
cgacagauuauuuugugacugc

SEQ ID NO: 76635 - RNA, 18 nt, Human
cuaagaggucguuucuca

SEQ ID NO: 76636 - RNA, 22 nt, Human
cuaagaaggaggaaaagugcca

SEQ ID NO: 76637 - RNA, 22 nt, Human
cgagaccaggcuuuuuuuagga

SEQ ID NO: 76638 - RNA, 22 nt, Human
cuauauucuggaauguccauuu

SEQ ID NO: 76639 - RNA, 22 nt, Human
cuauaucuguggauaguguaug

SEQ ID NO: 76640 - RNA, 22 nt, Human
cuauguuuugcuagugaugggu

SEQ ID NO: 76641 - RNA, 22 nt, Human
cuaugguaguggcacaggagga

SEQ ID NO: 76642 - RNA, 22 nt, Human
cucacugucagcugcagggcuu

SEQ ID NO: 76643 - RNA, 22 nt, Human
cuauuauuauugucguuuuaca

SEQ ID NO: 76644 - RNA, 22 nt, Human
cuauuuucccauaugguugaca

SEQ ID NO: 76645 - RNA, 19 nt, Human
cgcugcucccgcuguggcu

SEQ ID NO: 76646 - RNA, 22 nt, Human
cucagaauugucaccucaaaaa

SEQ ID NO: 76647 - RNA, 22 nt, Human
cucaugcugcaaauggcuguuu

SEQ ID NO: 76648 - RNA, 22 nt, Human
cggagcauacugccuggagaug

SEQ ID NO: 76649 - RNA, 22 nt, Human
cuccccucccuuuaacccccuu

SEQ ID NO: 76650 - RNA, 22 nt, Human
cuccccauuuucaugggcaggu

SEQ ID NO: 76651 - RNA, 22 nt, Human
cuccaucccccugugugucaau

SEQ ID NO: 76652 - RNA, 22 nt, Human
cuccaugagccaggagggcuac

SEQ ID NO: 76653 - RNA, 22 nt, Human
cuccuuuuccuacucauacuau

SEQ ID NO: 76654 - RNA, 22 nt, Human
cuccuugagaaugaacaaagga

SEQ ID NO: 76655 - RNA, 21 nt, Human
cuccuguaaaucaccuccgca

SEQ ID NO: 76656 - RNA, 22 nt, Human
cucuauuuuuucaucuuucagg

SEQ ID NO: 76657 - RNA, 22 nt, Human
cucuauucuaauggauucuggg

SEQ ID NO: 76658 - RNA, 22 nt, Human
cucguccugguuuaaguguccu

SEQ ID NO: 76659 - RNA, 22 nt, Human
cucuccaguuauagcugauuug

SEQ ID NO: 76660 - RNA, 22 nt, Human
cucuguggucugaagccuguga

SEQ ID NO: 76661 - RNA, 22 nt, Human
cucugugggcauauuuguaaaa

SEQ ID NO: 76662 - RNA, 22 nt, Human
cucuguugucaguggaagcagc

SEQ ID NO: 76663 - RNA, 22 nt, Human
cucugugucugauucugggaag

SEQ ID NO: 76664 - RNA, 22 nt, Human
cucuuagucugcuuuuuuucca

SEQ ID NO: 76665 - RNA, 22 nt, Human
cucuuauaaagaugucucuguu

SEQ ID NO: 76666 - RNA, 22 nt, Human
cucuucauguuggugcagaagc

SEQ ID NO: 76667 - RNA, 22 nt, Human
cucugucuggggaggggagagg

SEQ ID NO: 76668 - RNA, 22 nt, Human
cucuucugugggugcuauguca

SEQ ID NO: 76669 - RNA, 22 nt, Human
cucuuucauucuguccuuguuu

SEQ ID NO: 76670 - RNA, 22 nt, Human
cucuuuguauucuagaagcucu

SEQ ID NO: 76671 - RNA, 22 nt, Human
cucuuucauucuuagguugccg

SEQ ID NO: 76672 - RNA, 22 nt, Human
cucuuuucaaaccuguuuaugg

SEQ ID NO: 76673 - RNA, 22 nt, Human
cugaaagacagccaggcaaagc

SEQ ID NO: 76674 - RNA, 22 nt, Human
cggcuucucgggucggauuccg

SEQ ID NO: 76675 - RNA, 22 nt, Human
cgggagagacagaggaggcgcc

SEQ ID NO: 76676 - RNA, 22 nt, Human
cugaaagcaaaguaauucuuaa

SEQ ID NO: 76677 - RNA, 22 nt, Human
cugaacuaagcccaaagacacu

SEQ ID NO: 76678 - RNA, 22 nt, Human
cugaagaaagaaaauggccauc

SEQ ID NO: 76679 - RNA, 22 nt, Human
cugacagaucuggaucugaacu

SEQ ID NO: 76680 - RNA, 22 nt, Human
cugaauucuuguugucggagca

SEQ ID NO: 76681 - RNA, 22 nt, Human
cugaagcugggcacuuccuuuu

SEQ ID NO: 76682 - RNA, 22 nt, Human
cuccuuaaagggagcagcagcu

SEQ ID NO: 76683 - RNA, 22 nt, Human
cuggauuaaacaguuugauacu

SEQ ID NO: 76684 - RNA, 21 nt, Human
cuuuggcaagggagaagucac

SEQ ID NO: 76685 - RNA, 22 nt, Human
cuuugugcagcagaaaugugug

SEQ ID NO: 76686 - RNA, 22 nt, Human
cuguggaguccuggggaaugga

SEQ ID NO: 76687 - RNA, 22 nt, Human
gaaaggagacugcacuggagcc

SEQ ID NO: 76688 - RNA, 22 nt, Human
gaaaugucaagauauguuugga

SEQ ID NO: 76689 - RNA, 22 nt, Human
gaaagugaauguaacauguuau

SEQ ID NO: 76690 - RNA, 22 nt, Human
cuguuccuccaccucaacaaac

SEQ ID NO: 76691 - RNA, 22 nt, Human
cuguucuccacuccugacuucu

SEQ ID NO: 76692 - RNA, 20 nt, Human
cuguucucuugccacaugag

SEQ ID NO: 76693 - RNA, 22 nt, Human
cuguucagugcauauguauuga

SEQ ID NO: 76694 - RNA, 22 nt, Human
gaacaaaagauagcccaaacau

SEQ ID NO: 76695 - RNA, 22 nt, Human
cuguuucucugccugcacacau

SEQ ID NO: 76696 - RNA, 22 nt, Human
cuguuuggaugccauggucaag

SEQ ID NO: 76697 - RNA, 22 nt, Human
cuguuuuugccugugacaaaaa

SEQ ID NO: 76698 - RNA, 22 nt, Human
cuuauaucaacuggaaaaauua

SEQ ID NO: 76699 - RNA, 22 nt, Human
cuuaagacaggcucaaagauua

SEQ ID NO: 76700 - RNA, 23 nt, Human
cuuauauaaucauuagaaaccau

SEQ ID NO: 76701 - RNA, 22 nt, Human
cuucagagugacucagcaucuu

SEQ ID NO: 76702 - RNA, 22 nt, Human
gaagccaugauaaccagugugg

SEQ ID NO: 76703 - RNA, 22 nt, Human
cuucuuagugauuuaacaugua

SEQ ID NO: 76704 - RNA, 22 nt, Human
cuucuucaucuuuuggaggaac

SEQ ID NO: 76705 - RNA, 22 nt, Human
cuucuguggaauagguuugaca

SEQ ID NO: 76706 - RNA, 22 nt, Human
cuucuggaggcugcagaaaaga

SEQ ID NO: 76707 - RNA, 22 nt, Human
cuucuggaggcucuagaggaga

SEQ ID NO: 76708 - RNA, 22 nt, Human
cuucccuacuucagugcucccu

SEQ ID NO: 76709 - RNA, 22 nt, Human
cuucccuaagggacuggcauag

SEQ ID NO: 76710 - RNA, 22 nt, Human
cuucccaucaagcuggaggaug

SEQ ID NO: 76711 - RNA, 22 nt, Human
cuuccagugcauagguagauca

SEQ ID NO: 76712 - RNA, 22 nt, Human
cuucauuucaggcugaagaaua

SEQ ID NO: 76713 - RNA, 22 nt, Human
gaaggaaaagacgugcuaagua

SEQ ID NO: 76714 - RNA, 22 nt, Human
gaagcuucucaacugguggaau

SEQ ID NO: 76715 - RNA, 22 nt, Human
gaagcucaguugcuuagaucuc

SEQ ID NO: 76716 - RNA, 22 nt, Human
cuucaggaccugaagcccaucu

SEQ ID NO: 76717 - RNA, 20 nt, Human
gaaucuggucaaaugucuau

SEQ ID NO: 76718 - RNA, 22 nt, Human
cuugcucugggaauaugaguuu

SEQ ID NO: 76719 - RNA, 22 nt, Human
cuugccuuugaaagcauuucuc

SEQ ID NO: 76720 - RNA, 22 nt, Human
gaauacaaauaauaccaaggug

SEQ ID NO: 76721 - RNA, 22 nt, Human
cuucuuuucuacuggccuagaa

SEQ ID NO: 76722 - RNA, 22 nt, Human
cuucuuucuuuucuucuucucu

SEQ ID NO: 76723 - RNA, 22 nt, Human
cuucuugggaggggcggagcuc

SEQ ID NO: 76724 - RNA, 22 nt, Human
cuucuucuagaagauggggaag

SEQ ID NO: 76725 - RNA, 22 nt, Human
gaaugcacacgugugugcaugc

SEQ ID NO: 76726 - RNA, 22 nt, Human
cuuggcacauuuuguucuucug

SEQ ID NO: 76727 - RNA, 22 nt, Human
cuuggagauacagaggacauuu

SEQ ID NO: 76728 - RNA, 22 nt, Human
cuugcuuuaucugguuucucau

SEQ ID NO: 76729 - RNA, 20 nt, Human
gaauucugaagauaauuugg

SEQ ID NO: 76730 - RNA, 22 nt, Human
gaauccccugucggaacagugg

SEQ ID NO: 76731 - RNA, 22 nt, Human
gaauggagaacccuggacacug

SEQ ID NO: 76732 - RNA, 22 nt, Human
cuuguuuuaaacuguuguggcu

SEQ ID NO: 76733 - RNA, 19 nt, Human
gaauugcacgagcagaggc

SEQ ID NO: 76734 - RNA, 22 nt, Human
gacauuuauuggauuuuacgag

SEQ ID NO: 76735 - RNA, 22 nt, Human
cuuuucuuuucuucucuuccca

SEQ ID NO: 76736 - RNA, 22 nt, Human
cuuuuccuccaggaagccaagc

SEQ ID NO: 76737 - RNA, 22 nt, Human
cuuuucaaacaggacagguccu

SEQ ID NO: 76738 - RNA, 19 nt, Human
cuuugugguuuucagaacu

SEQ ID NO: 76739 - RNA, 22 nt, Human
gacucuucucucccaaaugccc

SEQ ID NO: 76740 - RNA, 22 nt, Human
gaaaagaaggcaggagcccaag

SEQ ID NO: 76741 - RNA, 22 nt, Human
gacuucuuaaagaggugaggaa

SEQ ID NO: 76742 - RNA, 22 nt, Human
gaaaaagucuuaaaguaaggca

SEQ ID NO: 76743 - RNA, 20 nt, Human
gacuucaauuucuaucuuuu

SEQ ID NO: 76744 - RNA, 22 nt, Human
gacuggucuuuugugauggaug

SEQ ID NO: 76745 - RNA, 22 nt, Human
gacuccugccucucuacuucug

SEQ ID NO: 76746 - RNA, 22 nt, Human
gaaagcuuggaaacgacuuuau

SEQ ID NO: 76747 - RNA, 22 nt, Human
gaaacguuguggaaaauccucu

SEQ ID NO: 76748 - RNA, 22 nt, Human
gaaaccauggcaaccagguccu

SEQ ID NO: 76749 - RNA, 20 nt, Human
gagaaugucauuccuuuuuu

SEQ ID NO: 76750 - RNA, 22 nt, Human
gagaagguggaccugaaggagc

SEQ ID NO: 76751 - RNA, 22 nt, Human
gaaauuucuuuguuaucuuggu

SEQ ID NO: 76752 - RNA, 22 nt, Human
gaaauaggcccuuacauggaaa

SEQ ID NO: 76753 - RNA, 22 nt, Human
gaaauagagacaguaagugucu

SEQ ID NO: 76754 - RNA, 22 nt, Human
gagauuuccauauuuuguaaca

SEQ ID NO: 76755 - RNA, 22 nt, Human
gagauuguggcagcagcuguuu

SEQ ID NO: 76756 - RNA, 22 nt, Human
gagaucuguguuugcugaagcu

SEQ ID NO: 76757 - RNA, 22 nt, Human
gaacauauuuagcaccuaauau

SEQ ID NO: 76758 - RNA, 22 nt, Human
gaacaguuucccuguagaaaau

SEQ ID NO: 76759 - RNA, 22 nt, Human
gagcacugagcuggaauuggag

SEQ ID NO: 76760 - RNA, 22 nt, Human
gagcaacacauugaaugaggau

SEQ ID NO: 76761 - RNA, 22 nt, Human
gagcagcacagaccaaacagaa

SEQ ID NO: 76762 - RNA, 22 nt, Human
gagcagcaggccagguugcagg

SEQ ID NO: 76763 - RNA, 22 nt, Human
gaacauuucugcagaugucuga

SEQ ID NO: 76764 - RNA, 22 nt, Human
gaacugaauguguaauguuggc

SEQ ID NO: 76765 - RNA, 22 nt, Human
gagcagcucgagaaggaagcag

SEQ ID NO: 76766 - RNA, 22 nt, Human
gaacucuugguggucauuagau

SEQ ID NO: 76767 - RNA, 22 nt, Human
gaacuugagugugcuauuucuu

SEQ ID NO: 76768 - RNA, 22 nt, Human
gaagaagagauaauggggagca

SEQ ID NO: 76769 - RNA, 22 nt, Human
gagcagcugagcuggaaugaga

SEQ ID NO: 76770 - RNA, 22 nt, Human
gaagaggaagaggagccagagc

SEQ ID NO: 76771 - RNA, 22 nt, Human
gaacuuaauauacaaucaguuc

SEQ ID NO: 76772 - RNA, 22 nt, Human
gagcagguuauuagaaauggaa

SEQ ID NO: 76773 - RNA, 22 nt, Human
cuucauguucaugcuaacauuu

SEQ ID NO: 76774 - RNA, 22 nt, Human
cugaucccuuuucauuugcagg

SEQ ID NO: 76775 - RNA, 20 nt, Human
cugauagauucuuccccaga

SEQ ID NO: 76776 - RNA, 22 nt, Human
cuucaguuaguuucaugugagc

SEQ ID NO: 76777 - RNA, 22 nt, Human
cuuccuaaucuuggguuauuuu

SEQ ID NO: 76778 - RNA, 22 nt, Human
cuuccguuacugacaaaauguu

SEQ ID NO: 76779 - RNA, 22 nt, Human
cugcaguaacuauuuucaauaa

SEQ ID NO: 76780 - RNA, 22 nt, Human
cuucucugcugccugccucuuu

SEQ ID NO: 76781 - RNA, 22 nt, Human
cuucucuuggguguggugucuu

SEQ ID NO: 76782 - RNA, 21 nt, Human
cuucgcuguuccagcucuugg

SEQ ID NO: 76783 - RNA, 22 nt, Human
cuucuaauucuuauguaagcuu

SEQ ID NO: 76784 - RNA, 22 nt, Human
cuucucuugugauguuagcgga

SEQ ID NO: 76785 - RNA, 22 nt, Human
cuucucuuugacaguugggugu

SEQ ID NO: 76786 - RNA, 22 nt, Human
cuucugaugugugcucuuaguu

SEQ ID NO: 76787 - RNA, 22 nt, Human
cuucuuaaaguugucacagcug

SEQ ID NO: 76788 - RNA, 22 nt, Human
cuucuguggcugagaaggcagc

SEQ ID NO: 76789 - RNA, 22 nt, Human
cuugagcugaguuugcagcucu

SEQ ID NO: 76790 - RNA, 22 nt, Human
cuucuuugacucacugguacgc

SEQ ID NO: 76791 - RNA, 22 nt, Human
cuucuugucagugauuucuucc

SEQ ID NO: 76792 - RNA, 22 nt, Human
cuucuuuccauguguuuugguu

SEQ ID NO: 76793 - RNA, 22 nt, Human
cugcccgcaugcaggaaugcug

SEQ ID NO: 76794 - RNA, 22 nt, Human
cuugccaguguugcagaagcuc

SEQ ID NO: 76795 - RNA, 20 nt, Human
cuugaguucagagcugucau

SEQ ID NO: 76796 - RNA, 22 nt, Human
cuuguuaaaagugacccuaaug

SEQ ID NO: 76797 - RNA, 19 nt, Human
cuuguggcuaugcagauac

SEQ ID NO: 76798 - RNA, 22 nt, Human
cugcuuguguugcucagaguca

SEQ ID NO: 76799 - RNA, 23 nt, Human
cuggacauucgcaaaguucaucu

SEQ ID NO: 76800 - RNA, 22 nt, Human
cuggaauugcuugagcuaggaa

SEQ ID NO: 76801 - RNA, 22 nt, Human
cuuguuaacaauugguaucuuu

SEQ ID NO: 76802 - RNA, 20 nt, Human
cuuguuaaauaugcagguag

SEQ ID NO: 76803 - RNA, 22 nt, Human
cuuguuuggccauaggugcugg

SEQ ID NO: 76804 - RNA, 22 nt, Human
cuuuauguuggggugucuuagu

SEQ ID NO: 76805 - RNA, 22 nt, Human
cuuuaguaaaacguauuuagga

SEQ ID NO: 76806 - RNA, 22 nt, Human
cuuuaagugaaaggggauuaaa

SEQ ID NO: 76807 - RNA, 18 nt, Human
cuuuagcugucaucuuug

SEQ ID NO: 76808 - RNA, 22 nt, Human
cuuuacauuaauuucuacugau

SEQ ID NO: 76809 - RNA, 22 nt, Human
cuuuaaaaauguauuuuugugg

SEQ ID NO: 76810 - RNA, 22 nt, Human
cuggagaucaguuggacaacag

SEQ ID NO: 76811 - RNA, 22 nt, Human
cuggagaagagguaguauguag

SEQ ID NO: 76812 - RNA, 22 nt, Human
cuuucucucaaacacacauaca

SEQ ID NO: 76813 - RNA, 22 nt, Human
cuuuagugaguguggagcuaga

SEQ ID NO: 76814 - RNA, 22 nt, Human
cuuuccugaaaucucuucugca

SEQ ID NO: 76815 - RNA, 18 nt, Human
cuuucugcccccauuagc

SEQ ID NO: 76816 - RNA, 22 nt, Human
cuuucuuucaaguucugcuuua

SEQ ID NO: 76817 - RNA, 22 nt, Human
cuuugauuucucugguccaauc

SEQ ID NO: 76818 - RNA, 22 nt, Human
cugcugugcagacagacucucu

SEQ ID NO: 76819 - RNA, 22 nt, Human
cugcugucuuuauuucacugcu

SEQ ID NO: 76820 - RNA, 22 nt, Human
cugcugcuugauugcaggaagu

SEQ ID NO: 76821 - RNA, 22 nt, Human
cuugucuaguuccuggugaugu

SEQ ID NO: 76822 - RNA, 21 nt, Human
cuuggagacucuuggccacau

SEQ ID NO: 76823 - RNA, 22 nt, Human
cuuggcaaaguggcaaaauuag

SEQ ID NO: 76824 - RNA, 22 nt, Human
cugcucuucccaucccuuaaau

SEQ ID NO: 76825 - RNA, 22 nt, Human
cuuggcauguucaucugcuugg

SEQ ID NO: 76826 - RNA, 22 nt, Human
cugcgcagaucugcuguucucu

SEQ ID NO: 76827 - RNA, 22 nt, Human
cugcuauaacacuaacaucuaa

SEQ ID NO: 76828 - RNA, 22 nt, Human
cucugcuagaaggucaaucucu

SEQ ID NO: 76829 - RNA, 22 nt, Human
cucugauuuuucuaauacuuca

SEQ ID NO: 76830 - RNA, 22 nt, Human
cucucugcugucuuucgggaaa

SEQ ID NO: 76831 - RNA, 22 nt, Human
cucucuaacuagagacaggagu

SEQ ID NO: 76832 - RNA, 22 nt, Human
cucucuccuuuuugauauuuag

SEQ ID NO: 76833 - RNA, 22 nt, Human
cuguagaugucagguuaaugag

SEQ ID NO: 76834 - RNA, 22 nt, Human
cucugguuucgcaggaaauaga

SEQ ID NO: 76835 - RNA, 22 nt, Human
cucuguauauugagugcuuacu

SEQ ID NO: 76836 - RNA, 22 nt, Human
cugucucugucucuguuuaucc

SEQ ID NO: 76837 - RNA, 22 nt, Human
cuguggaaugcaguugcgagca

SEQ ID NO: 76838 - RNA, 22 nt, Human
cuguggcugcgcccugggggag

SEQ ID NO: 76839 - RNA, 22 nt, Human
cucuuuuuccuaugaaaucuau

SEQ ID NO: 76840 - RNA, 22 nt, Human
cugacugaggaucaguucauca

SEQ ID NO: 76841 - RNA, 22 nt, Human
cucuugugucaccauggauaaa

SEQ ID NO: 76842 - RNA, 22 nt, Human
cuucacuccuggagugaguuuc

SEQ ID NO: 76843 - RNA, 22 nt, Human
cugaaucugccuccgaggguuu

SEQ ID NO: 76844 - RNA, 22 nt, Human
cugaaggacacgugaggagcca

SEQ ID NO: 76845 - RNA, 22 nt, Human
cuccaguugugucuuguaagaa

SEQ ID NO: 76846 - RNA, 22 nt, Human
cuccaggacugaggacagagcu

SEQ ID NO: 76847 - RNA, 22 nt, Human
cuccccuuauuccucaacauga

SEQ ID NO: 76848 - RNA, 22 nt, Human
cucccaucacaauucagggccu

SEQ ID NO: 76849 - RNA, 21 nt, Human
cugggaacccgaccaaggccu

SEQ ID NO: 76850 - RNA, 22 nt, Human
cuggcuuucauggcgcaguuga

SEQ ID NO: 76851 - RNA, 22 nt, Human
cuccuauugaucaguacuauuu

SEQ ID NO: 76852 - RNA, 22 nt, Human
cuccuuugagcaaaucuuugau

SEQ ID NO: 76853 - RNA, 22 nt, Human
cuccuuuacaauugugggaaaa

SEQ ID NO: 76854 - RNA, 22 nt, Human
cuccuugguuccggcguuggag

SEQ ID NO: 76855 - RNA, 22 nt, Human
cuccuagagcacaaaaggccau

SEQ ID NO: 76856 - RNA, 22 nt, Human
cugggagaggaaccucgagggu

SEQ ID NO: 76857 - RNA, 22 nt, Human
cuccuuuuugggaccgugcagc

SEQ ID NO: 76858 - RNA, 22 nt, Human
cugggggacagagagaggcggu

SEQ ID NO: 76859 - RNA, 22 nt, Human
cucuaagcuuugguguuucacu

SEQ ID NO: 76860 - RNA, 22 nt, Human
cucuccagucauauucucaguc

SEQ ID NO: 76861 - RNA, 22 nt, Human
cucucacucccuccuucccucu

SEQ ID NO: 76862 - RNA, 22 nt, Human
cucuaaauguggucugcagaua

SEQ ID NO: 76863 - RNA, 22 nt, Human
cuccuuuuuuuaaagauggauu

SEQ ID NO: 76864 - RNA, 22 nt, Human
cucauguucuaagcuuucuuca

SEQ ID NO: 76865 - RNA, 22 nt, Human
cuggcagcucugagucccuucu

SEQ ID NO: 76866 - RNA, 22 nt, Human
cuggauagaccccuuauugcau

SEQ ID NO: 76867 - RNA, 22 nt, Human
cuggaaaaauggauccugucuu

SEQ ID NO: 76868 - RNA, 22 nt, Human
cugagaaauacccaagucuggu

SEQ ID NO: 76869 - RNA, 22 nt, Human
cuggaagcgucggaggaagggc

SEQ ID NO: 76870 - RNA, 22 nt, Human
cuggaaauggcagaguugcauu

SEQ ID NO: 76871 - RNA, 22 nt, Human
cucaauuguuuggucucugguu

SEQ ID NO: 76872 - RNA, 22 nt, Human
cuggagaacucugugcuucacu

SEQ ID NO: 76873 - RNA, 22 nt, Human
cuggagaacagagcuguuuaga

SEQ ID NO: 76874 - RNA, 22 nt, Human
cagagccagcuguccuuggcau

SEQ ID NO: 76875 - RNA, 22 nt, Human
cagagaugaggcuggcgugguu

SEQ ID NO: 76876 - RNA, 20 nt, Human
cagagccaggguuuuguuuu

SEQ ID NO: 76877 - RNA, 22 nt, Human
caauugcuuccuucuguaagua

SEQ ID NO: 76878 - RNA, 22 nt, Human
cagaucacucugggcggcggga

SEQ ID NO: 76879 - RNA, 22 nt, Human
cagaugccauagguauaguaua

SEQ ID NO: 76880 - RNA, 22 nt, Human
cagauuuaauaaaaaaugcauc

SEQ ID NO: 76881 - RNA, 22 nt, Human
cagaaaaaaaugcagacuagca

SEQ ID NO: 76882 - RNA, 22 nt, Human
cacuuuuucccccuggugucau

SEQ ID NO: 76883 - RNA, 22 nt, Human
cagauaagcuauaaguaguacc

SEQ ID NO: 76884 - RNA, 22 nt, Human
cagaaacacuguauuuagggaa

SEQ ID NO: 76885 - RNA, 22 nt, Human
cagaaaacauuguguguauaag

SEQ ID NO: 76886 - RNA, 22 nt, Human
cagaggcugagcugcgggauga

SEQ ID NO: 76887 - RNA, 22 nt, Human
cagaggaugucuacaccuugag

SEQ ID NO: 76888 - RNA, 22 nt, Human
cagaguccuguaguauugcugg

SEQ ID NO: 76889 - RNA, 22 nt, Human
cagauacaacagcaggaaugaa

SEQ ID NO: 76890 - RNA, 22 nt, Human
cagcucugcugggaggaugcag

SEQ ID NO: 76891 - RNA, 22 nt, Human
cagcucgaauaauggagaacug

SEQ ID NO: 76892 - RNA, 22 nt, Human
cagcugcugguguaucgggucc

SEQ ID NO: 76893 - RNA, 22 nt, Human
cagcugcgcagcgccgggccug

SEQ ID NO: 76894 - RNA, 22 nt, Human
cagcucuccacccuccugguuc

SEQ ID NO: 76895 - RNA, 22 nt, Human
cagauguuugaaugcuuaccac

SEQ ID NO: 76896 - RNA, 20 nt, Human
cagaucuuauguuuuucugu

SEQ ID NO: 76897 - RNA, 22 nt, Human
cagauuuagcacugauaggacu

SEQ ID NO: 76898 - RNA, 19 nt, Human
cagcaaacacuguaaaugg

SEQ ID NO: 76899 - RNA, 21 nt, Human
cagcagaaaugagaggagaaa

SEQ ID NO: 76900 - RNA, 22 nt, Human
cagcagaugacuauuggagcug

SEQ ID NO: 76901 - RNA, 22 nt, Human
cagcuuaccucccacagcucuc

SEQ ID NO: 76902 - RNA, 22 nt, Human
cagcuguacgugaucuacaugg

SEQ ID NO: 76903 - RNA, 22 nt, Human
cagcuucaaaggcccugauggu

SEQ ID NO: 76904 - RNA, 22 nt, Human
cagcuuguucugaccugugauu

SEQ ID NO: 76905 - RNA, 22 nt, Human
cagcuuuugcagacuucuugcc

SEQ ID NO: 76906 - RNA, 22 nt, Human
caggagagucucugucuguacu

SEQ ID NO: 76907 - RNA, 22 nt, Human
cagcucuggcuauugaggacca

SEQ ID NO: 76908 - RNA, 22 nt, Human
cagcuauuguucuguauaauga

SEQ ID NO: 76909 - RNA, 22 nt, Human
caggaagucugaauucugagag

SEQ ID NO: 76910 - RNA, 22 nt, Human
cagggguaccuggguuaccugu

SEQ ID NO: 76911 - RNA, 22 nt, Human
caucuaaaauaagccuuauaau

SEQ ID NO: 76912 - RNA, 22 nt, Human
cagugcaacguugugcauucaa

SEQ ID NO: 76913 - RNA, 22 nt, Human
caugagaguaaccuagagaaga

SEQ ID NO: 76914 - RNA, 22 nt, Human
caucuccaagucuguaagcagu

SEQ ID NO: 76915 - RNA, 22 nt, Human
caucuuuguuuuggauauaauc

SEQ ID NO: 76916 - RNA, 22 nt, Human
caucugcagccucugcauuccc

SEQ ID NO: 76917 - RNA, 22 nt, Human
caugauaacacuucuguuuaau

SEQ ID NO: 76918 - RNA, 22 nt, Human
caugaugaacugugcuguuagg

SEQ ID NO: 76919 - RNA, 22 nt, Human
caugaugacagcauuccuuuua

SEQ ID NO: 76920 - RNA, 22 nt, Human
caguggggcuuccagacgcuga

SEQ ID NO: 76921 - RNA, 17 nt, Human
cagugcuguuuuagaaa

SEQ ID NO: 76922 - RNA, 22 nt, Human
caugccugaucagcggccagca

SEQ ID NO: 76923 - RNA, 22 nt, Human
caugccaguagccggcuugacu

SEQ ID NO: 76924 - RNA, 22 nt, Human
cauaaauuuuaccuuguaagug

SEQ ID NO: 76925 - RNA, 22 nt, Human
cauaagaauauuuaguggcagc

SEQ ID NO: 76926 - RNA, 22 nt, Human
cauggcacagaagaugucguuu

SEQ ID NO: 76927 - RNA, 22 nt, Human
cauaggaaauugcuguuaugga

SEQ ID NO: 76928 - RNA, 22 nt, Human
caugguaccuagccucauggau

SEQ ID NO: 76929 - RNA, 22 nt, Human
caugggaauaaaguuauuucaa

SEQ ID NO: 76930 - RNA, 22 nt, Human
caguaucucccauucacagugu

SEQ ID NO: 76931 - RNA, 22 nt, Human
caguaguucucauaacucauga

SEQ ID NO: 76932 - RNA, 22 nt, Human
caguacugucuuccugauggca

SEQ ID NO: 76933 - RNA, 19 nt, Human
caggucuucuuggaggacu

SEQ ID NO: 76934 - RNA, 22 nt, Human
caguccaugaugacuuuugcuc

SEQ ID NO: 76935 - RNA, 22 nt, Human
cagucaaauuugaaaacuuuga

SEQ ID NO: 76936 - RNA, 22 nt, Human
caggcagggcugccuucugcuu

SEQ ID NO: 76937 - RNA, 22 nt, Human
caggcgcauggugagcagauga

SEQ ID NO: 76938 - RNA, 22 nt, Human
cagggaaguauuacauguuucc

SEQ ID NO: 76939 - RNA, 22 nt, Human
caguagcuuuuugcagacaaga

SEQ ID NO: 76940 - RNA, 22 nt, Human
cagggacugcaggaggacaggu

SEQ ID NO: 76941 - RNA, 20 nt, Human
caggccuucaggauggcugg

SEQ ID NO: 76942 - RNA, 22 nt, Human
caguuuuggaagaaacaaggaa

SEQ ID NO: 76943 - RNA, 22 nt, Human
cagggcuuuuuccuccucuuug

SEQ ID NO: 76944 - RNA, 22 nt, Human
caucaaaugcaagagcguucuu

SEQ ID NO: 76945 - RNA, 22 nt, Human
caucaacagucuacuuuuugcc

SEQ ID NO: 76946 - RNA, 22 nt, Human
caucgagaauuggcagcuaaag

SEQ ID NO: 76947 - RNA, 22 nt, Human
caggucauaacuaugcaugaac

SEQ ID NO: 76948 - RNA, 22 nt, Human
cauagacauugauagguuauau

SEQ ID NO: 76949 - RNA, 22 nt, Human
caggugauuuuguuuucaaaug

SEQ ID NO: 76950 - RNA, 22 nt, Human
caggguugaugaauugucugua

SEQ ID NO: 76951 - RNA, 22 nt, Human
cauaccuugguaagagugauca

SEQ ID NO: 76952 - RNA, 22 nt, Human
caggguaguaauuuaauacaag

SEQ ID NO: 76953 - RNA, 22 nt, Human
auuuauuuucccucaaguaccu

SEQ ID NO: 76954 - RNA, 22 nt, Human
auuucagaaugaaaggaaaaau

SEQ ID NO: 76955 - RNA, 22 nt, Human
auuuaaagaguaauacaaucca

SEQ ID NO: 76956 - RNA, 22 nt, Human
auuuauuugaagagccauugca

SEQ ID NO: 76957 - RNA, 22 nt, Human
auuugaaaaucuaugaugugca

SEQ ID NO: 76958 - RNA, 22 nt, Human
auuuggaaacaugcugaccaug

SEQ ID NO: 76959 - RNA, 22 nt, Human
auuuccugugaacuuuucugau

SEQ ID NO: 76960 - RNA, 17 nt, Human
auuuccgaguuucuuuc

SEQ ID NO: 76961 - RNA, 22 nt, Human
auuucauccauuaagaguacuc

SEQ ID NO: 76962 - RNA, 22 nt, Human
auuucagaguagaucguuauuu

SEQ ID NO: 76963 - RNA, 22 nt, Human
auuucagcagcccauguuugga

SEQ ID NO: 76964 - RNA, 22 nt, Human
auugaaauuugcuuccucacug

SEQ ID NO: 76965 - RNA, 22 nt, Human
auucuuuucucuaaaugaugaa

SEQ ID NO: 76966 - RNA, 22 nt, Human
auuuaaaaacugguacaacagg

SEQ ID NO: 76967 - RNA, 22 nt, Human
auugacuucccaucaggugagu

SEQ ID NO: 76968 - RNA, 22 nt, Human
auugacagagguguaguugaga

SEQ ID NO: 76969 - RNA, 22 nt, Human
auuuaaaggaagugggugauaa

SEQ ID NO: 76970 - RNA, 22 nt, Human
auuuagagaaguagcaaggucc

SEQ ID NO: 76971 - RNA, 22 nt, Human
auuagaaaugacaugugggaau

SEQ ID NO: 76972 - RNA, 22 nt, Human
auuauacauuaggagauugauu

SEQ ID NO: 76973 - RNA, 22 nt, Human
auuguagucuggacuuuuggga

SEQ ID NO: 76974 - RNA, 22 nt, Human
auuguauugcguuugcgaaugu

SEQ ID NO: 76975 - RNA, 22 nt, Human
auuuaagacuguggugcaguuu

SEQ ID NO: 76976 - RNA, 22 nt, Human
auuuccacaaauuaagauugca

SEQ ID NO: 76977 - RNA, 22 nt, Human
auuugaaguauaaguaauugcu

SEQ ID NO: 76978 - RNA, 22 nt, Human
auuugacuugguaagacuuaag

SEQ ID NO: 76979 - RNA, 22 nt, Human
auuugcauguuuauuucuuaga

SEQ ID NO: 76980 - RNA, 22 nt, Human
auuugcaucagugagcgaugug

SEQ ID NO: 76981 - RNA, 22 nt, Human
auuugccaguuacucacaccac

SEQ ID NO: 76982 - RNA, 22 nt, Human
auuugcuuguucaccaguacuu

SEQ ID NO: 76983 - RNA, 22 nt, Human
auuuucuucauuuugauuguau

SEQ ID NO: 76984 - RNA, 22 nt, Human
auuuuugugucacaucuaggaa

SEQ ID NO: 76985 - RNA, 22 nt, Human
auuuggaaggcguuucucugua

SEQ ID NO: 76986 - RNA, 22 nt, Human
auuuggucuacauuuuccaaau

SEQ ID NO: 76987 - RNA, 18 nt, Human
auuuguggggguuauaga

SEQ ID NO: 76988 - RNA, 21 nt, Human
auuuguggugcaauuguggua

SEQ ID NO: 76989 - RNA, 22 nt, Human
auuuuucucucaugugcaacua

SEQ ID NO: 76990 - RNA, 22 nt, Human
caaagaugccaaaaggaagaca

SEQ ID NO: 76991 - RNA, 22 nt, Human
caaagagaugcaccauauuucu

SEQ ID NO: 76992 - RNA, 19 nt, Human
auuuugguucuuuccauuc

SEQ ID NO: 76993 - RNA, 22 nt, Human
auuuuggguguuaacaaugaaa

SEQ ID NO: 76994 - RNA, 22 nt, Human
caaaaaauccauagaaagaggu

SEQ ID NO: 76995 - RNA, 22 nt, Human
auuuuucuuucacauuuucuua

SEQ ID NO: 76996 - RNA, 22 nt, Human
caacaagcgcucagagcaaagc

SEQ ID NO: 76997 - RNA, 22 nt, Human
auuuuucacauuuugggggaca

SEQ ID NO: 76998 - RNA, 22 nt, Human
caacauuucaaggucuuuagga

SEQ ID NO: 76999 - RNA, 22 nt, Human
caagaaguugacagccagguga

SEQ ID NO: 77000 - RNA, 22 nt, Human
caagaaccuagcgaucagguaa

SEQ ID NO: 77001 - RNA, 22 nt, Human
cacagcagcaucauuuaucugg

SEQ ID NO: 77002 - RNA, 22 nt, Human
caacuucugcuuucuuccuugc

SEQ ID NO: 77003 - RNA, 22 nt, Human
caagcagauauuuuagucaaga

SEQ ID NO: 77004 - RNA, 22 nt, Human
caagcacaauuucuacauguua

SEQ ID NO: 77005 - RNA, 22 nt, Human
cacauaguuuaucuucauuuuc

SEQ ID NO: 77006 - RNA, 22 nt, Human
caagauauguccuguuacuaag

SEQ ID NO: 77007 - RNA, 22 nt, Human
cacauugguagaauuuagaaga

SEQ ID NO: 77008 - RNA, 22 nt, Human
cacauuguuuggucagagcaua

SEQ ID NO: 77009 - RNA, 22 nt, Human
cacauuucagcacucagggcau

SEQ ID NO: 77010 - RNA, 22 nt, Human
caaggaagguugguugaaggua

SEQ ID NO: 77011 - RNA, 22 nt, Human
caaggaguuuggggaccaagga

SEQ ID NO: 77012 - RNA, 22 nt, Human
caccaucugaauauucuccaag

SEQ ID NO: 77013 - RNA, 22 nt, Human
caaguugcaugugcuugaaaua

SEQ ID NO: 77014 - RNA, 22 nt, Human
caauaauugcuuuccagaguua

SEQ ID NO: 77015 - RNA, 22 nt, Human
caaugaaaauuuaaguugcagc

SEQ ID NO: 77016 - RNA, 22 nt, Human
caaucuucucuagaguauucua

SEQ ID NO: 77017 - RNA, 22 nt, Human
caauagcuauguaaccugaaga

SEQ ID NO: 77018 - RNA, 22 nt, Human
caaauacaaauacgggcagcuu

SEQ ID NO: 77019 - RNA, 22 nt, Human
caauggaguccucuuccucuuu

SEQ ID NO: 77020 - RNA, 22 nt, Human
caaaucagaucagagacaggcu

SEQ ID NO: 77021 - RNA, 22 nt, Human
caaaucuguuaauuucaaguug

SEQ ID NO: 77022 - RNA, 22 nt, Human
caauguuuuuccuuccuuaaua

SEQ ID NO: 77023 - RNA, 22 nt, Human
caaaugcaguggucgugcugga

SEQ ID NO: 77024 - RNA, 22 nt, Human
cacaacaaaaaauaaguaugag

SEQ ID NO: 77025 - RNA, 22 nt, Human
cacacaccagaaagccugggac

SEQ ID NO: 77026 - RNA, 22 nt, Human
caaccucuaucggucaggaagc

SEQ ID NO: 77027 - RNA, 22 nt, Human
caacuucuauucagucugcagu

SEQ ID NO: 77028 - RNA, 20 nt, Human
caacacugcccauuguuugc

SEQ ID NO: 77029 - RNA, 22 nt, Human
caacacaucaguucagucuuga

SEQ ID NO: 77030 - RNA, 22 nt, Human
caagaugcaagaccagucaggc

SEQ ID NO: 77031 - RNA, 22 nt, Human
caaagaagagauuuacagagcu

SEQ ID NO: 77032 - RNA, 22 nt, Human
caaggaaaacagaugaucaaca

SEQ ID NO: 77033 - RNA, 22 nt, Human
caaggaaaugucagaaaggcaa

SEQ ID NO: 77034 - RNA, 22 nt, Human
caaaacauucagagagcucacu

SEQ ID NO: 77035 - RNA, 22 nt, Human
caagaaaaaacaugaugagugu

SEQ ID NO: 77036 - RNA, 22 nt, Human
caagagcuuuagaaaugcucau

SEQ ID NO: 77037 - RNA, 22 nt, Human
caagagcucccagaccugggca

SEQ ID NO: 77038 - RNA, 22 nt, Human
caaggcuaagcuuuggcuuucu

SEQ ID NO: 77039 - RNA, 22 nt, Human
caaaguaggcuaagaccuucca

SEQ ID NO: 77040 - RNA, 22 nt, Human
caaagcuucaucuguuguuuug

SEQ ID NO: 77041 - RNA, 22 nt, Human
caauaccucuuggugauugggc

SEQ ID NO: 77042 - RNA, 22 nt, Human
caaagccuggggagaguaagga

SEQ ID NO: 77043 - RNA, 18 nt, Human
auggcuccagugucuucc

SEQ ID NO: 77044 - RNA, 22 nt, Human
auggcuucugucuuggaaauuu

SEQ ID NO: 77045 - RNA, 22 nt, Human
augguugugaaagagcaaagac

SEQ ID NO: 77046 - RNA, 22 nt, Human
augguugccugagauaagacug

SEQ ID NO: 77047 - RNA, 22 nt, Human
auguauuuauguauguguuaua

SEQ ID NO: 77048 - RNA, 22 nt, Human
augugaacuccagcugccaacc

SEQ ID NO: 77049 - RNA, 22 nt, Human
auguaaugucaaucuucagugg

SEQ ID NO: 77050 - RNA, 22 nt, Human
auguaugagagauucuuuuauu

SEQ ID NO: 77051 - RNA, 22 nt, Human
auguaaauauuuauauaugcau

SEQ ID NO: 77052 - RNA, 22 nt, Human
auguuagcaucuggcacuaugg

SEQ ID NO: 77053 - RNA, 22 nt, Human
augguuuuguccucuuugguuc

SEQ ID NO: 77054 - RNA, 22 nt, Human
augguuuugugaaaaugcuuug

SEQ ID NO: 77055 - RNA, 22 nt, Human
augugccuuaauauaggcgcug

SEQ ID NO: 77056 - RNA, 22 nt, Human
augugcauguauguaucauauu

SEQ ID NO: 77057 - RNA, 22 nt, Human
auguguguaugacugaaucuau

SEQ ID NO: 77058 - RNA, 22 nt, Human
auguggaaagcuugucuuagag

SEQ ID NO: 77059 - RNA, 22 nt, Human
augugaaauuugggcucuggga

SEQ ID NO: 77060 - RNA, 22 nt, Human
auguuccuuuaaaauauagauu

SEQ ID NO: 77061 - RNA, 22 nt, Human
auucccagucccucccaccccu

SEQ ID NO: 77062 - RNA, 22 nt, Human
auuaaguuauuaagcuaaauau

SEQ ID NO: 77063 - RNA, 22 nt, Human
auucauucugaccucaagagaa

SEQ ID NO: 77064 - RNA, 17 nt, Human
auucaugaacauguccu

SEQ ID NO: 77065 - RNA, 18 nt, Human
auucauuugcguuuggcu

SEQ ID NO: 77066 - RNA, 22 nt, Human
auucauuuuuacaucaccaaua

SEQ ID NO: 77067 - RNA, 22 nt, Human
auucauauagcgcuuacagccu

SEQ ID NO: 77068 - RNA, 22 nt, Human
auucaguucuaaggucagugcc

SEQ ID NO: 77069 - RNA, 22 nt, Human
auucaggacucuuccuugaaga

SEQ ID NO: 77070 - RNA, 22 nt, Human
auucaaugcacauguuuuggau

SEQ ID NO: 77071 - RNA, 22 nt, Human
auucaagauaagggucugggag

SEQ ID NO: 77072 - RNA, 22 nt, Human
auucaagauagaaggauuuuca

SEQ ID NO: 77073 - RNA, 22 nt, Human
auuauucaaggugaggguaaaa

SEQ ID NO: 77074 - RNA, 22 nt, Human
auuaugcagcugccuccaaggu

SEQ ID NO: 77075 - RNA, 22 nt, Human
auuaaacuaaauuaugaauugg

SEQ ID NO: 77076 - RNA, 22 nt, Human
auuaagacugcccauguuuuua

SEQ ID NO: 77077 - RNA, 22 nt, Human
auuacugaggcaaaguaguuuu

SEQ ID NO: 77078 - RNA, 22 nt, Human
auuacagauuauaaauuugagc

SEQ ID NO: 77079 - RNA, 22 nt, Human
auuacagaagauaugcucaaca

SEQ ID NO: 77080 - RNA, 20 nt, Human
auuaauuuuuagggcucacc

SEQ ID NO: 77081 - RNA, 19 nt, Human
auguuuccauuucuggaua

SEQ ID NO: 77082 - RNA, 19 nt, Human
auguucugaauuacuguaa

SEQ ID NO: 77083 - RNA, 22 nt, Human
auguuccuuaaugugcuuguag

SEQ ID NO: 77084 - RNA, 22 nt, Human
auguucucagguuguauuuauu

SEQ ID NO: 77085 - RNA, 18 nt, Human
auguuccugcaguuauuu

SEQ ID NO: 77086 - RNA, 22 nt, Human
auguuuuauacacauguaucac

SEQ ID NO: 77087 - RNA, 22 nt, Human
auguuuugaguuuuuuuacacc

SEQ ID NO: 77088 - RNA, 22 nt, Human
auguuuucuugucuggagaagu

SEQ ID NO: 77089 - RNA, 22 nt, Human
auuagugguguauuuggcacua

SEQ ID NO: 77090 - RNA, 22 nt, Human
auguuuuuugaaaauguauuuu

SEQ ID NO: 77091 - RNA, 21 nt, Human
auuauagugacuaaauugaua

SEQ ID NO: 77092 - RNA, 23 nt, Human
auuaugaagaagacucgccuguu

SEQ ID NO: 77093 - RNA, 22 nt, Human
auuaugaauuguguuacgaaga

SEQ ID NO: 77094 - RNA, 22 nt, Human
augccccuuuauauguuaaguc

SEQ ID NO: 77095 - RNA, 22 nt, Human
augcccugggagugcuguacca

SEQ ID NO: 77096 - RNA, 22 nt, Human
augcaccugucuuuuaaggaua

SEQ ID NO: 77097 - RNA, 23 nt, Human
augcaacauugccaguaugggca

SEQ ID NO: 77098 - RNA, 22 nt, Human
augcacaagguagauuauuauu

SEQ ID NO: 77099 - RNA, 22 nt, Human
augauggagaacaaagaaaauc

SEQ ID NO: 77100 - RNA, 22 nt, Human
augaugaugguuuaacuucagg

SEQ ID NO: 77101 - RNA, 22 nt, Human
augcagauguagauucugaaau

SEQ ID NO: 77102 - RNA, 22 nt, Human
augcacuugacucuauuccaca

SEQ ID NO: 77103 - RNA, 22 nt, Human
augcagagacugugggaaagca

SEQ ID NO: 77104 - RNA, 22 nt, Human
augcagaaucucuuuccugagg

SEQ ID NO: 77105 - RNA, 22 nt, Human
augcuagaaaauuucauauuau

SEQ ID NO: 77106 - RNA, 22 nt, Human
augcuacuugugaaaacccagg

SEQ ID NO: 77107 - RNA, 22 nt, Human
augcuucuguugcuuaggaggu

SEQ ID NO: 77108 - RNA, 22 nt, Human
augcugugccuggaaagcggcu

SEQ ID NO: 77109 - RNA, 22 nt, Human
augcugcuuguccauuuauuug

SEQ ID NO: 77110 - RNA, 22 nt, Human
augccucuugagagccagugcu

SEQ ID NO: 77111 - RNA, 22 nt, Human
augcuugaaaguuauuucauuu

SEQ ID NO: 77112 - RNA, 22 nt, Human
augcgcugugcacacucuuaac

SEQ ID NO: 77113 - RNA, 22 nt, Human
auggagugggaggacaugaagg

SEQ ID NO: 77114 - RNA, 22 nt, Human
augcucuuaauugcuagauaag

SEQ ID NO: 77115 - RNA, 22 nt, Human
augcugcuccuuuucaggcauu

SEQ ID NO: 77116 - RNA, 21 nt, Human
aucucaguccugggaaugauu

SEQ ID NO: 77117 - RNA, 22 nt, Human
auccucugcucaugagaaaugu

SEQ ID NO: 77118 - RNA, 22 nt, Human
aucuauguaucucagaagcuag

SEQ ID NO: 77119 - RNA, 22 nt, Human
aucugcugccuaggguuugucu

SEQ ID NO: 77120 - RNA, 22 nt, Human
aucugcuguaguuggugccagu

SEQ ID NO: 77121 - RNA, 22 nt, Human
aucuucaaggacgccaagaucc

SEQ ID NO: 77122 - RNA, 20 nt, Human
aucuuaucuaucuuuuguuc

SEQ ID NO: 77123 - RNA, 22 nt, Human
aucuucaaagcacaucguuugu

SEQ ID NO: 77124 - RNA, 22 nt, Human
aucuuaguuauuuggagaaacc

SEQ ID NO: 77125 - RNA, 20 nt, Human
aucugugaugagaacgguuu

SEQ ID NO: 77126 - RNA, 20 nt, Human
aucugguggggaauaacuuc

SEQ ID NO: 77127 - RNA, 22 nt, Human
aucuucuuucaucagccccuca

SEQ ID NO: 77128 - RNA, 22 nt, Human
aucuucucucucaucaggauca

SEQ ID NO: 77129 - RNA, 22 nt, Human
augagaaauaauuguguacuga

SEQ ID NO: 77130 - RNA, 22 nt, Human
aucuucuauguguaggcauuuu

SEQ ID NO: 77131 - RNA, 22 nt, Human
augauuauuugaaugaagagga

SEQ ID NO: 77132 - RNA, 22 nt, Human
augauucuaccaaugccaucuu

SEQ ID NO: 77133 - RNA, 22 nt, Human
augauuuguuaacagacuuaau

SEQ ID NO: 77134 - RNA, 22 nt, Human
augacuauaaauaggagauugu

SEQ ID NO: 77135 - RNA, 22 nt, Human
augaccuucuuuccuuaaauuu

SEQ ID NO: 77136 - RNA, 22 nt, Human
augagaguuagccugcauaguu

SEQ ID NO: 77137 - RNA, 22 nt, Human
augaggaacagcaagaauauuu

SEQ ID NO: 77138 - RNA, 22 nt, Human
augcacuaugaugagcuagucu

SEQ ID NO: 77139 - RNA, 22 nt, Human
augauaucuuguuuuucaugca

SEQ ID NO: 77140 - RNA, 22 nt, Human
augcacuccucagcuguucugg

SEQ ID NO: 77141 - RNA, 22 nt, Human
augaugauuauucauuuucugu

SEQ ID NO: 77142 - RNA, 22 nt, Human
augaggagucaaggagucggag

SEQ ID NO: 77143 - RNA, 22 nt, Human
augaggauuagcaucugcaaau

SEQ ID NO: 77144 - RNA, 22 nt, Human
augauguuggaauuuuaacuua

SEQ ID NO: 77145 - RNA, 22 nt, Human
augaauuugaacaccagguugg

SEQ ID NO: 77146 - RNA, 22 nt, Human
auauguuaugccauuuucaagg

SEQ ID NO: 77147 - RNA, 22 nt, Human
auauuauuaaaauagauggaua

SEQ ID NO: 77148 - RNA, 22 nt, Human
auauucaaugaggucauauaag

SEQ ID NO: 77149 - RNA, 22 nt, Human
auauguuuuaguagaaucccaa

SEQ ID NO: 77150 - RNA, 22 nt, Human
auauugcuuuauucuugaauau

SEQ ID NO: 77151 - RNA, 21 nt, Human
auauugguaucuuuuuaaauc

SEQ ID NO: 77152 - RNA, 22 nt, Human
aucaagacaaaggaaaggcuaa

SEQ ID NO: 77153 - RNA, 22 nt, Human
aucaaaauuuucagauacuaca

SEQ ID NO: 77154 - RNA, 22 nt, Human
auauuuuugcagaauuuuucgu

SEQ ID NO: 77155 - RNA, 22 nt, Human
aucaaaauguguagucuugauc

SEQ ID NO: 77156 - RNA, 21 nt, Human
aucagaaucucuagauuugga

SEQ ID NO: 77157 - RNA, 22 nt, Human
aucacaaauggaaucaccuccc

SEQ ID NO: 77158 - RNA, 22 nt, Human
aucagaagaaauggaugugacu

SEQ ID NO: 77159 - RNA, 22 nt, Human
aucaaugggucaaagagaaggu

SEQ ID NO: 77160 - RNA, 22 nt, Human
auauuuuacagcucucguugaa

SEQ ID NO: 77161 - RNA, 22 nt, Human
aucagcucuugaugccuuucuu

SEQ ID NO: 77162 - RNA, 19 nt, Human
aucagcaguuuugccugga

SEQ ID NO: 77163 - RNA, 22 nt, Human
aucaacacuguuggcggggacc

SEQ ID NO: 77164 - RNA, 22 nt, Human
aucaaguuauuaaguagcuuuc

SEQ ID NO: 77165 - RNA, 22 nt, Human
aucauaugugauaccauaauga

SEQ ID NO: 77166 - RNA, 22 nt, Human
aucaugcugacacaguuuaucu

SEQ ID NO: 77167 - RNA, 21 nt, Human
aucagaggacaucucagggcc

SEQ ID NO: 77168 - RNA, 22 nt, Human
aucauguauauuuuugcuauua

SEQ ID NO: 77169 - RNA, 22 nt, Human
aucauugaaaauuuaugcauuu

SEQ ID NO: 77170 - RNA, 20 nt, Human
auccuggucuuuggaagcuu

SEQ ID NO: 77171 - RNA, 22 nt, Human
aucauuuggaaauuuggccuaa

SEQ ID NO: 77172 - RNA, 22 nt, Human
aucauguuauguacaaauauga

SEQ ID NO: 77173 - RNA, 22 nt, Human
auccuucaaaaggaauagcagg

SEQ ID NO: 77174 - RNA, 18 nt, Human
auccuuugaucaucuguc

SEQ ID NO: 77175 - RNA, 22 nt, Human
auccaggggucugaauggauau

SEQ ID NO: 77176 - RNA, 22 nt, Human
auccagaaguauuuuggguacu

SEQ ID NO: 77177 - RNA, 22 nt, Human
aucuaauguggcaaguugcuga

SEQ ID NO: 77178 - RNA, 22 nt, Human
aucuacuaagugccaagcacag

SEQ ID NO: 77179 - RNA, 22 nt, Human
aucuaaaacuacgaauacuacc

SEQ ID NO: 77180 - RNA, 22 nt, Human
aucguuaugauagagaaagaga

SEQ ID NO: 77181 - RNA, 22 nt, Human
auccuccuuugcccugagauca

SEQ ID NO: 77182 - RNA, 22 nt, Human
auccugauggaaacugguauga

SEQ ID NO: 77183 - RNA, 22 nt, Human
auccuccuggggcagucuuccc

SEQ ID NO: 77184 - RNA, 22 nt, Human
aucauugcuaguaaggaucuug

SEQ ID NO: 77185 - RNA, 23 nt, Human
aucauuucuuagugagucccugc

SEQ ID NO: 77186 - RNA, 22 nt, Human
aucauuugaacagaauuuguuu

SEQ ID NO: 77187 - RNA, 22 nt, Human
auccucucuuaugaacaacugu

SEQ ID NO: 77188 - RNA, 22 nt, Human
aucauguauaugcagcguuugu

SEQ ID NO: 77189 - RNA, 22 nt, Human
auccuaagacgugugguuugag

SEQ ID NO: 77190 - RNA, 22 nt, Human
auccucaaggaauuaaauaggg

SEQ ID NO: 77191 - RNA, 22 nt, Human
auccuagacuccuaugccccaa

SEQ ID NO: 77192 - RNA, 19 nt, Human
auccucucuagaaguggga

SEQ ID NO: 77193 - RNA, 23 nt, Human
auccacauucuaguccuuuaugc

SEQ ID NO: 77194 - RNA, 22 nt, Human
aucauaccaguuuccaucagga

SEQ ID NO: 77195 - RNA, 20 nt, Human
aucaggagucgcggggagag

SEQ ID NO: 77196 - RNA, 22 nt, Human
aucauccuagaaggaagcuagg

SEQ ID NO: 77197 - RNA, 21 nt, Human
agugagauuuaugccugguuc

SEQ ID NO: 77198 - RNA, 22 nt, Human
agugaauuagccuauuuguaaa

SEQ ID NO: 77199 - RNA, 22 nt, Human
agugagcauuagugcuuauauu

SEQ ID NO: 77200 - RNA, 22 nt, Human
agugagaguauuaaugugaacu

SEQ ID NO: 77201 - RNA, 22 nt, Human
auagaaauagacaaugcaaaga

SEQ ID NO: 77202 - RNA, 22 nt, Human
auagaagugaaaagggaugacu

SEQ ID NO: 77203 - RNA, 20 nt, Human
auacuuguuuucaggcuuuu

SEQ ID NO: 77204 - RNA, 22 nt, Human
auagacacagcuaugauuugag

SEQ ID NO: 77205 - RNA, 22 nt, Human
auacaucuuaacgcgcucuugg

SEQ ID NO: 77206 - RNA, 22 nt, Human
auacaggcaguaagauucucag

SEQ ID NO: 77207 - RNA, 21 nt, Human
auacaguucagcuuuuacuau

SEQ ID NO: 77208 - RNA, 22 nt, Human
auagagcuggggaagaagcugg

SEQ ID NO: 77209 - RNA, 22 nt, Human
auagagaggaacagcaagaacu

SEQ ID NO: 77210 - RNA, 22 nt, Human
auagacuagccaaagacuucug

SEQ ID NO: 77211 - RNA, 20 nt, Human
auagaguggugugucacauu

SEQ ID NO: 77212 - RNA, 22 nt, Human
auaccaaugaaucccugagaau

SEQ ID NO: 77213 - RNA, 22 nt, Human
auagauugcucauauauuacuu

SEQ ID NO: 77214 - RNA, 22 nt, Human
auagauuuuaucagauuuuauc

SEQ ID NO: 77215 - RNA, 22 nt, Human
auagaugacaguuaggaagcug

SEQ ID NO: 77216 - RNA, 22 nt, Human
auagcuauuauuauuucuguua

SEQ ID NO: 77217 - RNA, 22 nt, Human
auaccaguagaggacugcccaa

SEQ ID NO: 77218 - RNA, 22 nt, Human
auacuacaucacagccaagaag

SEQ ID NO: 77219 - RNA, 23 nt, Human
auacuuuuuuucuacguuaucuc

SEQ ID NO: 77220 - RNA, 22 nt, Human
auagacauuuauagagaaugac

SEQ ID NO: 77221 - RNA, 18 nt, Human
auagacaggaaaaaugga

SEQ ID NO: 77222 - RNA, 22 nt, Human
auagaauggcaccagcaucuac

SEQ ID NO: 77223 - RNA, 22 nt, Human
auagaagguaaugccccaaggg

SEQ ID NO: 77224 - RNA, 22 nt, Human
auaguguguaaagugcagugau

SEQ ID NO: 77225 - RNA, 23 nt, Human
auagucuuaaaccagacuucacc

SEQ ID NO: 77226 - RNA, 22 nt, Human
auaguugcugucauuauuugag

SEQ ID NO: 77227 - RNA, 22 nt, Human
auagaguucucuuuggaggagu

SEQ ID NO: 77228 - RNA, 22 nt, Human
auaggacuguacagaauacaag

SEQ ID NO: 77229 - RNA, 22 nt, Human
auagcaucaugcuaucccccuu

SEQ ID NO: 77230 - RNA, 22 nt, Human
auaucuaggcugaauguaaaau

SEQ ID NO: 77231 - RNA, 19 nt, Human
auagcagaagucauuuuca

SEQ ID NO: 77232 - RNA, 22 nt, Human
auagauagaagggacguggugc

SEQ ID NO: 77233 - RNA, 22 nt, Human
auagaugaggaaauucaggugc

SEQ ID NO: 77234 - RNA, 22 nt, Human
auaugaagaaugaucugaagua

SEQ ID NO: 77235 - RNA, 22 nt, Human
auaguuuuagauacugagaaaa

SEQ ID NO: 77236 - RNA, 22 nt, Human
auauaagucacauuaaggaggu

SEQ ID NO: 77237 - RNA, 22 nt, Human
auaguuaucuguggauaagguu

SEQ ID NO: 77238 - RNA, 22 nt, Human
auaguccuucuuuaacuuagau

SEQ ID NO: 77239 - RNA, 22 nt, Human
auaggcauaacacugauguccu

SEQ ID NO: 77240 - RNA, 22 nt, Human
auaggacuuuguaucaggauga

SEQ ID NO: 77241 - RNA, 22 nt, Human
auauuuguuuggcagaguucag

SEQ ID NO: 77242 - RNA, 23 nt, Human
auaugucaugcaccagcacuuua

SEQ ID NO: 77243 - RNA, 22 nt, Human
auauuucuacaggcugauuuua

SEQ ID NO: 77244 - RNA, 22 nt, Human
auaucuuguuuuugauuucuug

SEQ ID NO: 77245 - RNA, 22 nt, Human
auauuguagcaucacugucuug

SEQ ID NO: 77246 - RNA, 22 nt, Human
auaucugaugacgugacuaugu

SEQ ID NO: 77247 - RNA, 22 nt, Human
auauaugcaacaagaaagcaua

SEQ ID NO: 77248 - RNA, 22 nt, Human
auauaguuggguuucauucuac

SEQ ID NO: 77249 - RNA, 22 nt, Human
auauaaugugugcuuuauugaa

SEQ ID NO: 77250 - RNA, 21 nt, Human
auauggauauuauuuuguguc

SEQ ID NO: 77251 - RNA, 18 nt, Human
uuuuuuguucuguuuugu

SEQ ID NO: 77252 - RNA, 22 nt, Human
uuuuuuuagaaagaucauaguu

SEQ ID NO: 77253 - RNA, 22 nt, Human
uuuuuuuaaguuuugauuuuag

SEQ ID NO: 77254 - RNA, 22 nt, Human
uuuuuugguuuggggauuauuu

SEQ ID NO: 77255 - RNA, 22 nt, Human
uuuuuucuggaguuugggguuu

SEQ ID NO: 77256 - RNA, 22 nt, Human
uuuuuucuucucuaucuuaaua

SEQ ID NO: 77257 - RNA, 22 nt, Human
uuuuuuccuguuugucuuuggg

SEQ ID NO: 77258 - RNA, 22 nt, Human
uuuuuguuauuuagguguagag

SEQ ID NO: 77259 - RNA, 22 nt, Human
uuuuugggccaaauauauuuac

SEQ ID NO: 77260 - RNA, 20 nt, Human
uuuuuuaaauagagcuguug

SEQ ID NO: 77261 - RNA, 22 nt, Human
uuuuuguauaugcuucgaggau

SEQ ID NO: 77262 - RNA, 22 nt, Human
uuuuuguaaaugaaguuuuauu

SEQ ID NO: 77263 - RNA, 22 nt, Human
uuuuugggaagaauucugauau

SEQ ID NO: 77264 - RNA, 21 nt, Human
uuuuuggagggguggggagga

SEQ ID NO: 77265 - RNA, 22 nt, Human
uuuuucuccucucucuuucauu

SEQ ID NO: 77266 - RNA, 22 nt, Human
uuuuugaauaagugcaucauca

SEQ ID NO: 77267 - RNA, 22 nt, Human
uuuuuuuguagguguaugaaaa

SEQ ID NO: 77268 - RNA, 22 nt, Human
uuuuuuuccaguuauucauuuu

SEQ ID NO: 77269 - RNA, 22 nt, Human
uuuuuauguaaaauauuaaaag

SEQ ID NO: 77270 - RNA, 22 nt, Human
uuuuucacacuccuuuccaguu

SEQ ID NO: 77271 - RNA, 22 nt, Human
uuuuuauaagagcagcagaguu

SEQ ID NO: 77272 - RNA, 22 nt, Human
uuuuuauaagauuuaaaaugua

SEQ ID NO: 77273 - RNA, 22 nt, Human
uuuuguuuacauuaaauuuuga

SEQ ID NO: 77274 - RNA, 22 nt, Human
uuuuuagcauaugucaaaucag

SEQ ID NO: 77275 - RNA, 22 nt, Human
uuuuuaauuuuaagcuauuugu

SEQ ID NO: 77276 - RNA, 22 nt, Human
uuuuuaagguuuguuuauauau

SEQ ID NO: 77277 - RNA, 22 nt, Human
uuuugucagggcaggaggaaga

SEQ ID NO: 77278 - RNA, 22 nt, Human
uuuugucuguggaaagcugcua

SEQ ID NO: 77279 - RNA, 22 nt, Human
uuuuguggacugauccgaggac

SEQ ID NO: 77280 - RNA, 18 nt, Human
uuuuguguuuauucugca

SEQ ID NO: 77281 - RNA, 22 nt, Human
uuuuggaaaaaccaguauggaa

SEQ ID NO: 77282 - RNA, 22 nt, Human
uuuugcuucuaguauauuuuuu

SEQ ID NO: 77283 - RNA, 22 nt, Human
uuuugggugcaaauuguuuguu

SEQ ID NO: 77284 - RNA, 22 nt, Human
uuuugguaguccagaguuuagu

SEQ ID NO: 77285 - RNA, 22 nt, Human
uuuugguauaauuuaaaauuaa

SEQ ID NO: 77286 - RNA, 22 nt, Human
uuuugccuauuguaucaucgua

SEQ ID NO: 77287 - RNA, 22 nt, Human
uuuugcuagaaaucaccaauac

SEQ ID NO: 77288 - RNA, 22 nt, Human
uuuugaugaccauucuucuuuu

SEQ ID NO: 77289 - RNA, 22 nt, Human
uuuucuuggaguggcuguccuu

SEQ ID NO: 77290 - RNA, 22 nt, Human
uuuucucucacuucacauauuu

SEQ ID NO: 77291 - RNA, 22 nt, Human
uuuucuucucauucugaccuca

SEQ ID NO: 77292 - RNA, 22 nt, Human
uuuucugauccuucuaacuuga

SEQ ID NO: 77293 - RNA, 22 nt, Human
uuuucuucggugcuggguugau

SEQ ID NO: 77294 - RNA, 23 nt, Human
uuuuccaaaucgacucucuaguu

SEQ ID NO: 77295 - RNA, 22 nt, Human
uuuucauagccagaaacugaaa

SEQ ID NO: 77296 - RNA, 22 nt, Human
uuuucucacugagagccuugau

SEQ ID NO: 77297 - RNA, 22 nt, Human
uuuucuacaaaucuggacuuuu

SEQ ID NO: 77298 - RNA, 22 nt, Human
uuuuaaaacaugucaaaaugug

SEQ ID NO: 77299 - RNA, 22 nt, Human
uuuguuuauuuacuuugggccu

SEQ ID NO: 77300 - RNA, 22 nt, Human
uuuguugucuucauaauacuuu

SEQ ID NO: 77301 - RNA, 19 nt, Human
uuuguuguaucagagcuuu

SEQ ID NO: 77302 - RNA, 21 nt, Human
uuuguucaggggcaaaguuaa

SEQ ID NO: 77303 - RNA, 22 nt, Human
uuuguucuagauaacugguaau

SEQ ID NO: 77304 - RNA, 22 nt, Human
uuuguucuucucaugcacacaa

SEQ ID NO: 77305 - RNA, 22 nt, Human
uuuguguuggaagaaaugcuac

SEQ ID NO: 77306 - RNA, 22 nt, Human
uuguaggguauagcaggagaac

SEQ ID NO: 77307 - RNA, 22 nt, Human
uuuagagguacaguaggcauga

SEQ ID NO: 77308 - RNA, 22 nt, Human
uuuagaaugaaugcaagagaau

SEQ ID NO: 77309 - RNA, 19 nt, Human
uuuacuuaggccacagaau

SEQ ID NO: 77310 - RNA, 22 nt, Human
uuuacuguuuacagcuaaugca

SEQ ID NO: 77311 - RNA, 22 nt, Human
uuuacuuguuuugcucuuuucc

SEQ ID NO: 77312 - RNA, 22 nt, Human
uuuacuuuugguaaggucauuu

SEQ ID NO: 77313 - RNA, 22 nt, Human
uuuuauguuccugaagcuaucu

SEQ ID NO: 77314 - RNA, 22 nt, Human
uuuuaucuuacauggaaucucc

SEQ ID NO: 77315 - RNA, 22 nt, Human
uuuucaaucaaguuuauuuaua

SEQ ID NO: 77316 - RNA, 22 nt, Human
uuuucaguuccaucucugcucu

SEQ ID NO: 77317 - RNA, 22 nt, Human
uuuuagccagcaucugggucga

SEQ ID NO: 77318 - RNA, 22 nt, Human
uuuuaguaauacuuuggccuuu

SEQ ID NO: 77319 - RNA, 22 nt, Human
uuuuaucagagcuugcagugug

SEQ ID NO: 77320 - RNA, 22 nt, Human
uuuuaacuuuaccauuucuuca

SEQ ID NO: 77321 - RNA, 22 nt, Human
uuuuaaucagguauuugaguau

SEQ ID NO: 77322 - RNA, 22 nt, Human
uuuuaacuuuggguucucuuua

SEQ ID NO: 77323 - RNA, 22 nt, Human
uuuuacuuuucccacuuacagc

SEQ ID NO: 77324 - RNA, 22 nt, Human
uucuccucuuugucacugcuuu

SEQ ID NO: 77325 - RNA, 22 nt, Human
uucucgaacaaccuacagggug

SEQ ID NO: 77326 - RNA, 22 nt, Human
uucuccugcccuuggacuucca

SEQ ID NO: 77327 - RNA, 22 nt, Human
uucuccacguucuucucggccu

SEQ ID NO: 77328 - RNA, 22 nt, Human
uucucagagaaagcuccucaug

SEQ ID NO: 77329 - RNA, 22 nt, Human
uucucaauggcaacuuguugcu

SEQ ID NO: 77330 - RNA, 22 nt, Human
uucuagauagucugauauuccu

SEQ ID NO: 77331 - RNA, 22 nt, Human
uucuaguuacagaagccuugcu

SEQ ID NO: 77332 - RNA, 22 nt, Human
uucuagcucauggugacagauc

SEQ ID NO: 77333 - RNA, 22 nt, Human
uuuuauuuguauguugaaugua

SEQ ID NO: 77334 - RNA, 22 nt, Human
uuuuaggauuugaguugcugga

SEQ ID NO: 77335 - RNA, 22 nt, Human
uuuuauaaaaccuguuugaccu

SEQ ID NO: 77336 - RNA, 22 nt, Human
uucuaauauuaugauuucuaag

SEQ ID NO: 77337 - RNA, 22 nt, Human
uucuacauugugaaguucuuua

SEQ ID NO: 77338 - RNA, 18 nt, Human
uucuaaauucuguuuuua

SEQ ID NO: 77339 - RNA, 22 nt, Human
uucguugaagcaacgacuuugg

SEQ ID NO: 77340 - RNA, 22 nt, Human
uuuguugaauggcaggauuuua

SEQ ID NO: 77341 - RNA, 22 nt, Human
uuccuaauguccaccuaguccu

SEQ ID NO: 77342 - RNA, 22 nt, Human
uucccugugcaguauguuccaa

SEQ ID NO: 77343 - RNA, 21 nt, Human
uuccuaaaaugcuuuugugcc

SEQ ID NO: 77344 - RNA, 20 nt, Human
uucugcagcagguguugaag

SEQ ID NO: 77345 - RNA, 22 nt, Human
uucugcauaggcuauauuuguu

SEQ ID NO: 77346 - RNA, 22 nt, Human
uucugaaacauugcuauuuucc

SEQ ID NO: 77347 - RNA, 22 nt, Human
uucucuuguaaaauuccuuuuu

SEQ ID NO: 77348 - RNA, 22 nt, Human
uuuuccuuaacagagggagaaa

SEQ ID NO: 77349 - RNA, 22 nt, Human
uuuucaauuuucauuugcaaga

SEQ ID NO: 77350 - RNA, 22 nt, Human
uucucuugccuucucuuuuauc

SEQ ID NO: 77351 - RNA, 21 nt, Human
uucugcuguucaccaccaccc

SEQ ID NO: 77352 - RNA, 23 nt, Human
uucugcuucccauagcacuuugu

SEQ ID NO: 77353 - RNA, 19 nt, Human
uucugcucaguaacacccu

SEQ ID NO: 77354 - RNA, 22 nt, Human
uuuuggagaaaugggacuuaau

SEQ ID NO: 77355 - RNA, 20 nt, Human
uucuguggcccguuuaagug

SEQ ID NO: 77356 - RNA, 22 nt, Human
uuuuggauugcuaacucagggu

SEQ ID NO: 77357 - RNA, 22 nt, Human
uucuguacuagaucuuaucagu

SEQ ID NO: 77358 - RNA, 22 nt, Human
uugaauuuagguuuaugugaaa

SEQ ID NO: 77359 - RNA, 22 nt, Human
uuuuuuguuccuugguuuuugu

SEQ ID NO: 77360 - RNA, 22 nt, Human
uugacuauacucuggcggaaaa

SEQ ID NO: 77361 - RNA, 22 nt, Human
uuuuuuuuacuccggacagcuc

SEQ ID NO: 77362 - RNA, 22 nt, Human
uugaggcugaucacuccuauaa

SEQ ID NO: 77363 - RNA, 20 nt, Human
uugaggagauauugaauacu

SEQ ID NO: 77364 - RNA, 22 nt, Human
uugaaggugggaggauuuauau

SEQ ID NO: 77365 - RNA, 22 nt, Human
uugaaagaacaauucugugaug

SEQ ID NO: 77366 - RNA, 19 nt, Human
uucuuuccccaccccuacc

SEQ ID NO: 77367 - RNA, 22 nt, Human
uuuuucuccauuccaggugccu

SEQ ID NO: 77368 - RNA, 21 nt, Human
uuuuucuccagaguuuccacu

SEQ ID NO: 77369 - RNA, 22 nt, Human
uucuugagaacaaauuccugga

SEQ ID NO: 77370 - RNA, 22 nt, Human
uuuuuagcuguuauuguggaag

SEQ ID NO: 77371 - RNA, 22 nt, Human
uuuuuagggauuaguguuugag

SEQ ID NO: 77372 - RNA, 19 nt, Human
uucuguggucccaggccuu

SEQ ID NO: 77373 - RNA, 22 nt, Human
uucuguucuuuguccccuuggu

SEQ ID NO: 77374 - RNA, 22 nt, Human
uucuguucugcuuucuccaucc

SEQ ID NO: 77375 - RNA, 22 nt, Human
uuuuguagauuggaaaaucugg

SEQ ID NO: 77376 - RNA, 22 nt, Human
uuuuguagauagggaaacagag

SEQ ID NO: 77377 - RNA, 22 nt, Human
uucuuagauuuuauuucuucug

SEQ ID NO: 77378 - RNA, 22 nt, Human
uuuuguuacugauuauuaaaau

SEQ ID NO: 77379 - RNA, 22 nt, Human
uuuuuaaaagaugauuuaauga

SEQ ID NO: 77380 - RNA, 21 nt, Human
uuuuguguugcgcacuuugag

SEQ ID NO: 77381 - RNA, 23 nt, Human
uuuaaacaauguggucguggugg

SEQ ID NO: 77382 - RNA, 22 nt, Human
uugugacuauuuuucauugaag

SEQ ID NO: 77383 - RNA, 22 nt, Human
uugugacaauacagcauggaga

SEQ ID NO: 77384 - RNA, 22 nt, Human
uuguuuguaaggcucuuagaau

SEQ ID NO: 77385 - RNA, 22 nt, Human
uuguuucagcuuccuccuccau

SEQ ID NO: 77386 - RNA, 22 nt, Human
uuuaaagucaggcuguaguggu

SEQ ID NO: 77387 - RNA, 20 nt, Human
uuuaacuggccuucuggcuc

SEQ ID NO: 77388 - RNA, 22 nt, Human
uuuaagguacagcuagcagcau

SEQ ID NO: 77389 - RNA, 22 nt, Human
uuuaaguuaguauggguuaggu

SEQ ID NO: 77390 - RNA, 18 nt, Human
uuuaauaagccuguuaug

SEQ ID NO: 77391 - RNA, 22 nt, Human
uuuaauauuacacuuaccuugu

SEQ ID NO: 77392 - RNA, 22 nt, Human
uuuaaugaugucuaugccuguu

SEQ ID NO: 77393 - RNA, 22 nt, Human
uugucccuaugagugguaauca

SEQ ID NO: 77394 - RNA, 22 nt, Human
uuguccacuaagaaagugcccu

SEQ ID NO: 77395 - RNA, 22 nt, Human
uugucuuggcauaccguuauau

SEQ ID NO: 77396 - RNA, 22 nt, Human
uuguacuuaaauaugcaaauag

SEQ ID NO: 77397 - RNA, 20 nt, Human
uuguacuuaugugagaagga

SEQ ID NO: 77398 - RNA, 22 nt, Human
uuggugauguagcagcaauugu

SEQ ID NO: 77399 - RNA, 22 nt, Human
uuggcaaagagaugcauaagga

SEQ ID NO: 77400 - RNA, 22 nt, Human
uuggcaaaaauacuguaggccu

SEQ ID NO: 77401 - RNA, 22 nt, Human
uugcuugcggccuuugugccuu

SEQ ID NO: 77402 - RNA, 22 nt, Human
uuggacugguuuacauuucaag

SEQ ID NO: 77403 - RNA, 22 nt, Human
uuggagagggugggcuuugaag

SEQ ID NO: 77404 - RNA, 22 nt, Human
uuggaagagagauggggagaga

SEQ ID NO: 77405 - RNA, 22 nt, Human
uuggaauuugagaccaagaaaa

SEQ ID NO: 77406 - RNA, 22 nt, Human
uugcuuugcuucuuuaugguca

SEQ ID NO: 77407 - RNA, 22 nt, Human
uugcagaauucuucccacucag

SEQ ID NO: 77408 - RNA, 20 nt, Human
uugcaaagugaauagcaauu

SEQ ID NO: 77409 - RNA, 22 nt, Human
uugcagagaacuaaagggagua

SEQ ID NO: 77410 - RNA, 22 nt, Human
uugcaugauuuaagaauaucug

SEQ ID NO: 77411 - RNA, 22 nt, Human
uugcaucagcaggcauaauugg

SEQ ID NO: 77412 - RNA, 22 nt, Human
uugccuacaaacgaaucuaucu

SEQ ID NO: 77413 - RNA, 22 nt, Human
uugcucaugucaccaaagcaca

SEQ ID NO: 77414 - RNA, 20 nt, Human
uugcucucuuguguugaugu

SEQ ID NO: 77415 - RNA, 22 nt, Human
uugcuaagguuuaacuauugga

SEQ ID NO: 77416 - RNA, 22 nt, Human
uucauugauuuccuuggaauaa

SEQ ID NO: 77417 - RNA, 22 nt, Human
uucauugcagaauuuggccuca

SEQ ID NO: 77418 - RNA, 22 nt, Human
uuuguacuuucuaauguauuua

SEQ ID NO: 77419 - RNA, 20 nt, Human
uuugguuggcuaggggaagc

SEQ ID NO: 77420 - RNA, 22 nt, Human
uuuguauuguuuauuucauuuu

SEQ ID NO: 77421 - RNA, 20 nt, Human
uuugucaacugcauccagca

SEQ ID NO: 77422 - RNA, 23 nt, Human
uuugucaucccucucacuuucug

SEQ ID NO: 77423 - RNA, 22 nt, Human
uuccaugccccucuuuggguac

SEQ ID NO: 77424 - RNA, 22 nt, Human
uuugugguuuugagagaguugc

SEQ ID NO: 77425 - RNA, 22 nt, Human
uuuguggaaaagagcccaggag

SEQ ID NO: 77426 - RNA, 22 nt, Human
uuccccaccagagacagagcug

SEQ ID NO: 77427 - RNA, 22 nt, Human
uuccccagaaaaguaaacaagg

SEQ ID NO: 77428 - RNA, 22 nt, Human
uuuguguuuugaggucuugcaa

SEQ ID NO: 77429 - RNA, 22 nt, Human
uuuguuaggguuucagcuagcc

SEQ ID NO: 77430 - RNA, 22 nt, Human
uuuguuaugguuggaagcagga

SEQ ID NO: 77431 - RNA, 19 nt, Human
uuugguaggcuugagggaa

SEQ ID NO: 77432 - RNA, 22 nt, Human
uuuggucaucaaagacaaguaa

SEQ ID NO: 77433 - RNA, 22 nt, Human
uuuggugacuguaggaaaggau

SEQ ID NO: 77434 - RNA, 22 nt, Human
uuugggcauuuuuaaggaucuu

SEQ ID NO: 77435 - RNA, 22 nt, Human
uucaguagagguggaaauaaca

SEQ ID NO: 77436 - RNA, 22 nt, Human
uucauacuguuuaaguucuguu

SEQ ID NO: 77437 - RNA, 18 nt, Human
uuugggauccucuuuucu

SEQ ID NO: 77438 - RNA, 22 nt, Human
uuugggaaguaauuaauugcag

SEQ ID NO: 77439 - RNA, 22 nt, Human
uuugcaggaaauguacugaaug

SEQ ID NO: 77440 - RNA, 22 nt, Human
uuugcauuaguuuagauuucaa

SEQ ID NO: 77441 - RNA, 22 nt, Human
uucaggaucuaggaguauuuuu

SEQ ID NO: 77442 - RNA, 18 nt, Human
uucaggcucuugcaugaa

SEQ ID NO: 77443 - RNA, 22 nt, Human
uucagguacuaagugcugauuc

SEQ ID NO: 77444 - RNA, 22 nt, Human
uuuggcaagcagaugaagguag

SEQ ID NO: 77445 - RNA, 22 nt, Human
uuucugguuuuauucugggguu

SEQ ID NO: 77446 - RNA, 22 nt, Human
uuugaguacagcugccuuuuug

SEQ ID NO: 77447 - RNA, 22 nt, Human
uuugaguaagauguugauacug

SEQ ID NO: 77448 - RNA, 22 nt, Human
uuugaugagaaaugacuuaagu

SEQ ID NO: 77449 - RNA, 22 nt, Human
uuugagaagauaggggaauacu

SEQ ID NO: 77450 - RNA, 21 nt, Human
uuugacagaccagguauaguu

SEQ ID NO: 77451 - RNA, 22 nt, Human
uucaaaccuaucuaagaaauag

SEQ ID NO: 77452 - RNA, 22 nt, Human
uucaacaacuugguucaaaugg

SEQ ID NO: 77453 - RNA, 22 nt, Human
uuauuuuuguaacacuguauag

SEQ ID NO: 77454 - RNA, 22 nt, Human
uuauuuucgugugugugugugu

SEQ ID NO: 77455 - RNA, 22 nt, Human
uucaaacaguguagaauauaug

SEQ ID NO: 77456 - RNA, 22 nt, Human
uuauuuuuguuuguuaagccua

SEQ ID NO: 77457 - RNA, 22 nt, Human
uuugaagaaacagucuuaagag

SEQ ID NO: 77458 - RNA, 22 nt, Human
uuucucuccucgaaauucuuau

SEQ ID NO: 77459 - RNA, 22 nt, Human
uuauuucuucucgaagcuuggg

SEQ ID NO: 77460 - RNA, 22 nt, Human
uuauuucauguaaaauuuaugu

SEQ ID NO: 77461 - RNA, 22 nt, Human
uuauuugcccauguuuagcaga

SEQ ID NO: 77462 - RNA, 22 nt, Human
uuucucuuguauuugaaucacu

SEQ ID NO: 77463 - RNA, 22 nt, Human
uuucucugggugaugagguggc

SEQ ID NO: 77464 - RNA, 22 nt, Human
uuucugaugaaguagaaagacc

SEQ ID NO: 77465 - RNA, 22 nt, Human
uuucugcauuuguauuggaaaa

SEQ ID NO: 77466 - RNA, 22 nt, Human
uuucuuaguuaaguagguaggc

SEQ ID NO: 77467 - RNA, 22 nt, Human
uuauuuuauaaagagaagacuu

SEQ ID NO: 77468 - RNA, 22 nt, Human
uuucuugugauuuugaugaacu

SEQ ID NO: 77469 - RNA, 22 nt, Human
uuucuguucuguuggauucuuu

SEQ ID NO: 77470 - RNA, 22 nt, Human
uuucuguugugaccugacucuu

SEQ ID NO: 77471 - RNA, 22 nt, Human
uuucuggacuaaagggagagau

SEQ ID NO: 77472 - RNA, 22 nt, Human
uuucugugguggguaguucaga

SEQ ID NO: 77473 - RNA, 22 nt, Human
uuucacugaguaggagagcacu

SEQ ID NO: 77474 - RNA, 22 nt, Human
uuucacagcgucuuucucuugc

SEQ ID NO: 77475 - RNA, 22 nt, Human
uuuauuuuccaugucucuaggu

SEQ ID NO: 77476 - RNA, 22 nt, Human
uuuauugaccugaguaucagca

SEQ ID NO: 77477 - RNA, 22 nt, Human
uuuauuuagguaaacaugaguu

SEQ ID NO: 77478 - RNA, 22 nt, Human
uuaguuauaggugaaucagaga

SEQ ID NO: 77479 - RNA, 22 nt, Human
uuuauaagccagacacugcguu

SEQ ID NO: 77480 - RNA, 22 nt, Human
uuuaucaucuucugaauuugga

SEQ ID NO: 77481 - RNA, 22 nt, Human
uuaggacucuauuuggguaucu

SEQ ID NO: 77482 - RNA, 22 nt, Human
uuuauauauauguaggagcaca

SEQ ID NO: 77483 - RNA, 22 nt, Human
uuagcccaggacuuuuuauagc

SEQ ID NO: 77484 - RNA, 22 nt, Human
uuagccuccaguuuucucauuu

SEQ ID NO: 77485 - RNA, 22 nt, Human
uuagcacugucugguuaucuug

SEQ ID NO: 77486 - RNA, 22 nt, Human
uuagagagguuggagugguaga

SEQ ID NO: 77487 - RNA, 22 nt, Human
uuagagagaggagagagagaga

SEQ ID NO: 77488 - RNA, 22 nt, Human
uuacaugcuugugcagguuuug

SEQ ID NO: 77489 - RNA, 22 nt, Human
uuaccgagaacaugacuggaau

SEQ ID NO: 77490 - RNA, 22 nt, Human
uuguaugcugggaagcgggagg

SEQ ID NO: 77491 - RNA, 22 nt, Human
uguuuguaugauggcacaucca

SEQ ID NO: 77492 - RNA, 22 nt, Human
uuuacaaggcaguuauuuuccu

SEQ ID NO: 77493 - RNA, 22 nt, Human
uuguauaaagauggcuagaucc

SEQ ID NO: 77494 - RNA, 21 nt, Human
uguuugcuuuuggagcaacug

SEQ ID NO: 77495 - RNA, 22 nt, Human
uguuugagaauuugcugauguu

SEQ ID NO: 77496 - RNA, 22 nt, Human
uuaccugccucaaacacgaaug

SEQ ID NO: 77497 - RNA, 20 nt, Human
uuacucaaccaggcuucuac

SEQ ID NO: 77498 - RNA, 22 nt, Human
uuacuggaauauaaagauaaga

SEQ ID NO: 77499 - RNA, 22 nt, Human
uuagagaagcacuguaggugaa

SEQ ID NO: 77500 - RNA, 22 nt, Human
uuagacaucaagaagccaaugu

SEQ ID NO: 77501 - RNA, 22 nt, Human
uuagacagagcuccuugagggc

SEQ ID NO: 77502 - RNA, 22 nt, Human
uuacuguaggugggugaauuug

SEQ ID NO: 77503 - RNA, 22 nt, Human
uuuagcaguuuauuuaaggggg

SEQ ID NO: 77504 - RNA, 22 nt, Human
uuagagaauagacuuuacccug

SEQ ID NO: 77505 - RNA, 22 nt, Human
uuuagcugugugugucgcucca

SEQ ID NO: 77506 - RNA, 22 nt, Human
uuuaggaagaucugaaggaaga

SEQ ID NO: 77507 - RNA, 22 nt, Human
uuuaggaauuugcugggcauga

SEQ ID NO: 77508 - RNA, 22 nt, Human
uuuagguccguguugcaguugg

SEQ ID NO: 77509 - RNA, 22 nt, Human
uuauggauuagaguuugauucu

SEQ ID NO: 77510 - RNA, 22 nt, Human
uuaucuuuuaaaaacacuugug

SEQ ID NO: 77511 - RNA, 22 nt, Human
uuuccacacucacugcacucau

SEQ ID NO: 77512 - RNA, 22 nt, Human
uuucauggaggccaggacagag

SEQ ID NO: 77513 - RNA, 22 nt, Human
uuuccagacaugguuuuucaaa

SEQ ID NO: 77514 - RNA, 22 nt, Human
uuucaugauuaacuuagugaau

SEQ ID NO: 77515 - RNA, 22 nt, Human
uuucagaaauggcacugaaauc

SEQ ID NO: 77516 - RNA, 22 nt, Human
uuucagauuauguucauggguu

SEQ ID NO: 77517 - RNA, 22 nt, Human
uuauacuucugccagaggacaa

SEQ ID NO: 77518 - RNA, 22 nt, Human
uuucacuucgaucagaguuuuu

SEQ ID NO: 77519 - RNA, 22 nt, Human
uuauaucagaaggugagauuga

SEQ ID NO: 77520 - RNA, 22 nt, Human
uuuccuuaauuguaaaauggag

SEQ ID NO: 77521 - RNA, 22 nt, Human
uuaugugcuuuuugagcucuaa

SEQ ID NO: 77522 - RNA, 22 nt, Human
uuuccugcagacaguuuaagca

SEQ ID NO: 77523 - RNA, 22 nt, Human
uuuccugacuucaccuuuuacc

SEQ ID NO: 77524 - RNA, 22 nt, Human
uuaugugcuacacauaauuugu

SEQ ID NO: 77525 - RNA, 22 nt, Human
uuaugguuuaauauccagcaca

SEQ ID NO: 77526 - RNA, 22 nt, Human
uuucuaaaaccagaguuuauaa

SEQ ID NO: 77527 - RNA, 22 nt, Human
uuucgcuuguucggagugcuuu

SEQ ID NO: 77528 - RNA, 22 nt, Human
uuucuaaaauuacugcagucgg

SEQ ID NO: 77529 - RNA, 22 nt, Human
uuauuguuuggguauaauuuga

SEQ ID NO: 77530 - RNA, 22 nt, Human
uuucuauauucaguuucauaaa

SEQ ID NO: 77531 - RNA, 22 nt, Human
uuucuaguagcuacagcaccau

SEQ ID NO: 77532 - RNA, 22 nt, Human
uuucucagccuccuugcuggag

SEQ ID NO: 77533 - RNA, 18 nt, Human
uugcucucucugggggca

SEQ ID NO: 77534 - RNA, 22 nt, Human
uugcucuuaccauuauguguga

SEQ ID NO: 77535 - RNA, 22 nt, Human
ugugcuugucuguuuugauugu

SEQ ID NO: 77536 - RNA, 22 nt, Human
ugugcuauuuuugcauaugugu

SEQ ID NO: 77537 - RNA, 22 nt, Human
uugcugaggcuggggagaggug

SEQ ID NO: 77538 - RNA, 21 nt, Human
uugcuggagcaauguaaauca

SEQ ID NO: 77539 - RNA, 22 nt, Human
uugcuggaguagaaaacuuaac

SEQ ID NO: 77540 - RNA, 22 nt, Human
uguggcuuaggugagcauguga

SEQ ID NO: 77541 - RNA, 22 nt, Human
uuggaaaugcauuuguuauuau

SEQ ID NO: 77542 - RNA, 22 nt, Human
uugcuuuuuuggguuuacuggg

SEQ ID NO: 77543 - RNA, 22 nt, Human
uuggaaaagaaauacucauaua

SEQ ID NO: 77544 - RNA, 22 nt, Human
uugcuuucuuuguagguuuucc

SEQ ID NO: 77545 - RNA, 22 nt, Human
uugcuuaggccaaauggcgcau

SEQ ID NO: 77546 - RNA, 23 nt, Human
uugcuuuugccccaaaagaguua

SEQ ID NO: 77547 - RNA, 22 nt, Human
uugcuuuuugggguuuacuggg

SEQ ID NO: 77548 - RNA, 22 nt, Human
uuggaggccacagucaucuuua

SEQ ID NO: 77549 - RNA, 22 nt, Human
uuggaguucuucaugcucugua

SEQ ID NO: 77550 - RNA, 22 nt, Human
uuggauguccucuguggaguau

SEQ ID NO: 77551 - RNA, 22 nt, Human
uuggaaauguagaaaagcagau

SEQ ID NO: 77552 - RNA, 22 nt, Human
uugggaaauuugaaaauaaaag

SEQ ID NO: 77553 - RNA, 22 nt, Human
uuggcuucuugcuaggaagcug

SEQ ID NO: 77554 - RNA, 22 nt, Human
uugggaacaggcuucccacugg

SEQ ID NO: 77555 - RNA, 22 nt, Human
uuggcuuuucaguuuuaaguua

SEQ ID NO: 77556 - RNA, 22 nt, Human
uugggagaggcagcagagucau

SEQ ID NO: 77557 - RNA, 22 nt, Human
uugggagagaaaccuaaugccu

SEQ ID NO: 77558 - RNA, 22 nt, Human
uugggaguaauacugaagagag

SEQ ID NO: 77559 - RNA, 22 nt, Human
uguucuuacuaaguaccugaaa

SEQ ID NO: 77560 - RNA, 22 nt, Human
uguugaagcaccucugucuuuc

SEQ ID NO: 77561 - RNA, 22 nt, Human
uguugaaacagcuauugacuuu

SEQ ID NO: 77562 - RNA, 22 nt, Human
uguugaugaccacaauuuaugc

SEQ ID NO: 77563 - RNA, 18 nt, Human
uguugguguucacucacu

SEQ ID NO: 77564 - RNA, 22 nt, Human
uugguuaccuucagaaaugagu

SEQ ID NO: 77565 - RNA, 22 nt, Human
uguugucaugcagucaguggua

SEQ ID NO: 77566 - RNA, 22 nt, Human
uuguagaucagauggccaguag

SEQ ID NO: 77567 - RNA, 22 nt, Human
uuguacuuguucuguuuccuug

SEQ ID NO: 77568 - RNA, 22 nt, Human
uugguugaaauguguucaugcu

SEQ ID NO: 77569 - RNA, 22 nt, Human
uuguacaaauaggaaccucuga

SEQ ID NO: 77570 - RNA, 22 nt, Human
uguuggaauaagugcuugaagg

SEQ ID NO: 77571 - RNA, 22 nt, Human
uguugcauguggcuguuugcca

SEQ ID NO: 77572 - RNA, 22 nt, Human
uuggugaugaaagugcugcgcu

SEQ ID NO: 77573 - RNA, 22 nt, Human
uuggugaugcuaggaauguagu

SEQ ID NO: 77574 - RNA, 22 nt, Human
uuggugaugcccaccuuuucau

SEQ ID NO: 77575 - RNA, 22 nt, Human
ugucacagugcacagcuaagaa

SEQ ID NO: 77576 - RNA, 22 nt, Human
uguaucucugacacagucucac

SEQ ID NO: 77577 - RNA, 22 nt, Human
uguauugaggauucauuuuugu

SEQ ID NO: 77578 - RNA, 21 nt, Human
ugucaucucuaaaaagauugu

SEQ ID NO: 77579 - RNA, 20 nt, Human
ugucccuggagagcugcaga

SEQ ID NO: 77580 - RNA, 22 nt, Human
uugauuuggaauuuuuagagcu

SEQ ID NO: 77581 - RNA, 22 nt, Human
ugucauuggugaucugaugccu

SEQ ID NO: 77582 - RNA, 22 nt, Human
ugugaugagaugaacuguagac

SEQ ID NO: 77583 - RNA, 22 nt, Human
ugugauaaaggcccgcagaucc

SEQ ID NO: 77584 - RNA, 22 nt, Human
uugccucuaauuagcucuguga

SEQ ID NO: 77585 - RNA, 22 nt, Human
ugugauuucaaagggugucuuu

SEQ ID NO: 77586 - RNA, 22 nt, Human
ugugcagaaggagguucuccgg

SEQ ID NO: 77587 - RNA, 23 nt, Human
ugugaauggccuucuuuagaggu

SEQ ID NO: 77588 - RNA, 22 nt, Human
ugugagccuuuauuaaccucau

SEQ ID NO: 77589 - RNA, 22 nt, Human
ugugagauuuuauuugauaugc

SEQ ID NO: 77590 - RNA, 22 nt, Human
ugugaaugacuuuguucuuugc

SEQ ID NO: 77591 - RNA, 22 nt, Human
ugucuuugaccuuaagaaguuu

SEQ ID NO: 77592 - RNA, 22 nt, Human
ugucuuuuaaaaauguguaaaa

SEQ ID NO: 77593 - RNA, 22 nt, Human
ugugaagaauuaaugugaauca

SEQ ID NO: 77594 - RNA, 22 nt, Human
uugcaagauaguguauuuuuca

SEQ ID NO: 77595 - RNA, 22 nt, Human
ugucuaaggaaaaagucuauuu

SEQ ID NO: 77596 - RNA, 22 nt, Human
uugcagauuucuuguccccauu

SEQ ID NO: 77597 - RNA, 21 nt, Human
ugguuuuaucuugguggcugc

SEQ ID NO: 77598 - RNA, 22 nt, Human
uucuuuuuagcugguuguaaga

SEQ ID NO: 77599 - RNA, 23 nt, Human
uguaaaacaccguuauugcaccu

SEQ ID NO: 77600 - RNA, 22 nt, Human
uugaaaaaaucugaggaggacc

SEQ ID NO: 77601 - RNA, 23 nt, Human
uucuuuccuuaucccauuuacuu

SEQ ID NO: 77602 - RNA, 21 nt, Human
uucuuugaagacccauuugag

SEQ ID NO: 77603 - RNA, 22 nt, Human
uucuuucgaacaagagaaguuc

SEQ ID NO: 77604 - RNA, 22 nt, Human
uugaacucagcuacugguuggu

SEQ ID NO: 77605 - RNA, 22 nt, Human
uugaacaguuuugucagguuca

SEQ ID NO: 77606 - RNA, 22 nt, Human
uugaacauuagaauaaguaauu

SEQ ID NO: 77607 - RNA, 22 nt, Human
uguauagcaggguucuuccucc

SEQ ID NO: 77608 - RNA, 22 nt, Human
uguauaugucugugagcuauua

SEQ ID NO: 77609 - RNA, 22 nt, Human
uugaagaagucaaaagcugcag

SEQ ID NO: 77610 - RNA, 22 nt, Human
uugaaaacugucaccuuuauuc

SEQ ID NO: 77611 - RNA, 22 nt, Human
uugaaaauuaauagguguacaa

SEQ ID NO: 77612 - RNA, 22 nt, Human
uucuucuguuggcagagcauac

SEQ ID NO: 77613 - RNA, 22 nt, Human
uucuucauucccuuacuuccga

SEQ ID NO: 77614 - RNA, 22 nt, Human
uucuuauuuuucguaaauccug

SEQ ID NO: 77615 - RNA, 22 nt, Human
uucuuacuaaguagaguacuca

SEQ ID NO: 77616 - RNA, 22 nt, Human
uucuugucuuuguuauguagga

SEQ ID NO: 77617 - RNA, 22 nt, Human
uucuuggcacagaugagauucu

SEQ ID NO: 77618 - RNA, 22 nt, Human
uggugguaggggugguuucuga

SEQ ID NO: 77619 - RNA, 18 nt, Human
uucugcggugacagauau

SEQ ID NO: 77620 - RNA, 22 nt, Human
uucuguuuaaccuggaaagugu

SEQ ID NO: 77621 - RNA, 23 nt, Human
uucugaggucacgguggaccugg

SEQ ID NO: 77622 - RNA, 22 nt, Human
uucucucacucuuagaucccgc

SEQ ID NO: 77623 - RNA, 22 nt, Human
uucugaugccuggguugcuucu

SEQ ID NO: 77624 - RNA, 22 nt, Human
uucugaaggcaggggcuaucuu

SEQ ID NO: 77625 - RNA, 22 nt, Human
uucugaaccauugagcacugcc

SEQ ID NO: 77626 - RNA, 22 nt, Human
uucugagccacaguaaggaucu

SEQ ID NO: 77627 - RNA, 22 nt, Human
ugcuauucuuggagcugaugga

SEQ ID NO: 77628 - RNA, 22 nt, Human
uuauguugauaggaaucugauu

SEQ ID NO: 77629 - RNA, 22 nt, Human
uuauuccauagaagucaaggaa

SEQ ID NO: 77630 - RNA, 22 nt, Human
uuauuaauacaugcaccugcau

SEQ ID NO: 77631 - RNA, 22 nt, Human
uuauucuuagccucgguauuuc

SEQ ID NO: 77632 - RNA, 22 nt, Human
uuauuguagcacuuuggcagug

SEQ ID NO: 77633 - RNA, 22 nt, Human
uuauuuaaaauguagguuggga

SEQ ID NO: 77634 - RNA, 22 nt, Human
uggagcuuuguguauuuuuaau

SEQ ID NO: 77635 - RNA, 22 nt, Human
uggaggaggagaacuuggcacu

SEQ ID NO: 77636 - RNA, 22 nt, Human
uggaggaggaugcauuuguugu

SEQ ID NO: 77637 - RNA, 22 nt, Human
uuauuuaagaucuuaauauaua

SEQ ID NO: 77638 - RNA, 22 nt, Human
uuauuuaaguauuuauugaagu

SEQ ID NO: 77639 - RNA, 22 nt, Human
uuauuucaggcauuuguaaaug

SEQ ID NO: 77640 - RNA, 22 nt, Human
uuauuuuguagcucugaucuuu

SEQ ID NO: 77641 - RNA, 22 nt, Human
uuauuugguuuuggcuuuagcu

SEQ ID NO: 77642 - RNA, 23 nt, Human
uucaccaaugcuguccaaguacc

SEQ ID NO: 77643 - RNA, 22 nt, Human
uggaugagugaauggauaaauc

SEQ ID NO: 77644 - RNA, 22 nt, Human
uucaauuacaucagaaucuaaa

SEQ ID NO: 77645 - RNA, 20 nt, Human
uucacagaggacucagguca

SEQ ID NO: 77646 - RNA, 22 nt, Human
uggaucaugcgaggccuccccu

SEQ ID NO: 77647 - RNA, 22 nt, Human
uggaucuugaugcuccaagagu

SEQ ID NO: 77648 - RNA, 22 nt, Human
uggauauuuuguaugugcguuu

SEQ ID NO: 77649 - RNA, 21 nt, Human
uggauauugaguaguuucuga

SEQ ID NO: 77650 - RNA, 22 nt, Human
uggaguuuuaaucuguacagaa

SEQ ID NO: 77651 - RNA, 21 nt, Human
uucaaccagcaauuggcagaa

SEQ ID NO: 77652 - RNA, 22 nt, Human
uggaguuuauuugaauucuugg

SEQ ID NO: 77653 - RNA, 22 nt, Human
uucaaacacugugcaauugggu

SEQ ID NO: 77654 - RNA, 22 nt, Human
uucaaaaugcagaauaguuugg

SEQ ID NO: 77655 - RNA, 21 nt, Human
uggaggcguaaucacuguuga

SEQ ID NO: 77656 - RNA, 22 nt, Human
uuauuuuuaggaauguagaggu

SEQ ID NO: 77657 - RNA, 22 nt, Human
uggcaaaaccugcaauuacuuu

SEQ ID NO: 77658 - RNA, 22 nt, Human
uggcaaggccacaggugcaguu

SEQ ID NO: 77659 - RNA, 22 nt, Human
uggauuuuggaauguuucagua

SEQ ID NO: 77660 - RNA, 22 nt, Human
uggauuguuuacaucaugucug

SEQ ID NO: 77661 - RNA, 22 nt, Human
uggauucucuguagccugguuc

SEQ ID NO: 77662 - RNA, 20 nt, Human
uggaugacuucaggcagccu

SEQ ID NO: 77663 - RNA, 22 nt, Human
uggauuagugcugaaaugaugg

SEQ ID NO: 77664 - RNA, 22 nt, Human
uggaugcuccaaguagaccuua

SEQ ID NO: 77665 - RNA, 22 nt, Human
uggcagcauuuuuuccagaaca

SEQ ID NO: 77666 - RNA, 22 nt, Human
uucagaaagugaaucuuguuau

SEQ ID NO: 77667 - RNA, 22 nt, Human
uucacuuuuucucugcuugaga

SEQ ID NO: 77668 - RNA, 22 nt, Human
uucagaagguaggaaugucccu

SEQ ID NO: 77669 - RNA, 22 nt, Human
uggcagcucauuuggaaaugga

SEQ ID NO: 77670 - RNA, 22 nt, Human
uucagaugcuugauuauggcaa

SEQ ID NO: 77671 - RNA, 22 nt, Human
uggcagugagauuucucuucug

SEQ ID NO: 77672 - RNA, 22 nt, Human
uggcauuugagcuggaaggaug

SEQ ID NO: 77673 - RNA, 23 nt, Human
uucagcucuccugaagcaucugu

SEQ ID NO: 77674 - RNA, 18 nt, Human
uggcaugcuuugauacau

SEQ ID NO: 77675 - RNA, 22 nt, Human
uggcaugugaauuguuacauug

SEQ ID NO: 77676 - RNA, 22 nt, Human
uucagcugcuugccugaaguca

SEQ ID NO: 77677 - RNA, 22 nt, Human
uucaggaaacaaauuugcaguu

SEQ ID NO: 77678 - RNA, 19 nt, Human
uucaggcuuuucauuuuuc

SEQ ID NO: 77679 - RNA, 22 nt, Human
uucaggggcaaauacauuuuga

SEQ ID NO: 77680 - RNA, 22 nt, Human
uucaguuugaauucuguagaac

SEQ ID NO: 77681 - RNA, 22 nt, Human
uucagguuuuuaaguucugccu

SEQ ID NO: 77682 - RNA, 22 nt, Human
uucagguuuuaugguaaugcuu

SEQ ID NO: 77683 - RNA, 22 nt, Human
uucauauuguggucuugcauuc

SEQ ID NO: 77684 - RNA, 22 nt, Human
uucauagggagcaucuaccuau

SEQ ID NO: 77685 - RNA, 22 nt, Human
uucauccucuaguacugaagug

SEQ ID NO: 77686 - RNA, 22 nt, Human
uucaucuucaaaccccagugcc

SEQ ID NO: 77687 - RNA, 22 nt, Human
uucaugcaagagugugaggucc

SEQ ID NO: 77688 - RNA, 20 nt, Human
uucaugcagugguugcugug

SEQ ID NO: 77689 - RNA, 22 nt, Human
uucauccucuuuaucuaccugu

SEQ ID NO: 77690 - RNA, 22 nt, Human
uucauggauuugugaaauuuag

SEQ ID NO: 77691 - RNA, 22 nt, Human
uucaugucuuugauucugauaa

SEQ ID NO: 77692 - RNA, 22 nt, Human
uucauuauuaauaauagcagcu

SEQ ID NO: 77693 - RNA, 22 nt, Human
uucauugcuacuuaaaauacca

SEQ ID NO: 77694 - RNA, 22 nt, Human
uucauuagcacauuuccuuggu

SEQ ID NO: 77695 - RNA, 22 nt, Human
uggcgacuggaauuaaucuuuu

SEQ ID NO: 77696 - RNA, 22 nt, Human
uucauuuccauuuuauagauaa

SEQ ID NO: 77697 - RNA, 22 nt, Human
uuccagauguuuaaguucugcu

SEQ ID NO: 77698 - RNA, 22 nt, Human
uuccaggacuggguguuugaag

SEQ ID NO: 77699 - RNA, 22 nt, Human
uggcuucugguuuauccuuaua

SEQ ID NO: 77700 - RNA, 22 nt, Human
uuccauuccauaucagguacag

SEQ ID NO: 77701 - RNA, 22 nt, Human
uuccccaugugaugcuauugcu

SEQ ID NO: 77702 - RNA, 22 nt, Human
ugggauauagaauuggcagagu

SEQ ID NO: 77703 - RNA, 23 nt, Human
ugggagcuauguuuggaaugggg

SEQ ID NO: 77704 - RNA, 22 nt, Human
ugggcaguccagcuggaaacgg

SEQ ID NO: 77705 - RNA, 19 nt, Human
uuccucaggugugaguuag

SEQ ID NO: 77706 - RNA, 22 nt, Human
ugggcacacugaaucugcuauu

SEQ ID NO: 77707 - RNA, 22 nt, Human
ugggauucugaaaauggauuac

SEQ ID NO: 77708 - RNA, 22 nt, Human
uuccuuuuuaauuaaucuaauu

SEQ ID NO: 77709 - RNA, 22 nt, Human
uggggaagaacuugccauuuca

SEQ ID NO: 77710 - RNA, 22 nt, Human
uggggacucacugacuaucuug

SEQ ID NO: 77711 - RNA, 22 nt, Human
uggggagucccaacgguggaag

SEQ ID NO: 77712 - RNA, 22 nt, Human
uucuaagaaauggaaaacgauu

SEQ ID NO: 77713 - RNA, 22 nt, Human
ugggggcacccagccgaugagg

SEQ ID NO: 77714 - RNA, 18 nt, Human
uucucucuggauaguagu

SEQ ID NO: 77715 - RNA, 22 nt, Human
uucucuggggacugucucuauu

SEQ ID NO: 77716 - RNA, 22 nt, Human
uucuagacaauugaaaacuguu

SEQ ID NO: 77717 - RNA, 18 nt, Human
uucuagaggucucaucca

SEQ ID NO: 77718 - RNA, 22 nt, Human
uucuaggagucugguuccugcc

SEQ ID NO: 77719 - RNA, 22 nt, Human
ugucuucauuccccaugaaguc

SEQ ID NO: 77720 - RNA, 22 nt, Human
ugucuucuuuucccuuagcccu

SEQ ID NO: 77721 - RNA, 22 nt, Human
ugcagaacacaguagacagaac

SEQ ID NO: 77722 - RNA, 22 nt, Human
ugugcaguauugaaauauaugu

SEQ ID NO: 77723 - RNA, 22 nt, Human
ugugccuucuucauuuaauuua

SEQ ID NO: 77724 - RNA, 22 nt, Human
ugugcgucuguguacagaugug

SEQ ID NO: 77725 - RNA, 21 nt, Human
uguggccauuugaaaacaggg

SEQ ID NO: 77726 - RNA, 22 nt, Human
ugcauuaguaaagagaggaggg

SEQ ID NO: 77727 - RNA, 22 nt, Human
ugcauugccucuauucauuaua

SEQ ID NO: 77728 - RNA, 22 nt, Human
ugugggaucauggaucagggcc

SEQ ID NO: 77729 - RNA, 22 nt, Human
ugccaucuuugccccuauuuua

SEQ ID NO: 77730 - RNA, 22 nt, Human
ugccauuggucuuaaggcuagc

SEQ ID NO: 77731 - RNA, 22 nt, Human
ugcauucugaacguaaauguga

SEQ ID NO: 77732 - RNA, 22 nt, Human
ugcauuugcaauggguacacaa

SEQ ID NO: 77733 - RNA, 22 nt, Human
ugcauuuugaaggaaaaaaaug

SEQ ID NO: 77734 - RNA, 22 nt, Human
uguggucuccucucugucuucc

SEQ ID NO: 77735 - RNA, 22 nt, Human
ugugguagagcuuaaaugaggu

SEQ ID NO: 77736 - RNA, 22 nt, Human
ugccucucucugucauuaugcu

SEQ ID NO: 77737 - RNA, 22 nt, Human
ugccuacuuuaguacuuuaaag

SEQ ID NO: 77738 - RNA, 22 nt, Human
uguguuuaaacuauaugccugc

SEQ ID NO: 77739 - RNA, 21 nt, Human
uguguuuauauguguuuauau

SEQ ID NO: 77740 - RNA, 22 nt, Human
uguguuucggauagcagauucu

SEQ ID NO: 77741 - RNA, 22 nt, Human
uguguuucucugaggggucccu

SEQ ID NO: 77742 - RNA, 22 nt, Human
uguuaaaaagucccuguuuugu

SEQ ID NO: 77743 - RNA, 22 nt, Human
ugccuuuuguguuuggcuaauc

SEQ ID NO: 77744 - RNA, 22 nt, Human
ugccuuuggcuguucugugacc

SEQ ID NO: 77745 - RNA, 22 nt, Human
uguuccucuuagucuuaugugu

SEQ ID NO: 77746 - RNA, 22 nt, Human
uguuacugaaugucucugcuuu

SEQ ID NO: 77747 - RNA, 21 nt, Human
uguugcuugucugagacuaug

SEQ ID NO: 77748 - RNA, 19 nt, Human
uguugcagcuugaucggua

SEQ ID NO: 77749 - RNA, 23 nt, Human
uguuccugaugccucguccuguc

SEQ ID NO: 77750 - RNA, 22 nt, Human
uguuccuggggaccugccuucc

SEQ ID NO: 77751 - RNA, 22 nt, Human
uguucuuaacuuuuguguauau

SEQ ID NO: 77752 - RNA, 22 nt, Human
uguucugaggaggguuucaagg

SEQ ID NO: 77753 - RNA, 22 nt, Human
uguucuucaaacucaguuccac

SEQ ID NO: 77754 - RNA, 22 nt, Human
ugacauuugagagagauauaca

SEQ ID NO: 77755 - RNA, 22 nt, Human
uggguagcucaauagagccaca

SEQ ID NO: 77756 - RNA, 22 nt, Human
uggugaggacccagauuuuccu

SEQ ID NO: 77757 - RNA, 22 nt, Human
ugggggauucaucucagagcgu

SEQ ID NO: 77758 - RNA, 22 nt, Human
uggugcaggauuuauuuaacua

SEQ ID NO: 77759 - RNA, 22 nt, Human
ugaggagggcuagagucuccug

SEQ ID NO: 77760 - RNA, 22 nt, Human
ugagcuauuucaccauauagau

SEQ ID NO: 77761 - RNA, 22 nt, Human
ugagcuuugguaccuucauuug

SEQ ID NO: 77762 - RNA, 22 nt, Human
ugaggaagugguuguaugguuu

SEQ ID NO: 77763 - RNA, 22 nt, Human
ugaggaaugugacaaaaccaag

SEQ ID NO: 77764 - RNA, 22 nt, Human
ugguggaggugggggguauuuu

SEQ ID NO: 77765 - RNA, 22 nt, Human
ugaggcuuucacuuggcaaaga

SEQ ID NO: 77766 - RNA, 22 nt, Human
ugguggagucugggggaggcuu

SEQ ID NO: 77767 - RNA, 22 nt, Human
ugagggaugccucuccuuccgg

SEQ ID NO: 77768 - RNA, 19 nt, Human
ugguggaggugcaccugac

SEQ ID NO: 77769 - RNA, 19 nt, Human
ugaggauugagguccagua

SEQ ID NO: 77770 - RNA, 22 nt, Human
uggugccuuccgagagcuguga

SEQ ID NO: 77771 - RNA, 23 nt, Human
ugaggucuuggaaguucuguuug

SEQ ID NO: 77772 - RNA, 23 nt, Human
uggugugaggaaggaagacuuua

SEQ ID NO: 77773 - RNA, 22 nt, Human
ugaguucugacugagcaugggg

SEQ ID NO: 77774 - RNA, 22 nt, Human
uguaaagaaagacgcagaguua

SEQ ID NO: 77775 - RNA, 22 nt, Human
uguaagaagaaaaccguaugga

SEQ ID NO: 77776 - RNA, 22 nt, Human
uguaaagguuuuagagcagaga

SEQ ID NO: 77777 - RNA, 22 nt, Human
uguaaagugguauuuaauuuua

SEQ ID NO: 77778 - RNA, 22 nt, Human
uguacagauaucaggagugagg

SEQ ID NO: 77779 - RNA, 22 nt, Human
ugaugaugccaaaauuuggcau

SEQ ID NO: 77780 - RNA, 22 nt, Human
uguaauuugguuagauuucuuu

SEQ ID NO: 77781 - RNA, 22 nt, Human
ugauguaaaauaggaaguucua

SEQ ID NO: 77782 - RNA, 22 nt, Human
uguagcaauauaucagugcaca

SEQ ID NO: 77783 - RNA, 22 nt, Human
uguagggaucugccucuuccuc

SEQ ID NO: 77784 - RNA, 22 nt, Human
uguagaccaaaccuucuaaacu

SEQ ID NO: 77785 - RNA, 22 nt, Human
uguaggcacauguauauauccc

SEQ ID NO: 77786 - RNA, 22 nt, Human
ugauguaggacauuauuauuuc

SEQ ID NO: 77787 - RNA, 22 nt, Human
ugaugugugaauucuuaaaugu

SEQ ID NO: 77788 - RNA, 22 nt, Human
uguauauuuucuguauaaaaua

SEQ ID NO: 77789 - RNA, 22 nt, Human
uguaucuguguguauguguuua

SEQ ID NO: 77790 - RNA, 22 nt, Human
uguauggguaggaaacagcugg

SEQ ID NO: 77791 - RNA, 22 nt, Human
uguauugugggugucagagugc

SEQ ID NO: 77792 - RNA, 22 nt, Human
ugcaaggcacccacucugcuuu

SEQ ID NO: 77793 - RNA, 22 nt, Human
ugcacauuucucacaauguaca

SEQ ID NO: 77794 - RNA, 22 nt, Human
ugcaaauucuuuacucugugau

SEQ ID NO: 77795 - RNA, 23 nt, Human
ugcaaaauuugcagaguucgaug

SEQ ID NO: 77796 - RNA, 21 nt, Human
ugcaacugaaaggaauauggu

SEQ ID NO: 77797 - RNA, 22 nt, Human
ugcaagagcccaaacuauauac

SEQ ID NO: 77798 - RNA, 22 nt, Human
ugcaagauccagucuugagaag

SEQ ID NO: 77799 - RNA, 22 nt, Human
ugcaaaaguuuuauacacagau

SEQ ID NO: 77800 - RNA, 22 nt, Human
uguauuuuuucccugaaauaaa

SEQ ID NO: 77801 - RNA, 22 nt, Human
uguauuugaagaaagagcuucu

SEQ ID NO: 77802 - RNA, 22 nt, Human
ugauugaauaauguuaugugaa

SEQ ID NO: 77803 - RNA, 19 nt, Human
uguauuuauauuucugugc

SEQ ID NO: 77804 - RNA, 22 nt, Human
uguauuuauuuuucaacuacca

SEQ ID NO: 77805 - RNA, 18 nt, Human
uguauuguucacuucugu

SEQ ID NO: 77806 - RNA, 22 nt, Human
ugaaauguggagaugguaagua

SEQ ID NO: 77807 - RNA, 22 nt, Human
ugaaauuuuuuggagauaauuu

SEQ ID NO: 77808 - RNA, 22 nt, Human
ugaaauugaguaccucuuuaua

SEQ ID NO: 77809 - RNA, 22 nt, Human
uggcuucagacuucugcuacgu

SEQ ID NO: 77810 - RNA, 22 nt, Human
uggcuucuggccaggcacagga

SEQ ID NO: 77811 - RNA, 22 nt, Human
uggcuugacaucaauacuuauu

SEQ ID NO: 77812 - RNA, 17 nt, Human
ucuuuuacuuucucucc

SEQ ID NO: 77813 - RNA, 22 nt, Human
ucuuuucagccagcugguagga

SEQ ID NO: 77814 - RNA, 22 nt, Human
ucuuuguuagucagaauugauc

SEQ ID NO: 77815 - RNA, 23 nt, Human
uggcucugagcuuccugguggcc

SEQ ID NO: 77816 - RNA, 22 nt, Human
ucuuuugaacauccaggauguc

SEQ ID NO: 77817 - RNA, 22 nt, Human
uggcucuucucaagcauuggcu

SEQ ID NO: 77818 - RNA, 22 nt, Human
ugggaaaauugugauucuuucu

SEQ ID NO: 77819 - RNA, 22 nt, Human
uggcuuuuuauuccuaugugau

SEQ ID NO: 77820 - RNA, 22 nt, Human
ugggaagaguuagagacagcug

SEQ ID NO: 77821 - RNA, 22 nt, Human
ugggaaacucuaaacuugagua

SEQ ID NO: 77822 - RNA, 22 nt, Human
ugaacuuacauugaggaauucu

SEQ ID NO: 77823 - RNA, 22 nt, Human
ugaacuguccuuguugucuaga

SEQ ID NO: 77824 - RNA, 21 nt, Human
ugaagcccugugaggugcuua

SEQ ID NO: 77825 - RNA, 22 nt, Human
ugggaugagcuauauagaaagu

SEQ ID NO: 77826 - RNA, 22 nt, Human
ugaagacuucuuuuggucacca

SEQ ID NO: 77827 - RNA, 22 nt, Human
ugaagccacacuagcuuguccu

SEQ ID NO: 77828 - RNA, 22 nt, Human
ugaagacaguuuuacucaugag

SEQ ID NO: 77829 - RNA, 22 nt, Human
ugaacuucccauguacagacug

SEQ ID NO: 77830 - RNA, 22 nt, Human
ugggagagauaggcuucuggac

SEQ ID NO: 77831 - RNA, 22 nt, Human
ugggauggacuuuagagaaucg

SEQ ID NO: 77832 - RNA, 22 nt, Human
ugaagguggcuugcagcuaguc

SEQ ID NO: 77833 - RNA, 22 nt, Human
ugggcagagggugaggaaggcg

SEQ ID NO: 77834 - RNA, 22 nt, Human
ugggcccaucauugcugugggc

SEQ ID NO: 77835 - RNA, 22 nt, Human
ugaauagcaccuugaguaauga

SEQ ID NO: 77836 - RNA, 22 nt, Human
ugaaucuuguuuacugauuccu

SEQ ID NO: 77837 - RNA, 22 nt, Human
ugaaugcuacccugcuggcucu

SEQ ID NO: 77838 - RNA, 18 nt, Human
ugggggacgcuuuuuuuc

SEQ ID NO: 77839 - RNA, 22 nt, Human
uggggcuuggcucacagaagcu

SEQ ID NO: 77840 - RNA, 22 nt, Human
ugaauuucuuuuuaaaauauua

SEQ ID NO: 77841 - RNA, 22 nt, Human
ugaauuuguaggaauucuccau

SEQ ID NO: 77842 - RNA, 22 nt, Human
ugaauuuuaacauucugcugga

SEQ ID NO: 77843 - RNA, 22 nt, Human
ugaauuagagugaaggaaagcu

SEQ ID NO: 77844 - RNA, 22 nt, Human
uggagucuugcuuugggagugc

SEQ ID NO: 77845 - RNA, 22 nt, Human
uggagggaagcaaacacuagau

SEQ ID NO: 77846 - RNA, 22 nt, Human
uggauaugaaacaaaacaagag

SEQ ID NO: 77847 - RNA, 18 nt, Human
uggcaaugccaaaggcuu

SEQ ID NO: 77848 - RNA, 22 nt, Human
ucuuauucuuuuaaacaacgca

SEQ ID NO: 77849 - RNA, 22 nt, Human
ucuuagacagagaagacuauug

SEQ ID NO: 77850 - RNA, 22 nt, Human
ucuuaaucauucuucacuuccu

SEQ ID NO: 77851 - RNA, 22 nt, Human
ucuucuuugugguugcccaagg

SEQ ID NO: 77852 - RNA, 22 nt, Human
ucuugauggugauguuguguca

SEQ ID NO: 77853 - RNA, 22 nt, Human
ucuugccccugcuuuggaacaa

SEQ ID NO: 77854 - RNA, 22 nt, Human
uggccauuuacucuguaagagu

SEQ ID NO: 77855 - RNA, 22 nt, Human
ucuuggggagacuaguguuugg

SEQ ID NO: 77856 - RNA, 22 nt, Human
ucuuguuaaagguuaaagguga

SEQ ID NO: 77857 - RNA, 22 nt, Human
ucuuuccagaccagccccagcu

SEQ ID NO: 77858 - RNA, 22 nt, Human
uggaaagauuuaaaauaacgag

SEQ ID NO: 77859 - RNA, 22 nt, Human
ucuacugagugcugagauuuug

SEQ ID NO: 77860 - RNA, 19 nt, Human
ugcugcaggaauucucaag

SEQ ID NO: 77861 - RNA, 22 nt, Human
uggaaauacaagaaguauguca

SEQ ID NO: 77862 - RNA, 22 nt, Human
uggaaauaguugugagucaggc

SEQ ID NO: 77863 - RNA, 22 nt, Human
ucugcuuuucuuaaggggauca

SEQ ID NO: 77864 - RNA, 22 nt, Human
uggaagaagcuacaagcgguga

SEQ ID NO: 77865 - RNA, 21 nt, Human
uggagcagggaggauuugggg

SEQ ID NO: 77866 - RNA, 22 nt, Human
uggagaugcacgagcaggugga

SEQ ID NO: 77867 - RNA, 22 nt, Human
uggagagcaaugaggggcaggc

SEQ ID NO: 77868 - RNA, 22 nt, Human
uggagccuugugagaccacaau

SEQ ID NO: 77869 - RNA, 22 nt, Human
uggaggaugacagagaugggcu

SEQ ID NO: 77870 - RNA, 22 nt, Human
uggaggauaacacaagaaguga

SEQ ID NO: 77871 - RNA, 22 nt, Human
uggaggauggaaggaaagcugg

SEQ ID NO: 77872 - RNA, 20 nt, Human
ucugugugccaucaccuaac

SEQ ID NO: 77873 - RNA, 22 nt, Human
uggaggagaacugauuuggcuu

SEQ ID NO: 77874 - RNA, 22 nt, Human
uggaagaucugguguagcuccu

SEQ ID NO: 77875 - RNA, 22 nt, Human
uggaaggaaauguguaucauaa

SEQ ID NO: 77876 - RNA, 22 nt, Human
uggaaugaaagaaaaauuguag

SEQ ID NO: 77877 - RNA, 21 nt, Human
uggaauuggaaaccauucuau

SEQ ID NO: 77878 - RNA, 22 nt, Human
uggacacugguggauauggaau

SEQ ID NO: 77879 - RNA, 22 nt, Human
uggagagaaguucuauaaauca

SEQ ID NO: 77880 - RNA, 22 nt, Human
ucgaugcuggcgcagguuucac

SEQ ID NO: 77881 - RNA, 23 nt, Human
ugcuaaaggcagaauauucaccu

SEQ ID NO: 77882 - RNA, 22 nt, Human
ugcuauuaagagaaagugaaca

SEQ ID NO: 77883 - RNA, 20 nt, Human
ugcuaucugcucucccuucu

SEQ ID NO: 77884 - RNA, 22 nt, Human
ugcuaguuuuugauacuuuugc

SEQ ID NO: 77885 - RNA, 22 nt, Human
ugcuaaugaauggaggaucuga

SEQ ID NO: 77886 - RNA, 22 nt, Human
ugcuaaugagugcugugugaag

SEQ ID NO: 77887 - RNA, 22 nt, Human
ugcuauuuuguuuucaguccau

SEQ ID NO: 77888 - RNA, 22 nt, Human
ugcuccguucuucugcuucuug

SEQ ID NO: 77889 - RNA, 22 nt, Human
ucguauaguugcugcagauggu

SEQ ID NO: 77890 - RNA, 22 nt, Human
ucuaaaaauuagaaauuagguc

SEQ ID NO: 77891 - RNA, 22 nt, Human
ucuaaagcuccuuccacuaaaa

SEQ ID NO: 77892 - RNA, 22 nt, Human
ucuaaaugaccuccuugcccag

SEQ ID NO: 77893 - RNA, 22 nt, Human
ucguuucuuuuucuucccugga

SEQ ID NO: 77894 - RNA, 22 nt, Human
ucguggaugaagaauagaggcc

SEQ ID NO: 77895 - RNA, 20 nt, Human
ucuaaugaagugagcuuagc

SEQ ID NO: 77896 - RNA, 22 nt, Human
ugcagcuuuugguuucuagaug

SEQ ID NO: 77897 - RNA, 22 nt, Human
ucccuucagcuccagcucugcu

SEQ ID NO: 77898 - RNA, 22 nt, Human
ucccuucccaccccugccuuuu

SEQ ID NO: 77899 - RNA, 22 nt, Human
ucccuuuuuccugaucugugaa

SEQ ID NO: 77900 - RNA, 22 nt, Human
ugcaugacugaucuguuuguca

SEQ ID NO: 77901 - RNA, 23 nt, Human
ugcaugagcaucuccaccucagu

SEQ ID NO: 77902 - RNA, 22 nt, Human
ugcauguuucuguauguuaaug

SEQ ID NO: 77903 - RNA, 21 nt, Human
uccuaaaggaaauacucaauu

SEQ ID NO: 77904 - RNA, 22 nt, Human
ugcauuccagcucccuucuggc

SEQ ID NO: 77905 - RNA, 22 nt, Human
ugcauugccauagcagggggau

SEQ ID NO: 77906 - RNA, 22 nt, Human
ugcauucugggucgcagagugg

SEQ ID NO: 77907 - RNA, 22 nt, Human
uccucagcaagacgcuggcagc

SEQ ID NO: 77908 - RNA, 23 nt, Human
ugccaggaagaaugaccucugcu

SEQ ID NO: 77909 - RNA, 22 nt, Human
ugccaugguuguacaguagcag

SEQ ID NO: 77910 - RNA, 22 nt, Human
uccucuucucuagagccggaau

SEQ ID NO: 77911 - RNA, 22 nt, Human
uccugagaagcacuuaauacac

SEQ ID NO: 77912 - RNA, 22 nt, Human
uccugaaggccugaguuccacc

SEQ ID NO: 77913 - RNA, 22 nt, Human
uccuuaggaccuagagguagua

SEQ ID NO: 77914 - RNA, 22 nt, Human
uccuuacuccuggagauucuga

SEQ ID NO: 77915 - RNA, 22 nt, Human
uccugguaaagaguaucagauu

SEQ ID NO: 77916 - RNA, 22 nt, Human
uccuuuucuuugaggaaggugu

SEQ ID NO: 77917 - RNA, 22 nt, Human
uccuuuuuagguuauuguacau

SEQ ID NO: 77918 - RNA, 22 nt, Human
uccuucuguuguuuauuuuaaa

SEQ ID NO: 77919 - RNA, 22 nt, Human
uccuucuuuucgccggaguuga

SEQ ID NO: 77920 - RNA, 22 nt, Human
uccuucucagggagacuugaua

SEQ ID NO: 77921 - RNA, 19 nt, Human
ugaguacuaaugagauuga

SEQ ID NO: 77922 - RNA, 22 nt, Human
ugagggucgcaagcaccaggcc

SEQ ID NO: 77923 - RNA, 22 nt, Human
ugagaaaacaguuuguaauaau

SEQ ID NO: 77924 - RNA, 22 nt, Human
ugaguuuuggaagauguuacag

SEQ ID NO: 77925 - RNA, 22 nt, Human
ugaguuuaggccaggauauggu

SEQ ID NO: 77926 - RNA, 22 nt, Human
ugaguugucacaacgucacaag

SEQ ID NO: 77927 - RNA, 22 nt, Human
ucauaucauuuugaaagcugag

SEQ ID NO: 77928 - RNA, 22 nt, Human
ucauaggaguagcagugagagg

SEQ ID NO: 77929 - RNA, 21 nt, Human
ugagucuuagagaacuucagg

SEQ ID NO: 77930 - RNA, 22 nt, Human
ugaguguuguaaccauaugauu

SEQ ID NO: 77931 - RNA, 22 nt, Human
ucauuguuucugcuuuucauga

SEQ ID NO: 77932 - RNA, 22 nt, Human
ucauuggagcauaugaugguua

SEQ ID NO: 77933 - RNA, 21 nt, Human
uccaaaggagacugagugugu

SEQ ID NO: 77934 - RNA, 22 nt, Human
ugaucuuugcuuuuggcuuagu

SEQ ID NO: 77935 - RNA, 22 nt, Human
ugauggaguauaauaaaaugac

SEQ ID NO: 77936 - RNA, 22 nt, Human
uccaccacgaaacugcagcugc

SEQ ID NO: 77937 - RNA, 22 nt, Human
uccaccugucccugcuuccugc

SEQ ID NO: 77938 - RNA, 22 nt, Human
uccagacucaaaaaccagaugg

SEQ ID NO: 77939 - RNA, 22 nt, Human
ugauuuggcaucaguguauccu

SEQ ID NO: 77940 - RNA, 22 nt, Human
uccagagcuguccuacugugag

SEQ ID NO: 77941 - RNA, 22 nt, Human
ugauuugauuuguuuaugccug

SEQ ID NO: 77942 - RNA, 22 nt, Human
uccagugaacaucauggcucca

SEQ ID NO: 77943 - RNA, 22 nt, Human
ugcaaaaagagcgaggagcccu

SEQ ID NO: 77944 - RNA, 18 nt, Human
uccauccucugcucuuca

SEQ ID NO: 77945 - RNA, 22 nt, Human
uccaucauucagaaauuuuuga

SEQ ID NO: 77946 - RNA, 22 nt, Human
ugcagagagccagcucucucgg

SEQ ID NO: 77947 - RNA, 22 nt, Human
ugcagaggagcuggaaggcugg

SEQ ID NO: 77948 - RNA, 22 nt, Human
ugcagaauauucuggugacaau

SEQ ID NO: 77949 - RNA, 22 nt, Human
ucccagaaauccaggcuuaaau

SEQ ID NO: 77950 - RNA, 22 nt, Human
ugcagccucacgcauccgcauu

SEQ ID NO: 77951 - RNA, 22 nt, Human
ugcagccuuuguccuugggcua

SEQ ID NO: 77952 - RNA, 22 nt, Human
ugcagcagaauauggcugcagg

SEQ ID NO: 77953 - RNA, 22 nt, Human
ugcagcaucuccuugugccaug

SEQ ID NO: 77954 - RNA, 17 nt, Human
uccauugagacaagaag

SEQ ID NO: 77955 - RNA, 21 nt, Human
uccauucuuggugguucugca

SEQ ID NO: 77956 - RNA, 22 nt, Human
ucccaaaacuugaagcaagccu

SEQ ID NO: 77957 - RNA, 22 nt, Human
uccauguagggagggcuuucaa

SEQ ID NO: 77958 - RNA, 22 nt, Human
uccauguugauaaucuugugaa

SEQ ID NO: 77959 - RNA, 19 nt, Human
ugcaagcuuuuucuuguua

SEQ ID NO: 77960 - RNA, 22 nt, Human
uagucucagaauauuugcugau

SEQ ID NO: 77961 - RNA, 22 nt, Human
ucuaaugcuuccucucauccca

SEQ ID NO: 77962 - RNA, 22 nt, Human
ucuaaucuacaaaaggaaauuc

SEQ ID NO: 77963 - RNA, 22 nt, Human
ucuacgugacagaacagacuga

SEQ ID NO: 77964 - RNA, 22 nt, Human
ucuuccagauacuuccugacuu

SEQ ID NO: 77965 - RNA, 22 nt, Human
ucuuccauuccccuccuacgcc

SEQ ID NO: 77966 - RNA, 22 nt, Human
ucuagagaauuuggaaauuaag

SEQ ID NO: 77967 - RNA, 22 nt, Human
ucuuccuuguaagggcuuuaga

SEQ ID NO: 77968 - RNA, 22 nt, Human
uauugucuuuuucuuccaccug

SEQ ID NO: 77969 - RNA, 22 nt, Human
ucuucuuauuuuaugaucgcuu

SEQ ID NO: 77970 - RNA, 22 nt, Human
ucuucuuuccuuuugugcauuu

SEQ ID NO: 77971 - RNA, 19 nt, Human
ucuugaggaaaguaaggca

SEQ ID NO: 77972 - RNA, 19 nt, Human
ucuugcaucuuccuacugu

SEQ ID NO: 77973 - RNA, 22 nt, Human
ucuugcuguagcuguuucuucu

SEQ ID NO: 77974 - RNA, 22 nt, Human
ucuugcuggagucaaggcuaca

SEQ ID NO: 77975 - RNA, 22 nt, Human
ucuucuguguguagugguugug

SEQ ID NO: 77976 - RNA, 22 nt, Human
ucuucuauaucuacauaugcaa

SEQ ID NO: 77977 - RNA, 22 nt, Human
ucuucuuaggaaagucaggagg

SEQ ID NO: 77978 - RNA, 22 nt, Human
uauucuucagcauaaaaauucu

SEQ ID NO: 77979 - RNA, 22 nt, Human
uauuggcucagucagaaguuuu

SEQ ID NO: 77980 - RNA, 22 nt, Human
uauugguagauggagagagaca

SEQ ID NO: 77981 - RNA, 20 nt, Human
ucuugucuggcagccuggag

SEQ ID NO: 77982 - RNA, 22 nt, Human
ucuugugagcugagauaaagcc

SEQ ID NO: 77983 - RNA, 22 nt, Human
ucuugcuguggcagaucuggag

SEQ ID NO: 77984 - RNA, 22 nt, Human
ucuuggcaguucuugugcuuuu

SEQ ID NO: 77985 - RNA, 22 nt, Human
ucuugcucuguucuaaaggauu

SEQ ID NO: 77986 - RNA, 22 nt, Human
ucuuuaaauucuuaugagugaa

SEQ ID NO: 77987 - RNA, 22 nt, Human
ucuuuaagugugugccuccagg

SEQ ID NO: 77988 - RNA, 19 nt, Human
ucuuucauuucuagcucug

SEQ ID NO: 77989 - RNA, 22 nt, Human
ucuuuauuucccuaacuugcua

SEQ ID NO: 77990 - RNA, 23 nt, Human
ucuuuccuuucauacagucagcu

SEQ ID NO: 77991 - RNA, 22 nt, Human
ucuuucucauccaaacuaguug

SEQ ID NO: 77992 - RNA, 19 nt, Human
ucuuugcuuuucuaagagg

SEQ ID NO: 77993 - RNA, 22 nt, Human
ucuuugcauggacauguguuuu

SEQ ID NO: 77994 - RNA, 22 nt, Human
ucuuugcugacacuuacacugu

SEQ ID NO: 77995 - RNA, 22 nt, Human
uauuuaggcagaaagugauauu

SEQ ID NO: 77996 - RNA, 22 nt, Human
uauuuaugcaucacuuuuuucc

SEQ ID NO: 77997 - RNA, 20 nt, Human
uauuucaaugugccaaguuu

SEQ ID NO: 77998 - RNA, 22 nt, Human
uauuuacuuugaggaaguuguu

SEQ ID NO: 77999 - RNA, 22 nt, Human
ucuuucugaugggaagggucaa

SEQ ID NO: 78000 - RNA, 22 nt, Human
ucuuugcagaauuuaacuuugc

SEQ ID NO: 78001 - RNA, 22 nt, Human
uauuguuuuaagguguauuaau

SEQ ID NO: 78002 - RNA, 22 nt, Human
uauugugaaggccaugugcuaa

SEQ ID NO: 78003 - RNA, 22 nt, Human
ucuuuuaucuguuguguaacaa

SEQ ID NO: 78004 - RNA, 22 nt, Human
ucuuuugugauuuucugaagca

SEQ ID NO: 78005 - RNA, 22 nt, Human
uauuucuagggcaugaaaauaa

SEQ ID NO: 78006 - RNA, 22 nt, Human
uauuuuaaaagcauuaauucuu

SEQ ID NO: 78007 - RNA, 22 nt, Human
uauuuguauugucuuaucacuu

SEQ ID NO: 78008 - RNA, 22 nt, Human
ucuuuuuaugucaaaaucgaug

SEQ ID NO: 78009 - RNA, 22 nt, Human
ugaaaaauauuuuuagaaauaa

SEQ ID NO: 78010 - RNA, 23 nt, Human
uauuuuccccuguaauauguauu

SEQ ID NO: 78011 - RNA, 22 nt, Human
uauuuuauuuagguuuaguugu

SEQ ID NO: 78012 - RNA, 22 nt, Human
uauuuuagaagauuuggagaaa

SEQ ID NO: 78013 - RNA, 22 nt, Human
ugaaaggaauuuaaauguuguu

SEQ ID NO: 78014 - RNA, 22 nt, Human
ugaaagcuggcucugcagagug

SEQ ID NO: 78015 - RNA, 22 nt, Human
ugaaaaaugcuuuaaugcaugu

SEQ ID NO: 78016 - RNA, 22 nt, Human
ugaaccuaacauuucuggcagu

SEQ ID NO: 78017 - RNA, 22 nt, Human
ugaagaauuccauggcuuccau

SEQ ID NO: 78018 - RNA, 22 nt, Human
uauuuuuacuguuugaugauuc

SEQ ID NO: 78019 - RNA, 22 nt, Human
ucaaaggcuugugguucuggga

SEQ ID NO: 78020 - RNA, 22 nt, Human
ucaaagaucuuugcuuuugggg

SEQ ID NO: 78021 - RNA, 22 nt, Human
ucaagaagauaaugucuagggu

SEQ ID NO: 78022 - RNA, 22 nt, Human
ucaagagauauaugcugguuua

SEQ ID NO: 78023 - RNA, 22 nt, Human
ucaagcaaggaauccuuuugua

SEQ ID NO: 78024 - RNA, 22 nt, Human
ugaagcuaguauuaacucagau

SEQ ID NO: 78025 - RNA, 22 nt, Human
ugaagcuagguucaugaggucg

SEQ ID NO: 78026 - RNA, 22 nt, Human
ugaaggaggugaauccaugcau

SEQ ID NO: 78027 - RNA, 22 nt, Human
ugaauaaauaaacuuuuacuac

SEQ ID NO: 78028 - RNA, 22 nt, Human
ugaaguuuagaaaaagugccuu

SEQ ID NO: 78029 - RNA, 23 nt, Human
ugaagugaaauuucacaagggac

SEQ ID NO: 78030 - RNA, 22 nt, Human
ucaaccucccugcucaccccuc

SEQ ID NO: 78031 - RNA, 23 nt, Human
ucacaaggcuauguuauauguac

SEQ ID NO: 78032 - RNA, 22 nt, Human
ugaaugaagcacuguaauucuc

SEQ ID NO: 78033 - RNA, 22 nt, Human
ugaaugaacugaugaacuuaac

SEQ ID NO: 78034 - RNA, 22 nt, Human
ugaaucugagccugcgcaaagu

SEQ ID NO: 78035 - RNA, 22 nt, Human
ugaaucaaugaauugcacuuca

SEQ ID NO: 78036 - RNA, 22 nt, Human
ucaagggaccaagcauucauua

SEQ ID NO: 78037 - RNA, 22 nt, Human
ugaauaaucuuggguauuaaua

SEQ ID NO: 78038 - RNA, 22 nt, Human
ucaagguauuauuuuuguggug

SEQ ID NO: 78039 - RNA, 22 nt, Human
ucaagucaauagguuaguaggu

SEQ ID NO: 78040 - RNA, 22 nt, Human
ucaauuggcuacaaauaaugua

SEQ ID NO: 78041 - RNA, 22 nt, Human
ugaauguguacacgauuguuug

SEQ ID NO: 78042 - RNA, 22 nt, Human
ugaauguggucaggaaauuguu

SEQ ID NO: 78043 - RNA, 22 nt, Human
ugaauuacacugggaucagggc

SEQ ID NO: 78044 - RNA, 22 nt, Human
ugaauuauaugguauugaacau

SEQ ID NO: 78045 - RNA, 22 nt, Human
ucacaguucaacuaguucagau

SEQ ID NO: 78046 - RNA, 22 nt, Human
ucacaggagucaaggaauagua

SEQ ID NO: 78047 - RNA, 22 nt, Human
ugaaucagaccuucauugggua

SEQ ID NO: 78048 - RNA, 22 nt, Human
ucacugaauuucaagcuagugg

SEQ ID NO: 78049 - RNA, 22 nt, Human
ugaauucaaacuuuuuaacaag

SEQ ID NO: 78050 - RNA, 22 nt, Human
ucacucagucugagcaauugcu

SEQ ID NO: 78051 - RNA, 22 nt, Human
ucacuaugcccagaauacaguu

SEQ ID NO: 78052 - RNA, 22 nt, Human
ucaccuuuugaauugcuguugu

SEQ ID NO: 78053 - RNA, 23 nt, Human
ucacuucucuuacccucucucug

SEQ ID NO: 78054 - RNA, 22 nt, Human
ucacuucugcuccuuggaugcc

SEQ ID NO: 78055 - RNA, 22 nt, Human
ugacagaggagcuggaaugauu

SEQ ID NO: 78056 - RNA, 22 nt, Human
ugaauuuuggcaauuuucugug

SEQ ID NO: 78057 - RNA, 22 nt, Human
ugacaagagaccccuccgcagg

SEQ ID NO: 78058 - RNA, 22 nt, Human
ucacuguaggaaucucuaaauu

SEQ ID NO: 78059 - RNA, 22 nt, Human
ucagagaaguaggcuaauggug

SEQ ID NO: 78060 - RNA, 20 nt, Human
ucagaaugugacccccaugg

SEQ ID NO: 78061 - RNA, 22 nt, Human
ugacaucuagauaaaugggaca

SEQ ID NO: 78062 - RNA, 22 nt, Human
ucagaaugaaauuucuuucaga

SEQ ID NO: 78063 - RNA, 18 nt, Human
ucagaggagauaccuaaa

SEQ ID NO: 78064 - RNA, 22 nt, Human
ucagaaggagagacagcgugga

SEQ ID NO: 78065 - RNA, 21 nt, Human
ucagaaucguuccagguagau

SEQ ID NO: 78066 - RNA, 22 nt, Human
ugacagugugcccggagguuag

SEQ ID NO: 78067 - RNA, 22 nt, Human
ugacaucagacugugagaagag

SEQ ID NO: 78068 - RNA, 22 nt, Human
ucagcguuaguuuuucaucuaa

SEQ ID NO: 78069 - RNA, 22 nt, Human
ucagcucucucuuggugaucuc

SEQ ID NO: 78070 - RNA, 21 nt, Human
ucaggaagagccaguucaugc

SEQ ID NO: 78071 - RNA, 22 nt, Human
ucaggagaguguucaguggagg

SEQ ID NO: 78072 - RNA, 22 nt, Human
ugaccucaagcaugcggagggc

SEQ ID NO: 78073 - RNA, 23 nt, Human
ugaccauauauccaucagauaua

SEQ ID NO: 78074 - RNA, 22 nt, Human
ugaccuacauuuauagcuguca

SEQ ID NO: 78075 - RNA, 22 nt, Human
ucagauaauccaauagagagga

SEQ ID NO: 78076 - RNA, 22 nt, Human
uaguuucuaauguugaaauuau

SEQ ID NO: 78077 - RNA, 22 nt, Human
uaguuuuaagcugacauuguuc

SEQ ID NO: 78078 - RNA, 22 nt, Human
uaguuucuucaacugucccagc

SEQ ID NO: 78079 - RNA, 22 nt, Human
uaguuuucaagugaguuggaag

SEQ ID NO: 78080 - RNA, 22 nt, Human
uaguugguggagcgauuugucu

SEQ ID NO: 78081 - RNA, 22 nt, Human
uagcauuuagaacaccuugaga

SEQ ID NO: 78082 - RNA, 22 nt, Human
uagcauacagauauuuaacucu

SEQ ID NO: 78083 - RNA, 22 nt, Human
gugcuaugugcugaacucaggu

SEQ ID NO: 78084 - RNA, 22 nt, Human
uagcauccugugugaauguauu

SEQ ID NO: 78085 - RNA, 22 nt, Human
uagcauuucacugaucuucacu

SEQ ID NO: 78086 - RNA, 22 nt, Human
uaguuauuucugcacuuaauga

SEQ ID NO: 78087 - RNA, 22 nt, Human
uaguuacuuuugcucuucauua

SEQ ID NO: 78088 - RNA, 22 nt, Human
uauagcaagagaaccauuacca

SEQ ID NO: 78089 - RNA, 22 nt, Human
uauauaauacacaaauauguac

SEQ ID NO: 78090 - RNA, 22 nt, Human
uauauauacauauagaauaugu

SEQ ID NO: 78091 - RNA, 22 nt, Human
uauaaucuugcccauaguauuu

SEQ ID NO: 78092 - RNA, 22 nt, Human
uauacauauacaaaugcacaua

SEQ ID NO: 78093 - RNA, 22 nt, Human
uauaagaaacaaggcaaauuuu

SEQ ID NO: 78094 - RNA, 22 nt, Human
uaucaguccaggguuuugugac

SEQ ID NO: 78095 - RNA, 22 nt, Human
uauauuuguccuagcuccuagc

SEQ ID NO: 78096 - RNA, 22 nt, Human
uaucaguagaacaauggacauu

SEQ ID NO: 78097 - RNA, 22 nt, Human
uaucacauaaaugaggaauauu

SEQ ID NO: 78098 - RNA, 22 nt, Human
uauauuaaagugcuuugcagug

SEQ ID NO: 78099 - RNA, 22 nt, Human
uauaugaggauauuuuaaagcu

SEQ ID NO: 78100 - RNA, 22 nt, Human
uauauauaugcaccacaugugu

SEQ ID NO: 78101 - RNA, 23 nt, Human
uaucccauacagagagugguaca

SEQ ID NO: 78102 - RNA, 22 nt, Human
uauccuaaaggguaguguggga

SEQ ID NO: 78103 - RNA, 22 nt, Human
uaucuccauucuagccccuugu

SEQ ID NO: 78104 - RNA, 22 nt, Human
uaucugcuggagguaauuacuc

SEQ ID NO: 78105 - RNA, 22 nt, Human
uaugaauauaccacaauuuagg

SEQ ID NO: 78106 - RNA, 22 nt, Human
uaugaccuuaggaagcaagaag

SEQ ID NO: 78107 - RNA, 22 nt, Human
uaugagguuaucuaugucguau

SEQ ID NO: 78108 - RNA, 22 nt, Human
gugugguguuaagcaaauuaau

SEQ ID NO: 78109 - RNA, 22 nt, Human
uaugaucuuaggauggaacuuc

SEQ ID NO: 78110 - RNA, 22 nt, Human
uauuuugaggugaaagaguuug

SEQ ID NO: 78111 - RNA, 22 nt, Human
uauuuuggaugcauugagaugc

SEQ ID NO: 78112 - RNA, 22 nt, Human
uauuuuggcuccugagcucuga

SEQ ID NO: 78113 - RNA, 22 nt, Human
guugaacagucacccugggagu

SEQ ID NO: 78114 - RNA, 22 nt, Human
guugagaagaccauuuuguuca

SEQ ID NO: 78115 - RNA, 22 nt, Human
guugagaaucucuagcuuagga

SEQ ID NO: 78116 - RNA, 22 nt, Human
guugauuuaaccucaccuuuga

SEQ ID NO: 78117 - RNA, 22 nt, Human
uauuucaugagugaauaucuag

SEQ ID NO: 78118 - RNA, 22 nt, Human
uauuucaucugaacuucccaac

SEQ ID NO: 78119 - RNA, 22 nt, Human
uauuugauggaacucuugcuuu

SEQ ID NO: 78120 - RNA, 18 nt, Human
uauuugugugugugugug

SEQ ID NO: 78121 - RNA, 22 nt, Human
uauuuguuucuaguggcagcaa

SEQ ID NO: 78122 - RNA, 22 nt, Human
uauuucaguuaagaugagguca

SEQ ID NO: 78123 - RNA, 22 nt, Human
uauuuacuguguucaucccucu

SEQ ID NO: 78124 - RNA, 22 nt, Human
guucuguauauauccuagcaaa

SEQ ID NO: 78125 - RNA, 18 nt, Human
uauuuacuguguguuacc

SEQ ID NO: 78126 - RNA, 22 nt, Human
uauuuaaagucagcaacuuuuc

SEQ ID NO: 78127 - RNA, 22 nt, Human
uauugaucuuugaaaccuuggu

SEQ ID NO: 78128 - RNA, 22 nt, Human
uauugauuuuguugcuaccugg

SEQ ID NO: 78129 - RNA, 22 nt, Human
guuccuaaauuugaaggacuuu

SEQ ID NO: 78130 - RNA, 22 nt, Human
uauuguauuagcucuuggagau

SEQ ID NO: 78131 - RNA, 22 nt, Human
uaugggaaggauuugucuuuca

SEQ ID NO: 78132 - RNA, 22 nt, Human
uaugguuagugcuguagauuau

SEQ ID NO: 78133 - RNA, 22 nt, Human
uauggcuucucagucaugaaaa

SEQ ID NO: 78134 - RNA, 22 nt, Human
uauggcuaguguguuuguaaca

SEQ ID NO: 78135 - RNA, 22 nt, Human
guguuagagucuugugcucauu

SEQ ID NO: 78136 - RNA, 22 nt, Human
guguugcaggaagauauagcug

SEQ ID NO: 78137 - RNA, 22 nt, Human
guguuaaucauuuuugauuuug

SEQ ID NO: 78138 - RNA, 22 nt, Human
uauguuaaauguuugauguuua

SEQ ID NO: 78139 - RNA, 22 nt, Human
uaugugugaguauauaugcaca

SEQ ID NO: 78140 - RNA, 22 nt, Human
uauguguaauuaaauacuauag

SEQ ID NO: 78141 - RNA, 18 nt, Human
uaugugucuguuacaacu

SEQ ID NO: 78142 - RNA, 22 nt, Human
uauuaaaagagaaaaagccacc

SEQ ID NO: 78143 - RNA, 22 nt, Human
guucacauccuugugaggauuu

SEQ ID NO: 78144 - RNA, 22 nt, Human
guuauuguuauugcguugucga

SEQ ID NO: 78145 - RNA, 21 nt, Human
uauucgcauuucugucuuuac

SEQ ID NO: 78146 - RNA, 22 nt, Human
guuccgcugcaaggccaggaaa

SEQ ID NO: 78147 - RNA, 22 nt, Human
guuguuaagugcugguuguuag

SEQ ID NO: 78148 - RNA, 19 nt, Human
guuguguuugguucuuuug

SEQ ID NO: 78149 - RNA, 21 nt, Human
ucaaguccuggcuuugcucuu

SEQ ID NO: 78150 - RNA, 22 nt, Human
ucaaggaagggguaggaauaau

SEQ ID NO: 78151 - RNA, 22 nt, Human
uauuuuuaccuaauuuaugaga

SEQ ID NO: 78152 - RNA, 22 nt, Human
guugauuuaggguuuugguuuu

SEQ ID NO: 78153 - RNA, 22 nt, Human
uauuuuucacagauuggugcuu

SEQ ID NO: 78154 - RNA, 22 nt, Human
guuuagauguagauucucuggu

SEQ ID NO: 78155 - RNA, 22 nt, Human
guuuaagcagauugcuguggug

SEQ ID NO: 78156 - RNA, 22 nt, Human
ucacaucugugugauugucauu

SEQ ID NO: 78157 - RNA, 22 nt, Human
ucacagguuuaguccagcaguc

SEQ ID NO: 78158 - RNA, 22 nt, Human
ucaauuuauguggcuauucauu

SEQ ID NO: 78159 - RNA, 22 nt, Human
ucacaagaagaaauuaaacugu

SEQ ID NO: 78160 - RNA, 22 nt, Human
guuucucuuugguggguugaga

SEQ ID NO: 78161 - RNA, 22 nt, Human
guuugcagacuauguaaacuuc

SEQ ID NO: 78162 - RNA, 22 nt, Human
guuuccaggcuuugguaugguu

SEQ ID NO: 78163 - RNA, 22 nt, Human
guuuauucuuuuauuugugaga

SEQ ID NO: 78164 - RNA, 22 nt, Human
ucacuuuacaucuguaaaagga

SEQ ID NO: 78165 - RNA, 22 nt, Human
ucacuucuaugaucugucucuu

SEQ ID NO: 78166 - RNA, 22 nt, Human
ucacuggauucauguuucuuua

SEQ ID NO: 78167 - RNA, 22 nt, Human
ucacugaacucucauagagaaa

SEQ ID NO: 78168 - RNA, 22 nt, Human
ucacuggaaaacaaauguuuua

SEQ ID NO: 78169 - RNA, 22 nt, Human
ucacuuccuugcagcuguagaa

SEQ ID NO: 78170 - RNA, 22 nt, Human
ucacucuuuaucuuuuaugucu

SEQ ID NO: 78171 - RNA, 22 nt, Human
ucagagccagacacacagcaga

SEQ ID NO: 78172 - RNA, 22 nt, Human
guuuuggagauguccauuuucc

SEQ ID NO: 78173 - RNA, 22 nt, Human
guuuuguucaugaacauugggu

SEQ ID NO: 78174 - RNA, 22 nt, Human
guuuuuacuuccaaugcuauga

SEQ ID NO: 78175 - RNA, 22 nt, Human
guuuugaugugauuucucaugu

SEQ ID NO: 78176 - RNA, 22 nt, Human
guuuguuugccagcuuaguaaa

SEQ ID NO: 78177 - RNA, 22 nt, Human
guuugguucucauuguuuuucu

SEQ ID NO: 78178 - RNA, 22 nt, Human
ucagaagguacugaagacaugg

SEQ ID NO: 78179 - RNA, 22 nt, Human
ucagauagcaagggauaccugu

SEQ ID NO: 78180 - RNA, 22 nt, Human
ucagcaaugggauucaggcuuu

SEQ ID NO: 78181 - RNA, 19 nt, Human
ucagcagauuuugcaaaca

SEQ ID NO: 78182 - RNA, 22 nt, Human
ucagcaggugcuuuguuuacuc

SEQ ID NO: 78183 - RNA, 22 nt, Human
uaaaaaccuuguauuuaacucu

SEQ ID NO: 78184 - RNA, 22 nt, Human
guuuuucuuugauuuagaacca

SEQ ID NO: 78185 - RNA, 21 nt, Human
uaaaagaugacaagacagcuc

SEQ ID NO: 78186 - RNA, 22 nt, Human
uaaaaauuagauauguauuuag

SEQ ID NO: 78187 - RNA, 22 nt, Human
uaaaaccauucauugaccuaug

SEQ ID NO: 78188 - RNA, 22 nt, Human
uaaaaguuagcuaggacaaagu

SEQ ID NO: 78189 - RNA, 22 nt, Human
uaaaaucaugacagauugacau

SEQ ID NO: 78190 - RNA, 22 nt, Human
uaaagaagaaaaggcuucaggc

SEQ ID NO: 78191 - RNA, 22 nt, Human
ucagcuauccauucuccuauga

SEQ ID NO: 78192 - RNA, 22 nt, Human
ucagcugggagaaaguuuuagg

SEQ ID NO: 78193 - RNA, 22 nt, Human
ucagcuucaucuugagcccaca

SEQ ID NO: 78194 - RNA, 20 nt, Human
uacaauauucccacuuugcu

SEQ ID NO: 78195 - RNA, 22 nt, Human
uacaaauguuucuucuccuuuu

SEQ ID NO: 78196 - RNA, 22 nt, Human
uaauuccacacucccgcaagcg

SEQ ID NO: 78197 - RNA, 22 nt, Human
uaauucuagauugacauuuuga

SEQ ID NO: 78198 - RNA, 22 nt, Human
uacaaauugccugacggcaggu

SEQ ID NO: 78199 - RNA, 22 nt, Human
uaauccaaaccaggaauucccu

SEQ ID NO: 78200 - RNA, 22 nt, Human
uaaugaugaacacuuggaagaa

SEQ ID NO: 78201 - RNA, 22 nt, Human
ucauucucucguauucgcgaau

SEQ ID NO: 78202 - RNA, 23 nt, Human
ucauugcucaagauaaugguuga

SEQ ID NO: 78203 - RNA, 20 nt, Human
ucaucuuucaaauuugugac

SEQ ID NO: 78204 - RNA, 22 nt, Human
uaaguuguagaacguuuucuua

SEQ ID NO: 78205 - RNA, 22 nt, Human
uaauaaaaauuuaauucacauu

SEQ ID NO: 78206 - RNA, 19 nt, Human
uaagaaucaccaggggugu

SEQ ID NO: 78207 - RNA, 22 nt, Human
uaagaauguuuguugaguaaau

SEQ ID NO: 78208 - RNA, 22 nt, Human
uaagauuuuuacaaauagagug

SEQ ID NO: 78209 - RNA, 22 nt, Human
uaagauauugagugguaauuug

SEQ ID NO: 78210 - RNA, 22 nt, Human
uaagagcagacacaaccugaga

SEQ ID NO: 78211 - RNA, 22 nt, Human
ucaggacacuuaauaggaacag

SEQ ID NO: 78212 - RNA, 21 nt, Human
uaagaacauuaucuucuuccu

SEQ ID NO: 78213 - RNA, 22 nt, Human
uaagcgagccaguggaaaaagc

SEQ ID NO: 78214 - RNA, 22 nt, Human
ucauccugaagaaccugcuucc

SEQ ID NO: 78215 - RNA, 22 nt, Human
ucaucuuuauaaugcaaguuuu

SEQ ID NO: 78216 - RNA, 22 nt, Human
uaagggaagucuucaggagaca

SEQ ID NO: 78217 - RNA, 22 nt, Human
uccacuaucagaccuguagucu

SEQ ID NO: 78218 - RNA, 22 nt, Human
uccacagugguggaauuguuca

SEQ ID NO: 78219 - RNA, 22 nt, Human
uccaccaccaucacagucagac

SEQ ID NO: 78220 - RNA, 22 nt, Human
uacaauguucgcauucucucug

SEQ ID NO: 78221 - RNA, 22 nt, Human
uacauaauucauuagcuccucu

SEQ ID NO: 78222 - RNA, 22 nt, Human
uccagaaaucucuguugauugu

SEQ ID NO: 78223 - RNA, 22 nt, Human
uccagaaagccguugacuuauu

SEQ ID NO: 78224 - RNA, 22 nt, Human
uacauuguguuaaaacagaaga

SEQ ID NO: 78225 - RNA, 22 nt, Human
uacauguggagauaacugaagc

SEQ ID NO: 78226 - RNA, 22 nt, Human
uacauggauguuauccuuacug

SEQ ID NO: 78227 - RNA, 23 nt, Human
uaccagacccugaaagaaagugu

SEQ ID NO: 78228 - RNA, 22 nt, Human
uccacuaucugagcuuaguugc

SEQ ID NO: 78229 - RNA, 20 nt, Human
uccacugagcgucacggcag

SEQ ID NO: 78230 - RNA, 22 nt, Human
uccauucccugacagccucuuu

SEQ ID NO: 78231 - RNA, 22 nt, Human
ucccagaaccuuuuagcuucac

SEQ ID NO: 78232 - RNA, 22 nt, Human
ucccagaacggguucuucccag

SEQ ID NO: 78233 - RNA, 22 nt, Human
uacugucuuuuccuaaaugggu

SEQ ID NO: 78234 - RNA, 22 nt, Human
uacuuaaaacacauuuagcauu

SEQ ID NO: 78235 - RNA, 22 nt, Human
ucccaaguguuuggcgaggaga

SEQ ID NO: 78236 - RNA, 22 nt, Human
uaggaucaugaugguaaggcaa

SEQ ID NO: 78237 - RNA, 22 nt, Human
ucgacguuguuuuuucucuguc

SEQ ID NO: 78238 - RNA, 22 nt, Human
ucgcuauuauuuuagguucuca

SEQ ID NO: 78239 - RNA, 22 nt, Human
uaggcuuuguuacuuucccuuu

SEQ ID NO: 78240 - RNA, 22 nt, Human
uaggggcccgugggauggacag

SEQ ID NO: 78241 - RNA, 22 nt, Human
uaggcaauauuagacuuugucu

SEQ ID NO: 78242 - RNA, 22 nt, Human
uccuuguaccauuugcucacag

SEQ ID NO: 78243 - RNA, 22 nt, Human
uaggcaguagcuuuggauguca

SEQ ID NO: 78244 - RNA, 22 nt, Human
uaggguuucaugcugguuucca

SEQ ID NO: 78245 - RNA, 22 nt, Human
ucgcuuuaauggucuucacagc

SEQ ID NO: 78246 - RNA, 22 nt, Human
ucgcuucugaguuggugacccc

SEQ ID NO: 78247 - RNA, 22 nt, Human
uagguuuugugucagaguagaa

SEQ ID NO: 78248 - RNA, 22 nt, Human
ucgugaagaaauguggacuuca

SEQ ID NO: 78249 - RNA, 22 nt, Human
uaguacuugauuuuaaauguua

SEQ ID NO: 78250 - RNA, 22 nt, Human
ucuaauagauuuggaguggaaa

SEQ ID NO: 78251 - RNA, 22 nt, Human
uagugauuuaagaaaggugacu

SEQ ID NO: 78252 - RNA, 22 nt, Human
uagucuuuguggucuuuagcua

SEQ ID NO: 78253 - RNA, 17 nt, Human
uagccagcuugugauuu

SEQ ID NO: 78254 - RNA, 22 nt, Human
uagccucuggaauccuuucucu

SEQ ID NO: 78255 - RNA, 22 nt, Human
uagccucauuauuuacucauga

SEQ ID NO: 78256 - RNA, 22 nt, Human
uccuuuggaaacuggaugucuu

SEQ ID NO: 78257 - RNA, 18 nt, Human
uccuuucaccccuucucu

SEQ ID NO: 78258 - RNA, 22 nt, Human
uccuuguuggaauauccuuacc

SEQ ID NO: 78259 - RNA, 22 nt, Human
uccuuguucugauuuuucuggg

SEQ ID NO: 78260 - RNA, 20 nt, Human
uagcacagacuuuugcuuac

SEQ ID NO: 78261 - RNA, 22 nt, Human
uagccaaguguuuuucaugacc

SEQ ID NO: 78262 - RNA, 22 nt, Human
uagcauuuauugggcuagcaaa

SEQ ID NO: 78263 - RNA, 22 nt, Human
uccugcaugcuagugagugcuu

SEQ ID NO: 78264 - RNA, 22 nt, Human
uagcaggaggcaguuccucgcu

SEQ ID NO: 78265 - RNA, 22 nt, Human
uacuuagagucgggaugcacaa

SEQ ID NO: 78266 - RNA, 22 nt, Human
uacuuacacugaagcaaagaua

SEQ ID NO: 78267 - RNA, 22 nt, Human
uacuuaauuuuaaaagcuagau

SEQ ID NO: 78268 - RNA, 22 nt, Human
uacuuaucuuagggaugcuugc

SEQ ID NO: 78269 - RNA, 22 nt, Human
ucccagcaggcaccgcuucugc

SEQ ID NO: 78270 - RNA, 17 nt, Human
uccuacaggugugcuga

SEQ ID NO: 78271 - RNA, 22 nt, Human
uccuaagaaacagacugaaaag

SEQ ID NO: 78272 - RNA, 22 nt, Human
uagaagaugccuuaaaguugaa

SEQ ID NO: 78273 - RNA, 22 nt, Human
uagaagagcuuccaccuggggc

SEQ ID NO: 78274 - RNA, 22 nt, Human
uccuaguucugaccucgcucac

SEQ ID NO: 78275 - RNA, 20 nt, Human
uccuacauugacccucuucc

SEQ ID NO: 78276 - RNA, 20 nt, Human
uccuaugagcuguuaaauug

SEQ ID NO: 78277 - RNA, 22 nt, Human
uccucuccaggugagccgaaau

SEQ ID NO: 78278 - RNA, 22 nt, Human
uccucuucaaaauagcucugaa

SEQ ID NO: 78279 - RNA, 22 nt, Human
uagaggaccacagggugcagag

SEQ ID NO: 78280 - RNA, 19 nt, Human
uagagcagcuucagauucc

SEQ ID NO: 78281 - RNA, 22 nt, Human
uagagagaaaccaggguuuggg

SEQ ID NO: 78282 - RNA, 22 nt, Human
uagagauagccaaguccuucaa

SEQ ID NO: 78283 - RNA, 19 nt, Human
uagaggagaauggcaaaga

SEQ ID NO: 78284 - RNA, 22 nt, Human
uagagcucaagaagcaaaagcu

SEQ ID NO: 78285 - RNA, 22 nt, Human
gugauuucagguuuuucauacu

SEQ ID NO: 78286 - RNA, 19 nt, Human
gugaugaugccacuccaac

SEQ ID NO: 78287 - RNA, 22 nt, Human
uagagaaauuacagcuuucuuu

SEQ ID NO: 78288 - RNA, 22 nt, Human
uagagaaauauuuguagugcug

SEQ ID NO: 78289 - RNA, 22 nt, Human
gugaugaaggccugcaccuggu

SEQ ID NO: 78290 - RNA, 22 nt, Human
uagacugagcuccuugaggaca

SEQ ID NO: 78291 - RNA, 21 nt, Human
uagaccagcugugcuccucgg

SEQ ID NO: 78292 - RNA, 19 nt, Human
uagacagauuuguguuacu

SEQ ID NO: 78293 - RNA, 22 nt, Human
uagaaugggaggggaaucaucc

SEQ ID NO: 78294 - RNA, 22 nt, Human
uagacauuuacuuugaaaaaau

SEQ ID NO: 78295 - RNA, 22 nt, Human
gugaguugugugaguaagcaga

SEQ ID NO: 78296 - RNA, 22 nt, Human
uagaaguuaaaggaauacagaa

SEQ ID NO: 78297 - RNA, 22 nt, Human
uagaaauaaacacugcuaccuu

SEQ ID NO: 78298 - RNA, 22 nt, Human
gugaguuuucgugacacuauuu

SEQ ID NO: 78299 - RNA, 22 nt, Human
uagcaaucugugaugugugugu

SEQ ID NO: 78300 - RNA, 22 nt, Human
uagauuuaaaaagggugggaug

SEQ ID NO: 78301 - RNA, 22 nt, Human
uagauuguaagcuccuugaggg

SEQ ID NO: 78302 - RNA, 22 nt, Human
gugcccaguugaggccaggacu

SEQ ID NO: 78303 - RNA, 22 nt, Human
gugccgcuggagcuggaauuga

SEQ ID NO: 78304 - RNA, 22 nt, Human
gugcuacacaaauguuaguugu

SEQ ID NO: 78305 - RNA, 22 nt, Human
uagcauaaaguuucuguguggu

SEQ ID NO: 78306 - RNA, 22 nt, Human
uagaggcuagugguuaugaccu

SEQ ID NO: 78307 - RNA, 22 nt, Human
uagaguauuuguuuacuaaguu

SEQ ID NO: 78308 - RNA, 22 nt, Human
uagaguaagugugugcugagcu

SEQ ID NO: 78309 - RNA, 22 nt, Human
gugccgaugaggccuggcauuc

SEQ ID NO: 78310 - RNA, 22 nt, Human
gugcaucuguaauuacaauggu

SEQ ID NO: 78311 - RNA, 22 nt, Human
gugccaaauagcuugauuaaga

SEQ ID NO: 78312 - RNA, 22 nt, Human
uagaucucugccuuguucagag

SEQ ID NO: 78313 - RNA, 23 nt, Human
uagauccuuccaacuacucuuac

SEQ ID NO: 78314 - RNA, 22 nt, Human
uagaucccauugguugguuggu

SEQ ID NO: 78315 - RNA, 22 nt, Human
uagaugaacagaaagccacugu

SEQ ID NO: 78316 - RNA, 22 nt, Human
uagaugguguccagaaagagaa

SEQ ID NO: 78317 - RNA, 22 nt, Human
uacagauggacacuguuucaag

SEQ ID NO: 78318 - RNA, 22 nt, Human
uacagcuuccucuaugguggcc

SEQ ID NO: 78319 - RNA, 22 nt, Human
uacaguauuuuuuaagaaaaaa

SEQ ID NO: 78320 - RNA, 22 nt, Human
uacauaauagcaaggugcuguc

SEQ ID NO: 78321 - RNA, 21 nt, Human
uaccacugaaauugaucguuc

SEQ ID NO: 78322 - RNA, 22 nt, Human
uacagucauaagguuucucucc

SEQ ID NO: 78323 - RNA, 22 nt, Human
uacuaaagaaugaguuaaguuu

SEQ ID NO: 78324 - RNA, 22 nt, Human
uacuauuuugacaugaaauuga

SEQ ID NO: 78325 - RNA, 22 nt, Human
uacugauggagauaggcuauca

SEQ ID NO: 78326 - RNA, 22 nt, Human
uacugaauuacugcugguaaau

SEQ ID NO: 78327 - RNA, 22 nt, Human
uacugaagaugccaucacaagc

SEQ ID NO: 78328 - RNA, 22 nt, Human
uacucucuuccauacaaucugu

SEQ ID NO: 78329 - RNA, 22 nt, Human
uacugaaagagugguggacucu

SEQ ID NO: 78330 - RNA, 22 nt, Human
uacugccauuauccugcugaaa

SEQ ID NO: 78331 - RNA, 22 nt, Human
uacaagcucuuguagggggaaa

SEQ ID NO: 78332 - RNA, 22 nt, Human
uacaccuuaagccgcggcuccc

SEQ ID NO: 78333 - RNA, 22 nt, Human
gucugcacgugccagggagggg

SEQ ID NO: 78334 - RNA, 20 nt, Human
uacaaggauguucaucagag

SEQ ID NO: 78335 - RNA, 22 nt, Human
gucuccugcccacccugguccc

SEQ ID NO: 78336 - RNA, 23 nt, Human
gucagcuugaccaguggagaguc

SEQ ID NO: 78337 - RNA, 22 nt, Human
uaauagauagggagaguugcug

SEQ ID NO: 78338 - RNA, 22 nt, Human
uacaacuuacuugaauggcuuu

SEQ ID NO: 78339 - RNA, 22 nt, Human
uacaaauuguuuugccacaaag

SEQ ID NO: 78340 - RNA, 22 nt, Human
guuuuaucuauguaauuauaaa

SEQ ID NO: 78341 - RNA, 22 nt, Human
guuuuauaacuauagugagaau

SEQ ID NO: 78342 - RNA, 22 nt, Human
gguauccaaauaaagcagguaa

SEQ ID NO: 78343 - RNA, 19 nt, Human
ggugggacaggugagauau

SEQ ID NO: 78344 - RNA, 22 nt, Human
guuuucuuguuaauuuugaacg

SEQ ID NO: 78345 - RNA, 22 nt, Human
guuuugauggaguguguuaaau

SEQ ID NO: 78346 - RNA, 22 nt, Human
guuuugaagagaagcaagucug

SEQ ID NO: 78347 - RNA, 22 nt, Human
gguggcauucaguaaguauaua

SEQ ID NO: 78348 - RNA, 22 nt, Human
gguggcauguaccucacagacu

SEQ ID NO: 78349 - RNA, 22 nt, Human
gguggcuugcugguaggugugc

SEQ ID NO: 78350 - RNA, 22 nt, Human
guuuuauguuuuauagacacaa

SEQ ID NO: 78351 - RNA, 22 nt, Human
uaaaugagcaccucuaguuuug

SEQ ID NO: 78352 - RNA, 22 nt, Human
uaaaugauaguauugaagguag

SEQ ID NO: 78353 - RNA, 22 nt, Human
guaaauaucucacgaaugauuc

SEQ ID NO: 78354 - RNA, 22 nt, Human
gguuuauucccacaaaggaagu

SEQ ID NO: 78355 - RNA, 21 nt, Human
gguuucugcaaaccuuguaca

SEQ ID NO: 78356 - RNA, 23 nt, Human
gguuggcuguacccaggcucccu

SEQ ID NO: 78357 - RNA, 22 nt, Human
gguuuaucuuuacaaaugaaau

SEQ ID NO: 78358 - RNA, 22 nt, Human
uaaagcacucaaaauuguagcu

SEQ ID NO: 78359 - RNA, 23 nt, Human
uaaagauaguuuaaaggugaguu

SEQ ID NO: 78360 - RNA, 22 nt, Human
uaaagacaauuucgagcuguag

SEQ ID NO: 78361 - RNA, 22 nt, Human
guuuuucuagaaaucuccuccu

SEQ ID NO: 78362 - RNA, 22 nt, Human
guuuuuaguuuaaguuuuugca

SEQ ID NO: 78363 - RNA, 22 nt, Human
guaucaggugugagcauuuuaa

SEQ ID NO: 78364 - RNA, 22 nt, Human
uaagaaaggggaaguuccucuu

SEQ ID NO: 78365 - RNA, 22 nt, Human
uaagaaacauuuuuaugacagu

SEQ ID NO: 78366 - RNA, 22 nt, Human
uaacuuuuuauccuguuaaaug

SEQ ID NO: 78367 - RNA, 22 nt, Human
guaucuuuauuuuaauuaagau

SEQ ID NO: 78368 - RNA, 22 nt, Human
guaugaguggauagauguaucu

SEQ ID NO: 78369 - RNA, 22 nt, Human
uaagagauuuauugaggacuuc

SEQ ID NO: 78370 - RNA, 21 nt, Human
uaagccaccaugugaaaccag

SEQ ID NO: 78371 - RNA, 22 nt, Human
uaaggaaaugcaaauuuaagaa

SEQ ID NO: 78372 - RNA, 22 nt, Human
gucacuuugcuugcgaugcucc

SEQ ID NO: 78373 - RNA, 21 nt, Human
uaaggaagagcauuuuagguc

SEQ ID NO: 78374 - RNA, 22 nt, Human
gucagauucuuucauuugcuga

SEQ ID NO: 78375 - RNA, 22 nt, Human
gucaaaggcggugcaggaggag

SEQ ID NO: 78376 - RNA, 22 nt, Human
guaguauuuucugaggacuggu

SEQ ID NO: 78377 - RNA, 22 nt, Human
guaguuagaguugugcuggaga

SEQ ID NO: 78378 - RNA, 22 nt, Human
uaacauuuaguuuuaagauggu

SEQ ID NO: 78379 - RNA, 22 nt, Human
uaacaacuuucugguguaacuu

SEQ ID NO: 78380 - RNA, 23 nt, Human
uaaauuuuauucugauaacacag

SEQ ID NO: 78381 - RNA, 23 nt, Human
uaacacaguccuggucuuuggcc

SEQ ID NO: 78382 - RNA, 22 nt, Human
uaacagugcuacaguuacuuuc

SEQ ID NO: 78383 - RNA, 22 nt, Human
guguuuauguuuuugcuaggga

SEQ ID NO: 78384 - RNA, 22 nt, Human
guguucucagcacccacuucau

SEQ ID NO: 78385 - RNA, 22 nt, Human
ggggagaugauaagugcauuug

SEQ ID NO: 78386 - RNA, 22 nt, Human
ggggaggaagcuggaacacggg

SEQ ID NO: 78387 - RNA, 22 nt, Human
ggggacaagggugucaguaggc

SEQ ID NO: 78388 - RNA, 22 nt, Human
ggggacugccgacagucucaaa

SEQ ID NO: 78389 - RNA, 22 nt, Human
guuaaaugcagauucugacuca

SEQ ID NO: 78390 - RNA, 22 nt, Human
guuagaauggacaaagcugaaa

SEQ ID NO: 78391 - RNA, 22 nt, Human
ggggcggggagcaugagcuggg

SEQ ID NO: 78392 - RNA, 22 nt, Human
gggguuggaugccuuggaaauu

SEQ ID NO: 78393 - RNA, 22 nt, Human
gggucauugcgugacgcgagca

SEQ ID NO: 78394 - RNA, 22 nt, Human
guuauuuugucuuguucaugaa

SEQ ID NO: 78395 - RNA, 22 nt, Human
guuauugggagagggaauggga

SEQ ID NO: 78396 - RNA, 22 nt, Human
ggggcuuccagcgcccgccggu

SEQ ID NO: 78397 - RNA, 22 nt, Human
guuagacuugcguggaucauga

SEQ ID NO: 78398 - RNA, 22 nt, Human
gggugcuuaagcuuguuuguaa

SEQ ID NO: 78399 - RNA, 22 nt, Human
guucuacaacuucgcuugcaga

SEQ ID NO: 78400 - RNA, 22 nt, Human
guuccuauauagccuuaaggau

SEQ ID NO: 78401 - RNA, 22 nt, Human
guuccucugaaggauuuucaga

SEQ ID NO: 78402 - RNA, 22 nt, Human
guuccugugcccuguucuuucc

SEQ ID NO: 78403 - RNA, 22 nt, Human
gggugcuucauaggugaugcug

SEQ ID NO: 78404 - RNA, 21 nt, Human
guucuuaguuauauucucaau

SEQ ID NO: 78405 - RNA, 22 nt, Human
guucuuagguacucauauuuaa

SEQ ID NO: 78406 - RNA, 22 nt, Human
guugauauggaaacucuagguu

SEQ ID NO: 78407 - RNA, 22 nt, Human
guugcaaaugggaagaugguua

SEQ ID NO: 78408 - RNA, 21 nt, Human
gguagggaagguguuccucau

SEQ ID NO: 78409 - RNA, 22 nt, Human
guugcuaugaaauuaaaauuua

SEQ ID NO: 78410 - RNA, 22 nt, Human
gguagagagugaggaggggcuc

SEQ ID NO: 78411 - RNA, 22 nt, Human
gguagauacaaaaagauugugg

SEQ ID NO: 78412 - RNA, 22 nt, Human
gguaaucuccucauugacguua

SEQ ID NO: 78413 - RNA, 22 nt, Human
guugagacugaaguucugaaag

SEQ ID NO: 78414 - RNA, 22 nt, Human
ggguguuuuuggugacagggag

SEQ ID NO: 78415 - RNA, 22 nt, Human
ggguuggaggcauugaaacaga

SEQ ID NO: 78416 - RNA, 22 nt, Human
ggguuuuggggaggaagugagc

SEQ ID NO: 78417 - RNA, 22 nt, Human
gggcuacugagcuggaacuggg

SEQ ID NO: 78418 - RNA, 22 nt, Human
gggcucaaccauagcacaaaga

SEQ ID NO: 78419 - RNA, 20 nt, Human
gggcucugcauccaucagcc

SEQ ID NO: 78420 - RNA, 22 nt, Human
gggcuacagaugggagggauga

SEQ ID NO: 78421 - RNA, 22 nt, Human
guguagauuuguucaccuauua

SEQ ID NO: 78422 - RNA, 22 nt, Human
guguauuucuagaagaaaugaa

SEQ ID NO: 78423 - RNA, 22 nt, Human
guggugauuugggucuagcuuu

SEQ ID NO: 78424 - RNA, 22 nt, Human
guggugggcgugguguaugccu

SEQ ID NO: 78425 - RNA, 22 nt, Human
guguggcgacucagagcugccu

SEQ ID NO: 78426 - RNA, 22 nt, Human
gggcuuguuaacuuggcuucca

SEQ ID NO: 78427 - RNA, 22 nt, Human
guguucuuuaugguuguagugu

SEQ ID NO: 78428 - RNA, 22 nt, Human
guguucuuuguagaggaucuug

SEQ ID NO: 78429 - RNA, 22 nt, Human
guggcuuaauauuuauagcaga

SEQ ID NO: 78430 - RNA, 22 nt, Human
gugggaaacagccuugcuucua

SEQ ID NO: 78431 - RNA, 22 nt, Human
gugggagaaugggaggaguaau

SEQ ID NO: 78432 - RNA, 22 nt, Human
guggcuuuguuuccaaaugaaa

SEQ ID NO: 78433 - RNA, 22 nt, Human
gugggcagauuaauuucucaau

SEQ ID NO: 78434 - RNA, 22 nt, Human
gggcaugugauggacgugugcc

SEQ ID NO: 78435 - RNA, 22 nt, Human
guggagaucuggugcccccugg

SEQ ID NO: 78436 - RNA, 22 nt, Human
guggagauauuugugauagggg

SEQ ID NO: 78437 - RNA, 22 nt, Human
gggcaugcagcaauucuguggu

SEQ ID NO: 78438 - RNA, 22 nt, Human
guggacuuuggucugugccauc

SEQ ID NO: 78439 - RNA, 22 nt, Human
guggagaaauauguucagcuuc

SEQ ID NO: 78440 - RNA, 22 nt, Human
gggcagagggcgagcugggaga

SEQ ID NO: 78441 - RNA, 22 nt, Human
gugcuuuaccuuauuggucucg

SEQ ID NO: 78442 - RNA, 22 nt, Human
gugcuuugcuaggaccgauugu

SEQ ID NO: 78443 - RNA, 23 nt, Human
ggccuuuuuaaccgcgagcgaca

SEQ ID NO: 78444 - RNA, 22 nt, Human
guggaaauuuuaggaucaucuu

SEQ ID NO: 78445 - RNA, 22 nt, Human
ggaagcuguugugagugcagca

SEQ ID NO: 78446 - RNA, 20 nt, Human
ggaaguauccacaaauuccu

SEQ ID NO: 78447 - RNA, 22 nt, Human
ggaagugagcucauuacuuuag

SEQ ID NO: 78448 - RNA, 22 nt, Human
gccugcugggcucuuccugcug

SEQ ID NO: 78449 - RNA, 22 nt, Human
ggacagagcaacccuacgcagc

SEQ ID NO: 78450 - RNA, 22 nt, Human
ggacccagggcuuauucauguu

SEQ ID NO: 78451 - RNA, 22 nt, Human
ggacugggagaauggaggcaag

SEQ ID NO: 78452 - RNA, 22 nt, Human
ggacucuaccuggagcagccuc

SEQ ID NO: 78453 - RNA, 21 nt, Human
ggacccucagauggcagugag

SEQ ID NO: 78454 - RNA, 22 nt, Human
ggagcagaggaaagaguagcau

SEQ ID NO: 78455 - RNA, 18 nt, Human
ggagaagaacagaugugg

SEQ ID NO: 78456 - RNA, 22 nt, Human
ggauggaugugaucugccuccu

SEQ ID NO: 78457 - RNA, 22 nt, Human
ggaugcugcuccacaucccaca

SEQ ID NO: 78458 - RNA, 22 nt, Human
ggaugauuuucaguuguguggg

SEQ ID NO: 78459 - RNA, 22 nt, Human
ggaucgauuccaaauguagauc

SEQ ID NO: 78460 - RNA, 20 nt, Human
ggauugaacuauuucucagc

SEQ ID NO: 78461 - RNA, 22 nt, Human
ggcaaggaagaaagcagaaguu

SEQ ID NO: 78462 - RNA, 22 nt, Human
ggcagauaaacaauguuguaua

SEQ ID NO: 78463 - RNA, 21 nt, Human
ggcagagaagcuggaaguugg

SEQ ID NO: 78464 - RNA, 22 nt, Human
gcuacauuagcuucaauggcua

SEQ ID NO: 78465 - RNA, 22 nt, Human
gcucaugggcccagagcagccc

SEQ ID NO: 78466 - RNA, 20 nt, Human
gcucaguggagaaaugcacc

SEQ ID NO: 78467 - RNA, 20 nt, Human
gcucuucuccgggucugccu

SEQ ID NO: 78468 - RNA, 22 nt, Human
gcucuugcuuuuucuagaaaga

SEQ ID NO: 78469 - RNA, 22 nt, Human
gcugcagggagcuggaaggcuc

SEQ ID NO: 78470 - RNA, 18 nt, Human
ggccucagccuggccgga

SEQ ID NO: 78471 - RNA, 22 nt, Human
ggccuugguggcuuugcugaug

SEQ ID NO: 78472 - RNA, 22 nt, Human
ggccuucuuuucaugucuuucg

SEQ ID NO: 78473 - RNA, 22 nt, Human
gcugcuggcggagcuggcgcug

SEQ ID NO: 78474 - RNA, 22 nt, Human
gcugcuggcuuccugcuguuuu

SEQ ID NO: 78475 - RNA, 22 nt, Human
ggcgauuggccgggaggaggca

SEQ ID NO: 78476 - RNA, 22 nt, Human
ggcgaugaggucuuagaaucua

SEQ ID NO: 78477 - RNA, 22 nt, Human
ggcuauuguuuuaaaaaaugag

SEQ ID NO: 78478 - RNA, 22 nt, Human
ggcgccuuguggaaugagagcu

SEQ ID NO: 78479 - RNA, 22 nt, Human
ggcgcaguguucgcccucucgc

SEQ ID NO: 78480 - RNA, 22 nt, Human
ggcuccucaggcugggguaagg

SEQ ID NO: 78481 - RNA, 22 nt, Human
gcuggaagggccagcuuucagg

SEQ ID NO: 78482 - RNA, 22 nt, Human
ggcugcagggaacaggaugggu

SEQ ID NO: 78483 - RNA, 21 nt, Human
ggcugcucgugaugaacuuca

SEQ ID NO: 78484 - RNA, 22 nt, Human
ggcugcuggaguugggucucuc

SEQ ID NO: 78485 - RNA, 22 nt, Human
ggcugcugcccaccccugcaug

SEQ ID NO: 78486 - RNA, 22 nt, Human
ggcuucucuuggccaugguccc

SEQ ID NO: 78487 - RNA, 22 nt, Human
ggcuuauauguauucccagaga

SEQ ID NO: 78488 - RNA, 22 nt, Human
ggcuuacgcgcuaacagugaau

SEQ ID NO: 78489 - RNA, 22 nt, Human
ggauaauguauuuuaaaauggg

SEQ ID NO: 78490 - RNA, 22 nt, Human
gguaauguucugaugaauuugu

SEQ ID NO: 78491 - RNA, 22 nt, Human
ggauugaagggaaccucagaau

SEQ ID NO: 78492 - RNA, 22 nt, Human
ggauuucuucucauaacugaga

SEQ ID NO: 78493 - RNA, 22 nt, Human
ggucuuauaauuaauuuaggcu

SEQ ID NO: 78494 - RNA, 22 nt, Human
ggauuugaugagacuaucuacu

SEQ ID NO: 78495 - RNA, 22 nt, Human
ggcaaagaguacaucguccugg

SEQ ID NO: 78496 - RNA, 22 nt, Human
ggcaagcacugggugucuuagc

SEQ ID NO: 78497 - RNA, 22 nt, Human
ggcagcagaacuggcccuguau

SEQ ID NO: 78498 - RNA, 22 nt, Human
ggcaggaaguaaggaugcuaca

SEQ ID NO: 78499 - RNA, 22 nt, Human
ggcaggauggagcagggcuaaa

SEQ ID NO: 78500 - RNA, 22 nt, Human
ggcagucaucacuuauucauca

SEQ ID NO: 78501 - RNA, 22 nt, Human
ggugcuggggaaauuaggguag

SEQ ID NO: 78502 - RNA, 22 nt, Human
guaguuuuugagcuguaaucuu

SEQ ID NO: 78503 - RNA, 22 nt, Human
guaguucuccaggggcuguuca

SEQ ID NO: 78504 - RNA, 22 nt, Human
guaggaaaugaauaagguaccu

SEQ ID NO: 78505 - RNA, 22 nt, Human
guagaucaugaaaauucacugc

SEQ ID NO: 78506 - RNA, 22 nt, Human
guagucuuaggaaugauuuugu

SEQ ID NO: 78507 - RNA, 22 nt, Human
guagugauuguuccucaggggu

SEQ ID NO: 78508 - RNA, 22 nt, Human
guagaaaauagauugucucuug

SEQ ID NO: 78509 - RNA, 22 nt, Human
guagagccaccaccaccauagc

SEQ ID NO: 78510 - RNA, 22 nt, Human
guagagcagaaacauggagaaa

SEQ ID NO: 78511 - RNA, 22 nt, Human
ggcccucucuacauguuagacg

SEQ ID NO: 78512 - RNA, 22 nt, Human
gguugccuguggcucccuguua

SEQ ID NO: 78513 - RNA, 22 nt, Human
gguugauuuuuaugaagccaug

SEQ ID NO: 78514 - RNA, 22 nt, Human
ggccagcuuugagcugcaggaa

SEQ ID NO: 78515 - RNA, 22 nt, Human
gguugaagcuacuuucuggaug

SEQ ID NO: 78516 - RNA, 22 nt, Human
ggugucagccacuuugucggag

SEQ ID NO: 78517 - RNA, 22 nt, Human
guaaggcaggagucuuaaaccu

SEQ ID NO: 78518 - RNA, 22 nt, Human
guaaugcuuuuauuucggggaa

SEQ ID NO: 78519 - RNA, 22 nt, Human
guaauucugugugaaucuauua

SEQ ID NO: 78520 - RNA, 22 nt, Human
guacauauggcacaugcuauuu

SEQ ID NO: 78521 - RNA, 22 nt, Human
guaagaauauacccaggaguca

SEQ ID NO: 78522 - RNA, 22 nt, Human
gguuuucuuguucauuuuuuaa

SEQ ID NO: 78523 - RNA, 23 nt, Human
gcuuugaaaaugcuuucuuccag

SEQ ID NO: 78524 - RNA, 22 nt, Human
gcuuuguucauuuaguuuuuuu

SEQ ID NO: 78525 - RNA, 22 nt, Human
gcuuuguugauggugagucugu

SEQ ID NO: 78526 - RNA, 22 nt, Human
gcuuuucaaguuacaauuagcu

SEQ ID NO: 78527 - RNA, 21 nt, Human
gggaggagcuucccuuugccc

SEQ ID NO: 78528 - RNA, 22 nt, Human
gggauuaaaaaucaccaaagua

SEQ ID NO: 78529 - RNA, 19 nt, Human
gggauuccuggcuuuagaa

SEQ ID NO: 78530 - RNA, 22 nt, Human
ggaaaaucaaaccauuuacagu

SEQ ID NO: 78531 - RNA, 22 nt, Human
gggcaagaagcuggaagcauuc

SEQ ID NO: 78532 - RNA, 22 nt, Human
gggcaagagaggaagagauggc

SEQ ID NO: 78533 - RNA, 22 nt, Human
ggaagucuacucuuccgaaaac

SEQ ID NO: 78534 - RNA, 22 nt, Human
gggcucuuaauuuuuuucucua

SEQ ID NO: 78535 - RNA, 23 nt, Human
ggaauuucagaugugaaauaaaa

SEQ ID NO: 78536 - RNA, 18 nt, Human
ggacaguuguagaggacu

SEQ ID NO: 78537 - RNA, 22 nt, Human
gggcuguggggccugcagaagg

SEQ ID NO: 78538 - RNA, 22 nt, Human
gggcuguaggagcuggaauggg

SEQ ID NO: 78539 - RNA, 22 nt, Human
ggacauggaaagugugugauuu

SEQ ID NO: 78540 - RNA, 22 nt, Human
ggacuuucuccugcacaaagug

SEQ ID NO: 78541 - RNA, 22 nt, Human
ggacuuuggauuuuauucuaaa

SEQ ID NO: 78542 - RNA, 22 nt, Human
ggagaaacuaguuagauccaau

SEQ ID NO: 78543 - RNA, 22 nt, Human
ggggaagagagaagaaugaucu

SEQ ID NO: 78544 - RNA, 22 nt, Human
ggggaaauauuucugaccugug

SEQ ID NO: 78545 - RNA, 22 nt, Human
ggggaauuaaaugagaagccuu

SEQ ID NO: 78546 - RNA, 22 nt, Human
ggggacuugguuuuaaugagcu

SEQ ID NO: 78547 - RNA, 23 nt, Human
ggagaaggaugucaucaaaagac

SEQ ID NO: 78548 - RNA, 22 nt, Human
ggagacagugacuuagagacug

SEQ ID NO: 78549 - RNA, 22 nt, Human
ggggaauaaacacuuugucacu

SEQ ID NO: 78550 - RNA, 22 nt, Human
ggggauuucccaaugcgaagca

SEQ ID NO: 78551 - RNA, 22 nt, Human
ggagaccaauuaaugaaggaau

SEQ ID NO: 78552 - RNA, 22 nt, Human
ggagauaugugaaaaagacagc

SEQ ID NO: 78553 - RNA, 22 nt, Human
ggagagaacguaaucuaguauu

SEQ ID NO: 78554 - RNA, 22 nt, Human
ggagaggaggugagaggaagua

SEQ ID NO: 78555 - RNA, 22 nt, Human
ggagaggaaguuuaaagaauug

SEQ ID NO: 78556 - RNA, 22 nt, Human
ggagagcuagugagcuggaggu

SEQ ID NO: 78557 - RNA, 22 nt, Human
ggguauuugacaaacugacacu

SEQ ID NO: 78558 - RNA, 19 nt, Human
ggaguugccaggagaagga

SEQ ID NO: 78559 - RNA, 22 nt, Human
ggaguguuaggaaguuguguuu

SEQ ID NO: 78560 - RNA, 22 nt, Human
ggaguguuagacuaaauuggga

SEQ ID NO: 78561 - RNA, 22 nt, Human
ggagaugaaugugguaaaacug

SEQ ID NO: 78562 - RNA, 22 nt, Human
gggguauuugguagacauuuug

SEQ ID NO: 78563 - RNA, 22 nt, Human
ggagaucucauugauacugaua

SEQ ID NO: 78564 - RNA, 22 nt, Human
ggagaucugggcuguuucuggc

SEQ ID NO: 78565 - RNA, 22 nt, Human
gcagcgcugagaugauuuguug

SEQ ID NO: 78566 - RNA, 22 nt, Human
gccuuuugcaaugguguuggug

SEQ ID NO: 78567 - RNA, 22 nt, Human
gccuuucuugguuugucaggca

SEQ ID NO: 78568 - RNA, 22 nt, Human
gcagcucagcacgcacagguaa

SEQ ID NO: 78569 - RNA, 22 nt, Human
gcgguguuuuaacacucccucg

SEQ ID NO: 78570 - RNA, 22 nt, Human
gcaggacugauggagcauaugu

SEQ ID NO: 78571 - RNA, 22 nt, Human
gcaggacuucuguuuaaccagu

SEQ ID NO: 78572 - RNA, 22 nt, Human
gcguggaugauuuugagucggu

SEQ ID NO: 78573 - RNA, 22 nt, Human
gcuaaccaaaccuguuguuugg

SEQ ID NO: 78574 - RNA, 19 nt, Human
gcaguuauggcccacuucc

SEQ ID NO: 78575 - RNA, 22 nt, Human
gcaguuaccuauuuuguagaaa

SEQ ID NO: 78576 - RNA, 22 nt, Human
gcuacaggggucaguccuuugc

SEQ ID NO: 78577 - RNA, 22 nt, Human
gcuacaacugugucuguggggc

SEQ ID NO: 78578 - RNA, 22 nt, Human
gcuacaaauaaaaugggugacu

SEQ ID NO: 78579 - RNA, 22 nt, Human
gcuacaaaaccagggcaaagga

SEQ ID NO: 78580 - RNA, 22 nt, Human
gcauaacaacagacucuguguu

SEQ ID NO: 78581 - RNA, 22 nt, Human
gcaguuguagcuguuucuacuc

SEQ ID NO: 78582 - RNA, 22 nt, Human
gcucaacucaacgucauuugaa

SEQ ID NO: 78583 - RNA, 22 nt, Human
gcaguugugguuucguuuccuu

SEQ ID NO: 78584 - RNA, 22 nt, Human
gcuccuuaugguccugacccua

SEQ ID NO: 78585 - RNA, 22 nt, Human
gcaucuguuguguuaauuuaca

SEQ ID NO: 78586 - RNA, 22 nt, Human
gcaucuccugagucagauuuug

SEQ ID NO: 78587 - RNA, 22 nt, Human
gcaucuguuagagugugcaugc

SEQ ID NO: 78588 - RNA, 22 nt, Human
gcucaacuucuaggacuucagg

SEQ ID NO: 78589 - RNA, 22 nt, Human
gcucugcuccaucuguuuccuc

SEQ ID NO: 78590 - RNA, 22 nt, Human
gcucucuggccugggaggagga

SEQ ID NO: 78591 - RNA, 23 nt, Human
gcucugauaccagcuacaucuag

SEQ ID NO: 78592 - RNA, 22 nt, Human
gcugagcaaugcacugccgcau

SEQ ID NO: 78593 - RNA, 22 nt, Human
gcugagaguguaggauguuuac

SEQ ID NO: 78594 - RNA, 22 nt, Human
gcucuggcugccuuaguuuugu

SEQ ID NO: 78595 - RNA, 22 nt, Human
gcucuggcuacuguggcuaccg

SEQ ID NO: 78596 - RNA, 22 nt, Human
gcucuucuaaguuuacccuucc

SEQ ID NO: 78597 - RNA, 23 nt, Human
gcugagcaccagccauaucuuuu

SEQ ID NO: 78598 - RNA, 22 nt, Human
gcugauucuucugcuuuuucuc

SEQ ID NO: 78599 - RNA, 23 nt, Human
gcauuugcaggaaacuggaaaag

SEQ ID NO: 78600 - RNA, 22 nt, Human
gccagcuuagaucccccagccc

SEQ ID NO: 78601 - RNA, 22 nt, Human
gccaaucaggaggcuguacauc

SEQ ID NO: 78602 - RNA, 22 nt, Human
gcuggaaauaacuuguguagaa

SEQ ID NO: 78603 - RNA, 22 nt, Human
gcugcuuagaaccauauuuaaa

SEQ ID NO: 78604 - RNA, 22 nt, Human
gccauauucaugcaggugcuaa

SEQ ID NO: 78605 - RNA, 22 nt, Human
gcugccucacuagauagguaug

SEQ ID NO: 78606 - RNA, 22 nt, Human
gccaucugcuuagauugcuggg

SEQ ID NO: 78607 - RNA, 21 nt, Human
gcuggcugucucuuacacggu

SEQ ID NO: 78608 - RNA, 22 nt, Human
gcccagaagguagcgaguaguc

SEQ ID NO: 78609 - RNA, 22 nt, Human
gccauguuuugguaaauaccau

SEQ ID NO: 78610 - RNA, 22 nt, Human
gauugauguaggugauaaaucu

SEQ ID NO: 78611 - RNA, 22 nt, Human
gauugcugccagcguguccgug

SEQ ID NO: 78612 - RNA, 22 nt, Human
gauuucauaaaacgagaaacuc

SEQ ID NO: 78613 - RNA, 22 nt, Human
gauuucuucauuuaaaaauauu

SEQ ID NO: 78614 - RNA, 22 nt, Human
gccuucccuccucugcucucag

SEQ ID NO: 78615 - RNA, 22 nt, Human
gccuucauuggaaucuagcuuc

SEQ ID NO: 78616 - RNA, 22 nt, Human
gccuuuauauuacauuuggaag

SEQ ID NO: 78617 - RNA, 22 nt, Human
gccugcuugaaagcacuuucug

SEQ ID NO: 78618 - RNA, 22 nt, Human
gccuggaaugcaaugugacgaa

SEQ ID NO: 78619 - RNA, 22 nt, Human
gccugaaaugaaccagaggacu

SEQ ID NO: 78620 - RNA, 22 nt, Human
gcaacccugggucaugguugac

SEQ ID NO: 78621 - RNA, 22 nt, Human
gccucucagagcuguucaguuu

SEQ ID NO: 78622 - RNA, 22 nt, Human
gccuccuuccgaccucaguccu

SEQ ID NO: 78623 - RNA, 20 nt, Human
gccuccuccaaguuucauca

SEQ ID NO: 78624 - RNA, 22 nt, Human
gauuuucauuauagcuaguuuc

SEQ ID NO: 78625 - RNA, 22 nt, Human
gauuuuaaaagauguauaaggu

SEQ ID NO: 78626 - RNA, 19 nt, Human
gaguaaaacuagagagaaa

SEQ ID NO: 78627 - RNA, 22 nt, Human
gauaagugauucugauucacau

SEQ ID NO: 78628 - RNA, 22 nt, Human
gcaggccuccccugcuggagcu

SEQ ID NO: 78629 - RNA, 22 nt, Human
gauaaugcuuuggucagacaug

SEQ ID NO: 78630 - RNA, 22 nt, Human
gcauuuaaauuugaacuucaga

SEQ ID NO: 78631 - RNA, 22 nt, Human
gcauuccagaguugcuggaaaa

SEQ ID NO: 78632 - RNA, 22 nt, Human
gauauauuucaaauucuuuugc

SEQ ID NO: 78633 - RNA, 22 nt, Human
gauagaaagagaaucagaacuu

SEQ ID NO: 78634 - RNA, 22 nt, Human
gauacuuuguggaauccuggau

SEQ ID NO: 78635 - RNA, 22 nt, Human
gauacaugucacaaguugugca

SEQ ID NO: 78636 - RNA, 22 nt, Human
gcauguucaaguuaguauauuu

SEQ ID NO: 78637 - RNA, 22 nt, Human
gcauuagacuaguacacggcag

SEQ ID NO: 78638 - RNA, 22 nt, Human
gaugcuaauuaaugaagaggag

SEQ ID NO: 78639 - RNA, 22 nt, Human
gauauggaaacuugauguugug

SEQ ID NO: 78640 - RNA, 22 nt, Human
gaugccuccaggaaagaggacg

SEQ ID NO: 78641 - RNA, 22 nt, Human
gauggcaaugcuagaaauuuag

SEQ ID NO: 78642 - RNA, 22 nt, Human
gauggcauucacaaacuuaacu

SEQ ID NO: 78643 - RNA, 22 nt, Human
gaucauuuucauuaauguugca

SEQ ID NO: 78644 - RNA, 22 nt, Human
gaugauaacagcauuucaacug

SEQ ID NO: 78645 - RNA, 22 nt, Human
gauauuuugugaaaaaacaacu

SEQ ID NO: 78646 - RNA, 22 nt, Human
gauauucauaggcagguauuua

SEQ ID NO: 78647 - RNA, 22 nt, Human
gcauuuuaauuggggcaguuag

SEQ ID NO: 78648 - RNA, 22 nt, Human
gcauuucuguuuuuuuaaauga

SEQ ID NO: 78649 - RNA, 22 nt, Human
gagggauuuuagugcagcaacu

SEQ ID NO: 78650 - RNA, 22 nt, Human
gcagagaaugucagauuuuguu

SEQ ID NO: 78651 - RNA, 22 nt, Human
gcagauaaaauuuuugauggga

SEQ ID NO: 78652 - RNA, 22 nt, Human
gaggggaauguuccugagcugg

SEQ ID NO: 78653 - RNA, 22 nt, Human
gaggguaagcugggacuccucg

SEQ ID NO: 78654 - RNA, 20 nt, Human
gcagcagacagacaggggac

SEQ ID NO: 78655 - RNA, 22 nt, Human
gaggucuugagugacuuagcag

SEQ ID NO: 78656 - RNA, 22 nt, Human
gagguagaggaaaagauuauca

SEQ ID NO: 78657 - RNA, 20 nt, Human
gcagcugacccuagugcuug

SEQ ID NO: 78658 - RNA, 22 nt, Human
gcaggaagauugcagaaggcug

SEQ ID NO: 78659 - RNA, 21 nt, Human
gcacucagucacuacucaaga

SEQ ID NO: 78660 - RNA, 22 nt, Human
gcacuaccaguaauuaaaucug

SEQ ID NO: 78661 - RNA, 22 nt, Human
gaggcauaaguagaagagauug

SEQ ID NO: 78662 - RNA, 22 nt, Human
gaggauuugagggucacuccac

SEQ ID NO: 78663 - RNA, 22 nt, Human
gaggcagaggaugggacuguau

SEQ ID NO: 78664 - RNA, 22 nt, Human
gcacauauuuagaucuugaugu

SEQ ID NO: 78665 - RNA, 22 nt, Human
gcaccacccaaaggcggggcuc

SEQ ID NO: 78666 - RNA, 22 nt, Human
gaggcucagagggacuuucaag

SEQ ID NO: 78667 - RNA, 22 nt, Human
gcacucugggucaucugcugcc

SEQ ID NO: 78668 - RNA, 22 nt, Human
gagggagagaugcuggaccggg

SEQ ID NO: 78669 - RNA, 21 nt, Human
gcagaaagugauuugcuauuc

SEQ ID NO: 78670 - RNA, 22 nt, Human
gaggcaggaagggaggguugug

SEQ ID NO: 78671 - RNA, 22 nt, Human
gaggaggacauuggaaagaacu

SEQ ID NO: 78672 - RNA, 22 nt, Human
gaggaggagacggaggccuggg

SEQ ID NO: 78673 - RNA, 21 nt, Human
gcacaacucucacauucuucu

SEQ ID NO: 78674 - RNA, 22 nt, Human
gaggauaaugaaucugaaucau

SEQ ID NO: 78675 - RNA, 22 nt, Human
gcacagaguguaaaaguuucau

SEQ ID NO: 78676 - RNA, 22 nt, Human
gaggacuucaggccuggccagg

SEQ ID NO: 78677 - RNA, 22 nt, Human
gagcuuuagcugagaccugcuu

SEQ ID NO: 78678 - RNA, 22 nt, Human
gaggaagucuuaucuggaugca

SEQ ID NO: 78679 - RNA, 22 nt, Human
gcaagagaagaaagaauaguuu

SEQ ID NO: 78680 - RNA, 22 nt, Human
gaggagaaacagccgugauagu

SEQ ID NO: 78681 - RNA, 22 nt, Human
gcaauuggaaugaauucuauuu

SEQ ID NO: 78682 - RNA, 22 nt, Human
gcaacuccuaggcgaggccuuc

SEQ ID NO: 78683 - RNA, 22 nt, Human
gcaauaaguuuucucuucuguc

SEQ ID NO: 78684 - RNA, 22 nt, Human
gcaauuguauugucaagacaug

SEQ ID NO: 78685 - RNA, 22 nt, Human
gaggagagcuggccagguuucu

SEQ ID NO: 78686 - RNA, 22 nt, Human
gauuaaaggucuugauuauaag

SEQ ID NO: 78687 - RNA, 22 nt, Human
gagcaggucuuugguaaugcuu

SEQ ID NO: 78688 - RNA, 22 nt, Human
gauuaagaaagauagaugugga

SEQ ID NO: 78689 - RNA, 19 nt, Human
gagcaugacuggccuugca

SEQ ID NO: 78690 - RNA, 22 nt, Human
gagccaugagauaagagcaccu

SEQ ID NO: 78691 - RNA, 22 nt, Human
gauucuaucauucuguauauua

SEQ ID NO: 78692 - RNA, 22 nt, Human
gauucugaaauuaacagacugg

SEQ ID NO: 78693 - RNA, 22 nt, Human
gauugcaucaauauuuagagua

SEQ ID NO: 78694 - RNA, 22 nt, Human
gauugauuuaauaugagaggau

SEQ ID NO: 78695 - RNA, 22 nt, Human
gauugcauaugcauucugauac

SEQ ID NO: 78696 - RNA, 22 nt, Human
gauuggucacacaauaguauau

SEQ ID NO: 78697 - RNA, 22 nt, Human
gauugggagugugacauuguau

SEQ ID NO: 78698 - RNA, 22 nt, Human
gagccuaggguucagacuuucc

SEQ ID NO: 78699 - RNA, 22 nt, Human
gagccucaggguuuuguugaca

SEQ ID NO: 78700 - RNA, 22 nt, Human
gagcgcacagaaggaagcagcc

SEQ ID NO: 78701 - RNA, 22 nt, Human
gagccuaccugcugcucuuuca

SEQ ID NO: 78702 - RNA, 22 nt, Human
gauuuugaaccuuauuuggaaa

SEQ ID NO: 78703 - RNA, 21 nt, Human
gauuuuagggcagccaaacac

SEQ ID NO: 78704 - RNA, 22 nt, Human
gagcucucgggcuggggcguug

SEQ ID NO: 78705 - RNA, 22 nt, Human
gagcuaauagacagcaacauca

SEQ ID NO: 78706 - RNA, 22 nt, Human
gcaaagaauugauucauuuugc

SEQ ID NO: 78707 - RNA, 22 nt, Human
gauuuuuaaaaguaguuuugaa

SEQ ID NO: 78708 - RNA, 22 nt, Human
gcaaaaacaguguagucuucug

SEQ ID NO: 78709 - RNA, 22 nt, Human
gagauccccagugugucucggc

SEQ ID NO: 78710 - RNA, 22 nt, Human
gaugggaaggugguaaaguuua

SEQ ID NO: 78711 - RNA, 22 nt, Human
gagaguuggaggguauguuagu

SEQ ID NO: 78712 - RNA, 22 nt, Human
gagauuaauuaaaaccuuuaug

SEQ ID NO: 78713 - RNA, 22 nt, Human
gagauggauuuuuuugccaguc

SEQ ID NO: 78714 - RNA, 22 nt, Human
gagauuucauuugugaggcuca

SEQ ID NO: 78715 - RNA, 22 nt, Human
gaugguggaggaaucgcugaag

SEQ ID NO: 78716 - RNA, 22 nt, Human
gauggggaaaaaauggaucuuu

SEQ ID NO: 78717 - RNA, 22 nt, Human
gaugguuuuacauuuuaauguu

SEQ ID NO: 78718 - RNA, 22 nt, Human
gauguaucugagcugcuuaggu

SEQ ID NO: 78719 - RNA, 22 nt, Human
gaugucauguuggcagacaguu

SEQ ID NO: 78720 - RNA, 22 nt, Human
gauguuaauauguuucaccaaa

SEQ ID NO: 78721 - RNA, 22 nt, Human
gaugguggggggcagcugggag

SEQ ID NO: 78722 - RNA, 22 nt, Human
gagcacuucagcauaaaucaca

SEQ ID NO: 78723 - RNA, 22 nt, Human
gagauuugaguuccuacugagu

SEQ ID NO: 78724 - RNA, 22 nt, Human
gaugcucuugauuggaccaggg

SEQ ID NO: 78725 - RNA, 22 nt, Human
gagagucuuaaguuacagaacu

SEQ ID NO: 78726 - RNA, 22 nt, Human
gagagcaaaccuguguuuggag

SEQ ID NO: 78727 - RNA, 22 nt, Human
gagaggaagugccugcucccag

SEQ ID NO: 78728 - RNA, 22 nt, Human
gagagaggggaagagaagcucu

SEQ ID NO: 78729 - RNA, 22 nt, Human
gagccauggaggaugugcagca

SEQ ID NO: 78730 - RNA, 20 nt, Human
gagaauuccagguuucugug

SEQ ID NO: 78731 - RNA, 22 nt, Human
gaagauuauuacucauugcagg

SEQ ID NO: 78732 - RNA, 22 nt, Human
gagaccaagcgugggugauaau

SEQ ID NO: 78733 - RNA, 23 nt, Human
gaugauggcaacuacauccggug

SEQ ID NO: 78734 - RNA, 22 nt, Human
gagagagacugggaaaucauca

SEQ ID NO: 78735 - RNA, 22 nt, Human
gagagaaggaagugaauuuccc

SEQ ID NO: 78736 - RNA, 22 nt, Human
gaugauuccuuuguucauugug

SEQ ID NO: 78737 - RNA, 22 nt, Human
gaugauuuuguaacuggggaca

SEQ ID NO: 78738 - RNA, 22 nt, Human
aaaagaaugaugggagcugggu

SEQ ID NO: 78739 - RNA, 22 nt, Human
aaaaauuucuggugaaaugccu

SEQ ID NO: 78740 - RNA, 22 nt, Human
aaaaccugcaagaugaaaucag

SEQ ID NO: 78741 - RNA, 22 nt, Human
aaaauaauauuauaccacugcu

SEQ ID NO: 78742 - RNA, 22 nt, Human
aaaagggucugacacugcuuga

SEQ ID NO: 78743 - RNA, 22 nt, Human
aaaauaaccuucauuugcauug

SEQ ID NO: 78744 - RNA, 22 nt, Human
aaaagguuauagcuuugccuug

SEQ ID NO: 78745 - RNA, 22 nt, Human
aaaaggucacuguaaaaugacg

SEQ ID NO: 78746 - RNA, 22 nt, Human
aaaaggaagaguuuucagagac

SEQ ID NO: 78747 - RNA, 22 nt, Human
aaaagauguaaacauauauuaa

SEQ ID NO: 78748 - RNA, 22 nt, Human
aaacaauaauaauuaggaagga

SEQ ID NO: 78749 - RNA, 22 nt, Human
aaacagguuugaacuucuuaac

SEQ ID NO: 78750 - RNA, 22 nt, Human
aaaaugggaaaauuuuagauua

SEQ ID NO: 78751 - RNA, 22 nt, Human
aaacuagaacagagagagaagc

SEQ ID NO: 78752 - RNA, 22 nt, Human
aaaauauuuaucuagcucuuaa

SEQ ID NO: 78753 - RNA, 17 nt, Human
aaaaucaaaggaggugc

SEQ ID NO: 78754 - RNA, 22 nt, Human
aaaaucucagaaaaguuuaggu

SEQ ID NO: 78755 - RNA, 22 nt, Human
aaaauuuccuuggaccauuuuu

SEQ ID NO: 78756 - RNA, 22 nt, Human
aaacaaauccaauaauaaaauu

SEQ ID NO: 78757 - RNA, 22 nt, Human
aaaauauucuauaucaaagaua

SEQ ID NO: 78758 - RNA, 22 nt, Human
aaaaguauaagugucuccugau

SEQ ID NO: 78759 - RNA, 22 nt, Human
aaaagguauuuagcgauugcau

SEQ ID NO: 78760 - RNA, 22 nt, Human
aaagaugaaguucagcgaagaa

SEQ ID NO: 78761 - RNA, 22 nt, Human
aaagagugugcauguaccugug

SEQ ID NO: 78762 - RNA, 23 nt, Human
aaagaggugaauccaggacaagc

SEQ ID NO: 78763 - RNA, 22 nt, Human
aaagcauucuaaccgaucgacg

SEQ ID NO: 78764 - RNA, 20 nt, Human
aaagauacuuuuuguaaugg

SEQ ID NO: 78765 - RNA, 22 nt, Human
aaacuuuaucaaguacucuuca

SEQ ID NO: 78766 - RNA, 23 nt, Human
aaacuacauuuauaguuuuucuc

SEQ ID NO: 78767 - RNA, 22 nt, Human
aaacccuagcguuguuuauuga

SEQ ID NO: 78768 - RNA, 22 nt, Human
aaacgcaauuucuugcauguca

SEQ ID NO: 78769 - RNA, 21 nt, Human
aaagaagagcucagagguaga

SEQ ID NO: 78770 - RNA, 22 nt, Human
aaagaacguuucugggaaucag

SEQ ID NO: 78771 - RNA, 22 nt, Human
aaagaguuguauucuuuuugag

SEQ ID NO: 78772 - RNA, 22 nt, Human
aaagaguuaagagucuuaagcu

SEQ ID NO: 78773 - RNA, 17 nt, Human
aaagccgaucagauguu

SEQ ID NO: 78774 - RNA, 22 nt, Human
aaagcaaauaguugcuuaauau

SEQ ID NO: 78775 - RNA, 22 nt, Human
aaagccauaucuauucuauucu

SEQ ID NO: 78776 - RNA, 22 nt, Human
aaagaugucauacacauuaaga

SEQ ID NO: 78777 - RNA, 22 nt, Human
aaaggaaacuaugaaucucugg

SEQ ID NO: 78778 - RNA, 22 nt, Human
aaaggagugaaaugagaggaaa

SEQ ID NO: 78779 - RNA, 22 nt, Human
aaagccaagguccauguacuuu

SEQ ID NO: 78780 - RNA, 22 nt, Human
aaagggagauaaaguaauuuua

SEQ ID NO: 78781 - RNA, 22 nt, Human
aaagggaugauuucugaagaua

SEQ ID NO: 78782 - RNA, 22 nt, Human
aaagggcugaaguagucucugu

SEQ ID NO: 78783 - RNA, 22 nt, Human
aaagccaagucugauuuuguug

SEQ ID NO: 78784 - RNA, 22 nt, Human
aaagcccuccaggguauacauu

SEQ ID NO: 78785 - RNA, 22 nt, Human
aaaggcaugugcaacuacaaau

SEQ ID NO: 78786 - RNA, 22 nt, Human
aaagcuccaaauggguggaagu

SEQ ID NO: 78787 - RNA, 22 nt, Human
aaagcgagccggcuuggaggga

SEQ ID NO: 78788 - RNA, 22 nt, Human
aaagccuacagucaugguuaga

SEQ ID NO: 78789 - RNA, 22 nt, Human
aaagcugaaacgaaaugacaac

SEQ ID NO: 78790 - RNA, 22 nt, Human
aaaguagaugagaauuuuguug

SEQ ID NO: 78791 - RNA, 21 nt, Human
aaagugguaaggauuauuuug

SEQ ID NO: 78792 - RNA, 22 nt, Human
aaaguguuaacacuggcuacuu

SEQ ID NO: 78793 - RNA, 22 nt, Human
aaaguuacacgacuauuuaugu

SEQ ID NO: 78794 - RNA, 22 nt, Human
aaaguaaagccuauuuaauaau

SEQ ID NO: 78795 - RNA, 22 nt, Human
aaauaggaguagugauguauua

SEQ ID NO: 78796 - RNA, 22 nt, Human
aaaguagaauaauaaacccuug

SEQ ID NO: 78797 - RNA, 22 nt, Human
aaauagucagaaaucaacgugc

SEQ ID NO: 78798 - RNA, 22 nt, Human
aaaguuuguacugggaguuacu

SEQ ID NO: 78799 - RNA, 22 nt, Human
aaaucaaaagugguuauuuuau

SEQ ID NO: 78800 - RNA, 22 nt, Human
aaaguuguccuuugugccuuua

SEQ ID NO: 78801 - RNA, 22 nt, Human
aaauagauuugacuacuuggug

SEQ ID NO: 78802 - RNA, 22 nt, Human
aaaucgcuugaacccaggaagu

SEQ ID NO: 78803 - RNA, 21 nt, Human
aaauccagugaucuccucuaa

SEQ ID NO: 78804 - RNA, 22 nt, Human
aaaucauagccaugaacauuug

SEQ ID NO: 78805 - RNA, 22 nt, Human
aaaguguuuaacaaauugcuuu

SEQ ID NO: 78806 - RNA, 22 nt, Human
aaauauauauaauauauauauu

SEQ ID NO: 78807 - RNA, 22 nt, Human
aaauauuaaugaugaagguagu

SEQ ID NO: 78808 - RNA, 22 nt, Human
aaaguugcauccuaugaccuca

SEQ ID NO: 78809 - RNA, 22 nt, Human
aaauauuugaaugguguaagau

SEQ ID NO: 78810 - RNA, 22 nt, Human
aacaggcuaaauuguccauuuc

SEQ ID NO: 78811 - RNA, 22 nt, Human
aacaaagaaaagcuugagguuu

SEQ ID NO: 78812 - RNA, 19 nt, Human
aacaaaauaguucuaguua

SEQ ID NO: 78813 - RNA, 22 nt, Human
aacauuuauguuuugaccaagu

SEQ ID NO: 78814 - RNA, 22 nt, Human
aacaugggcaacuucuuuucag

SEQ ID NO: 78815 - RNA, 22 nt, Human
aacacaguuucucuaugagagu

SEQ ID NO: 78816 - RNA, 22 nt, Human
aacacaucagcacacuaacgga

SEQ ID NO: 78817 - RNA, 22 nt, Human
aacaaguagaauagguuuuuuu

SEQ ID NO: 78818 - RNA, 22 nt, Human
aacaaccuaguaguaucuuuca

SEQ ID NO: 78819 - RNA, 20 nt, Human
aacagcucucgacuuaucuu

SEQ ID NO: 78820 - RNA, 22 nt, Human
aacagagauucuucccuucuuu

SEQ ID NO: 78821 - RNA, 22 nt, Human
aacaaagaacuuucuuccuuug

SEQ ID NO: 78822 - RNA, 22 nt, Human
aaauguauuagccuaugugaga

SEQ ID NO: 78823 - RNA, 22 nt, Human
aaauuuauaacuuaaagugaau

SEQ ID NO: 78824 - RNA, 22 nt, Human
aaauugcauuuuaaagguagau

SEQ ID NO: 78825 - RNA, 22 nt, Human
aaaucuuccugaaauuuguuca

SEQ ID NO: 78826 - RNA, 22 nt, Human
aaauuaggcccugauuuuaugu

SEQ ID NO: 78827 - RNA, 22 nt, Human
aaauuagucacaccagugucuu

SEQ ID NO: 78828 - RNA, 22 nt, Human
aaauggaaguuuguucucagcc

SEQ ID NO: 78829 - RNA, 22 nt, Human
aaaucaagucagcugaauucca

SEQ ID NO: 78830 - RNA, 22 nt, Human
aaauauugaauuugaggaugua

SEQ ID NO: 78831 - RNA, 22 nt, Human
aaaguuacccaaucucuaugaa

SEQ ID NO: 78832 - RNA, 22 nt, Human
aaauauuagacauaccuggaga

SEQ ID NO: 78833 - RNA, 22 nt, Human
aaaucugaauuaaaaucugguu

SEQ ID NO: 78834 - RNA, 22 nt, Human
aaaucuuucacauauuuuuuau

SEQ ID NO: 78835 - RNA, 22 nt, Human
aaauauauccuucuguccugcc

SEQ ID NO: 78836 - RNA, 22 nt, Human
aaauauagugacacuuauaguc

SEQ ID NO: 78837 - RNA, 22 nt, Human
aaugcuaaagaagaaggaguag

SEQ ID NO: 78838 - RNA, 22 nt, Human
aaucccaguugacagaacuguu

SEQ ID NO: 78839 - RNA, 22 nt, Human
aaucaugagguguuucuuugca

SEQ ID NO: 78840 - RNA, 22 nt, Human
aaucacuuagaacccaggaagu

SEQ ID NO: 78841 - RNA, 22 nt, Human
aaucacuucuuugucuucuuca

SEQ ID NO: 78842 - RNA, 22 nt, Human
aaugcuuuuugcgaaaugugca

SEQ ID NO: 78843 - RNA, 22 nt, Human
aaugcugugggauagggcuccu

SEQ ID NO: 78844 - RNA, 22 nt, Human
aaugcugugauuuauuaaguau

SEQ ID NO: 78845 - RNA, 22 nt, Human
aauggaaaaagaacuguuuaaa

SEQ ID NO: 78846 - RNA, 22 nt, Human
aauggaaaaauccacagggaac

SEQ ID NO: 78847 - RNA, 22 nt, Human
aauggaugauuaaauggaugaa

SEQ ID NO: 78848 - RNA, 22 nt, Human
aauggcaauagugcauuaugua

SEQ ID NO: 78849 - RNA, 22 nt, Human
aauguuugaacuuugcauauuu

SEQ ID NO: 78850 - RNA, 22 nt, Human
aauguuuuucaaguguggagca

SEQ ID NO: 78851 - RNA, 22 nt, Human
aauguuaguauuuaagagcuug

SEQ ID NO: 78852 - RNA, 22 nt, Human
aauuaaauguuugguuugagcu

SEQ ID NO: 78853 - RNA, 22 nt, Human
aauuauguugaaauaugagaac

SEQ ID NO: 78854 - RNA, 22 nt, Human
aauuauguuugcuuuagaugga

SEQ ID NO: 78855 - RNA, 22 nt, Human
aauuauuaagcuuucuccagug

SEQ ID NO: 78856 - RNA, 22 nt, Human
aauuauuaucauuaucuuccug

SEQ ID NO: 78857 - RNA, 22 nt, Human
aauuauuauguggaagacgacg

SEQ ID NO: 78858 - RNA, 22 nt, Human
aauuauucaugucugggcagcc

SEQ ID NO: 78859 - RNA, 22 nt, Human
aaugguagaguauuuuaauccu

SEQ ID NO: 78860 - RNA, 23 nt, Human
aaugugaaauugaguuuuuguua

SEQ ID NO: 78861 - RNA, 22 nt, Human
aaugugcugguaacugcuuugc

SEQ ID NO: 78862 - RNA, 22 nt, Human
aauguggaguugguuuccuucc

SEQ ID NO: 78863 - RNA, 22 nt, Human
aauguucauauggguagcagau

SEQ ID NO: 78864 - RNA, 22 nt, Human
aauuuaaguuauugcuaaugug

SEQ ID NO: 78865 - RNA, 22 nt, Human
aauugguuugaauaaauaaaga

SEQ ID NO: 78866 - RNA, 20 nt, Human
aauuuagaguuuuaccaagg

SEQ ID NO: 78867 - RNA, 22 nt, Human
aauuuaauugguuuuuacuugu

SEQ ID NO: 78868 - RNA, 22 nt, Human
aauuuauccuuuugcuaaagca

SEQ ID NO: 78869 - RNA, 22 nt, Human
aauuucagaccaacgagucagg

SEQ ID NO: 78870 - RNA, 22 nt, Human
aauugcuuucacaaguguuaua

SEQ ID NO: 78871 - RNA, 22 nt, Human
aauugcauucauuuguauauuu

SEQ ID NO: 78872 - RNA, 22 nt, Human
aauugauauuagauuugucuca

SEQ ID NO: 78873 - RNA, 22 nt, Human
aauucugcagucguacuauaau

SEQ ID NO: 78874 - RNA, 22 nt, Human
aauuauugucuuuuuuaaaagc

SEQ ID NO: 78875 - RNA, 21 nt, Human
aauugccuaauauaugggaag

SEQ ID NO: 78876 - RNA, 21 nt, Human
aauuauuugcauuuuucuugu

SEQ ID NO: 78877 - RNA, 22 nt, Human
aauucuguugguuagaguugga

SEQ ID NO: 78878 - RNA, 21 nt, Human
acaaaaccuaacuuggcugcu

SEQ ID NO: 78879 - RNA, 22 nt, Human
aauuuuauuuuuuccccuagau

SEQ ID NO: 78880 - RNA, 22 nt, Human
aauuuuagcuaaagauccaugg

SEQ ID NO: 78881 - RNA, 22 nt, Human
aauuuuauuagacaggcauaau

SEQ ID NO: 78882 - RNA, 22 nt, Human
aauuucuuuagagguacugauc

SEQ ID NO: 78883 - RNA, 22 nt, Human
aauuucuccuuuucaguuagau

SEQ ID NO: 78884 - RNA, 22 nt, Human
aauuucuuucagcugcuuuaag

SEQ ID NO: 78885 - RNA, 22 nt, Human
acaaagugaaaagcaucgaauu

SEQ ID NO: 78886 - RNA, 18 nt, Human
acaaaaauagugcuuugg

SEQ ID NO: 78887 - RNA, 22 nt, Human
acaaaaauauuguagaagugcu

SEQ ID NO: 78888 - RNA, 22 nt, Human
acaaacugggauaggauccugu

SEQ ID NO: 78889 - RNA, 20 nt, Human
acaaccacugcucacaguuu

SEQ ID NO: 78890 - RNA, 22 nt, Human
acaaaucccuguaaacacagcu

SEQ ID NO: 78891 - RNA, 22 nt, Human
acaaauuuaaauguugucuguu

SEQ ID NO: 78892 - RNA, 22 nt, Human
acaacagaacuccugggauuuu

SEQ ID NO: 78893 - RNA, 22 nt, Human
acaaccaugucaguucaaacca

SEQ ID NO: 78894 - RNA, 22 nt, Human
acaaggaagaaaacauuacuuu

SEQ ID NO: 78895 - RNA, 22 nt, Human
acaacuuuaauggguuucagcu

SEQ ID NO: 78896 - RNA, 20 nt, Human
acaacuuaguugagagacua

SEQ ID NO: 78897 - RNA, 22 nt, Human
acaagguugauucuggcaucug

SEQ ID NO: 78898 - RNA, 22 nt, Human
acaagaaaggucugggaacaau

SEQ ID NO: 78899 - RNA, 22 nt, Human
acaauaauguuuuuagguuauu

SEQ ID NO: 78900 - RNA, 22 nt, Human
acaaguuucauuguuuagaacc

SEQ ID NO: 78901 - RNA, 22 nt, Human
acaaucagcacugaguuuaucu

SEQ ID NO: 78902 - RNA, 22 nt, Human
acacaacuuuauuaauuuauac

SEQ ID NO: 78903 - RNA, 22 nt, Human
acaaucuuauuaguaguauaga

SEQ ID NO: 78904 - RNA, 17 nt, Human
acaaugggcaacaauau

SEQ ID NO: 78905 - RNA, 21 nt, Human
acacagcuggagcaucccggu

SEQ ID NO: 78906 - RNA, 22 nt, Human
acacagugaccuacauuccaaa

SEQ ID NO: 78907 - RNA, 22 nt, Human
acacaggacacaaaagucacca

SEQ ID NO: 78908 - RNA, 22 nt, Human
acacccuugcagacgguuccuu

SEQ ID NO: 78909 - RNA, 22 nt, Human
acacuagcgcaaauacgcccau

SEQ ID NO: 78910 - RNA, 22 nt, Human
acacuuuugcgagagcaugcag

SEQ ID NO: 78911 - RNA, 22 nt, Human
acacucagaaaggcagagguuc

SEQ ID NO: 78912 - RNA, 23 nt, Human
acagcaagaggaccagaugugag

SEQ ID NO: 78913 - RNA, 22 nt, Human
acagaucuauauuauauauaca

SEQ ID NO: 78914 - RNA, 22 nt, Human
acagaauugggguucuugggga

SEQ ID NO: 78915 - RNA, 22 nt, Human
acagacuugaccuuggagaggc

SEQ ID NO: 78916 - RNA, 22 nt, Human
acagacuuuuagacuuaugagu

SEQ ID NO: 78917 - RNA, 22 nt, Human
acagagcucccagccaucuccu

SEQ ID NO: 78918 - RNA, 22 nt, Human
acagaucugcacagugaacaau

SEQ ID NO: 78919 - RNA, 22 nt, Human
acacucaugcucagcuggugcu

SEQ ID NO: 78920 - RNA, 22 nt, Human
acagacaucaucaacaucuucc

SEQ ID NO: 78921 - RNA, 21 nt, Human
acagaaguggcuuggucucag

SEQ ID NO: 78922 - RNA, 22 nt, Human
acagacuuaguauccugcugcu

SEQ ID NO: 78923 - RNA, 22 nt, Human
acagcagguuauuguuauggca

SEQ ID NO: 78924 - RNA, 22 nt, Human
acagcuauuuaaaggcuuuagg

SEQ ID NO: 78925 - RNA, 20 nt, Human
acagagauccucucuuuauc

SEQ ID NO: 78926 - RNA, 22 nt, Human
acagcaauccuggcagaggguu

SEQ ID NO: 78927 - RNA, 22 nt, Human
acagcugagaugcuacuugugg

SEQ ID NO: 78928 - RNA, 22 nt, Human
acaggaaaugaaaugguaucua

SEQ ID NO: 78929 - RNA, 22 nt, Human
acagcucaggcccaucaacccc

SEQ ID NO: 78930 - RNA, 22 nt, Human
acaggaaugaagaugagagagu

SEQ ID NO: 78931 - RNA, 19 nt, Human
acaggaaggaaaauuucaa

SEQ ID NO: 78932 - RNA, 22 nt, Human
acagguuggagguguggaguca

SEQ ID NO: 78933 - RNA, 22 nt, Human
acagguuucuccccugguuauu

SEQ ID NO: 78934 - RNA, 22 nt, Human
acagguaucccuuucuaccuga

SEQ ID NO: 78935 - RNA, 22 nt, Human
acaggccuggguucaaauuugg

SEQ ID NO: 78936 - RNA, 22 nt, Human
acagucuuggauuccaggaguc

SEQ ID NO: 78937 - RNA, 22 nt, Human
acaggauuuucagggaagguga

SEQ ID NO: 78938 - RNA, 22 nt, Human
acauauggcagguugaucaaug

SEQ ID NO: 78939 - RNA, 22 nt, Human
acaggggauaggcaggaaggca

SEQ ID NO: 78940 - RNA, 22 nt, Human
acauaaacaugcagccugccaa

SEQ ID NO: 78941 - RNA, 19 nt, Human
acaguucuguggccuguuc

SEQ ID NO: 78942 - RNA, 22 nt, Human
acaguuuucugagaaucacagg

SEQ ID NO: 78943 - RNA, 22 nt, Human
acauaaauagcacugugaauuu

SEQ ID NO: 78944 - RNA, 22 nt, Human
acauagcuuaaaugagaagaua

SEQ ID NO: 78945 - RNA, 22 nt, Human
acagugugcaagaaauggggga

SEQ ID NO: 78946 - RNA, 22 nt, Human
acagucucucaagcauauccug

SEQ ID NO: 78947 - RNA, 22 nt, Human
aaggaaaguuaagguaaacucu

SEQ ID NO: 78948 - RNA, 22 nt, Human
aaggaacuucagggcgaaugga

SEQ ID NO: 78949 - RNA, 22 nt, Human
aaggaaaaaauggcuugugaua

SEQ ID NO: 78950 - RNA, 22 nt, Human
aagcuuugggcagaagaggauu

SEQ ID NO: 78951 - RNA, 22 nt, Human
aagggaaaagcugaaugagaug

SEQ ID NO: 78952 - RNA, 22 nt, Human
aaggcuuugugcugaguugucg

SEQ ID NO: 78953 - RNA, 22 nt, Human
aagggagaguauccagaaacag

SEQ ID NO: 78954 - RNA, 22 nt, Human
aagggagagggagaagguggga

SEQ ID NO: 78955 - RNA, 22 nt, Human
aaggggauuuaagguaagaaga

SEQ ID NO: 78956 - RNA, 22 nt, Human
aaggucucucgggcuuugcuga

SEQ ID NO: 78957 - RNA, 22 nt, Human
aaguagaaaaccgcacuggacu

SEQ ID NO: 78958 - RNA, 22 nt, Human
aaguccgggcagcaggaauucu

SEQ ID NO: 78959 - RNA, 20 nt, Human
aagucuauuuagaguugcuu

SEQ ID NO: 78960 - RNA, 22 nt, Human
aaguauuccccaaguauucugg

SEQ ID NO: 78961 - RNA, 22 nt, Human
aagugauuuagagagcucuuag

SEQ ID NO: 78962 - RNA, 22 nt, Human
aagugauuuucccaccaucuac

SEQ ID NO: 78963 - RNA, 22 nt, Human
aagugaggagaccucuucuuca

SEQ ID NO: 78964 - RNA, 22 nt, Human
aagugagaugggagucagagga

SEQ ID NO: 78965 - RNA, 22 nt, Human
aagugauauaaaucgagaggga

SEQ ID NO: 78966 - RNA, 22 nt, Human
aagugaaaaaagucaguacuga

SEQ ID NO: 78967 - RNA, 22 nt, Human
aagucuuugagaucggacauag

SEQ ID NO: 78968 - RNA, 20 nt, Human
aauaaauauaacccauaauu

SEQ ID NO: 78969 - RNA, 22 nt, Human
aauaaagcuugaaagcagggaa

SEQ ID NO: 78970 - RNA, 16 nt, Human
aaguuuuaucuucuca

SEQ ID NO: 78971 - RNA, 21 nt, Human
aaguuucucccuaauuguugc

SEQ ID NO: 78972 - RNA, 21 nt, Human
aaguuuuggcuguacaguugu

SEQ ID NO: 78973 - RNA, 22 nt, Human
aauaacuuacucuaugcuuagu

SEQ ID NO: 78974 - RNA, 22 nt, Human
aauaagagaauaaaaucuguua

SEQ ID NO: 78975 - RNA, 22 nt, Human
aagugauuuuccuacuugcuaa

SEQ ID NO: 78976 - RNA, 23 nt, Human
aagugcucaguggacagcauugc

SEQ ID NO: 78977 - RNA, 20 nt, Human
aagugcuguuagcugccuga

SEQ ID NO: 78978 - RNA, 20 nt, Human
aaguugaaguuacuucaugg

SEQ ID NO: 78979 - RNA, 22 nt, Human
aaguucuugguuaauuagggaa

SEQ ID NO: 78980 - RNA, 22 nt, Human
aaguugaaugucuugcugaaug

SEQ ID NO: 78981 - RNA, 22 nt, Human
aaguucuuauguucugaugugc

SEQ ID NO: 78982 - RNA, 22 nt, Human
aaguuuaagguagugaugauga

SEQ ID NO: 78983 - RNA, 22 nt, Human
aauagagacaguuuaacaauau

SEQ ID NO: 78984 - RNA, 22 nt, Human
aauagaguccuguacugaauga

SEQ ID NO: 78985 - RNA, 22 nt, Human
aauagcuuuuuguuugguguau

SEQ ID NO: 78986 - RNA, 22 nt, Human
aauagcaauuacccuucaacuc

SEQ ID NO: 78987 - RNA, 22 nt, Human
aauaauuuuuuugugauuaugu

SEQ ID NO: 78988 - RNA, 20 nt, Human
aauagcacagcucaaacauu

SEQ ID NO: 78989 - RNA, 22 nt, Human
aauauuuaaauagaauuacauc

SEQ ID NO: 78990 - RNA, 22 nt, Human
aauaugccaaauccugucacau

SEQ ID NO: 78991 - RNA, 23 nt, Human
aaucacuggauuugagcaugagg

SEQ ID NO: 78992 - RNA, 22 nt, Human
aauauuuugggacugaggaauu

SEQ ID NO: 78993 - RNA, 22 nt, Human
aaucaucuguuguucccuugga

SEQ ID NO: 78994 - RNA, 22 nt, Human
aauaugucacacuccuuaauag

SEQ ID NO: 78995 - RNA, 22 nt, Human
aagcaggaaaugaaaugcuugc

SEQ ID NO: 78996 - RNA, 22 nt, Human
aagcaugagguggugagugaca

SEQ ID NO: 78997 - RNA, 22 nt, Human
aagcucuauaggagauacagua

SEQ ID NO: 78998 - RNA, 22 nt, Human
aagcucagcugguggugauugc

SEQ ID NO: 78999 - RNA, 22 nt, Human
aagcaacccagugcuuguauag

SEQ ID NO: 79000 - RNA, 22 nt, Human
aaggaaaaccugacugaagaac

SEQ ID NO: 79001 - RNA, 22 nt, Human
aagcuuugaauauuagaccuug

SEQ ID NO: 79002 - RNA, 22 nt, Human
aagcccuuugaaaauguguguc

SEQ ID NO: 79003 - RNA, 22 nt, Human
aagccuguugacagcugucagu

SEQ ID NO: 79004 - RNA, 22 nt, Human
aagcucugggacugaggcuccu

SEQ ID NO: 79005 - RNA, 22 nt, Human
aagcugcagacccccugucuca

SEQ ID NO: 79006 - RNA, 22 nt, Human
aaggauuuccaggccugcgccu

SEQ ID NO: 79007 - RNA, 22 nt, Human
aaggcacuugcccagagcugca

SEQ ID NO: 79008 - RNA, 22 nt, Human
aaggaggugauucaccuuuugg

SEQ ID NO: 79009 - RNA, 22 nt, Human
aaggacaaaacagcuguucuaa

SEQ ID NO: 79010 - RNA, 22 nt, Human
aaggagaggagucauugggaua

SEQ ID NO: 79011 - RNA, 22 nt, Human
aaggaggaugaauugucugcaa

SEQ ID NO: 79012 - RNA, 22 nt, Human
aagcuguuauuucacagguuca

SEQ ID NO: 79013 - RNA, 22 nt, Human
aagcucuuuccacuaaaccacu

SEQ ID NO: 79014 - RNA, 22 nt, Human
aagcugaguaggaaugguaggu

SEQ ID NO: 79015 - RNA, 22 nt, Human
aagccuuagauuggcgaugucg

SEQ ID NO: 79016 - RNA, 22 nt, Human
aagaaagaucugaaagaagcga

SEQ ID NO: 79017 - RNA, 22 nt, Human
aagaaaccauauuaguuccugg

SEQ ID NO: 79018 - RNA, 22 nt, Human
aaccaauaagaggaugccauuu

SEQ ID NO: 79019 - RNA, 22 nt, Human
aagaacaugggugugggcauuc

SEQ ID NO: 79020 - RNA, 22 nt, Human
aagacagugacagucacaauug

SEQ ID NO: 79021 - RNA, 22 nt, Human
aagacagaaaagcagagagagg

SEQ ID NO: 79022 - RNA, 22 nt, Human
aagaaaggagauauucuuuuag

SEQ ID NO: 79023 - RNA, 22 nt, Human
aagaaauagauagaggaauacu

SEQ ID NO: 79024 - RNA, 22 nt, Human
aagaagcuacugucacuaucag

SEQ ID NO: 79025 - RNA, 22 nt, Human
aagaaggaaggcaagagauggg

SEQ ID NO: 79026 - RNA, 22 nt, Human
aagacccuaccccuggagagga

SEQ ID NO: 79027 - RNA, 22 nt, Human
aagagaaaaaucuuaaucuagu

SEQ ID NO: 79028 - RNA, 22 nt, Human
aagaggauuuuaguuugccaga

SEQ ID NO: 79029 - RNA, 22 nt, Human
aagaggaggcuggaauccuaaa

SEQ ID NO: 79030 - RNA, 22 nt, Human
aagacacuuucuaaauagaagu

SEQ ID NO: 79031 - RNA, 23 nt, Human
aagcaacagacuucaucagauau

SEQ ID NO: 79032 - RNA, 22 nt, Human
aagcaaaugguauugguauuau

SEQ ID NO: 79033 - RNA, 22 nt, Human
aagauauauaacccuuucacuu

SEQ ID NO: 79034 - RNA, 22 nt, Human
aagaucugaccgugauggcggc

SEQ ID NO: 79035 - RNA, 22 nt, Human
aagaugcaagcauuuugaacug

SEQ ID NO: 79036 - RNA, 22 nt, Human
aagaguuaggagugggcuuuga

SEQ ID NO: 79037 - RNA, 22 nt, Human
aagauagaaugauguuggcuca

SEQ ID NO: 79038 - RNA, 22 nt, Human
aagaugaucagagggcaagagg

SEQ ID NO: 79039 - RNA, 22 nt, Human
aagaugaguuacaaaggaguaa

SEQ ID NO: 79040 - RNA, 22 nt, Human
aagaugcuucaugagaguuggg

SEQ ID NO: 79041 - RNA, 22 nt, Human
aagaggcuacagcccugugucu

SEQ ID NO: 79042 - RNA, 22 nt, Human
aagagugugagguugugcuuuu

SEQ ID NO: 79043 - RNA, 22 nt, Human
aagcaaagucaucuagaguagu

SEQ ID NO: 79044 - RNA, 22 nt, Human
aguuccaaauuugcaagaaaau

SEQ ID NO: 79045 - RNA, 22 nt, Human
aguucuuugcucccugcuuuuu

SEQ ID NO: 79046 - RNA, 22 nt, Human
aguugcugccagguccugggag

SEQ ID NO: 79047 - RNA, 22 nt, Human
aguucucaagguuaggaaaagu

SEQ ID NO: 79048 - RNA, 22 nt, Human
aguugguauuuacugcaguugg

SEQ ID NO: 79049 - RNA, 22 nt, Human
aguuggaagacacccugaaauc

SEQ ID NO: 79050 - RNA, 22 nt, Human
aguucuguucccccaguuacau

SEQ ID NO: 79051 - RNA, 22 nt, Human
aguugaggguuaguaaauagcu

SEQ ID NO: 79052 - RNA, 22 nt, Human
aguuguucucagcagaagaacu

SEQ ID NO: 79053 - RNA, 22 nt, Human
aguugugagaaugaacacugaa

SEQ ID NO: 79054 - RNA, 22 nt, Human
aguugcuucccuauucuuagca

SEQ ID NO: 79055 - RNA, 22 nt, Human
aguugcuaauacaaaaaguccc

SEQ ID NO: 79056 - RNA, 22 nt, Human
aguugguggaagcuaagcuucu

SEQ ID NO: 79057 - RNA, 22 nt, Human
aguuuggauccugcuaaaccag

SEQ ID NO: 79058 - RNA, 22 nt, Human
aguuucuugaagacugauguuu

SEQ ID NO: 79059 - RNA, 22 nt, Human
aguuuucugccucuggaugcgu

SEQ ID NO: 79060 - RNA, 22 nt, Human
auaaaaaguggcugcuauugga

SEQ ID NO: 79061 - RNA, 22 nt, Human
aguuuuugccucgaauucugcg

SEQ ID NO: 79062 - RNA, 22 nt, Human
aguuucaguuaguugggugaca

SEQ ID NO: 79063 - RNA, 22 nt, Human
aguuucccucacaggucugcau

SEQ ID NO: 79064 - RNA, 22 nt, Human
aguuuuguuuguuuguuuguua

SEQ ID NO: 79065 - RNA, 22 nt, Human
aguuuuuaacgccauguuugaa

SEQ ID NO: 79066 - RNA, 22 nt, Human
aguugguucgucucgccuugag

SEQ ID NO: 79067 - RNA, 22 nt, Human
aguuugauuugucuaucuucau

SEQ ID NO: 79068 - RNA, 22 nt, Human
aguuuaaauuguucuaucagaa

SEQ ID NO: 79069 - RNA, 22 nt, Human
aguuuguagguuaggaucagca

SEQ ID NO: 79070 - RNA, 22 nt, Human
aguuuggaggagaaagugcggg

SEQ ID NO: 79071 - RNA, 22 nt, Human
aguuguuuuucuuagauuuuag

SEQ ID NO: 79072 - RNA, 22 nt, Human
auaaucuuugaguagaguugag

SEQ ID NO: 79073 - RNA, 22 nt, Human
auacauauaugcacauuaauau

SEQ ID NO: 79074 - RNA, 22 nt, Human
auaaucuuuccagucaguuucc

SEQ ID NO: 79075 - RNA, 21 nt, Human
auaccaaaagaacaccuuguu

SEQ ID NO: 79076 - RNA, 22 nt, Human
auacaugacucacacauucugc

SEQ ID NO: 79077 - RNA, 22 nt, Human
auaccuauagcagacugagacu

SEQ ID NO: 79078 - RNA, 18 nt, Human
auaccaggauagggacaa

SEQ ID NO: 79079 - RNA, 22 nt, Human
auaagcuucucugcaguucagu

SEQ ID NO: 79080 - RNA, 22 nt, Human
auaaggaaagugagugcuuaaa

SEQ ID NO: 79081 - RNA, 22 nt, Human
auaaauucuaugauggauuggg

SEQ ID NO: 79082 - RNA, 22 nt, Human
auaaauuugacagcucuucaug

SEQ ID NO: 79083 - RNA, 22 nt, Human
auaaauuugccagcauauguuc

SEQ ID NO: 79084 - RNA, 22 nt, Human
auacacauguuauuguggaagc

SEQ ID NO: 79085 - RNA, 22 nt, Human
auaauugaauaagagcugcagg

SEQ ID NO: 79086 - RNA, 22 nt, Human
auacaaaaaguggugaguguau

SEQ ID NO: 79087 - RNA, 22 nt, Human
auacagacacuguagguuauuu

SEQ ID NO: 79088 - RNA, 22 nt, Human
auacacuucauguuuucaucug

SEQ ID NO: 79089 - RNA, 22 nt, Human
auaaaucaagggcaguauuucc

SEQ ID NO: 79090 - RNA, 22 nt, Human
auaaaaauguuuuuguguggua

SEQ ID NO: 79091 - RNA, 22 nt, Human
auaaaaucugaagcaagaauaa

SEQ ID NO: 79092 - RNA, 22 nt, Human
auaaaagcacaauagaguuaug

SEQ ID NO: 79093 - RNA, 22 nt, Human
aguuuuugagaauucuucugaa

SEQ ID NO: 79094 - RNA, 22 nt, Human
auaaggcauagugagucaucau

SEQ ID NO: 79095 - RNA, 22 nt, Human
auaacgaaagcaauuauuuuca

SEQ ID NO: 79096 - RNA, 22 nt, Human
auaagccugccuuaucuccaga

SEQ ID NO: 79097 - RNA, 22 nt, Human
auaaaguaaugcauauaaugug

SEQ ID NO: 79098 - RNA, 20 nt, Human
auaaauaggauuuucugaca

SEQ ID NO: 79099 - RNA, 23 nt, Human
auaaugauaaugcuauuuuuugu

SEQ ID NO: 79100 - RNA, 22 nt, Human
auaaaacagaucaggagaauga

SEQ ID NO: 79101 - RNA, 22 nt, Human
agugucagcagcuucauugucu

SEQ ID NO: 79102 - RNA, 22 nt, Human
aguguauuugccuauaaaaaug

SEQ ID NO: 79103 - RNA, 22 nt, Human
agugucuuuagucgcugagcaa

SEQ ID NO: 79104 - RNA, 22 nt, Human
aguguuaggaauuaauguaggg

SEQ ID NO: 79105 - RNA, 22 nt, Human
aguguucaauuugagcucaaag

SEQ ID NO: 79106 - RNA, 23 nt, Human
aguguucagcauguaguaaauac

SEQ ID NO: 79107 - RNA, 22 nt, Human
aguguuuuaagaaaguaauuuu

SEQ ID NO: 79108 - RNA, 22 nt, Human
aguuaaagggggcuacagugug

SEQ ID NO: 79109 - RNA, 20 nt, Human
aguguugaacuacacuuccc

SEQ ID NO: 79110 - RNA, 22 nt, Human
aguuaguagacuuuuccauuua

SEQ ID NO: 79111 - RNA, 23 nt, Human
aguuaucuaaugaaguucuucca

SEQ ID NO: 79112 - RNA, 22 nt, Human
aguuauggguauguauuauaau

SEQ ID NO: 79113 - RNA, 22 nt, Human
aguuaggaaauaaguugaguuu

SEQ ID NO: 79114 - RNA, 22 nt, Human
aguuaucuauaaaucccugagg

SEQ ID NO: 79115 - RNA, 20 nt, Human
aguucagguuauuuuccucc

SEQ ID NO: 79116 - RNA, 22 nt, Human
aguucaugcuuagaucucauuu

SEQ ID NO: 79117 - RNA, 22 nt, Human
aguuauuaagaaaauuuugcca

SEQ ID NO: 79118 - RNA, 22 nt, Human
aguucauucuagcugggagcag

SEQ ID NO: 79119 - RNA, 22 nt, Human
aguuauuuuucacuauuaggcu

SEQ ID NO: 79120 - RNA, 23 nt, Human
agugaugcaguaucugggucugu

SEQ ID NO: 79121 - RNA, 20 nt, Human
agugauuuguuaguacauug

SEQ ID NO: 79122 - RNA, 23 nt, Human
agugaucuguguuugaagaaugc

SEQ ID NO: 79123 - RNA, 22 nt, Human
aguggcuagaucaugagugagc

SEQ ID NO: 79124 - RNA, 22 nt, Human
agugcuuuauguuguugugcaa

SEQ ID NO: 79125 - RNA, 22 nt, Human
aguggagguuacagcuguacau

SEQ ID NO: 79126 - RNA, 23 nt, Human
aguggaggucgggguggggagac

SEQ ID NO: 79127 - RNA, 19 nt, Human
agugggcaaggaagaugac

SEQ ID NO: 79128 - RNA, 19 nt, Human
agugggauggcuuuuuccc

SEQ ID NO: 79129 - RNA, 21 nt, Human
agugaagagugggcuugauca

SEQ ID NO: 79130 - RNA, 22 nt, Human
agugaaagaaaacuguuagaac

SEQ ID NO: 79131 - RNA, 22 nt, Human
agugaaauaugcccauugcugu

SEQ ID NO: 79132 - RNA, 20 nt, Human
agucuucaggugugaggauu

SEQ ID NO: 79133 - RNA, 22 nt, Human
agugaaaacugaaucaccuucc

SEQ ID NO: 79134 - RNA, 22 nt, Human
agucugaguaucucugagccag

SEQ ID NO: 79135 - RNA, 20 nt, Human
agucuuaucugcauuuagaa

SEQ ID NO: 79136 - RNA, 20 nt, Human
aguacugacaauauucugug

SEQ ID NO: 79137 - RNA, 22 nt, Human
aguacuuggaaaaaugcccacu

SEQ ID NO: 79138 - RNA, 22 nt, Human
aguacuuugacuagaggcagcu

SEQ ID NO: 79139 - RNA, 22 nt, Human
aguagcaguuccauuugaugug

SEQ ID NO: 79140 - RNA, 22 nt, Human
aguagagacgggguuuuaguag

SEQ ID NO: 79141 - RNA, 22 nt, Human
aguaggagugacaagcagguca

SEQ ID NO: 79142 - RNA, 22 nt, Human
agugauguaauggugaauguga

SEQ ID NO: 79143 - RNA, 22 nt, Human
agugaugcuuuggagaagaucc

SEQ ID NO: 79144 - RNA, 22 nt, Human
agugaggggagaaugaggugga

SEQ ID NO: 79145 - RNA, 22 nt, Human
agugaugauccaaaugaauuga

SEQ ID NO: 79146 - RNA, 22 nt, Human
agugacuguccuacuuuguaga

SEQ ID NO: 79147 - RNA, 22 nt, Human
agugagcuuuuaaaauuuacca

SEQ ID NO: 79148 - RNA, 22 nt, Human
agugacauuauuuuguguacua

SEQ ID NO: 79149 - RNA, 22 nt, Human
agucuuuguuccugggaccuga

SEQ ID NO: 79150 - RNA, 22 nt, Human
aggcuuaacuacaauuuuugcc

SEQ ID NO: 79151 - RNA, 22 nt, Human
aggcuuagaugaguucccacau

SEQ ID NO: 79152 - RNA, 22 nt, Human
aggcucucccacauucauuaca

SEQ ID NO: 79153 - RNA, 22 nt, Human
agggaaauaggagaagaaagga

SEQ ID NO: 79154 - RNA, 22 nt, Human
agggcuguuggugcccucgagg

SEQ ID NO: 79155 - RNA, 22 nt, Human
agggcucuuucauuguuaagaa

SEQ ID NO: 79156 - RNA, 22 nt, Human
agggcuucugcugcagagaccu

SEQ ID NO: 79157 - RNA, 22 nt, Human
aggguguuugggagcagaggau

SEQ ID NO: 79158 - RNA, 22 nt, Human
agggggaaaauguggauuaugg

SEQ ID NO: 79159 - RNA, 22 nt, Human
aggucagacagggugucuuucu

SEQ ID NO: 79160 - RNA, 22 nt, Human
agguauuuuaugucgugugaug

SEQ ID NO: 79161 - RNA, 22 nt, Human
aggguuucucuccaguguggac

SEQ ID NO: 79162 - RNA, 22 nt, Human
aggguauguuuuuaucuacugu

SEQ ID NO: 79163 - RNA, 22 nt, Human
aggguuaugcuccuucaucuug

SEQ ID NO: 79164 - RNA, 20 nt, Human
agggucucuccuggcucugc

SEQ ID NO: 79165 - RNA, 22 nt, Human
aggucgugggugagagagagac

SEQ ID NO: 79166 - RNA, 22 nt, Human
aggucuacaugcuuaauauauc

SEQ ID NO: 79167 - RNA, 22 nt, Human
aggugauauuauguauuucuau

SEQ ID NO: 79168 - RNA, 19 nt, Human
aggugaugugacucuagaa

SEQ ID NO: 79169 - RNA, 22 nt, Human
aggucuugcggaagauauggcu

SEQ ID NO: 79170 - RNA, 22 nt, Human
aggugauaugggcuucucugag

SEQ ID NO: 79171 - RNA, 22 nt, Human
aggugcuuaaagaauguguggu

SEQ ID NO: 79172 - RNA, 22 nt, Human
agguuaugcacugcacaacccu

SEQ ID NO: 79173 - RNA, 22 nt, Human
agguuuuacuuuuuuuggaggu

SEQ ID NO: 79174 - RNA, 20 nt, Human
agguugguuuacuagucugu

SEQ ID NO: 79175 - RNA, 22 nt, Human
agguggcuaugaggaugcaguc

SEQ ID NO: 79176 - RNA, 22 nt, Human
agguuuaggaaaacugagaguc

SEQ ID NO: 79177 - RNA, 22 nt, Human
agguuuggguucauugcuggcu

SEQ ID NO: 79178 - RNA, 22 nt, Human
agguuuuagaagcugaagccaa

SEQ ID NO: 79179 - RNA, 22 nt, Human
agguuuggaaguggcgauccau

SEQ ID NO: 79180 - RNA, 22 nt, Human
aguaauaaacaacucauuuugg

SEQ ID NO: 79181 - RNA, 22 nt, Human
aguaacagguguacagacuauc

SEQ ID NO: 79182 - RNA, 22 nt, Human
agguuuggccuuggggggaguu

SEQ ID NO: 79183 - RNA, 22 nt, Human
aggaaauaagggcacuucagau

SEQ ID NO: 79184 - RNA, 22 nt, Human
agcgcugugaaggcugggccac

SEQ ID NO: 79185 - RNA, 22 nt, Human
aggaauugucgucauguauaau

SEQ ID NO: 79186 - RNA, 22 nt, Human
aggaauguugagacauggcuaa

SEQ ID NO: 79187 - RNA, 22 nt, Human
aggaaguucuggaauuacuagg

SEQ ID NO: 79188 - RNA, 22 nt, Human
aggaaauaggaccagacaaagc

SEQ ID NO: 79189 - RNA, 22 nt, Human
aggaauuuuaauaugcuugucu

SEQ ID NO: 79190 - RNA, 22 nt, Human
aggacaaaggaccagaucugga

SEQ ID NO: 79191 - RNA, 22 nt, Human
aggaauuucacugcguuuuuua

SEQ ID NO: 79192 - RNA, 22 nt, Human
aggacaagacaaggaccagaga

SEQ ID NO: 79193 - RNA, 16 nt, Human
aggagcagaaagcagu

SEQ ID NO: 79194 - RNA, 22 nt, Human
aggaauuugggguuacaugaug

SEQ ID NO: 79195 - RNA, 22 nt, Human
aggaggcaaaugagagggcuca

SEQ ID NO: 79196 - RNA, 22 nt, Human
aggagcccggucgucaugguaa

SEQ ID NO: 79197 - RNA, 22 nt, Human
aggauuuauuccagaaaugcaa

SEQ ID NO: 79198 - RNA, 22 nt, Human
aggagggucauguugaagugua

SEQ ID NO: 79199 - RNA, 22 nt, Human
aggauauguccuuuuuuucccc

SEQ ID NO: 79200 - RNA, 22 nt, Human
aggauaaaugggucauuaggca

SEQ ID NO: 79201 - RNA, 22 nt, Human
aggaguuugaaaacuuaacuaa

SEQ ID NO: 79202 - RNA, 20 nt, Human
aggauuauguacauggaugc

SEQ ID NO: 79203 - RNA, 22 nt, Human
aggauugauggcauguuuacug

SEQ ID NO: 79204 - RNA, 22 nt, Human
aggauugucuccugugaugugc

SEQ ID NO: 79205 - RNA, 22 nt, Human
aggauugaaaaaacacauauau

SEQ ID NO: 79206 - RNA, 23 nt, Human
aggcaagaacggguuguucaccc

SEQ ID NO: 79207 - RNA, 22 nt, Human
aggauuagucaccauuauuauu

SEQ ID NO: 79208 - RNA, 22 nt, Human
aggauggauagcaaggaagccg

SEQ ID NO: 79209 - RNA, 22 nt, Human
aggcaacagacaggcuugguuc

SEQ ID NO: 79210 - RNA, 22 nt, Human
aggcagagaggucuuccuggaa

SEQ ID NO: 79211 - RNA, 16 nt, Human
aggauauauucucuuc

SEQ ID NO: 79212 - RNA, 22 nt, Human
aggauucuccuguuucccaccc

SEQ ID NO: 79213 - RNA, 22 nt, Human
aggauuuagcaugaaaugugaa

SEQ ID NO: 79214 - RNA, 22 nt, Human
aggauuuaauugcauuuuucuc

SEQ ID NO: 79215 - RNA, 22 nt, Human
aggcagagauggcugcagggcc

SEQ ID NO: 79216 - RNA, 22 nt, Human
aggcaagauuaggaccagaaga

SEQ ID NO: 79217 - RNA, 22 nt, Human
aggcaauuuuuaggguuguugu

SEQ ID NO: 79218 - RNA, 22 nt, Human
aggcacagaauccagucugcug

SEQ ID NO: 79219 - RNA, 20 nt, Human
aggcagacaaggagucuguu

SEQ ID NO: 79220 - RNA, 22 nt, Human
aggcagaugggagcuggaaguu

SEQ ID NO: 79221 - RNA, 21 nt, Human
aggcagcgauuuucauauugc

SEQ ID NO: 79222 - RNA, 22 nt, Human
aggcaggauuugcgaugugguu

SEQ ID NO: 79223 - RNA, 22 nt, Human
aggcugggaaguguguccugag

SEQ ID NO: 79224 - RNA, 22 nt, Human
aggcagugccuggaccccagcu

SEQ ID NO: 79225 - RNA, 21 nt, Human
aggcauuuucuuggagauucu

SEQ ID NO: 79226 - RNA, 22 nt, Human
aggcauuuucuuguuauuuuua

SEQ ID NO: 79227 - RNA, 22 nt, Human
aggcauauaguguuuaaaaaaa

SEQ ID NO: 79228 - RNA, 22 nt, Human
aggcaguggcuuuuguuguguu

SEQ ID NO: 79229 - RNA, 22 nt, Human
aggcaguguguagcuggaagag

SEQ ID NO: 79230 - RNA, 22 nt, Human
aggcagugguguuugcuggugg

SEQ ID NO: 79231 - RNA, 22 nt, Human
aggcauuuaaagauguaagacu

SEQ ID NO: 79232 - RNA, 22 nt, Human
aggccacucagggggccaagau

SEQ ID NO: 79233 - RNA, 22 nt, Human
aggcauuuaucaggaaauguuc

SEQ ID NO: 79234 - RNA, 22 nt, Human
agcccagguggagugugugggg

SEQ ID NO: 79235 - RNA, 22 nt, Human
agcccgggagggcugucuggga

SEQ ID NO: 79236 - RNA, 22 nt, Human
agccaucuggugucaaugauuc

SEQ ID NO: 79237 - RNA, 22 nt, Human
agcagggagaccaucucuuccu

SEQ ID NO: 79238 - RNA, 22 nt, Human
agcaggguggcaagucuuucug

SEQ ID NO: 79239 - RNA, 22 nt, Human
agccgauaaauuguuuucuugg

SEQ ID NO: 79240 - RNA, 22 nt, Human
agccauggagaacagacuugaa

SEQ ID NO: 79241 - RNA, 22 nt, Human
agccacacuuagucacaaagau

SEQ ID NO: 79242 - RNA, 22 nt, Human
agccagugcagcuggaaauuca

SEQ ID NO: 79243 - RNA, 22 nt, Human
agcgaaaagaauggaguggagu

SEQ ID NO: 79244 - RNA, 22 nt, Human
agccuacauuugacuauagucu

SEQ ID NO: 79245 - RNA, 22 nt, Human
agccuauucaucugaucuugaa

SEQ ID NO: 79246 - RNA, 22 nt, Human
agccuguacuuagagggauuaa

SEQ ID NO: 79247 - RNA, 19 nt, Human
agcgccucuacugcaugga

SEQ ID NO: 79248 - RNA, 22 nt, Human
agcauacuaggauguuuucugg

SEQ ID NO: 79249 - RNA, 17 nt, Human
agcagcuggguugaucu

SEQ ID NO: 79250 - RNA, 22 nt, Human
agcaggagaaagaguaugggcu

SEQ ID NO: 79251 - RNA, 22 nt, Human
agcaggauggaguaacgugaaa

SEQ ID NO: 79252 - RNA, 22 nt, Human
agcaaagguagcagcucccagg

SEQ ID NO: 79253 - RNA, 22 nt, Human
agcacagugccugacauauaug

SEQ ID NO: 79254 - RNA, 22 nt, Human
agcaauucagagcauggacuuu

SEQ ID NO: 79255 - RNA, 22 nt, Human
agcacauguuucuuuugcaauu

SEQ ID NO: 79256 - RNA, 22 nt, Human
agcaccuuguucagaucuuaca

SEQ ID NO: 79257 - RNA, 22 nt, Human
agcacuugggugauaguacuuu

SEQ ID NO: 79258 - RNA, 22 nt, Human
agcagcaaugacaauucaacca

SEQ ID NO: 79259 - RNA, 22 nt, Human
agcagauuguacagugcauuag

SEQ ID NO: 79260 - RNA, 22 nt, Human
agcaauucugaaauuacuugac

SEQ ID NO: 79261 - RNA, 22 nt, Human
agcaaauaauugucuuugaggg

SEQ ID NO: 79262 - RNA, 22 nt, Human
agauuuucuuuuccaucuuugu

SEQ ID NO: 79263 - RNA, 22 nt, Human
agcaaaauuccaaaaugcuaau

SEQ ID NO: 79264 - RNA, 22 nt, Human
agauuuuacggaguauuagggu

SEQ ID NO: 79265 - RNA, 22 nt, Human
agcagagaacauucauucaugu

SEQ ID NO: 79266 - RNA, 22 nt, Human
agcacuuuagaauuuagaguug

SEQ ID NO: 79267 - RNA, 22 nt, Human
agcagauaaagguugcauuucu

SEQ ID NO: 79268 - RNA, 22 nt, Human
agcacuagcugcuugucucaag

SEQ ID NO: 79269 - RNA, 22 nt, Human
agcacguucuucauuacuucac

SEQ ID NO: 79270 - RNA, 22 nt, Human
agcaaggagcugaaaccgggcu

SEQ ID NO: 79271 - RNA, 22 nt, Human
agcaaggguugguuuucugaca

SEQ ID NO: 79272 - RNA, 22 nt, Human
agauauuauuuucuauuuauca

SEQ ID NO: 79273 - RNA, 22 nt, Human
agaugaguaaauggagucuucc

SEQ ID NO: 79274 - RNA, 22 nt, Human
agauagccagauauaaauaguc

SEQ ID NO: 79275 - RNA, 22 nt, Human
agauauguuaggcuuguucccu

SEQ ID NO: 79276 - RNA, 22 nt, Human
agauaucuuguuggcauaaaug

SEQ ID NO: 79277 - RNA, 22 nt, Human
agauggaggaaagcaguuagaa

SEQ ID NO: 79278 - RNA, 22 nt, Human
agauccuagaugugaauagcua

SEQ ID NO: 79279 - RNA, 19 nt, Human
agaucaggauguauuuuug

SEQ ID NO: 79280 - RNA, 22 nt, Human
agauauucugccuaacagguuu

SEQ ID NO: 79281 - RNA, 17 nt, Human
agaucugaaggagaaca

SEQ ID NO: 79282 - RNA, 22 nt, Human
agaugguucagaauuauaaaga

SEQ ID NO: 79283 - RNA, 22 nt, Human
agaugggacauuugucccuagg

SEQ ID NO: 79284 - RNA, 23 nt, Human
agaugaugaauaaagagugagga

SEQ ID NO: 79285 - RNA, 22 nt, Human
agaugaugugugucuucagcua

SEQ ID NO: 79286 - RNA, 22 nt, Human
agauguugucucuuacguuuga

SEQ ID NO: 79287 - RNA, 22 nt, Human
agauucucccuccuggcgcugu

SEQ ID NO: 79288 - RNA, 22 nt, Human
agauuucaauggauauugcaag

SEQ ID NO: 79289 - RNA, 22 nt, Human
agauugaugugaccauuggaag

SEQ ID NO: 79290 - RNA, 22 nt, Human
agauggaguccugaagccagaa

SEQ ID NO: 79291 - RNA, 19 nt, Human
agauggcaaaaugcaaaga

SEQ ID NO: 79292 - RNA, 22 nt, Human
agauguuaauaaccuuagggca

SEQ ID NO: 79293 - RNA, 22 nt, Human
agauucgucuuuaauucaccau

SEQ ID NO: 79294 - RNA, 22 nt, Human
agauuauuuaagacaggaacca

SEQ ID NO: 79295 - RNA, 22 nt, Human
agauugaacgagcuggcaugga

SEQ ID NO: 79296 - RNA, 22 nt, Human
agcaaagccucuuugaaaaaaa

SEQ ID NO: 79297 - RNA, 22 nt, Human
agcaacauggaguuugugcgca

SEQ ID NO: 79298 - RNA, 22 nt, Human
agaugucauguguugcuccaag

SEQ ID NO: 79299 - RNA, 22 nt, Human
agcaaaacuaaagacacagaca

SEQ ID NO: 79300 - RNA, 22 nt, Human
agacacugacaggguccaugga

SEQ ID NO: 79301 - RNA, 22 nt, Human
agagcaauggugcuuuaauucu

SEQ ID NO: 79302 - RNA, 22 nt, Human
agagcagauggagcuggaagag

SEQ ID NO: 79303 - RNA, 22 nt, Human
agacagaaaaguugucaaucau

SEQ ID NO: 79304 - RNA, 22 nt, Human
agagauuuacaacuugggcuuu

SEQ ID NO: 79305 - RNA, 22 nt, Human
agacgacucuuaaggcagaauu

SEQ ID NO: 79306 - RNA, 22 nt, Human
agacuauuuugugauaacuaau

SEQ ID NO: 79307 - RNA, 22 nt, Human
agacuaauaucccauuucugac

SEQ ID NO: 79308 - RNA, 22 nt, Human
agagcauagggcauuaggaagg

SEQ ID NO: 79309 - RNA, 22 nt, Human
agagcuauuucuuaaaagcugu

SEQ ID NO: 79310 - RNA, 22 nt, Human
agagcucguggcucauugagga

SEQ ID NO: 79311 - RNA, 22 nt, Human
agagccggagucuucuuguuug

SEQ ID NO: 79312 - RNA, 22 nt, Human
agagccaugcuugugcauauau

SEQ ID NO: 79313 - RNA, 22 nt, Human
agaggcagagcugggguuugac

SEQ ID NO: 79314 - RNA, 22 nt, Human
agaggcaugaacucccguagcc

SEQ ID NO: 79315 - RNA, 22 nt, Human
agauaaacaacucuuagcuguu

SEQ ID NO: 79316 - RNA, 21 nt, Human
agaguuuucuccauuucaggc

SEQ ID NO: 79317 - RNA, 22 nt, Human
agaguuaguggccucagcaggg

SEQ ID NO: 79318 - RNA, 22 nt, Human
agaguucuauccagacucaugu

SEQ ID NO: 79319 - RNA, 22 nt, Human
agaguacagaagcauuucagau

SEQ ID NO: 79320 - RNA, 22 nt, Human
agaguagucuuuacucuuccaa

SEQ ID NO: 79321 - RNA, 22 nt, Human
agagugagauaugugguuggua

SEQ ID NO: 79322 - RNA, 22 nt, Human
agaguucaccccacugaugagu

SEQ ID NO: 79323 - RNA, 22 nt, Human
agaucauuaaccaccuguucug

SEQ ID NO: 79324 - RNA, 22 nt, Human
agaugacuuuguccugagcuga

SEQ ID NO: 79325 - RNA, 22 nt, Human
agauacaaaagauaagauuuag

SEQ ID NO: 79326 - RNA, 22 nt, Human
agaugacuaacauaguauugcu

SEQ ID NO: 79327 - RNA, 22 nt, Human
agauaacauguugcagauucug

SEQ ID NO: 79328 - RNA, 22 nt, Human
agauaaaucauuuauuaagcgg

SEQ ID NO: 79329 - RNA, 22 nt, Human
acgccugccuguacuugugggg

SEQ ID NO: 79330 - RNA, 20 nt, Human
acgcauguauaugcaucacc

SEQ ID NO: 79331 - RNA, 22 nt, Human
acaucuucuauggagguucgga

SEQ ID NO: 79332 - RNA, 22 nt, Human
acgcauguacuuguaugcaaug

SEQ ID NO: 79333 - RNA, 21 nt, Human
acaguaugaucaaaugugcca

SEQ ID NO: 79334 - RNA, 22 nt, Human
acauccaguaucagaagcauca

SEQ ID NO: 79335 - RNA, 22 nt, Human
acaucuaugucugaggccuugg

SEQ ID NO: 79336 - RNA, 21 nt, Human
acggaucucgcaccucuccug

SEQ ID NO: 79337 - RNA, 22 nt, Human
acuauauaaugcacacaguaua

SEQ ID NO: 79338 - RNA, 22 nt, Human
acuauacaguauguacgugcac

SEQ ID NO: 79339 - RNA, 22 nt, Human
acgguguuucucguucaggguu

SEQ ID NO: 79340 - RNA, 22 nt, Human
acgguuuugugagguaguacuu

SEQ ID NO: 79341 - RNA, 22 nt, Human
acgucuacaugcaauucuuaua

SEQ ID NO: 79342 - RNA, 22 nt, Human
acuauuguccgauuucuuuacu

SEQ ID NO: 79343 - RNA, 22 nt, Human
acuauggaguucagaucuugag

SEQ ID NO: 79344 - RNA, 22 nt, Human
acuauugcuuuagggggaaacc

SEQ ID NO: 79345 - RNA, 22 nt, Human
acuacuguaauuuauuguuaca

SEQ ID NO: 79346 - RNA, 20 nt, Human
acuagaaagucacugggggg

SEQ ID NO: 79347 - RNA, 22 nt, Human
acuaucuauugucuucuucaug

SEQ ID NO: 79348 - RNA, 22 nt, Human
acucaaccaucugcauuuuuga

SEQ ID NO: 79349 - RNA, 22 nt, Human
acucagaguuugcguuccauac

SEQ ID NO: 79350 - RNA, 22 nt, Human
acucagucauuuggggaacagu

SEQ ID NO: 79351 - RNA, 22 nt, Human
acuccuauuugguagauggaag

SEQ ID NO: 79352 - RNA, 21 nt, Human
acucaucuuuuuggagaccag

SEQ ID NO: 79353 - RNA, 22 nt, Human
acuccuuuuaugugugcuaaaa

SEQ ID NO: 79354 - RNA, 22 nt, Human
acucugaaaggcuacaaaugcu

SEQ ID NO: 79355 - RNA, 18 nt, Human
acucugaagcuaagucac

SEQ ID NO: 79356 - RNA, 22 nt, Human
acucucugcugcugagcuuggg

SEQ ID NO: 79357 - RNA, 22 nt, Human
acucugagaugugucuugauuc

SEQ ID NO: 79358 - RNA, 23 nt, Human
acucucuguuuggaggcacuggu

SEQ ID NO: 79359 - RNA, 22 nt, Human
acucugaggauuucaguuuuac

SEQ ID NO: 79360 - RNA, 22 nt, Human
acucuguaauucugaagcaccu

SEQ ID NO: 79361 - RNA, 22 nt, Human
acucuuauuuugaaguaauaau

SEQ ID NO: 79362 - RNA, 22 nt, Human
acugaacuaaagaaaugggcaa

SEQ ID NO: 79363 - RNA, 22 nt, Human
acucuugacuaaugcuaauguc

SEQ ID NO: 79364 - RNA, 22 nt, Human
acugaaggcuggaccaugcauc

SEQ ID NO: 79365 - RNA, 22 nt, Human
acugaucuguguaauauguuac

SEQ ID NO: 79366 - RNA, 22 nt, Human
acugcaggucccaucaccugcg

SEQ ID NO: 79367 - RNA, 22 nt, Human
acugaugacaaugugaguguuc

SEQ ID NO: 79368 - RNA, 22 nt, Human
acugcagauccucugagaaacc

SEQ ID NO: 79369 - RNA, 22 nt, Human
acugcauuaucaccaagaugua

SEQ ID NO: 79370 - RNA, 22 nt, Human
acugccauauuaggagcuucag

SEQ ID NO: 79371 - RNA, 22 nt, Human
acugcauuucauaaauuacaau

SEQ ID NO: 79372 - RNA, 22 nt, Human
acugcugauuauugaaguagag

SEQ ID NO: 79373 - RNA, 22 nt, Human
acuggagcccguggaggcgcag

SEQ ID NO: 79374 - RNA, 22 nt, Human
acugcucugugguuggaagccu

SEQ ID NO: 79375 - RNA, 22 nt, Human
acugcuguugugauggguauuu

SEQ ID NO: 79376 - RNA, 22 nt, Human
agaacccaaggcccagggaugu

SEQ ID NO: 79377 - RNA, 22 nt, Human
agaagaagacccuaaggaaagg

SEQ ID NO: 79378 - RNA, 22 nt, Human
agaagaaugguuugaaagauuu

SEQ ID NO: 79379 - RNA, 22 nt, Human
agaagguggaguagaacaagcu

SEQ ID NO: 79380 - RNA, 19 nt, Human
agaacccccuuccucugcu

SEQ ID NO: 79381 - RNA, 22 nt, Human
agaaguagacaguuggauauaa

SEQ ID NO: 79382 - RNA, 22 nt, Human
agaaguuuguuauguaaacaaa

SEQ ID NO: 79383 - RNA, 22 nt, Human
agaauacuaauaagggauuugc

SEQ ID NO: 79384 - RNA, 22 nt, Human
agaauacaauuguucaguaaua

SEQ ID NO: 79385 - RNA, 22 nt, Human
agaagcauaagggcuuugccag

SEQ ID NO: 79386 - RNA, 22 nt, Human
agaagcagaaggaagcagggcc

SEQ ID NO: 79387 - RNA, 22 nt, Human
agaaggcaucugcucgcuucca

SEQ ID NO: 79388 - RNA, 16 nt, Human
agaaggcuaguaacag

SEQ ID NO: 79389 - RNA, 22 nt, Human
agaaucugcauuuuaacaagau

SEQ ID NO: 79390 - RNA, 22 nt, Human
agaauccugagggaaauuuggc

SEQ ID NO: 79391 - RNA, 22 nt, Human
agaaguguacuuagagaacaua

SEQ ID NO: 79392 - RNA, 21 nt, Human
agaaguuauuccauggguguu

SEQ ID NO: 79393 - RNA, 22 nt, Human
agaauaagucuaauauauuggu

SEQ ID NO: 79394 - RNA, 22 nt, Human
agacaauuccauccuacguggg

SEQ ID NO: 79395 - RNA, 22 nt, Human
agaauuuguaucuacggugugc

SEQ ID NO: 79396 - RNA, 22 nt, Human
agacacauuuucagcucugcca

SEQ ID NO: 79397 - RNA, 22 nt, Human
agacacagcaauaacuacuguu

SEQ ID NO: 79398 - RNA, 22 nt, Human
agaccccugcuggggcugcugu

SEQ ID NO: 79399 - RNA, 22 nt, Human
agaauauaguaaauauuuucua

SEQ ID NO: 79400 - RNA, 22 nt, Human
agacaaucaacuguugaugccu

SEQ ID NO: 79401 - RNA, 22 nt, Human
agacaagagcugaggacauauu

SEQ ID NO: 79402 - RNA, 19 nt, Human
agaaauagccuuccuuguc

SEQ ID NO: 79403 - RNA, 22 nt, Human
agaaauuguaauaaaucugguc

SEQ ID NO: 79404 - RNA, 22 nt, Human
agaaauggccagacuugccccu

SEQ ID NO: 79405 - RNA, 22 nt, Human
agaaagcacccugcacuuucug

SEQ ID NO: 79406 - RNA, 22 nt, Human
acuuugaauuagaauuuugcug

SEQ ID NO: 79407 - RNA, 22 nt, Human
agaaaauagguaguagacgggc

SEQ ID NO: 79408 - RNA, 22 nt, Human
acuuuccuggcuuugcaaggua

SEQ ID NO: 79409 - RNA, 22 nt, Human
agaaaaggaagcuuagacugua

SEQ ID NO: 79410 - RNA, 22 nt, Human
acuuuaaauaucauuugguagg

SEQ ID NO: 79411 - RNA, 22 nt, Human
acuuuauacuagugauaguuug

SEQ ID NO: 79412 - RNA, 22 nt, Human
acuuuaaaucuguugcuuagcu

SEQ ID NO: 79413 - RNA, 22 nt, Human
acuuguaaaauagagauaggga

SEQ ID NO: 79414 - RNA, 22 nt, Human
acuugaugcauauggaagagca

SEQ ID NO: 79415 - RNA, 22 nt, Human
acuucccacugcagugacugag

SEQ ID NO: 79416 - RNA, 22 nt, Human
acuucagugugguauaaaacgu

SEQ ID NO: 79417 - RNA, 22 nt, Human
acuuguuuacaagcaguucuga

SEQ ID NO: 79418 - RNA, 22 nt, Human
acuuccuuccagcaaauggcau

SEQ ID NO: 79419 - RNA, 22 nt, Human
acuucaggagcagucucuggaa

SEQ ID NO: 79420 - RNA, 22 nt, Human
acuucaggacggcaguggaggg

SEQ ID NO: 79421 - RNA, 22 nt, Human
acuugcauuguguaguguuuuu

SEQ ID NO: 79422 - RNA, 22 nt, Human
acuugauggaguuucacuguau

SEQ ID NO: 79423 - RNA, 22 nt, Human
acuugggaaaugaaaauacaga

SEQ ID NO: 79424 - RNA, 22 nt, Human
acuugagcuugaaagguaugcu

SEQ ID NO: 79425 - RNA, 22 nt, Human
acuguugugaauaaugaaaugc

SEQ ID NO: 79426 - RNA, 17 nt, Human
acuuaagacaguggaaa

SEQ ID NO: 79427 - RNA, 22 nt, Human
acuuagaacagccuaugggaag

SEQ ID NO: 79428 - RNA, 22 nt, Human
acuuauaaauuuaguacacugu

SEQ ID NO: 79429 - RNA, 22 nt, Human
acuucugcccuggcgagggcgu

SEQ ID NO: 79430 - RNA, 22 nt, Human
acuucauuugaaaugguugaau

SEQ ID NO: 79431 - RNA, 21 nt, Human
acuuccacaucacugaguaga

SEQ ID NO: 79432 - RNA, 21 nt, Human
gaaaaucuaaugugacaaugc

SEQ ID NO: 79433 - RNA, 22 nt, Human
gaagauucugacccugacucag

SEQ ID NO: 79434 - RNA, 22 nt, Human
gaaacauuuguugaguacuugc

SEQ ID NO: 79435 - RNA, 22 nt, Human
gagagaguaucugcugguucac

SEQ ID NO: 79436 - RNA, 22 nt, Human
gaaaaucaggauggaugugagg

SEQ ID NO: 79437 - RNA, 22 nt, Human
gaagcaagagggaucaggaucu

SEQ ID NO: 79438 - RNA, 18 nt, Human
gaagcaacaguucugagu

SEQ ID NO: 79439 - RNA, 22 nt, Human
gaagcuucgaaagagugauuuc

SEQ ID NO: 79440 - RNA, 21 nt, Human
gaagcugcuaugaagggggac

SEQ ID NO: 79441 - RNA, 22 nt, Human
gaagcuccaggaugccugcacu

SEQ ID NO: 79442 - RNA, 18 nt, Human
gagcucuucccuuuucuc

SEQ ID NO: 79443 - RNA, 22 nt, Human
gagccuguuaggcaccuguguu

SEQ ID NO: 79444 - RNA, 22 nt, Human
gaagcgucaugaaagaaaggcu

SEQ ID NO: 79445 - RNA, 22 nt, Human
gagcuggagaaacacauaagaa

SEQ ID NO: 79446 - RNA, 22 nt, Human
gagcuggacauacaggaaacca

SEQ ID NO: 79447 - RNA, 22 nt, Human
gaggaaaauggaguguaauuaa

SEQ ID NO: 79448 - RNA, 22 nt, Human
gaaggauaauuuugcuggaugu

SEQ ID NO: 79449 - RNA, 22 nt, Human
gaaggaagcugucuggaugugu

SEQ ID NO: 79450 - RNA, 22 nt, Human
gaaggagaggauugugaggcug

SEQ ID NO: 79451 - RNA, 22 nt, Human
gaggagagaaauguuuucugug

SEQ ID NO: 79452 - RNA, 22 nt, Human
gaggacugguugggaaugugaa

SEQ ID NO: 79453 - RNA, 22 nt, Human
gaggagcuucagaggaaucuua

SEQ ID NO: 79454 - RNA, 22 nt, Human
gaggagcaggcaggaucugguc

SEQ ID NO: 79455 - RNA, 22 nt, Human
gaggaggucaccuggugagcaa

SEQ ID NO: 79456 - RNA, 22 nt, Human
gaggaggagaagcggcggcgga

SEQ ID NO: 79457 - RNA, 22 nt, Human
gaauauuuaucucagcugcaga

SEQ ID NO: 79458 - RNA, 22 nt, Human
gaauacaagccugccaccugga

SEQ ID NO: 79459 - RNA, 22 nt, Human
gaaucucuuugucccugaguuu

SEQ ID NO: 79460 - RNA, 22 nt, Human
gaauaauuuugaucagaaggga

SEQ ID NO: 79461 - RNA, 22 nt, Human
gaauagauuagaaagaguaugu

SEQ ID NO: 79462 - RNA, 22 nt, Human
gaagugagcauccuaguuaacc

SEQ ID NO: 79463 - RNA, 22 nt, Human
gaaguucuuagucucauuugca

SEQ ID NO: 79464 - RNA, 22 nt, Human
gaauaagaauccacuucuggca

SEQ ID NO: 79465 - RNA, 21 nt, Human
gaaguagcucugagaaaagug

SEQ ID NO: 79466 - RNA, 22 nt, Human
gaagucagaucuuuugacuccc

SEQ ID NO: 79467 - RNA, 22 nt, Human
gaggcuaugucuacgcucagcg

SEQ ID NO: 79468 - RNA, 22 nt, Human
gaauggaugcuggucaguuugg

SEQ ID NO: 79469 - RNA, 22 nt, Human
gaauggaacauagcaacaucuu

SEQ ID NO: 79470 - RNA, 22 nt, Human
gagggcugccacguugggcgag

SEQ ID NO: 79471 - RNA, 22 nt, Human
gaauuagacggcaucacauggg

SEQ ID NO: 79472 - RNA, 22 nt, Human
gagggcucaacuacuacuaggc

SEQ ID NO: 79473 - RNA, 22 nt, Human
gaggggaacaggcauucuuaag

SEQ ID NO: 79474 - RNA, 22 nt, Human
gaggggaagaacaauuuaauuu

SEQ ID NO: 79475 - RNA, 22 nt, Human
gaauguuaaugcacuucuagcu

SEQ ID NO: 79476 - RNA, 22 nt, Human
gaauguuugagugccaugugac

SEQ ID NO: 79477 - RNA, 22 nt, Human
gagggcauugucuucuuaguuu

SEQ ID NO: 79478 - RNA, 22 nt, Human
gaauggcagaaugaagcagugu

SEQ ID NO: 79479 - RNA, 22 nt, Human
gagggaaaggggccaugauugg

SEQ ID NO: 79480 - RNA, 22 nt, Human
gaauuccaggugagagaaggua

SEQ ID NO: 79481 - RNA, 22 nt, Human
gaauucuaguucuguaucucug

SEQ ID NO: 79482 - RNA, 22 nt, Human
gacaacuucaguaaaguagauu

SEQ ID NO: 79483 - RNA, 22 nt, Human
gaggggcucuugggcaugaagg

SEQ ID NO: 79484 - RNA, 22 nt, Human
gaggggcuccagguguugagga

SEQ ID NO: 79485 - RNA, 22 nt, Human
gacagguagacaugaauauuaa

SEQ ID NO: 79486 - RNA, 22 nt, Human
gaguaaaagaugaggcaguaga

SEQ ID NO: 79487 - RNA, 22 nt, Human
gacaguggagccacguugggag

SEQ ID NO: 79488 - RNA, 22 nt, Human
gaggucaugcagcucugaguuc

SEQ ID NO: 79489 - RNA, 22 nt, Human
gaggucauuaaagaaaagaguc

SEQ ID NO: 79490 - RNA, 22 nt, Human
gaggguuagauuuuaagaaaga

SEQ ID NO: 79491 - RNA, 22 nt, Human
gacaccuucuacugacuaugga

SEQ ID NO: 79492 - RNA, 22 nt, Human
gacaaguagguuauuuuuagca

SEQ ID NO: 79493 - RNA, 22 nt, Human
gacaauuucucaauauagaaac

SEQ ID NO: 79494 - RNA, 22 nt, Human
gaccaggagauuugagcuaggc

SEQ ID NO: 79495 - RNA, 22 nt, Human
gacauugaauugaauccagauu

SEQ ID NO: 79496 - RNA, 22 nt, Human
gaccagaacuucuagucuaagu

SEQ ID NO: 79497 - RNA, 22 nt, Human
gaguauuacuaaaauucgccua

SEQ ID NO: 79498 - RNA, 20 nt, Human
gacgaacuagaacaguggua

SEQ ID NO: 79499 - RNA, 22 nt, Human
gaguauuuaccacuaaaugguu

SEQ ID NO: 79500 - RNA, 22 nt, Human
gaguauucuauguauauuauug

SEQ ID NO: 79501 - RNA, 22 nt, Human
gagucuuuuaagaugucuuacu

SEQ ID NO: 79502 - RNA, 19 nt, Human
gagugaggagcaucguuua

SEQ ID NO: 79503 - RNA, 22 nt, Human
gacggagugcgcuugcuguuca

SEQ ID NO: 79504 - RNA, 22 nt, Human
gaguuucacguagaucaggguc

SEQ ID NO: 79505 - RNA, 22 nt, Human
gaguugucggaggaagggggcg

SEQ ID NO: 79506 - RNA, 22 nt, Human
gacuaaauaaaagccaaacuuc

SEQ ID NO: 79507 - RNA, 19 nt, Human
gacuccugagaugugaaac

SEQ ID NO: 79508 - RNA, 22 nt, Human
gaguguuugcuguauaauugga

SEQ ID NO: 79509 - RNA, 22 nt, Human
gacuugaagcucucugguuuug

SEQ ID NO: 79510 - RNA, 22 nt, Human
gacuugauugguuugucaaguu

SEQ ID NO: 79511 - RNA, 22 nt, Human
gauaaauaguguuuggggacau

SEQ ID NO: 79512 - RNA, 22 nt, Human
gacuuaaccacggucacauggu

SEQ ID NO: 79513 - RNA, 22 nt, Human
gagaaagggagaaaaagaucuu

SEQ ID NO: 79514 - RNA, 22 nt, Human
gagaaauagauucaugguagau

SEQ ID NO: 79515 - RNA, 22 nt, Human
gagaaagauuguccuucagggg

SEQ ID NO: 79516 - RNA, 22 nt, Human
gagaaaacauacuuaguguccu

SEQ ID NO: 79517 - RNA, 22 nt, Human
gauauuaguuuuggaaggaggg

SEQ ID NO: 79518 - RNA, 22 nt, Human
gagaaaaauuucuuugcugcac

SEQ ID NO: 79519 - RNA, 20 nt, Human
gauagcacaaagagaauggg

SEQ ID NO: 79520 - RNA, 22 nt, Human
gagaaggagcagaaaaucuccu

SEQ ID NO: 79521 - RNA, 22 nt, Human
gagaaugagucagagcuggcug

SEQ ID NO: 79522 - RNA, 22 nt, Human
gagaagugaauaacgaagcagg

SEQ ID NO: 79523 - RNA, 22 nt, Human
gagaagugggggucugggauga

SEQ ID NO: 79524 - RNA, 19 nt, Human
gauauugagcugagaauuc

SEQ ID NO: 79525 - RNA, 22 nt, Human
gagaacagauaugaugacuuca

SEQ ID NO: 79526 - RNA, 22 nt, Human
gaucacuuugauuagauguccu

SEQ ID NO: 79527 - RNA, 22 nt, Human
gaucauauccagucaccacuau

SEQ ID NO: 79528 - RNA, 22 nt, Human
cuuuccaugucuucuuucucca

SEQ ID NO: 79529 - RNA, 22 nt, Human
gacacucuuaauccuaucccug

SEQ ID NO: 79530 - RNA, 22 nt, Human
cuuucugauguaaggaacuagg

SEQ ID NO: 79531 - RNA, 22 nt, Human
cuuucuccagagugaagauccu

SEQ ID NO: 79532 - RNA, 22 nt, Human
cuuucuuuuugguuucccccca

SEQ ID NO: 79533 - RNA, 22 nt, Human
gacagcuauggaguucacuucu

SEQ ID NO: 79534 - RNA, 22 nt, Human
gacagggacacagccagugagg

SEQ ID NO: 79535 - RNA, 22 nt, Human
gacaggcagagaggaagagaga

SEQ ID NO: 79536 - RNA, 22 nt, Human
cuuuggauuuuuugcuuuugua

SEQ ID NO: 79537 - RNA, 22 nt, Human
gacccucucagacuuccaggca

SEQ ID NO: 79538 - RNA, 22 nt, Human
gacaucuguccauggcacugga

SEQ ID NO: 79539 - RNA, 22 nt, Human
gaccugaccucauuagcaaguu

SEQ ID NO: 79540 - RNA, 22 nt, Human
gaccuuucccuaucucacucuc

SEQ ID NO: 79541 - RNA, 22 nt, Human
gacuugcucaaaucagauuuua

SEQ ID NO: 79542 - RNA, 22 nt, Human
gacuuguguagcuucagaauuu

SEQ ID NO: 79543 - RNA, 22 nt, Human
gacuucaagaugaaucuuuggg

SEQ ID NO: 79544 - RNA, 22 nt, Human
cuuuuugcccuugggcuuccug

SEQ ID NO: 79545 - RNA, 22 nt, Human
gacuuaaaugcuccccucaggg

SEQ ID NO: 79546 - RNA, 22 nt, Human
cuuuuucuuaucuuuuucuaug

SEQ ID NO: 79547 - RNA, 22 nt, Human
gacuguuggcagauguuugagu

SEQ ID NO: 79548 - RNA, 22 nt, Human
gagaacaaggaagagucggcag

SEQ ID NO: 79549 - RNA, 22 nt, Human
gagacucagccccugcucucaa

SEQ ID NO: 79550 - RNA, 22 nt, Human
gagacuguaagcuccuugagga

SEQ ID NO: 79551 - RNA, 22 nt, Human
gagaccuuaagagaugucagcu

SEQ ID NO: 79552 - RNA, 22 nt, Human
gaaaaauggguuguuugaagau

SEQ ID NO: 79553 - RNA, 22 nt, Human
gaagaugacaucggaucugucu

SEQ ID NO: 79554 - RNA, 22 nt, Human
gaagaugcugcuuguucacggg

SEQ ID NO: 79555 - RNA, 22 nt, Human
cuuccugcaacaccuguguugc

SEQ ID NO: 79556 - RNA, 22 nt, Human
gaaggugcugaaacagaaauuu

SEQ ID NO: 79557 - RNA, 22 nt, Human
gaaggggacuccauggaaugau

SEQ ID NO: 79558 - RNA, 22 nt, Human
cuucuagucaaaauggauaagc

SEQ ID NO: 79559 - RNA, 22 nt, Human
cuucucuuccuucucauccuca

SEQ ID NO: 79560 - RNA, 22 nt, Human
gaagguuuuguuugcaaaucau

SEQ ID NO: 79561 - RNA, 22 nt, Human
gaagucuuuucuuccacccaaa

SEQ ID NO: 79562 - RNA, 22 nt, Human
cuugcagagcccauggauguca

SEQ ID NO: 79563 - RNA, 22 nt, Human
cuucuuuuggggaugaaaaugg

SEQ ID NO: 79564 - RNA, 22 nt, Human
cuugcaaugaaggcacacuuau

SEQ ID NO: 79565 - RNA, 19 nt, Human
gaauggguucuguagggag

SEQ ID NO: 79566 - RNA, 22 nt, Human
gaauuacagaguuguuaaguca

SEQ ID NO: 79567 - RNA, 16 nt, Human
gaauuccauugcucug

SEQ ID NO: 79568 - RNA, 22 nt, Human
cuugggacucccuguagcagug

SEQ ID NO: 79569 - RNA, 22 nt, Human
gacacucauauuaagccuauuu

SEQ ID NO: 79570 - RNA, 22 nt, Human
cuugugagaagaccuuccgcau

SEQ ID NO: 79571 - RNA, 22 nt, Human
cuuucauuuuugggcaucugag

SEQ ID NO: 79572 - RNA, 22 nt, Human
gacaagaagaacggagguuuca

SEQ ID NO: 79573 - RNA, 22 nt, Human
cuugguuugaaacauacucuac

SEQ ID NO: 79574 - RNA, 22 nt, Human
gacaagaugacaucauggcuuc

SEQ ID NO: 79575 - RNA, 22 nt, Human
cugaucuuaaguaacauuauuu

SEQ ID NO: 79576 - RNA, 23 nt, Human
cuucagaccucagaaggucuguu

SEQ ID NO: 79577 - RNA, 22 nt, Human
cugaugcucuggauguagucaa

SEQ ID NO: 79578 - RNA, 20 nt, Human
cuuauuuuggagaacuuuuc

SEQ ID NO: 79579 - RNA, 22 nt, Human
cuggagcucugggcaucucagg

SEQ ID NO: 79580 - RNA, 22 nt, Human
cuuugcaaagagagaaaguggg

SEQ ID NO: 79581 - RNA, 19 nt, Human
cuuuuagagggagaggacu

SEQ ID NO: 79582 - RNA, 22 nt, Human
cuuuugcaauagugacacugau

SEQ ID NO: 79583 - RNA, 22 nt, Human
cuggcuaaugugcugauagcca

SEQ ID NO: 79584 - RNA, 22 nt, Human
cugggcaugggaacuucaaggc

SEQ ID NO: 79585 - RNA, 22 nt, Human
cuuuuucuugugguuaauaucu

SEQ ID NO: 79586 - RNA, 22 nt, Human
cuuuuucaugggugaugagugg

SEQ ID NO: 79587 - RNA, 22 nt, Human
cuuuuuaaaguaaauggcuaga

SEQ ID NO: 79588 - RNA, 22 nt, Human
gaaaaagagaaggaguucagua

SEQ ID NO: 79589 - RNA, 22 nt, Human
gaaaaaccacaauugguauuuu

SEQ ID NO: 79590 - RNA, 22 nt, Human
gaaaaacucagugggggucuuu

SEQ ID NO: 79591 - RNA, 22 nt, Human
cugggugggcacccagccuggg

SEQ ID NO: 79592 - RNA, 22 nt, Human
cuuuuuuucuccauauuucugg

SEQ ID NO: 79593 - RNA, 22 nt, Human
gaaaucuggugauuuucuguug

SEQ ID NO: 79594 - RNA, 22 nt, Human
gaaaugaaacacacaugcagcu

SEQ ID NO: 79595 - RNA, 20 nt, Human
gaacauaaauaacucuuuac

SEQ ID NO: 79596 - RNA, 22 nt, Human
gaacaaggauucccaaagaaga

SEQ ID NO: 79597 - RNA, 22 nt, Human
cugugguuuuauuuauuugaag

SEQ ID NO: 79598 - RNA, 22 nt, Human
gaaagagaugucguuugucuuc

SEQ ID NO: 79599 - RNA, 22 nt, Human
cuguuacggaggcuuucuaguu

SEQ ID NO: 79600 - RNA, 22 nt, Human
gaaccauuuaauggagaugcuc

SEQ ID NO: 79601 - RNA, 22 nt, Human
cuguuguucacuuugcugguga

SEQ ID NO: 79602 - RNA, 22 nt, Human
gaagaaggaagaucaugcuuga

SEQ ID NO: 79603 - RNA, 22 nt, Human
cuggguuuggcugugcuugaau

SEQ ID NO: 79604 - RNA, 22 nt, Human
gaaaagaaaggaugguaugugu

SEQ ID NO: 79605 - RNA, 22 nt, Human
gaaaaggaggggaggcagaugg

SEQ ID NO: 79606 - RNA, 22 nt, Human
gaaaagcucuuuagaagagguu

SEQ ID NO: 79607 - RNA, 22 nt, Human
cuguauggaggaggugcuagcc

SEQ ID NO: 79608 - RNA, 22 nt, Human
cuguacuuguuuuaggaugaug

SEQ ID NO: 79609 - RNA, 22 nt, Human
gaaaaugcacacauacacaccc

SEQ ID NO: 79610 - RNA, 22 nt, Human
gaaaauaguucaucacaaugau

SEQ ID NO: 79611 - RNA, 22 nt, Human
cugguuuuccaauguuuugacu

SEQ ID NO: 79612 - RNA, 22 nt, Human
gaaaaguuuaaccuuguacauu

SEQ ID NO: 79613 - RNA, 22 nt, Human
gaaaaucaugaaaguguguugu

SEQ ID NO: 79614 - RNA, 22 nt, Human
cucacgguuugcaucaagagug

SEQ ID NO: 79615 - RNA, 22 nt, Human
cucacauacaagagauggugga

SEQ ID NO: 79616 - RNA, 22 nt, Human
cuauaagguguuucuauugguc

SEQ ID NO: 79617 - RNA, 22 nt, Human
cucaaagcagacuuuucccuuu

SEQ ID NO: 79618 - RNA, 22 nt, Human
cuauugguaucacacugauuuc

SEQ ID NO: 79619 - RNA, 22 nt, Human
cugcuucacccugccugagaac

SEQ ID NO: 79620 - RNA, 22 nt, Human
cucagcacauuccuaagggaug

SEQ ID NO: 79621 - RNA, 22 nt, Human
cucagaagaacaaaggcucuac

SEQ ID NO: 79622 - RNA, 22 nt, Human
cucagugacuuccugcucaauu

SEQ ID NO: 79623 - RNA, 22 nt, Human
cucaugaauggcucuuugugcu

SEQ ID NO: 79624 - RNA, 22 nt, Human
cucaugagucugucagagucau

SEQ ID NO: 79625 - RNA, 22 nt, Human
cucaggaaaauauugaagaagu

SEQ ID NO: 79626 - RNA, 22 nt, Human
cuggcaguguccagcucgugau

SEQ ID NO: 79627 - RNA, 22 nt, Human
cucccucauaugguugcuuauc

SEQ ID NO: 79628 - RNA, 22 nt, Human
cugggagaugacucagagcagg

SEQ ID NO: 79629 - RNA, 22 nt, Human
cucugagcucgugcaguacuuc

SEQ ID NO: 79630 - RNA, 22 nt, Human
cuggucuugguauucgcagaag

SEQ ID NO: 79631 - RNA, 22 nt, Human
cugggaguugacgaggcuugua

SEQ ID NO: 79632 - RNA, 22 nt, Human
cuccuuuuuauaucuuucucug

SEQ ID NO: 79633 - RNA, 22 nt, Human
cugguuacuucagaucaguagu

SEQ ID NO: 79634 - RNA, 22 nt, Human
cucuggagggaggcugagcugg

SEQ ID NO: 79635 - RNA, 22 nt, Human
cuggugaagccuucggagaccc

SEQ ID NO: 79636 - RNA, 22 nt, Human
cuggugagaccgacuuccacuu

SEQ ID NO: 79637 - RNA, 19 nt, Human
cuguccacacacucgcuuc

SEQ ID NO: 79638 - RNA, 22 nt, Human
cuguaaguggugaaauuaguuu

SEQ ID NO: 79639 - RNA, 21 nt, Human
cugugggaaggccugaggucu

SEQ ID NO: 79640 - RNA, 20 nt, Human
cucuuucugcuuuaugccuc

SEQ ID NO: 79641 - RNA, 20 nt, Human
cucuuuaugagaccacuguc

SEQ ID NO: 79642 - RNA, 22 nt, Human
cugugcuguuaagaaauuuagu

SEQ ID NO: 79643 - RNA, 22 nt, Human
cucuuuuuuugucuuaagaacc

SEQ ID NO: 79644 - RNA, 22 nt, Human
cugugcauguucucuagcugau

SEQ ID NO: 79645 - RNA, 23 nt, Human
cugaaauucagaugcuaaagaua

SEQ ID NO: 79646 - RNA, 20 nt, Human
cugaaaggaaagaaauuuuu

SEQ ID NO: 79647 - RNA, 22 nt, Human
cugaaagacgaggggaagucgg

SEQ ID NO: 79648 - RNA, 22 nt, Human
cuguuguauuuauuucccuuuc

SEQ ID NO: 79649 - RNA, 22 nt, Human
cugagcaucaaaugggcaauua

SEQ ID NO: 79650 - RNA, 22 nt, Human
cuguuucuuugcugucagagag

SEQ ID NO: 79651 - RNA, 20 nt, Human
cuguuugcuaucaugagcug

SEQ ID NO: 79652 - RNA, 22 nt, Human
cugucucugauaagcucgaggg

SEQ ID NO: 79653 - RNA, 22 nt, Human
cuuaggaaauccuguacucccc

SEQ ID NO: 79654 - RNA, 22 nt, Human
cugagguagaggaaauguagcu

SEQ ID NO: 79655 - RNA, 22 nt, Human
cuuauuagaaagaaaagacaug

SEQ ID NO: 79656 - RNA, 22 nt, Human
cuuauucuucuggacuuggagu

SEQ ID NO: 79657 - RNA, 22 nt, Human
cuuauuugcccauguuucuuua

SEQ ID NO: 79658 - RNA, 22 nt, Human
cuaaauuuuuuagugaaauagg

SEQ ID NO: 79659 - RNA, 22 nt, Human
cuacugaugccccgcugugccu

SEQ ID NO: 79660 - RNA, 22 nt, Human
cuacauuuacacaguuaggcuu

SEQ ID NO: 79661 - RNA, 22 nt, Human
cuacuucuguggcucuaagaga

SEQ ID NO: 79662 - RNA, 22 nt, Human
cuagaaaguaugcuuuuauaau

SEQ ID NO: 79663 - RNA, 22 nt, Human
cuacuuucuucuucagaauugu

SEQ ID NO: 79664 - RNA, 22 nt, Human
cuagaucuggcaggcacaaggu

SEQ ID NO: 79665 - RNA, 22 nt, Human
cuagaucuuuaaaaaucuggaa

SEQ ID NO: 79666 - RNA, 22 nt, Human
cugccuucaaaguaauauuuua

SEQ ID NO: 79667 - RNA, 22 nt, Human
cugccuuggcccuaguucaugg

SEQ ID NO: 79668 - RNA, 22 nt, Human
cuagcaggacucagcagauauu

SEQ ID NO: 79669 - RNA, 21 nt, Human
cuauaaaaaugguucuuugcg

SEQ ID NO: 79670 - RNA, 21 nt, Human
cugcugaaggaaccccaugga

SEQ ID NO: 79671 - RNA, 22 nt, Human
cuaguucugccauucaguguca

SEQ ID NO: 79672 - RNA, 22 nt, Human
cuaguuuucacaaaggaagggc

SEQ ID NO: 79673 - RNA, 22 nt, Human
cuaugaaucaauuucugcaguu

SEQ ID NO: 79674 - RNA, 22 nt, Human
cuauacuuagaacuccauuuuc

SEQ ID NO: 79675 - RNA, 22 nt, Human
cuauuaauggccaggagucaug

SEQ ID NO: 79676 - RNA, 22 nt, Human
cuauguuucagauauauauaua

SEQ ID NO: 79677 - RNA, 22 nt, Human
cugcuguugagguuccaggcca

SEQ ID NO: 79678 - RNA, 22 nt, Human
cugcuguuuuccccaccaucuc

SEQ ID NO: 79679 - RNA, 22 nt, Human
cugcuguuuucugggcuucuua

SEQ ID NO: 79680 - RNA, 22 nt, Human
cugcagagaccuaggucagguu

SEQ ID NO: 79681 - RNA, 22 nt, Human
cugauuucaaauggugcuagau

SEQ ID NO: 79682 - RNA, 22 nt, Human
cugcacagucauuuccucucaa

SEQ ID NO: 79683 - RNA, 22 nt, Human
cugauuguagccacugugauga

SEQ ID NO: 79684 - RNA, 20 nt, Human
cugauguucgugcuuccugg

SEQ ID NO: 79685 - RNA, 22 nt, Human
cugauguuuaucucaagaguuc

SEQ ID NO: 79686 - RNA, 22 nt, Human
cuaaagucauacaaggugggag

SEQ ID NO: 79687 - RNA, 22 nt, Human
cuaaaaauguucuaguaguuca

SEQ ID NO: 79688 - RNA, 22 nt, Human
cugcaucacagcaggaggcaca

SEQ ID NO: 79689 - RNA, 22 nt, Human
cguuugagggaguuggaacugc

SEQ ID NO: 79690 - RNA, 22 nt, Human
cugcagauguagcugcuuuccu

SEQ ID NO: 79691 - RNA, 22 nt, Human
cugcagauaaguguuuugaaaa

SEQ ID NO: 79692 - RNA, 22 nt, Human
cgguuuuuaaaagucucuucua

SEQ ID NO: 79693 - RNA, 22 nt, Human
cucugcuuagacaggcuuuaag

SEQ ID NO: 79694 - RNA, 21 nt, Human
cgucccggcgugagagagcug

SEQ ID NO: 79695 - RNA, 22 nt, Human
cugaguuuuucaaaucugaauu

SEQ ID NO: 79696 - RNA, 22 nt, Human
cugagggagacagugcggacua

SEQ ID NO: 79697 - RNA, 22 nt, Human
cugaggaguaguucuggaggac

SEQ ID NO: 79698 - RNA, 22 nt, Human
cugaggcuaauagaauuuucug

SEQ ID NO: 79699 - RNA, 22 nt, Human
cugagcuauauauuaugcauag

SEQ ID NO: 79700 - RNA, 22 nt, Human
cguggaggucgcauauuccucu

SEQ ID NO: 79701 - RNA, 22 nt, Human
cugaugucaaauuuaucaaagc

SEQ ID NO: 79702 - RNA, 21 nt, Human
cugauguaccucaagccuagu

SEQ ID NO: 79703 - RNA, 22 nt, Human
cugauggagagugugauuuggg

SEQ ID NO: 79704 - RNA, 22 nt, Human
cugauagagcauuagugugaga

SEQ ID NO: 79705 - RNA, 22 nt, Human
cugauaauaaccauuuuaaaau

SEQ ID NO: 79706 - RNA, 22 nt, Human
cuagcacagugcuuggcacaca

SEQ ID NO: 79707 - RNA, 22 nt, Human
cgcagcuucagggccaggaggg

SEQ ID NO: 79708 - RNA, 22 nt, Human
cuaggcuuucugugugacuaga

SEQ ID NO: 79709 - RNA, 22 nt, Human
cuaggaugcuguaauggugucu

SEQ ID NO: 79710 - RNA, 18 nt, Human
cuaguuuguuuucuacau

SEQ ID NO: 79711 - RNA, 22 nt, Human
cucaaaauccauaaaaucaggu

SEQ ID NO: 79712 - RNA, 22 nt, Human
cucaaauggguuuguagaauau

SEQ ID NO: 79713 - RNA, 22 nt, Human
cucaagagaaaucggaaucaga

SEQ ID NO: 79714 - RNA, 22 nt, Human
cucaaugagcuauuuguuucau

SEQ ID NO: 79715 - RNA, 22 nt, Human
cucaguauugacgaaagagauu

SEQ ID NO: 79716 - RNA, 22 nt, Human
cucagcaauuaccugugucucu

SEQ ID NO: 79717 - RNA, 22 nt, Human
cucaucuucuuccuucuuuucc

SEQ ID NO: 79718 - RNA, 22 nt, Human
cucaucagagcccuccucuggc

SEQ ID NO: 79719 - RNA, 22 nt, Human
cucauugacagagcagcucuac

SEQ ID NO: 79720 - RNA, 20 nt, Human
cucauugcuuucauuuucuu

SEQ ID NO: 79721 - RNA, 22 nt, Human
cucccuucaggggaggacuagg

SEQ ID NO: 79722 - RNA, 22 nt, Human
cuccaccucagugucaucuucu

SEQ ID NO: 79723 - RNA, 22 nt, Human
cuccagcucgcgagcucugcuc

SEQ ID NO: 79724 - RNA, 22 nt, Human
cucuaccugcacaugccugacu

SEQ ID NO: 79725 - RNA, 22 nt, Human
cggaggcugcuuucuguugcua

SEQ ID NO: 79726 - RNA, 22 nt, Human
cuccugcuuuuucuucuuccga

SEQ ID NO: 79727 - RNA, 22 nt, Human
cuccucguccucuucauccucu

SEQ ID NO: 79728 - RNA, 22 nt, Human
cucugaguuuacaguauguuuu

SEQ ID NO: 79729 - RNA, 22 nt, Human
cucucuguuaugcuuucaugaa

SEQ ID NO: 79730 - RNA, 22 nt, Human
cucucuuuuuuucccuuguuaa

SEQ ID NO: 79731 - RNA, 22 nt, Human
cuaaacacuauucuggaaauag

SEQ ID NO: 79732 - RNA, 22 nt, Human
cuaaacuucauauguugcuuua

SEQ ID NO: 79733 - RNA, 22 nt, Human
cuaaagacagcaagacaucauc

SEQ ID NO: 79734 - RNA, 22 nt, Human
cuaaauucuauauccuugcuuc

SEQ ID NO: 79735 - RNA, 22 nt, Human
cuaaauguuuuaucuuccuggc

SEQ ID NO: 79736 - RNA, 18 nt, Human
cuacauucauaggaaagg

SEQ ID NO: 79737 - RNA, 22 nt, Human
cuacacgauaaauuuuaguggu

SEQ ID NO: 79738 - RNA, 19 nt, Human
cuacaguguuuuucuuucc

SEQ ID NO: 79739 - RNA, 22 nt, Human
cgaggagguccaggagcaguag

SEQ ID NO: 79740 - RNA, 22 nt, Human
cgaguagagaugugguuucuga

SEQ ID NO: 79741 - RNA, 22 nt, Human
cuacugaagcaugcuuauaugu

SEQ ID NO: 79742 - RNA, 22 nt, Human
cuacuguaguuaaaguuuugua

SEQ ID NO: 79743 - RNA, 22 nt, Human
cuacuucucccuagaucagaaa

SEQ ID NO: 79744 - RNA, 22 nt, Human
cuagaaguuuggguccauuaag

SEQ ID NO: 79745 - RNA, 22 nt, Human
cuagaggaacaguuucagguuu

SEQ ID NO: 79746 - RNA, 22 nt, Human
cuagagaaaaagcuuagguacg

SEQ ID NO: 79747 - RNA, 22 nt, Human
cgauuccugauaagugaauaag

SEQ ID NO: 79748 - RNA, 22 nt, Human
cgugaucuguuauauagugagc

SEQ ID NO: 79749 - RNA, 17 nt, Human
cgugaggaccaggcagc

SEQ ID NO: 79750 - RNA, 21 nt, Human
ccuuugaguguguuugaagua

SEQ ID NO: 79751 - RNA, 22 nt, Human
ccuuucuggucucugagagacu

SEQ ID NO: 79752 - RNA, 22 nt, Human
ccuugugauugaucuaaguugc

SEQ ID NO: 79753 - RNA, 22 nt, Human
cgggagaugaggagagcuucgg

SEQ ID NO: 79754 - RNA, 22 nt, Human
ccuugcgaggaugcugugagcu

SEQ ID NO: 79755 - RNA, 22 nt, Human
ccuugagacacagccaaagaug

SEQ ID NO: 79756 - RNA, 22 nt, Human
ccuucugcuggucaucccagug

SEQ ID NO: 79757 - RNA, 22 nt, Human
ccuucucuucuuggaaggaacu

SEQ ID NO: 79758 - RNA, 22 nt, Human
ccuuggcuuaccuucugugugg

SEQ ID NO: 79759 - RNA, 22 nt, Human
ccuuggaucugcauaucagcua

SEQ ID NO: 79760 - RNA, 22 nt, Human
ccuauauuacaggcuugcucua

SEQ ID NO: 79761 - RNA, 22 nt, Human
ccuagcauagcuuuugccuccc

SEQ ID NO: 79762 - RNA, 22 nt, Human
ccuuuuuagaugugcgaauguu

SEQ ID NO: 79763 - RNA, 21 nt, Human
ccuaugucucaaagguucucc

SEQ ID NO: 79764 - RNA, 22 nt, Human
cgaagcuuuuguuggcgugucg

SEQ ID NO: 79765 - RNA, 22 nt, Human
cgaaggaaucacuuaacacuuu

SEQ ID NO: 79766 - RNA, 22 nt, Human
ccuccuggaguuacuuccaaaa

SEQ ID NO: 79767 - RNA, 22 nt, Human
ccuccuuucaggaaguaggugg

SEQ ID NO: 79768 - RNA, 22 nt, Human
cgagugauuauucuggcugaga

SEQ ID NO: 79769 - RNA, 22 nt, Human
ccugagacucuccugugcagcc

SEQ ID NO: 79770 - RNA, 20 nt, Human
ccucucugcaugcucccuga

SEQ ID NO: 79771 - RNA, 22 nt, Human
ccucucugcgaaugcugauagu

SEQ ID NO: 79772 - RNA, 22 nt, Human
cgcuuugacuuuagaaggccaa

SEQ ID NO: 79773 - RNA, 22 nt, Human
ccagaauuugaacccacaaaug

SEQ ID NO: 79774 - RNA, 21 nt, Human
ccuggagacaaagacagggug

SEQ ID NO: 79775 - RNA, 22 nt, Human
ccugugacucugucugaugguc

SEQ ID NO: 79776 - RNA, 22 nt, Human
ccuuagaaaaucauggaauauu

SEQ ID NO: 79777 - RNA, 22 nt, Human
ccuuugcccugagaaauguucc

SEQ ID NO: 79778 - RNA, 21 nt, Human
ccuuuggagacugcagcaaug

SEQ ID NO: 79779 - RNA, 22 nt, Human
ccuuugcugggccucuccaucu

SEQ ID NO: 79780 - RNA, 22 nt, Human
ccuuuuaagggagacuagagau

SEQ ID NO: 79781 - RNA, 20 nt, Human
ccuuuuguugcuguuuggau

SEQ ID NO: 79782 - RNA, 18 nt, Human
ccuucaucucugcuucuu

SEQ ID NO: 79783 - RNA, 22 nt, Human
ccuugguuuagcaauuuuucuu

SEQ ID NO: 79784 - RNA, 22 nt, Human
ccuuuccucuucaugacuuucu

SEQ ID NO: 79785 - RNA, 22 nt, Human
ccuuuccuggaaaugguaaguu

SEQ ID NO: 79786 - RNA, 22 nt, Human
ccuuucuaacagauuguggauc

SEQ ID NO: 79787 - RNA, 17 nt, Human
ccuuucugaucaucuga

SEQ ID NO: 79788 - RNA, 22 nt, Human
cauuccuaccauaucugcucuu

SEQ ID NO: 79789 - RNA, 22 nt, Human
cauugcaaccauuccaaauggc

SEQ ID NO: 79790 - RNA, 20 nt, Human
ccagaagagaagaaaaggaa

SEQ ID NO: 79791 - RNA, 19 nt, Human
ccagaagggcaagcaaagg

SEQ ID NO: 79792 - RNA, 22 nt, Human
cauugcugccaaggugagcugg

SEQ ID NO: 79793 - RNA, 22 nt, Human
cauugcuguuaauugucucuag

SEQ ID NO: 79794 - RNA, 22 nt, Human
ccagagcacaccguuugccuuc

SEQ ID NO: 79795 - RNA, 22 nt, Human
ccagaggcuuaugcagcugcug

SEQ ID NO: 79796 - RNA, 22 nt, Human
cauuuacauaacaguaacgcug

SEQ ID NO: 79797 - RNA, 22 nt, Human
cauuuaucacuugcuaaacaua

SEQ ID NO: 79798 - RNA, 22 nt, Human
cauugguacaaaauguacuuug

SEQ ID NO: 79799 - RNA, 22 nt, Human
ccagagaugcagugggugcagu

SEQ ID NO: 79800 - RNA, 22 nt, Human
ccagacucucucauuuuccugu

SEQ ID NO: 79801 - RNA, 22 nt, Human
cauuucaaacaguuacagcugc

SEQ ID NO: 79802 - RNA, 22 nt, Human
cauuucuggccuggggagcggg

SEQ ID NO: 79803 - RNA, 22 nt, Human
cauuuuccucugcugguguuca

SEQ ID NO: 79804 - RNA, 22 nt, Human
cauuuuaucagcacacgucacu

SEQ ID NO: 79805 - RNA, 22 nt, Human
ccagcuuuucagaaucugccug

SEQ ID NO: 79806 - RNA, 22 nt, Human
cauuuuuuuuccccuccuggua

SEQ ID NO: 79807 - RNA, 22 nt, Human
ccaaagaagcaaugagaauagu

SEQ ID NO: 79808 - RNA, 22 nt, Human
ccaaagaauuuggaaaaucuga

SEQ ID NO: 79809 - RNA, 22 nt, Human
ccaaaguauuaaaucuuagcaa

SEQ ID NO: 79810 - RNA, 22 nt, Human
ccagggcuggaggaggucagga

SEQ ID NO: 79811 - RNA, 22 nt, Human
ccaaucaacuguguggcuuucu

SEQ ID NO: 79812 - RNA, 22 nt, Human
ccaaggcuguggggcugugcag

SEQ ID NO: 79813 - RNA, 22 nt, Human
ccacagugauucacuuuugaag

SEQ ID NO: 79814 - RNA, 22 nt, Human
ccaccacauuugccuagacuuu

SEQ ID NO: 79815 - RNA, 22 nt, Human
ccacuacauugagugcuuucuc

SEQ ID NO: 79816 - RNA, 22 nt, Human
ccauggaugcucagauguuagc

SEQ ID NO: 79817 - RNA, 22 nt, Human
ccacuuugagaagcugaugaaa

SEQ ID NO: 79818 - RNA, 22 nt, Human
ccacucagaagaaacaagagag

SEQ ID NO: 79819 - RNA, 22 nt, Human
caugauguuaucaagcacaaag

SEQ ID NO: 79820 - RNA, 22 nt, Human
caugaugagaguaauaacacag

SEQ ID NO: 79821 - RNA, 20 nt, Human
caugaugcaaacaguaacgu

SEQ ID NO: 79822 - RNA, 22 nt, Human
cauuuugguccucauguguagc

SEQ ID NO: 79823 - RNA, 22 nt, Human
caugcuggcacugaccagccua

SEQ ID NO: 79824 - RNA, 22 nt, Human
caugcuaacacguugcucaccg

SEQ ID NO: 79825 - RNA, 22 nt, Human
ccaaggcugcagccgugacgcg

SEQ ID NO: 79826 - RNA, 22 nt, Human
ccaaggcuggagggcuuaugua

SEQ ID NO: 79827 - RNA, 22 nt, Human
ccaaauuaccuucuuggauuca

SEQ ID NO: 79828 - RNA, 22 nt, Human
caugggaaauauaagaauuuuc

SEQ ID NO: 79829 - RNA, 22 nt, Human
cauggcggcgcucucccugccu

SEQ ID NO: 79830 - RNA, 22 nt, Human
cauggccaaagaauuauauuuu

SEQ ID NO: 79831 - RNA, 22 nt, Human
ccacagcauugaaaucuauaau

SEQ ID NO: 79832 - RNA, 22 nt, Human
cauguauguuaguggcugcuuu

SEQ ID NO: 79833 - RNA, 21 nt, Human
caugguaaguacaaagaugac

SEQ ID NO: 79834 - RNA, 23 nt, Human
cauguacacacagcuguacagug

SEQ ID NO: 79835 - RNA, 20 nt, Human
cauuccaugcaucuuggucc

SEQ ID NO: 79836 - RNA, 22 nt, Human
cauucauagaaucaguuuggga

SEQ ID NO: 79837 - RNA, 22 nt, Human
cagguuuuuauuacaacuuuga

SEQ ID NO: 79838 - RNA, 22 nt, Human
cauguggaaaugcaugcuuuuu

SEQ ID NO: 79839 - RNA, 22 nt, Human
cauaucuuaaacaucaucucug

SEQ ID NO: 79840 - RNA, 22 nt, Human
cauauuaugcauguuguucuuu

SEQ ID NO: 79841 - RNA, 22 nt, Human
cagguguugcaguugaagacug

SEQ ID NO: 79842 - RNA, 22 nt, Human
cauuccuucucagguacuggca

SEQ ID NO: 79843 - RNA, 22 nt, Human
cauugcaaccccaaaaagaaca

SEQ ID NO: 79844 - RNA, 22 nt, Human
cauugcugugggcauuugcugc

SEQ ID NO: 79845 - RNA, 22 nt, Human
cauucauaagacuuugcucuug

SEQ ID NO: 79846 - RNA, 22 nt, Human
cauuauacaugaagacucaccc

SEQ ID NO: 79847 - RNA, 22 nt, Human
cauuccaagaaguaguucugca

SEQ ID NO: 79848 - RNA, 22 nt, Human
cauuccaaguauauacaugaua

SEQ ID NO: 79849 - RNA, 21 nt, Human
caucaagaucaauggagggcu

SEQ ID NO: 79850 - RNA, 22 nt, Human
caucaauagguauuugagagac

SEQ ID NO: 79851 - RNA, 22 nt, Human
cauuuagagaagauuacaagga

SEQ ID NO: 79852 - RNA, 22 nt, Human
caugaagugaaaagguuaauuu

SEQ ID NO: 79853 - RNA, 22 nt, Human
cauuucuugugagccgcauccu

SEQ ID NO: 79854 - RNA, 23 nt, Human
cauuugauccucacaauaaaugg

SEQ ID NO: 79855 - RNA, 22 nt, Human
cauuugcuuaucacucuucuuu

SEQ ID NO: 79856 - RNA, 22 nt, Human
cauuuucugcaagucugcucaa

SEQ ID NO: 79857 - RNA, 22 nt, Human
cauuuugguaauguucguuugc

SEQ ID NO: 79858 - RNA, 22 nt, Human
caucccaacaggugaucuggua

SEQ ID NO: 79859 - RNA, 22 nt, Human
cauccagggguacccuggagcc

SEQ ID NO: 79860 - RNA, 22 nt, Human
cauuggcacauguauucugggc

SEQ ID NO: 79861 - RNA, 22 nt, Human
caucucagguuuguucugagac

SEQ ID NO: 79862 - RNA, 22 nt, Human
cauccuauuacugaggcucccc

SEQ ID NO: 79863 - RNA, 18 nt, Human
cauuguacaaugcuuuau

SEQ ID NO: 79864 - RNA, 22 nt, Human
cauuuaaccccuugguacugaa

SEQ ID NO: 79865 - RNA, 22 nt, Human
caaaagcaaagaucuuugauug

SEQ ID NO: 79866 - RNA, 22 nt, Human
caaugccaggaaccugggggaa

SEQ ID NO: 79867 - RNA, 22 nt, Human
cacagaauuaagggagaaauau

SEQ ID NO: 79868 - RNA, 21 nt, Human
cacuguauagcaggagaaaac

SEQ ID NO: 79869 - RNA, 22 nt, Human
cacaggacuuggcuucucacag

SEQ ID NO: 79870 - RNA, 23 nt, Human
cacaggcagaaaucaagacggua

SEQ ID NO: 79871 - RNA, 22 nt, Human
cacaguccugcauuuacugccu

SEQ ID NO: 79872 - RNA, 22 nt, Human
cacagucugagcccagccuugu

SEQ ID NO: 79873 - RNA, 22 nt, Human
cacuuauuuuuccuuugugauu

SEQ ID NO: 79874 - RNA, 22 nt, Human
cacuucaguacuagaggaugaa

SEQ ID NO: 79875 - RNA, 22 nt, Human
cacuugagagcugaagaagucu

SEQ ID NO: 79876 - RNA, 22 nt, Human
cagaaagaaguggggauagagg

SEQ ID NO: 79877 - RNA, 22 nt, Human
cacauuuuccagaagaaucaga

SEQ ID NO: 79878 - RNA, 22 nt, Human
caccaaaauaucccuuuguaca

SEQ ID NO: 79879 - RNA, 22 nt, Human
cacaucucagggcuacaggcag

SEQ ID NO: 79880 - RNA, 22 nt, Human
cagacaaauccuuaugagacug

SEQ ID NO: 79881 - RNA, 22 nt, Human
cacuauguacauaauagcugcu

SEQ ID NO: 79882 - RNA, 22 nt, Human
cacuaaccauguucccaacagc

SEQ ID NO: 79883 - RNA, 22 nt, Human
caccugcaaauuccagauuucu

SEQ ID NO: 79884 - RNA, 22 nt, Human
caccacauguccgaaauucagc

SEQ ID NO: 79885 - RNA, 22 nt, Human
cagagacuuuugcuccgauucu

SEQ ID NO: 79886 - RNA, 22 nt, Human
cagagaggagcacaaagugaag

SEQ ID NO: 79887 - RNA, 22 nt, Human
cagagaagaggucuugaccccu

SEQ ID NO: 79888 - RNA, 22 nt, Human
cagaccucucaggcuguucuug

SEQ ID NO: 79889 - RNA, 22 nt, Human
cagaccucuaugggguaaaucu

SEQ ID NO: 79890 - RNA, 23 nt, Human
cagagaaaauagaauaugcugug

SEQ ID NO: 79891 - RNA, 22 nt, Human
cagacugugagcuccuugaggg

SEQ ID NO: 79892 - RNA, 22 nt, Human
cagacugagaaagugccacagg

SEQ ID NO: 79893 - RNA, 22 nt, Human
cacuguugaagauacuuccucu

SEQ ID NO: 79894 - RNA, 21 nt, Human
cagagcuuuggagacggagga

SEQ ID NO: 79895 - RNA, 22 nt, Human
cacugcugaggcccguguuacu

SEQ ID NO: 79896 - RNA, 22 nt, Human
cacucuucucucauuuuccuuu

SEQ ID NO: 79897 - RNA, 22 nt, Human
cagaaaguauguucuaguaguu

SEQ ID NO: 79898 - RNA, 22 nt, Human
cagaaagugauuugcuauucca

SEQ ID NO: 79899 - RNA, 22 nt, Human
cacuuaaaauucagggcuuaua

SEQ ID NO: 79900 - RNA, 22 nt, Human
cacuguugagcaauguacagug

SEQ ID NO: 79901 - RNA, 21 nt, Human
cagcagaugccagggucucug

SEQ ID NO: 79902 - RNA, 22 nt, Human
cagcagaggagguggcagcacc

SEQ ID NO: 79903 - RNA, 22 nt, Human
cagaaauuggcagagaagaccu

SEQ ID NO: 79904 - RNA, 22 nt, Human
cagccauucuaacacugccagu

SEQ ID NO: 79905 - RNA, 22 nt, Human
cagaaguugcuugagagagagc

SEQ ID NO: 79906 - RNA, 22 nt, Human
caggaagagaacugcucagccu

SEQ ID NO: 79907 - RNA, 22 nt, Human
caggaacagcaccaggagcuag

SEQ ID NO: 79908 - RNA, 22 nt, Human
cagguuuuccuuuuaaaaggaa

SEQ ID NO: 79909 - RNA, 19 nt, Human
caggauuguuuaaagcuuu

SEQ ID NO: 79910 - RNA, 22 nt, Human
caggaggaaaguuccacucaac

SEQ ID NO: 79911 - RNA, 22 nt, Human
caggaggaggccgggaggaagc

SEQ ID NO: 79912 - RNA, 22 nt, Human
cagucucuugcuucauuaguug

SEQ ID NO: 79913 - RNA, 22 nt, Human
cagugcuggaggggugcuugca

SEQ ID NO: 79914 - RNA, 22 nt, Human
cagugcucauagcuguuccucc

SEQ ID NO: 79915 - RNA, 22 nt, Human
cagugguaaaugucguuccugu

SEQ ID NO: 79916 - RNA, 22 nt, Human
caguguuuagcacagugcuugg

SEQ ID NO: 79917 - RNA, 22 nt, Human
caggguuuuauuuggcuuuaaa

SEQ ID NO: 79918 - RNA, 22 nt, Human
caguuuccagacauuauugaua

SEQ ID NO: 79919 - RNA, 22 nt, Human
caguuuuauacacugcagcucc

SEQ ID NO: 79920 - RNA, 21 nt, Human
caguucuaagugucaucuuuu

SEQ ID NO: 79921 - RNA, 22 nt, Human
caguucacggcugguaugaauu

SEQ ID NO: 79922 - RNA, 22 nt, Human
caguugcuauugagagaacaca

SEQ ID NO: 79923 - RNA, 22 nt, Human
cauaucuccagguucugcugga

SEQ ID NO: 79924 - RNA, 22 nt, Human
cauaacuugguguuggaaacug

SEQ ID NO: 79925 - RNA, 22 nt, Human
caguuuuucaaaauuacaugau

SEQ ID NO: 79926 - RNA, 22 nt, Human
cagaggagcgaguuggacgcca

SEQ ID NO: 79927 - RNA, 22 nt, Human
cagccuggccucuggauauuug

SEQ ID NO: 79928 - RNA, 22 nt, Human
cagagcagaaaccugggugauu

SEQ ID NO: 79929 - RNA, 22 nt, Human
cagagcugagucuucaagguug

SEQ ID NO: 79930 - RNA, 22 nt, Human
cagcuccagcccaggcagcucc

SEQ ID NO: 79931 - RNA, 22 nt, Human
cagcaugguggagcugcucuuu

SEQ ID NO: 79932 - RNA, 22 nt, Human
cagcaugcaaguccagaugugg

SEQ ID NO: 79933 - RNA, 22 nt, Human
cagcauugagcacagaaggaaa

SEQ ID NO: 79934 - RNA, 22 nt, Human
caggaacucggagcccaucucu

SEQ ID NO: 79935 - RNA, 22 nt, Human
caggagaaauucacauuaguga

SEQ ID NO: 79936 - RNA, 22 nt, Human
caggacuuccucuaugguggcg

SEQ ID NO: 79937 - RNA, 22 nt, Human
caggauuuaauaagauaguguu

SEQ ID NO: 79938 - RNA, 22 nt, Human
caggauauguucaagguuuucu

SEQ ID NO: 79939 - RNA, 22 nt, Human
cagcuacuaccuguagacaaag

SEQ ID NO: 79940 - RNA, 22 nt, Human
caggguuuuaguugcagguuau

SEQ ID NO: 79941 - RNA, 22 nt, Human
cagcuguauuucucugguuaga

SEQ ID NO: 79942 - RNA, 22 nt, Human
cagcuucaugacaaacaguuuu

SEQ ID NO: 79943 - RNA, 22 nt, Human
cagcuucuccauucuucuggcu

SEQ ID NO: 79944 - RNA, 22 nt, Human
cagcuucacuuaaaacaugcaa

SEQ ID NO: 79945 - RNA, 19 nt, Human
auccuugcucacucacuga

SEQ ID NO: 79946 - RNA, 18 nt, Human
auccuucggccuagugga

SEQ ID NO: 79947 - RNA, 22 nt, Human
auccuugacuguagugauauua

SEQ ID NO: 79948 - RNA, 22 nt, Human
aucugcugcuccuucuucuugc

SEQ ID NO: 79949 - RNA, 22 nt, Human
aucuggaacuucucugcauuga

SEQ ID NO: 79950 - RNA, 22 nt, Human
auacuaguuacuuuccuugggg

SEQ ID NO: 79951 - RNA, 22 nt, Human
auacuagguggauauacaaaga

SEQ ID NO: 79952 - RNA, 22 nt, Human
aucuccaguuagcaguacugau

SEQ ID NO: 79953 - RNA, 22 nt, Human
auacaauugcaauggaagauga

SEQ ID NO: 79954 - RNA, 22 nt, Human
auacuagauaccucuucuaccu

SEQ ID NO: 79955 - RNA, 22 nt, Human
aucuuagagagucguguuuugu

SEQ ID NO: 79956 - RNA, 22 nt, Human
aucggucuccuauaauucaaac

SEQ ID NO: 79957 - RNA, 22 nt, Human
aucuagguuuggaagauagagu

SEQ ID NO: 79958 - RNA, 22 nt, Human
aucuacuuugggaguuucucuu

SEQ ID NO: 79959 - RNA, 22 nt, Human
aucuucaggggcaauggagaua

SEQ ID NO: 79960 - RNA, 22 nt, Human
aucuccagcagugcuuuugagc

SEQ ID NO: 79961 - RNA, 22 nt, Human
aucucaaagauaugcugguaaa

SEQ ID NO: 79962 - RNA, 22 nt, Human
aucuuugccuuuaugccucuag

SEQ ID NO: 79963 - RNA, 22 nt, Human
aucucccaaauuagccucuuga

SEQ ID NO: 79964 - RNA, 22 nt, Human
aucucuguaaaccauaaauuga

SEQ ID NO: 79965 - RNA, 22 nt, Human
aucugcauguggcagguggauu

SEQ ID NO: 79966 - RNA, 22 nt, Human
augaaugccggucucgggggaa

SEQ ID NO: 79967 - RNA, 22 nt, Human
aucugugauuuuggcaagauuu

SEQ ID NO: 79968 - RNA, 20 nt, Human
augaaugcuccccacguuuc

SEQ ID NO: 79969 - RNA, 22 nt, Human
augaauuaucugguguuggaaa

SEQ ID NO: 79970 - RNA, 22 nt, Human
aucuguucuucaaaauauuaca

SEQ ID NO: 79971 - RNA, 22 nt, Human
aucuguuccccuaugcucucua

SEQ ID NO: 79972 - RNA, 22 nt, Human
aucuuugauuuuggcuuuuagg

SEQ ID NO: 79973 - RNA, 22 nt, Human
augaaaacggaccagagcuauu

SEQ ID NO: 79974 - RNA, 22 nt, Human
augaaggauagggcaaaauuuu

SEQ ID NO: 79975 - RNA, 22 nt, Human
augaacugcaguauaaacuugg

SEQ ID NO: 79976 - RNA, 22 nt, Human
aucuuggccuucuccuggagug

SEQ ID NO: 79977 - RNA, 22 nt, Human
augacagcuaaggaauguguag

SEQ ID NO: 79978 - RNA, 22 nt, Human
aucuuggauccuuugccagcuu

SEQ ID NO: 79979 - RNA, 22 nt, Human
aucuugaaacauauaugcauuu

SEQ ID NO: 79980 - RNA, 22 nt, Human
augacugaugcugacucauggg

SEQ ID NO: 79981 - RNA, 22 nt, Human
augaccauccagaaguccagcu

SEQ ID NO: 79982 - RNA, 22 nt, Human
aucuuagcucaacucucaccaa

SEQ ID NO: 79983 - RNA, 21 nt, Human
augagguggcuacuaaagagu

SEQ ID NO: 79984 - RNA, 22 nt, Human
augagugugugguucuaaauga

SEQ ID NO: 79985 - RNA, 19 nt, Human
aucuuucagcagcuccccu

SEQ ID NO: 79986 - RNA, 22 nt, Human
aucuuguuagaaggcaguaggu

SEQ ID NO: 79987 - RNA, 22 nt, Human
aucuuuguaaguaaucaaagcu

SEQ ID NO: 79988 - RNA, 22 nt, Human
aucuuuuuucacaauuuauuuu

SEQ ID NO: 79989 - RNA, 23 nt, Human
augaaaugauacuuuauucacug

SEQ ID NO: 79990 - RNA, 18 nt, Human
augauaauguuugcauca

SEQ ID NO: 79991 - RNA, 19 nt, Human
augcacgugaaaugcauuu

SEQ ID NO: 79992 - RNA, 19 nt, Human
augcaauguuaucaauaac

SEQ ID NO: 79993 - RNA, 22 nt, Human
augcauaucuccuaucuccuca

SEQ ID NO: 79994 - RNA, 22 nt, Human
augcaguuagguaauagucuca

SEQ ID NO: 79995 - RNA, 22 nt, Human
augccacuguuuaugucacuua

SEQ ID NO: 79996 - RNA, 22 nt, Human
augcaugaucccgguaugugaa

SEQ ID NO: 79997 - RNA, 22 nt, Human
augcaaaaucuuauuuuuucua

SEQ ID NO: 79998 - RNA, 22 nt, Human
augcccagaacccccuggaugg

SEQ ID NO: 79999 - RNA, 17 nt, Human
augcccagggcucccug

SEQ ID NO: 80000 - RNA, 22 nt, Human
augcuuuauuggagacagucau

SEQ ID NO: 80001 - RNA, 22 nt, Human
auggaagagacaaugcuaucug

SEQ ID NO: 80002 - RNA, 22 nt, Human
augcuuucucuucuauuucuca

SEQ ID NO: 80003 - RNA, 22 nt, Human
auggagguuugucugguuuugu

SEQ ID NO: 80004 - RNA, 22 nt, Human
auggaacccgggcgucugcucu

SEQ ID NO: 80005 - RNA, 22 nt, Human
auggaaggggagguagggagga

SEQ ID NO: 80006 - RNA, 22 nt, Human
auggaauuuaaauuuugguguc

SEQ ID NO: 80007 - RNA, 22 nt, Human
augggaggguagagugaacaga

SEQ ID NO: 80008 - RNA, 22 nt, Human
augggagggagcagugaguguu

SEQ ID NO: 80009 - RNA, 22 nt, Human
auggcaucuucgguuggacugc

SEQ ID NO: 80010 - RNA, 22 nt, Human
auggggaucugcaguguugauc

SEQ ID NO: 80011 - RNA, 22 nt, Human
auggggaauugaccguggaucu

SEQ ID NO: 80012 - RNA, 22 nt, Human
auggacagcucuuaugugggca

SEQ ID NO: 80013 - RNA, 22 nt, Human
auggaggaugugcagcaugggc

SEQ ID NO: 80014 - RNA, 22 nt, Human
augggagggugaggaggcagcu

SEQ ID NO: 80015 - RNA, 19 nt, Human
augguauugcuggguuuuu

SEQ ID NO: 80016 - RNA, 22 nt, Human
auggauggaagcagccugaacu

SEQ ID NO: 80017 - RNA, 22 nt, Human
auggauuggguugauggcauac

SEQ ID NO: 80018 - RNA, 22 nt, Human
auggugaaaugauuugauguca

SEQ ID NO: 80019 - RNA, 22 nt, Human
augggauuugaaaaguggaaau

SEQ ID NO: 80020 - RNA, 22 nt, Human
augguaaguuuuuaaaaagcgu

SEQ ID NO: 80021 - RNA, 22 nt, Human
auggugaugaugaugaugauaa

SEQ ID NO: 80022 - RNA, 22 nt, Human
augguguaggugaagagaacau

SEQ ID NO: 80023 - RNA, 22 nt, Human
auguacugacuguacuuuuaaa

SEQ ID NO: 80024 - RNA, 22 nt, Human
auguuguugaacucuuugcaug

SEQ ID NO: 80025 - RNA, 22 nt, Human
auguuguuuauggguuaucaag

SEQ ID NO: 80026 - RNA, 21 nt, Human
auguguucugauagugcuugc

SEQ ID NO: 80027 - RNA, 23 nt, Human
auguagcugcucccgaugcccuc

SEQ ID NO: 80028 - RNA, 22 nt, Human
auguguuuccaacagagaggga

SEQ ID NO: 80029 - RNA, 22 nt, Human
auuaaaaaaagauaaugaguua

SEQ ID NO: 80030 - RNA, 22 nt, Human
auuaaaaaugagaguagggauu

SEQ ID NO: 80031 - RNA, 22 nt, Human
auuaaagcaugaauaauaugua

SEQ ID NO: 80032 - RNA, 22 nt, Human
auguuugugauugcugaaaaga

SEQ ID NO: 80033 - RNA, 22 nt, Human
auguuuaauuugaaauuuuauu

SEQ ID NO: 80034 - RNA, 22 nt, Human
auguuuucauuuagaagcuaau

SEQ ID NO: 80035 - RNA, 22 nt, Human
auuguuuccccggaauuauuca

SEQ ID NO: 80036 - RNA, 22 nt, Human
auuguucuagaauuuuuuuucc

SEQ ID NO: 80037 - RNA, 22 nt, Human
auucuuuauuuucuguacuugc

SEQ ID NO: 80038 - RNA, 22 nt, Human
auucuuuagaguccuucaaaua

SEQ ID NO: 80039 - RNA, 18 nt, Human
auugagcaugacagaccu

SEQ ID NO: 80040 - RNA, 22 nt, Human
auugagcuguugaagucccaca

SEQ ID NO: 80041 - RNA, 22 nt, Human
auugaugccugaaaaauaugua

SEQ ID NO: 80042 - RNA, 22 nt, Human
auugaugaaaauaguuauuuua

SEQ ID NO: 80043 - RNA, 22 nt, Human
auuucauuuuagaaauaagugu

SEQ ID NO: 80044 - RNA, 22 nt, Human
auuucaguuugcaguuucucuc

SEQ ID NO: 80045 - RNA, 22 nt, Human
auuuggucuguaauuacaugga

SEQ ID NO: 80046 - RNA, 22 nt, Human
auuucccugcagugcuuaggaa

SEQ ID NO: 80047 - RNA, 22 nt, Human
auuuaucugcucuucgcguuga

SEQ ID NO: 80048 - RNA, 22 nt, Human
auuuaggacagugucugaauug

SEQ ID NO: 80049 - RNA, 22 nt, Human
auuuauccuugggguagagcca

SEQ ID NO: 80050 - RNA, 22 nt, Human
auuuauauauuuuguucuggua

SEQ ID NO: 80051 - RNA, 22 nt, Human
auuuaaguuacuucucuuuccu

SEQ ID NO: 80052 - RNA, 22 nt, Human
auuuagacaacaagccuucucc

SEQ ID NO: 80053 - RNA, 23 nt, Human
auuugcugaucguagaugacuag

SEQ ID NO: 80054 - RNA, 22 nt, Human
auuguuuugugaaacauaguga

SEQ ID NO: 80055 - RNA, 22 nt, Human
auuggccaguggacagcgccgu

SEQ ID NO: 80056 - RNA, 22 nt, Human
auuggagacauuaagucuaaga

SEQ ID NO: 80057 - RNA, 22 nt, Human
auuuccagcagcauauuugucu

SEQ ID NO: 80058 - RNA, 22 nt, Human
auuuuuagagugaaagaauuaa

SEQ ID NO: 80059 - RNA, 22 nt, Human
auuuugcuuuucuaguggguuu

SEQ ID NO: 80060 - RNA, 22 nt, Human
auuuugcaguuuauugccaauc

SEQ ID NO: 80061 - RNA, 22 nt, Human
auuuucuugucucuguuguagg

SEQ ID NO: 80062 - RNA, 22 nt, Human
auuuucauauggguuauuugua

SEQ ID NO: 80063 - RNA, 22 nt, Human
auuucuguaauucugaggagug

SEQ ID NO: 80064 - RNA, 19 nt, Human
auuuccuggcauauaucac

SEQ ID NO: 80065 - RNA, 23 nt, Human
auuuccuaaaagauaaucauuac

SEQ ID NO: 80066 - RNA, 22 nt, Human
auuuuaccauuaguuuguaaua

SEQ ID NO: 80067 - RNA, 21 nt, Human
auuuuucagaaggaugugaua

SEQ ID NO: 80068 - RNA, 22 nt, Human
auuuuagagaaacaaacguagg

SEQ ID NO: 80069 - RNA, 22 nt, Human
auuuuauuuugggaucuuuuua

SEQ ID NO: 80070 - RNA, 22 nt, Human
auuuuacuaugauaguugagaa

SEQ ID NO: 80071 - RNA, 22 nt, Human
auuuuuucaugugugguugaga

SEQ ID NO: 80072 - RNA, 23 nt, Human
auuuuuccacacacagacucagu

SEQ ID NO: 80073 - RNA, 22 nt, Human
auuuuuuuuccugucucuuuca

SEQ ID NO: 80074 - RNA, 22 nt, Human
caaaaauacuugccuguaucug

SEQ ID NO: 80075 - RNA, 22 nt, Human
auuuuuuuaggcugucagccgc

SEQ ID NO: 80076 - RNA, 22 nt, Human
auuuuuuuggucauaugagaua

SEQ ID NO: 80077 - RNA, 19 nt, Human
caagagcaaagucuuauga

SEQ ID NO: 80078 - RNA, 22 nt, Human
auuuuugguuucaccugcacgc

SEQ ID NO: 80079 - RNA, 22 nt, Human
auuuuugugcuuuauuggggua

SEQ ID NO: 80080 - RNA, 22 nt, Human
auuuuugguuauaaaauaguuu

SEQ ID NO: 80081 - RNA, 22 nt, Human
caaagaaccuucgagacagggc

SEQ ID NO: 80082 - RNA, 22 nt, Human
caaaggaauuacauguuucgga

SEQ ID NO: 80083 - RNA, 22 nt, Human
auuuuguugaaacccuuguugu

SEQ ID NO: 80084 - RNA, 22 nt, Human
auuuuuagucuugcugcaauca

SEQ ID NO: 80085 - RNA, 22 nt, Human
caaaugaugcauggcuagugag

SEQ ID NO: 80086 - RNA, 22 nt, Human
auuuuuaucuaaaauccacuuu

SEQ ID NO: 80087 - RNA, 22 nt, Human
auuuuuauuugccuaugauaua

SEQ ID NO: 80088 - RNA, 22 nt, Human
auugcaggucguguggaaguga

SEQ ID NO: 80089 - RNA, 22 nt, Human
auugauuuugugcuuuccuacg

SEQ ID NO: 80090 - RNA, 22 nt, Human
auugaguucaccucuuucagaa

SEQ ID NO: 80091 - RNA, 22 nt, Human
auugccauaauagagccaugua

SEQ ID NO: 80092 - RNA, 22 nt, Human
auuggaagacgcuggaggcacu

SEQ ID NO: 80093 - RNA, 17 nt, Human
auucuuauacucuguga

SEQ ID NO: 80094 - RNA, 22 nt, Human
auucuucauguugaagcuguca

SEQ ID NO: 80095 - RNA, 22 nt, Human
auucucuguacagaagguaccg

SEQ ID NO: 80096 - RNA, 22 nt, Human
auucugagaucucuucuaggcc

SEQ ID NO: 80097 - RNA, 22 nt, Human
auucugcaauaaucaguccuua

SEQ ID NO: 80098 - RNA, 21 nt, Human
auucugauguuucuauuguuu

SEQ ID NO: 80099 - RNA, 22 nt, Human
auucugcauuucuaaccagguc

SEQ ID NO: 80100 - RNA, 22 nt, Human
auucugcugccuaguuuaugaa

SEQ ID NO: 80101 - RNA, 22 nt, Human
auucuuauaaaaaguguugacu

SEQ ID NO: 80102 - RNA, 20 nt, Human
auucuguguaaauguccugu

SEQ ID NO: 80103 - RNA, 22 nt, Human
auucuguaggcuuuuguuaaaa

SEQ ID NO: 80104 - RNA, 22 nt, Human
auucuguugguuuaauagucaa

SEQ ID NO: 80105 - RNA, 22 nt, Human
auucucauguuaccaaauucua

SEQ ID NO: 80106 - RNA, 22 nt, Human
auucucauguuuuaaaaaaguu

SEQ ID NO: 80107 - RNA, 17 nt, Human
auucuaguuggcuuuuu

SEQ ID NO: 80108 - RNA, 22 nt, Human
auucuaugaaugacuguuagau

SEQ ID NO: 80109 - RNA, 22 nt, Human
auugaaguguacguuugaucua

SEQ ID NO: 80110 - RNA, 22 nt, Human
auugaauuagauguuguagucc

SEQ ID NO: 80111 - RNA, 22 nt, Human
auucucuauugguaaauuugac

SEQ ID NO: 80112 - RNA, 22 nt, Human
auugacuuucccuucuccucau

SEQ ID NO: 80113 - RNA, 22 nt, Human
auugagaaaauucgagcaaguu

SEQ ID NO: 80114 - RNA, 22 nt, Human
auucuugauauagauaguuaau

SEQ ID NO: 80115 - RNA, 19 nt, Human
auucuucucuuccugcugu

SEQ ID NO: 80116 - RNA, 20 nt, Human
auucuuguuccauuucccag

SEQ ID NO: 80117 - RNA, 22 nt, Human
auuccagggaaauggggaugga

SEQ ID NO: 80118 - RNA, 22 nt, Human
auuccuguggcuggguaaagua

SEQ ID NO: 80119 - RNA, 22 nt, Human
auucuacgcuccgucucuauca

SEQ ID NO: 80120 - RNA, 22 nt, Human
auucuaauaagcguuuugucgc

SEQ ID NO: 80121 - RNA, 20 nt, Human
auucucaccaugugacaugg

SEQ ID NO: 80122 - RNA, 22 nt, Human
auucuagaguuucaauccaagg

SEQ ID NO: 80123 - RNA, 22 nt, Human
auucucugaugcagguggaaga

SEQ ID NO: 80124 - RNA, 22 nt, Human
auucuccucaaaacaucugcug

SEQ ID NO: 80125 - RNA, 22 nt, Human
auucuacucuuuaaauaugaaa

SEQ ID NO: 80126 - RNA, 22 nt, Human
auuaucugacugaguagucugu

SEQ ID NO: 80127 - RNA, 22 nt, Human
auuaugugagggacuuaaucau

SEQ ID NO: 80128 - RNA, 22 nt, Human
auuauggacuuucuuguuuggg

SEQ ID NO: 80129 - RNA, 22 nt, Human
auguugcugauccuguggcugu

SEQ ID NO: 80130 - RNA, 22 nt, Human
auuaaauagcagaagaaagaug

SEQ ID NO: 80131 - RNA, 22 nt, Human
auuaaagcuaguugagauuuaa

SEQ ID NO: 80132 - RNA, 22 nt, Human
auucuacucuccuacaggucua

SEQ ID NO: 80133 - RNA, 22 nt, Human
auuauaguuuugcccuuaagaa

SEQ ID NO: 80134 - RNA, 22 nt, Human
auucaucuguacuucaauaucu

SEQ ID NO: 80135 - RNA, 19 nt, Human
auucaagugcuuagagauc

SEQ ID NO: 80136 - RNA, 22 nt, Human
auucuguuuaauacacgaaagg

SEQ ID NO: 80137 - RNA, 22 nt, Human
auucuuacaaagcagagucugu

SEQ ID NO: 80138 - RNA, 21 nt, Human
auucaaagaagaggaaggccc

SEQ ID NO: 80139 - RNA, 22 nt, Human
auuauuugcuuaagcuggucuc

SEQ ID NO: 80140 - RNA, 22 nt, Human
auuauucuuugggaaaguugaa

SEQ ID NO: 80141 - RNA, 20 nt, Human
auuauuucuucugcccaaag

SEQ ID NO: 80142 - RNA, 21 nt, Human
auucugaguugucagucuuca

SEQ ID NO: 80143 - RNA, 22 nt, Human
auucaagagcccauguuuccug

SEQ ID NO: 80144 - RNA, 22 nt, Human
auucugaagcagaaaaggcaga

SEQ ID NO: 80145 - RNA, 22 nt, Human
uuugggaaacuuaggggucaga

SEQ ID NO: 80146 - RNA, 17 nt, Human
uuugugauggcagaugc

SEQ ID NO: 80147 - RNA, 22 nt, Human
uuucgggauuucaaagagcaaa

SEQ ID NO: 80148 - RNA, 22 nt, Human
uuuccuuacuuauaaaaugggg

SEQ ID NO: 80149 - RNA, 22 nt, Human
uuuccuuuguuuugguauaugu

SEQ ID NO: 80150 - RNA, 18 nt, Human
uuuccucauuugcagacu

SEQ ID NO: 80151 - RNA, 22 nt, Human
uuuccuguuuugguuuggagag

SEQ ID NO: 80152 - RNA, 22 nt, Human
uuucuaaguuugaggcgaagca

SEQ ID NO: 80153 - RNA, 22 nt, Human
uuucuacauuuguaaccagauu

SEQ ID NO: 80154 - RNA, 22 nt, Human
uuucuaguauauaacuagaucu

SEQ ID NO: 80155 - RNA, 21 nt, Human
uuucauuaguacaucaauuug

SEQ ID NO: 80156 - RNA, 22 nt, Human
uuucauguuggauacuguuuca

SEQ ID NO: 80157 - RNA, 22 nt, Human
uuuccuaggaaaugauugaagu

SEQ ID NO: 80158 - RNA, 21 nt, Human
uuucauaggguuaaaggguua

SEQ ID NO: 80159 - RNA, 22 nt, Human
uuucagguggaaguuuuagaug

SEQ ID NO: 80160 - RNA, 22 nt, Human
uuucagcaugacuguuaucuuu

SEQ ID NO: 80161 - RNA, 22 nt, Human
uuucagugaaugaauggcuaac

SEQ ID NO: 80162 - RNA, 22 nt, Human
uuucagagaaagcccaaagacu

SEQ ID NO: 80163 - RNA, 22 nt, Human
uuucuuuuucuacaccuuagcu

SEQ ID NO: 80164 - RNA, 18 nt, Human
uuucuuuuauuccagguc

SEQ ID NO: 80165 - RNA, 22 nt, Human
uuugaaaggagcuuuauccaga

SEQ ID NO: 80166 - RNA, 22 nt, Human
uuucuuugcugguuggcucucc

SEQ ID NO: 80167 - RNA, 22 nt, Human
uuucuuugggcccuggcagucu

SEQ ID NO: 80168 - RNA, 22 nt, Human
uuucuugggaaaugucagaagu

SEQ ID NO: 80169 - RNA, 22 nt, Human
uuucuuaaaagcuuuuaaaguu

SEQ ID NO: 80170 - RNA, 22 nt, Human
uuucuuccuucuugaucauuug

SEQ ID NO: 80171 - RNA, 22 nt, Human
uuucuuccaucuggcuuuauuu

SEQ ID NO: 80172 - RNA, 22 nt, Human
uuucucagcauauugccuuuga

SEQ ID NO: 80173 - RNA, 22 nt, Human
uuucuauuuacagugcuaggua

SEQ ID NO: 80174 - RNA, 19 nt, Human
uuucucacugagucguuug

SEQ ID NO: 80175 - RNA, 22 nt, Human
uuucucuuucaaucugcaguac

SEQ ID NO: 80176 - RNA, 22 nt, Human
uuucugagccacauauaauuug

SEQ ID NO: 80177 - RNA, 22 nt, Human
uuucuggauaagcagggucucu

SEQ ID NO: 80178 - RNA, 22 nt, Human
uuucuggaaacuguaaagagga

SEQ ID NO: 80179 - RNA, 22 nt, Human
uuucugcuuucuaguugguguu

SEQ ID NO: 80180 - RNA, 17 nt, Human
uuucugcaugauuggac

SEQ ID NO: 80181 - RNA, 23 nt, Human
uuucugaguuuuuuaaaagucca

SEQ ID NO: 80182 - RNA, 22 nt, Human
uuugaugauuuucuagagugua

SEQ ID NO: 80183 - RNA, 22 nt, Human
uuugagugccucgaguguggga

SEQ ID NO: 80184 - RNA, 22 nt, Human
uuugagaaugucaaucacaaga

SEQ ID NO: 80185 - RNA, 22 nt, Human
uuugaagaccuuaucucuaaau

SEQ ID NO: 80186 - RNA, 22 nt, Human
uuugaagauaaauauggagaaa

SEQ ID NO: 80187 - RNA, 23 nt, Human
uuugaaucauuguggggcuuuug

SEQ ID NO: 80188 - RNA, 22 nt, Human
uuugcaaaguccauugaaguua

SEQ ID NO: 80189 - RNA, 23 nt, Human
uuugcaaauuggacacaaccaca

SEQ ID NO: 80190 - RNA, 20 nt, Human
uuugauugccccucugacuu

SEQ ID NO: 80191 - RNA, 22 nt, Human
uuugauauaaaggcuugggcug

SEQ ID NO: 80192 - RNA, 22 nt, Human
uuugauuuuguuuauagugccg

SEQ ID NO: 80193 - RNA, 22 nt, Human
uuugcugggaagccuucacucu

SEQ ID NO: 80194 - RNA, 22 nt, Human
uuugcuguaaugcaugucagag

SEQ ID NO: 80195 - RNA, 23 nt, Human
uuugccuaaugaagacuauguca

SEQ ID NO: 80196 - RNA, 22 nt, Human
uuuguauuucaaggcacucuca

SEQ ID NO: 80197 - RNA, 22 nt, Human
uuugucaucuuccauauuugca

SEQ ID NO: 80198 - RNA, 20 nt, Human
uuugugaggccagagaacag

SEQ ID NO: 80199 - RNA, 22 nt, Human
uuuggugauuuuuaaucccccu

SEQ ID NO: 80200 - RNA, 22 nt, Human
uuugguguuuucaggaauauac

SEQ ID NO: 80201 - RNA, 22 nt, Human
uuuguaaguuuguucuccuggg

SEQ ID NO: 80202 - RNA, 22 nt, Human
uuuggucuggaaucuucagggu

SEQ ID NO: 80203 - RNA, 23 nt, Human
uuugggaaauagccuauaggcac

SEQ ID NO: 80204 - RNA, 22 nt, Human
uuuggcugucauuugaaaaugu

SEQ ID NO: 80205 - RNA, 22 nt, Human
uuugcuguccaauauucagggu

SEQ ID NO: 80206 - RNA, 22 nt, Human
uuugcuuugacuuugggaguau

SEQ ID NO: 80207 - RNA, 22 nt, Human
uuuggaggaaugaguuuaauau

SEQ ID NO: 80208 - RNA, 19 nt, Human
uuuauuugagacaugccuu

SEQ ID NO: 80209 - RNA, 22 nt, Human
uuuauuuggugguguuacuguu

SEQ ID NO: 80210 - RNA, 22 nt, Human
uuuauucuuugcuagguuccau

SEQ ID NO: 80211 - RNA, 22 nt, Human
uuuauuugugguaguguaaucu

SEQ ID NO: 80212 - RNA, 19 nt, Human
uuucacaaagagagcguga

SEQ ID NO: 80213 - RNA, 22 nt, Human
uuucaaguagagggaucgcuag

SEQ ID NO: 80214 - RNA, 22 nt, Human
uuuauaauuguuauguuaccca

SEQ ID NO: 80215 - RNA, 22 nt, Human
uuuauaauuacguaaaauauuu

SEQ ID NO: 80216 - RNA, 22 nt, Human
uuuaucaggccaucuuaugucu

SEQ ID NO: 80217 - RNA, 22 nt, Human
uuuaugauguagccuagagcug

SEQ ID NO: 80218 - RNA, 22 nt, Human
uuguuuaaagaacuucugacuu

SEQ ID NO: 80219 - RNA, 22 nt, Human
uuguuguuguuguuauuuaguu

SEQ ID NO: 80220 - RNA, 22 nt, Human
uuguugcaagccuggaaucugg

SEQ ID NO: 80221 - RNA, 22 nt, Human
uuguguugaagugguuagggcg

SEQ ID NO: 80222 - RNA, 22 nt, Human
uuguuccuuucuucuguagucg

SEQ ID NO: 80223 - RNA, 22 nt, Human
uuuagugaagcuuugcauuuca

SEQ ID NO: 80224 - RNA, 22 nt, Human
uuuaguauaguaugugcucaaa

SEQ ID NO: 80225 - RNA, 22 nt, Human
uuuagguuguguucuggcaugu

SEQ ID NO: 80226 - RNA, 22 nt, Human
uuuaggauaacuccaguuuucc

SEQ ID NO: 80227 - RNA, 22 nt, Human
uuuacuaauuaguuuuggaaca

SEQ ID NO: 80228 - RNA, 22 nt, Human
uuuagaugcuguauguuauuuc

SEQ ID NO: 80229 - RNA, 22 nt, Human
uuuacuauuaguauuucauuuu

SEQ ID NO: 80230 - RNA, 19 nt, Human
uuuagcuacugugguauua

SEQ ID NO: 80231 - RNA, 22 nt, Human
uugauuuccauuguccagcauu

SEQ ID NO: 80232 - RNA, 20 nt, Human
uugauucacaaaaagcuuag

SEQ ID NO: 80233 - RNA, 22 nt, Human
uugauuccagcguuccaucagc

SEQ ID NO: 80234 - RNA, 22 nt, Human
uugauggaggaaaaguuggaau

SEQ ID NO: 80235 - RNA, 22 nt, Human
uugauuaauugaugaaccucuc

SEQ ID NO: 80236 - RNA, 22 nt, Human
uuggaggcagagucuugcugag

SEQ ID NO: 80237 - RNA, 20 nt, Human
uuggagaucacguguccagg

SEQ ID NO: 80238 - RNA, 19 nt, Human
uuggagcaucccaaaggcu

SEQ ID NO: 80239 - RNA, 22 nt, Human
uuggaggucucugugguggugg

SEQ ID NO: 80240 - RNA, 22 nt, Human
uugggagaaauaguugauccgc

SEQ ID NO: 80241 - RNA, 22 nt, Human
uugggcauuucuuauguauuuu

SEQ ID NO: 80242 - RNA, 22 nt, Human
uugggauucugucagugugugu

SEQ ID NO: 80243 - RNA, 22 nt, Human
uuggggaauuuggggccguccg

SEQ ID NO: 80244 - RNA, 22 nt, Human
uugucaugauccuucuguuagg

SEQ ID NO: 80245 - RNA, 22 nt, Human
uuguauuguuugcgucuguguu

SEQ ID NO: 80246 - RNA, 22 nt, Human
uugucaagauauuuuaggaggc

SEQ ID NO: 80247 - RNA, 22 nt, Human
uuguggacgcaauucaaggaua

SEQ ID NO: 80248 - RNA, 18 nt, Human
uugugccugagaaggugg

SEQ ID NO: 80249 - RNA, 22 nt, Human
uuguaauaguguuuuacguugu

SEQ ID NO: 80250 - RNA, 22 nt, Human
uuguaaguuuuagguguuucaa

SEQ ID NO: 80251 - RNA, 22 nt, Human
uugguuuacucuggggauaucu

SEQ ID NO: 80252 - RNA, 22 nt, Human
uugguugcugaugagcuuugag

SEQ ID NO: 80253 - RNA, 19 nt, Human
uugguuuguugcuuaggug

SEQ ID NO: 80254 - RNA, 22 nt, Human
uuggggauugggugcaagggac

SEQ ID NO: 80255 - RNA, 22 nt, Human
uuggggaaaaagaccuaaugac

SEQ ID NO: 80256 - RNA, 22 nt, Human
uugguguaauacaagcaauuug

SEQ ID NO: 80257 - RNA, 22 nt, Human
uuggugauugggaauggauggg

SEQ ID NO: 80258 - RNA, 22 nt, Human
uugguuccauuuuaccagcucu

SEQ ID NO: 80259 - RNA, 22 nt, Human
uucuagaagggccuaggcauaa

SEQ ID NO: 80260 - RNA, 22 nt, Human
uuuuacauuuuauucguuuauu

SEQ ID NO: 80261 - RNA, 22 nt, Human
uuuuacaaugcaaauucuugcu

SEQ ID NO: 80262 - RNA, 22 nt, Human
uuuuagaagcauuuaugagauu

SEQ ID NO: 80263 - RNA, 22 nt, Human
uuuuagagacagcauggagaaa

SEQ ID NO: 80264 - RNA, 22 nt, Human
uucgcucuucacacagugcuga

SEQ ID NO: 80265 - RNA, 22 nt, Human
uuuuaauucaacauuugcuuuu

SEQ ID NO: 80266 - RNA, 22 nt, Human
uucucugaagagccagcccuua

SEQ ID NO: 80267 - RNA, 22 nt, Human
uuuuccaaaaguggagaggaau

SEQ ID NO: 80268 - RNA, 22 nt, Human
uucucucaguuaaacuuuguga

SEQ ID NO: 80269 - RNA, 22 nt, Human
uuuuccuuagaaauacauugau

SEQ ID NO: 80270 - RNA, 22 nt, Human
uuuucauuguuaguuucuccuu

SEQ ID NO: 80271 - RNA, 22 nt, Human
uucucaagccuuccuuucccaa

SEQ ID NO: 80272 - RNA, 22 nt, Human
uuuuauaauacccuugacuaau

SEQ ID NO: 80273 - RNA, 21 nt, Human
uucuauauugagaauuggcua

SEQ ID NO: 80274 - RNA, 22 nt, Human
uuuucuguuuaugaaauugugu

SEQ ID NO: 80275 - RNA, 22 nt, Human
uuuucuugagucacuccaguga

SEQ ID NO: 80276 - RNA, 22 nt, Human
uuuucucuuugcuucucuaaaa

SEQ ID NO: 80277 - RNA, 22 nt, Human
uuuucucaguuuuuuucaaaag

SEQ ID NO: 80278 - RNA, 22 nt, Human
uuuucuacaaucacucuggaag

SEQ ID NO: 80279 - RNA, 22 nt, Human
uuuucuaggcccuggauuaugu

SEQ ID NO: 80280 - RNA, 20 nt, Human
uucucugcagcaggcggccc

SEQ ID NO: 80281 - RNA, 22 nt, Human
uuuuccuucuuccugccuugcc

SEQ ID NO: 80282 - RNA, 22 nt, Human
uuuugaauaauucagaaacagc

SEQ ID NO: 80283 - RNA, 22 nt, Human
uuuugagucuggcaguuuuguu

SEQ ID NO: 80284 - RNA, 22 nt, Human
uuuugauacaaguuguaaaaaa

SEQ ID NO: 80285 - RNA, 22 nt, Human
uuuugcaaauuacuaaauuucu

SEQ ID NO: 80286 - RNA, 22 nt, Human
uucuguuuauaauuugcaguug

SEQ ID NO: 80287 - RNA, 22 nt, Human
uucuuaaugcauccuguguuca

SEQ ID NO: 80288 - RNA, 22 nt, Human
uuuugguuugaguauuuuuuuu

SEQ ID NO: 80289 - RNA, 22 nt, Human
uuuugguauggcuugauagagu

SEQ ID NO: 80290 - RNA, 22 nt, Human
uucuuuucuucccuguuuauua

SEQ ID NO: 80291 - RNA, 22 nt, Human
uuuuugcccuaaagaagucauu

SEQ ID NO: 80292 - RNA, 22 nt, Human
uuuuugcuuuuuugucaucuaa

SEQ ID NO: 80293 - RNA, 22 nt, Human
uuuuuggacccaucuucuuuuu

SEQ ID NO: 80294 - RNA, 22 nt, Human
uucuuugcccauguuuccuaag

SEQ ID NO: 80295 - RNA, 22 nt, Human
uucuuugcucaccugccgcucc

SEQ ID NO: 80296 - RNA, 22 nt, Human
uucuuuuaauagagauccugug

SEQ ID NO: 80297 - RNA, 22 nt, Human
uuuuucuuugcuuuccacuggc

SEQ ID NO: 80298 - RNA, 22 nt, Human
uuuuucuuugguaacucuuccu

SEQ ID NO: 80299 - RNA, 22 nt, Human
uucuugugugaauauaauuaca

SEQ ID NO: 80300 - RNA, 22 nt, Human
uuuuuaaaauuaggacggcacg

SEQ ID NO: 80301 - RNA, 22 nt, Human
uucuuguccacagaagagcuca

SEQ ID NO: 80302 - RNA, 22 nt, Human
uucuugcgaaagaaugagcuga

SEQ ID NO: 80303 - RNA, 22 nt, Human
uucuuccagugaaacgugcauc

SEQ ID NO: 80304 - RNA, 22 nt, Human
uucuucgacuguauaaaaguau

SEQ ID NO: 80305 - RNA, 22 nt, Human
uuuuuuaaucaaguaggaaaca

SEQ ID NO: 80306 - RNA, 22 nt, Human
uuuuuuccagcuucuagaggcc

SEQ ID NO: 80307 - RNA, 22 nt, Human
uugaaaaaauguguuuaaggag

SEQ ID NO: 80308 - RNA, 22 nt, Human
uuuuuugucuugaagaaauggu

SEQ ID NO: 80309 - RNA, 22 nt, Human
uuuuuuguggcuggaagaaaaa

SEQ ID NO: 80310 - RNA, 22 nt, Human
uugauaacuuagcugggcugcu

SEQ ID NO: 80311 - RNA, 22 nt, Human
uugauagauuuuagaggcaggc

SEQ ID NO: 80312 - RNA, 22 nt, Human
uugaugacuaaagaaagcugcu

SEQ ID NO: 80313 - RNA, 21 nt, Human
uucaaguucacacucaaaggu

SEQ ID NO: 80314 - RNA, 22 nt, Human
uucaaccuucagcuugaguugg

SEQ ID NO: 80315 - RNA, 22 nt, Human
uucacaauuuuaaaaaguggaa

SEQ ID NO: 80316 - RNA, 22 nt, Human
uuuauucacuuaucaggaacga

SEQ ID NO: 80317 - RNA, 22 nt, Human
uuuauguugagcaaaauaccac

SEQ ID NO: 80318 - RNA, 22 nt, Human
uuuauuugggauuucucaucug

SEQ ID NO: 80319 - RNA, 22 nt, Human
uuagugucugacgcaggcgcca

SEQ ID NO: 80320 - RNA, 22 nt, Human
uuaguuaauaaauauugagugu

SEQ ID NO: 80321 - RNA, 22 nt, Human
uucagaauuaucauaauuuuga

SEQ ID NO: 80322 - RNA, 22 nt, Human
uucagaauguacugauagaaca

SEQ ID NO: 80323 - RNA, 22 nt, Human
uuugauuuuuugagcaguguau

SEQ ID NO: 80324 - RNA, 22 nt, Human
uucagaacugucuguccuuuuc

SEQ ID NO: 80325 - RNA, 22 nt, Human
uuugaauauacuucaaacaaag

SEQ ID NO: 80326 - RNA, 22 nt, Human
uucacauucauuucuuauguuu

SEQ ID NO: 80327 - RNA, 22 nt, Human
uucacugacaguauugaggagg

SEQ ID NO: 80328 - RNA, 22 nt, Human
uucacugugauguuuaagagaa

SEQ ID NO: 80329 - RNA, 22 nt, Human
uucacguuguugaagaaaauac

SEQ ID NO: 80330 - RNA, 22 nt, Human
uucagcaagugucucuacuguc

SEQ ID NO: 80331 - RNA, 22 nt, Human
uucagcauaggcugcucuucaa

SEQ ID NO: 80332 - RNA, 22 nt, Human
uucagcacuggacagcgagucu

SEQ ID NO: 80333 - RNA, 22 nt, Human
uuuggaugcugucauaugcugc

SEQ ID NO: 80334 - RNA, 22 nt, Human
uuugcugaaaaaccacuugagu

SEQ ID NO: 80335 - RNA, 22 nt, Human
uucaucauuuuccauuccucuu

SEQ ID NO: 80336 - RNA, 22 nt, Human
uucagguuauugaagagcuuuc

SEQ ID NO: 80337 - RNA, 22 nt, Human
uucaggugguuuaagaauugga

SEQ ID NO: 80338 - RNA, 22 nt, Human
uucauagaagggaguuuuuccu

SEQ ID NO: 80339 - RNA, 22 nt, Human
uuuggcgucucucaggagcuca

SEQ ID NO: 80340 - RNA, 22 nt, Human
uucaggacacauuauuuaugaa

SEQ ID NO: 80341 - RNA, 22 nt, Human
uuuggcuacucuucauugguga

SEQ ID NO: 80342 - RNA, 22 nt, Human
uuuggcuuugauccuaggauuc

SEQ ID NO: 80343 - RNA, 22 nt, Human
uucccuagagagauuuuuauuc

SEQ ID NO: 80344 - RNA, 22 nt, Human
uuuguguuuucaggcacauggc

SEQ ID NO: 80345 - RNA, 22 nt, Human
uucccauuccagcucgaucaau

SEQ ID NO: 80346 - RNA, 18 nt, Human
uuccauuuuucagucuuc

SEQ ID NO: 80347 - RNA, 22 nt, Human
uucauuagcguaggauguguac

SEQ ID NO: 80348 - RNA, 21 nt, Human
uucauucauggcauaauauag

SEQ ID NO: 80349 - RNA, 22 nt, Human
uuugugauaaguggauucaagg

SEQ ID NO: 80350 - RNA, 22 nt, Human
uuccaaggcugcuauuuguuuc

SEQ ID NO: 80351 - RNA, 22 nt, Human
uuccagcaaagguaguguguua

SEQ ID NO: 80352 - RNA, 22 nt, Human
uuccagaacaauguggacguau

SEQ ID NO: 80353 - RNA, 22 nt, Human
uuuguuugcuaguauuuuguuu

SEQ ID NO: 80354 - RNA, 17 nt, Human
uuuguuucauacuucau

SEQ ID NO: 80355 - RNA, 22 nt, Human
uuuuaaaagguugcuguuauaa

SEQ ID NO: 80356 - RNA, 22 nt, Human
uuuuaaaguaauugaagcuugu

SEQ ID NO: 80357 - RNA, 22 nt, Human
uuuguuuuggugucaugcguga

SEQ ID NO: 80358 - RNA, 22 nt, Human
uuuguuugcugagugaauucaa

SEQ ID NO: 80359 - RNA, 22 nt, Human
uuccucauuuuguuaauuuuac

SEQ ID NO: 80360 - RNA, 22 nt, Human
uuccucauuuauaggaaagaga

SEQ ID NO: 80361 - RNA, 20 nt, Human
uuccucaaaagucugaugcu

SEQ ID NO: 80362 - RNA, 22 nt, Human
uuccucauuuggcacaucugag

SEQ ID NO: 80363 - RNA, 20 nt, Human
uuccuuucuuucuuuuuuuu

SEQ ID NO: 80364 - RNA, 22 nt, Human
uuccuuuucuucuaccacaugu

SEQ ID NO: 80365 - RNA, 22 nt, Human
uuuuaaguauuuucuuuuuuua

SEQ ID NO: 80366 - RNA, 22 nt, Human
uuuuaaauggcuuuuacuuuuc

SEQ ID NO: 80367 - RNA, 23 nt, Human
uuuuaauaguaugacaugagcug

SEQ ID NO: 80368 - RNA, 22 nt, Human
uuuuaauaguauaucuagacac

SEQ ID NO: 80369 - RNA, 22 nt, Human
uuggauugugaaaguauucucu

SEQ ID NO: 80370 - RNA, 22 nt, Human
uguguguuguuuugccagaaua

SEQ ID NO: 80371 - RNA, 22 nt, Human
uguguguguguguguaauauau

SEQ ID NO: 80372 - RNA, 17 nt, Human
uguguauucuccaggug

SEQ ID NO: 80373 - RNA, 22 nt, Human
ugugucauuugagaggagacga

SEQ ID NO: 80374 - RNA, 22 nt, Human
uguguguguauacauguauaua

SEQ ID NO: 80375 - RNA, 22 nt, Human
ugugugcuaguuuugucaguau

SEQ ID NO: 80376 - RNA, 22 nt, Human
uuggaagacagccgucuuuauu

SEQ ID NO: 80377 - RNA, 22 nt, Human
ugugccuuucacuaugucauuc

SEQ ID NO: 80378 - RNA, 22 nt, Human
uuggaaguggcaaaggcuaaag

SEQ ID NO: 80379 - RNA, 22 nt, Human
uuggacuucauuuaccucucuc

SEQ ID NO: 80380 - RNA, 22 nt, Human
uuggagaaagcugcaggcucug

SEQ ID NO: 80381 - RNA, 22 nt, Human
uuggauguggggauggaguggg

SEQ ID NO: 80382 - RNA, 22 nt, Human
uuggcaaaagauuggguacuua

SEQ ID NO: 80383 - RNA, 22 nt, Human
uuggcacagagcugcagccugg

SEQ ID NO: 80384 - RNA, 22 nt, Human
uguguucuuugcuuaauuaaag

SEQ ID NO: 80385 - RNA, 22 nt, Human
uuggcagagaacagaaugauuu

SEQ ID NO: 80386 - RNA, 22 nt, Human
uguguuuuucauuuuaaguccu

SEQ ID NO: 80387 - RNA, 21 nt, Human
uuggcuacugcuucagaggga

SEQ ID NO: 80388 - RNA, 22 nt, Human
uuggcuguguugaaaacgugga

SEQ ID NO: 80389 - RNA, 22 nt, Human
uuggcguuuccuguucugggug

SEQ ID NO: 80390 - RNA, 22 nt, Human
uguuauugccucaugagacucc

SEQ ID NO: 80391 - RNA, 22 nt, Human
uguuccaacuacugaauuggca

SEQ ID NO: 80392 - RNA, 22 nt, Human
uguucaguuugcuaucauaauc

SEQ ID NO: 80393 - RNA, 22 nt, Human
uuggggaggaagauagggugaa

SEQ ID NO: 80394 - RNA, 22 nt, Human
uguucugauggauuacaugucu

SEQ ID NO: 80395 - RNA, 22 nt, Human
uugucaggaacuaugauuaugc

SEQ ID NO: 80396 - RNA, 22 nt, Human
uugucagcuagugaugcuguuc

SEQ ID NO: 80397 - RNA, 22 nt, Human
uuguaagacuguagaaugcaaa

SEQ ID NO: 80398 - RNA, 22 nt, Human
uuguauguuucugugcacauga

SEQ ID NO: 80399 - RNA, 22 nt, Human
uuguauuaauacacuccuuuuc

SEQ ID NO: 80400 - RNA, 22 nt, Human
uguuuaaauagaacauacugca

SEQ ID NO: 80401 - RNA, 22 nt, Human
uguuuagcucugacuaugugau

SEQ ID NO: 80402 - RNA, 22 nt, Human
uugguuuuuugguguaucuuau

SEQ ID NO: 80403 - RNA, 22 nt, Human
uugggugcugcacccuucaaca

SEQ ID NO: 80404 - RNA, 22 nt, Human
uugguauucaguuggauuugga

SEQ ID NO: 80405 - RNA, 22 nt, Human
uugguauuuguuuaaauuacac

SEQ ID NO: 80406 - RNA, 22 nt, Human
uuggucaagacugauaucaaga

SEQ ID NO: 80407 - RNA, 22 nt, Human
uugguuuuauucguauuuguau

SEQ ID NO: 80408 - RNA, 22 nt, Human
uugucauuuucuuaauguuccu

SEQ ID NO: 80409 - RNA, 22 nt, Human
uguuuucccacugguuuguaca

SEQ ID NO: 80410 - RNA, 22 nt, Human
uguuuucuuuccccuucuuuuc

SEQ ID NO: 80411 - RNA, 22 nt, Human
uguuuucuauuaccugagauug

SEQ ID NO: 80412 - RNA, 22 nt, Human
uugugaggaugugcuuuuuagu

SEQ ID NO: 80413 - RNA, 21 nt, Human
uugugaaaguccaggaacaac

SEQ ID NO: 80414 - RNA, 22 nt, Human
uugucuuucguauggaacacua

SEQ ID NO: 80415 - RNA, 22 nt, Human
uugucucuacagagaguaguag

SEQ ID NO: 80416 - RNA, 22 nt, Human
uguuuuuucccccccuucuaaa

SEQ ID NO: 80417 - RNA, 23 nt, Human
uugugguuauauuugcccauuuu

SEQ ID NO: 80418 - RNA, 22 nt, Human
uuguggagaggaagcaaggagg

SEQ ID NO: 80419 - RNA, 22 nt, Human
uugugauuaauaacuuuucucu

SEQ ID NO: 80420 - RNA, 22 nt, Human
uguuuuuagcuguuuuuuggau

SEQ ID NO: 80421 - RNA, 22 nt, Human
uuuaccuuauguaaauaagagu

SEQ ID NO: 80422 - RNA, 22 nt, Human
uuuaccucguuguguccuuguu

SEQ ID NO: 80423 - RNA, 22 nt, Human
uuuaaugucuuuggccuuuaau

SEQ ID NO: 80424 - RNA, 19 nt, Human
uuuaaugugugcugcaauc

SEQ ID NO: 80425 - RNA, 22 nt, Human
uuaccuuuucuuguuuacaagu

SEQ ID NO: 80426 - RNA, 18 nt, Human
uuuacgaacucacuugag

SEQ ID NO: 80427 - RNA, 22 nt, Human
uuacuguguguaaaauaucuuu

SEQ ID NO: 80428 - RNA, 22 nt, Human
uuacuuucugggauaucaaaug

SEQ ID NO: 80429 - RNA, 22 nt, Human
uuuaaucaauaaccuccugggu

SEQ ID NO: 80430 - RNA, 22 nt, Human
uuuaacauaugaaagaauauuu

SEQ ID NO: 80431 - RNA, 22 nt, Human
uuaauuguuagauagauuauag

SEQ ID NO: 80432 - RNA, 22 nt, Human
uuuaaucaguugguaauauuga

SEQ ID NO: 80433 - RNA, 22 nt, Human
uuuagagauaaaugcucuccca

SEQ ID NO: 80434 - RNA, 22 nt, Human
uuuagcaaaaaagcucugcgua

SEQ ID NO: 80435 - RNA, 22 nt, Human
uuuagauguucccucuacccug

SEQ ID NO: 80436 - RNA, 22 nt, Human
uuagaaauguccuacuaauaug

SEQ ID NO: 80437 - RNA, 22 nt, Human
uuacuuuuuucccccuuagaug

SEQ ID NO: 80438 - RNA, 22 nt, Human
uuuagcaaggagaaauaauccu

SEQ ID NO: 80439 - RNA, 22 nt, Human
uuagauaaaucagcccugagua

SEQ ID NO: 80440 - RNA, 22 nt, Human
uuagauaguaaauagcacuaag

SEQ ID NO: 80441 - RNA, 22 nt, Human
uuuagugagugugaaucaaaug

SEQ ID NO: 80442 - RNA, 22 nt, Human
uuuaguugcuuuaguugagcug

SEQ ID NO: 80443 - RNA, 22 nt, Human
uuaggagugccaucuuguggac

SEQ ID NO: 80444 - RNA, 22 nt, Human
uuaggcuaauagagauggaaug

SEQ ID NO: 80445 - RNA, 22 nt, Human
uuaggcuuuauugaaaacaaua

SEQ ID NO: 80446 - RNA, 22 nt, Human
uuuauguuuguuuuugaaauaa

SEQ ID NO: 80447 - RNA, 22 nt, Human
uuuaugucaaaaguaaaaugaa

SEQ ID NO: 80448 - RNA, 22 nt, Human
uuuaugguacaggaaugcuguu

SEQ ID NO: 80449 - RNA, 22 nt, Human
uuaguccuaaauuuagauuuuc

SEQ ID NO: 80450 - RNA, 22 nt, Human
uuaagggauugagauggaauga

SEQ ID NO: 80451 - RNA, 22 nt, Human
uuaaggcuguggggauuacugc

SEQ ID NO: 80452 - RNA, 23 nt, Human
uuaaggugccguguaauucaugc

SEQ ID NO: 80453 - RNA, 22 nt, Human
uuaacgaauugugcauaauucc

SEQ ID NO: 80454 - RNA, 22 nt, Human
uuguuauaggaucagugucacu

SEQ ID NO: 80455 - RNA, 20 nt, Human
uuguuagguucaguguuucc

SEQ ID NO: 80456 - RNA, 22 nt, Human
uuguuauuauuauuuucguucu

SEQ ID NO: 80457 - RNA, 22 nt, Human
uuguguuuaaucuguuccacua

SEQ ID NO: 80458 - RNA, 22 nt, Human
uuaaaauuguuaacuuugguga

SEQ ID NO: 80459 - RNA, 22 nt, Human
uuaauaaauugugguaccagag

SEQ ID NO: 80460 - RNA, 22 nt, Human
uuaaggcauagcuuguguugac

SEQ ID NO: 80461 - RNA, 22 nt, Human
uuguuccuaguuguccaucaca

SEQ ID NO: 80462 - RNA, 22 nt, Human
uuguuucauggggacgacuggc

SEQ ID NO: 80463 - RNA, 22 nt, Human
uuguugcuguugaacccugcug

SEQ ID NO: 80464 - RNA, 22 nt, Human
uuuaaaacagcauuuaaaaggu

SEQ ID NO: 80465 - RNA, 22 nt, Human
uuguuuucuaguguuuugaaua

SEQ ID NO: 80466 - RNA, 22 nt, Human
uuguuuucuugaugaaauuauu

SEQ ID NO: 80467 - RNA, 22 nt, Human
uuguuuuaguagaaguuacaug

SEQ ID NO: 80468 - RNA, 22 nt, Human
uuguuuuaaaaagaauaacuac

SEQ ID NO: 80469 - RNA, 22 nt, Human
uuuaaaacaguacguuuucuua

SEQ ID NO: 80470 - RNA, 22 nt, Human
uuuaaaauguuuuauuuauuua

SEQ ID NO: 80471 - RNA, 22 nt, Human
uuuaaauaguugguuuuuuugc

SEQ ID NO: 80472 - RNA, 22 nt, Human
uuuaaauuucugaaucuugagg

SEQ ID NO: 80473 - RNA, 22 nt, Human
uuuaaacuaacaguacacguug

SEQ ID NO: 80474 - RNA, 22 nt, Human
uuaaugcagguacuguuacaau

SEQ ID NO: 80475 - RNA, 22 nt, Human
uuaaugcauguaaaugugcaaa

SEQ ID NO: 80476 - RNA, 21 nt, Human
uuaaugcuaugcagaaaaucu

SEQ ID NO: 80477 - RNA, 22 nt, Human
uuaauguugacacacuagcaca

SEQ ID NO: 80478 - RNA, 22 nt, Human
uuaauucuugagcugucuuucc

SEQ ID NO: 80479 - RNA, 22 nt, Human
uuuaaaccuuggaagccacaua

SEQ ID NO: 80480 - RNA, 22 nt, Human
uugaauaguuuuggauagcaua

SEQ ID NO: 80481 - RNA, 19 nt, Human
uugaauguuugauagucuc

SEQ ID NO: 80482 - RNA, 22 nt, Human
uugagauggccuuuuuuauacu

SEQ ID NO: 80483 - RNA, 22 nt, Human
uugagaugacuuaaaucacugu

SEQ ID NO: 80484 - RNA, 20 nt, Human
uugagccucauggauugucu

SEQ ID NO: 80485 - RNA, 22 nt, Human
uugacucuuucauuuauuauuu

SEQ ID NO: 80486 - RNA, 22 nt, Human
uugaguuuacauuguauuagcc

SEQ ID NO: 80487 - RNA, 22 nt, Human
uugaggaagggaggcaaaacug

SEQ ID NO: 80488 - RNA, 21 nt, Human
uugagcuuuuaguacagacag

SEQ ID NO: 80489 - RNA, 22 nt, Human
uugaugacauuuagcauaauug

SEQ ID NO: 80490 - RNA, 22 nt, Human
uugaugagucacuuucuguaaa

SEQ ID NO: 80491 - RNA, 23 nt, Human
uugaucuggaaaauacuuguuug

SEQ ID NO: 80492 - RNA, 22 nt, Human
ugucccuggacuccaggagcca

SEQ ID NO: 80493 - RNA, 22 nt, Human
ugucugaauuguaauguugcgu

SEQ ID NO: 80494 - RNA, 22 nt, Human
ugucugauccuucaggagcccc

SEQ ID NO: 80495 - RNA, 22 nt, Human
ugucucuagggcagauagagug

SEQ ID NO: 80496 - RNA, 21 nt, Human
uugauuuagcagaucuagcug

SEQ ID NO: 80497 - RNA, 22 nt, Human
ugucuuaugcugcauagacuau

SEQ ID NO: 80498 - RNA, 22 nt, Human
ugucuucagguuccucaccacu

SEQ ID NO: 80499 - RNA, 22 nt, Human
ugucuguauuugaggacauugu

SEQ ID NO: 80500 - RNA, 22 nt, Human
ugucuuaaaauuuuagggcuau

SEQ ID NO: 80501 - RNA, 20 nt, Human
ugucugguaagacgcccauc

SEQ ID NO: 80502 - RNA, 22 nt, Human
uugauuuggcguuuuccuccug

SEQ ID NO: 80503 - RNA, 22 nt, Human
uugcaucaaauauguaccacag

SEQ ID NO: 80504 - RNA, 22 nt, Human
uugcccuaccccaggccuuuuu

SEQ ID NO: 80505 - RNA, 22 nt, Human
uugccaggagacaucuggagcc

SEQ ID NO: 80506 - RNA, 22 nt, Human
uugccaggggacaucuggagcc

SEQ ID NO: 80507 - RNA, 22 nt, Human
uugcaugugugaaaugcacaga

SEQ ID NO: 80508 - RNA, 23 nt, Human
uugcauuaauguggaggcacagg

SEQ ID NO: 80509 - RNA, 22 nt, Human
uugaaagucuaagaauagguau

SEQ ID NO: 80510 - RNA, 22 nt, Human
uguagucucagggagcugcuuc

SEQ ID NO: 80511 - RNA, 22 nt, Human
uugaaaaaugcccagcagacaa

SEQ ID NO: 80512 - RNA, 22 nt, Human
uguacauacauagauauacaca

SEQ ID NO: 80513 - RNA, 22 nt, Human
uguacauuuacaaaagcuuuau

SEQ ID NO: 80514 - RNA, 22 nt, Human
uguacuuguaauaucagugaaa

SEQ ID NO: 80515 - RNA, 20 nt, Human
uugaaagucagggcuccagu

SEQ ID NO: 80516 - RNA, 22 nt, Human
uguagaaguuaauugaugagua

SEQ ID NO: 80517 - RNA, 22 nt, Human
uucuuuguccuagcauucuaca

SEQ ID NO: 80518 - RNA, 22 nt, Human
uucuuuuaauuucugucugcag

SEQ ID NO: 80519 - RNA, 22 nt, Human
uucugugacuccucagagauuu

SEQ ID NO: 80520 - RNA, 22 nt, Human
uggucuccucuuaauugccuac

SEQ ID NO: 80521 - RNA, 22 nt, Human
uggucucuacggaggaaagcug

SEQ ID NO: 80522 - RNA, 22 nt, Human
uggucuuuccuucauuguccag

SEQ ID NO: 80523 - RNA, 22 nt, Human
uggugcucuugauauauaaggc

SEQ ID NO: 80524 - RNA, 22 nt, Human
uggugcucucgauauauaaggc

SEQ ID NO: 80525 - RNA, 22 nt, Human
uucuguuuuuauucuaucucug

SEQ ID NO: 80526 - RNA, 22 nt, Human
uucuguguauggaagaaugucc

SEQ ID NO: 80527 - RNA, 22 nt, Human
ugguuauauaaggauuaaauac

SEQ ID NO: 80528 - RNA, 21 nt, Human
uucuuugcugcuguuuuugua

SEQ ID NO: 80529 - RNA, 22 nt, Human
ugguuauggaacuggcuauggc

SEQ ID NO: 80530 - RNA, 22 nt, Human
uucuugcuuccggugcuccagg

SEQ ID NO: 80531 - RNA, 22 nt, Human
uucuugcuucucugucugccuc

SEQ ID NO: 80532 - RNA, 22 nt, Human
uucuucuuuccuauaauuaauu

SEQ ID NO: 80533 - RNA, 22 nt, Human
uucuucuucuuccucauccuca

SEQ ID NO: 80534 - RNA, 22 nt, Human
uucuccucagcaaggcagcuuu

SEQ ID NO: 80535 - RNA, 22 nt, Human
uucuccucaaaccaucagacau

SEQ ID NO: 80536 - RNA, 22 nt, Human
uucuccugacuggccauucagu

SEQ ID NO: 80537 - RNA, 22 nt, Human
uggguagggagcuggaauccua

SEQ ID NO: 80538 - RNA, 22 nt, Human
uggggcuauggcccgaccacgu

SEQ ID NO: 80539 - RNA, 22 nt, Human
uggggcuggccaggaggagucu

SEQ ID NO: 80540 - RNA, 22 nt, Human
uucuaguuacucuuaaaugcug

SEQ ID NO: 80541 - RNA, 22 nt, Human
uucuauaagagaugaauacagu

SEQ ID NO: 80542 - RNA, 20 nt, Human
uggguucaguuguuucuggc

SEQ ID NO: 80543 - RNA, 22 nt, Human
uucucuauuugcugcaccucuc

SEQ ID NO: 80544 - RNA, 22 nt, Human
ugggugggcagagucuaagaua

SEQ ID NO: 80545 - RNA, 22 nt, Human
ugggugccgcaucuugcuguuc

SEQ ID NO: 80546 - RNA, 22 nt, Human
ugguaauuuaacaaaauuguca

SEQ ID NO: 80547 - RNA, 22 nt, Human
ugguacaaaaaagauuuuggac

SEQ ID NO: 80548 - RNA, 22 nt, Human
uucuggagacccagcaacaggg

SEQ ID NO: 80549 - RNA, 22 nt, Human
uucuggagucuauuuugaaaag

SEQ ID NO: 80550 - RNA, 22 nt, Human
ugguauaaaaauuugugaaugu

SEQ ID NO: 80551 - RNA, 22 nt, Human
ugguaaaguguacugaauauga

SEQ ID NO: 80552 - RNA, 17 nt, Human
uucugcucaggaacaga

SEQ ID NO: 80553 - RNA, 22 nt, Human
uucugcuagugguauauguuga

SEQ ID NO: 80554 - RNA, 22 nt, Human
ugguauauuugaccauaugugu

SEQ ID NO: 80555 - RNA, 22 nt, Human
uucuggugauuugccucuuuag

SEQ ID NO: 80556 - RNA, 19 nt, Human
uucugguacauacugccug

SEQ ID NO: 80557 - RNA, 22 nt, Human
uucuggaguuugaagaucaggu

SEQ ID NO: 80558 - RNA, 22 nt, Human
uggagcugaaguacucucacua

SEQ ID NO: 80559 - RNA, 22 nt, Human
uggagcuggcuuguggaaguug

SEQ ID NO: 80560 - RNA, 22 nt, Human
uuaugcaaaggggccucuuccu

SEQ ID NO: 80561 - RNA, 22 nt, Human
uuaugccuguuaggcagcaucu

SEQ ID NO: 80562 - RNA, 22 nt, Human
uucauuuuauauuagagcuguu

SEQ ID NO: 80563 - RNA, 22 nt, Human
uuccacauucggaauuuucuga

SEQ ID NO: 80564 - RNA, 22 nt, Human
uuccaacaugugcuuguguuga

SEQ ID NO: 80565 - RNA, 22 nt, Human
uggcuuuuuucuccccuuggau

SEQ ID NO: 80566 - RNA, 22 nt, Human
ugggaacuggaaaaaaugaagu

SEQ ID NO: 80567 - RNA, 22 nt, Human
ugggaaaauagcuauuuugaaa

SEQ ID NO: 80568 - RNA, 22 nt, Human
ugggaagcugagccucgaugug

SEQ ID NO: 80569 - RNA, 22 nt, Human
ugggaagccaguaucagacuaa

SEQ ID NO: 80570 - RNA, 22 nt, Human
uuccucauucuggggcauguug

SEQ ID NO: 80571 - RNA, 22 nt, Human
ugggagagaagcugaggcaggg

SEQ ID NO: 80572 - RNA, 22 nt, Human
ugggagagaaauuuaaguuuuu

SEQ ID NO: 80573 - RNA, 22 nt, Human
uuccucuugaaucugucugacu

SEQ ID NO: 80574 - RNA, 21 nt, Human
uuccuccucuggagaagaaga

SEQ ID NO: 80575 - RNA, 22 nt, Human
uuccugcuggucaaaguugccu

SEQ ID NO: 80576 - RNA, 22 nt, Human
uuccugaucuuuucccagaguu

SEQ ID NO: 80577 - RNA, 22 nt, Human
uucccuauaauauggcucuucu

SEQ ID NO: 80578 - RNA, 22 nt, Human
uuccgcuuucaauggcuuggcu

SEQ ID NO: 80579 - RNA, 22 nt, Human
uuccuaauugccaugaaguuau

SEQ ID NO: 80580 - RNA, 22 nt, Human
uucccuacuagccuuaauguuu

SEQ ID NO: 80581 - RNA, 21 nt, Human
uuccuggaggcagaaacguga

SEQ ID NO: 80582 - RNA, 22 nt, Human
uuccuguggggugucaucauag

SEQ ID NO: 80583 - RNA, 20 nt, Human
uuccuuaucuguaaagugga

SEQ ID NO: 80584 - RNA, 22 nt, Human
uuccuuuaaccaagagcaguac

SEQ ID NO: 80585 - RNA, 22 nt, Human
uucgucaauaugcagccuguga

SEQ ID NO: 80586 - RNA, 22 nt, Human
uguuggaaucuucuagucuucc

SEQ ID NO: 80587 - RNA, 22 nt, Human
ugcuccucugcaugucugcggc

SEQ ID NO: 80588 - RNA, 22 nt, Human
uguuggugcacugaaaggcagg

SEQ ID NO: 80589 - RNA, 21 nt, Human
uguuggccuucauucucuguc

SEQ ID NO: 80590 - RNA, 22 nt, Human
ugcucgauuauuucauuuugca

SEQ ID NO: 80591 - RNA, 22 nt, Human
ugcucuguucaguguaucuugu

SEQ ID NO: 80592 - RNA, 22 nt, Human
ugcucuguuuuaacucuuucaa

SEQ ID NO: 80593 - RNA, 22 nt, Human
ugcucuuguauccaaaagugau

SEQ ID NO: 80594 - RNA, 22 nt, Human
ugcucugcuaggagaagaauga

SEQ ID NO: 80595 - RNA, 23 nt, Human
uguuguccaacugaucuccaggc

SEQ ID NO: 80596 - RNA, 22 nt, Human
ugcucuuucaggcauagaccuu

SEQ ID NO: 80597 - RNA, 22 nt, Human
uguuguucuuuuucuucuuguu

SEQ ID NO: 80598 - RNA, 22 nt, Human
uguuucaguaugauuuucccuc

SEQ ID NO: 80599 - RNA, 22 nt, Human
uguuuccuaagugucucugaag

SEQ ID NO: 80600 - RNA, 22 nt, Human
uguuuaagugguuaaaggauuc

SEQ ID NO: 80601 - RNA, 22 nt, Human
uguuucguugguggagagcuac

SEQ ID NO: 80602 - RNA, 22 nt, Human
ugcucuuuguagcugcuuugcu

SEQ ID NO: 80603 - RNA, 22 nt, Human
uguuuuuuagagugauacuuuu

SEQ ID NO: 80604 - RNA, 22 nt, Human
uguuuuucaagcauuuauuaau

SEQ ID NO: 80605 - RNA, 22 nt, Human
ugcugcggauauacaggaucug

SEQ ID NO: 80606 - RNA, 21 nt, Human
uguuuuguaauagauacuaug

SEQ ID NO: 80607 - RNA, 22 nt, Human
uguuuuuauucuuaauguuuca

SEQ ID NO: 80608 - RNA, 23 nt, Human
uguuugggcuaucuuuuguucuc

SEQ ID NO: 80609 - RNA, 22 nt, Human
uuaaaagaauccuguuauccuc

SEQ ID NO: 80610 - RNA, 23 nt, Human
ugcugcuggaguaucuacaaugc

SEQ ID NO: 80611 - RNA, 22 nt, Human
ugcuggaaggguaguauuaacu

SEQ ID NO: 80612 - RNA, 22 nt, Human
ugcugcuguuaucauuuuacca

SEQ ID NO: 80613 - RNA, 22 nt, Human
uuaaagaguuuauuacuuguaa

SEQ ID NO: 80614 - RNA, 22 nt, Human
ugcuggagccauguuuucucua

SEQ ID NO: 80615 - RNA, 22 nt, Human
ugcugggagcugggccucgaca

SEQ ID NO: 80616 - RNA, 22 nt, Human
ugcuggagucucuugacccugg

SEQ ID NO: 80617 - RNA, 23 nt, Human
uuaagacuggcugaacuuaguag

SEQ ID NO: 80618 - RNA, 22 nt, Human
uuaacauuguccuuagcagauu

SEQ ID NO: 80619 - RNA, 22 nt, Human
ugcugugagaccauuuguugag

SEQ ID NO: 80620 - RNA, 22 nt, Human
uuaagagaagaguaucuagaac

SEQ ID NO: 80621 - RNA, 22 nt, Human
ugcuugaacccaggaaguggag

SEQ ID NO: 80622 - RNA, 22 nt, Human
uuacaacgcacacagauuucac

SEQ ID NO: 80623 - RNA, 22 nt, Human
uuaauguuuuagaaugagagug

SEQ ID NO: 80624 - RNA, 22 nt, Human
uuaagguggcauacaacacagc

SEQ ID NO: 80625 - RNA, 22 nt, Human
uuaauauuaagauauugagugg

SEQ ID NO: 80626 - RNA, 22 nt, Human
uuaauauuuauugguaaucacu

SEQ ID NO: 80627 - RNA, 22 nt, Human
ugcuuagcggugggggcuccau

SEQ ID NO: 80628 - RNA, 22 nt, Human
ugcuuacgcaaccuguguuugg

SEQ ID NO: 80629 - RNA, 22 nt, Human
ugcuucucacuucuugguuucc

SEQ ID NO: 80630 - RNA, 22 nt, Human
ugcuucucucuaggaagacgcu

SEQ ID NO: 80631 - RNA, 22 nt, Human
uuaggaauugcuucauguuugg

SEQ ID NO: 80632 - RNA, 22 nt, Human
uuaguauuuucaccauaugagg

SEQ ID NO: 80633 - RNA, 22 nt, Human
uuagggacagcucuguagguga

SEQ ID NO: 80634 - RNA, 22 nt, Human
uuaggggcuuaggcagaguuug

SEQ ID NO: 80635 - RNA, 22 nt, Human
uuaguauuuuuugaaugaugaa

SEQ ID NO: 80636 - RNA, 23 nt, Human
uggaagaaaaugguuuggcugug

SEQ ID NO: 80637 - RNA, 22 nt, Human
uuagucauucccucuugauauu

SEQ ID NO: 80638 - RNA, 22 nt, Human
uggaagcuagggguuucuguug

SEQ ID NO: 80639 - RNA, 22 nt, Human
uggaagcccagaaggaagcaga

SEQ ID NO: 80640 - RNA, 20 nt, Human
uggaaggaaagguguaucuu

SEQ ID NO: 80641 - RNA, 22 nt, Human
uuagugaagaagcaucuuuagu

SEQ ID NO: 80642 - RNA, 22 nt, Human
uggaauuaucugaagugauuug

SEQ ID NO: 80643 - RNA, 22 nt, Human
uggaaugccgggccaggcuccg

SEQ ID NO: 80644 - RNA, 23 nt, Human
uggaaguugagagucugcuuugu

SEQ ID NO: 80645 - RNA, 22 nt, Human
uuauauuaaaaaucgcuaacag

SEQ ID NO: 80646 - RNA, 22 nt, Human
uuauaaguaagggucucuggca

SEQ ID NO: 80647 - RNA, 22 nt, Human
uuaucuguuuuaaugaauaauu

SEQ ID NO: 80648 - RNA, 22 nt, Human
uuaucugugcuuuacugacaga

SEQ ID NO: 80649 - RNA, 22 nt, Human
uuaucugcccauuguagaauug

SEQ ID NO: 80650 - RNA, 22 nt, Human
uggagauauucuauauuuuaua

SEQ ID NO: 80651 - RNA, 22 nt, Human
uggacuguucauugauacugga

SEQ ID NO: 80652 - RNA, 22 nt, Human
uggagagauagucauucuagag

SEQ ID NO: 80653 - RNA, 22 nt, Human
uuauauuuuauuuaauuaaaua

SEQ ID NO: 80654 - RNA, 22 nt, Human
uuaucaaaaaauaguacuuuga

SEQ ID NO: 80655 - RNA, 22 nt, Human
uggagagcaggugaaggaaaga

SEQ ID NO: 80656 - RNA, 22 nt, Human
uggaaaguuggaagucucagga

SEQ ID NO: 80657 - RNA, 22 nt, Human
uggaaaggaguucuguuuauuu

SEQ ID NO: 80658 - RNA, 22 nt, Human
uuagaauggaaucauuugcauu

SEQ ID NO: 80659 - RNA, 22 nt, Human
uggaaauagauguaggaaauug

SEQ ID NO: 80660 - RNA, 22 nt, Human
uggaaagaagacugugguugag

SEQ ID NO: 80661 - RNA, 22 nt, Human
uuagaaaaaggcuguggucuua

SEQ ID NO: 80662 - RNA, 22 nt, Human
uuacuuaucugaugugauuuuu

SEQ ID NO: 80663 - RNA, 17 nt, Human
uuagagcuacauguuga

SEQ ID NO: 80664 - RNA, 22 nt, Human
uuagagguuuuuuuccucauuc

SEQ ID NO: 80665 - RNA, 22 nt, Human
uuagagauuuuauguuaaugua

SEQ ID NO: 80666 - RNA, 22 nt, Human
uuagaguguguguaguagggug

SEQ ID NO: 80667 - RNA, 22 nt, Human
uggaacugauuaaaagggcaga

SEQ ID NO: 80668 - RNA, 22 nt, Human
uggaacugguuugcuucagacu

SEQ ID NO: 80669 - RNA, 22 nt, Human
uggaaaugcuuagaggugaucu

SEQ ID NO: 80670 - RNA, 22 nt, Human
uuagaguucaagcuuuaggaaa

SEQ ID NO: 80671 - RNA, 22 nt, Human
uggaagaaaacuuggaaggcau

SEQ ID NO: 80672 - RNA, 22 nt, Human
uuagaugaaaaucggaacaugu

SEQ ID NO: 80673 - RNA, 22 nt, Human
uuagcagacagauggagagaga

SEQ ID NO: 80674 - RNA, 22 nt, Human
uuaccuaagaaacucauuucgu

SEQ ID NO: 80675 - RNA, 21 nt, Human
ugcuuucugugcuuuuucugc

SEQ ID NO: 80676 - RNA, 22 nt, Human
ugcuuucaaugaauuguauacu

SEQ ID NO: 80677 - RNA, 22 nt, Human
uuacaagaucuuugaaggcaag

SEQ ID NO: 80678 - RNA, 19 nt, Human
uuacaugacauaugaagga

SEQ ID NO: 80679 - RNA, 22 nt, Human
uuacaguuuacauaagaauugu

SEQ ID NO: 80680 - RNA, 22 nt, Human
uuaccauaguacuaucaguuua

SEQ ID NO: 80681 - RNA, 21 nt, Human
uuacuaagagagcagagggac

SEQ ID NO: 80682 - RNA, 22 nt, Human
uuaccuuggaccggguaucaga

SEQ ID NO: 80683 - RNA, 22 nt, Human
uuaccugagcggauuuguugca

SEQ ID NO: 80684 - RNA, 22 nt, Human
uuacucucugaggcacucaaaa

SEQ ID NO: 80685 - RNA, 22 nt, Human
uggaaaacgcaguuuaauuuuu

SEQ ID NO: 80686 - RNA, 20 nt, Human
uuacugagguauuuuuauca

SEQ ID NO: 80687 - RNA, 22 nt, Human
ucuuuuucccugguuccuuuuu

SEQ ID NO: 80688 - RNA, 22 nt, Human
ugaaagccuacagcucacuguu

SEQ ID NO: 80689 - RNA, 22 nt, Human
ugaccuuuuuaaauuauuuuua

SEQ ID NO: 80690 - RNA, 22 nt, Human
ugacuuauuaaaaguuuuuauu

SEQ ID NO: 80691 - RNA, 22 nt, Human
ugguauaaaaaaaugaguauaa

SEQ ID NO: 80692 - RNA, 22 nt, Human
ugguaaaugucuaacaaucacu

SEQ ID NO: 80693 - RNA, 22 nt, Human
ugagaauuuaacuugauuagga

SEQ ID NO: 80694 - RNA, 20 nt, Human
ugagaaacaagggcuggucu

SEQ ID NO: 80695 - RNA, 22 nt, Human
ugagaagaggucuuuugggaug

SEQ ID NO: 80696 - RNA, 22 nt, Human
uggucaaauccuagauccuuug

SEQ ID NO: 80697 - RNA, 23 nt, Human
ugagacacuggaaggcaagaaaa

SEQ ID NO: 80698 - RNA, 22 nt, Human
ugagagggagacagcucuagca

SEQ ID NO: 80699 - RNA, 22 nt, Human
ugagauuuagaacuggauuuca

SEQ ID NO: 80700 - RNA, 19 nt, Human
ugagauuguaugaggagau

SEQ ID NO: 80701 - RNA, 22 nt, Human
ugagauucuguucagaaaaaug

SEQ ID NO: 80702 - RNA, 22 nt, Human
ugagcaaacacagauaggcuua

SEQ ID NO: 80703 - RNA, 20 nt, Human
uggucucuugaaagaggcuc

SEQ ID NO: 80704 - RNA, 22 nt, Human
uggucucaaagcaaggaaggaa

SEQ ID NO: 80705 - RNA, 22 nt, Human
uggugcuuuuguggaugcuaac

SEQ ID NO: 80706 - RNA, 22 nt, Human
ugguucuagaugagaugaugag

SEQ ID NO: 80707 - RNA, 22 nt, Human
ugguucugccacuuuccccuug

SEQ ID NO: 80708 - RNA, 22 nt, Human
ugagucuguugcuagggggaau

SEQ ID NO: 80709 - RNA, 20 nt, Human
ugagucagcugcaugggugg

SEQ ID NO: 80710 - RNA, 22 nt, Human
ugagugacuguugucaagaugg

SEQ ID NO: 80711 - RNA, 22 nt, Human
ugguuuuuuguaggauaaacau

SEQ ID NO: 80712 - RNA, 22 nt, Human
ugguuuguauauguuugugaga

SEQ ID NO: 80713 - RNA, 22 nt, Human
uguaauguuagaaacaauugcu

SEQ ID NO: 80714 - RNA, 20 nt, Human
ugauaugcgguacagagagg

SEQ ID NO: 80715 - RNA, 22 nt, Human
ugaugaaguuggaaggaaaguu

SEQ ID NO: 80716 - RNA, 22 nt, Human
ugucacagagcgugcaacagaa

SEQ ID NO: 80717 - RNA, 22 nt, Human
ugauuuguuuaaauugcucguu

SEQ ID NO: 80718 - RNA, 22 nt, Human
ugauuugaaaccuuuggcaaga

SEQ ID NO: 80719 - RNA, 22 nt, Human
ugaugcuagaacuuccaagaua

SEQ ID NO: 80720 - RNA, 22 nt, Human
ugaugccauaguaaaauuugcu

SEQ ID NO: 80721 - RNA, 22 nt, Human
uguagacaugcuuuucugauga

SEQ ID NO: 80722 - RNA, 22 nt, Human
ugauuucauaugacagcuuuuu

SEQ ID NO: 80723 - RNA, 22 nt, Human
ugcaaauuuuuuuauuuuuccu

SEQ ID NO: 80724 - RNA, 21 nt, Human
ugucagaaagccugugacuuu

SEQ ID NO: 80725 - RNA, 23 nt, Human
ugucacuuguggucacuaggcug

SEQ ID NO: 80726 - RNA, 22 nt, Human
ugucauggacuggauuucugcu

SEQ ID NO: 80727 - RNA, 22 nt, Human
ugcaagugccauggauucaggu

SEQ ID NO: 80728 - RNA, 22 nt, Human
ugcaaugagcuucuuugauaaa

SEQ ID NO: 80729 - RNA, 22 nt, Human
ugucuagacauuagcuucagcu

SEQ ID NO: 80730 - RNA, 22 nt, Human
ugcacacaguucucaggaaaga

SEQ ID NO: 80731 - RNA, 22 nt, Human
ugucucuuccuccucuugguac

SEQ ID NO: 80732 - RNA, 22 nt, Human
ugucuuucuuucucuugacaga

SEQ ID NO: 80733 - RNA, 22 nt, Human
ugucuuuagagugaacagaaga

SEQ ID NO: 80734 - RNA, 22 nt, Human
ugugaaugacuguguucuuugc

SEQ ID NO: 80735 - RNA, 22 nt, Human
ugugaagugaugggugaccgag

SEQ ID NO: 80736 - RNA, 17 nt, Human
ugucuuuuuccuccucc

SEQ ID NO: 80737 - RNA, 19 nt, Human
ugcagcacuaaaaacuuuc

SEQ ID NO: 80738 - RNA, 22 nt, Human
ugucuuguaaacaagaggggcu

SEQ ID NO: 80739 - RNA, 22 nt, Human
ugugagcugccacuucuaaucu

SEQ ID NO: 80740 - RNA, 22 nt, Human
ugcauguuuuaagugaagcuga

SEQ ID NO: 80741 - RNA, 22 nt, Human
ugcaugguuauauacuacuagu

SEQ ID NO: 80742 - RNA, 22 nt, Human
ugcauuacuuugauaagcgucu

SEQ ID NO: 80743 - RNA, 22 nt, Human
ugccagcuccgaggagcugcag

SEQ ID NO: 80744 - RNA, 22 nt, Human
ugugugcacguacauacuguau

SEQ ID NO: 80745 - RNA, 22 nt, Human
ugugucuuuggcgaugucugga

SEQ ID NO: 80746 - RNA, 22 nt, Human
uguguggaaaugcuguauaugu

SEQ ID NO: 80747 - RNA, 20 nt, Human
ugcagcucccccgcaguuuc

SEQ ID NO: 80748 - RNA, 22 nt, Human
ugugauugcauugcagauuacu

SEQ ID NO: 80749 - RNA, 18 nt, Human
ugcagcuuugugauuggc

SEQ ID NO: 80750 - RNA, 22 nt, Human
ugcaggaacucgaaaacuauag

SEQ ID NO: 80751 - RNA, 22 nt, Human
ugcagcuucucugcaacaggag

SEQ ID NO: 80752 - RNA, 22 nt, Human
ugcaugaucucacuuacaggug

SEQ ID NO: 80753 - RNA, 22 nt, Human
ugcaucccaaacaugguuuccu

SEQ ID NO: 80754 - RNA, 22 nt, Human
ugcaucuaaguggcuaacaacc

SEQ ID NO: 80755 - RNA, 22 nt, Human
ucugaucuuucauccuaaaugg

SEQ ID NO: 80756 - RNA, 22 nt, Human
ucugauucucuuguugaccuag

SEQ ID NO: 80757 - RNA, 17 nt, Human
ucugcagaggcaaaccu

SEQ ID NO: 80758 - RNA, 22 nt, Human
ucugauaaggaaggauuaaaag

SEQ ID NO: 80759 - RNA, 22 nt, Human
ucugaugaccacaugugggacu

SEQ ID NO: 80760 - RNA, 22 nt, Human
ucugcuguugaucaugacuagc

SEQ ID NO: 80761 - RNA, 22 nt, Human
ucugcuuaguuuucuugaacag

SEQ ID NO: 80762 - RNA, 22 nt, Human
ucugcuggugucauuuuugcua

SEQ ID NO: 80763 - RNA, 22 nt, Human
uggaagaaaugguugagccaug

SEQ ID NO: 80764 - RNA, 22 nt, Human
ucugcgggccuggcucccagcg

SEQ ID NO: 80765 - RNA, 19 nt, Human
uggaagugauaguauagua

SEQ ID NO: 80766 - RNA, 22 nt, Human
uggaagucuucucucccaugga

SEQ ID NO: 80767 - RNA, 22 nt, Human
ucuguucacaauuacacacacu

SEQ ID NO: 80768 - RNA, 22 nt, Human
ucuguuauaaaucacacugcau

SEQ ID NO: 80769 - RNA, 22 nt, Human
ucuguguguguggcuaaacaag

SEQ ID NO: 80770 - RNA, 22 nt, Human
ucuguuuuuaucuauucuguua

SEQ ID NO: 80771 - RNA, 22 nt, Human
ucuguuuuucagaccuuuuugg

SEQ ID NO: 80772 - RNA, 22 nt, Human
ucuguuuugugcuuuguuuucu

SEQ ID NO: 80773 - RNA, 22 nt, Human
uggagaaauaacauuuggauuc

SEQ ID NO: 80774 - RNA, 22 nt, Human
ucuguaguaugguacuuauuua

SEQ ID NO: 80775 - RNA, 22 nt, Human
ucuguagucuuggagccgcaca

SEQ ID NO: 80776 - RNA, 22 nt, Human
ucuguagcuaauucucuuuaaa

SEQ ID NO: 80777 - RNA, 22 nt, Human
ucuguaauccacacagguggau

SEQ ID NO: 80778 - RNA, 22 nt, Human
uggagucagaaugcgacaggcc

SEQ ID NO: 80779 - RNA, 22 nt, Human
uggaguagaagggcuccuggaa

SEQ ID NO: 80780 - RNA, 20 nt, Human
ucuguggcagguggcgcuug

SEQ ID NO: 80781 - RNA, 22 nt, Human
uggcaucucggugcugguucuu

SEQ ID NO: 80782 - RNA, 22 nt, Human
uggcaucuggugauauggacua

SEQ ID NO: 80783 - RNA, 22 nt, Human
ucuugccuuuucuagcuucuag

SEQ ID NO: 80784 - RNA, 22 nt, Human
uggcauuuuguagcuguguauc

SEQ ID NO: 80785 - RNA, 22 nt, Human
uggccaaauuggccugauguau

SEQ ID NO: 80786 - RNA, 22 nt, Human
uggccgaugagcaugcgcugau

SEQ ID NO: 80787 - RNA, 22 nt, Human
ucuuuaucugugagcagucucc

SEQ ID NO: 80788 - RNA, 22 nt, Human
ucuuuaaggggccuuuguguca

SEQ ID NO: 80789 - RNA, 22 nt, Human
uggcuacauuuauacucucauu

SEQ ID NO: 80790 - RNA, 19 nt, Human
ucuuccaucuauccuccuc

SEQ ID NO: 80791 - RNA, 22 nt, Human
ucuuccaaacaaaaaucugugu

SEQ ID NO: 80792 - RNA, 22 nt, Human
ucuucauuucuggggaauuggc

SEQ ID NO: 80793 - RNA, 22 nt, Human
ucuucuuacauuaaguugaaac

SEQ ID NO: 80794 - RNA, 22 nt, Human
uggcagugggaagcuggaaguc

SEQ ID NO: 80795 - RNA, 22 nt, Human
ucuuccucuccuggggcauuug

SEQ ID NO: 80796 - RNA, 22 nt, Human
ucuuccuuacucuggauguuau

SEQ ID NO: 80797 - RNA, 22 nt, Human
uggcaacucaauuucuacaaga

SEQ ID NO: 80798 - RNA, 22 nt, Human
uggcaagcuguuggcagauagc

SEQ ID NO: 80799 - RNA, 20 nt, Human
ucuucagcuccaagucuggc

SEQ ID NO: 80800 - RNA, 22 nt, Human
ucuucagacuguuguucuuuug

SEQ ID NO: 80801 - RNA, 22 nt, Human
ucuucaaauacagucauauuga

SEQ ID NO: 80802 - RNA, 22 nt, Human
ucuucacagaugcauauacuuc

SEQ ID NO: 80803 - RNA, 22 nt, Human
ugcuucuuuccuuggugacuuc

SEQ ID NO: 80804 - RNA, 22 nt, Human
ugcuucuuuaggauguaguuau

SEQ ID NO: 80805 - RNA, 22 nt, Human
ucucuccauguuuucuguccag

SEQ ID NO: 80806 - RNA, 21 nt, Human
ucucuaucguauaccagccgg

SEQ ID NO: 80807 - RNA, 20 nt, Human
ucucucacccuugcugugca

SEQ ID NO: 80808 - RNA, 22 nt, Human
ucucuagcuuccuuaggaacac

SEQ ID NO: 80809 - RNA, 22 nt, Human
ucucuagaggaauuguucuagg

SEQ ID NO: 80810 - RNA, 22 nt, Human
ugcuucuuugggggugaagaga

SEQ ID NO: 80811 - RNA, 22 nt, Human
ucuccuuuacuggcuccuuuug

SEQ ID NO: 80812 - RNA, 22 nt, Human
ucuccuuugaaaguuaggacug

SEQ ID NO: 80813 - RNA, 17 nt, Human
ucuccuggcucuaucag

SEQ ID NO: 80814 - RNA, 20 nt, Human
ucucuaacaugaaugcuauc

SEQ ID NO: 80815 - RNA, 22 nt, Human
ucucuacugcuucugugaguga

SEQ ID NO: 80816 - RNA, 22 nt, Human
ucucuacuuggcuuguguucac

SEQ ID NO: 80817 - RNA, 22 nt, Human
ugcuuaucuccuuaguuuuugc

SEQ ID NO: 80818 - RNA, 22 nt, Human
ucucugaggacagaaaguuugu

SEQ ID NO: 80819 - RNA, 22 nt, Human
ucucuggacggacauuuaaggu

SEQ ID NO: 80820 - RNA, 22 nt, Human
ugcuuggagaaucagucccagc

SEQ ID NO: 80821 - RNA, 22 nt, Human
ugcuugcuaucuaaguguuuca

SEQ ID NO: 80822 - RNA, 22 nt, Human
ugcuuguuuguuuucuuccauu

SEQ ID NO: 80823 - RNA, 22 nt, Human
ugcuuuaccuuccauuuaagga

SEQ ID NO: 80824 - RNA, 22 nt, Human
ucucugugaauggcgucaccug

SEQ ID NO: 80825 - RNA, 22 nt, Human
ugcuuuauucgacaucugguag

SEQ ID NO: 80826 - RNA, 22 nt, Human
ugcuuucagauaucuguuucaa

SEQ ID NO: 80827 - RNA, 22 nt, Human
ucugaagagaacucuuaguguu

SEQ ID NO: 80828 - RNA, 22 nt, Human
ugcuuuggcccaacauugaugc

SEQ ID NO: 80829 - RNA, 22 nt, Human
ugcuuuuguaucagaguauuca

SEQ ID NO: 80830 - RNA, 21 nt, Human
ugcuuuuguugucagcugcug

SEQ ID NO: 80831 - RNA, 22 nt, Human
ugcuuuuggcagcaguguuuau

SEQ ID NO: 80832 - RNA, 22 nt, Human
ucugaccccccuugccuccacu

SEQ ID NO: 80833 - RNA, 22 nt, Human
uggaaaagaugucuuccugaau

SEQ ID NO: 80834 - RNA, 22 nt, Human
uggaaaauuuagaaagauuuau

SEQ ID NO: 80835 - RNA, 22 nt, Human
ucugaguuaaaauuccagaggu

SEQ ID NO: 80836 - RNA, 22 nt, Human
ucugagcaggaaagagcagaga

SEQ ID NO: 80837 - RNA, 22 nt, Human
ucugacugucccguagaggaac

SEQ ID NO: 80838 - RNA, 22 nt, Human
ugcugcucuucaccauggccuc

SEQ ID NO: 80839 - RNA, 21 nt, Human
ucucauuuuaacacagaguug

SEQ ID NO: 80840 - RNA, 20 nt, Human
ucucauuuugauuucgcauu

SEQ ID NO: 80841 - RNA, 22 nt, Human
ugcuggaguggcacuguguggc

SEQ ID NO: 80842 - RNA, 22 nt, Human
ugcuguacaagacccucuguuu

SEQ ID NO: 80843 - RNA, 22 nt, Human
ucucccuggccagcccuuuccc

SEQ ID NO: 80844 - RNA, 22 nt, Human
ucucccaaaucuuucuagcaca

SEQ ID NO: 80845 - RNA, 22 nt, Human
ugcugugcuggcggcagaggcc

SEQ ID NO: 80846 - RNA, 20 nt, Human
ugcuguggguaagcuuuaua

SEQ ID NO: 80847 - RNA, 20 nt, Human
ugcugugugucuacuguggg

SEQ ID NO: 80848 - RNA, 22 nt, Human
ucuccucuauuucuguauguau

SEQ ID NO: 80849 - RNA, 22 nt, Human
ucuccugacaccucuugugggg

SEQ ID NO: 80850 - RNA, 22 nt, Human
ucuaugcuacguuccucugaaa

SEQ ID NO: 80851 - RNA, 22 nt, Human
ucucaaagagcuacuggucuau

SEQ ID NO: 80852 - RNA, 22 nt, Human
ucuaguguuaaggcaaaguaaa

SEQ ID NO: 80853 - RNA, 23 nt, Human
ucucacucauucuccucugucca

SEQ ID NO: 80854 - RNA, 22 nt, Human
ucucaccuagucuuggaggucu

SEQ ID NO: 80855 - RNA, 22 nt, Human
ucucaaagguuuuccucuuuuu

SEQ ID NO: 80856 - RNA, 22 nt, Human
ugcugcggcgcaggcacuccag

SEQ ID NO: 80857 - RNA, 22 nt, Human
ugcugcucaagcugcagcaaaa

SEQ ID NO: 80858 - RNA, 22 nt, Human
ugcugcuguuuccuacaucuca

SEQ ID NO: 80859 - RNA, 22 nt, Human
ucucagaagaaacaucugcugg

SEQ ID NO: 80860 - RNA, 20 nt, Human
ucuaggacaggcaaaguaca

SEQ ID NO: 80861 - RNA, 22 nt, Human
ucgcuguguccuuuucacuuau

SEQ ID NO: 80862 - RNA, 22 nt, Human
ugccuaaaccauuccccuuccu

SEQ ID NO: 80863 - RNA, 22 nt, Human
ugccuaguuuaaaucauuuucu

SEQ ID NO: 80864 - RNA, 22 nt, Human
ugccucucuggaucugcuguga

SEQ ID NO: 80865 - RNA, 22 nt, Human
uccuugaauugcguccacaaga

SEQ ID NO: 80866 - RNA, 19 nt, Human
uccuugacuguauucagag

SEQ ID NO: 80867 - RNA, 22 nt, Human
uccuuggagaaucuuguuuuac

SEQ ID NO: 80868 - RNA, 22 nt, Human
uccuggccucugagucaagaac

SEQ ID NO: 80869 - RNA, 22 nt, Human
uccugcccuguccuugccucug

SEQ ID NO: 80870 - RNA, 22 nt, Human
ucgagcacaccagacuugcaga

SEQ ID NO: 80871 - RNA, 22 nt, Human
ugcgccuccugcugccugcccu

SEQ ID NO: 80872 - RNA, 22 nt, Human
ugccucuccaagcuuccuaagg

SEQ ID NO: 80873 - RNA, 22 nt, Human
ugccuucugccaaggacggugc

SEQ ID NO: 80874 - RNA, 21 nt, Human
ugccuggccuuugcuuuuccu

SEQ ID NO: 80875 - RNA, 22 nt, Human
uccuuuauuuaugggcagugua

SEQ ID NO: 80876 - RNA, 22 nt, Human
uccuuucaaauuuauuugacau

SEQ ID NO: 80877 - RNA, 22 nt, Human
uccucaucuuaucaucccaaga

SEQ ID NO: 80878 - RNA, 22 nt, Human
ugccaacaggcuugccugaugu

SEQ ID NO: 80879 - RNA, 22 nt, Human
uccuccuggagacuuucucucu

SEQ ID NO: 80880 - RNA, 22 nt, Human
ugcccagagccucuuaccucca

SEQ ID NO: 80881 - RNA, 22 nt, Human
uccuccuuccugccccuaacuu

SEQ ID NO: 80882 - RNA, 22 nt, Human
ugcaucccugaggcauuauccu

SEQ ID NO: 80883 - RNA, 22 nt, Human
ugcaucauuaagguacaguugg

SEQ ID NO: 80884 - RNA, 22 nt, Human
ugcauaagguuaaauuagcaga

SEQ ID NO: 80885 - RNA, 19 nt, Human
uccuacaugagacagagag

SEQ ID NO: 80886 - RNA, 22 nt, Human
uccucagagacaaguugagagg

SEQ ID NO: 80887 - RNA, 22 nt, Human
uccucaaauccuagccucaucg

SEQ ID NO: 80888 - RNA, 22 nt, Human
ugcauguuauuguggcaagaau

SEQ ID NO: 80889 - RNA, 17 nt, Human
ugcaugcgucugugaua

SEQ ID NO: 80890 - RNA, 22 nt, Human
ugcauuguuuauggaauaaaau

SEQ ID NO: 80891 - RNA, 22 nt, Human
ugcauuuuuaauuuggaaaaaa

SEQ ID NO: 80892 - RNA, 22 nt, Human
ugcauuuucuaccacacccacu

SEQ ID NO: 80893 - RNA, 22 nt, Human
ucccugcugggcgaucuucucu

SEQ ID NO: 80894 - RNA, 21 nt, Human
ucccugcagccccaggccccc

SEQ ID NO: 80895 - RNA, 22 nt, Human
ucccugagcucacauggcagga

SEQ ID NO: 80896 - RNA, 22 nt, Human
ugcaggagaaaguacggagcgu

SEQ ID NO: 80897 - RNA, 22 nt, Human
ugcaggagcccaggaauacuau

SEQ ID NO: 80898 - RNA, 22 nt, Human
ugcagugaugcuucuggcucag

SEQ ID NO: 80899 - RNA, 22 nt, Human
ugcaggucuggacccccacuuu

SEQ ID NO: 80900 - RNA, 22 nt, Human
ugcacagagggaggcauaaaau

SEQ ID NO: 80901 - RNA, 21 nt, Human
uccccugugccuggcauacag

SEQ ID NO: 80902 - RNA, 22 nt, Human
ucccucuccugucugcuucuuu

SEQ ID NO: 80903 - RNA, 22 nt, Human
ucccucacacagcugggagaac

SEQ ID NO: 80904 - RNA, 22 nt, Human
uccagccauaucuuguagcccu

SEQ ID NO: 80905 - RNA, 22 nt, Human
uccagcugugcuccaggaggug

SEQ ID NO: 80906 - RNA, 21 nt, Human
uccaggagcacgggacuagga

SEQ ID NO: 80907 - RNA, 22 nt, Human
ugauuuagguauuuucuuuugu

SEQ ID NO: 80908 - RNA, 22 nt, Human
ugagagguagaacuuguagugu

SEQ ID NO: 80909 - RNA, 22 nt, Human
ugagaggaagggaaagaugauu

SEQ ID NO: 80910 - RNA, 22 nt, Human
ugagagaauuacuaaagggcuu

SEQ ID NO: 80911 - RNA, 22 nt, Human
ugagagaggugaaaugacuuuc

SEQ ID NO: 80912 - RNA, 22 nt, Human
ucagucauguuuaccagacgua

SEQ ID NO: 80913 - RNA, 22 nt, Human
ugagacuuggggggcugagggc

SEQ ID NO: 80914 - RNA, 22 nt, Human
ucaguauaugaauuugggggua

SEQ ID NO: 80915 - RNA, 22 nt, Human
ugagacugaguuugguuuuguu

SEQ ID NO: 80916 - RNA, 22 nt, Human
ugagaagucagucuauugugaa

SEQ ID NO: 80917 - RNA, 22 nt, Human
ucuucaugaaauugauugcuua

SEQ ID NO: 80918 - RNA, 22 nt, Human
ucuucaguaaucgacauuccac

SEQ ID NO: 80919 - RNA, 22 nt, Human
ucuucaggaaaaccaaaguugu

SEQ ID NO: 80920 - RNA, 18 nt, Human
ucagggaaacuuugccug

SEQ ID NO: 80921 - RNA, 22 nt, Human
uauucuucaacuuuucuccucu

SEQ ID NO: 80922 - RNA, 22 nt, Human
ucuuccacuugaaccuucuguc

SEQ ID NO: 80923 - RNA, 22 nt, Human
ugagaacacuuuucucuuugcu

SEQ ID NO: 80924 - RNA, 22 nt, Human
ucagguagugguuaaguucugu

SEQ ID NO: 80925 - RNA, 22 nt, Human
ugagaaauauacaccagacaca

SEQ ID NO: 80926 - RNA, 22 nt, Human
ucaguggaacacacagaguggg

SEQ ID NO: 80927 - RNA, 22 nt, Human
ugagauguaauguaguacuuug

SEQ ID NO: 80928 - RNA, 22 nt, Human
ucagucugguggaugcucauug

SEQ ID NO: 80929 - RNA, 22 nt, Human
ucagucuucaggacuaugaaaa

SEQ ID NO: 80930 - RNA, 22 nt, Human
ucagugagauuuuuagcaguag

SEQ ID NO: 80931 - RNA, 22 nt, Human
ucaguugauggcaguuaauguc

SEQ ID NO: 80932 - RNA, 22 nt, Human
ucaguugagguggucuauugcg

SEQ ID NO: 80933 - RNA, 22 nt, Human
ugaggaugagaaggaagagaag

SEQ ID NO: 80934 - RNA, 22 nt, Human
ugaggaugaggaagaagaagaa

SEQ ID NO: 80935 - RNA, 22 nt, Human
ucauaaaaucaguguccauugu

SEQ ID NO: 80936 - RNA, 22 nt, Human
ucauaaaggugccacucaguuu

SEQ ID NO: 80937 - RNA, 21 nt, Human
ucauccagguccugcuucuuc

SEQ ID NO: 80938 - RNA, 22 nt, Human
ucaugcagaguagaaagggcaa

SEQ ID NO: 80939 - RNA, 22 nt, Human
ucaugagagaaaacgugcuucu

SEQ ID NO: 80940 - RNA, 22 nt, Human
ucauguauucugggcaggagau

SEQ ID NO: 80941 - RNA, 22 nt, Human
ucaugggcaaacuuggggauca

SEQ ID NO: 80942 - RNA, 22 nt, Human
ucaucuuucuuuauggaaauac

SEQ ID NO: 80943 - RNA, 22 nt, Human
ucaucuauaaguagcaucuggg

SEQ ID NO: 80944 - RNA, 22 nt, Human
ugauaugguaauaagauauucu

SEQ ID NO: 80945 - RNA, 22 nt, Human
ugaucauugaacaucgaguuaa

SEQ ID NO: 80946 - RNA, 22 nt, Human
ugaugaugauacauuucuucag

SEQ ID NO: 80947 - RNA, 22 nt, Human
ugaugaugaagaaauauuauca

SEQ ID NO: 80948 - RNA, 19 nt, Human
uccaaaauacuuguuacug

SEQ ID NO: 80949 - RNA, 22 nt, Human
ucauuuuaucaggaauggaauc

SEQ ID NO: 80950 - RNA, 18 nt, Human
ugauggcuaagagccggg

SEQ ID NO: 80951 - RNA, 22 nt, Human
ugauggaucuguuggcggguuu

SEQ ID NO: 80952 - RNA, 22 nt, Human
ugauguuucugaagggguuacu

SEQ ID NO: 80953 - RNA, 22 nt, Human
ucauuagaccucucugguucag

SEQ ID NO: 80954 - RNA, 22 nt, Human
uccaaggacucuugucagcugu

SEQ ID NO: 80955 - RNA, 22 nt, Human
ugauguauaaaaagagugaaau

SEQ ID NO: 80956 - RNA, 22 nt, Human
uccaaggacuaaauucuagauu

SEQ ID NO: 80957 - RNA, 20 nt, Human
ugauuauuccaacaagaaug

SEQ ID NO: 80958 - RNA, 22 nt, Human
ugauucacgcuucucuuuaaac

SEQ ID NO: 80959 - RNA, 22 nt, Human
ugauuccugugcuuauuccagu

SEQ ID NO: 80960 - RNA, 22 nt, Human
ugauucuuugaccaaaaaauug

SEQ ID NO: 80961 - RNA, 22 nt, Human
ugauugauaaugaagacaguca

SEQ ID NO: 80962 - RNA, 22 nt, Human
ugauugcucgacacucugcuug

SEQ ID NO: 80963 - RNA, 22 nt, Human
ugauugcucagcuagccucuuu

SEQ ID NO: 80964 - RNA, 23 nt, Human
ucucaccaggauaugacugucac

SEQ ID NO: 80965 - RNA, 21 nt, Human
ucucaagguaacauuuaagau

SEQ ID NO: 80966 - RNA, 22 nt, Human
ucucagaaaugacaggagguac

SEQ ID NO: 80967 - RNA, 22 nt, Human
ucucacucuuccccaugucaga

SEQ ID NO: 80968 - RNA, 22 nt, Human
ucuagggcaguacaaauucaag

SEQ ID NO: 80969 - RNA, 22 nt, Human
ucuauauucuauguucuucuuu

SEQ ID NO: 80970 - RNA, 22 nt, Human
ucuagguuguaauuuguaguaa

SEQ ID NO: 80971 - RNA, 22 nt, Human
ucuauuguuauccuuuccauuu

SEQ ID NO: 80972 - RNA, 22 nt, Human
ucuauuauauuuacacgagagu

SEQ ID NO: 80973 - RNA, 22 nt, Human
uagcugucauuggaucagaagg

SEQ ID NO: 80974 - RNA, 19 nt, Human
uagcuguucuugaguguga

SEQ ID NO: 80975 - RNA, 22 nt, Human
uaggaagagauuuucacauggc

SEQ ID NO: 80976 - RNA, 21 nt, Human
uaggaacuguucugagugguc

SEQ ID NO: 80977 - RNA, 22 nt, Human
uaggagcagauggcagcaggug

SEQ ID NO: 80978 - RNA, 22 nt, Human
ucuaggcugugugugggcaggg

SEQ ID NO: 80979 - RNA, 22 nt, Human
ucuaggaguugauaaaagggcu

SEQ ID NO: 80980 - RNA, 22 nt, Human
uagugucuuccaggacauggua

SEQ ID NO: 80981 - RNA, 22 nt, Human
uauaagaaaagucauuaucaaa

SEQ ID NO: 80982 - RNA, 22 nt, Human
ucuccccucuggucugggcucu

SEQ ID NO: 80983 - RNA, 22 nt, Human
uauagccuuacaagauauuaua

SEQ ID NO: 80984 - RNA, 22 nt, Human
ucuccuuuggggccucaggguu

SEQ ID NO: 80985 - RNA, 22 nt, Human
ucuccuaauuacauacuugauu

SEQ ID NO: 80986 - RNA, 22 nt, Human
ucuccucucugaucuugcuccg

SEQ ID NO: 80987 - RNA, 22 nt, Human
ucuccucuuaaugcacguuucc

SEQ ID NO: 80988 - RNA, 22 nt, Human
uauaggaugaugucauguugcu

SEQ ID NO: 80989 - RNA, 22 nt, Human
ucucauugugcuuuuuguacug

SEQ ID NO: 80990 - RNA, 22 nt, Human
ucuccaccccugggaggcagaa

SEQ ID NO: 80991 - RNA, 22 nt, Human
uauaaagaccuuauccuucaua

SEQ ID NO: 80992 - RNA, 22 nt, Human
ucucauacguuuccagguguca

SEQ ID NO: 80993 - RNA, 23 nt, Human
uaguuucaucuccacccugcccu

SEQ ID NO: 80994 - RNA, 18 nt, Human
uauaaacacacuuagguu

SEQ ID NO: 80995 - RNA, 22 nt, Human
uaguuuucuuuuguguuauucu

SEQ ID NO: 80996 - RNA, 22 nt, Human
ucucucagauuguuuccauuuu

SEQ ID NO: 80997 - RNA, 22 nt, Human
ucucuggcuuuuuuuccauuuu

SEQ ID NO: 80998 - RNA, 22 nt, Human
uauaugcagauuuucaucaucg

SEQ ID NO: 80999 - RNA, 19 nt, Human
ucucugguggcuccaucag

SEQ ID NO: 81000 - RNA, 22 nt, Human
ucucugagggugaucaugagaa

SEQ ID NO: 81001 - RNA, 22 nt, Human
uauauacacgcacauauacaua

SEQ ID NO: 81002 - RNA, 22 nt, Human
ucucucguuuuuugcagauaaa

SEQ ID NO: 81003 - RNA, 22 nt, Human
ucucucucucuuccagcauguu

SEQ ID NO: 81004 - RNA, 22 nt, Human
ucucucugcuguccagcguuau

SEQ ID NO: 81005 - RNA, 22 nt, Human
ucucugaggaagcgaucuuuag

SEQ ID NO: 81006 - RNA, 22 nt, Human
ucugaaauuuuaguuauagaaa

SEQ ID NO: 81007 - RNA, 22 nt, Human
ucucuuuuuuuaaaacucuaug

SEQ ID NO: 81008 - RNA, 20 nt, Human
ucucuuuuucuucuuuucuc

SEQ ID NO: 81009 - RNA, 22 nt, Human
ucugaauauguuuaucaucucu

SEQ ID NO: 81010 - RNA, 18 nt, Human
ucugaaggaaugauucca

SEQ ID NO: 81011 - RNA, 22 nt, Human
ucugaaaggagaguagggcaga

SEQ ID NO: 81012 - RNA, 22 nt, Human
ucucuucacuuguaugcuauca

SEQ ID NO: 81013 - RNA, 22 nt, Human
ucucuugcuauugcgaacaggu

SEQ ID NO: 81014 - RNA, 22 nt, Human
uauccauaccuucaaguuugcu

SEQ ID NO: 81015 - RNA, 22 nt, Human
uaucuagguacacaucuccucu

SEQ ID NO: 81016 - RNA, 22 nt, Human
uaucuucaauagcccagaugug

SEQ ID NO: 81017 - RNA, 22 nt, Human
uaucuuugccuuggguuuuguu

SEQ ID NO: 81018 - RNA, 22 nt, Human
uaucuguauuguagaacuguug

SEQ ID NO: 81019 - RNA, 22 nt, Human
ucugagagcuguagaagccuau

SEQ ID NO: 81020 - RNA, 22 nt, Human
uaucuuagaagaaaugggucca

SEQ ID NO: 81021 - RNA, 22 nt, Human
ucugagucgcucccuggaucca

SEQ ID NO: 81022 - RNA, 21 nt, Human
ucugaggagaaacucuuggug

SEQ ID NO: 81023 - RNA, 22 nt, Human
uauguucaauaccagguucuuu

SEQ ID NO: 81024 - RNA, 22 nt, Human
ucuggucugccgagauccauuu

SEQ ID NO: 81025 - RNA, 21 nt, Human
ucuggggacaagguccaggaa

SEQ ID NO: 81026 - RNA, 22 nt, Human
ucuguagcuuuagaggacagga

SEQ ID NO: 81027 - RNA, 22 nt, Human
ucuguauuuuuuacacacaugc

SEQ ID NO: 81028 - RNA, 22 nt, Human
ucuguaacaucaguguaauuuu

SEQ ID NO: 81029 - RNA, 22 nt, Human
ucugguuccugcauucauucaa

SEQ ID NO: 81030 - RNA, 22 nt, Human
ucuguaaaugcaaguuuuccuc

SEQ ID NO: 81031 - RNA, 22 nt, Human
ucuggugcacucugauauuuga

SEQ ID NO: 81032 - RNA, 19 nt, Human
ucuguggagcucagaguag

SEQ ID NO: 81033 - RNA, 22 nt, Human
ucugugcuggacugauuucaua

SEQ ID NO: 81034 - RNA, 22 nt, Human
uauuagggaacugcaagacuaa

SEQ ID NO: 81035 - RNA, 22 nt, Human
ucugucaguguccucguguggu

SEQ ID NO: 81036 - RNA, 22 nt, Human
ucugucuaaccauauuuuccua

SEQ ID NO: 81037 - RNA, 22 nt, Human
uauguuuugcaaauaucaaaca

SEQ ID NO: 81038 - RNA, 22 nt, Human
uauuaauugugguuauuguauu

SEQ ID NO: 81039 - RNA, 22 nt, Human
uauguuugcaguucuaggucuu

SEQ ID NO: 81040 - RNA, 22 nt, Human
uauuacugccacaucauuaggu

SEQ ID NO: 81041 - RNA, 22 nt, Human
ucuuauugugaugaugaagaac

SEQ ID NO: 81042 - RNA, 22 nt, Human
ucuuaaguuccaggugugcuca

SEQ ID NO: 81043 - RNA, 22 nt, Human
ucuuacuguccucuguuuuucu

SEQ ID NO: 81044 - RNA, 21 nt, Human
ucuuauacagcaauagaucug

SEQ ID NO: 81045 - RNA, 22 nt, Human
ucuguuucaggggucuggaaug

SEQ ID NO: 81046 - RNA, 22 nt, Human
ucuuaaauaugaaaaggauuau

SEQ ID NO: 81047 - RNA, 22 nt, Human
ucuguuuuccaggaaucucaua

SEQ ID NO: 81048 - RNA, 22 nt, Human
ucuguuuacaugucagcagcaa

SEQ ID NO: 81049 - RNA, 22 nt, Human
ucuguucucuuguucugacggu

SEQ ID NO: 81050 - RNA, 22 nt, Human
uauucagugcugguucuuuuuc

SEQ ID NO: 81051 - RNA, 22 nt, Human
uauuaugguuguagguuaacaa

SEQ ID NO: 81052 - RNA, 22 nt, Human
uauuauggguuuuuguguaaau

SEQ ID NO: 81053 - RNA, 22 nt, Human
uauucauuuuuauuugugacug

SEQ ID NO: 81054 - RNA, 22 nt, Human
uauucccacuccucagcaauuu

SEQ ID NO: 81055 - RNA, 18 nt, Human
uauuccucuuccucuauc

SEQ ID NO: 81056 - RNA, 22 nt, Human
uaugggcaagagauaggugguc

SEQ ID NO: 81057 - RNA, 22 nt, Human
uauggacagcuuucuuuguguu

SEQ ID NO: 81058 - RNA, 22 nt, Human
uaugcuguauucuguauguuag

SEQ ID NO: 81059 - RNA, 22 nt, Human
uauguaacaccauuuacaaagu

SEQ ID NO: 81060 - RNA, 22 nt, Human
uaugguuucuccugcagauuug

SEQ ID NO: 81061 - RNA, 22 nt, Human
ucuggaaauggaaguaacuaug

SEQ ID NO: 81062 - RNA, 22 nt, Human
uauguauguauguauguauaug

SEQ ID NO: 81063 - RNA, 22 nt, Human
ucugagugacguccugacagga

SEQ ID NO: 81064 - RNA, 19 nt, Human
uaugaaguugauaaaaguu

SEQ ID NO: 81065 - RNA, 22 nt, Human
uaugaggagaacauuccugaac

SEQ ID NO: 81066 - RNA, 19 nt, Human
uaugacaaguacuaguucu

SEQ ID NO: 81067 - RNA, 22 nt, Human
ucugagugggaacucucaugac

SEQ ID NO: 81068 - RNA, 22 nt, Human
ucugauucauucugguaaaugg

SEQ ID NO: 81069 - RNA, 22 nt, Human
uaugagugccaaguuaccuggg

SEQ ID NO: 81070 - RNA, 22 nt, Human
uaugcuagauggaaaaauauug

SEQ ID NO: 81071 - RNA, 22 nt, Human
uaugccaaaaauaaguuuuaug

SEQ ID NO: 81072 - RNA, 21 nt, Human
ucugccaguuucucuuacuuu

SEQ ID NO: 81073 - RNA, 22 nt, Human
uaugauuuucaugguagaguua

SEQ ID NO: 81074 - RNA, 22 nt, Human
uaugcacacguguccaugugca

SEQ ID NO: 81075 - RNA, 22 nt, Human
uaugcagauaguuugccauuca

SEQ ID NO: 81076 - RNA, 23 nt, Human
uccaagagagauuuuaaauuucu

SEQ ID NO: 81077 - RNA, 22 nt, Human
uccacagcagagcacgguaccu

SEQ ID NO: 81078 - RNA, 22 nt, Human
uccacaaagucuaugagaguug

SEQ ID NO: 81079 - RNA, 22 nt, Human
uacaggaggaugugcagccagg

SEQ ID NO: 81080 - RNA, 22 nt, Human
uacagcgaaaauuuagcuugau

SEQ ID NO: 81081 - RNA, 22 nt, Human
uccaggagucagacagauggug

SEQ ID NO: 81082 - RNA, 22 nt, Human
uccaugaguuuuuuaguuucac

SEQ ID NO: 81083 - RNA, 22 nt, Human
uccaugauauauaugugcacau

SEQ ID NO: 81084 - RNA, 22 nt, Human
guucuaguauuugccuuaggau

SEQ ID NO: 81085 - RNA, 22 nt, Human
uacuuccuucugcccccucuga

SEQ ID NO: 81086 - RNA, 22 nt, Human
uacuugucuuuauuuuaaugcu

SEQ ID NO: 81087 - RNA, 22 nt, Human
ucccucguuucgaucuuuagaa

SEQ ID NO: 81088 - RNA, 22 nt, Human
ucccugagagacuucuuuggcu

SEQ ID NO: 81089 - RNA, 22 nt, Human
ucccugcaggcauguacucuga

SEQ ID NO: 81090 - RNA, 22 nt, Human
uagaccuccagcggaggagauu

SEQ ID NO: 81091 - RNA, 22 nt, Human
uagaggauucuaaaggaagcug

SEQ ID NO: 81092 - RNA, 22 nt, Human
uagagugcugucaaagacuugu

SEQ ID NO: 81093 - RNA, 22 nt, Human
uagaagaacaugucaaacuaua

SEQ ID NO: 81094 - RNA, 22 nt, Human
uagaacaaacagcauguuugau

SEQ ID NO: 81095 - RNA, 22 nt, Human
ucccuguuuccugcgcuccuuc

SEQ ID NO: 81096 - RNA, 22 nt, Human
ucccuguggauuaaggagaugu

SEQ ID NO: 81097 - RNA, 22 nt, Human
uacuuuuuucacuucuagcccc

SEQ ID NO: 81098 - RNA, 22 nt, Human
uagaagagcaugucaaacuaua

SEQ ID NO: 81099 - RNA, 22 nt, Human
ucccuuuggagguguccagcac

SEQ ID NO: 81100 - RNA, 22 nt, Human
ucccuuaacucaaguggugcuc

SEQ ID NO: 81101 - RNA, 23 nt, Human
ucccuuuguucuugcuaggaugu

SEQ ID NO: 81102 - RNA, 22 nt, Human
uagauuccaaaauaguuugguu

SEQ ID NO: 81103 - RNA, 22 nt, Human
uagaugcugagcuuaagagaau

SEQ ID NO: 81104 - RNA, 20 nt, Human
uccugaaauuacgugauuca

SEQ ID NO: 81105 - RNA, 22 nt, Human
uccugaaugguguaauagguuu

SEQ ID NO: 81106 - RNA, 22 nt, Human
uagcagcacuauuuguuguagu

SEQ ID NO: 81107 - RNA, 22 nt, Human
uagcagaacaauagucaaugau

SEQ ID NO: 81108 - RNA, 22 nt, Human
uccuggaagggaugguugagga

SEQ ID NO: 81109 - RNA, 22 nt, Human
uccuggccuuggggagagaagu

SEQ ID NO: 81110 - RNA, 22 nt, Human
uccugcucucuccauuccuucc

SEQ ID NO: 81111 - RNA, 22 nt, Human
uagcucuuaccagugaaguuug

SEQ ID NO: 81112 - RNA, 22 nt, Human
uagcuagacacucagggccuca

SEQ ID NO: 81113 - RNA, 22 nt, Human
uagcucuaaggagaaucccucu

SEQ ID NO: 81114 - RNA, 22 nt, Human
uccuugaccuccugacaguaac

SEQ ID NO: 81115 - RNA, 22 nt, Human
uccuuccucuuucaaauuuguu

SEQ ID NO: 81116 - RNA, 22 nt, Human
uaagcuauuccugaagaagguu

SEQ ID NO: 81117 - RNA, 21 nt, Human
uaagcuaaacauucaguuaac

SEQ ID NO: 81118 - RNA, 22 nt, Human
ucaguuguuggaaguagaugua

SEQ ID NO: 81119 - RNA, 22 nt, Human
ucaguuuaauuggaucuuuuuc

SEQ ID NO: 81120 - RNA, 22 nt, Human
ucaugucagugucugugugugg

SEQ ID NO: 81121 - RNA, 22 nt, Human
ucauggucucccagcccccucu

SEQ ID NO: 81122 - RNA, 22 nt, Human
ucauggcucuaaagacauagau

SEQ ID NO: 81123 - RNA, 22 nt, Human
ucauuauuuggaauaugggacu

SEQ ID NO: 81124 - RNA, 22 nt, Human
uaaggagagaauuuagagguuu

SEQ ID NO: 81125 - RNA, 22 nt, Human
ucaugcagauaagaauaaguaa

SEQ ID NO: 81126 - RNA, 22 nt, Human
uaagugcuagaauuccagguuu

SEQ ID NO: 81127 - RNA, 20 nt, Human
ucauucagaaucaguaugca

SEQ ID NO: 81128 - RNA, 22 nt, Human
uacaaaugaucaucucuuugaa

SEQ ID NO: 81129 - RNA, 22 nt, Human
ucauuguuuacugucuuuuuuc

SEQ ID NO: 81130 - RNA, 22 nt, Human
uacaaaauucaaauaauguuug

SEQ ID NO: 81131 - RNA, 22 nt, Human
uaauuucauuuugcaaugaucu

SEQ ID NO: 81132 - RNA, 22 nt, Human
uaauuugauuucucccuggaaa

SEQ ID NO: 81133 - RNA, 17 nt, Human
ucauuucaguaaaucca

SEQ ID NO: 81134 - RNA, 22 nt, Human
ucauuuaauuuggaacucagag

SEQ ID NO: 81135 - RNA, 17 nt, Human
ucauuuauccucuuugg

SEQ ID NO: 81136 - RNA, 22 nt, Human
ucauuuaucgcugccuuuuaaa

SEQ ID NO: 81137 - RNA, 22 nt, Human
uccaagacagauaccuagaaga

SEQ ID NO: 81138 - RNA, 18 nt, Human
uacagauguaugucuaca

SEQ ID NO: 81139 - RNA, 22 nt, Human
uccaaauagcuggaugauggug

SEQ ID NO: 81140 - RNA, 22 nt, Human
ucaggcuagcccagugcuuggg

SEQ ID NO: 81141 - RNA, 20 nt, Human
ucaggguuucccauucuugg

SEQ ID NO: 81142 - RNA, 22 nt, Human
uaaaggaccuguacuagguuua

SEQ ID NO: 81143 - RNA, 22 nt, Human
ucaagcacugugcaaugagcuu

SEQ ID NO: 81144 - RNA, 22 nt, Human
uaaaggaguguauaauuguagu

SEQ ID NO: 81145 - RNA, 22 nt, Human
ucaagcuggaaaugaagaaucu

SEQ ID NO: 81146 - RNA, 22 nt, Human
uaaaugaaaugaagugaaagcu

SEQ ID NO: 81147 - RNA, 22 nt, Human
uaaagugaaguucagaauggcu

SEQ ID NO: 81148 - RNA, 22 nt, Human
ucagguuuuuaaggagcuagga

SEQ ID NO: 81149 - RNA, 22 nt, Human
ucaguaagauugauauuucccc

SEQ ID NO: 81150 - RNA, 23 nt, Human
ucagggaucgucagaaaaugaaa

SEQ ID NO: 81151 - RNA, 22 nt, Human
uaaauuagauucccagcgcuau

SEQ ID NO: 81152 - RNA, 22 nt, Human
uaaauuugugaauuagcuauca

SEQ ID NO: 81153 - RNA, 22 nt, Human
uaaauuggaauaaugagaagug

SEQ ID NO: 81154 - RNA, 22 nt, Human
ucagucauacuuuaugauugaa

SEQ ID NO: 81155 - RNA, 22 nt, Human
ucagucugcuauagguauuugu

SEQ ID NO: 81156 - RNA, 22 nt, Human
ucagugauccagauauuugagc

SEQ ID NO: 81157 - RNA, 22 nt, Human
ucagugugacccuucuauuuuu

SEQ ID NO: 81158 - RNA, 22 nt, Human
uaacuuuucuguucaauuuucc

SEQ ID NO: 81159 - RNA, 22 nt, Human
uaacucuagggacucgcccaga

SEQ ID NO: 81160 - RNA, 22 nt, Human
uaacgcaucuggaaacaggaca

SEQ ID NO: 81161 - RNA, 22 nt, Human
uaaccuugaagacugagcugac

SEQ ID NO: 81162 - RNA, 22 nt, Human
uaacauuucggugacaguggga

SEQ ID NO: 81163 - RNA, 22 nt, Human
uaacaguauacuacaucauauu

SEQ ID NO: 81164 - RNA, 22 nt, Human
uaacacauagauauuuuaacuu

SEQ ID NO: 81165 - RNA, 22 nt, Human
uaacaguggucugugguaucug

SEQ ID NO: 81166 - RNA, 22 nt, Human
uagcguaugcugugugaugaau

SEQ ID NO: 81167 - RNA, 21 nt, Human
uagcuugaucauuuuauuucc

SEQ ID NO: 81168 - RNA, 22 nt, Human
uagcuucacuuuuguugaugcg

SEQ ID NO: 81169 - RNA, 20 nt, Human
uagcuucaccuagagauagc

SEQ ID NO: 81170 - RNA, 22 nt, Human
gugcucuagaaauugucagugg

SEQ ID NO: 81171 - RNA, 22 nt, Human
gugcucgagcugugcgcgcugc

SEQ ID NO: 81172 - RNA, 22 nt, Human
gugcugcaaggauggagaggca

SEQ ID NO: 81173 - RNA, 22 nt, Human
uagccucaagagauucagggac

SEQ ID NO: 81174 - RNA, 22 nt, Human
uagaacuguaaauuaucucucc

SEQ ID NO: 81175 - RNA, 22 nt, Human
gugagagugguuuauguccaug

SEQ ID NO: 81176 - RNA, 21 nt, Human
uagaagagggaauuugucuuu

SEQ ID NO: 81177 - RNA, 22 nt, Human
guggaaauaugggcaacaaaga

SEQ ID NO: 81178 - RNA, 22 nt, Human
guggaaggaauuaacagacuag

SEQ ID NO: 81179 - RNA, 22 nt, Human
guggaagauauuucugguccag

SEQ ID NO: 81180 - RNA, 22 nt, Human
guggacagacauaauccuaauu

SEQ ID NO: 81181 - RNA, 22 nt, Human
guggagaaagcuggaaucugag

SEQ ID NO: 81182 - RNA, 22 nt, Human
gugcuggcaaagagaacaucuu

SEQ ID NO: 81183 - RNA, 22 nt, Human
gugcugcaugagcaucacguag

SEQ ID NO: 81184 - RNA, 22 nt, Human
uagcuucccagcuaaccauguc

SEQ ID NO: 81185 - RNA, 22 nt, Human
guggagaugagauauaccccuu

SEQ ID NO: 81186 - RNA, 22 nt, Human
guggauggagcuggaagccauu

SEQ ID NO: 81187 - RNA, 22 nt, Human
guggaggaagaucuuugaugau

SEQ ID NO: 81188 - RNA, 22 nt, Human
guggauuucaggcuccccucag

SEQ ID NO: 81189 - RNA, 22 nt, Human
uaggagccagaauugcauuagu

SEQ ID NO: 81190 - RNA, 22 nt, Human
uaggauauuuuagaaugguaca

SEQ ID NO: 81191 - RNA, 22 nt, Human
uaggauugguguauguagguuu

SEQ ID NO: 81192 - RNA, 22 nt, Human
uaggcauguaaaagugaguucg

SEQ ID NO: 81193 - RNA, 22 nt, Human
uaggccugcugaagagcaagcu

SEQ ID NO: 81194 - RNA, 22 nt, Human
uaggggaagcauagguuuagaa

SEQ ID NO: 81195 - RNA, 22 nt, Human
guggcagguguacagcucagcu

SEQ ID NO: 81196 - RNA, 22 nt, Human
guggcaaguuuucugacaagga

SEQ ID NO: 81197 - RNA, 22 nt, Human
uaguacguuccaaaucacugga

SEQ ID NO: 81198 - RNA, 22 nt, Human
uaguagcuguuguuuuuuaaac

SEQ ID NO: 81199 - RNA, 22 nt, Human
uaggucuuggagguggggcugg

SEQ ID NO: 81200 - RNA, 22 nt, Human
uagguuguaagaggucuuuugu

SEQ ID NO: 81201 - RNA, 22 nt, Human
guggccugacagaucggaacag

SEQ ID NO: 81202 - RNA, 22 nt, Human
guggcuuucuaccauuaaauug

SEQ ID NO: 81203 - RNA, 22 nt, Human
guggcuuauguccagcagauau

SEQ ID NO: 81204 - RNA, 22 nt, Human
gugggccaguuccucacaggua

SEQ ID NO: 81205 - RNA, 22 nt, Human
gugggaguggagcucagcaugu

SEQ ID NO: 81206 - RNA, 22 nt, Human
gugggauaaccugagauaacau

SEQ ID NO: 81207 - RNA, 22 nt, Human
gugggggugaggaauguucuau

SEQ ID NO: 81208 - RNA, 22 nt, Human
uaguauuuguaauuaucaaagc

SEQ ID NO: 81209 - RNA, 22 nt, Human
uaguaugugccuguugucucug

SEQ ID NO: 81210 - RNA, 22 nt, Human
uaguauuguguuguuugacagu

SEQ ID NO: 81211 - RNA, 22 nt, Human
uagucaauuagaaagaggccuu

SEQ ID NO: 81212 - RNA, 23 nt, Human
uaguguuauuaauuaguaaggau

SEQ ID NO: 81213 - RNA, 22 nt, Human
uagugggauuuugaacaaaacc

SEQ ID NO: 81214 - RNA, 22 nt, Human
uagugggguccacuuccuucac

SEQ ID NO: 81215 - RNA, 22 nt, Human
uaguggaaccuucuaaaugacg

SEQ ID NO: 81216 - RNA, 22 nt, Human
gugguggggaguuggauggaag

SEQ ID NO: 81217 - RNA, 22 nt, Human
guggugaacauuugcaucugcu

SEQ ID NO: 81218 - RNA, 22 nt, Human
uaucauuuuacugugacauuuu

SEQ ID NO: 81219 - RNA, 22 nt, Human
uaucauuaggagugcugcucgg

SEQ ID NO: 81220 - RNA, 22 nt, Human
uauccaaaggaacaaucacagc

SEQ ID NO: 81221 - RNA, 22 nt, Human
uaugaaggauacaccucugauu

SEQ ID NO: 81222 - RNA, 22 nt, Human
uaugaaagguuuuuucuugaaa

SEQ ID NO: 81223 - RNA, 22 nt, Human
uaugcauaauuggauaaguaga

SEQ ID NO: 81224 - RNA, 17 nt, Human
gugguguacauuuccau

SEQ ID NO: 81225 - RNA, 20 nt, Human
uaugcgaagccuuucuggac

SEQ ID NO: 81226 - RNA, 22 nt, Human
uaugugaaauggaauauagaaa

SEQ ID NO: 81227 - RNA, 22 nt, Human
uaugucuauugacuuaggauuu

SEQ ID NO: 81228 - RNA, 20 nt, Human
uaugugcaguuugguuuauc

SEQ ID NO: 81229 - RNA, 22 nt, Human
guuaaaaugauuugugauuuau

SEQ ID NO: 81230 - RNA, 22 nt, Human
guuacagagcugcuaugugugc

SEQ ID NO: 81231 - RNA, 22 nt, Human
guuaucauccucagaggcaguu

SEQ ID NO: 81232 - RNA, 22 nt, Human
guguuuugagaggaugguuuua

SEQ ID NO: 81233 - RNA, 22 nt, Human
guguuucccuggcacaagaacc

SEQ ID NO: 81234 - RNA, 23 nt, Human
guguuguugauuuucgaaucuuu

SEQ ID NO: 81235 - RNA, 22 nt, Human
guguugaugugucuguauucua

SEQ ID NO: 81236 - RNA, 22 nt, Human
uauguauaacuugauaggauga

SEQ ID NO: 81237 - RNA, 22 nt, Human
guguucuucacuguuagaaggu

SEQ ID NO: 81238 - RNA, 19 nt, Human
guguucuguuauacaguug

SEQ ID NO: 81239 - RNA, 22 nt, Human
guucgucuguggugugaggugc

SEQ ID NO: 81240 - RNA, 17 nt, Human
guucucaaacugacuga

SEQ ID NO: 81241 - RNA, 16 nt, Human
guuccuguguguacaa

SEQ ID NO: 81242 - RNA, 22 nt, Human
guuauuaaauauuuuggugauu

SEQ ID NO: 81243 - RNA, 23 nt, Human
guuauugcuggugcuggccagcc

SEQ ID NO: 81244 - RNA, 19 nt, Human
uauuagccucaucccagcc

SEQ ID NO: 81245 - RNA, 22 nt, Human
guuauacuuaugugcaaaaaua

SEQ ID NO: 81246 - RNA, 22 nt, Human
guucuucucuuguaauggaauc

SEQ ID NO: 81247 - RNA, 22 nt, Human
guucuuagcacuucugcccauu

SEQ ID NO: 81248 - RNA, 22 nt, Human
guucuuuacuucgcaucugcua

SEQ ID NO: 81249 - RNA, 22 nt, Human
uauuuccugcguuucugugagc

SEQ ID NO: 81250 - RNA, 22 nt, Human
guucuggaggagagccuggugu

SEQ ID NO: 81251 - RNA, 22 nt, Human
guucuguucuucacagguuugu

SEQ ID NO: 81252 - RNA, 22 nt, Human
guucucauugugaugcuuaguu

SEQ ID NO: 81253 - RNA, 22 nt, Human
guucucuuaauccuaguuggua

SEQ ID NO: 81254 - RNA, 22 nt, Human
guucucuccugcuggugaugga

SEQ ID NO: 81255 - RNA, 22 nt, Human
guugcuucuuggcuuuuccaac

SEQ ID NO: 81256 - RNA, 22 nt, Human
ucaaaaauaagauauucuggac

SEQ ID NO: 81257 - RNA, 22 nt, Human
uauuuuuuuaacauuuauugua

SEQ ID NO: 81258 - RNA, 22 nt, Human
uauuuuuguuuaccaguuaaca

SEQ ID NO: 81259 - RNA, 22 nt, Human
uauuuuagccaacagaaugaug

SEQ ID NO: 81260 - RNA, 22 nt, Human
uauuuucucugccacacuucca

SEQ ID NO: 81261 - RNA, 22 nt, Human
guugguggaggcgagagaagaa

SEQ ID NO: 81262 - RNA, 22 nt, Human
ucaacagaagugauagcuauua

SEQ ID NO: 81263 - RNA, 22 nt, Human
ucaaaucuuuuuuccuucccug

SEQ ID NO: 81264 - RNA, 22 nt, Human
gguguuaaccagcuaaaguuug

SEQ ID NO: 81265 - RNA, 19 nt, Human
uaaguagaugacugaugcu

SEQ ID NO: 81266 - RNA, 22 nt, Human
uaagucaagagcuagaaaaagc

SEQ ID NO: 81267 - RNA, 22 nt, Human
gucacuccuucccagagggagc

SEQ ID NO: 81268 - RNA, 22 nt, Human
gucagugaaccuucaccaaacc

SEQ ID NO: 81269 - RNA, 22 nt, Human
guauucugugugaucaagugau

SEQ ID NO: 81270 - RNA, 22 nt, Human
guauggaguuuuguugcacuuc

SEQ ID NO: 81271 - RNA, 22 nt, Human
guaugucuuaggguucaguaac

SEQ ID NO: 81272 - RNA, 22 nt, Human
guacuugauucauuauugcauu

SEQ ID NO: 81273 - RNA, 22 nt, Human
guagauaauuuuggaaagcugg

SEQ ID NO: 81274 - RNA, 22 nt, Human
guagagagugucuuccagaaau

SEQ ID NO: 81275 - RNA, 22 nt, Human
gucaugaugauacagguggagg

SEQ ID NO: 81276 - RNA, 22 nt, Human
guccguaauuuuugcuugcaga

SEQ ID NO: 81277 - RNA, 22 nt, Human
uaauauauuuuuuaagggaugu

SEQ ID NO: 81278 - RNA, 22 nt, Human
uaauauaacugccaguuaaggu

SEQ ID NO: 81279 - RNA, 22 nt, Human
uaauccaaaacugaaucugugg

SEQ ID NO: 81280 - RNA, 22 nt, Human
guccuuaaauacgaugaacaug

SEQ ID NO: 81281 - RNA, 22 nt, Human
uaaugcucauuuggcucugcaa

SEQ ID NO: 81282 - RNA, 22 nt, Human
uaauuauuaauuuuagguugcu

SEQ ID NO: 81283 - RNA, 22 nt, Human
guccugaaaaaaaucccugagu

SEQ ID NO: 81284 - RNA, 22 nt, Human
uaauucuucaauccaguguuca

SEQ ID NO: 81285 - RNA, 22 nt, Human
uaauucuacagggaacucugga

SEQ ID NO: 81286 - RNA, 22 nt, Human
guccuuuuuuuauacccaggcc

SEQ ID NO: 81287 - RNA, 22 nt, Human
uaauuuagugcauuuccuagua

SEQ ID NO: 81288 - RNA, 22 nt, Human
gucguucugcuauucuaugagg

SEQ ID NO: 81289 - RNA, 22 nt, Human
gucgagaacauucauuaugcaa

SEQ ID NO: 81290 - RNA, 22 nt, Human
gucugguggaguuguauauacu

SEQ ID NO: 81291 - RNA, 22 nt, Human
uaauuuugucacagugacaugc

SEQ ID NO: 81292 - RNA, 22 nt, Human
gugaaaauaguaaccuggcuag

SEQ ID NO: 81293 - RNA, 22 nt, Human
gucuucugacacuguuaggagg

SEQ ID NO: 81294 - RNA, 22 nt, Human
gucuugugaagacggcagaaag

SEQ ID NO: 81295 - RNA, 22 nt, Human
uacauuugauuuuugcuucuuu

SEQ ID NO: 81296 - RNA, 22 nt, Human
uacauccuuuugaaaucccaga

SEQ ID NO: 81297 - RNA, 22 nt, Human
uacuucauucaaguucgcuaua

SEQ ID NO: 81298 - RNA, 22 nt, Human
uacuucuuuuguaaaguauuga

SEQ ID NO: 81299 - RNA, 22 nt, Human
uacgugucacugaugaaguuua

SEQ ID NO: 81300 - RNA, 22 nt, Human
uacguggcucguuaauuuccug

SEQ ID NO: 81301 - RNA, 20 nt, Human
uacguguccgaugaucacag

SEQ ID NO: 81302 - RNA, 22 nt, Human
uaccuagaagagacuuuucugg

SEQ ID NO: 81303 - RNA, 22 nt, Human
uacuuuggugaaauuggaaaua

SEQ ID NO: 81304 - RNA, 23 nt, Human
uacuuuggcuagaguugucucuu

SEQ ID NO: 81305 - RNA, 22 nt, Human
uacuuugucauucuaaccuucc

SEQ ID NO: 81306 - RNA, 22 nt, Human
uacuugcaaggcucuuggaaua

SEQ ID NO: 81307 - RNA, 22 nt, Human
uacuuuaauugcaaaaauaaau

SEQ ID NO: 81308 - RNA, 20 nt, Human
gugaaguuuucugaagacag

SEQ ID NO: 81309 - RNA, 22 nt, Human
gugaaggcaugugugcugugcu

SEQ ID NO: 81310 - RNA, 22 nt, Human
gugacugagcuggcaaaguaug

SEQ ID NO: 81311 - RNA, 22 nt, Human
ggugccugggcacggaaagcau

SEQ ID NO: 81312 - RNA, 22 nt, Human
ggugguucagugguuagggcca

SEQ ID NO: 81313 - RNA, 22 nt, Human
gguguagagaaaauaguuguau

SEQ ID NO: 81314 - RNA, 22 nt, Human
uaaaacuaugcaaccuacuacc

SEQ ID NO: 81315 - RNA, 22 nt, Human
uaaaguguacaagucauaagua

SEQ ID NO: 81316 - RNA, 22 nt, Human
uaaauaugcaugugguauucau

SEQ ID NO: 81317 - RNA, 22 nt, Human
guaccuuucuaucuagaaggua

SEQ ID NO: 81318 - RNA, 22 nt, Human
guacuacagguuugguaguggg

SEQ ID NO: 81319 - RNA, 22 nt, Human
uaaauuccuagucacaaacuuc

SEQ ID NO: 81320 - RNA, 22 nt, Human
uaaaccuuauuugaauaccaac

SEQ ID NO: 81321 - RNA, 22 nt, Human
uaaaaugcucagauaaauauau

SEQ ID NO: 81322 - RNA, 22 nt, Human
uaaaauaccacauauggugcuc

SEQ ID NO: 81323 - RNA, 22 nt, Human
uaaacugacagugagggagagu

SEQ ID NO: 81324 - RNA, 22 nt, Human
uaaacgaagcuucaugcuugaa

SEQ ID NO: 81325 - RNA, 22 nt, Human
uaaaguauucaaguagcuuucu

SEQ ID NO: 81326 - RNA, 22 nt, Human
gguuuuuggcucaauauuuugg

SEQ ID NO: 81327 - RNA, 22 nt, Human
uaaaggcaaacucuccaaggau

SEQ ID NO: 81328 - RNA, 22 nt, Human
gguuugggaagaacuauucccu

SEQ ID NO: 81329 - RNA, 22 nt, Human
gugcuguuagcgguuuauaaca

SEQ ID NO: 81330 - RNA, 22 nt, Human
gugcucuauguugauuccuuga

SEQ ID NO: 81331 - RNA, 22 nt, Human
gugcugucguggaacugggcug

SEQ ID NO: 81332 - RNA, 22 nt, Human
guugucguucccccugcuuaaa

SEQ ID NO: 81333 - RNA, 22 nt, Human
guuggugagaguuagggauuua

SEQ ID NO: 81334 - RNA, 22 nt, Human
ggucgacuaauguuucauuuca

SEQ ID NO: 81335 - RNA, 22 nt, Human
ggugaaggaucccucuuggccu

SEQ ID NO: 81336 - RNA, 22 nt, Human
ggucuuccuugggggacuugaa

SEQ ID NO: 81337 - RNA, 22 nt, Human
guuuggguggcuagagaaagaa

SEQ ID NO: 81338 - RNA, 22 nt, Human
guuuccuuuugugguuuuucua

SEQ ID NO: 81339 - RNA, 22 nt, Human
guuguuuuuguuaaaacaguga

SEQ ID NO: 81340 - RNA, 22 nt, Human
guuuaaaagcaaccaacaggcu

SEQ ID NO: 81341 - RNA, 22 nt, Human
ggucuucauaugccacagaguc

SEQ ID NO: 81342 - RNA, 22 nt, Human
guuuauuucuuaucaucacuau

SEQ ID NO: 81343 - RNA, 22 nt, Human
ggucuucauucuaccagacuuu

SEQ ID NO: 81344 - RNA, 22 nt, Human
guuuacaacaucuuguccuuca

SEQ ID NO: 81345 - RNA, 22 nt, Human
gguuucuuuccucucugugccu

SEQ ID NO: 81346 - RNA, 22 nt, Human
gguuugauauguuugugauucu

SEQ ID NO: 81347 - RNA, 22 nt, Human
gguuuucagaaugcaguccugu

SEQ ID NO: 81348 - RNA, 22 nt, Human
guauaaagaugccauacuuacu

SEQ ID NO: 81349 - RNA, 22 nt, Human
guauccuccccgcuggccuuca

SEQ ID NO: 81350 - RNA, 22 nt, Human
guaucugaaaaagaauucugac

SEQ ID NO: 81351 - RNA, 22 nt, Human
guauauccaauaggugaugaaa

SEQ ID NO: 81352 - RNA, 22 nt, Human
guaucaggacuaaauuauggau

SEQ ID NO: 81353 - RNA, 22 nt, Human
guauauuuaugagcauuagccu

SEQ ID NO: 81354 - RNA, 21 nt, Human
guaucuuucuuuuaaaauauc

SEQ ID NO: 81355 - RNA, 22 nt, Human
gucaagaugcuacauaauggga

SEQ ID NO: 81356 - RNA, 22 nt, Human
guauuugcaaucacaaacaaaa

SEQ ID NO: 81357 - RNA, 22 nt, Human
guauuggcaguauacauagcac

SEQ ID NO: 81358 - RNA, 22 nt, Human
guauuauauaaccauugguucu

SEQ ID NO: 81359 - RNA, 22 nt, Human
guauuaagaaaugccugugaaa

SEQ ID NO: 81360 - RNA, 22 nt, Human
gucagaagauagaggaaguuug

SEQ ID NO: 81361 - RNA, 22 nt, Human
gucacuuuuaagggccuuuucu

SEQ ID NO: 81362 - RNA, 22 nt, Human
gucaggugcaccuccaccaaca

SEQ ID NO: 81363 - RNA, 22 nt, Human
gucaggaugagggaugaggagu

SEQ ID NO: 81364 - RNA, 19 nt, Human
gucagucuuaaguuucagc

SEQ ID NO: 81365 - RNA, 22 nt, Human
gucaucugagggacgagauuuc

SEQ ID NO: 81366 - RNA, 22 nt, Human
ggcuccccagagcuccuuacuc

SEQ ID NO: 81367 - RNA, 23 nt, Human
gucauuacuguuaccuuauucuu

SEQ ID NO: 81368 - RNA, 22 nt, Human
guccauauuuauccuuaaagua

SEQ ID NO: 81369 - RNA, 22 nt, Human
ggcgucuugcgggcgguagcgc

SEQ ID NO: 81370 - RNA, 22 nt, Human
gucccagaggacagggucacau

SEQ ID NO: 81371 - RNA, 22 nt, Human
guccccuauaugaggaagccau

SEQ ID NO: 81372 - RNA, 22 nt, Human
ggcucccccauggcugacagac

SEQ ID NO: 81373 - RNA, 22 nt, Human
ggcucuccacuauggaugagaa

SEQ ID NO: 81374 - RNA, 22 nt, Human
guccugauggccauuuuucacu

SEQ ID NO: 81375 - RNA, 22 nt, Human
guccucgugucuuuuucucuaa

SEQ ID NO: 81376 - RNA, 22 nt, Human
gucccagaaugguuucccagaa

SEQ ID NO: 81377 - RNA, 17 nt, Human
ggcugccaggcaacaua

SEQ ID NO: 81378 - RNA, 22 nt, Human
gucgguacuaguacugguguug

SEQ ID NO: 81379 - RNA, 22 nt, Human
guccuuuauuugaacaugacau

SEQ ID NO: 81380 - RNA, 22 nt, Human
gucguuugucaauuuugaugug

SEQ ID NO: 81381 - RNA, 22 nt, Human
ggcuggaacuucuucuggcauu

SEQ ID NO: 81382 - RNA, 22 nt, Human
gucuauuuauagacagauccua

SEQ ID NO: 81383 - RNA, 22 nt, Human
gucuccuucauuuacuguuucc

SEQ ID NO: 81384 - RNA, 22 nt, Human
gucucacuucauuuucuuagcc

SEQ ID NO: 81385 - RNA, 22 nt, Human
gucucuuuugauuuuucacuca

SEQ ID NO: 81386 - RNA, 22 nt, Human
gucugaaauaucuuuugucuug

SEQ ID NO: 81387 - RNA, 22 nt, Human
gucugcucauguuugguuugug

SEQ ID NO: 81388 - RNA, 22 nt, Human
gucuggugguggguguagggca

SEQ ID NO: 81389 - RNA, 22 nt, Human
gucuggagccacugcugcugcu

SEQ ID NO: 81390 - RNA, 22 nt, Human
gucugcuuuuaucacaugucau

SEQ ID NO: 81391 - RNA, 22 nt, Human
gggaauguuaaccuuucuauuu

SEQ ID NO: 81392 - RNA, 22 nt, Human
gugaugugugaaggucugcagg

SEQ ID NO: 81393 - RNA, 22 nt, Human
gugauggucgagcgcuuguugu

SEQ ID NO: 81394 - RNA, 22 nt, Human
gggaauuuuaggaugacuccua

SEQ ID NO: 81395 - RNA, 22 nt, Human
gugauuucaaauauagagugag

SEQ ID NO: 81396 - RNA, 22 nt, Human
gugcagcugguggagucugggg

SEQ ID NO: 81397 - RNA, 21 nt, Human
gggagaguagcgguagggagg

SEQ ID NO: 81398 - RNA, 22 nt, Human
gggagcuggagcuggaagacuc

SEQ ID NO: 81399 - RNA, 22 nt, Human
gggaggaagaguaggaauuuga

SEQ ID NO: 81400 - RNA, 22 nt, Human
gggagccucccacugggggaag

SEQ ID NO: 81401 - RNA, 22 nt, Human
gggagcugagcuggaagagaau

SEQ ID NO: 81402 - RNA, 21 nt, Human
gggagugucuguugcaaggug

SEQ ID NO: 81403 - RNA, 22 nt, Human
gugccuuuuucccaguucauug

SEQ ID NO: 81404 - RNA, 22 nt, Human
gugcucaucuucuguaacuguu

SEQ ID NO: 81405 - RNA, 22 nt, Human
gugcucaagacauuaggaauau

SEQ ID NO: 81406 - RNA, 22 nt, Human
gggauguauguuuguguggaga

SEQ ID NO: 81407 - RNA, 22 nt, Human
gggauuuaaugggaaaaauaug

SEQ ID NO: 81408 - RNA, 22 nt, Human
gggaaaucugcuuccuagggcu

SEQ ID NO: 81409 - RNA, 22 nt, Human
gggaaaugugucuuggcauucu

SEQ ID NO: 81410 - RNA, 22 nt, Human
gugacucuacuuaagauuaagc

SEQ ID NO: 81411 - RNA, 22 nt, Human
gggaaaaaggaguuagagauaa

SEQ ID NO: 81412 - RNA, 22 nt, Human
gggaaaaaggaaccuuauuacu

SEQ ID NO: 81413 - RNA, 22 nt, Human
gggaagaagaaaagagguggga

SEQ ID NO: 81414 - RNA, 22 nt, Human
gggaagaacugauuucacacca

SEQ ID NO: 81415 - RNA, 22 nt, Human
gggaagugagcuggaaucaagg

SEQ ID NO: 81416 - RNA, 22 nt, Human
gggaagccugggugauccuaaa

SEQ ID NO: 81417 - RNA, 21 nt, Human
gggaagagaagagaaaggagg

SEQ ID NO: 81418 - RNA, 22 nt, Human
gggaagagggagcuggaaugau

SEQ ID NO: 81419 - RNA, 17 nt, Human
gugagcugagucaggac

SEQ ID NO: 81420 - RNA, 22 nt, Human
gggaacuuugugagacuggaga

SEQ ID NO: 81421 - RNA, 22 nt, Human
ggcuuaugaucugacccaucga

SEQ ID NO: 81422 - RNA, 22 nt, Human
ggcuuccuggugcagaguuaua

SEQ ID NO: 81423 - RNA, 22 nt, Human
gugaaauuguacacucaguacc

SEQ ID NO: 81424 - RNA, 22 nt, Human
ggcuuguccuucugguugucuu

SEQ ID NO: 81425 - RNA, 22 nt, Human
ggcuuugggaggaugaggcggu

SEQ ID NO: 81426 - RNA, 22 nt, Human
ggcuucuuaacauuuggacacc

SEQ ID NO: 81427 - RNA, 22 nt, Human
gucuucuauuuggcaugacaga

SEQ ID NO: 81428 - RNA, 22 nt, Human
gucuuucuuuuacauauuugug

SEQ ID NO: 81429 - RNA, 22 nt, Human
gucugaggagaggcagcauaac

SEQ ID NO: 81430 - RNA, 18 nt, Human
gucuguuccuuuaauguc

SEQ ID NO: 81431 - RNA, 22 nt, Human
ggcuguggcagcuggaaguggu

SEQ ID NO: 81432 - RNA, 22 nt, Human
gucuguacugccguuauucaga

SEQ ID NO: 81433 - RNA, 22 nt, Human
gugaaaaauggccaucaggaca

SEQ ID NO: 81434 - RNA, 22 nt, Human
gucuuugagccucaguuuccuc

SEQ ID NO: 81435 - RNA, 22 nt, Human
gucuuuguaguuuuaauuugag

SEQ ID NO: 81436 - RNA, 22 nt, Human
ggccaauuuccuagacauuagu

SEQ ID NO: 81437 - RNA, 22 nt, Human
gcuguguaugaugcaggcaccu

SEQ ID NO: 81438 - RNA, 22 nt, Human
ggcuuguaggugauggagaacu

SEQ ID NO: 81439 - RNA, 22 nt, Human
gcuguugagucagacaaguuuu

SEQ ID NO: 81440 - RNA, 19 nt, Human
ggcuuugcccuucgcuccg

SEQ ID NO: 81441 - RNA, 22 nt, Human
gcuguguucauccugcccaggu

SEQ ID NO: 81442 - RNA, 22 nt, Human
ggcuuuuucccuaggguaagag

SEQ ID NO: 81443 - RNA, 22 nt, Human
ggcuuuuguuauaaucaggccu

SEQ ID NO: 81444 - RNA, 22 nt, Human
gcuuagaaucagaccuggguca

SEQ ID NO: 81445 - RNA, 23 nt, Human
gggaaaucaaaagauauuucuuc

SEQ ID NO: 81446 - RNA, 22 nt, Human
gggaaaauguuucugagacaaa

SEQ ID NO: 81447 - RNA, 22 nt, Human
gcuguugcaaucaaggccaugg

SEQ ID NO: 81448 - RNA, 22 nt, Human
gcuguuuaaguggaauuuguuu

SEQ ID NO: 81449 - RNA, 22 nt, Human
gcuuccuuagcuuaccaaguau

SEQ ID NO: 81450 - RNA, 22 nt, Human
gggaacuuggcaggaaaauuau

SEQ ID NO: 81451 - RNA, 22 nt, Human
gggaacgacuguuaguacuugg

SEQ ID NO: 81452 - RNA, 22 nt, Human
gcuucucauguuuauuuuuaca

SEQ ID NO: 81453 - RNA, 18 nt, Human
gggaagaugccacaguga

SEQ ID NO: 81454 - RNA, 22 nt, Human
gggaagaaccucugcuaccaau

SEQ ID NO: 81455 - RNA, 20 nt, Human
gcuugaauuugauggccaga

SEQ ID NO: 81456 - RNA, 22 nt, Human
gcuugcuuuguaaauaucugug

SEQ ID NO: 81457 - RNA, 22 nt, Human
gggacugcgagauucucaaggg

SEQ ID NO: 81458 - RNA, 22 nt, Human
gcuuggagaacguuuucuagaa

SEQ ID NO: 81459 - RNA, 22 nt, Human
gggacucugaaucuagauuccu

SEQ ID NO: 81460 - RNA, 22 nt, Human
gcuuguuagcaaugcagaaucu

SEQ ID NO: 81461 - RNA, 22 nt, Human
gcuuucagggucacugucaaca

SEQ ID NO: 81462 - RNA, 22 nt, Human
gggagaaccagccagugcaagg

SEQ ID NO: 81463 - RNA, 22 nt, Human
gggagauuuguguaggaaaacu

SEQ ID NO: 81464 - RNA, 19 nt, Human
gggagaaaaucuuuauccu

SEQ ID NO: 81465 - RNA, 22 nt, Human
gggagcucaccaugcucugcau

SEQ ID NO: 81466 - RNA, 22 nt, Human
ggaagauagaaguucaaaaguu

SEQ ID NO: 81467 - RNA, 22 nt, Human
ggaagacuuagaguagcaucag

SEQ ID NO: 81468 - RNA, 22 nt, Human
ggaagaagagggagcuguggga

SEQ ID NO: 81469 - RNA, 22 nt, Human
ggaaaaauggguggugauauga

SEQ ID NO: 81470 - RNA, 22 nt, Human
gggcaggcuggguggugguccc

SEQ ID NO: 81471 - RNA, 22 nt, Human
ggaaguuaguucuuggcaaagg

SEQ ID NO: 81472 - RNA, 22 nt, Human
ggaagcucaauacuuuccucuu

SEQ ID NO: 81473 - RNA, 22 nt, Human
gggccuguccccccaggagaac

SEQ ID NO: 81474 - RNA, 22 nt, Human
ggaagcugucugcccggcgcuc

SEQ ID NO: 81475 - RNA, 22 nt, Human
ggaaguuugagcaucuguuucc

SEQ ID NO: 81476 - RNA, 21 nt, Human
ggaauagcuuaaagugagggg

SEQ ID NO: 81477 - RNA, 18 nt, Human
ggaauagcuuguuuccca

SEQ ID NO: 81478 - RNA, 22 nt, Human
ggaauuaagaggcuggacaggg

SEQ ID NO: 81479 - RNA, 22 nt, Human
gggcuguuugcauauguuuaua

SEQ ID NO: 81480 - RNA, 22 nt, Human
ggaauuauuuuaaauagacauu

SEQ ID NO: 81481 - RNA, 22 nt, Human
ggacuggugaagccuucggaga

SEQ ID NO: 81482 - RNA, 22 nt, Human
ggacucucaggcugucggcuuc

SEQ ID NO: 81483 - RNA, 22 nt, Human
ggucaaucaugggucauugucu

SEQ ID NO: 81484 - RNA, 22 nt, Human
ggcaucuuuaaugaacaugaau

SEQ ID NO: 81485 - RNA, 22 nt, Human
ggcauuccucucuguucaugga

SEQ ID NO: 81486 - RNA, 20 nt, Human
ggcaucugacaacuaguugc

SEQ ID NO: 81487 - RNA, 22 nt, Human
ggugaucucagucuagaugguu

SEQ ID NO: 81488 - RNA, 22 nt, Human
ggcagcagaaccaacuguggcu

SEQ ID NO: 81489 - RNA, 22 nt, Human
ggugcuuuucacaagcauggga

SEQ ID NO: 81490 - RNA, 22 nt, Human
gguggagacucagauuuguugc

SEQ ID NO: 81491 - RNA, 20 nt, Human
ggcauuuuuuaguugagcuu

SEQ ID NO: 81492 - RNA, 22 nt, Human
ggccaaagagcacaaugaauag

SEQ ID NO: 81493 - RNA, 22 nt, Human
gguuauuucugauuauaugaua

SEQ ID NO: 81494 - RNA, 22 nt, Human
ggagggcuggacguacuagggc

SEQ ID NO: 81495 - RNA, 22 nt, Human
ggguggaaugugagugugugug

SEQ ID NO: 81496 - RNA, 22 nt, Human
ggguuuuaccagauguguggug

SEQ ID NO: 81497 - RNA, 22 nt, Human
ggguuuguuccuacuucuacuc

SEQ ID NO: 81498 - RNA, 22 nt, Human
ggaugauacuuggagaaauauu

SEQ ID NO: 81499 - RNA, 22 nt, Human
ggaucaccagguuuguuguugg

SEQ ID NO: 81500 - RNA, 22 nt, Human
ggauccuuccuggugaagacug

SEQ ID NO: 81501 - RNA, 22 nt, Human
ggaucuaaagccagaauauaug

SEQ ID NO: 81502 - RNA, 22 nt, Human
ggagaugucugugccacgucuc

SEQ ID NO: 81503 - RNA, 22 nt, Human
gggggacaggaugaauaucugu

SEQ ID NO: 81504 - RNA, 22 nt, Human
ggagaugacaucccagcccggc

SEQ ID NO: 81505 - RNA, 22 nt, Human
ggaggagggaguucaggaguau

SEQ ID NO: 81506 - RNA, 22 nt, Human
ggaggaggggcggggaggggag

SEQ ID NO: 81507 - RNA, 22 nt, Human
ggaggaugaggguggugguguu

SEQ ID NO: 81508 - RNA, 22 nt, Human
ggagccucuaaacaguuaucaa

SEQ ID NO: 81509 - RNA, 22 nt, Human
ggagcaucuaccauuucuagau

SEQ ID NO: 81510 - RNA, 20 nt, Human
gccugggagaagaucaggga

SEQ ID NO: 81511 - RNA, 22 nt, Human
ggaagaggaagaugaggcagca

SEQ ID NO: 81512 - RNA, 22 nt, Human
ggaauauaaaucagaugcuccg

SEQ ID NO: 81513 - RNA, 22 nt, Human
ggaaucuucagccaugccaaga

SEQ ID NO: 81514 - RNA, 22 nt, Human
ggaauccugguguuuucugccu

SEQ ID NO: 81515 - RNA, 22 nt, Human
ggaaugcagugagcauuagaua

SEQ ID NO: 81516 - RNA, 22 nt, Human
ggaaugcuuggcaugagaaccu

SEQ ID NO: 81517 - RNA, 22 nt, Human
ggacauagaucuagacuuuaaa

SEQ ID NO: 81518 - RNA, 22 nt, Human
ggacauuguuguuggauccuug

SEQ ID NO: 81519 - RNA, 22 nt, Human
gccuuuuaaggcagagggagau

SEQ ID NO: 81520 - RNA, 22 nt, Human
ggagaagaggagcuggaagccu

SEQ ID NO: 81521 - RNA, 17 nt, Human
ggacuuucugccugucc

SEQ ID NO: 81522 - RNA, 22 nt, Human
ggacuuggcagugucaaauuua

SEQ ID NO: 81523 - RNA, 22 nt, Human
ggacuugaaguaguuauggccu

SEQ ID NO: 81524 - RNA, 22 nt, Human
ggacuucuggggacuguagauu

SEQ ID NO: 81525 - RNA, 22 nt, Human
ggagcucaggaguugauuauuu

SEQ ID NO: 81526 - RNA, 22 nt, Human
ggagcucacuacgaaauaagcu

SEQ ID NO: 81527 - RNA, 22 nt, Human
ggagcuaagagaauggacaagg

SEQ ID NO: 81528 - RNA, 22 nt, Human
ggagagagggaucuuuguggag

SEQ ID NO: 81529 - RNA, 19 nt, Human
ggacuuaggcagacuaauu

SEQ ID NO: 81530 - RNA, 22 nt, Human
ggagacagauggcgucucaguu

SEQ ID NO: 81531 - RNA, 22 nt, Human
ggaggaaauccuuaguaaggca

SEQ ID NO: 81532 - RNA, 22 nt, Human
ggagcuaaggauuuuuauaugu

SEQ ID NO: 81533 - RNA, 19 nt, Human
ggaggguguccucaguguc

SEQ ID NO: 81534 - RNA, 22 nt, Human
ggaguucaaaucuuuuggaucu

SEQ ID NO: 81535 - RNA, 22 nt, Human
ggaguucacagcaauggaacag

SEQ ID NO: 81536 - RNA, 22 nt, Human
ggaguuucugucaucccguccc

SEQ ID NO: 81537 - RNA, 22 nt, Human
ggauaaaugaaggcauacagau

SEQ ID NO: 81538 - RNA, 22 nt, Human
ggauaauugaugauuuauaaga

SEQ ID NO: 81539 - RNA, 22 nt, Human
ggcaauuacguauuagucaugu

SEQ ID NO: 81540 - RNA, 22 nt, Human
gcgugcauguguguaugcgugu

SEQ ID NO: 81541 - RNA, 22 nt, Human
gcgugcauggccguguguaugc

SEQ ID NO: 81542 - RNA, 22 nt, Human
gcguguauuccagaccuuaacg

SEQ ID NO: 81543 - RNA, 22 nt, Human
ggcagaaaacaauaaccauuuc

SEQ ID NO: 81544 - RNA, 21 nt, Human
ggcagccuggcaggggcacug

SEQ ID NO: 81545 - RNA, 20 nt, Human
ggcagcaaccauaugcuaca

SEQ ID NO: 81546 - RNA, 22 nt, Human
ggcagcuuucaauaggguuaug

SEQ ID NO: 81547 - RNA, 22 nt, Human
gcuagaaacuguuuaaucucuu

SEQ ID NO: 81548 - RNA, 17 nt, Human
gcuaguuguuuccagua

SEQ ID NO: 81549 - RNA, 22 nt, Human
gcuaguguuccacgaugugugu

SEQ ID NO: 81550 - RNA, 22 nt, Human
gcuaguaagugauagagcugag

SEQ ID NO: 81551 - RNA, 22 nt, Human
gcucggcuggcucaucucaugu

SEQ ID NO: 81552 - RNA, 22 nt, Human
gcucuccuugcuagagguucua

SEQ ID NO: 81553 - RNA, 22 nt, Human
gcucuccuugaugcccucuguu

SEQ ID NO: 81554 - RNA, 22 nt, Human
gcucgauugucaguguuaggga

SEQ ID NO: 81555 - RNA, 19 nt, Human
gcuccugcagcuagagugc

SEQ ID NO: 81556 - RNA, 22 nt, Human
gcucucucuucugcaggccuua

SEQ ID NO: 81557 - RNA, 22 nt, Human
gcucugaacugucaugaauugg

SEQ ID NO: 81558 - RNA, 22 nt, Human
ggcauuccgggguccccuucuc

SEQ ID NO: 81559 - RNA, 22 nt, Human
ggcagugguaggagcccaggag

SEQ ID NO: 81560 - RNA, 22 nt, Human
gcauucuugucaguggggucag

SEQ ID NO: 81561 - RNA, 22 nt, Human
gcauugcuauuucuguuagugu

SEQ ID NO: 81562 - RNA, 22 nt, Human
gcccuagaguugagagcaccca

SEQ ID NO: 81563 - RNA, 22 nt, Human
gcccuguuuucuggguuccuug

SEQ ID NO: 81564 - RNA, 21 nt, Human
gcuguagauucacaaagaggu

SEQ ID NO: 81565 - RNA, 22 nt, Human
gcugguuucucucauugucagu

SEQ ID NO: 81566 - RNA, 22 nt, Human
gcugguggcagagcuccgcggc

SEQ ID NO: 81567 - RNA, 22 nt, Human
gcuguuguugcacggaaggugg

SEQ ID NO: 81568 - RNA, 22 nt, Human
gcuuacagauaaugaggagacu

SEQ ID NO: 81569 - RNA, 22 nt, Human
gcuguugugaggaucagcauau

SEQ ID NO: 81570 - RNA, 22 nt, Human
gcuguuggaggaguucagugcu

SEQ ID NO: 81571 - RNA, 22 nt, Human
gcuguggacacagcucucuuca

SEQ ID NO: 81572 - RNA, 22 nt, Human
gcuguggagaagcugccuaugg

SEQ ID NO: 81573 - RNA, 22 nt, Human
gcuguggaaaaugggucuccaa

SEQ ID NO: 81574 - RNA, 22 nt, Human
gcuucucacccuuacuaucucu

SEQ ID NO: 81575 - RNA, 22 nt, Human
gcuucacucugagacuuggagc

SEQ ID NO: 81576 - RNA, 22 nt, Human
gcuuauugcuuauagauaggaa

SEQ ID NO: 81577 - RNA, 21 nt, Human
gcuucaauucauccaccucuc

SEQ ID NO: 81578 - RNA, 17 nt, Human
ggaagaaaaggaucauc

SEQ ID NO: 81579 - RNA, 22 nt, Human
gccugcaaagacuuccuucucu

SEQ ID NO: 81580 - RNA, 22 nt, Human
gccugcagccagggaguucucu

SEQ ID NO: 81581 - RNA, 22 nt, Human
ggaaauguguguaagaaaguau

SEQ ID NO: 81582 - RNA, 22 nt, Human
ggaaaggaagggaaggagaugc

SEQ ID NO: 81583 - RNA, 22 nt, Human
ggaaagagaaacaugaacuaga

SEQ ID NO: 81584 - RNA, 22 nt, Human
ggaaaaugcugaagcaucugaa

SEQ ID NO: 81585 - RNA, 22 nt, Human
gccuagggacuuugguuuagau

SEQ ID NO: 81586 - RNA, 22 nt, Human
gccucaaaaguguuguagaggg

SEQ ID NO: 81587 - RNA, 22 nt, Human
gccuagaagaaugagcgcaggg

SEQ ID NO: 81588 - RNA, 22 nt, Human
gcuugaggaacucagacuugag

SEQ ID NO: 81589 - RNA, 22 nt, Human
gcuugcugaacaggaaccuggc

SEQ ID NO: 81590 - RNA, 22 nt, Human
gcuuuccuggcccugucccugc

SEQ ID NO: 81591 - RNA, 22 nt, Human
gcuuucauuauguuguguuuuu

SEQ ID NO: 81592 - RNA, 22 nt, Human
gcuuucacugcaauagaugaau

SEQ ID NO: 81593 - RNA, 22 nt, Human
gcuuguauguguauauauacau

SEQ ID NO: 81594 - RNA, 22 nt, Human
gcuuuugaauacuacaggaguu

SEQ ID NO: 81595 - RNA, 22 nt, Human
gcuuuucucccugcuuucuucc

SEQ ID NO: 81596 - RNA, 22 nt, Human
gcuuuuaaauuaucugacaaug

SEQ ID NO: 81597 - RNA, 22 nt, Human
gcuuuugagaaaguguuuuccc

SEQ ID NO: 81598 - RNA, 22 nt, Human
gcuuuuuaauuugcuucccugg

SEQ ID NO: 81599 - RNA, 22 nt, Human
ggaaaagaauuguuaguuagug

SEQ ID NO: 81600 - RNA, 22 nt, Human
ggaaaagccauauuauaggcaa

SEQ ID NO: 81601 - RNA, 22 nt, Human
gaucuuacucacuucagcuggc

SEQ ID NO: 81602 - RNA, 22 nt, Human
gaugaagaaacucaaccaagaa

SEQ ID NO: 81603 - RNA, 22 nt, Human
gaugaaguaguccacuggaagg

SEQ ID NO: 81604 - RNA, 18 nt, Human
gaugaagaggaagaggag

SEQ ID NO: 81605 - RNA, 22 nt, Human
gagaagucaggaguggagaaca

SEQ ID NO: 81606 - RNA, 22 nt, Human
gagaauuauacaugagcuauuu

SEQ ID NO: 81607 - RNA, 22 nt, Human
gcaguagauccagcagccugca

SEQ ID NO: 81608 - RNA, 19 nt, Human
gaguacuuuacaaguuuuc

SEQ ID NO: 81609 - RNA, 19 nt, Human
gcaguuccucuuaagagaa

SEQ ID NO: 81610 - RNA, 22 nt, Human
gcagugcugcgacagucgggug

SEQ ID NO: 81611 - RNA, 22 nt, Human
gcaguuugugauguggcaguca

SEQ ID NO: 81612 - RNA, 22 nt, Human
gaguuaaauagcuuaggauuca

SEQ ID NO: 81613 - RNA, 21 nt, Human
gcauccucguacucuucaggu

SEQ ID NO: 81614 - RNA, 22 nt, Human
gcaucacacgcacauacacaca

SEQ ID NO: 81615 - RNA, 22 nt, Human
gcauaaaggacuauaaggauca

SEQ ID NO: 81616 - RNA, 22 nt, Human
gcaugaauggaacccccugagu

SEQ ID NO: 81617 - RNA, 22 nt, Human
gcaucccagaagauucugauuu

SEQ ID NO: 81618 - RNA, 22 nt, Human
gaguuauuuuuccuguuuuuua

SEQ ID NO: 81619 - RNA, 22 nt, Human
gaguucuagauguauuauuaau

SEQ ID NO: 81620 - RNA, 20 nt, Human
gccaaggaggagaaacaggc

SEQ ID NO: 81621 - RNA, 21 nt, Human
gccacugcugcucauucucug

SEQ ID NO: 81622 - RNA, 22 nt, Human
gauccucagacccuccucuggu

SEQ ID NO: 81623 - RNA, 22 nt, Human
gaugguaucugcuggcuuucag

SEQ ID NO: 81624 - RNA, 22 nt, Human
gauggguuugagauguuugggu

SEQ ID NO: 81625 - RNA, 22 nt, Human
gaugggaggaugaauuggaccu

SEQ ID NO: 81626 - RNA, 20 nt, Human
gcccuucccccuccgcgagc

SEQ ID NO: 81627 - RNA, 22 nt, Human
gauguuuugaaagaagaauaca

SEQ ID NO: 81628 - RNA, 22 nt, Human
gauuccugcuauucacagggcu

SEQ ID NO: 81629 - RNA, 22 nt, Human
gauuccuuucgccugccgagcu

SEQ ID NO: 81630 - RNA, 22 nt, Human
gauucagagcugcaacaaagaa

SEQ ID NO: 81631 - RNA, 22 nt, Human
gauuaagugaauuggagaaaag

SEQ ID NO: 81632 - RNA, 22 nt, Human
gauuaagauuacauauuuaagu

SEQ ID NO: 81633 - RNA, 22 nt, Human
gauuuugcuuuagugaaggaag

SEQ ID NO: 81634 - RNA, 22 nt, Human
gcaaggaagcagaguugcuauc

SEQ ID NO: 81635 - RNA, 22 nt, Human
gcccuuuuaucaacuccuagaa

SEQ ID NO: 81636 - RNA, 22 nt, Human
gcaauagccuacaugcgucaga

SEQ ID NO: 81637 - RNA, 22 nt, Human
gcaaggaggguaaccacauuuc

SEQ ID NO: 81638 - RNA, 22 nt, Human
gccugcacucaaacacucucuu

SEQ ID NO: 81639 - RNA, 22 nt, Human
gcacaaaagguacuucauguag

SEQ ID NO: 81640 - RNA, 22 nt, Human
gccugcaggaaggugugccugu

SEQ ID NO: 81641 - RNA, 22 nt, Human
gcacagucaacacuuauucacc

SEQ ID NO: 81642 - RNA, 22 nt, Human
gcagaaguauuguacgguggga

SEQ ID NO: 81643 - RNA, 21 nt, Human
gcagaacuaggacuugaacau

SEQ ID NO: 81644 - RNA, 22 nt, Human
gcagaugagagugugaucuggg

SEQ ID NO: 81645 - RNA, 22 nt, Human
gcagaggcaaagucuggaugac

SEQ ID NO: 81646 - RNA, 22 nt, Human
gcagcauuaccaagacauggca

SEQ ID NO: 81647 - RNA, 23 nt, Human
gcagccaacccacgugagagaag

SEQ ID NO: 81648 - RNA, 22 nt, Human
gcagcaauaaaacugaaggugu

SEQ ID NO: 81649 - RNA, 22 nt, Human
gcagauuggguacauaaacagu

SEQ ID NO: 81650 - RNA, 22 nt, Human
gcagauccaaauauaguucuug

SEQ ID NO: 81651 - RNA, 22 nt, Human
gcgcucuccugcagacagccuc

SEQ ID NO: 81652 - RNA, 22 nt, Human
gcagcuuuggagguggaacucu

SEQ ID NO: 81653 - RNA, 22 nt, Human
gcaggaaugguacauaccuguu

SEQ ID NO: 81654 - RNA, 22 nt, Human
gcagagcugucuaagucacuuc

SEQ ID NO: 81655 - RNA, 22 nt, Human
gcaguaaauugagagucauguu

SEQ ID NO: 81656 - RNA, 22 nt, Human
gcaguauuguguguggucaugg

SEQ ID NO: 81657 - RNA, 22 nt, Human
gcaguccuguagcgacuuuuuu

SEQ ID NO: 81658 - RNA, 22 nt, Human
gcauggaaaagggaugcuaacu

SEQ ID NO: 81659 - RNA, 22 nt, Human
gcaugcuguuuggaaacgauaa

SEQ ID NO: 81660 - RNA, 22 nt, Human
gcucuagcuggcgcugaccugg

SEQ ID NO: 81661 - RNA, 18 nt, Human
gcugaaauucuaaacaaa

SEQ ID NO: 81662 - RNA, 23 nt, Human
gcaucgcaggucuaagauuagcu

SEQ ID NO: 81663 - RNA, 22 nt, Human
gcauccugacuauggugguggu

SEQ ID NO: 81664 - RNA, 22 nt, Human
gcauccaaggagcagaagugau

SEQ ID NO: 81665 - RNA, 23 nt, Human
gcucauguugcuucuguucuguc

SEQ ID NO: 81666 - RNA, 22 nt, Human
gcuccagcuccauaaacauaag

SEQ ID NO: 81667 - RNA, 22 nt, Human
gcagugucacuaguaauagucu

SEQ ID NO: 81668 - RNA, 22 nt, Human
gcuagauugucacuugaguguc

SEQ ID NO: 81669 - RNA, 22 nt, Human
gcuagagaagagcccacaccgg

SEQ ID NO: 81670 - RNA, 22 nt, Human
gcuagagaccagaggccuugaa

SEQ ID NO: 81671 - RNA, 22 nt, Human
gcucagagaaaacuggggcuug

SEQ ID NO: 81672 - RNA, 22 nt, Human
auguuuaauuugaaauuuuauu

SEQ ID NO: 81673 - RNA, 22 nt, Human
gggauggggagcuggaaagggg

SEQ ID NO: 81674 - RNA, 22 nt, Human
auagaaauagacaaugcaaaga

SEQ ID NO: 81675 - RNA, 22 nt, Human
uuuuuuaaucaaguaggaaaca

SEQ ID NO: 81676 - RNA, 22 nt, Human
agcagggagacagugcagcauu

SEQ ID NO: 81677 - RNA, 22 nt, Human
auaaaaauguuuuuguguggua

SEQ ID NO: 81678 - RNA, 22 nt, Human
uuucuauuuacagugcuaggua

SEQ ID NO: 81679 - RNA, 22 nt, Human
uguuuguuuuguauuuuuaauu

SEQ ID NO: 81680 - RNA, 20 nt, Human
uucacagaucucuaacugag

SEQ ID NO: 81681 - RNA, 22 nt, Human
agcgcucauuuuccuccugcuc

SEQ ID NO: 81682 - RNA, 22 nt, Human
auaucuuguuuuugauuucuug

SEQ ID NO: 81683 - RNA, 22 nt, Human
ucucucugcuguccagcguuau

SEQ ID NO: 81684 - RNA, 19 nt, Human
agagucuccacuccacuug

SEQ ID NO: 81685 - RNA, 22 nt, Human
auauucaaugaggucauauaag

SEQ ID NO: 81686 - RNA, 22 nt, Human
ucuuuauuucccuaacuugcua

SEQ ID NO: 81687 - RNA, 23 nt, Human
aaauaauaauuucucuguuggga

SEQ ID NO: 81688 - RNA, 22 nt, Human
gggcuguggggccugcagaagg

SEQ ID NO: 81689 - RNA, 22 nt, Human
cugccucucaugccugcuugcu

SEQ ID NO: 81690 - RNA, 22 nt, Human
cccuguccuucccuccaucuga

SEQ ID NO: 81691 - RNA, 22 nt, Human
ccagaugggggcugugggaggg

SEQ ID NO: 81692 - RNA, 22 nt, Human
gggggacagugugccuggugug

SEQ ID NO: 81693 - RNA, 22 nt, Human
agugccaucuuuaacuguccca

SEQ ID NO: 81694 - RNA, 22 nt, Human
ucugagugacguccugacagga

SEQ ID NO: 81695 - RNA, 22 nt, Human
uucauuuccauuuuauagauaa

SEQ ID NO: 81696 - RNA, 20 nt, Human
gaacauaaauaacucuuuac

SEQ ID NO: 81697 - RNA, 20 nt, Human
cuccuccccucggccccacc

SEQ ID NO: 81698 - RNA, 22 nt, Human
cuaaaccaauauauuuucuucc

SEQ ID NO: 81699 - RNA, 22 nt, Human
ucuccucucugaucuugcuccg

SEQ ID NO: 81700 - RNA, 22 nt, Human
gggggagcuacaggucccuugg

SEQ ID NO: 81701 - RNA, 22 nt, Human
agguggucccaauggcugggca

SEQ ID NO: 81702 - RNA, 22 nt, Human
uugcuuuuuuggguuuacuggg

SEQ ID NO: 81703 - RNA, 22 nt, Human
acugucuuguuguaugugagcu

SEQ ID NO: 81704 - RNA, 22 nt, Human
ggcugcagggaacaggaugggu

SEQ ID NO: 81705 - RNA, 22 nt, Human
ucccaaguguuuggcgaggaga

SEQ ID NO: 81706 - RNA, 22 nt, Human
ugucccaucacagaggagacua

SEQ ID NO: 81707 - RNA, 22 nt, Human
ggcuccaggguaccccuggaug

SEQ ID NO: 81708 - RNA, 22 nt, Human
caaaucuguuaauuucaaguug

SEQ ID NO: 81709 - RNA, 22 nt, Human
gggagguaaugggggugcaggg

SEQ ID NO: 81710 - RNA, 22 nt, Human
gaggagcuucagaggaaucuua

SEQ ID NO: 81711 - RNA, 22 nt, Human
cacugguugccucuuucuguuc

SEQ ID NO: 81712 - RNA, 22 nt, Human
uacugcaguuccugcugucucc

SEQ ID NO: 81713 - RNA, 23 nt, Human
ccagcugugccuggcccaggagc

SEQ ID NO: 81714 - RNA, 22 nt, Human
cucuuucauucuguccuuguuu

SEQ ID NO: 81715 - RNA, 22 nt, Human
gcccugucagcucucauggaca

SEQ ID NO: 81716 - RNA, 20 nt, Human
uucacagaggacucagguca

SEQ ID NO: 81717 - RNA, 22 nt, Human
uuauuuaaguauuuauugaagu

SEQ ID NO: 81718 - RNA, 22 nt, Human
gucuugugaagacggcagaaag

SEQ ID NO: 81719 - RNA, 22 nt, Human
augcuuucucuucuauuucuca

SEQ ID NO: 81720 - RNA, 22 nt, Human
gcccagccucagggcaucagcu

SEQ ID NO: 81721 - RNA, 22 nt, Human
gcugcaggaggugguagggucu

SEQ ID NO: 81722 - RNA, 22 nt, Human
gaggaggcuggagaggccagga

SEQ ID NO: 81723 - RNA, 22 nt, Human
ugugugcuaguuuugucaguau

SEQ ID NO: 81724 - RNA, 22 nt, Human
guguugaugugucuguauucua

SEQ ID NO: 81725 - RNA, 22 nt, Human
uuguuuuaguagaaguuacaug

SEQ ID NO: 81726 - RNA, 22 nt, Human
cuuggggauuuuaaagaccucu

SEQ ID NO: 81727 - RNA, 22 nt, Human
ggaggaagagaccagggggcuu

SEQ ID NO: 81728 - RNA, 22 nt, Human
ggggcaucguugauugcauggu

SEQ ID NO: 81729 - RNA, 22 nt, Human
uaugggcaagagauaggugguc

SEQ ID NO: 81730 - RNA, 22 nt, Human
ggugucuuugauguugggcuga

SEQ ID NO: 81731 - RNA, 22 nt, Human
guugcuaugaaauuaaaauuua

SEQ ID NO: 81732 - RNA, 21 nt, Human
gggagaguagcgguagggagg

SEQ ID NO: 81733 - RNA, 19 nt, Human
uagcuguucuugaguguga

SEQ ID NO: 81734 - RNA, 22 nt, Human
guuguugucauuagcuguuuaa

SEQ ID NO: 81735 - RNA, 22 nt, Human
cagcucugcugggaggaugcag

SEQ ID NO: 81736 - RNA, 22 nt, Human
augcggcugugggggaauggga

SEQ ID NO: 81737 - RNA, 20 nt, Human
agaaggagagaugaggcaaa

SEQ ID NO: 81738 - RNA, 22 nt, Human
guuuggguggcuagagaaagaa

SEQ ID NO: 81739 - RNA, 22 nt, Human
agggcaggguuggugcuggugc

SEQ ID NO: 81740 - RNA, 22 nt, Human
auagggaggcggagggagcugg

SEQ ID NO: 81741 - RNA, 22 nt, Human
aggauggaaguaacuggauaau

SEQ ID NO: 81742 - RNA, 22 nt, Human
ggcucagaggagcuggaacggu

SEQ ID NO: 81743 - RNA, 22 nt, Human
uuggugauguagcagcaauugu

SEQ ID NO: 81744 - RNA, 22 nt, Human
ucacuuccuugcagcuguagaa

SEQ ID NO: 81745 - RNA, 22 nt, Human
uguuaguauuggcaaauuuguu

SEQ ID NO: 81746 - RNA, 21 nt, Human
uggcaggcagcuggaagcuug

SEQ ID NO: 81747 - RNA, 22 nt, Human
ucuugugguggaucccucauuu

SEQ ID NO: 81748 - RNA, 22 nt, Human
uuccugcuggucaaaguugccu

SEQ ID NO: 81749 - RNA, 22 nt, Human
guuuuauaacuauagugagaau

SEQ ID NO: 81750 - RNA, 22 nt, Human
ccagggaggucauagugcuggu

SEQ ID NO: 81751 - RNA, 22 nt, Human
augugugugcgagcgugugugu

SEQ ID NO: 81752 - RNA, 22 nt, Human
agaucugucaccauccuggagc

SEQ ID NO: 81753 - RNA, 22 nt, Human
ugaggaagugguuguaugguuu

SEQ ID NO: 81754 - RNA, 23 nt, Human
agagggaagagcuuagaugggga

SEQ ID NO: 81755 - RNA, 22 nt, Human
cagguggauggcgagcccugca

SEQ ID NO: 81756 - RNA, 20 nt, Human
ggcagagcuaugucuguugc

SEQ ID NO: 81757 - RNA, 22 nt, Human
agucaccuacagcucaugcuuc

SEQ ID NO: 81758 - RNA, 22 nt, Human
ucuuucugaugggaagggucaa

SEQ ID NO: 81759 - RNA, 22 nt, Human
agucacuguucugucaugucaa

SEQ ID NO: 81760 - RNA, 21 nt, Human
gcagcucaggauauagacuug

SEQ ID NO: 81761 - RNA, 22 nt, Human
cggggcuggcguuagggaggca

SEQ ID NO: 81762 - RNA, 22 nt, Human
ggcuggagcaggcugcacagug

SEQ ID NO: 81763 - RNA, 22 nt, Human
uaucauuuuacugugacauuuu

SEQ ID NO: 81764 - RNA, 22 nt, Human
acgugugugugcacguguguau

SEQ ID NO: 81765 - RNA, 22 nt, Human
agauggaguccugaagccagaa

SEQ ID NO: 81766 - RNA, 22 nt, Human
cacugcacuccagccugggcaa

SEQ ID NO: 81767 - RNA, 22 nt, Human
uggacacugguggauauggaau

SEQ ID NO: 81768 - RNA, 22 nt, Human
uggcagccugcgugaaggagcu

SEQ ID NO: 81769 - RNA, 22 nt, Human
augaggaacagcaagaauauuu

SEQ ID NO: 81770 - RNA, 22 nt, Human
ugggcagggagcuggaaccaca

SEQ ID NO: 81771 - RNA, 22 nt, Human
gaggcaggaagggaggguugug

SEQ ID NO: 81772 - RNA, 22 nt, Human
agucccugauggacuggaugag

SEQ ID NO: 81773 - RNA, 19 nt, Human
ucaggaggucgaccuggca

SEQ ID NO: 81774 - RNA, 22 nt, Human
ucccuugacauuacuugggagg

SEQ ID NO: 81775 - RNA, 22 nt, Human
uuaggggcuuaggcagaguuug

SEQ ID NO: 81776 - RNA, 22 nt, Human
uuuaauauuacacuuaccuugu

SEQ ID NO: 81777 - RNA, 22 nt, Human
uuugcaggaaauguacugaaug

SEQ ID NO: 81778 - RNA, 22 nt, Human
agagggagagaccuccgugccu

SEQ ID NO: 81779 - RNA, 22 nt, Human
augggagggagcagugaguguu

SEQ ID NO: 81780 - RNA, 21 nt, Human
guucuuaguuauauucucaau

SEQ ID NO: 81781 - RNA, 22 nt, Human
uguugaagcaccucugucuuuc

SEQ ID NO: 81782 - RNA, 22 nt, Human
aguaggauguuuagcccuucuu

SEQ ID NO: 81783 - RNA, 22 nt, Human
gucacuuugcuugcgaugcucc

SEQ ID NO: 81784 - RNA, 22 nt, Human
uaucugcuggagguaauuacuc

SEQ ID NO: 81785 - RNA, 22 nt, Human
uucacuguucuuagagaagacc

SEQ ID NO: 81786 - RNA, 18 nt, Human
auucauuugcguuuggcu

SEQ ID NO: 81787 - RNA, 22 nt, Human
ucagcucucucuuggugaucuc

SEQ ID NO: 81788 - RNA, 22 nt, Human
cugggggacagagagaggcggu

SEQ ID NO: 81789 - RNA, 21 nt, Human
ugagcccaaagcuguauuggu

SEQ ID NO: 81790 - RNA, 22 nt, Human
cagagagcguccauccggugcc

SEQ ID NO: 81791 - RNA, 22 nt, Human
aggguggaggacaggccaguga

SEQ ID NO: 81792 - RNA, 22 nt, Human
agauggaggaaagcaguuagaa

SEQ ID NO: 81793 - RNA, 22 nt, Human
gcucucuggccugggaggagga

SEQ ID NO: 81794 - RNA, 22 nt, Human
ggaggccagagaagagccaggc

SEQ ID NO: 81795 - RNA, 22 nt, Human
acuguugagggaagcagaugaa

SEQ ID NO: 81796 - RNA, 22 nt, Human
ggggaaggaaggggagggcacg

SEQ ID NO: 81797 - RNA, 22 nt, Human
cccagaggcugaguugggagca

SEQ ID NO: 81798 - RNA, 22 nt, Human
uugcucuuaccauuauguguga

SEQ ID NO: 81799 - RNA, 22 nt, Human
ugggcagggauuuggggaaacu

SEQ ID NO: 81800 - RNA, 22 nt, Human
aagagaggaaagggugugaggu

SEQ ID NO: 81801 - RNA, 22 nt, Human
gaguucuagauguauuauuaau

SEQ ID NO: 81802 - RNA, 22 nt, Human
ggcagggagagcgccgccaugc

SEQ ID NO: 81803 - RNA, 22 nt, Human
gggggcugugugcccgcucccc

SEQ ID NO: 81804 - RNA, 22 nt, Human
ucacuguuucaccgucugaagg

SEQ ID NO: 81805 - RNA, 22 nt, Human
uuuuguuacugauuauuaaaau

SEQ ID NO: 81806 - RNA, 22 nt, Human
uggaggcccagcugggggccgg

SEQ ID NO: 81807 - RNA, 22 nt, Human
agugaggggagaaugaggugga

SEQ ID NO: 81808 - RNA, 20 nt, Human
ugcugugugucuacuguggg

SEQ ID NO: 81809 - RNA, 22 nt, Human
gcuuucagggucacugucaaca

SEQ ID NO: 81810 - RNA, 22 nt, Human
acuuuauacuagugauaguuug

SEQ ID NO: 81811 - RNA, 22 nt, Human
uuguuauuauuauuuucguucu

SEQ ID NO: 81812 - RNA, 22 nt, Human
gccaguggucagugggagggug

SEQ ID NO: 81813 - RNA, 22 nt, Human
uuuucaaucaaguuuauuuaua

SEQ ID NO: 81814 - RNA, 22 nt, Human
uuauuuaagaucuuaauauaua

SEQ ID NO: 81815 - RNA, 22 nt, Human
uggcaaggccacaggugcaguu

SEQ ID NO: 81816 - RNA, 22 nt, Human
auauugcuuuauucuugaauau

SEQ ID NO: 81817 - RNA, 22 nt, Human
ggcuggggccuguugaagaugc

SEQ ID NO: 81818 - RNA, 22 nt, Human
uggaagugggcaucaccaucca

SEQ ID NO: 81819 - RNA, 22 nt, Human
gcugucccccaaagaugcuccu

SEQ ID NO: 81820 - RNA, 22 nt, Human
guuuuucuuugauuuagaacca

SEQ ID NO: 81821 - RNA, 22 nt, Human
gccucucuggcaaagcggugau

SEQ ID NO: 81822 - RNA, 22 nt, Human
gcuguugugaggaucagcauau

SEQ ID NO: 81823 - RNA, 22 nt, Human
uauuaaaagagaaaaagccacc

SEQ ID NO: 81824 - RNA, 22 nt, Human
gcagaaguauuguacgguggga

SEQ ID NO: 81825 - RNA, 22 nt, Human
auuagugguguauuuggcacua

SEQ ID NO: 81826 - RNA, 23 nt, Human
ucucacucauucuccucugucca

SEQ ID NO: 81827 - RNA, 22 nt, Human
caagggcagaggcagggccccg

SEQ ID NO: 81828 - RNA, 22 nt, Human
uugguuuacucuggggauaucu

SEQ ID NO: 81829 - RNA, 22 nt, Human
cuucuuucuuuucuucuucucu

SEQ ID NO: 81830 - RNA, 22 nt, Human
ugcucacugcuuguguucaguu

SEQ ID NO: 81831 - RNA, 22 nt, Human
ccagcaggagacuagcaacaua

SEQ ID NO: 81832 - RNA, 22 nt, Human
ccuuuggaugucauucuuggca

SEQ ID NO: 81833 - RNA, 22 nt, Human
gcuguggagaagcugccuaugg

SEQ ID NO: 81834 - RNA, 21 nt, Human
aaguuucucccuaauuguugc

SEQ ID NO: 81835 - RNA, 22 nt, Human
guuuuguagucuggagacuguc

SEQ ID NO: 81836 - RNA, 22 nt, Human
gagggugguggcggccggcacc

SEQ ID NO: 81837 - RNA, 22 nt, Human
cauuuugguaauguucguuugc

SEQ ID NO: 81838 - RNA, 22 nt, Human
acucacuguuuugaaauugaac

SEQ ID NO: 81839 - RNA, 22 nt, Human
uggccccauuuuucuggagccu

SEQ ID NO: 81840 - RNA, 23 nt, Human
uugcuuuugccccaaaagaguua

SEQ ID NO: 81841 - RNA, 22 nt, Human
ggcucccgugggaugguggagc

SEQ ID NO: 81842 - RNA, 22 nt, Human
cagggcagaguuaagaugcugg

SEQ ID NO: 81843 - RNA, 22 nt, Human
ggcugugguggacgcgggaaac

SEQ ID NO: 81844 - RNA, 22 nt, Human
ugaaguuuagaaaaagugccuu

SEQ ID NO: 81845 - RNA, 22 nt, Human
guucaaucucucaugcauuuuc

SEQ ID NO: 81846 - RNA, 22 nt, Human
uucacugugauguuuaagagaa

SEQ ID NO: 81847 - RNA, 22 nt, Human
aaugagaauguaagugaagaga

SEQ ID NO: 81848 - RNA, 22 nt, Human
uuuauguuuguuuuugaaauaa

SEQ ID NO: 81849 - RNA, 22 nt, Human
uggggcauacgugaaauaauuu

SEQ ID NO: 81850 - RNA, 22 nt, Human
gcuugcuuuguaaauaucugug

SEQ ID NO: 81851 - RNA, 19 nt, Human
acuggggcaggcugggcuu

SEQ ID NO: 81852 - RNA, 22 nt, Human
cagagcugucauuugccaguga

SEQ ID NO: 81853 - RNA, 17 nt, Human
ucuguguccgcucaguc

SEQ ID NO: 81854 - RNA, 22 nt, Human
guuuauucuuuuauuugugaga

SEQ ID NO: 81855 - RNA, 22 nt, Human
uucacugugauugggguggauu

SEQ ID NO: 81856 - RNA, 22 nt, Human
ccagggcuggaggaggucagga

SEQ ID NO: 81857 - RNA, 22 nt, Human
agauucucccuccuggcgcugu

SEQ ID NO: 81858 - RNA, 22 nt, Human
uggagcugguucuggggaagcu

SEQ ID NO: 81859 - RNA, 22 nt, Human
ggaggccgugcugugcugccag

SEQ ID NO: 81860 - RNA, 21 nt, Human
aggugaaggcgagggggacag

SEQ ID NO: 81861 - RNA, 22 nt, Human
cagaccagaaggaagccgacaa

SEQ ID NO: 81862 - RNA, 22 nt, Human
aggcucagcaucugauucauau

SEQ ID NO: 81863 - RNA, 22 nt, Human
gcuguguaugaugcaggcaccu

SEQ ID NO: 81864 - RNA, 22 nt, Human
uuucacuucgaucagaguuuuu

SEQ ID NO: 81865 - RNA, 22 nt, Human
caguggacacuuccucuacaau

SEQ ID NO: 81866 - RNA, 22 nt, Human
ugguugauuaauuuugccaagc

SEQ ID NO: 81867 - RNA, 20 nt, Human
ugccagagagcucauacccu

SEQ ID NO: 81868 - RNA, 22 nt, Human
uuuugcuucuaguauauuuuuu

SEQ ID NO: 81869 - RNA, 22 nt, Human
agggggaauccugcuuauggau

SEQ ID NO: 81870 - RNA, 22 nt, Human
ggacauaguugcuauggagagu

SEQ ID NO: 81871 - RNA, 22 nt, Human
agggcugcugcuccgggcccag

SEQ ID NO: 81872 - RNA, 22 nt, Human
uuuuaauaguauaucuagacac

SEQ ID NO: 81873 - RNA, 22 nt, Human
acauaaaccccccuuccccagg

SEQ ID NO: 81874 - RNA, 22 nt, Human
auuugcuuguucaccaguacuu

SEQ ID NO: 81875 - RNA, 22 nt, Human
ucccuucccaccccugccuuuu

SEQ ID NO: 81876 - RNA, 22 nt, Human
agagacuguaaugagagguaca

SEQ ID NO: 81877 - RNA, 22 nt, Human
ccugccagaaaagagggaguuc

SEQ ID NO: 81878 - RNA, 22 nt, Human
uaauaaaaauuuaauucacauu

SEQ ID NO: 81879 - RNA, 22 nt, Human
cucuugugucaccauggauaaa

SEQ ID NO: 81880 - RNA, 22 nt, Human
uccuuuauuuaugggcagugua

SEQ ID NO: 81881 - RNA, 22 nt, Human
cuguggcuaggaagcuguggga

SEQ ID NO: 81882 - RNA, 20 nt, Human
cuggaguguagcaguggcug

SEQ ID NO: 81883 - RNA, 22 nt, Human
aaauauuaaugaugaagguagu

SEQ ID NO: 81884 - RNA, 22 nt, Human
uuucucuuguauuugaaucacu

SEQ ID NO: 81885 - RNA, 22 nt, Human
uguuuucuuuccccuucuuuuc

SEQ ID NO: 81886 - RNA, 22 nt, Human
agcugaggccccgcagcagggu

SEQ ID NO: 81887 - RNA, 22 nt, Human
gaggccagcacccagaugcaug

SEQ ID NO: 81888 - RNA, 22 nt, Human
gcuggggaucgaaggcagagcc

SEQ ID NO: 81889 - RNA, 22 nt, Human
uugcuuucuuuguagguuuucc

SEQ ID NO: 81890 - RNA, 19 nt, Human
agcaucuccacagaaaaag

SEQ ID NO: 81891 - RNA, 22 nt, Human
auggaguguggccaggcaguaa

SEQ ID NO: 81892 - RNA, 22 nt, Human
ccucccuucccggcauggcucu

SEQ ID NO: 81893 - RNA, 22 nt, Human
agcggccucgcugccugcucag

SEQ ID NO: 81894 - RNA, 22 nt, Human
gaggggacugucuggcuccgag

SEQ ID NO: 81895 - RNA, 22 nt, Human
ggagacagauggcgucucaguu

SEQ ID NO: 81896 - RNA, 22 nt, Human
uggguauauauguugcuacaga

SEQ ID NO: 81897 - RNA, 22 nt, Human
cugcagagaccuaggucagguu

SEQ ID NO: 81898 - RNA, 22 nt, Human
ggugaguagaaguaguuggcuu

SEQ ID NO: 81899 - RNA, 20 nt, Human
uggguucaguuguuucuggc

SEQ ID NO: 81900 - RNA, 22 nt, Human
uuuuuaagguuuguuuauauau

SEQ ID NO: 81901 - RNA, 22 nt, Human
ggaggcccagaaggaagcccag

SEQ ID NO: 81902 - RNA, 22 nt, Human
agggcucacuacaacccuggga

SEQ ID NO: 81903 - RNA, 22 nt, Human
ccaggcuccccaggaggcccuu

SEQ ID NO: 81904 - RNA, 22 nt, Human
uggggcuccuccuggcaggagg

SEQ ID NO: 81905 - RNA, 22 nt, Human
gcagggcucuggagucaggcug

SEQ ID NO: 81906 - RNA, 22 nt, Human
gugcugggaggcccaggaugga

SEQ ID NO: 81907 - RNA, 22 nt, Human
caggccccagggacugggcgcu

SEQ ID NO: 81908 - RNA, 20 nt, Human
gacaugagggagcaaagagc

SEQ ID NO: 81909 - RNA, 22 nt, Human
agggaggagggacagaaagagg

SEQ ID NO: 81910 - RNA, 22 nt, Human
uuguuuguaaggcucuuagaau

SEQ ID NO: 81911 - RNA, 22 nt, Human
ugauucacagacuucacaaggc

SEQ ID NO: 81912 - RNA, 22 nt, Human
agagacaggguuuugucguguu

SEQ ID NO: 81913 - RNA, 22 nt, Human
uggcucaggccuacgacgccuu

SEQ ID NO: 81914 - RNA, 22 nt, Human
uacagaccaguaguucucagcg

SEQ ID NO: 81915 - RNA, 19 nt, Human
ggaggguguccucaguguc

SEQ ID NO: 81916 - RNA, 22 nt, Human
gagggcugccacguugggcgag

SEQ ID NO: 81917 - RNA, 22 nt, Human
uuucuugugauuuugaugaacu

SEQ ID NO: 81918 - RNA, 22 nt, Human
gaauuagguaauagaacuagua

SEQ ID NO: 81919 - RNA, 22 nt, Human
gcucagcuggagagggacgggu

SEQ ID NO: 81920 - RNA, 22 nt, Human
gaauucuaguucuguaucucug

SEQ ID NO: 81921 - RNA, 22 nt, Human
guauauuuaugagcauuagccu

SEQ ID NO: 81922 - RNA, 22 nt, Human
aggggaggcugggcuggggggc

SEQ ID NO: 81923 - RNA, 22 nt, Human
uucuugugugaauauaauuaca

SEQ ID NO: 81924 - RNA, 22 nt, Human
ggacggggagcuggaaagggga

SEQ ID NO: 81925 - RNA, 22 nt, Human
agcaagggucucucauggcuug

SEQ ID NO: 81926 - RNA, 22 nt, Human
ggcugggagguggcgaggaggc

SEQ ID NO: 81927 - RNA, 22 nt, Human
gucuuucuuuuacauauuugug

SEQ ID NO: 81928 - RNA, 22 nt, Human
gacuggggcauuagaguagcuu

SEQ ID NO: 81929 - RNA, 22 nt, Human
cagcuggggagagacauggcag

SEQ ID NO: 81930 - RNA, 22 nt, Human
aggcaggggagcuggaagggua

SEQ ID NO: 81931 - RNA, 22 nt, Human
uggaagcccagaaggaagcaga

SEQ ID NO: 81932 - RNA, 22 nt, Human
cuguggcugcgcccugggggag

SEQ ID NO: 81933 - RNA, 22 nt, Human
aggugagaacguggaggggcgg

SEQ ID NO: 81934 - RNA, 22 nt, Human
acagagcucccagccaucuccu

SEQ ID NO: 81935 - RNA, 22 nt, Human
ucagucucuggggcuucuguuu

SEQ ID NO: 81936 - RNA, 22 nt, Human
gaggagggagcuggaagcucuu

SEQ ID NO: 81937 - RNA, 20 nt, Human
aggggcuguaguuagaugac

SEQ ID NO: 81938 - RNA, 20 nt, Human
uucucugcagcaggcggccc

SEQ ID NO: 81939 - RNA, 22 nt, Human
uuuaucaggccaucuuaugucu

SEQ ID NO: 81940 - RNA, 22 nt, Human
uucuccaccugcuccucccacc

SEQ ID NO: 81941 - RNA, 22 nt, Human
gaaggagaggauugugaggcug

SEQ ID NO: 81942 - RNA, 22 nt, Human
uuuuauuuguauguugaaugua

SEQ ID NO: 81943 - RNA, 22 nt, Human
uuauuugcccauguuuagcaga

SEQ ID NO: 81944 - RNA, 22 nt, Human
uacauuugauuuuugcuucuuu

SEQ ID NO: 81945 - RNA, 22 nt, Human
aagccucaugccagauccaggu

SEQ ID NO: 81946 - RNA, 22 nt, Human
ccucaggaauuuauucuucugu

SEQ ID NO: 81947 - RNA, 20 nt, Human
ucugugugccaucaccuaac

SEQ ID NO: 81948 - RNA, 22 nt, Human
auccugugggguauugcugcau

SEQ ID NO: 81949 - RNA, 20 nt, Human
uuguacuuaugugagaagga

SEQ ID NO: 81950 - RNA, 22 nt, Human
aaagggagauaaaguaauuuua

SEQ ID NO: 81951 - RNA, 22 nt, Human
aagaugcuucaugagaguuggg

SEQ ID NO: 81952 - RNA, 22 nt, Human
aaaucauagccaugaacauuug

SEQ ID NO: 81953 - RNA, 22 nt, Human
gauuuuuaaaaguaguuuugaa

SEQ ID NO: 81954 - RNA, 22 nt, Human
uagggaggguuugggguggagg

SEQ ID NO: 81955 - RNA, 22 nt, Human
gcuguggaaaaugggucuccaa

SEQ ID NO: 81956 - RNA, 22 nt, Human
gggggcagguuccaggccagcu

SEQ ID NO: 81957 - RNA, 20 nt, Human
ccugggcuccaggagccccg

SEQ ID NO: 81958 - RNA, 22 nt, Human
guacauauccuuuacguuuugu

SEQ ID NO: 81959 - RNA, 22 nt, Human
ggcucacuguaccugccgccgc

SEQ ID NO: 81960 - RNA, 23 nt, Human
aggcugcagaagaauagggucau

SEQ ID NO: 81961 - RNA, 22 nt, Human
auggagugggaggacaugaagg

SEQ ID NO: 81962 - RNA, 22 nt, Human
ggcuagggagacagagggcaug

SEQ ID NO: 81963 - RNA, 22 nt, Human
uauuuuuacuguuugaugauuc

SEQ ID NO: 81964 - RNA, 22 nt, Human
uucuagcucauggugacagauc

SEQ ID NO: 81965 - RNA, 22 nt, Human
caauccccaggucccagaacag

SEQ ID NO: 81966 - RNA, 22 nt, Human
aagggagagggagaagguggga

SEQ ID NO: 81967 - RNA, 22 nt, Human
agccccaauuacagcugugcug

SEQ ID NO: 81968 - RNA, 22 nt, Human
uucacauucauuucuuauguuu

SEQ ID NO: 81969 - RNA, 22 nt, Human
ggagugaguauguucugaugca

SEQ ID NO: 81970 - RNA, 22 nt, Human
aucuguuccccuaugcucucua

SEQ ID NO: 81971 - RNA, 21 nt, Human
acugggcuagccugacuucug

SEQ ID NO: 81972 - RNA, 22 nt, Human
aggggaggggaguaucaggauu

SEQ ID NO: 81973 - RNA, 22 nt, Human
uugaauaguuuuggauagcaua

SEQ ID NO: 81974 - RNA, 22 nt, Human
gcaggggguaaggggcagggcu

SEQ ID NO: 81975 - RNA, 22 nt, Human
ugaguucugacugagcaugggg

SEQ ID NO: 81976 - RNA, 22 nt, Human
gaggcaggcggggcccaggugg

SEQ ID NO: 81977 - RNA, 22 nt, Human
gaggcucagagggacuuucaag

SEQ ID NO: 81978 - RNA, 21 nt, Human
caguucuaagugucaucuuuu

SEQ ID NO: 81979 - RNA, 22 nt, Human
ucccuguggauuaaggagaugu

SEQ ID NO: 81980 - RNA, 22 nt, Human
aucucacuucugucauguggca

SEQ ID NO: 81981 - RNA, 22 nt, Human
aagugauuuucccaccaucuac

SEQ ID NO: 81982 - RNA, 22 nt, Human
ccuucugcuggucaucccagug

SEQ ID NO: 81983 - RNA, 22 nt, Human
ggcagagcugugcgcccaccca

SEQ ID NO: 81984 - RNA, 22 nt, Human
gggcaagaagcuggaagcauuc

SEQ ID NO: 81985 - RNA, 22 nt, Human
ggcugugaaguacguugaaggu

SEQ ID NO: 81986 - RNA, 22 nt, Human
gagcagcucgagaaggaagcag

SEQ ID NO: 81987 - RNA, 22 nt, Human
aggggcugugucauuuguccua

SEQ ID NO: 81988 - RNA, 22 nt, Human
guguucuuuguagaggaucuug

SEQ ID NO: 81989 - RNA, 18 nt, Human
ggagaagaacagaugugg

SEQ ID NO: 81990 - RNA, 22 nt, Human
cuccuugguuccggcguuggag

SEQ ID NO: 81991 - RNA, 22 nt, Human
aguuaggaaauaaguugaguuu

SEQ ID NO: 81992 - RNA, 22 nt, Human
ucugcaugccucaggaggccug

SEQ ID NO: 81993 - RNA, 19 nt, Human
uccuacaugagacagagag

SEQ ID NO: 81994 - RNA, 20 nt, Human
uuuuuuaaauagagcuguug

SEQ ID NO: 81995 - RNA, 22 nt, Human
uuugaagaaacagucuuaagag

SEQ ID NO: 81996 - RNA, 22 nt, Human
cacagcuggggaagcugaggcc

SEQ ID NO: 81997 - RNA, 22 nt, Human
uacaagcucuuguagggggaaa

SEQ ID NO: 81998 - RNA, 22 nt, Human
cguuuugaguagauagccauau

SEQ ID NO: 81999 - RNA, 18 nt, Human
aggcuggggaucacaggg

SEQ ID NO: 82000 - RNA, 21 nt, Human
gggagugaguaaugauggggg

SEQ ID NO: 82001 - RNA, 22 nt, Human
cugguacuggaggaguucagag

SEQ ID NO: 82002 - RNA, 22 nt, Human
auuuauauauuuuguucuggua

SEQ ID NO: 82003 - RNA, 22 nt, Human
uuuacuauuaguauuucauuuu

SEQ ID NO: 82004 - RNA, 22 nt, Human
aagaaggaaggcaagagauggg

SEQ ID NO: 82005 - RNA, 22 nt, Human
agggcaguuuuacugaaaggug

SEQ ID NO: 82006 - RNA, 22 nt, Human
gaggcuugccacuguccauggc

SEQ ID NO: 82007 - RNA, 22 nt, Human
cucugcuuguaucacauuugcu

SEQ ID NO: 82008 - RNA, 22 nt, Human
uuuguauuguuuauuucauuuu

SEQ ID NO: 82009 - RNA, 23 nt, Human
aaguggugacugugcuacugaga

SEQ ID NO: 82010 - RNA, 22 nt, Human
ugggggaggaggagacagacug

SEQ ID NO: 82011 - RNA, 22 nt, Human
gggagggucugagagcugcacc

SEQ ID NO: 82012 - RNA, 22 nt, Human
cuugcucugggaauaugaguuu

SEQ ID NO: 82013 - RNA, 22 nt, Human
uguaaauucuauacacuuaaaa

SEQ ID NO: 82014 - RNA, 22 nt, Human
uuuuccuuagaaauacauugau

SEQ ID NO: 82015 - RNA, 22 nt, Human
ccauuuggccauucaguuguuc

SEQ ID NO: 82016 - RNA, 22 nt, Human
gugugucucaguugcuccgaag

SEQ ID NO: 82017 - RNA, 22 nt, Human
cacugcaaccuccaccucccgg

SEQ ID NO: 82018 - RNA, 22 nt, Human
gagcagcugagcuggaaugaga

SEQ ID NO: 82019 - RNA, 22 nt, Human
ugguucuagaugagaugaugag

SEQ ID NO: 82020 - RNA, 22 nt, Human
uuccuuuaaccaagagcaguac

SEQ ID NO: 82021 - RNA, 22 nt, Human
ggcuguggcagcuggaaguggu

SEQ ID NO: 82022 - RNA, 22 nt, Human
uuuuuuuaaguuuugauuuuag

SEQ ID NO: 82023 - RNA, 23 nt, Human
caggggacaggugaccugggcuc

SEQ ID NO: 82024 - RNA, 22 nt, Human
uuuuuuuuacuccggacagcuc

SEQ ID NO: 82025 - RNA, 22 nt, Human
uuggugaugcccaccuuuucau

SEQ ID NO: 82026 - RNA, 22 nt, Human
caguggagaccugccugcugga

SEQ ID NO: 82027 - RNA, 22 nt, Human
aaggugggacugagaggggaca

SEQ ID NO: 82028 - RNA, 18 nt, Human
ggccucagccuggccgga

SEQ ID NO: 82029 - RNA, 22 nt, Human
uaagggagcagaagcugugaaa

SEQ ID NO: 82030 - RNA, 22 nt, Human
cagggggacuuguuagguuuua

SEQ ID NO: 82031 - RNA, 22 nt, Human
cuccucccagcccaggcgccac

SEQ ID NO: 82032 - RNA, 22 nt, Human
ggaggaugaggguggugguguu

SEQ ID NO: 82033 - RNA, 22 nt, Human
agagggagagauuggcaaucag

SEQ ID NO: 82034 - RNA, 21 nt, Human
agaugaggauacugaggccua

SEQ ID NO: 82035 - RNA, 22 nt, Human
ucacaucugugugauugucauu

SEQ ID NO: 82036 - RNA, 22 nt, Human
uguguuguuggggauguuuuca

SEQ ID NO: 82037 - RNA, 22 nt, Human
aguugggaaaugcugcaguagu

SEQ ID NO: 82038 - RNA, 22 nt, Human
uucauauuguggucuugcauuc

SEQ ID NO: 82039 - RNA, 22 nt, Human
acucugcaguaaggaauuguuu

SEQ ID NO: 82040 - RNA, 22 nt, Human
ggcaaggaagaaagcagaaguu

SEQ ID NO: 82041 - RNA, 22 nt, Human
uucaugucuuugauucugauaa

SEQ ID NO: 82042 - RNA, 20 nt, Human
ucagugggaaagugagagug

SEQ ID NO: 82043 - RNA, 22 nt, Human
ugccagcuccgaggagcugcag

SEQ ID NO: 82044 - RNA, 22 nt, Human
ggccugcuaccagcugugaccu

SEQ ID NO: 82045 - RNA, 20 nt, Human
ucacuguaauugccuacauu

SEQ ID NO: 82046 - RNA, 22 nt, Human
ugucuuugaccuuaagaaguuu

SEQ ID NO: 82047 - RNA, 22 nt, Human
auuuucuugucucuguuguagg

SEQ ID NO: 82048 - RNA, 22 nt, Human
uuccgcuuucaauggcuuggcu

SEQ ID NO: 82049 - RNA, 22 nt, Human
aggcuccucugggggccccgga

SEQ ID NO: 82050 - RNA, 22 nt, Human
gugaucagaagaaccugccgaa

SEQ ID NO: 82051 - RNA, 18 nt, Human
cccagaggaaugccugga

SEQ ID NO: 82052 - RNA, 22 nt, Human
cccuguccugcuaggcccuggu

SEQ ID NO: 82053 - RNA, 22 nt, Human
gcagguggaagcagcagacuca

SEQ ID NO: 82054 - RNA, 22 nt, Human
aggcgaagggaccagacgguag

SEQ ID NO: 82055 - RNA, 22 nt, Human
gugguuuagccuucauuaaccu

SEQ ID NO: 82056 - RNA, 22 nt, Human
uuuuuaaaagaugauuuaauga

SEQ ID NO: 82057 - RNA, 22 nt, Human
auucauucugaccucaagagaa

SEQ ID NO: 82058 - RNA, 22 nt, Human
uucuugucuuuguuauguagga

SEQ ID NO: 82059 - RNA, 22 nt, Human
gucucacuucauuuucuuagcc

SEQ ID NO: 82060 - RNA, 22 nt, Human
uggcucaguaaucgagucuccu

SEQ ID NO: 82061 - RNA, 22 nt, Human
uaggauugguguauguagguuu

SEQ ID NO: 82062 - RNA, 22 nt, Human
gcugcuuagaaccauauuuaaa

SEQ ID NO: 82063 - RNA, 22 nt, Human
aguaggaauucaaagagacaaa

SEQ ID NO: 82064 - RNA, 22 nt, Human
gaaccauuuaauggagaugcuc

SEQ ID NO: 82065 - RNA, 22 nt, Human
gagccucaggguuuuguugaca

SEQ ID NO: 82066 - RNA, 22 nt, Human
cuguccauuuucgugccuccuu

SEQ ID NO: 82067 - RNA, 22 nt, Human
aagaaauacagaaauggcagua

SEQ ID NO: 82068 - RNA, 22 nt, Human
gcucagagaaaacuggggcuug

SEQ ID NO: 82069 - RNA, 22 nt, Human
aaggucuucgaaccuuauguua

SEQ ID NO: 82070 - RNA, 22 nt, Human
guucuacaugacacucaacauu

SEQ ID NO: 82071 - RNA, 22 nt, Human
auuuuuuuuccugucucuuuca

SEQ ID NO: 82072 - RNA, 22 nt, Human
aucauguauauuuuugcuauua

SEQ ID NO: 82073 - RNA, 22 nt, Human
uggagccugauggauaggaacg

SEQ ID NO: 82074 - RNA, 22 nt, Human
agcuuucuauauaugaguugcu

SEQ ID NO: 82075 - RNA, 22 nt, Human
cucucugcugucuuucgggaaa

SEQ ID NO: 82076 - RNA, 22 nt, Human
uucccugugcaguauguuccaa

SEQ ID NO: 82077 - RNA, 22 nt, Human
augcagauguagauucugaaau

SEQ ID NO: 82078 - RNA, 22 nt, Human
ugcuguugacuuuguuguucuu

SEQ ID NO: 82079 - RNA, 22 nt, Human
uggggcugguaccguaauauau

SEQ ID NO: 82080 - RNA, 18 nt, Human
guucaagcauuuugcucu

SEQ ID NO: 82081 - RNA, 22 nt, Human
cugucucugauaagcucgaggg

SEQ ID NO: 82082 - RNA, 22 nt, Human
cauaggcucuucagagaacuga

SEQ ID NO: 82083 - RNA, 22 nt, Human
ugggggagggagaguugauggg

SEQ ID NO: 82084 - RNA, 22 nt, Human
gggcugagagcuggaaucugag

SEQ ID NO: 82085 - RNA, 22 nt, Human
uguugaaacagcuauugacuuu

SEQ ID NO: 82086 - RNA, 22 nt, Human
gugucacuuucaggagcucuaa

SEQ ID NO: 82087 - RNA, 22 nt, Human
uccagcugugcuccaggaggug

SEQ ID NO: 82088 - RNA, 22 nt, Human
ugcuuuauucgacaucugguag

SEQ ID NO: 82089 - RNA, 22 nt, Human
agugagaguauuaaugugaacu

SEQ ID NO: 82090 - RNA, 22 nt, Human
ugagggaggggaaugugugcag

SEQ ID NO: 82091 - RNA, 22 nt, Human
gggagccucccacugggggaag

SEQ ID NO: 82092 - RNA, 22 nt, Human
cuccugcuuuuucuucuuccga

SEQ ID NO: 82093 - RNA, 18 nt, Human
uucucucuggauaguagu

SEQ ID NO: 82094 - RNA, 20 nt, Human
uuggagaucacguguccagg

SEQ ID NO: 82095 - RNA, 22 nt, Human
auguacugacuguacuuuuaaa

SEQ ID NO: 82096 - RNA, 22 nt, Human
guccuguguaaguacuugcuca

SEQ ID NO: 82097 - RNA, 22 nt, Human
ggggaggguuuggaugagaguc

SEQ ID NO: 82098 - RNA, 22 nt, Human
guggaaggaauuaacagacuag

SEQ ID NO: 82099 - RNA, 22 nt, Human
cuuuuuaaaguaaauggcuaga

SEQ ID NO: 82100 - RNA, 22 nt, Human
ggcuagggaucuagaccaggac

SEQ ID NO: 82101 - RNA, 18 nt, Human
uucaggcucuugcaugaa

SEQ ID NO: 82102 - RNA, 22 nt, Human
uuuaaauuucugaaucuugagg

SEQ ID NO: 82103 - RNA, 22 nt, Human
agggcaguuaugaaugucucca

SEQ ID NO: 82104 - RNA, 22 nt, Human
aggggcugagaguuugaugugg

SEQ ID NO: 82105 - RNA, 22 nt, Human
aggauggauagcaaggaagccg

SEQ ID NO: 82106 - RNA, 22 nt, Human
uaguggaaccuucuaaaugacg

SEQ ID NO: 82107 - RNA, 22 nt, Human
aggccccacaaacucgccuuug

SEQ ID NO: 82108 - RNA, 22 nt, Human
aagcucuuuccacuaaaccacu

SEQ ID NO: 82109 - RNA, 22 nt, Human
uacauaauagcaaggugcuguc

SEQ ID NO: 82110 - RNA, 22 nt, Human
aagaacuagauagugguguaaa

SEQ ID NO: 82111 - RNA, 22 nt, Human
cuguuucucugccugcacacau

SEQ ID NO: 82112 - RNA, 22 nt, Human
gaggagcugggucagggagaca

SEQ ID NO: 82113 - RNA, 22 nt, Human
caauggagccaagaggaggaaa

SEQ ID NO: 82114 - RNA, 22 nt, Human
ucucugaccuccaccccaggag

SEQ ID NO: 82115 - RNA, 22 nt, Human
ggaaggggagcuggaaagggua

SEQ ID NO: 82116 - RNA, 22 nt, Human
gggcagagagcuggaacuccuu

SEQ ID NO: 82117 - RNA, 22 nt, Human
gccugggguuugcggggcugca

SEQ ID NO: 82118 - RNA, 22 nt, Human
gugucccaaagauuagaaauca

SEQ ID NO: 82119 - RNA, 23 nt, Human
uccuccccaccuuuguccccucc

SEQ ID NO: 82120 - RNA, 22 nt, Human
auggugaugaugaugaugauaa

SEQ ID NO: 82121 - RNA, 22 nt, Human
uauuuuuaccuaauuuaugaga

SEQ ID NO: 82122 - RNA, 22 nt, Human
ccaaggcuguggggcugugcag

SEQ ID NO: 82123 - RNA, 22 nt, Human
cauggcaggugcagauucugug

SEQ ID NO: 82124 - RNA, 22 nt, Human
ucuuugcugacacuuacacugu

SEQ ID NO: 82125 - RNA, 22 nt, Human
ccaggcucaccuggagccccug

SEQ ID NO: 82126 - RNA, 17 nt, Human
aaagccgaucagauguu

SEQ ID NO: 82127 - RNA, 22 nt, Human
agcaaggguugguuuucugaca

SEQ ID NO: 82128 - RNA, 21 nt, Human
uuucauuaguacaucaauuug

SEQ ID NO: 82129 - RNA, 22 nt, Human
uggggggacagauggagaggac

SEQ ID NO: 82130 - RNA, 22 nt, Human
gucugcagcacugugcacgguc

SEQ ID NO: 82131 - RNA, 22 nt, Human
ucagccuugguuuugguguugg

SEQ ID NO: 82132 - RNA, 22 nt, Human
agauggggccugaggacacugu

SEQ ID NO: 82133 - RNA, 22 nt, Human
gccagggcucgagcaggccagc

SEQ ID NO: 82134 - RNA, 22 nt, Human
cucacugucagcugcagggcuu

SEQ ID NO: 82135 - RNA, 22 nt, Human
uucauggauuugugaaauuuag

SEQ ID NO: 82136 - RNA, 22 nt, Human
uugcaagcccugaagggcugga

SEQ ID NO: 82137 - RNA, 22 nt, Human
ucgcccagguuggagugcagug

SEQ ID NO: 82138 - RNA, 22 nt, Human
uggcucagcgcggccuggucuu

SEQ ID NO: 82139 - RNA, 22 nt, Human
auuuuuuuggucauaugagaua

SEQ ID NO: 82140 - RNA, 22 nt, Human
cuguuaauugugaauuuuacau

SEQ ID NO: 82141 - RNA, 22 nt, Human
gcagaggcugccgugggcagga

SEQ ID NO: 82142 - RNA, 22 nt, Human
cacuguugagcaauguacagug

SEQ ID NO: 82143 - RNA, 22 nt, Human
aaaauauaaaggauguggguuu

SEQ ID NO: 82144 - RNA, 22 nt, Human
uuuguugucuucauaauacuuu

SEQ ID NO: 82145 - RNA, 20 nt, Human
uaguggaccuugaaggccuc

SEQ ID NO: 82146 - RNA, 21 nt, Human
ugcuuucugugcuuuuucugc

SEQ ID NO: 82147 - RNA, 22 nt, Human
uugucaggaacuaugauuaugc

SEQ ID NO: 82148 - RNA, 22 nt, Human
cauggcggcgcucucccugccu

SEQ ID NO: 82149 - RNA, 22 nt, Human
ugcccacuucaaaaucuucauu

SEQ ID NO: 82150 - RNA, 22 nt, Human
gcucagccuuuuguucuauuca

SEQ ID NO: 82151 - RNA, 21 nt, Human
cuauaaaaaugguucuuugcg

SEQ ID NO: 82152 - RNA, 22 nt, Human
aggggaggcugcgggcugccgu

SEQ ID NO: 82153 - RNA, 22 nt, Human
cauaaauuuuaccuuguaagug

SEQ ID NO: 82154 - RNA, 22 nt, Human
guggguauauauaugugugcug

SEQ ID NO: 82155 - RNA, 22 nt, Human
gagggggaaaagggcagcagag

SEQ ID NO: 82156 - RNA, 22 nt, Human
gugaaauuguacacucaguacc

SEQ ID NO: 82157 - RNA, 22 nt, Human
uucucugcgcuccggcccaguu

SEQ ID NO: 82158 - RNA, 22 nt, Human
uuuugaauaauucagaaacagc

SEQ ID NO: 82159 - RNA, 23 nt, Human
ucagaccaaccucuugcuggaac

SEQ ID NO: 82160 - RNA, 22 nt, Human
ucaguggaacacacagaguggg

SEQ ID NO: 82161 - RNA, 22 nt, Human
auucuuuagaguccuucaaaua

SEQ ID NO: 82162 - RNA, 22 nt, Human
augggagggugaggaggcagcu

SEQ ID NO: 82163 - RNA, 20 nt, Human
ccuuguggaugucuuuuuug

SEQ ID NO: 82164 - RNA, 22 nt, Human
ggagagcuagugagcuggaggu

SEQ ID NO: 82165 - RNA, 22 nt, Human
cuccacagccccuccaguggca

SEQ ID NO: 82166 - RNA, 22 nt, Human
aagcucagcugguggugauugc

SEQ ID NO: 82167 - RNA, 22 nt, Human
uuuauaauuacguaaaauauuu

SEQ ID NO: 82168 - RNA, 22 nt, Human
uccucccugcacucagugaagu

SEQ ID NO: 82169 - RNA, 22 nt, Human
agggagucuggccgucggcugg

SEQ ID NO: 82170 - RNA, 22 nt, Human
gagggaggugacaaggacauag

SEQ ID NO: 82171 - RNA, 22 nt, Human
gcuggccugcgagggcaggcug

SEQ ID NO: 82172 - RNA, 22 nt, Human
ugaauucaaacuuuuuaacaag

SEQ ID NO: 82173 - RNA, 22 nt, Human
cuguguguauaauguuugauaa

SEQ ID NO: 82174 - RNA, 22 nt, Human
uuguuguuguuguuauuuaguu

SEQ ID NO: 82175 - RNA, 22 nt, Human
uugcuuuuugggguuuacuggg

SEQ ID NO: 82176 - RNA, 22 nt, Human
uguguuguuuggggauguccau

SEQ ID NO: 82177 - RNA, 22 nt, Human
ugagggaguguggauacaguag

SEQ ID NO: 82178 - RNA, 22 nt, Human
caguagcuuuuugcagacaaga

SEQ ID NO: 82179 - RNA, 22 nt, Human
cucugugucugauucugggaag

SEQ ID NO: 82180 - RNA, 22 nt, Human
acuggagcccguggaggcgcag

SEQ ID NO: 82181 - RNA, 23 nt, Human
ucugccuccuaauuguugguguc

SEQ ID NO: 82182 - RNA, 22 nt, Human
caagaaaaaacaugaugagugu

SEQ ID NO: 82183 - RNA, 22 nt, Human
uuuguacuuucuaauguauuua

SEQ ID NO: 82184 - RNA, 22 nt, Human
augcugugccuggaaagcggcu

SEQ ID NO: 82185 - RNA, 22 nt, Human
ugugaagaauuaaugugaauca

SEQ ID NO: 82186 - RNA, 22 nt, Human
gugauggucgagcgcuuguugu

SEQ ID NO: 82187 - RNA, 22 nt, Human
gcagggcucagccgcucccacc

SEQ ID NO: 82188 - RNA, 22 nt, Human
caauaccucuuggugauugggc

SEQ ID NO: 82189 - RNA, 22 nt, Human
uuuuaggauuugaguugcugga

SEQ ID NO: 82190 - RNA, 23 nt, Human
aaggugaagccaccaggugagga

SEQ ID NO: 82191 - RNA, 17 nt, Human
uuagagcuacauguuga

SEQ ID NO: 82192 - RNA, 22 nt, Human
gagggagugggcccgugggcac

SEQ ID NO: 82193 - RNA, 22 nt, Human
uggguucaaauccugguuccac

SEQ ID NO: 82194 - RNA, 22 nt, Human
cccagagggcugaggauaugaa

SEQ ID NO: 82195 - RNA, 22 nt, Human
aggauagacuucagaaggcaua

SEQ ID NO: 82196 - RNA, 22 nt, Human
ugugucuuuggcgaugucugga

SEQ ID NO: 82197 - RNA, 22 nt, Human
uggggcuggccaggaggagucu

SEQ ID NO: 82198 - RNA, 22 nt, Human
gguuuucacgauccucccuuuu

SEQ ID NO: 82199 - RNA, 22 nt, Human
ugagagggagacagcucuagca

SEQ ID NO: 82200 - RNA, 22 nt, Human
ggggaggugugcaggacaccuc

SEQ ID NO: 82201 - RNA, 22 nt, Human
cugcugugcagacagacucucu

SEQ ID NO: 82202 - RNA, 22 nt, Human
ggggcucauuugcaggggggag

SEQ ID NO: 82203 - RNA, 22 nt, Human
uugauagauuuuagaggcaggc

SEQ ID NO: 82204 - RNA, 22 nt, Human
cagcuguggagauggggugcau

SEQ ID NO: 82205 - RNA, 22 nt, Human
ccuccuuuccuguuuuccugag

SEQ ID NO: 82206 - RNA, 22 nt, Human
agggcugggcuuggcaggcugg

SEQ ID NO: 82207 - RNA, 22 nt, Human
ggagccucuaaacaguuaucaa

SEQ ID NO: 82208 - RNA, 19 nt, Human
agcucaggcccaucguccc

SEQ ID NO: 82209 - RNA, 22 nt, Human
ggagcucacuacgaaauaagcu

SEQ ID NO: 82210 - RNA, 22 nt, Human
cuacuucucccuagaucagaaa

SEQ ID NO: 82211 - RNA, 22 nt, Human
uguuuagcucugacuaugugau

SEQ ID NO: 82212 - RNA, 22 nt, Human
auggauggaagcagccugaacu

SEQ ID NO: 82213 - RNA, 22 nt, Human
aagagaggcccaaguggcuggc

SEQ ID NO: 82214 - RNA, 22 nt, Human
ccagcugggucccugcuggggc

SEQ ID NO: 82215 - RNA, 22 nt, Human
cacauuuuccagaagaaucaga

SEQ ID NO: 82216 - RNA, 22 nt, Human
uucuucuucuuccucauccuca

SEQ ID NO: 82217 - RNA, 22 nt, Human
ucccugcugggcgaucuucucu

SEQ ID NO: 82218 - RNA, 22 nt, Human
auaguugcugucauuauuugag

SEQ ID NO: 82219 - RNA, 22 nt, Human
aggcagagaggucuuccuggaa

SEQ ID NO: 82220 - RNA, 22 nt, Human
cucuguguguuugugugugugu

SEQ ID NO: 82221 - RNA, 22 nt, Human
cugguuuauuucauaguuuguu

SEQ ID NO: 82222 - RNA, 22 nt, Human
gaggggaacaggcauucuuaag

SEQ ID NO: 82223 - RNA, 22 nt, Human
gaguagaacagauagucaagaa

SEQ ID NO: 82224 - RNA, 22 nt, Human
ggcucccccauggcugacagac

SEQ ID NO: 82225 - RNA, 22 nt, Human
gcagagcugucuaagucacuuc

SEQ ID NO: 82226 - RNA, 22 nt, Human
agauuuucuuuuccaucuuugu

SEQ ID NO: 82227 - RNA, 22 nt, Human
gcuguggacacagcucucuuca

SEQ ID NO: 82228 - RNA, 22 nt, Human
uuuaacauaugaaagaauauuu

SEQ ID NO: 82229 - RNA, 22 nt, Human
cucagcgagggaaagaggccgc

SEQ ID NO: 82230 - RNA, 22 nt, Human
cggcugcagcggagcaggcugg

SEQ ID NO: 82231 - RNA, 22 nt, Human
cuggaagcgucggaggaagggc

SEQ ID NO: 82232 - RNA, 22 nt, Human
uggagccuugugagaccacaau

SEQ ID NO: 82233 - RNA, 22 nt, Human
acauuccugaagguaaugagaa

SEQ ID NO: 82234 - RNA, 22 nt, Human
uuauauuuuauuuaauuaaaua

SEQ ID NO: 82235 - RNA, 22 nt, Human
agggaguuccgaucugugcacc

SEQ ID NO: 82236 - RNA, 22 nt, Human
uggaugccuugggggaggagga

SEQ ID NO: 82237 - RNA, 22 nt, Human
cuccuuugagcaaaucuuugau

SEQ ID NO: 82238 - RNA, 22 nt, Human
gaggugauuccucccauguaau

SEQ ID NO: 82239 - RNA, 22 nt, Human
auguguguaugacugaaucuau

SEQ ID NO: 82240 - RNA, 22 nt, Human
uucugcuuuaaagcucauguuu

SEQ ID NO: 82241 - RNA, 19 nt, Human
gauauugagcugagaauuc

SEQ ID NO: 82242 - RNA, 22 nt, Chlamydophila pneumoniae TW-183
aaauaaagaacacauugcagau

SEQ ID NO: 82243 - RNA, 22 nt, Chlamydophila pneumoniae TW-183
agaguucugcugcugcuagacc

SEQ ID NO: 82244 - RNA, 23 nt, Chlamydophila pneumoniae TW-183
gcuuaugcauuaggaaggagagc

SEQ ID NO: 82245 - RNA, 22 nt, Chlamydophila pneumoniae TW-183
uggcuauucucuuugguauagg

SEQ ID NO: 82246 - RNA, 22 nt, Chlamydophila pneumoniae TW-183
ggauuuaaauugggauucccag

SEQ ID NO: 82247 - RNA, 22 nt, Chlamydophila pneumoniae TW-183
uacuucaacucguugauuguga

SEQ ID NO: 82248 - RNA, 22 nt, Chlamydophila pneumoniae TW-183
aucaucugauccauaaggauag

SEQ ID NO: 82249 - RNA, 22 nt, Chlamydophila pneumoniae TW-183
uauguuaggaaauaguguugga

SEQ ID NO: 82250 - RNA, 22 nt, Chlamydophila pneumoniae TW-183
gugcuaugagaucuuuugggcu

SEQ ID NO: 82251 - RNA, 22 nt, Chlamydophila pneumoniae TW-183
cuucuagagacucgcgaaguaa

SEQ ID NO: 82252 - RNA, 22 nt, Chlamydophila pneumoniae TW-183
acauccauuguucaggcugacu

SEQ ID NO: 82253 - RNA, 22 nt, Chlamydophila pneumoniae TW-183
uaggagcuauuugugucauugc

SEQ ID NO: 82254 - RNA, 22 nt, Chlamydophila pneumoniae TW-183
uacaggaaaaacuuuaagaauu

SEQ ID NO: 82255 - RNA, 22 nt, Chlamydophila pneumoniae TW-183
agguguagagggaugacauuca

SEQ ID NO: 82256 - RNA, 21 nt, Chlamydophila pneumoniae TW-183
acaagaaucacaguucuauca

SEQ ID NO: 82257 - RNA, 22 nt, Chlamydophila pneumoniae TW-183
ugaugcuacgaucacuuaagaa

SEQ ID NO: 82258 - RNA, 22 nt, Chlamydophila pneumoniae TW-183
cuugauagaacugugauucuug

SEQ ID NO: 82259 - RNA, 22 nt, Chlamydophila pneumoniae TW-183
cauuguuccuuuaagauuucug

SEQ ID NO: 82260 - RNA, 22 nt, Chlamydophila pneumoniae TW-183
cugcagaaggagugggagcacg

SEQ ID NO: 82261 - RNA, 22 nt, Chlamydophila pneumoniae TW-183
uuauuguucuuggugaaucugu

SEQ ID NO: 82262 - RNA, 22 nt, Chlamydophila pneumoniae TW-183
gaaggauaguuucucuaugaua

SEQ ID NO: 82263 - RNA, 22 nt, Chlamydophila pneumoniae TW-183
uaguugaaacagauggaagagu

SEQ ID NO: 82264 - RNA, 22 nt, Chlamydophila pneumoniae TW-183
uuacgagaaaaguuagaauuua

SEQ ID NO: 82265 - RNA, 22 nt, Chlamydophila pneumoniae TW-183
uuuagugaaagaagcguuuuuc

SEQ ID NO: 82266 - RNA, 22 nt, Chlamydophila pneumoniae TW-183
ugauuuugcuucgcagcuugaa

SEQ ID NO: 82267 - RNA, 22 nt, Chlamydophila pneumoniae TW-183
ucuccucccagcaauuucucgu

SEQ ID NO: 82268 - RNA, 22 nt, Chlamydophila pneumoniae TW-183
agcuucucgaauuucuaauguu

SEQ ID NO: 82269 - RNA, 22 nt, Chlamydophila pneumoniae TW-183
ugaugaaaugacagguauggaa

SEQ ID NO: 82270 - RNA, 22 nt, Chlamydophila pneumoniae TW-183
gauucuguggaguaugcaucca

SEQ ID NO: 82271 - RNA, 23 nt, Chlamydophila pneumoniae TW-183
uccucagucuucccuagggaacu

SEQ ID NO: 82272 - RNA, 22 nt, Chlamydophila pneumoniae TW-183
aauuuucuguucuuuaccgcug

SEQ ID NO: 82273 - RNA, 22 nt, Chlamydophila pneumoniae TW-183
agugaugccuuugauuacgaaa

SEQ ID NO: 82274 - RNA, 22 nt, Chlamydophila pneumoniae TW-183
gcugccgauagaacuugauuug

SEQ ID NO: 82275 - RNA, 22 nt, Chlamydophila pneumoniae TW-183
uagaggaagagguugaccugca

SEQ ID NO: 82276 - RNA, 22 nt, Chlamydophila pneumoniae TW-183
ucugaaguccuagcauugaaag

SEQ ID NO: 82277 - RNA, 22 nt, Chlamydophila pneumoniae TW-183
aacauuuuccacugagaaguug

SEQ ID NO: 82278 - RNA, 22 nt, Chlamydophila pneumoniae TW-183
gagaguauagggguguuucgga

SEQ ID NO: 82279 - RNA, 22 nt, Chlamydophila pneumoniae TW-183
aucugcaauguguucuuuauuu

SEQ ID NO: 82280 - RNA, 22 nt, Chlamydophila pneumoniae TW-183
agaaaccagucauugcuuagga

SEQ ID NO: 82281 - RNA, 22 nt, Chlamydophila pneumoniae TW-183
aaaauauaugcagaguuauggu

SEQ ID NO: 82282 - RNA, 22 nt, Chlamydophila pneumoniae TW-183
ucguaugggacuugccuaucgu

SEQ ID NO: 82283 - RNA, 22 nt, Chlamydophila pneumoniae TW-183
cauuuuuaaauacgauggucgu

SEQ ID NO: 82284 - RNA, 19 nt, Chlamydophila pneumoniae TW-183
uagaaaaagaucuaagucg

SEQ ID NO: 82285 - RNA, 22 nt, Chlamydophila pneumoniae TW-183
uccuauuuucaugagaaagggg

SEQ ID NO: 82286 - RNA, 22 nt, Chlamydophila pneumoniae TW-183
uuaaacucucgagacuccguaa

SEQ ID NO: 82287 - RNA, 22 nt, Chlamydophila pneumoniae TW-183
guucuagugaucuaaguacgaa

SEQ ID NO: 82288 - RNA, 22 nt, Chlamydophila pneumoniae TW-183
uagaacgugcguucucuuaugu

SEQ ID NO: 82289 - RNA, 22 nt, Chlamydophila pneumoniae TW-183
cuggagacgcuuggaaagaagc

SEQ ID NO: 82290 - RNA, 22 nt, Chlamydophila pneumoniae TW-183
uugaaagauacccggaugauuc

SEQ ID NO: 82291 - RNA, 22 nt, Chlamydophila pneumoniae TW-183
uccugcaaaaacuccuuuggaa

SEQ ID NO: 82292 - RNA, 22 nt, Chlamydophila pneumoniae TW-183
auaacgcaaaugaggucgacuu

SEQ ID NO: 82293 - RNA, 21 nt, Chlamydophila pneumoniae TW-183
aauuccucacuuccuuuaccu

SEQ ID NO: 82294 - RNA, 22 nt, Chlamydophila pneumoniae TW-183
aagaagaagaauccguggauga

SEQ ID NO: 82295 - RNA, 22 nt, Chlamydophila pneumoniae TW-183
aaaucaagaauacaucgcagau

SEQ ID NO: 82296 - RNA, 22 nt, Chlamydophila pneumoniae TW-183
ggaaguuuacucuugauuuugg

SEQ ID NO: 82297 - RNA, 22 nt, Chlamydophila pneumoniae TW-183
ucuucacuucccgcaguuuuag

SEQ ID NO: 82298 - RNA, 22 nt, Chlamydophila pneumoniae TW-183
uauucgacuguugcugcucuaa

SEQ ID NO: 82299 - RNA, 22 nt, Chlamydophila pneumoniae TW-183
auuggggauuguuacgauagac

SEQ ID NO: 82300 - RNA, 22 nt, Chlamydophila pneumoniae TW-183
aaacuucaggaacuuucugagu

SEQ ID NO: 82301 - RNA, 22 nt, Chlamydophila pneumoniae TW-183
aauuggauaggguuucuugagg

SEQ ID NO: 82302 - RNA, 22 nt, Chlamydophila pneumoniae TW-183
ggucgcaccccggaaggguaga

SEQ ID NO: 82303 - RNA, 22 nt, Chlamydophila pneumoniae TW-183
uucgugaucaagggaaaacugu

SEQ ID NO: 82304 - RNA, 22 nt, Chlamydophila pneumoniae TW-183
aguuuuaccuuuaagugugauu

SEQ ID NO: 82305 - RNA, 22 nt, Chlamydophila pneumoniae TW-183
cauuuaaaccaaucggaagaga

SEQ ID NO: 82306 - RNA, 22 nt, Chlamydophila pneumoniae TW-183
ucuggaauucuuuaugcuguaa

SEQ ID NO: 82307 - RNA, 22 nt, Chlamydophila pneumoniae TW-183
auugugaaugcuauuuuguaaa

SEQ ID NO: 82308 - RNA, 22 nt, Chlamydophila pneumoniae TW-183
ucaccuccagggaugauucgua

SEQ ID NO: 82309 - RNA, 22 nt, Chlamydophila pneumoniae TW-183
ccugcagauguguaugcaagau

SEQ ID NO: 82310 - RNA, 22 nt, Chlamydophila pneumoniae TW-183
cuaagauuccucuauuuccugc

SEQ ID NO: 82311 - RNA, 22 nt, Chlamydophila pneumoniae TW-183
aaggaauuauccuaaagcagag

SEQ ID NO: 82312 - RNA, 22 nt, Chlamydophila pneumoniae TW-183
uggucuugauuuuuauagaaaa

SEQ ID NO: 82313 - RNA, 22 nt, Chlamydophila pneumoniae TW-183
uucagacuuuagaaacuucuuc

SEQ ID NO: 82314 - RNA, 22 nt, Chlamydophila pneumoniae TW-183
aggagauuuucucacuuacagc

SEQ ID NO: 82315 - RNA, 22 nt, Chlamydophila pneumoniae TW-183
cucuucaggaucggcauuauuu

SEQ ID NO: 82316 - RNA, 22 nt, Chlamydophila pneumoniae TW-183
aaauuaucggucaaaagcuaag

SEQ ID NO: 82317 - RNA, 22 nt, Chlamydophila pneumoniae TW-183
gaugguaaaauuguuauaggaa

SEQ ID NO: 82318 - RNA, 22 nt, Chlamydophila pneumoniae TW-183
gaauugaacucuaaggacuacu

SEQ ID NO: 82319 - RNA, 22 nt, Chlamydophila pneumoniae TW-183
ggaaggaucuuuaucggaauau

SEQ ID NO: 82320 - RNA, 22 nt, Chlamydophila pneumoniae TW-183
ugccugcuucucaagauacucg

SEQ ID NO: 82321 - RNA, 22 nt, Chlamydophila pneumoniae TW-183
cuuuuugcuauuaaggaguauu

SEQ ID NO: 82322 - RNA, 22 nt, Chlamydophila pneumoniae TW-183
auccugaagauauucaggcaau

SEQ ID NO: 82323 - RNA, 22 nt, Chlamydophila pneumoniae TW-183
uuacucuauagaugcagaucca

SEQ ID NO: 82324 - RNA, 22 nt, Chlamydophila pneumoniae TW-183
agaacaaaccucagagcuaguu

SEQ ID NO: 82325 - RNA, 22 nt, Chlamydophila pneumoniae TW-183
aucuuuaggacuugaugaaggc

SEQ ID NO: 82326 - RNA, 22 nt, Chlamydophila pneumoniae TW-183
gagugguucuuccuaaagaacu

SEQ ID NO: 82327 - RNA, 22 nt, Chlamydophila pneumoniae TW-183
ucuuuaauuuucugaaagauua

SEQ ID NO: 82328 - RNA, 23 nt, Chlamydophila pneumoniae TW-183
cucaggaaaaacgacaacagcgg

SEQ ID NO: 82329 - RNA, 22 nt, Chlamydophila pneumoniae TW-183
uaggauaguauagugaggagau

SEQ ID NO: 82330 - RNA, 22 nt, Chlamydophila pneumoniae TW-183
ucuaugauuuuaguggguagag

SEQ ID NO: 82331 - RNA, 22 nt, Chlamydophila pneumoniae TW-183
uuuuuagggcuaaagcgagcga

SEQ ID NO: 82332 - RNA, 22 nt, Chlamydophila pneumoniae TW-183
ucugguggucccuuauguuggg

SEQ ID NO: 82333 - RNA, 22 nt, Chlamydophila pneumoniae TW-183
uccuguagagccuauuuaugau

SEQ ID NO: 82334 - RNA, 22 nt, Chlamydophila pneumoniae TW-183
ugagaaaagaggucuuuacaga

SEQ ID NO: 82335 - RNA, 18 nt, Chlamydophila pneumoniae TW-183
ucuuggucugugaccauu

SEQ ID NO: 82336 - RNA, 22 nt, Chlamydophila pneumoniae TW-183
guucuuuauuauacuccugaca

SEQ ID NO: 82337 - RNA, 22 nt, Chlamydophila pneumoniae TW-183
aaaaucagcaacuaacauagcu

SEQ ID NO: 82338 - RNA, 22 nt, Chlamydophila pneumoniae TW-183
uagaaaagaucuaagucguugu

SEQ ID NO: 82339 - RNA, 22 nt, Chlamydophila pneumoniae TW-183
aaagaggagaaagccgccuaug

SEQ ID NO: 82340 - RNA, 22 nt, Chlamydophila pneumoniae TW-183
uugaagaauuuguaaacucgua

SEQ ID NO: 82341 - RNA, 20 nt, Chlamydophila pneumoniae TW-183
auuuucugaucacgaaguuu

SEQ ID NO: 82342 - RNA, 22 nt, Chlamydophila pneumoniae TW-183
auucuucacaauaggagaaagu

SEQ ID NO: 82343 - RNA, 22 nt, Chlamydophila pneumoniae TW-183
uagcuacgucuuuucauaauaa

SEQ ID NO: 82344 - RNA, 22 nt, Chlamydophila pneumoniae TW-183
gagaagaguuaaaauaaugacg

SEQ ID NO: 82345 - RNA, 22 nt, Chlamydophila pneumoniae TW-183
aguuugcuuuguuauuaugauc

SEQ ID NO: 82346 - RNA, 22 nt, Chlamydophila pneumoniae TW-183
uauuuucuuuguagcuaccaau

SEQ ID NO: 82347 - RNA, 22 nt, Chlamydophila pneumoniae TW-183
ugcaugauucucccuacguggc

SEQ ID NO: 82348 - RNA, 22 nt, Chlamydophila pneumoniae TW-183
gcauuccauuuccaagcuuaua

SEQ ID NO: 82349 - RNA, 22 nt, Chlamydophila pneumoniae TW-183
uuccauucagaacggaagccua

SEQ ID NO: 82350 - RNA, 20 nt, Chlamydophila pneumoniae TW-183
uggcgugcuuccuaugagua

SEQ ID NO: 82351 - RNA, 22 nt, Chlamydophila pneumoniae TW-183
aggaaaagucgcgaagcguuau

SEQ ID NO: 82352 - RNA, 22 nt, Chlamydophila pneumoniae TW-183
uguaaagacuacagauccugaa

SEQ ID NO: 82353 - RNA, 22 nt, Chlamydophila pneumoniae TW-183
auguuccaagagaagaaagagu

SEQ ID NO: 82354 - RNA, 22 nt, Chlamydophila pneumoniae TW-183
uaguuucugcagggcacucuca

SEQ ID NO: 82355 - RNA, 22 nt, Chlamydophila pneumoniae TW-183
ucuaaagcugcauagcuuuccu

SEQ ID NO: 82356 - RNA, 22 nt, Chlamydophila pneumoniae TW-183
uuauggucggcugauuuucccu

SEQ ID NO: 82357 - RNA, 22 nt, Chlamydophila pneumoniae TW-183
agcacuauuggagaaucuggag

SEQ ID NO: 82358 - RNA, 22 nt, Chlamydophila pneumoniae TW-183
uggacgauacguuuuuaaugua

SEQ ID NO: 82359 - RNA, 22 nt, Chlamydophila pneumoniae TW-183
gagagauuuuuucauacuuauc

SEQ ID NO: 82360 - RNA, 17 nt, Chlamydophila pneumoniae TW-183
ucuugagcaucuuuuaa

SEQ ID NO: 82361 - RNA, 22 nt, Chlamydophila pneumoniae TW-183
aaggcuaucgauuugauagaug

SEQ ID NO: 82362 - RNA, 22 nt, Chlamydophila pneumoniae TW-183
auuuuaucuauagcacuuugcu

SEQ ID NO: 82363 - RNA, 22 nt, Chlamydophila pneumoniae TW-183
gaagauucuuuuaguggauugg

SEQ ID NO: 82364 - RNA, 22 nt, Chlamydophila pneumoniae TW-183
aagucucuggauaguaauaccc

SEQ ID NO: 82365 - RNA, 22 nt, Chlamydophila pneumoniae TW-183
gaaagaugacgaccgcccuuua

SEQ ID NO: 82366 - RNA, 22 nt, Chlamydophila pneumoniae TW-183
ugauuguaaugucuuuauuaga

SEQ ID NO: 82367 - RNA, 22 nt, Chlamydophila pneumoniae TW-183
uagaaggaccucgaucagugcu

SEQ ID NO: 82368 - RNA, 17 nt, Chlamydophila pneumoniae TW-183
gucuccucuuggaagga

SEQ ID NO: 82369 - RNA, 22 nt, Chlamydophila pneumoniae TW-183
agugcuucgauguagcgagaaa

SEQ ID NO: 82370 - RNA, 22 nt, Chlamydophila pneumoniae TW-183
caagaagauggucggcgcauua

SEQ ID NO: 82371 - RNA, 22 nt, Chlamydophila pneumoniae TW-183
cuaguuuugacguaggaagagg

SEQ ID NO: 82372 - RNA, 22 nt, Chlamydophila pneumoniae TW-183
aacucgggcagacguacugcau

SEQ ID NO: 82373 - RNA, 22 nt, Chlamydophila pneumoniae TW-183
uauuucagcuuaugucaaaggu

SEQ ID NO: 82374 - RNA, 22 nt, Chlamydophila pneumoniae TW-183
cauucuuuaaccaagggaaucu

SEQ ID NO: 82375 - RNA, 22 nt, Chlamydophila pneumoniae TW-183
uccaagagauacguaggaagag

SEQ ID NO: 82376 - RNA, 22 nt, Chlamydophila pneumoniae TW-183
ggucuucaagccaaaugaucag

SEQ ID NO: 82377 - RNA, 21 nt, Chlamydophila pneumoniae TW-183
uucuauggcugcucagaauau

SEQ ID NO: 82378 - RNA, 22 nt, Chlamydophila pneumoniae TW-183
uaucuuagagcgaugcugaccg

SEQ ID NO: 82379 - RNA, 22 nt, Chlamydophila pneumoniae TW-183
gauuuggaucaccaaagaaaau

SEQ ID NO: 82380 - RNA, 22 nt, Chlamydophila pneumoniae TW-183
aaaaaucucagaaccaagcuuu

SEQ ID NO: 82381 - RNA, 22 nt, Chlamydophila pneumoniae TW-183
uugugauuccucgagcgagacg

SEQ ID NO: 82382 - RNA, 22 nt, Chlamydophila pneumoniae TW-183
cuuggauuuucaagucuuuuga

SEQ ID NO: 82383 - RNA, 22 nt, Chlamydophila pneumoniae TW-183
ugcaugcuaaccuuccagagga

SEQ ID NO: 82384 - RNA, 22 nt, Chlamydophila pneumoniae TW-183
cccguauacgauuaaucacaga

SEQ ID NO: 82385 - RNA, 22 nt, Chlamydophila pneumoniae TW-183
uaggaucuuagaauguuguagg

SEQ ID NO: 82386 - RNA, 22 nt, Chlamydophila pneumoniae TW-183
uggaugaagaagcuggaaaucc

SEQ ID NO: 82387 - RNA, 22 nt, Chlamydophila pneumoniae TW-183
uagagcucuuaagcaggagauc

SEQ ID NO: 82388 - RNA, 22 nt, Chlamydophila pneumoniae TW-183
aaugucucucagguuuauuccu

SEQ ID NO: 82389 - RNA, 22 nt, Chlamydophila pneumoniae TW-183
aaucucugaacuuuugcuguug

SEQ ID NO: 82390 - RNA, 22 nt, Chlamydophila pneumoniae TW-183
uuguaggguuauuguccucugu

SEQ ID NO: 82391 - RNA, 22 nt, Chlamydophila pneumoniae TW-183
guucuaguaggacucgagaugg

SEQ ID NO: 82392 - RNA, 22 nt, Chlamydophila pneumoniae TW-183
gaggaauuuuugcguaauguuc

SEQ ID NO: 82393 - RNA, 21 nt, Chlamydophila pneumoniae TW-183
uaacucucgucgacuuuuccu

SEQ ID NO: 82394 - RNA, 20 nt, Chlamydophila pneumoniae TW-183
uuugugcgauuuucuugaac

SEQ ID NO: 82395 - RNA, 23 nt, Chlamydophila pneumoniae TW-183
aucuuuccagucuucugagaugc

SEQ ID NO: 82396 - RNA, 22 nt, Chlamydophila pneumoniae TW-183
agcugcucccguaauuacugcg

SEQ ID NO: 82397 - RNA, 19 nt, Chlamydophila pneumoniae TW-183
gaggaaaaggguccugaau

SEQ ID NO: 82398 - RNA, 20 nt, Chlamydophila pneumoniae TW-183
ccucaauuagggcuaaagau

SEQ ID NO: 82399 - RNA, 22 nt, Chlamydophila pneumoniae TW-183
ucuguauugucccagacaacca

SEQ ID NO: 82400 - RNA, 21 nt, Chlamydophila pneumoniae TW-183
cuuacgaguuuccuggaguuu

SEQ ID NO: 82401 - RNA, 22 nt, Chlamydophila pneumoniae TW-183
uuguaggggcuuguaucggauu

SEQ ID NO: 82402 - RNA, 22 nt, Chlamydophila pneumoniae TW-183
agcaagaguugucaaaaugaua

SEQ ID NO: 82403 - RNA, 22 nt, Chlamydophila pneumoniae TW-183
agaaucuugauggguagcggca

SEQ ID NO: 82404 - RNA, 22 nt, Chlamydophila pneumoniae TW-183
ugaguaggcucccccugcuaag

SEQ ID NO: 82405 - RNA, 22 nt, Chlamydophila pneumoniae TW-183
auaaaucuguacaagauccucu

SEQ ID NO: 82406 - RNA, 22 nt, Chlamydophila pneumoniae TW-183
augaaguuugaugcgacagaaa

SEQ ID NO: 82407 - RNA, 22 nt, Chlamydophila pneumoniae TW-183
aaggagcucguacaggaguucu

SEQ ID NO: 82408 - RNA, 22 nt, Chlamydophila pneumoniae TW-183
uuccauuaaccaaacauuugau

SEQ ID NO: 82409 - RNA, 22 nt, Chlamydophila pneumoniae TW-183
cugcucaaugguuuuaggaauc

SEQ ID NO: 82410 - RNA, 22 nt, Chlamydophila pneumoniae TW-183
uauugauuuaagaguuucaggg

SEQ ID NO: 82411 - RNA, 21 nt, Chlamydophila pneumoniae TW-183
uccugaguuuccuaaggaacu

SEQ ID NO: 82412 - RNA, 22 nt, Chlamydophila pneumoniae TW-183
uugcucuucgcuacuuuuacag

SEQ ID NO: 82413 - RNA, 22 nt, Chlamydophila pneumoniae TW-183
aggaaaauugaacuuagagaac

SEQ ID NO: 82414 - RNA, 22 nt, Chlamydophila pneumoniae TW-183
aggaaaccaucuucucucuuug

SEQ ID NO: 82415 - RNA, 19 nt, Chlamydophila pneumoniae TW-183
uuuagaggaucggguaucg

SEQ ID NO: 82416 - RNA, 22 nt, Chlamydophila pneumoniae TW-183
uuuuuguaaguugccaucuucu

SEQ ID NO: 82417 - RNA, 22 nt, Chlamydophila pneumoniae TW-183
aaagaacucuccuauaauggca

SEQ ID NO: 82418 - RNA, 22 nt, Chlamydophila pneumoniae TW-183
uucgaguaguuauaggagagca

SEQ ID NO: 82419 - RNA, 22 nt, Chlamydophila pneumoniae TW-183
aagcucuuccagaaacaagauc

SEQ ID NO: 82420 - RNA, 22 nt, Chlamydophila pneumoniae TW-183
aagaucaugucuccucugugcg

SEQ ID NO: 82421 - RNA, 22 nt, Chlamydophila pneumoniae TW-183
auuucugaaaagcuugcgauga

SEQ ID NO: 82422 - RNA, 20 nt, Chlamydophila pneumoniae TW-183
ucuuaucaccggaaacuuuc

SEQ ID NO: 82423 - RNA, 22 nt, Chlamydophila pneumoniae TW-183
gcguuguuauaucgaguugacu

SEQ ID NO: 82424 - RNA, 22 nt, Chlamydophila pneumoniae TW-183
cuuguaggaaagccuuauuuac

SEQ ID NO: 82425 - RNA, 22 nt, Chlamydophila pneumoniae TW-183
ggcaaaucuuugacucuaccgc

SEQ ID NO: 82426 - RNA, 22 nt, Chlamydophila pneumoniae TW-183
augccuauguguaacucuauag

SEQ ID NO: 82427 - RNA, 22 nt, Chlamydophila pneumoniae TW-183
uagaauccucucgaaguauguc

SEQ ID NO: 82428 - RNA, 19 nt, Chlamydophila pneumoniae TW-183
uuauugauacgauuuuaga

SEQ ID NO: 82429 - RNA, 22 nt, Chlamydophila pneumoniae TW-183
uacagauucaccaagaacaaua

SEQ ID NO: 82430 - RNA, 22 nt, Chlamydophila pneumoniae TW-183
uuaggaucggcagaauuaccaa

SEQ ID NO: 82431 - RNA, 22 nt, Chlamydophila pneumoniae TW-183
uuccuacagaucguauuuuccg

SEQ ID NO: 82432 - RNA, 22 nt, Chlamydophila pneumoniae TW-183
auucuagaugguguaacuuuuu

SEQ ID NO: 82433 - RNA, 22 nt, Chlamydophila pneumoniae TW-183
uucuuuuucuaugaugaugagu

SEQ ID NO: 82434 - RNA, 22 nt, Chlamydophila pneumoniae TW-183
ugaagcauuugcucuuugggaa

SEQ ID NO: 82435 - RNA, 22 nt, Chlamydophila pneumoniae TW-183
cgaguauuuuuucauguccgca

SEQ ID NO: 82436 - RNA, 22 nt, Chlamydophila pneumoniae TW-183
uaguaccugcucuuuuguacga

SEQ ID NO: 82437 - RNA, 22 nt, Chlamydophila pneumoniae TW-183
ucuggagacaucuuuugaagcu

SEQ ID NO: 82438 - RNA, 22 nt, Chlamydophila pneumoniae TW-183
accagcuguagagggauugggg

SEQ ID NO: 82439 - RNA, 22 nt, Chlamydophila pneumoniae TW-183
acuccucuaucguauuggggau

SEQ ID NO: 82440 - RNA, 22 nt, Chlamydophila pneumoniae TW-183
auuggggauuguuacgauagac

SEQ ID NO: 82441 - RNA, 22 nt, Chlamydophila pneumoniae TW-183
cacaaccaaaacgugcgcaggg

SEQ ID NO: 82442 - RNA, 23 nt, Chlamydophila pneumoniae TW-183
ucagucucuagaggagcucuuug

SEQ ID NO: 82443 - RNA, 22 nt, Chlamydophila pneumoniae TW-183
ucccuuuggauccagaagcuaa

SEQ ID NO: 82444 - RNA, 22 nt, Chlamydophila pneumoniae TW-183
ucugaaguccuagcauugaaag

SEQ ID NO: 82445 - RNA, 22 nt, Chlamydophila pneumoniae TW-183
uauccuaauuuacaacuauccu

SEQ ID NO: 82446 - RNA, 22 nt, Chlamydophila pneumoniae TW-183
gugcaggucaugagcuugccgg

SEQ ID NO: 82447 - RNA, 22 nt, Chlamydophila pneumoniae TW-183
gccaaggcucuugcggauguua

SEQ ID NO: 82448 - RNA, 22 nt, Chlamydophila pneumoniae TW-183
gcagguggugcauggacuccuc

SEQ ID NO: 82449 - RNA, 22 nt, Chlamydophila pneumoniae TW-183
gaagcucaggaucugucaguuc

SEQ ID NO: 82450 - RNA, 22 nt, Chlamydophila pneumoniae TW-183
cugugcucuugaagauuguguc

SEQ ID NO: 82451 - RNA, 22 nt, Chlamydophila pneumoniae TW-183
agcagggcuugauagagcgucu

SEQ ID NO: 82452 - RNA, 22 nt, Chlamydophila pneumoniae TW-183
agcccgagguacuacaaggcga

SEQ ID NO: 82453 - RNA, 22 nt, Chlamydophila pneumoniae TW-183
aaucucugaacuuuugcuguug

SEQ ID NO: 82454 - RNA, 22 nt, Chlamydophila pneumoniae TW-183
agaguucugcugcugcuagacc

SEQ ID NO: 82455 - RNA, 22 nt, Chlamydophila pneumoniae TW-183
agagaaggugaaaaucggggaa

SEQ ID NO: 82456 - RNA, 22 nt, Chlamydophila pneumoniae TW-183
aagaagaagaauccguggauga

SEQ ID NO: 82457 - RNA, 22 nt, Chlamydophila pneumoniae TW-183
aaaauauaugcagaguuauggu

SEQ ID NO: 82458 - RNA, 22 nt, Chlamydophila pneumoniae TW-183
uugaccagaugcaugagaauag

SEQ ID NO: 82459 - RNA, 19 nt, Chlamydophila pneumoniae TW-183
uucuuucaggagcuccuca

SEQ ID NO: 82460 - RNA, 22 nt, Chlamydophila pneumoniae TW-183
uugugauuccucgagcgagacg

SEQ ID NO: 82461 - RNA, 22 nt, Chlamydophila pneumoniae TW-183
ugaagcauuugcucuuugggaa

SEQ ID NO: 82462 - RNA, 22 nt, Chlamydophila pneumoniae TW-183
ucuuuaauuuucugaaagauua

SEQ ID NO: 82463 - RNA, 22 nt, Chlamydophila pneumoniae TW-183
ggagacaguuugcuuuaucucu

SEQ ID NO: 82464 - RNA, 22 nt, Chlamydophila pneumoniae TW-183
gagaggggaagaaaaauagcca

SEQ ID NO: 82465 - RNA, 22 nt, Chlamydophila pneumoniae TW-183
cauuuuuaaauacgauggucgu

SEQ ID NO: 82466 - RNA, 22 nt, Chlamydophila pneumoniae TW-183
ccuagcauuuauuauuacuuca

SEQ ID NO: 82467 - RNA, 22 nt, Chlamydophila pneumoniae TW-183
uuuuuagggcuaaagcgagcga

SEQ ID NO: 82468 - RNA, 22 nt, Human
aaagaccuucacuuucuggcug

SEQ ID NO: 82469 - RNA, 22 nt, Human
aaagacuaaccaguugucaaaa

SEQ ID NO: 82470 - RNA, 22 nt, Human
aaagaucaguuaacgccaucaa

SEQ ID NO: 82471 - RNA, 22 nt, Human
aaaugcuuuaauugaguucaug

SEQ ID NO: 82472 - RNA, 22 nt, Human
aaauuaaaguuuuauuuagagc

SEQ ID NO: 82473 - RNA, 22 nt, Human
aaauucuuccaggaggaaauac

SEQ ID NO: 82474 - RNA, 22 nt, Human
aacagaaaucauuuagggcucu

SEQ ID NO: 82475 - RNA, 22 nt, Human
aacacuguaucagucuucaaua

SEQ ID NO: 82476 - RNA, 22 nt, Human
aacagagauucuucccuucuuu

SEQ ID NO: 82477 - RNA, 22 nt, Human
aacagaauaucaaaagauuaug

SEQ ID NO: 82478 - RNA, 21 nt, Human
aacaaaagggaagaacagcug

SEQ ID NO: 82479 - RNA, 22 nt, Human
aaauuuuguugaaaaauauuuu

SEQ ID NO: 82480 - RNA, 22 nt, Human
aacucgaugcaauucacuuugu

SEQ ID NO: 82481 - RNA, 22 nt, Human
aacucccucaacuuccuucucu

SEQ ID NO: 82482 - RNA, 22 nt, Human
aaccuuauuguguaucaccaua

SEQ ID NO: 82483 - RNA, 20 nt, Human
aaccuauuguaauauucuaa

SEQ ID NO: 82484 - RNA, 22 nt, Human
aaccucuuugugaaugucauga

SEQ ID NO: 82485 - RNA, 22 nt, Human
aagcagaacuguuuuguuuucu

SEQ ID NO: 82486 - RNA, 22 nt, Human
aagcagaaaaacugagcuccaa

SEQ ID NO: 82487 - RNA, 22 nt, Human
aagcaaaagguuacacuucugg

SEQ ID NO: 82488 - RNA, 21 nt, Human
aagcagcugcagaauuucagu

SEQ ID NO: 82489 - RNA, 22 nt, Human
aagcagcauaugacagcaucca

SEQ ID NO: 82490 - RNA, 22 nt, Human
aagcaaguucuaaaguaauucu

SEQ ID NO: 82491 - RNA, 22 nt, Human
aagaugcuucaugagaguuggg

SEQ ID NO: 82492 - RNA, 22 nt, Human
aagagcuuguuaugcugcucuu

SEQ ID NO: 82493 - RNA, 22 nt, Human
aagagaaaugcuuuaacuuuau

SEQ ID NO: 82494 - RNA, 22 nt, Human
aagagaaagggaaaaugguaaa

SEQ ID NO: 82495 - RNA, 22 nt, Human
aagagugaguagcuugguuggu

SEQ ID NO: 82496 - RNA, 22 nt, Human
aagaggaauaauaaaaauugca

SEQ ID NO: 82497 - RNA, 22 nt, Human
aagacccuaccccuggagagga

SEQ ID NO: 82498 - RNA, 22 nt, Human
aagaggcuacagcccugugucu

SEQ ID NO: 82499 - RNA, 22 nt, Human
aagagaggaaagggugugaggu

SEQ ID NO: 82500 - RNA, 23 nt, Human
aagaaugcuucugaagagcugcc

SEQ ID NO: 82501 - RNA, 22 nt, Human
aagacacuuucuaaauagaagu

SEQ ID NO: 82502 - RNA, 22 nt, Human
aagaagcuacugucacuaucag

SEQ ID NO: 82503 - RNA, 22 nt, Human
aagaaauacagaaauggcagua

SEQ ID NO: 82504 - RNA, 22 nt, Human
aacuucuggaaacuuccaugug

SEQ ID NO: 82505 - RNA, 22 nt, Human
aacuuguaaugaaaggcaauag

SEQ ID NO: 82506 - RNA, 22 nt, Human
aagaaaggagauauucuuuuag

SEQ ID NO: 82507 - RNA, 22 nt, Human
aacuuucuuugcaucuaaguuu

SEQ ID NO: 82508 - RNA, 22 nt, Human
aacuuucugaaaagcuugauca

SEQ ID NO: 82509 - RNA, 22 nt, Human
aacuuucagaauccuaugcauu

SEQ ID NO: 82510 - RNA, 22 nt, Human
aacugggugauucaggcuguuu

SEQ ID NO: 82511 - RNA, 22 nt, Human
aagaaaagaaacauggguaugc

SEQ ID NO: 82512 - RNA, 22 nt, Human
aacuguugucacgaauguggcu

SEQ ID NO: 82513 - RNA, 22 nt, Human
aacugaaguuuucagauuuugc

SEQ ID NO: 82514 - RNA, 22 nt, Human
aacucugcaaugaaaucauguu

SEQ ID NO: 82515 - RNA, 22 nt, Human
aacucugacgcugucaaauaca

SEQ ID NO: 82516 - RNA, 22 nt, Human
aaugcauacguguuuguggcaa

SEQ ID NO: 82517 - RNA, 22 nt, Human
aaugaaaaucugucaguucaag

SEQ ID NO: 82518 - RNA, 22 nt, Human
aaugaacuuugaagauggugaa

SEQ ID NO: 82519 - RNA, 22 nt, Human
aaucuuuuugaaggaggagaga

SEQ ID NO: 82520 - RNA, 22 nt, Human
aaucaugguacaaguaagcacg

SEQ ID NO: 82521 - RNA, 22 nt, Human
aaucuacaaugaaaaaauguuu

SEQ ID NO: 82522 - RNA, 22 nt, Human
aaucucguuaugaagaugguug

SEQ ID NO: 82523 - RNA, 22 nt, Human
aauguacucuguguuucucaug

SEQ ID NO: 82524 - RNA, 21 nt, Human
aauuauuugcauuuuucuugu

SEQ ID NO: 82525 - RNA, 22 nt, Human
aaugcugaaugcauguuuccau

SEQ ID NO: 82526 - RNA, 22 nt, Human
aaugcuaaagaagaaggaguag

SEQ ID NO: 82527 - RNA, 22 nt, Human
aauggaugauuaaauggaugaa

SEQ ID NO: 82528 - RNA, 22 nt, Human
aauguaguuuacugugagugca

SEQ ID NO: 82529 - RNA, 22 nt, Human
aauacagauggcaugugaagau

SEQ ID NO: 82530 - RNA, 22 nt, Human
aaguuuaagguagugaugauga

SEQ ID NO: 82531 - RNA, 22 nt, Human
aauagagacaguuuaacaauau

SEQ ID NO: 82532 - RNA, 22 nt, Human
aauaucuagccuuuagcagcuu

SEQ ID NO: 82533 - RNA, 22 nt, Human
aaguuccuaaagucagggguca

SEQ ID NO: 82534 - RNA, 22 nt, Human
aagugguuuauuguaugguuuu

SEQ ID NO: 82535 - RNA, 22 nt, Human
aaguacugauucuguuccucaa

SEQ ID NO: 82536 - RNA, 22 nt, Human
aaguaauuugugaaggcauguu

SEQ ID NO: 82537 - RNA, 22 nt, Human
aagggaauagagcagcaaaaau

SEQ ID NO: 82538 - RNA, 22 nt, Human
aaggcgauuuaaagauguuagg

SEQ ID NO: 82539 - RNA, 22 nt, Human
aaggcugaccaguuuacacuuu

SEQ ID NO: 82540 - RNA, 22 nt, Human
aaggaucuuucuuuuuaccauu

SEQ ID NO: 82541 - RNA, 22 nt, Human
aaggaggaugaauugucugcaa

SEQ ID NO: 82542 - RNA, 22 nt, Human
aagccugguuauuugaggaugu

SEQ ID NO: 82543 - RNA, 22 nt, Human
aagcaguuuagucaucgggauu

SEQ ID NO: 82544 - RNA, 22 nt, Human
aaaacuuucagggauacagaaa

SEQ ID NO: 82545 - RNA, 22 nt, Human
aaaaauuucuggugaaaugccu

SEQ ID NO: 82546 - RNA, 22 nt, Human
aaaaacuuaccccagggcaagg

SEQ ID NO: 82547 - RNA, 20 nt, Human
aaaaacaguaaugcugaaga

SEQ ID NO: 82548 - RNA, 22 nt, Human
aaaaaaacuaauuuuaaaugug

SEQ ID NO: 82549 - RNA, 22 nt, Human
aaaaaauugcuggcagagcugu

SEQ ID NO: 82550 - RNA, 22 nt, Human
aaagacucaauuguucccuaau

SEQ ID NO: 82551 - RNA, 22 nt, Human
aaacuuuugaaggaggaaaaag

SEQ ID NO: 82552 - RNA, 21 nt, Human
aaagaagagcucagagguaga

SEQ ID NO: 82553 - RNA, 22 nt, Human
aaacuagaacagagagagaagc

SEQ ID NO: 82554 - RNA, 22 nt, Human
aaacucuaagacuaaaauugaa

SEQ ID NO: 82555 - RNA, 20 nt, Human
aaacucucugaucuuacagu

SEQ ID NO: 82556 - RNA, 20 nt, Human
aaacucuuuucuuacauuuu

SEQ ID NO: 82557 - RNA, 22 nt, Human
aaacugcuuucucugccuuucc

SEQ ID NO: 82558 - RNA, 21 nt, Human
aaagaaguuaguucagugguu

SEQ ID NO: 82559 - RNA, 22 nt, Human
aaacaauaauaauuaggaagga

SEQ ID NO: 82560 - RNA, 22 nt, Human
aaaauacuaggaaaauaaauca

SEQ ID NO: 82561 - RNA, 18 nt, Human
aaacauggcuuaaaggcu

SEQ ID NO: 82562 - RNA, 22 nt, Human
acauuuuaccaucuguggauga

SEQ ID NO: 82563 - RNA, 22 nt, Human
acauucucuuuuagaaagcugu

SEQ ID NO: 82564 - RNA, 22 nt, Human
accaauaaaagcaauucacagu

SEQ ID NO: 82565 - RNA, 22 nt, Human
acauuuuuggguugaugucuga

SEQ ID NO: 82566 - RNA, 22 nt, Human
acauuuuaaaaacaguaccugg

SEQ ID NO: 82567 - RNA, 22 nt, Human
acauuucuccuacuuguuauuu

SEQ ID NO: 82568 - RNA, 22 nt, Human
acauuccugaagguaaugagaa

SEQ ID NO: 82569 - RNA, 22 nt, Human
acaugcacagcaagggugagag

SEQ ID NO: 82570 - RNA, 22 nt, Human
acauccaguaucagaagcauca

SEQ ID NO: 82571 - RNA, 22 nt, Human
acauaaauagcacugugaauuu

SEQ ID NO: 82572 - RNA, 22 nt, Human
acaguuuuccuugguauagaac

SEQ ID NO: 82573 - RNA, 22 nt, Human
acaguuuucugagaaucacagg

SEQ ID NO: 82574 - RNA, 22 nt, Human
aauugccaagaauuagugauac

SEQ ID NO: 82575 - RNA, 22 nt, Human
aauucuaaugaguucuuaucua

SEQ ID NO: 82576 - RNA, 22 nt, Human
aauucgcugcauuccaucuagg

SEQ ID NO: 82577 - RNA, 20 nt, Human
accuucuuugguagacggaa

SEQ ID NO: 82578 - RNA, 19 nt, Human
accuguucaaccucgugcu

SEQ ID NO: 82579 - RNA, 22 nt, Human
accuuaagugauuaugacauau

SEQ ID NO: 82580 - RNA, 22 nt, Human
accccuauugcuugugauuaug

SEQ ID NO: 82581 - RNA, 22 nt, Human
accauccaaaagcuuuucauca

SEQ ID NO: 82582 - RNA, 22 nt, Human
accaggaguuuugaccaggggc

SEQ ID NO: 82583 - RNA, 22 nt, Human
agaguguggaaauguucagagu

SEQ ID NO: 82584 - RNA, 21 nt, Human
agaggacuuuuuugauguuuu

SEQ ID NO: 82585 - RNA, 22 nt, Human
agaggaauuauugaguuagauu

SEQ ID NO: 82586 - RNA, 22 nt, Human
agagauugagcucagaagaccu

SEQ ID NO: 82587 - RNA, 22 nt, Human
agagauuagagaagaugauaaa

SEQ ID NO: 82588 - RNA, 20 nt, Human
agagaacaguuuggucacag

SEQ ID NO: 82589 - RNA, 22 nt, Human
agacuucucuuggcuauauuau

SEQ ID NO: 82590 - RNA, 21 nt, Human
agacuucuacuaucuuaugac

SEQ ID NO: 82591 - RNA, 22 nt, Human
agagaacaggcagcuggugccg

SEQ ID NO: 82592 - RNA, 22 nt, Human
agagauuuacaacuugggcuuu

SEQ ID NO: 82593 - RNA, 22 nt, Human
agagcuagaaggaagcauuucu

SEQ ID NO: 82594 - RNA, 22 nt, Human
agagccaugcuugugcauauau

SEQ ID NO: 82595 - RNA, 22 nt, Human
agagacaagggaccucuggaga

SEQ ID NO: 82596 - RNA, 22 nt, Human
agagacaggguuuugucguguu

SEQ ID NO: 82597 - RNA, 22 nt, Human
agagaauuugggaauauaaauc

SEQ ID NO: 82598 - RNA, 21 nt, Human
agagaccuaagcugagauucc

SEQ ID NO: 82599 - RNA, 16 nt, Human
agagagaugguggugg

SEQ ID NO: 82600 - RNA, 22 nt, Human
agacucuggcaugcuaacuagu

SEQ ID NO: 82601 - RNA, 17 nt, Human
agacucuagccacuagc

SEQ ID NO: 82602 - RNA, 22 nt, Human
agacuguuuucccaucucuugg

SEQ ID NO: 82603 - RNA, 22 nt, Human
agagaagaauccccugguggag

SEQ ID NO: 82604 - RNA, 22 nt, Human
agagaaacauuaauugaugagg

SEQ ID NO: 82605 - RNA, 22 nt, Human
agagaaauguacuagucuaacu

SEQ ID NO: 82606 - RNA, 22 nt, Human
agacuucucuaacuugaggacc

SEQ ID NO: 82607 - RNA, 22 nt, Human
agacauuuggugugaagggagg

SEQ ID NO: 82608 - RNA, 22 nt, Human
agacuguuccgucagacucagu

SEQ ID NO: 82609 - RNA, 22 nt, Human
agacagcggugcaauaaauggu

SEQ ID NO: 82610 - RNA, 21 nt, Human
agaaugaagaagaggucuuug

SEQ ID NO: 82611 - RNA, 22 nt, Human
agaaucagagcagaaucuucau

SEQ ID NO: 82612 - RNA, 22 nt, Human
agaauccucuagggauggcagg

SEQ ID NO: 82613 - RNA, 22 nt, Human
agacagaacauaauuaguacug

SEQ ID NO: 82614 - RNA, 22 nt, Human
agacagaaaaguugucaaucau

SEQ ID NO: 82615 - RNA, 22 nt, Human
agaaagcacccugcacuuucug

SEQ ID NO: 82616 - RNA, 22 nt, Human
agaagcaauuggaaaguacagg

SEQ ID NO: 82617 - RNA, 22 nt, Human
agaaauggggugaagcaaaugg

SEQ ID NO: 82618 - RNA, 22 nt, Human
agaagauucagcaguagggugg

SEQ ID NO: 82619 - RNA, 22 nt, Human
agaagcaaagcaaacacauucu

SEQ ID NO: 82620 - RNA, 22 nt, Human
acuuuuagccuucccacaacag

SEQ ID NO: 82621 - RNA, 22 nt, Human
agaacaagaaacccgaaaagug

SEQ ID NO: 82622 - RNA, 22 nt, Human
agaaaagagacaauguuuuugg

SEQ ID NO: 82623 - RNA, 22 nt, Human
acuuuugaguuacauaccugaa

SEQ ID NO: 82624 - RNA, 22 nt, Human
acuuuauacuagugauaguuug

SEQ ID NO: 82625 - RNA, 22 nt, Human
acuugauggaguuucacuguau

SEQ ID NO: 82626 - RNA, 22 nt, Human
acuugcauuguguaguguuuuu

SEQ ID NO: 82627 - RNA, 22 nt, Human
acuguuauugguguauguggca

SEQ ID NO: 82628 - RNA, 17 nt, Human
acuuaagacaguggaaa

SEQ ID NO: 82629 - RNA, 22 nt, Human
acuucucuuuucauuaauuuug

SEQ ID NO: 82630 - RNA, 22 nt, Human
acuuccuuuuuuggggauagca

SEQ ID NO: 82631 - RNA, 22 nt, Human
acugucauuaaugaauguaaua

SEQ ID NO: 82632 - RNA, 22 nt, Human
acuggggcaggaaaguaugcug

SEQ ID NO: 82633 - RNA, 19 nt, Human
acuggggcaggcugggcuu

SEQ ID NO: 82634 - RNA, 22 nt, Human
acugcagauccucugagaaacc

SEQ ID NO: 82635 - RNA, 22 nt, Human
acuaaguagaggagugaugauu

SEQ ID NO: 82636 - RNA, 22 nt, Human
acugccuugcaccauggcuuuu

SEQ ID NO: 82637 - RNA, 22 nt, Human
aggaaaaagaagaaaagaauca

SEQ ID NO: 82638 - RNA, 22 nt, Human
agcuuugcccaaugaguuaugu

SEQ ID NO: 82639 - RNA, 22 nt, Human
agcuuucuauauaugaguugcu

SEQ ID NO: 82640 - RNA, 22 nt, Human
agcuuccaaagaccaggauuga

SEQ ID NO: 82641 - RNA, 22 nt, Human
aggaacaacagccuuuauaucc

SEQ ID NO: 82642 - RNA, 22 nt, Human
agcugugaccuucaagagcuac

SEQ ID NO: 82643 - RNA, 22 nt, Human
aggaaaguugagcugucuguag

SEQ ID NO: 82644 - RNA, 22 nt, Human
aggaaauaggaccagacaaagc

SEQ ID NO: 82645 - RNA, 22 nt, Human
aggaaauaagggcacuucagau

SEQ ID NO: 82646 - RNA, 22 nt, Human
agcuggaaucucggcaaagcgu

SEQ ID NO: 82647 - RNA, 22 nt, Human
aggaagagcuggaccagaggac

SEQ ID NO: 82648 - RNA, 20 nt, Human
aggaagauccuuucuuuuaa

SEQ ID NO: 82649 - RNA, 22 nt, Human
aggaaaguugcuuguagugcug

SEQ ID NO: 82650 - RNA, 22 nt, Human
aggaguuugaaaacuuaacuaa

SEQ ID NO: 82651 - RNA, 22 nt, Human
aggauaaaugggucauuaggca

SEQ ID NO: 82652 - RNA, 22 nt, Human
aggacguaacccaggacagccu

SEQ ID NO: 82653 - RNA, 22 nt, Human
aggagaaagaccagccugccga

SEQ ID NO: 82654 - RNA, 22 nt, Human
aggacuguauacucuaggugaa

SEQ ID NO: 82655 - RNA, 22 nt, Human
aggaaagacgcauuucuguagg

SEQ ID NO: 82656 - RNA, 20 nt, Human
agcuuucaccaguacuucca

SEQ ID NO: 82657 - RNA, 19 nt, Human
agcuuauuuacugcaggac

SEQ ID NO: 82658 - RNA, 22 nt, Human
agcuguugaccuucccuuucag

SEQ ID NO: 82659 - RNA, 22 nt, Human
agcuugaaccuaaaacaauaau

SEQ ID NO: 82660 - RNA, 22 nt, Human
agcuguaacagguuaauaugga

SEQ ID NO: 82661 - RNA, 22 nt, Human
agcugaugucucaccuguuaga

SEQ ID NO: 82662 - RNA, 22 nt, Human
agcucuucugacucuaggcuca

SEQ ID NO: 82663 - RNA, 22 nt, Human
agcucagugugucuaugaggua

SEQ ID NO: 82664 - RNA, 22 nt, Human
agcguucuguuccaugcuaaca

SEQ ID NO: 82665 - RNA, 22 nt, Human
agcgcucauuuuccuccugcuc

SEQ ID NO: 82666 - RNA, 22 nt, Human
agcccuauacuuagauuuauuc

SEQ ID NO: 82667 - RNA, 22 nt, Human
agcauucuguggucuucuaugg

SEQ ID NO: 82668 - RNA, 22 nt, Human
agccacacuuagucacaaagau

SEQ ID NO: 82669 - RNA, 22 nt, Human
agcauuuuaaaacuaguuacca

SEQ ID NO: 82670 - RNA, 22 nt, Human
agcauuucuacugugucagaaa

SEQ ID NO: 82671 - RNA, 19 nt, Human
agcaucuccacagaaaaag

SEQ ID NO: 82672 - RNA, 22 nt, Human
agcauacuaggauguuuucugg

SEQ ID NO: 82673 - RNA, 22 nt, Human
agcaucuaucuucaaugugugu

SEQ ID NO: 82674 - RNA, 22 nt, Human
agcacguucuucauuacuucac

SEQ ID NO: 82675 - RNA, 22 nt, Human
aggauggaaguaacuggauaau

SEQ ID NO: 82676 - RNA, 22 nt, Human
aggcauuuaaagauguaagacu

SEQ ID NO: 82677 - RNA, 22 nt, Human
agggacuugugucuguguuuuu

SEQ ID NO: 82678 - RNA, 22 nt, Human
agggaugcaguaaaaacuguag

SEQ ID NO: 82679 - RNA, 22 nt, Human
agggaagccggagcgacggggg

SEQ ID NO: 82680 - RNA, 22 nt, Human
aggcgguuggcuuugucugggu

SEQ ID NO: 82681 - RNA, 22 nt, Human
agggaagagaaacaaagauuca

SEQ ID NO: 82682 - RNA, 22 nt, Human
aggucgugggugagagagagac

SEQ ID NO: 82683 - RNA, 22 nt, Human
aggggcuuguggaguugcuggu

SEQ ID NO: 82684 - RNA, 22 nt, Human
aggggagaguuaaugugaaugu

SEQ ID NO: 82685 - RNA, 22 nt, Human
agggaagaggaccagagucucu

SEQ ID NO: 82686 - RNA, 22 nt, Human
agggaccacauccccucugugg

SEQ ID NO: 82687 - RNA, 21 nt, Human
agugaagagugggcuugauca

SEQ ID NO: 82688 - RNA, 22 nt, Human
agucuauacuucccaguugaca

SEQ ID NO: 82689 - RNA, 18 nt, Human
agucauguuuuagucacu

SEQ ID NO: 82690 - RNA, 22 nt, Human
agucauuugaggcaugauuaug

SEQ ID NO: 82691 - RNA, 22 nt, Human
agucauuugucauuuuuuugag

SEQ ID NO: 82692 - RNA, 22 nt, Human
agucaggacagauuuucugggg

SEQ ID NO: 82693 - RNA, 22 nt, Human
aguccucagauauggagaucug

SEQ ID NO: 82694 - RNA, 22 nt, Human
agucagaaggugucagaucuug

SEQ ID NO: 82695 - RNA, 22 nt, Human
aguauuuucuuuaguuuguuag

SEQ ID NO: 82696 - RNA, 22 nt, Human
agucaaaaaaccuagaaacacc

SEQ ID NO: 82697 - RNA, 22 nt, Human
agguuaugcacugcacaacccu

SEQ ID NO: 82698 - RNA, 22 nt, Human
aggucuugcggaagauauggcu

SEQ ID NO: 82699 - RNA, 22 nt, Human
aguaaucgugaucgagagauca

SEQ ID NO: 82700 - RNA, 22 nt, Human
aguaauaaacaacucauuuugg

SEQ ID NO: 82701 - RNA, 22 nt, Human
aguauggaauuuuuaaugacag

SEQ ID NO: 82702 - RNA, 22 nt, Human
aguaugcuggcaccuuugagug

SEQ ID NO: 82703 - RNA, 22 nt, Human
auauaaugugugcuuuauugaa

SEQ ID NO: 82704 - RNA, 22 nt, Human
auauaugcaacaagaaagcaua

SEQ ID NO: 82705 - RNA, 22 nt, Human
auauccugguucuaucaaaagg

SEQ ID NO: 82706 - RNA, 22 nt, Human
auaucuaggcugaauguaaaau

SEQ ID NO: 82707 - RNA, 22 nt, Human
auaucuuguuuuugauuucuug

SEQ ID NO: 82708 - RNA, 22 nt, Human
auaggacuuuguaucaggauga

SEQ ID NO: 82709 - RNA, 22 nt, Human
auaguccuucuuuaacuuagau

SEQ ID NO: 82710 - RNA, 22 nt, Human
auauaagucacauuaaggaggu

SEQ ID NO: 82711 - RNA, 22 nt, Human
auaucugaugacgugacuaugu

SEQ ID NO: 82712 - RNA, 22 nt, Human
auaguuuuagauacugagaaaa

SEQ ID NO: 82713 - RNA, 22 nt, Human
auaugaagaaugaucugaagua

SEQ ID NO: 82714 - RNA, 22 nt, Human
auagaugaggaaauucaggugc

SEQ ID NO: 82715 - RNA, 22 nt, Human
auagauagaagggacguggugc

SEQ ID NO: 82716 - RNA, 22 nt, Human
auagaugacaguuaggaagcug

SEQ ID NO: 82717 - RNA, 22 nt, Human
auagcuauuauuauuucuguua

SEQ ID NO: 82718 - RNA, 22 nt, Human
auagaguucucuuuggaggagu

SEQ ID NO: 82719 - RNA, 22 nt, Human
auagaagguaaugccccaaggg

SEQ ID NO: 82720 - RNA, 18 nt, Human
auagacaggaaaaaugga

SEQ ID NO: 82721 - RNA, 22 nt, Human
auagagaggaacagcaagaacu

SEQ ID NO: 82722 - RNA, 22 nt, Human
auagaaauagacaaugcaaaga

SEQ ID NO: 82723 - RNA, 22 nt, Human
auagcacuuaauaugaaacagu

SEQ ID NO: 82724 - RNA, 22 nt, Human
auaggacuguacagaauacaag

SEQ ID NO: 82725 - RNA, 22 nt, Human
auaggcauaacacugauguccu

SEQ ID NO: 82726 - RNA, 22 nt, Human
auaggagcaagauuauagcagg

SEQ ID NO: 82727 - RNA, 22 nt, Human
auagacuagccaaagacuucug

SEQ ID NO: 82728 - RNA, 22 nt, Human
auagagcuggggaagaagcugg

SEQ ID NO: 82729 - RNA, 22 nt, Human
auacaggcaguaagauucucag

SEQ ID NO: 82730 - RNA, 22 nt, Human
agugacauuauuuuguguacua

SEQ ID NO: 82731 - RNA, 22 nt, Human
agugaaauaugcccauugcugu

SEQ ID NO: 82732 - RNA, 22 nt, Human
aucauaccaguuuccaucagga

SEQ ID NO: 82733 - RNA, 22 nt, Human
aucauuugaacagaauuuguuu

SEQ ID NO: 82734 - RNA, 22 nt, Human
auccucaaggaauuaaauaggg

SEQ ID NO: 82735 - RNA, 23 nt, Human
aucauuucuuagugagucccugc

SEQ ID NO: 82736 - RNA, 22 nt, Human
aucauugcuaguaaggaucuug

SEQ ID NO: 82737 - RNA, 22 nt, Human
auccuaagacgugugguuugag

SEQ ID NO: 82738 - RNA, 22 nt, Human
auccugauggaaacugguauga

SEQ ID NO: 82739 - RNA, 22 nt, Human
aucuaaaacuacgaauacuacc

SEQ ID NO: 82740 - RNA, 22 nt, Human
auccaggggucugaauggauau

SEQ ID NO: 82741 - RNA, 22 nt, Human
aucauguuauguacaaauauga

SEQ ID NO: 82742 - RNA, 20 nt, Human
auccuggucuuuggaagcuu

SEQ ID NO: 82743 - RNA, 22 nt, Human
aucauugaaaauuuaugcauuu

SEQ ID NO: 82744 - RNA, 22 nt, Human
aucaugcugacacaguuuaucu

SEQ ID NO: 82745 - RNA, 22 nt, Human
aucauaugugauaccauaauga

SEQ ID NO: 82746 - RNA, 22 nt, Human
aucaaugggucaaagagaaggu

SEQ ID NO: 82747 - RNA, 22 nt, Human
auauuuguuuggcagaguucag

SEQ ID NO: 82748 - RNA, 22 nt, Human
aucacaaauggaaucaccuccc

SEQ ID NO: 82749 - RNA, 21 nt, Human
aucagaaucucuagauuugga

SEQ ID NO: 82750 - RNA, 22 nt, Human
aucaaaauguguagucuugauc

SEQ ID NO: 82751 - RNA, 22 nt, Human
aucaagacaaaggaaaggcuaa

SEQ ID NO: 82752 - RNA, 22 nt, Human
auauuguagcaucacugucuug

SEQ ID NO: 82753 - RNA, 22 nt, Human
auauucaaugaggucauauaag

SEQ ID NO: 82754 - RNA, 22 nt, Human
augauguuggaauuuuaacuua

SEQ ID NO: 82755 - RNA, 22 nt, Human
augaggauuagcaucugcaaau

SEQ ID NO: 82756 - RNA, 22 nt, Human
augaggaacagcaagaauauuu

SEQ ID NO: 82757 - RNA, 22 nt, Human
augagaguuagccugcauaguu

SEQ ID NO: 82758 - RNA, 22 nt, Human
augaccuucuuuccuuaaauuu

SEQ ID NO: 82759 - RNA, 22 nt, Human
augacugaugcugacucauggg

SEQ ID NO: 82760 - RNA, 22 nt, Human
augagaaauaauuguguacuga

SEQ ID NO: 82761 - RNA, 20 nt, Human
aucugguggggaauaacuuc

SEQ ID NO: 82762 - RNA, 20 nt, Human
aucugugaugagaacgguuu

SEQ ID NO: 82763 - RNA, 22 nt, Human
aucuucaaagcacaucguuugu

SEQ ID NO: 82764 - RNA, 20 nt, Human
aucuuaucuaucuuuuguuc

SEQ ID NO: 82765 - RNA, 22 nt, Human
aucuauguaucucagaagcuag

SEQ ID NO: 82766 - RNA, 22 nt, Human
augcuugaaaguuauuucauuu

SEQ ID NO: 82767 - RNA, 22 nt, Human
augcugacaacaaagaaggaag

SEQ ID NO: 82768 - RNA, 22 nt, Human
augcuacuugugaaaacccagg

SEQ ID NO: 82769 - RNA, 22 nt, Human
augcugugccuggaaagcggcu

SEQ ID NO: 82770 - RNA, 22 nt, Human
augcaguuagguaauagucuca

SEQ ID NO: 82771 - RNA, 22 nt, Human
augcucuuaauugcuagauaag

SEQ ID NO: 82772 - RNA, 22 nt, Human
augcagaaucucuuuccugagg

SEQ ID NO: 82773 - RNA, 22 nt, Human
augauggagaacaaagaaaauc

SEQ ID NO: 82774 - RNA, 22 nt, Human
auuaaaaaaagauaaugaguua

SEQ ID NO: 82775 - RNA, 22 nt, Human
auguuuuuugaaaauguauuuu

SEQ ID NO: 82776 - RNA, 22 nt, Human
auuagugguguauuuggcacua

SEQ ID NO: 82777 - RNA, 22 nt, Human
auuauacauuaggagauugauu

SEQ ID NO: 82778 - RNA, 22 nt, Human
auguuuugaguuuuuuuacacc

SEQ ID NO: 82779 - RNA, 22 nt, Human
auguuugugauugcugaaaaga

SEQ ID NO: 82780 - RNA, 22 nt, Human
auuagaaaugacaugugggaau

SEQ ID NO: 82781 - RNA, 22 nt, Human
auuaaaaaugagaguagggauu

SEQ ID NO: 82782 - RNA, 22 nt, Human
auucaagauaagggucugggag

SEQ ID NO: 82783 - RNA, 22 nt, Human
auucaagagcccauguuuccug

SEQ ID NO: 82784 - RNA, 22 nt, Human
auucauucugaccucaagagaa

SEQ ID NO: 82785 - RNA, 22 nt, Human
auuccagggaaauggggaugga

SEQ ID NO: 82786 - RNA, 22 nt, Human
auguucucagguuguauuuauu

SEQ ID NO: 82787 - RNA, 21 nt, Human
auguguucugauagugcuugc

SEQ ID NO: 82788 - RNA, 22 nt, Human
auguguuuugaccccugcuaaa

SEQ ID NO: 82789 - RNA, 22 nt, Human
auggugaaaugauuugauguca

SEQ ID NO: 82790 - RNA, 22 nt, Human
augugaacuccagcugccaacc

SEQ ID NO: 82791 - RNA, 22 nt, Human
caagagcuuuagaaaugcucau

SEQ ID NO: 82792 - RNA, 22 nt, Human
caaaacauucagagagcucacu

SEQ ID NO: 82793 - RNA, 22 nt, Human
caaagaagagauuuacagagcu

SEQ ID NO: 82794 - RNA, 22 nt, Human
caagaugcaagaccagucaggc

SEQ ID NO: 82795 - RNA, 22 nt, Human
caacuucuauucagucugcagu

SEQ ID NO: 82796 - RNA, 22 nt, Human
caaccucuaucggucaggaagc

SEQ ID NO: 82797 - RNA, 22 nt, Human
cacaacaaaaaauaaguaugag

SEQ ID NO: 82798 - RNA, 22 nt, Human
caauggaguccucuuccucuuu

SEQ ID NO: 82799 - RNA, 22 nt, Human
caauagcuauguaaccugaaga

SEQ ID NO: 82800 - RNA, 22 nt, Human
cacauuucagcacucagggcau

SEQ ID NO: 82801 - RNA, 23 nt, Human
cacaggcagaaaucaagacggua

SEQ ID NO: 82802 - RNA, 22 nt, Human
cacagucugagcccagccuugu

SEQ ID NO: 82803 - RNA, 22 nt, Human
caaggaaaacagaugaucaaca

SEQ ID NO: 82804 - RNA, 22 nt, Human
cacagcagcaucauuuaucugg

SEQ ID NO: 82805 - RNA, 22 nt, Human
cacagaauuaagggagaaauau

SEQ ID NO: 82806 - RNA, 22 nt, Human
caagaaaaaacaugaugagugu

SEQ ID NO: 82807 - RNA, 22 nt, Human
caagagcucccagaccugggca

SEQ ID NO: 82808 - RNA, 22 nt, Human
caacaagcgcucagagcaaagc

SEQ ID NO: 82809 - RNA, 22 nt, Human
caaauacaaauacgggcagcuu

SEQ ID NO: 82810 - RNA, 22 nt, Human
auuuugcaguuuauugccaauc

SEQ ID NO: 82811 - RNA, 22 nt, Human
caaagagaugcaccauauuucu

SEQ ID NO: 82812 - RNA, 22 nt, Human
caaagaaccuucgagacagggc

SEQ ID NO: 82813 - RNA, 22 nt, Human
auuuuucucucaugugcaacua

SEQ ID NO: 82814 - RNA, 22 nt, Human
auuuuugugucacaucuaggaa

SEQ ID NO: 82815 - RNA, 23 nt, Human
auuugcugaucguagaugacuag

SEQ ID NO: 82816 - RNA, 21 nt, Human
auuuguggugcaauuguggua

SEQ ID NO: 82817 - RNA, 22 nt, Human
auuagguaguauaaucuuuguu

SEQ ID NO: 82818 - RNA, 22 nt, Human
auuacagauuauaaauuugagc

SEQ ID NO: 82819 - RNA, 22 nt, Human
auuacagaagauaugcucaaca

SEQ ID NO: 82820 - RNA, 22 nt, Human
auugacuuucccuucuccucau

SEQ ID NO: 82821 - RNA, 22 nt, Human
auucuuuucucuaaaugaugaa

SEQ ID NO: 82822 - RNA, 22 nt, Human
auugaaauuugcuuccucacug

SEQ ID NO: 82823 - RNA, 22 nt, Human
auuuauuuucccucaaguaccu

SEQ ID NO: 82824 - RNA, 19 nt, Human
auuuccuggcauauaucac

SEQ ID NO: 82825 - RNA, 22 nt, Human
auuguuuugugaaacauaguga

SEQ ID NO: 82826 - RNA, 22 nt, Human
auuuggaaggcguuucucugua

SEQ ID NO: 82827 - RNA, 22 nt, Human
caucccaacaggugaucuggua

SEQ ID NO: 82828 - RNA, 22 nt, Human
caguaucucccauucacagugu

SEQ ID NO: 82829 - RNA, 22 nt, Human
cauccagagcugccugaccccg

SEQ ID NO: 82830 - RNA, 22 nt, Human
cauaccuugguaagagugauca

SEQ ID NO: 82831 - RNA, 22 nt, Human
cauagacauugauagguuauau

SEQ ID NO: 82832 - RNA, 22 nt, Human
caugcuggcacugaccagccua

SEQ ID NO: 82833 - RNA, 22 nt, Human
cauaaauuuuaccuuguaagug

SEQ ID NO: 82834 - RNA, 21 nt, Human
caguucuaagugucaucuuuu

SEQ ID NO: 82835 - RNA, 22 nt, Human
caugaugagaguaauaacacag

SEQ ID NO: 82836 - RNA, 22 nt, Human
caucuuuguuuuggauauaauc

SEQ ID NO: 82837 - RNA, 22 nt, Human
caucucagguuuguucugagac

SEQ ID NO: 82838 - RNA, 22 nt, Human
cagucaaauuugaaaacuuuga

SEQ ID NO: 82839 - RNA, 22 nt, Human
caguccaugaugacuuuugcuc

SEQ ID NO: 82840 - RNA, 22 nt, Human
cagcuuguucugaccugugauu

SEQ ID NO: 82841 - RNA, 22 nt, Human
cagcuguacgugaucuacaugg

SEQ ID NO: 82842 - RNA, 21 nt, Human
cagcagaaaugagaggagaaa

SEQ ID NO: 82843 - RNA, 22 nt, Human
cagcuguauuucucugguuaga

SEQ ID NO: 82844 - RNA, 22 nt, Human
cagauacaacagcaggaaugaa

SEQ ID NO: 82845 - RNA, 22 nt, Human
cagaaaacauuguguguauaag

SEQ ID NO: 82846 - RNA, 22 nt, Human
cagauuuagcacugauaggacu

SEQ ID NO: 82847 - RNA, 22 nt, Human
cagagaagaggucuugaccccu

SEQ ID NO: 82848 - RNA, 19 nt, Human
cagcaaacacuguaaaugg

SEQ ID NO: 82849 - RNA, 22 nt, Human
caaugaaaauuuaaguugcagc

SEQ ID NO: 82850 - RNA, 22 nt, Human
caaucuucucuagaguauucua

SEQ ID NO: 82851 - RNA, 22 nt, Human
cacucaaacugaaauccuuuuu

SEQ ID NO: 82852 - RNA, 22 nt, Human
cucaaugagcuauuuguuucau

SEQ ID NO: 82853 - RNA, 22 nt, Human
cuggaaauggcagaguugcauu

SEQ ID NO: 82854 - RNA, 22 nt, Human
cugacugaggaucaguucauca

SEQ ID NO: 82855 - RNA, 22 nt, Human
cucauugacagagcagcucuac

SEQ ID NO: 82856 - RNA, 22 nt, Human
cucuauucuaauggauucuggg

SEQ ID NO: 82857 - RNA, 22 nt, Human
cuccaugagccaggagggcuac

SEQ ID NO: 82858 - RNA, 22 nt, Human
cuccaguugugucuuguaagaa

SEQ ID NO: 82859 - RNA, 22 nt, Human
cugaggaguaguucuggaggac

SEQ ID NO: 82860 - RNA, 22 nt, Human
cugagaaauacccaagucuggu

SEQ ID NO: 82861 - RNA, 22 nt, Human
cucugguuucgcaggaaauaga

SEQ ID NO: 82862 - RNA, 22 nt, Human
cuguacuuguuuuaggaugaug

SEQ ID NO: 82863 - RNA, 22 nt, Human
cucucuccuuuuugauauuuag

SEQ ID NO: 82864 - RNA, 22 nt, Human
cucucuguuaugcuuucaugaa

SEQ ID NO: 82865 - RNA, 22 nt, Human
cugcgcagaucugcuguucucu

SEQ ID NO: 82866 - RNA, 21 nt, Human
cugcugaaggaaccccaugga

SEQ ID NO: 82867 - RNA, 22 nt, Human
cuuggagauacagaggacauuu

SEQ ID NO: 82868 - RNA, 22 nt, Human
cugcuucacccugccugagaac

SEQ ID NO: 82869 - RNA, 22 nt, Human
cuuucuuucaaguucugcuuua

SEQ ID NO: 82870 - RNA, 22 nt, Human
cuuuccugaaaucucuucugca

SEQ ID NO: 82871 - RNA, 22 nt, Human
cuuuccaugucuucuuucucca

SEQ ID NO: 82872 - RNA, 22 nt, Human
cuggagaagagguaguauguag

SEQ ID NO: 82873 - RNA, 18 nt, Human
cuuuagcugucaucuuug

SEQ ID NO: 82874 - RNA, 22 nt, Human
cuuuauguuggggugucuuagu

SEQ ID NO: 82875 - RNA, 22 nt, Human
cugcuuguguugcucagaguca

SEQ ID NO: 82876 - RNA, 22 nt, Human
cuggaaaaauggauccugucuu

SEQ ID NO: 82877 - RNA, 22 nt, Human
cuugcaaugaaggcacacuuau

SEQ ID NO: 82878 - RNA, 22 nt, Human
cuugcagagcccauggauguca

SEQ ID NO: 82879 - RNA, 22 nt, Human
cuugccuuugaaagcauuucuc

SEQ ID NO: 82880 - RNA, 22 nt, Human
cuucuuucuuuucuucuucucu

SEQ ID NO: 82881 - RNA, 22 nt, Human
cuucuugucagugauuucuucc

SEQ ID NO: 82882 - RNA, 22 nt, Human
cuucuuuuggggaugaaaaugg

SEQ ID NO: 82883 - RNA, 22 nt, Human
cuucuuaaaguugucacagcug

SEQ ID NO: 82884 - RNA, 22 nt, Human
cuucucuuugacaguugggugu

SEQ ID NO: 82885 - RNA, 22 nt, Human
cuucuggaggcucuagaggaga

SEQ ID NO: 82886 - RNA, 22 nt, Human
cuucucuuggguguggugucuu

SEQ ID NO: 82887 - RNA, 22 nt, Human
cuucucuuccuucucauccuca

SEQ ID NO: 82888 - RNA, 22 nt, Human
cuucucugcugccugccucuuu

SEQ ID NO: 82889 - RNA, 22 nt, Human
cugcagauguagcugcuuuccu

SEQ ID NO: 82890 - RNA, 22 nt, Human
cuuccugcaacaccuguguugc

SEQ ID NO: 82891 - RNA, 20 nt, Human
cugauagauucuuccccaga

SEQ ID NO: 82892 - RNA, 22 nt, Human
cugcacagucauuuccucucaa

SEQ ID NO: 82893 - RNA, 22 nt, Human
cuucauuucaggcugaagaaua

SEQ ID NO: 82894 - RNA, 22 nt, Human
gaagaugcugcuuguucacggg

SEQ ID NO: 82895 - RNA, 22 nt, Human
gaagaugacaucggaucugucu

SEQ ID NO: 82896 - RNA, 19 nt, Human
gaacuaaggggagcucugg

SEQ ID NO: 82897 - RNA, 22 nt, Human
gaacauuucugcagaugucuga

SEQ ID NO: 82898 - RNA, 22 nt, Human
gagauuguggcagcagcuguuu

SEQ ID NO: 82899 - RNA, 22 nt, Human
gaaauagagacaguaagugucu

SEQ ID NO: 82900 - RNA, 22 nt, Human
gagaggaagugccugcucccag

SEQ ID NO: 82901 - RNA, 22 nt, Human
gaaagagaugucguuugucuuc

SEQ ID NO: 82902 - RNA, 22 nt, Human
gaaaaacucagugggggucuuu

SEQ ID NO: 82903 - RNA, 19 nt, Human
gacuccugagaugugaaac

SEQ ID NO: 82904 - RNA, 22 nt, Human
cuuuuucuugugguuaauaucu

SEQ ID NO: 82905 - RNA, 22 nt, Human
cuuuucuuuucuucucuuccca

SEQ ID NO: 82906 - RNA, 22 nt, Human
cuuggcacauuuuguucuucug

SEQ ID NO: 82907 - RNA, 22 nt, Human
cuucuucuagaagauggggaag

SEQ ID NO: 82908 - RNA, 22 nt, Human
cuucuugggaggggcggagcuc

SEQ ID NO: 82909 - RNA, 22 nt, Human
cuucuuuccauguguuuugguu

SEQ ID NO: 82910 - RNA, 22 nt, Human
gaauacaagccugccaccugga

SEQ ID NO: 82911 - RNA, 22 nt, Human
gaauauuuaucucagcugcaga

SEQ ID NO: 82912 - RNA, 22 nt, Human
cuugcucugggaauaugaguuu

SEQ ID NO: 82913 - RNA, 22 nt, Human
cuucccuaagggacuggcauag

SEQ ID NO: 82914 - RNA, 22 nt, Human
cuucuggaggcugcagaaaaga

SEQ ID NO: 82915 - RNA, 22 nt, Human
cuucucuugugauguuagcgga

SEQ ID NO: 82916 - RNA, 22 nt, Human
cuucuuagugauuuaacaugua

SEQ ID NO: 82917 - RNA, 22 nt, Human
cuucagagugacucagcaucuu

SEQ ID NO: 82918 - RNA, 23 nt, Human
cuucagaccucagaaggucuguu

SEQ ID NO: 82919 - RNA, 23 nt, Human
cuuauauaaucauuagaaaccau

SEQ ID NO: 82920 - RNA, 22 nt, Human
cuuauaucaacuggaaaaauua

SEQ ID NO: 82921 - RNA, 20 nt, Human
cuguuugcuaucaugagcug

SEQ ID NO: 82922 - RNA, 22 nt, Human
gaacaaaagauagcccaaacau

SEQ ID NO: 82923 - RNA, 20 nt, Human
cuguucucuugccacaugag

SEQ ID NO: 82924 - RNA, 22 nt, Human
gaaagugaauguaacauguuau

SEQ ID NO: 82925 - RNA, 22 nt, Human
gaaauaggcccuuacauggaaa

SEQ ID NO: 82926 - RNA, 22 nt, Human
cuggcaguguccagcucgugau

SEQ ID NO: 82927 - RNA, 22 nt, Human
cugaagaaagaaaauggccauc

SEQ ID NO: 82928 - RNA, 23 nt, Human
cugaaauucagaugcuaaagaua

SEQ ID NO: 82929 - RNA, 22 nt, Human
cugaaagacagccaggcaaagc

SEQ ID NO: 82930 - RNA, 22 nt, Human
cucuuuguauucuagaagcucu

SEQ ID NO: 82931 - RNA, 20 nt, Human
cucuuuaugagaccacuguc

SEQ ID NO: 82932 - RNA, 22 nt, Human
cucuuagucugcuuuuuuucca

SEQ ID NO: 82933 - RNA, 22 nt, Human
cucuguggucugaagccuguga

SEQ ID NO: 82934 - RNA, 22 nt, Human
cucuccaguuauagcugauuug

SEQ ID NO: 82935 - RNA, 22 nt, Human
cucuaaauguggucugcagaua

SEQ ID NO: 82936 - RNA, 22 nt, Human
cuccuuugagcaaaucuuugau

SEQ ID NO: 82937 - RNA, 22 nt, Human
cucuauuuuuucaucuuucagg

SEQ ID NO: 82938 - RNA, 21 nt, Human
cuccuguaaaucaccuccgca

SEQ ID NO: 82939 - RNA, 22 nt, Human
cuccaucccccugugugucaau

SEQ ID NO: 82940 - RNA, 22 nt, Human
cucaugcugcaaauggcuguuu

SEQ ID NO: 82941 - RNA, 22 nt, Human
cucagaauugucaccucaaaaa

SEQ ID NO: 82942 - RNA, 19 nt, Human
cgcugcucccgcuguggcu

SEQ ID NO: 82943 - RNA, 22 nt, Human
cucaggaaaauauugaagaagu

SEQ ID NO: 82944 - RNA, 22 nt, Human
cucacugucagcugcagggcuu

SEQ ID NO: 82945 - RNA, 22 nt, Human
cuauguuuugcuagugaugggu

SEQ ID NO: 82946 - RNA, 22 nt, Human
cuauaucuguggauaguguaug

SEQ ID NO: 82947 - RNA, 21 nt, Human
cuauaaaaaugguucuuugcg

SEQ ID NO: 82948 - RNA, 18 nt, Human
cuaagaggucguuucuca

SEQ ID NO: 82949 - RNA, 22 nt, Human
ccuuuuaagggagacuagagau

SEQ ID NO: 82950 - RNA, 22 nt, Human
ccugugacucugucugaugguc

SEQ ID NO: 82951 - RNA, 19 nt, Human
cgguaugaauguacuaugg

SEQ ID NO: 82952 - RNA, 22 nt, Human
ccuuagcuggguaacuuugggc

SEQ ID NO: 82953 - RNA, 22 nt, Human
ccuuaauaguguucuaauguuu

SEQ ID NO: 82954 - RNA, 22 nt, Human
ccucauagccuuuccuacuuua

SEQ ID NO: 82955 - RNA, 22 nt, Human
ccucuaugcccuucuggggguc

SEQ ID NO: 82956 - RNA, 22 nt, Human
ccucuagaauuaucacuuuuaa

SEQ ID NO: 82957 - RNA, 22 nt, Human
ccucacuucuuucucuucacuu

SEQ ID NO: 82958 - RNA, 22 nt, Human
ccugaguucuuauuuccaguca

SEQ ID NO: 82959 - RNA, 22 nt, Human
ccucuccucugugcagacugcc

SEQ ID NO: 82960 - RNA, 22 nt, Human
ccuccugggccuugcucuguga

SEQ ID NO: 82961 - RNA, 22 nt, Human
ccccuauaugccugcagugauu

SEQ ID NO: 82962 - RNA, 22 nt, Human
ccuaauuuuagacccacuccua

SEQ ID NO: 82963 - RNA, 22 nt, Human
ccucacaaagaaugucuagaca

SEQ ID NO: 82964 - RNA, 22 nt, Human
ccucaggaauuuauucuucugu

SEQ ID NO: 82965 - RNA, 22 nt, Human
ccaugaggcaaagacugauaua

SEQ ID NO: 82966 - RNA, 22 nt, Human
ccauaaaguaggaaacacuaca

SEQ ID NO: 82967 - RNA, 22 nt, Human
ccaguuuuuccagugcuuucug

SEQ ID NO: 82968 - RNA, 19 nt, Human
cccgauggagacuuagcag

SEQ ID NO: 82969 - RNA, 22 nt, Human
uuuuuuuccaguuauucauuuu

SEQ ID NO: 82970 - RNA, 21 nt, Human
uuuuucuccagaguuuccacu

SEQ ID NO: 82971 - RNA, 21 nt, Human
uuuuuggagggguggggagga

SEQ ID NO: 82972 - RNA, 22 nt, Human
uuuuugggaagaauucugauau

SEQ ID NO: 82973 - RNA, 22 nt, Human
uuuuuguaaaugaaguuuuauu

SEQ ID NO: 82974 - RNA, 22 nt, Human
uuuuuuaaucaaguaggaaaca

SEQ ID NO: 82975 - RNA, 22 nt, Human
uuuuuguuauuuagguguagag

SEQ ID NO: 82976 - RNA, 22 nt, Human
uuuuuucuucucuaucuuaaua

SEQ ID NO: 82977 - RNA, 22 nt, Human
uuuuuugucuugaagaaauggu

SEQ ID NO: 82978 - RNA, 22 nt, Human
uuuuuuguggcuggaagaaaaa

SEQ ID NO: 82979 - RNA, 22 nt, Human
uuuuuuuagaaagaucauaguu

SEQ ID NO: 82980 - RNA, 18 nt, Human
uuuuuuguucuguuuugu

SEQ ID NO: 82981 - RNA, 22 nt, Human
uuuucaauuuucauuugcaaga

SEQ ID NO: 82982 - RNA, 22 nt, Human
uuuuauuuguauguugaaugua

SEQ ID NO: 82983 - RNA, 22 nt, Human
uuuguucuagauaacugguaau

SEQ ID NO: 82984 - RNA, 21 nt, Human
uuuguucaggggcaaaguuaa

SEQ ID NO: 82985 - RNA, 22 nt, Human
uuuguucaccuagcaaacuuuu

SEQ ID NO: 82986 - RNA, 22 nt, Human
uuuguuuauuuacuuugggccu

SEQ ID NO: 82987 - RNA, 22 nt, Human
uuuguuuuggugucaugcguga

SEQ ID NO: 82988 - RNA, 22 nt, Human
uuuuccuucuuccugccuugcc

SEQ ID NO: 82989 - RNA, 22 nt, Human
uuuucuacaaucacucuggaag

SEQ ID NO: 82990 - RNA, 22 nt, Human
uuuuccuuagaaauacauugau

SEQ ID NO: 82991 - RNA, 22 nt, Human
uuuucugauccuucuaacuuga

SEQ ID NO: 82992 - RNA, 22 nt, Human
uuuucucucacuucacauauuu

SEQ ID NO: 82993 - RNA, 22 nt, Human
uuuucucuuugcuucucuaaaa

SEQ ID NO: 82994 - RNA, 22 nt, Human
uuuucuuggaguggcuguccuu

SEQ ID NO: 82995 - RNA, 22 nt, Human
uuuugaugaccauucuucuuuu

SEQ ID NO: 82996 - RNA, 22 nt, Human
uuuugcuagaaaucaccaauac

SEQ ID NO: 82997 - RNA, 22 nt, Human
uuuugguaguccagaguuuagu

SEQ ID NO: 82998 - RNA, 22 nt, Human
uuuugguauggcuugauagagu

SEQ ID NO: 82999 - RNA, 22 nt, Human
uuuugguuugaguauuuuuuuu

SEQ ID NO: 83000 - RNA, 22 nt, Human
uuuugcuucuaguauauuuuuu

SEQ ID NO: 83001 - RNA, 22 nt, Human
uuuuuaagguuuguuuauauau

SEQ ID NO: 83002 - RNA, 22 nt, Human
uuuuuauaagauuuaaaaugua

SEQ ID NO: 83003 - RNA, 22 nt, Human
uuuuuagggauuaguguuugag

SEQ ID NO: 83004 - RNA, 22 nt, Human
gagacugugucugucaagcuag

SEQ ID NO: 83005 - RNA, 22 nt, Human
gagacuguaagcuccuugagga

SEQ ID NO: 83006 - RNA, 22 nt, Human
gauggcauucacaaacuuaacu

SEQ ID NO: 83007 - RNA, 22 nt, Human
gauggcaaugcuagaaauuuag

SEQ ID NO: 83008 - RNA, 22 nt, Human
gagauuugaguuccuacugagu

SEQ ID NO: 83009 - RNA, 22 nt, Human
gagcacuucagcauaaaucaca

SEQ ID NO: 83010 - RNA, 22 nt, Human
gaugguuuuacauuuuaauguu

SEQ ID NO: 83011 - RNA, 22 nt, Human
gauuuuuaaaaguaguuuugaa

SEQ ID NO: 83012 - RNA, 22 nt, Human
gauuucuucauuuaaaaauauu

SEQ ID NO: 83013 - RNA, 22 nt, Human
gauugggagugugacauuguau

SEQ ID NO: 83014 - RNA, 22 nt, Human
gauucugaaauuaacagacugg

SEQ ID NO: 83015 - RNA, 22 nt, Human
gauucuaucauucuguauauua

SEQ ID NO: 83016 - RNA, 22 nt, Human
gauuaagaaagauagaugugga

SEQ ID NO: 83017 - RNA, 22 nt, Human
gauguuuugaaagaagaauaca

SEQ ID NO: 83018 - RNA, 22 nt, Human
gauguuaauauguuucaccaaa

SEQ ID NO: 83019 - RNA, 22 nt, Human
gaggaagucuuaucuggaugca

SEQ ID NO: 83020 - RNA, 22 nt, Human
gcacagaguguaaaaguuucau

SEQ ID NO: 83021 - RNA, 22 nt, Human
gaggaggucaccuggugagcaa

SEQ ID NO: 83022 - RNA, 22 nt, Human
gaggcucagagggacuuucaag

SEQ ID NO: 83023 - RNA, 22 nt, Human
gcacuaccaguaauuaaaucug

SEQ ID NO: 83024 - RNA, 22 nt, Human
gcaggacuucuguuuaaccagu

SEQ ID NO: 83025 - RNA, 22 nt, Human
gcaggacugauggagcauaugu

SEQ ID NO: 83026 - RNA, 22 nt, Human
gagguagaggaaaagauuauca

SEQ ID NO: 83027 - RNA, 22 nt, Human
gaggucauuaaagaaaagaguc

SEQ ID NO: 83028 - RNA, 22 nt, Human
gcagagcugucuaagucacuuc

SEQ ID NO: 83029 - RNA, 22 nt, Human
gagggcauugucuucuuaguuu

SEQ ID NO: 83030 - RNA, 22 nt, Human
gaucacuuugauuagauguccu

SEQ ID NO: 83031 - RNA, 22 nt, Human
gaucauauccagucaccacuau

SEQ ID NO: 83032 - RNA, 22 nt, Human
gaugcucuugauuggaccaggg

SEQ ID NO: 83033 - RNA, 22 nt, Human
gcauuccagaguugcuggaaaa

SEQ ID NO: 83034 - RNA, 22 nt, Human
gcauucuugucaguggggucag

SEQ ID NO: 83035 - RNA, 22 nt, Human
gcaugcuguuuggaaacgauaa

SEQ ID NO: 83036 - RNA, 22 nt, Human
gauaagugauucugauucacau

SEQ ID NO: 83037 - RNA, 19 nt, Human
gaguaaaacuagagagaaa

SEQ ID NO: 83038 - RNA, 22 nt, Human
gauuuuaaaagauguauaaggu

SEQ ID NO: 83039 - RNA, 22 nt, Human
gauuuucauuauagcuaguuuc

SEQ ID NO: 83040 - RNA, 20 nt, Human
gccuccuccaaguuucauca

SEQ ID NO: 83041 - RNA, 22 nt, Human
gcaacccugggucaugguugac

SEQ ID NO: 83042 - RNA, 22 nt, Human
gcaagagaagaaagaauaguuu

SEQ ID NO: 83043 - RNA, 22 nt, Human
gccuucccuccucugcucucag

SEQ ID NO: 83044 - RNA, 22 nt, Human
gauugcugccagcguguccgug

SEQ ID NO: 83045 - RNA, 22 nt, Human
gauugauguaggugauaaaucu

SEQ ID NO: 83046 - RNA, 22 nt, Human
gauugauuuaauaugagaggau

SEQ ID NO: 83047 - RNA, 22 nt, Human
gccauguuuugguaaauaccau

SEQ ID NO: 83048 - RNA, 23 nt, Human
gcugagcaccagccauaucuuuu

SEQ ID NO: 83049 - RNA, 22 nt, Human
gcugagaguguaggauguuuac

SEQ ID NO: 83050 - RNA, 23 nt, Human
gcucugauaccagcuacaucuag

SEQ ID NO: 83051 - RNA, 22 nt, Human
gcucucuggccugggaggagga

SEQ ID NO: 83052 - RNA, 22 nt, Human
gcucugcuccaucuguuuccuc

SEQ ID NO: 83053 - RNA, 22 nt, Human
gcauaaaggacuauaaggauca

SEQ ID NO: 83054 - RNA, 22 nt, Human
gcuacaaaaccagggcaaagga

SEQ ID NO: 83055 - RNA, 22 nt, Human
gcuacaggggucaguccuuugc

SEQ ID NO: 83056 - RNA, 22 nt, Human
gcguggaugauuuugagucggu

SEQ ID NO: 83057 - RNA, 22 nt, Human
gcgugcauguguguaugcgugu

SEQ ID NO: 83058 - RNA, 22 nt, Human
gccuuuuaaggcagagggagau

SEQ ID NO: 83059 - RNA, 22 nt, Human
ggagagcuagugagcuggaggu

SEQ ID NO: 83060 - RNA, 22 nt, Human
ggggacuugguuuuaaugagcu

SEQ ID NO: 83061 - RNA, 22 nt, Human
ggggagaugauaagugcauuug

SEQ ID NO: 83062 - RNA, 22 nt, Human
ggggaauuaaaugagaagccuu

SEQ ID NO: 83063 - RNA, 22 nt, Human
ggggaagagagaagaaugaucu

SEQ ID NO: 83064 - RNA, 22 nt, Human
ggacauagaucuagacuuuaaa

SEQ ID NO: 83065 - RNA, 22 nt, Human
gggcucuuaauuuuuuucucua

SEQ ID NO: 83066 - RNA, 22 nt, Human
gggcuacagaugggagggauga

SEQ ID NO: 83067 - RNA, 22 nt, Human
ggaagucuacucuuccgaaaac

SEQ ID NO: 83068 - RNA, 20 nt, Human
ggaaguauccacaaauuccu

SEQ ID NO: 83069 - RNA, 17 nt, Human
ggaagaaaaggaucauc

SEQ ID NO: 83070 - RNA, 22 nt, Human
gcuuuguugauggugagucugu

SEQ ID NO: 83071 - RNA, 22 nt, Human
gcuuuuaaauuaucugacaaug

SEQ ID NO: 83072 - RNA, 22 nt, Human
gcuguggagaagcugccuaugg

SEQ ID NO: 83073 - RNA, 22 nt, Human
guaauucugugugaaucuauua

SEQ ID NO: 83074 - RNA, 22 nt, Human
ggugucagccacuuugucggag

SEQ ID NO: 83075 - RNA, 22 nt, Human
gguugccuguggcucccuguua

SEQ ID NO: 83076 - RNA, 22 nt, Human
guagaaaauagauugucucuug

SEQ ID NO: 83077 - RNA, 22 nt, Human
guagugauuguuccucaggggu

SEQ ID NO: 83078 - RNA, 22 nt, Human
guaggaaaugaauaagguaccu

SEQ ID NO: 83079 - RNA, 22 nt, Human
guaguucuccaggggcuguuca

SEQ ID NO: 83080 - RNA, 18 nt, Human
ggccucagccuggccgga

SEQ ID NO: 83081 - RNA, 22 nt, Human
ggcagugguaggagcccaggag

SEQ ID NO: 83082 - RNA, 22 nt, Human
ggauuucuucucauaacugaga

SEQ ID NO: 83083 - RNA, 22 nt, Human
ggcuucucuuggccaugguccc

SEQ ID NO: 83084 - RNA, 21 nt, Human
gcuguagauucacaaagaggu

SEQ ID NO: 83085 - RNA, 22 nt, Human
ggcugcuggaguugggucucuc

SEQ ID NO: 83086 - RNA, 21 nt, Human
gcuggcugucucuuacacggu

SEQ ID NO: 83087 - RNA, 22 nt, Human
gcugcuuagaaccauauuuaaa

SEQ ID NO: 83088 - RNA, 22 nt, Human
ggcuccucaggcugggguaagg

SEQ ID NO: 83089 - RNA, 22 nt, Human
ggcgaugaggucuuagaaucua

SEQ ID NO: 83090 - RNA, 22 nt, Human
gcugcuggcuuccugcuguuuu

SEQ ID NO: 83091 - RNA, 22 nt, Human
gcucaugggcccagagcagccc

SEQ ID NO: 83092 - RNA, 22 nt, Human
gcuacauuagcuucaauggcua

SEQ ID NO: 83093 - RNA, 22 nt, Human
gcuacaacugugucuguggggc

SEQ ID NO: 83094 - RNA, 22 nt, Human
gcuacaaauaaaaugggugacu

SEQ ID NO: 83095 - RNA, 20 nt, Human
ggauugaacuauuucucagc

SEQ ID NO: 83096 - RNA, 22 nt, Human
ggaugcugcuccacaucccaca

SEQ ID NO: 83097 - RNA, 22 nt, Human
ggaucuaaagccagaauauaug

SEQ ID NO: 83098 - RNA, 18 nt, Human
ggagaagaacagaugugg

SEQ ID NO: 83099 - RNA, 22 nt, Human
ggagaggaaguuuaaagaauug

SEQ ID NO: 83100 - RNA, 22 nt, Human
ggagaggaggugagaggaagua

SEQ ID NO: 83101 - RNA, 23 nt, Human
ggaauuucagaugugaaauaaaa

SEQ ID NO: 83102 - RNA, 22 nt, Human
ggaagugagcucauuacuuuag

SEQ ID NO: 83103 - RNA, 22 nt, Human
ggaagcuguugugagugcagca

SEQ ID NO: 83104 - RNA, 22 nt, Human
ggaagcugucugcccggcgcuc

SEQ ID NO: 83105 - RNA, 22 nt, Human
guggaaauaugggcaacaaaga

SEQ ID NO: 83106 - RNA, 22 nt, Human
gggcaugcagcaauucuguggu

SEQ ID NO: 83107 - RNA, 22 nt, Human
guggagauauuugugauagggg

SEQ ID NO: 83108 - RNA, 22 nt, Human
gugggagaaugggaggaguaau

SEQ ID NO: 83109 - RNA, 22 nt, Human
gugggggugaggaauguucuau

SEQ ID NO: 83110 - RNA, 22 nt, Human
guggauggagcuggaagccauu

SEQ ID NO: 83111 - RNA, 22 nt, Human
guguucuuuguagaggaucuug

SEQ ID NO: 83112 - RNA, 22 nt, Human
gugugguguuaagcaaauuaau

SEQ ID NO: 83113 - RNA, 22 nt, Human
gggcuguuugcauauguuuaua

SEQ ID NO: 83114 - RNA, 22 nt, Human
guugagacugaaguucugaaag

SEQ ID NO: 83115 - RNA, 22 nt, Human
gguaaucuccucauugacguua

SEQ ID NO: 83116 - RNA, 21 nt, Human
guucuuaguuauauucucaau

SEQ ID NO: 83117 - RNA, 22 nt, Human
guuauuguuauugcguugucga

SEQ ID NO: 83118 - RNA, 22 nt, Human
ggggauuucccaaugcgaagca

SEQ ID NO: 83119 - RNA, 22 nt, Human
guauaaagaugccauacuuacu

SEQ ID NO: 83120 - RNA, 22 nt, Human
uaacuuuucuguucaauuuucc

SEQ ID NO: 83121 - RNA, 22 nt, Human
gucagauucuuucauuugcuga

SEQ ID NO: 83122 - RNA, 22 nt, Human
gucacuuugcuugcgaugcucc

SEQ ID NO: 83123 - RNA, 22 nt, Human
uaaggaaaugcaaauuuaagaa

SEQ ID NO: 83124 - RNA, 22 nt, Human
gguuuaucuuuacaaaugaaau

SEQ ID NO: 83125 - RNA, 22 nt, Human
guuuuaucuauguaauuauaaa

SEQ ID NO: 83126 - RNA, 22 nt, Human
gguggagacucagauuuguugc

SEQ ID NO: 83127 - RNA, 22 nt, Human
uacaaauguuucuucuccuuuu

SEQ ID NO: 83128 - RNA, 22 nt, Human
uaauaaaaauuuaauucacauu

SEQ ID NO: 83129 - RNA, 22 nt, Human
gucugcacgugccagggagggg

SEQ ID NO: 83130 - RNA, 22 nt, Human
uacuuacacugaagcaaagaua

SEQ ID NO: 83131 - RNA, 22 nt, Human
uacucucuuccauacaaucugu

SEQ ID NO: 83132 - RNA, 22 nt, Human
uacuauuuugacaugaaauuga

SEQ ID NO: 83133 - RNA, 22 nt, Human
uacuaaagaaugaguuaaguuu

SEQ ID NO: 83134 - RNA, 22 nt, Human
uagagugcugucaaagacuugu

SEQ ID NO: 83135 - RNA, 22 nt, Human
gugccgcuggagcuggaauuga

SEQ ID NO: 83136 - RNA, 22 nt, Human
uagauuuaaaaagggugggaug

SEQ ID NO: 83137 - RNA, 22 nt, Human
uacuuaucuuagggaugcuugc

SEQ ID NO: 83138 - RNA, 22 nt, Human
uagagaaauuacagcuuucuuu

SEQ ID NO: 83139 - RNA, 22 nt, Human
gugauuucaaauauagagugag

SEQ ID NO: 83140 - RNA, 19 nt, Human
uagagcagcuucagauucc

SEQ ID NO: 83141 - RNA, 22 nt, Human
uagagagaaaccaggguuuggg

SEQ ID NO: 83142 - RNA, 22 nt, Human
uagagcucaagaagcaaaagcu

SEQ ID NO: 83143 - RNA, 22 nt, Human
uagagaaauauuuguagugcug

SEQ ID NO: 83144 - RNA, 22 nt, Human
uccucagagacaaguugagagg

SEQ ID NO: 83145 - RNA, 19 nt, Human
uccuacaugagacagagag

SEQ ID NO: 83146 - RNA, 22 nt, Human
uagaagagcuuccaccuggggc

SEQ ID NO: 83147 - RNA, 22 nt, Human
uagaagaugccuuaaaguugaa

SEQ ID NO: 83148 - RNA, 22 nt, Human
uagaaguuaaaggaauacagaa

SEQ ID NO: 83149 - RNA, 21 nt, Human
uagaagagggaauuugucuuu

SEQ ID NO: 83150 - RNA, 22 nt, Human
uccuaagaaacagacugaaaag

SEQ ID NO: 83151 - RNA, 22 nt, Human
uagacauuuacuuugaaaaaau

SEQ ID NO: 83152 - RNA, 22 nt, Human
ucccagcaggcaccgcuucugc

SEQ ID NO: 83153 - RNA, 22 nt, Human
uagcauacagauauuuaacucu

SEQ ID NO: 83154 - RNA, 22 nt, Human
uccugaaugguguaauagguuu

SEQ ID NO: 83155 - RNA, 22 nt, Human
uccuuucaaauuuauuugacau

SEQ ID NO: 83156 - RNA, 22 nt, Human
ucguggaugaagaauagaggcc

SEQ ID NO: 83157 - RNA, 22 nt, Human
ucuaaagcuccuuccacuaaaa

SEQ ID NO: 83158 - RNA, 22 nt, Human
uagguuuugugucagaguagaa

SEQ ID NO: 83159 - RNA, 22 nt, Human
ucgcuguguccuuuucacuuau

SEQ ID NO: 83160 - RNA, 22 nt, Human
uaggggcccgugggauggacag

SEQ ID NO: 83161 - RNA, 22 nt, Human
uccuuuuuagguuauuguacau

SEQ ID NO: 83162 - RNA, 21 nt, Human
uccauucuuggugguucugca

SEQ ID NO: 83163 - RNA, 23 nt, Human
uaccagacccugaaagaaagugu

SEQ ID NO: 83164 - RNA, 22 nt, Human
uacauuugauuuuugcuucuuu

SEQ ID NO: 83165 - RNA, 22 nt, Human
uacagucauaagguuucucucc

SEQ ID NO: 83166 - RNA, 21 nt, Human
uaagaacauuaucuucuuccu

SEQ ID NO: 83167 - RNA, 22 nt, Human
uaacuuuuuauccuguuaaaug

SEQ ID NO: 83168 - RNA, 23 nt, Human
uaaagauaguuuaaaggugaguu

SEQ ID NO: 83169 - RNA, 22 nt, Human
uaaagacaauuucgagcuguag

SEQ ID NO: 83170 - RNA, 22 nt, Human
uaagagcagacacaaccugaga

SEQ ID NO: 83171 - RNA, 19 nt, Human
uaagaaucaccaggggugu

SEQ ID NO: 83172 - RNA, 22 nt, Human
uaaguuguagaacguuuucuua

SEQ ID NO: 83173 - RNA, 22 nt, Human
ucauuggagcauaugaugguua

SEQ ID NO: 83174 - RNA, 22 nt, Human
uaauuccacacucccgcaagcg

SEQ ID NO: 83175 - RNA, 22 nt, Human
uaauuauuaauuuuagguugcu

SEQ ID NO: 83176 - RNA, 22 nt, Human
uaaagaagaaaaggcuucaggc

SEQ ID NO: 83177 - RNA, 22 nt, Human
uaaaaugcucagauaaauauau

SEQ ID NO: 83178 - RNA, 22 nt, Human
uaaaaccauucauugaccuaug

SEQ ID NO: 83179 - RNA, 21 nt, Human
uaaaagaugacaagacagcuc

SEQ ID NO: 83180 - RNA, 19 nt, Human
ucagcagauuuugcaaaca

SEQ ID NO: 83181 - RNA, 21 nt, Human
ucagaaucguuccagguagau

SEQ ID NO: 83182 - RNA, 22 nt, Human
guuuucuuguuaauuuugaacg

SEQ ID NO: 83183 - RNA, 18 nt, Human
ucagaggagauaccuaaa

SEQ ID NO: 83184 - RNA, 22 nt, Human
ucagagaaguaggcuaauggug

SEQ ID NO: 83185 - RNA, 22 nt, Human
ucacucuuuaucuuuuaugucu

SEQ ID NO: 83186 - RNA, 22 nt, Human
ucacuuccuugcagcuguagaa

SEQ ID NO: 83187 - RNA, 22 nt, Human
ucacuucuaugaucugucucuu

SEQ ID NO: 83188 - RNA, 22 nt, Human
ucacuucugcuccuuggaugcc

SEQ ID NO: 83189 - RNA, 22 nt, Human
guuuauucuuuuauuugugaga

SEQ ID NO: 83190 - RNA, 22 nt, Human
ucacaagaagaaauuaaacugu

SEQ ID NO: 83191 - RNA, 22 nt, Human
guuuaagcagauugcuguggug

SEQ ID NO: 83192 - RNA, 22 nt, Human
uauuuuucacagauuggugcuu

SEQ ID NO: 83193 - RNA, 22 nt, Human
uauuuuuacuguuugaugauuc

SEQ ID NO: 83194 - RNA, 22 nt, Human
uauuuuuaccuaauuuaugaga

SEQ ID NO: 83195 - RNA, 22 nt, Human
ucaaggaagggguaggaauaau

SEQ ID NO: 83196 - RNA, 21 nt, Human
ucaaguccuggcuuugcucuu

SEQ ID NO: 83197 - RNA, 22 nt, Human
ucaagggaccaagcauucauua

SEQ ID NO: 83198 - RNA, 21 nt, Human
uauucgcauuucugucuuuac

SEQ ID NO: 83199 - RNA, 22 nt, Human
guuauuuugucuuguucaugaa

SEQ ID NO: 83200 - RNA, 22 nt, Human
uauguguaauuaaauacuauag

SEQ ID NO: 83201 - RNA, 22 nt, Human
uaugugugaguauauaugcaca

SEQ ID NO: 83202 - RNA, 22 nt, Human
guguugcaggaagauauagcug

SEQ ID NO: 83203 - RNA, 22 nt, Human
uauggcuucucagucaugaaaa

SEQ ID NO: 83204 - RNA, 22 nt, Human
uaugguuagugcuguagauuau

SEQ ID NO: 83205 - RNA, 22 nt, Human
guuccucugaaggauuuucaga

SEQ ID NO: 83206 - RNA, 22 nt, Human
guuccuaaauuugaaggacuuu

SEQ ID NO: 83207 - RNA, 22 nt, Human
uauuguuuuaagguguauuaau

SEQ ID NO: 83208 - RNA, 22 nt, Human
uauugugaaggccaugugcuaa

SEQ ID NO: 83209 - RNA, 22 nt, Human
uauuuaaagucagcaacuuuuc

SEQ ID NO: 83210 - RNA, 20 nt, Human
uauuucaaugugccaaguuu

SEQ ID NO: 83211 - RNA, 22 nt, Human
uauuuguuucuaguggcagcaa

SEQ ID NO: 83212 - RNA, 22 nt, Human
guucuuuacuucgcaucugcua

SEQ ID NO: 83213 - RNA, 22 nt, Human
guugagaaucucuagcuuagga

SEQ ID NO: 83214 - RNA, 22 nt, Human
uauuuuggaugcauugagaugc

SEQ ID NO: 83215 - RNA, 22 nt, Human
uaugcacacguguccaugugca

SEQ ID NO: 83216 - RNA, 22 nt, Human
uaucuguauuguagaacuguug

SEQ ID NO: 83217 - RNA, 22 nt, Human
uauauuuguccuagcuccuagc

SEQ ID NO: 83218 - RNA, 22 nt, Human
uauacauauacaaaugcacaua

SEQ ID NO: 83219 - RNA, 22 nt, Human
uagcauuucacugaucuucacu

SEQ ID NO: 83220 - RNA, 22 nt, Human
gugcuaaguaaguauuuuggag

SEQ ID NO: 83221 - RNA, 22 nt, Human
uaguugguggagcgauuugucu

SEQ ID NO: 83222 - RNA, 22 nt, Human
ucagcaaugggauucaggcuuu

SEQ ID NO: 83223 - RNA, 22 nt, Human
ugacauuugagagagauauaca

SEQ ID NO: 83224 - RNA, 22 nt, Human
ucacuguaggaaucucuaaauu

SEQ ID NO: 83225 - RNA, 23 nt, Human
ucacuucucuuacccucucucug

SEQ ID NO: 83226 - RNA, 22 nt, Human
ucaagguauuauuuuuguggug

SEQ ID NO: 83227 - RNA, 22 nt, Human
ugaaugaacugaugaacuuaac

SEQ ID NO: 83228 - RNA, 22 nt, Human
ugaaucuuguuuacugauuccu

SEQ ID NO: 83229 - RNA, 22 nt, Human
ugaagguggcuugcagcuaguc

SEQ ID NO: 83230 - RNA, 22 nt, Human
ugaagcuagguucaugaggucg

SEQ ID NO: 83231 - RNA, 22 nt, Human
ucaagaagauaaugucuagggu

SEQ ID NO: 83232 - RNA, 22 nt, Human
ucaaaucugauaggcgacaccu

SEQ ID NO: 83233 - RNA, 22 nt, Human
ucaaaaauaagauauucuggac

SEQ ID NO: 83234 - RNA, 22 nt, Human
ugaacuuacauugaggaauucu

SEQ ID NO: 83235 - RNA, 22 nt, Human
ugaaaggaauuuaaauguuguu

SEQ ID NO: 83236 - RNA, 22 nt, Human
ugaaauguggagaugguaagua

SEQ ID NO: 83237 - RNA, 22 nt, Human
uauuuuagccaacagaaugaug

SEQ ID NO: 83238 - RNA, 22 nt, Human
uauuuuauuuagguuuaguugu

SEQ ID NO: 83239 - RNA, 22 nt, Human
ugaaaaauauuuuuagaaauaa

SEQ ID NO: 83240 - RNA, 22 nt, Human
uauuuuggcuccugagcucuga

SEQ ID NO: 83241 - RNA, 22 nt, Human
ucuuuuuaugucaaaaucgaug

SEQ ID NO: 83242 - RNA, 22 nt, Human
uauuugauggaacucuugcuuu

SEQ ID NO: 83243 - RNA, 18 nt, Human
uauuugugugugugugug

SEQ ID NO: 83244 - RNA, 22 nt, Human
uauuucuagggcaugaaaauaa

SEQ ID NO: 83245 - RNA, 22 nt, Human
uauuuccugcguuucugugagc

SEQ ID NO: 83246 - RNA, 22 nt, Human
ucuuugcagaauuuaacuuugc

SEQ ID NO: 83247 - RNA, 22 nt, Human
ucuuugcugacacuuacacugu

SEQ ID NO: 83248 - RNA, 22 nt, Human
ucuuucucauccaaacuaguug

SEQ ID NO: 83249 - RNA, 23 nt, Human
ucuuuccuuucauacagucagcu

SEQ ID NO: 83250 - RNA, 22 nt, Human
ucuuuauuucccuaacuugcua

SEQ ID NO: 83251 - RNA, 22 nt, Human
uauuggcucagucagaaguuuu

SEQ ID NO: 83252 - RNA, 22 nt, Human
ucuucuauaucuacauaugcaa

SEQ ID NO: 83253 - RNA, 22 nt, Human
ucuugcuguagcuguuucuucu

SEQ ID NO: 83254 - RNA, 19 nt, Human
ucuugcaucuuccuacugu

SEQ ID NO: 83255 - RNA, 22 nt, Human
ucuugauggugauguuguguca

SEQ ID NO: 83256 - RNA, 22 nt, Human
ucuagagaauuuggaaauuaag

SEQ ID NO: 83257 - RNA, 22 nt, Human
ucuuccauuccccuccuacgcc

SEQ ID NO: 83258 - RNA, 19 nt, Human
ugcaagcuuuuucuuguua

SEQ ID NO: 83259 - RNA, 22 nt, Human
ugcaagauccagucuugagaag

SEQ ID NO: 83260 - RNA, 22 nt, Human
ucccaaaacuugaagcaagccu

SEQ ID NO: 83261 - RNA, 22 nt, Human
ugcaaugagcuucuuugauaaa

SEQ ID NO: 83262 - RNA, 22 nt, Human
uccaucauucagaaauuuuuga

SEQ ID NO: 83263 - RNA, 18 nt, Human
uccauccucugcucuuca

SEQ ID NO: 83264 - RNA, 22 nt, Human
ugcaaaaagagcgaggagcccu

SEQ ID NO: 83265 - RNA, 22 nt, Human
ugauuuguuuaaauugcucguu

SEQ ID NO: 83266 - RNA, 22 nt, Human
ugauggaguauaauaaaaugac

SEQ ID NO: 83267 - RNA, 22 nt, Human
ucauucucucguauucgcgaau

SEQ ID NO: 83268 - RNA, 22 nt, Human
ucauuagaccucucugguucag

SEQ ID NO: 83269 - RNA, 22 nt, Human
ugaguguuguaaccauaugauu

SEQ ID NO: 83270 - RNA, 21 nt, Human
ugagucuuagagaacuucagg

SEQ ID NO: 83271 - RNA, 22 nt, Human
ugagaaaacaguuuguaauaau

SEQ ID NO: 83272 - RNA, 22 nt, Human
uccuucuguuguuuauuuuaaa

SEQ ID NO: 83273 - RNA, 22 nt, Human
uccuuccucuuucaaauuuguu

SEQ ID NO: 83274 - RNA, 22 nt, Human
uccugaaggccugaguuccacc

SEQ ID NO: 83275 - RNA, 22 nt, Human
uccucuucaaaauagcucugaa

SEQ ID NO: 83276 - RNA, 20 nt, Human
uccugaaauuacgugauuca

SEQ ID NO: 83277 - RNA, 22 nt, Human
ugccauuggucuuaaggcuagc

SEQ ID NO: 83278 - RNA, 23 nt, Human
ugccaggaagaaugaccucugcu

SEQ ID NO: 83279 - RNA, 22 nt, Human
ugccagcuccgaggagcugcag

SEQ ID NO: 83280 - RNA, 22 nt, Human
uccucagcaagacgcuggcagc

SEQ ID NO: 83281 - RNA, 22 nt, Human
ugcauguuucuguauguuaaug

SEQ ID NO: 83282 - RNA, 22 nt, Human
ugcucuuuguagcugcuuugcu

SEQ ID NO: 83283 - RNA, 22 nt, Human
ugcuauuuuguuuucaguccau

SEQ ID NO: 83284 - RNA, 22 nt, Human
ugcuaaguacauuccaggacuu

SEQ ID NO: 83285 - RNA, 22 nt, Human
ugcuaaugaauggaggaucuga

SEQ ID NO: 83286 - RNA, 22 nt, Human
ugcuaguuuuugauacuuuugc

SEQ ID NO: 83287 - RNA, 20 nt, Human
ugcuaucugcucucccuucu

SEQ ID NO: 83288 - RNA, 22 nt, Human
ugcuauucuuggagcugaugga

SEQ ID NO: 83289 - RNA, 22 nt, Human
ucgaugcuggcgcagguuucac

SEQ ID NO: 83290 - RNA, 22 nt, Human
uggaggagaacugauuuggcuu

SEQ ID NO: 83291 - RNA, 22 nt, Human
uggaggauaacacaagaaguga

SEQ ID NO: 83292 - RNA, 22 nt, Human
uggagccuugugagaccacaau

SEQ ID NO: 83293 - RNA, 21 nt, Human
uggagcagggaggauuugggg

SEQ ID NO: 83294 - RNA, 17 nt, Human
ucugcagaggcaaaccu

SEQ ID NO: 83295 - RNA, 19 nt, Human
ucuuucauuucuagcucug

SEQ ID NO: 83296 - RNA, 22 nt, Human
ucuuguuaaagguuaaagguga

SEQ ID NO: 83297 - RNA, 20 nt, Human
ucuugucuggcagccuggag

SEQ ID NO: 83298 - RNA, 22 nt, Human
ucuugugagcugagauaaagcc

SEQ ID NO: 83299 - RNA, 22 nt, Human
ucuuggcaguucuugugcuuuu

SEQ ID NO: 83300 - RNA, 22 nt, Human
ucuucuuugugguugcccaagg

SEQ ID NO: 83301 - RNA, 22 nt, Human
ucuucuuuccuuuugugcauuu

SEQ ID NO: 83302 - RNA, 22 nt, Human
ucuuaaucauucuucacuuccu

SEQ ID NO: 83303 - RNA, 22 nt, Human
ucuuagacagagaagacuauug

SEQ ID NO: 83304 - RNA, 22 nt, Human
ucuuauucuuuuaaacaacgca

SEQ ID NO: 83305 - RNA, 18 nt, Human
uggcaaugccaaaggcuu

SEQ ID NO: 83306 - RNA, 22 nt, Human
uggaugcuccaaguagaccuua

SEQ ID NO: 83307 - RNA, 21 nt, Human
uggaggcguaaucacuguuga

SEQ ID NO: 83308 - RNA, 22 nt, Human
ucuguucucuuguucugacggu

SEQ ID NO: 83309 - RNA, 22 nt, Human
ugaauuuuaacauucugcugga

SEQ ID NO: 83310 - RNA, 22 nt, Human
ugaauuucuuuuuaaaauauua

SEQ ID NO: 83311 - RNA, 22 nt, Human
ugaauuuuggcaauuuucugug

SEQ ID NO: 83312 - RNA, 22 nt, Human
uggggcuauggcccgaccacgu

SEQ ID NO: 83313 - RNA, 22 nt, Human
ugaaucaaugaauugcacuuca

SEQ ID NO: 83314 - RNA, 22 nt, Human
uggggaagaacuugccauuuca

SEQ ID NO: 83315 - RNA, 22 nt, Human
uggggacucacugacuaucuug

SEQ ID NO: 83316 - RNA, 23 nt, Human
ugaagugaaauuucacaagggac

SEQ ID NO: 83317 - RNA, 22 nt, Human
ugaagcuaguauuaacucagau

SEQ ID NO: 83318 - RNA, 22 nt, Human
ugaagacaguuuuacucaugag

SEQ ID NO: 83319 - RNA, 22 nt, Human
ugaagacuucuuuuggucacca

SEQ ID NO: 83320 - RNA, 22 nt, Human
ugggaaacucuaaacuugagua

SEQ ID NO: 83321 - RNA, 22 nt, Human
ugggaaaauugugauucuuucu

SEQ ID NO: 83322 - RNA, 22 nt, Human
ugggaaaauagcuauuuugaaa

SEQ ID NO: 83323 - RNA, 22 nt, Human
ucuuuuaucuguuguguaacaa

SEQ ID NO: 83324 - RNA, 22 nt, Human
ugauucuuugaccaaaaaauug

SEQ ID NO: 83325 - RNA, 22 nt, Human
ugucaaguuguuaaguucuggg

SEQ ID NO: 83326 - RNA, 22 nt, Human
ugcaaaaguuuuauacacagau

SEQ ID NO: 83327 - RNA, 22 nt, Human
ugcaagagcccaaacuauauac

SEQ ID NO: 83328 - RNA, 23 nt, Human
ugcaaaauuugcagaguucgaug

SEQ ID NO: 83329 - RNA, 22 nt, Human
uguaggcacauguauauauccc

SEQ ID NO: 83330 - RNA, 22 nt, Human
uguagaccaaaccuucuaaacu

SEQ ID NO: 83331 - RNA, 22 nt, Human
ugaugaugauacauuucuucag

SEQ ID NO: 83332 - RNA, 22 nt, Human
uguaagaagaaaaccguaugga

SEQ ID NO: 83333 - RNA, 22 nt, Human
ugaguuuaggccaggauauggu

SEQ ID NO: 83334 - RNA, 22 nt, Human
ugagggucgcaagcaccaggcc

SEQ ID NO: 83335 - RNA, 22 nt, Human
ugggggcacccagccgaugagg

SEQ ID NO: 83336 - RNA, 19 nt, Human
uguugcagcuugaucggua

SEQ ID NO: 83337 - RNA, 21 nt, Human
uguugcuugucugagacuaug

SEQ ID NO: 83338 - RNA, 22 nt, Human
uguuggaauaagugcuugaagg

SEQ ID NO: 83339 - RNA, 22 nt, Human
uguugaagcaccucugucuuuc

SEQ ID NO: 83340 - RNA, 23 nt, Human
ugcuaaaggcagaauauucaccu

SEQ ID NO: 83341 - RNA, 22 nt, Human
ugccuuuggcuguucugugacc

SEQ ID NO: 83342 - RNA, 22 nt, Human
ugccucucucugucauuaugcu

SEQ ID NO: 83343 - RNA, 22 nt, Human
ugugguagagcuuaaaugaggu

SEQ ID NO: 83344 - RNA, 22 nt, Human
uguggucuccucucugucuucc

SEQ ID NO: 83345 - RNA, 22 nt, Human
ugcaggucuggacccccacuuu

SEQ ID NO: 83346 - RNA, 22 nt, Human
uucuagcucauggugacagauc

SEQ ID NO: 83347 - RNA, 22 nt, Human
uucuagaagggccuaggcauaa

SEQ ID NO: 83348 - RNA, 22 nt, Human
uucucuggggacugucucuauu

SEQ ID NO: 83349 - RNA, 22 nt, Human
uucucuugccuucucuuuuauc

SEQ ID NO: 83350 - RNA, 22 nt, Human
uucucugaagagccagcccuua

SEQ ID NO: 83351 - RNA, 22 nt, Human
uucucucaguuaaacuuuguga

SEQ ID NO: 83352 - RNA, 22 nt, Human
uucuaagaaauggaaaacgauu

SEQ ID NO: 83353 - RNA, 18 nt, Human
uucuaaauucuguuuuua

SEQ ID NO: 83354 - RNA, 22 nt, Human
uucuacauugugaaguucuuua

SEQ ID NO: 83355 - RNA, 22 nt, Human
uggggagucccaacgguggaag

SEQ ID NO: 83356 - RNA, 22 nt, Human
ugggauucugaaaauggauuac

SEQ ID NO: 83357 - RNA, 20 nt, Human
uuccucaaaagucugaugcu

SEQ ID NO: 83358 - RNA, 22 nt, Human
ugggagagauaggcuucuggac

SEQ ID NO: 83359 - RNA, 22 nt, Human
uucauugauuuccuuggaauaa

SEQ ID NO: 83360 - RNA, 22 nt, Human
uucaggacacauuauuuaugaa

SEQ ID NO: 83361 - RNA, 22 nt, Human
uggcagugagauuucucuucug

SEQ ID NO: 83362 - RNA, 22 nt, Human
uggcaucuggugauauggacua

SEQ ID NO: 83363 - RNA, 22 nt, Human
uggauuguuuacaucaugucug

SEQ ID NO: 83364 - RNA, 22 nt, Human
uuauuuuuguaacacuguauag

SEQ ID NO: 83365 - RNA, 22 nt, Human
uuauuuuuguuuguuaagccua

SEQ ID NO: 83366 - RNA, 22 nt, Human
uggauaugaaacaaaacaagag

SEQ ID NO: 83367 - RNA, 22 nt, Human
uucaauuacaucagaaucuaaa

SEQ ID NO: 83368 - RNA, 22 nt, Human
uuauuucaggcauuuguaaaug

SEQ ID NO: 83369 - RNA, 22 nt, Human
uuauuucuucucgaagcuuggg

SEQ ID NO: 83370 - RNA, 22 nt, Human
uggaggaggaugcauuuguugu

SEQ ID NO: 83371 - RNA, 22 nt, Human
uuauucuuagccucgguauuuc

SEQ ID NO: 83372 - RNA, 22 nt, Human
uucuguucugcuuucuccaucc

SEQ ID NO: 83373 - RNA, 22 nt, Human
uucuugucuuuguuauguagga

SEQ ID NO: 83374 - RNA, 22 nt, Human
uucuuacuaaguagaguacuca

SEQ ID NO: 83375 - RNA, 22 nt, Human
uucuucauucccuuacuuccga

SEQ ID NO: 83376 - RNA, 22 nt, Human
uugaaagaacaauucugugaug

SEQ ID NO: 83377 - RNA, 21 nt, Human
uucuuugaagacccauuugag

SEQ ID NO: 83378 - RNA, 22 nt, Human
uucuuugcccauguuuccuaag

SEQ ID NO: 83379 - RNA, 23 nt, Human
uucuuuccuuaucccauuuacuu

SEQ ID NO: 83380 - RNA, 22 nt, Human
uugaaaaaaucugaggaggacc

SEQ ID NO: 83381 - RNA, 22 nt, Human
uucuuuuuagcugguuguaaga

SEQ ID NO: 83382 - RNA, 22 nt, Human
uugcaagauaguguauuuuuca

SEQ ID NO: 83383 - RNA, 22 nt, Human
ugugaagaauuaaugugaauca

SEQ ID NO: 83384 - RNA, 22 nt, Human
ugucuuuuaaaaauguguaaaa

SEQ ID NO: 83385 - RNA, 22 nt, Human
ugugagccuuuauuaaccucau

SEQ ID NO: 83386 - RNA, 22 nt, Human
ugucuucuuuucccuuagcccu

SEQ ID NO: 83387 - RNA, 22 nt, Human
ugugauugcauugcagauuacu

SEQ ID NO: 83388 - RNA, 22 nt, Human
uugauggaggaaaaguuggaau

SEQ ID NO: 83389 - RNA, 23 nt, Human
ugucacuuguggucacuaggcug

SEQ ID NO: 83390 - RNA, 21 nt, Human
ugucagaaagccugugacuuu

SEQ ID NO: 83391 - RNA, 22 nt, Human
uuggugaugaaagugcugcgcu

SEQ ID NO: 83392 - RNA, 22 nt, Human
uguuggaaucuucuagucuucc

SEQ ID NO: 83393 - RNA, 22 nt, Human
uguugaaacagcuauugacuuu

SEQ ID NO: 83394 - RNA, 22 nt, Human
uguucuucaaacucaguuccac

SEQ ID NO: 83395 - RNA, 22 nt, Human
uugggaguaauacugaagagag

SEQ ID NO: 83396 - RNA, 22 nt, Human
uugggagaggcagcagagucau

SEQ ID NO: 83397 - RNA, 22 nt, Human
uugggaaauuugaaaauaaaag

SEQ ID NO: 83398 - RNA, 22 nt, Human
uuggaggucucugugguggugg

SEQ ID NO: 83399 - RNA, 23 nt, Human
uugcuuuugccccaaaagaguua

SEQ ID NO: 83400 - RNA, 22 nt, Human
uugcuuugcuucuuuaugguca

SEQ ID NO: 83401 - RNA, 22 nt, Human
uugcuuuuuuggguuuacuggg

SEQ ID NO: 83402 - RNA, 22 nt, Human
uuggaaaugcauuuguuauuau

SEQ ID NO: 83403 - RNA, 22 nt, Human
ugugggaucauggaucagggcc

SEQ ID NO: 83404 - RNA, 22 nt, Human
uuucuauuuacagugcuaggua

SEQ ID NO: 83405 - RNA, 22 nt, Human
uuucuauauucaguuucauaaa

SEQ ID NO: 83406 - RNA, 22 nt, Human
uuaugugcuacacauaauuugu

SEQ ID NO: 83407 - RNA, 18 nt, Human
uuuccucauuugcagacu

SEQ ID NO: 83408 - RNA, 22 nt, Human
uuaugugcuuuuugagcucuaa

SEQ ID NO: 83409 - RNA, 22 nt, Human
uuauuccauagaagucaaggaa

SEQ ID NO: 83410 - RNA, 22 nt, Human
uuauauuuuauuuaauuaaaua

SEQ ID NO: 83411 - RNA, 22 nt, Human
uuauaggugauuaauuuuaacc

SEQ ID NO: 83412 - RNA, 22 nt, Human
uuaucugugcuuuacugacaga

SEQ ID NO: 83413 - RNA, 22 nt, Human
uuuagguccguguugcaguugg

SEQ ID NO: 83414 - RNA, 22 nt, Human
uuuagcugugugugucgcucca

SEQ ID NO: 83415 - RNA, 22 nt, Human
uuguaggguauagcaggagaac

SEQ ID NO: 83416 - RNA, 22 nt, Human
uuacuguaggugggugaauuug

SEQ ID NO: 83417 - RNA, 22 nt, Human
uuagacagagcuccuugagggc

SEQ ID NO: 83418 - RNA, 19 nt, Human
uuuacuuaggccacagaau

SEQ ID NO: 83419 - RNA, 22 nt, Human
uuaccuaagaaacucauuucgu

SEQ ID NO: 83420 - RNA, 22 nt, Human
uuaccauaguacuaucaguuua

SEQ ID NO: 83421 - RNA, 22 nt, Human
uuagcacugucugguuaucuug

SEQ ID NO: 83422 - RNA, 22 nt, Human
uuagagauuuuauguuaaugua

SEQ ID NO: 83423 - RNA, 22 nt, Human
uuaggacucuauuuggguaucu

SEQ ID NO: 83424 - RNA, 22 nt, Human
uuuauugaccugaguaucagca

SEQ ID NO: 83425 - RNA, 22 nt, Human
uuucuggaaacuguaaagagga

SEQ ID NO: 83426 - RNA, 22 nt, Human
uuucuuaguuaaguagguaggc

SEQ ID NO: 83427 - RNA, 22 nt, Human
uuucuuugggcccuggcagucu

SEQ ID NO: 83428 - RNA, 22 nt, Human
uuucugcauuuguauuggaaaa

SEQ ID NO: 83429 - RNA, 22 nt, Human
uuucugaugaaguagaaagacc

SEQ ID NO: 83430 - RNA, 22 nt, Human
uuucucuccucgaaauucuuau

SEQ ID NO: 83431 - RNA, 22 nt, Human
uuugaagaaacagucuuaagag

SEQ ID NO: 83432 - RNA, 22 nt, Human
uuugaagauaaauauggagaaa

SEQ ID NO: 83433 - RNA, 22 nt, Human
uuauuuuuaggaauguagaggu

SEQ ID NO: 83434 - RNA, 18 nt, Human
uuucuuuuauuccagguc

SEQ ID NO: 83435 - RNA, 22 nt, Human
uucaacaacuugguucaaaugg

SEQ ID NO: 83436 - RNA, 22 nt, Human
uuugaugagaaaugacuuaagu

SEQ ID NO: 83437 - RNA, 22 nt, Human
uuugagugccucgaguguggga

SEQ ID NO: 83438 - RNA, 22 nt, Human
uuugagaaugucaaucacaaga

SEQ ID NO: 83439 - RNA, 22 nt, Human
uuugcaaaguccauugaaguua

SEQ ID NO: 83440 - RNA, 18 nt, Human
uuugggauccucuuuucu

SEQ ID NO: 83441 - RNA, 19 nt, Human
uuugguaggcuugagggaa

SEQ ID NO: 83442 - RNA, 22 nt, Human
uucccuauaauauggcucuucu

SEQ ID NO: 83443 - RNA, 17 nt, Human
uuugugauggcagaugc

SEQ ID NO: 83444 - RNA, 22 nt, Human
uuuguaguuguggaugcugaag

SEQ ID NO: 83445 - RNA, 22 nt, Human
uuuguaaguuuguucuccuggg

SEQ ID NO: 83446 - RNA, 22 nt, Human
uucauuuccauuuuauagauaa

SEQ ID NO: 83447 - RNA, 22 nt, Human
uugcguaauuugagauuguaaa

SEQ ID NO: 83448 - RNA, 20 nt, Human
uugcucucuuguguugaugu

SEQ ID NO: 83449 - RNA, 20 nt, Human
uugcaaagugaauagcaauu

SEQ ID NO: 83450 - RNA, 22 nt, Human
uugcuuuuugggguuuacuggg

SEQ ID NO: 83451 - RNA, 22 nt, Human
uuggaaaagaaauacucauaua

SEQ ID NO: 83452 - RNA, 22 nt, Human
uuggagagggugggcuuugaag

SEQ ID NO: 83453 - RNA, 22 nt, Human
uuggagaaagcugcaggcucug

SEQ ID NO: 83454 - RNA, 22 nt, Human
uugcuuucuuuguagguuuucc

SEQ ID NO: 83455 - RNA, 22 nt, Human
uugcucuuaccauuauguguga

SEQ ID NO: 83456 - RNA, 21 nt, Human
uugcuggagcaauguaaauca

SEQ ID NO: 83457 - RNA, 22 nt, Human
uuggcaaaaauacuguaggccu

SEQ ID NO: 83458 - RNA, 22 nt, Human
uuggcagagaacagaaugauuu

SEQ ID NO: 83459 - RNA, 22 nt, Human
uugucucuacagagaguaguag

SEQ ID NO: 83460 - RNA, 22 nt, Human
uuuaagguacagcuagcagcau

SEQ ID NO: 83461 - RNA, 20 nt, Human
uuuaacuggccuucuggcuc

SEQ ID NO: 83462 - RNA, 22 nt, Human
uuuaacauaugaaagaauauuu

SEQ ID NO: 83463 - RNA, 22 nt, Human
uuuaaauuucugaaucuugagg

SEQ ID NO: 83464 - RNA, 22 nt, Human
uuguuuuaguagaaguuacaug

SEQ ID NO: 83465 - RNA, 22 nt, Human
uuguuuucuaguguuuugaaua

SEQ ID NO: 83466 - RNA, 22 nt, Human
uuguuuucuugaugaaauuauu

SEQ ID NO: 83467 - RNA, 22 nt, Human
uucuuagauuuuauuucuucug

SEQ ID NO: 83468 - RNA, 22 nt, Human
uucuuauuuuucguaaauccug

SEQ ID NO: 83469 - RNA, 22 nt, Human
uuuuguagauuggaaaaucugg

SEQ ID NO: 83470 - RNA, 22 nt, Human
uucuguguauggaagaaugucc

SEQ ID NO: 83471 - RNA, 22 nt, Human
uugaaaaaugcccagcagacaa

SEQ ID NO: 83472 - RNA, 22 nt, Human
uuuuucuccucucucuuucauu

SEQ ID NO: 83473 - RNA, 22 nt, Human
uuuuucacacuccuuuccaguu

SEQ ID NO: 83474 - RNA, 22 nt, Human
uugaagaagucaaaagcugcag

SEQ ID NO: 83475 - RNA, 22 nt, Human
uugaacucagcuacugguuggu

SEQ ID NO: 83476 - RNA, 20 nt, Human
uugaggagauauugaauacu

SEQ ID NO: 83477 - RNA, 22 nt, Human
uucuggugauuugccucuuuag

SEQ ID NO: 83478 - RNA, 22 nt, Human
uuuuggauugcuaacucagggu

SEQ ID NO: 83479 - RNA, 22 nt, Human
uuuuggagaaaugggacuuaau

SEQ ID NO: 83480 - RNA, 22 nt, Human
uucucuuguaaaauuccuuuuu

SEQ ID NO: 83481 - RNA, 22 nt, Human
uucugaugccuggguugcuucu

SEQ ID NO: 83482 - RNA, 22 nt, Human
uuccuaauugccaugaaguuau

SEQ ID NO: 83483 - RNA, 22 nt, Human
uucuaguuacagaagccuugcu

SEQ ID NO: 83484 - RNA, 22 nt, Human
uucuagauagucugauauuccu

SEQ ID NO: 83485 - RNA, 22 nt, Human
uucucaauggcaacuuguugcu

SEQ ID NO: 83486 - RNA, 22 nt, Human
uucuccucaaaccaucagacau

SEQ ID NO: 83487 - RNA, 22 nt, Human
uucucucacucuuagaucccgc

SEQ ID NO: 83488 - RNA, 22 nt, Human
aaaucaagucagcugaauucca

SEQ ID NO: 83489 - RNA, 22 nt, Human
aaauggaaguuuguucucagcc

SEQ ID NO: 83490 - RNA, 22 nt, Human
aaaucuuccugaaauuuguuca

SEQ ID NO: 83491 - RNA, 22 nt, Human
aaauugcauuuuaaagguagau

SEQ ID NO: 83492 - RNA, 22 nt, Human
aaauuuauaacuuaaagugaau

SEQ ID NO: 83493 - RNA, 22 nt, Human
aacaaagaacuuucuuccuuug

SEQ ID NO: 83494 - RNA, 22 nt, Human
aacaaaacauuuuacgaauaua

SEQ ID NO: 83495 - RNA, 19 nt, Human
aacaaaauaguucuaguua

SEQ ID NO: 83496 - RNA, 22 nt, Human
aacauuguggacaagggcaggu

SEQ ID NO: 83497 - RNA, 22 nt, Human
aacaaagaaaagcuugagguuu

SEQ ID NO: 83498 - RNA, 22 nt, Human
aacaggcuaaauuguccauuuc

SEQ ID NO: 83499 - RNA, 22 nt, Human
aaauauugaauuugaggaugua

SEQ ID NO: 83500 - RNA, 22 nt, Human
aaaguguuuaacaaauugcuuu

SEQ ID NO: 83501 - RNA, 22 nt, Human
aaaucugaaggaaacagcuuca

SEQ ID NO: 83502 - RNA, 22 nt, Human
aaauagauuugacuacuuggug

SEQ ID NO: 83503 - RNA, 22 nt, Human
aaaguagaauaauaaacccuug

SEQ ID NO: 83504 - RNA, 22 nt, Human
aaaguugcauccuaugaccuca

SEQ ID NO: 83505 - RNA, 22 nt, Human
aaaguaaagccuauuuaauaau

SEQ ID NO: 83506 - RNA, 22 nt, Human
aaagcugaaacgaaaugacaac

SEQ ID NO: 83507 - RNA, 22 nt, Human
aaagccauaucuauucuauucu

SEQ ID NO: 83508 - RNA, 22 nt, Human
aaaggaaacuaugaaucucugg

SEQ ID NO: 83509 - RNA, 22 nt, Human
aaagaguuguauucuuuuugag

SEQ ID NO: 83510 - RNA, 22 nt, Human
aaacccuagcguuguuuauuga

SEQ ID NO: 83511 - RNA, 22 nt, Human
aaacuuuaucaaguacucuuca

SEQ ID NO: 83512 - RNA, 22 nt, Human
aaagaguuaagagucuuaagcu

SEQ ID NO: 83513 - RNA, 22 nt, Human
aaagcauucuaaccgaucgacg

SEQ ID NO: 83514 - RNA, 22 nt, Human
aaagagugugcauguaccugug

SEQ ID NO: 83515 - RNA, 22 nt, Human
aaagcaaauaguugcuuaauau

SEQ ID NO: 83516 - RNA, 22 nt, Human
aaagagacaacaacaacuucua

SEQ ID NO: 83517 - RNA, 22 nt, Human
aaaaggucacuguaaaaugacg

SEQ ID NO: 83518 - RNA, 22 nt, Human
aaaauauucuauaucaaagaua

SEQ ID NO: 83519 - RNA, 22 nt, Human
aaaaucucagaaaaguuuaggu

SEQ ID NO: 83520 - RNA, 17 nt, Human
aaaaucaaaggaggugc

SEQ ID NO: 83521 - RNA, 22 nt, Human
aaaauuuccuuggaccauuuuu

SEQ ID NO: 83522 - RNA, 22 nt, Human
aaacaaauccaauaauaaaauu

SEQ ID NO: 83523 - RNA, 22 nt, Human
aaaagcucucuucuucggcuuu

SEQ ID NO: 83524 - RNA, 22 nt, Human
aaaagggucugacacugcuuga

SEQ ID NO: 83525 - RNA, 22 nt, Human
aagauuugaaaguggugcauuu

SEQ ID NO: 83526 - RNA, 22 nt, Human
aagauagaaugauguuggcuca

SEQ ID NO: 83527 - RNA, 22 nt, Human
aagaugcaagcauuuugaacug

SEQ ID NO: 83528 - RNA, 22 nt, Human
aagcaacccagugcuuguauag

SEQ ID NO: 83529 - RNA, 22 nt, Human
aagaugaucagagggcaagagg

SEQ ID NO: 83530 - RNA, 22 nt, Human
aagaaugaaaugaaagaacuaa

SEQ ID NO: 83531 - RNA, 22 nt, Human
aagaagguugaaugacuacuuu

SEQ ID NO: 83532 - RNA, 22 nt, Human
aagagaaaaaucuuaaucuagu

SEQ ID NO: 83533 - RNA, 22 nt, Human
aagagaaacauauggccagauu

SEQ ID NO: 83534 - RNA, 22 nt, Human
aagaagagaauauauuuacguc

SEQ ID NO: 83535 - RNA, 22 nt, Human
aagacagaaaagcagagagagg

SEQ ID NO: 83536 - RNA, 22 nt, Human
aagaacaacugcuuuaaaagca

SEQ ID NO: 83537 - RNA, 22 nt, Human
aagaaaagguaaccgcuuaucu

SEQ ID NO: 83538 - RNA, 22 nt, Human
aagaaaagcaucuuuguaguag

SEQ ID NO: 83539 - RNA, 22 nt, Human
aagaaagaucugaaagaagcga

SEQ ID NO: 83540 - RNA, 22 nt, Human
aagcucuuuccacuaaaccacu

SEQ ID NO: 83541 - RNA, 22 nt, Human
aagcugcagacccccugucuca

SEQ ID NO: 83542 - RNA, 22 nt, Human
aagcuuugaauauuagaccuug

SEQ ID NO: 83543 - RNA, 22 nt, Human
aagcuuugggcagaagaggauu

SEQ ID NO: 83544 - RNA, 22 nt, Human
aaggaaaguuaagguaaacucu

SEQ ID NO: 83545 - RNA, 22 nt, Human
aagccucaugccagauccaggu

SEQ ID NO: 83546 - RNA, 22 nt, Human
aagcauuuuagauaaagcauca

SEQ ID NO: 83547 - RNA, 22 nt, Human
aagcaaaaucgcaucuggggcc

SEQ ID NO: 83548 - RNA, 22 nt, Human
aagcaauucacaguucacuuaa

SEQ ID NO: 83549 - RNA, 22 nt, Human
aauauuuugggacugaggaauu

SEQ ID NO: 83550 - RNA, 22 nt, Human
aaucaaagccugcaaguugacu

SEQ ID NO: 83551 - RNA, 22 nt, Human
aauagcaauuacccuucaacuc

SEQ ID NO: 83552 - RNA, 22 nt, Human
aauaucuugaguuauaaauuca

SEQ ID NO: 83553 - RNA, 20 nt, Human
aaguugaaguuacuucaugg

SEQ ID NO: 83554 - RNA, 22 nt, Human
aaguucuuauguucugaugugc

SEQ ID NO: 83555 - RNA, 23 nt, Human
aagugcucaguggacagcauugc

SEQ ID NO: 83556 - RNA, 22 nt, Human
aauaacuuacucuaugcuuagu

SEQ ID NO: 83557 - RNA, 21 nt, Human
aaguuuuggcuguacaguugu

SEQ ID NO: 83558 - RNA, 16 nt, Human
aaguuuuaucuucuca

SEQ ID NO: 83559 - RNA, 22 nt, Human
aauaaagcuugaaagcagggaa

SEQ ID NO: 83560 - RNA, 22 nt, Human
aagucuuugagaucggacauag

SEQ ID NO: 83561 - RNA, 22 nt, Human
aagugaaaaaagucaguacuga

SEQ ID NO: 83562 - RNA, 22 nt, Human
aagugaagccaauuuuuuuagg

SEQ ID NO: 83563 - RNA, 20 nt, Human
aagucuauuuagaguugcuu

SEQ ID NO: 83564 - RNA, 22 nt, Human
aagugauuuagagagcucuuag

SEQ ID NO: 83565 - RNA, 22 nt, Human
aaguagaaaaccgcacuggacu

SEQ ID NO: 83566 - RNA, 22 nt, Human
aaggugcugaggguccuggcuu

SEQ ID NO: 83567 - RNA, 22 nt, Human
aaggaaaaccugacugaagaac

SEQ ID NO: 83568 - RNA, 22 nt, Human
aaggaaaaaauggcuugugaua

SEQ ID NO: 83569 - RNA, 22 nt, Human
acauaaacaugcagccugccaa

SEQ ID NO: 83570 - RNA, 22 nt, Human
acaggggauaggcaggaaggca

SEQ ID NO: 83571 - RNA, 22 nt, Human
acagguaucccuuucuaccuga

SEQ ID NO: 83572 - RNA, 22 nt, Human
acaggccuggguucaaauuugg

SEQ ID NO: 83573 - RNA, 22 nt, Human
acaggaaugaagaugagagagu

SEQ ID NO: 83574 - RNA, 22 nt, Human
acaggaaaugaaaugguaucua

SEQ ID NO: 83575 - RNA, 20 nt, Human
acagagauccucucuuuauc

SEQ ID NO: 83576 - RNA, 22 nt, Human
acagaucuauauuauauauaca

SEQ ID NO: 83577 - RNA, 22 nt, Human
acagacuuaguauccugcugcu

SEQ ID NO: 83578 - RNA, 22 nt, Human
acagaauugggguucuugggga

SEQ ID NO: 83579 - RNA, 22 nt, Human
acacuuuugcgagagcaugcag

SEQ ID NO: 83580 - RNA, 22 nt, Human
acagacaucaucaacaucuucc

SEQ ID NO: 83581 - RNA, 22 nt, Human
acacagugaccuacauuccaaa

SEQ ID NO: 83582 - RNA, 22 nt, Human
acaaucagcacugaguuuaucu

SEQ ID NO: 83583 - RNA, 17 nt, Human
acaaugggcaacaauau

SEQ ID NO: 83584 - RNA, 22 nt, Human
acaaguuucauuguuuagaacc

SEQ ID NO: 83585 - RNA, 22 nt, Human
acaacuuuaauggguuucagcu

SEQ ID NO: 83586 - RNA, 22 nt, Human
acaaccaugucaguucaaacca

SEQ ID NO: 83587 - RNA, 22 nt, Human
acaaaucccuguaaacacagcu

SEQ ID NO: 83588 - RNA, 22 nt, Human
acaaaaauauuguagaagugcu

SEQ ID NO: 83589 - RNA, 22 nt, Human
aauuucuccuuuucaguuagau

SEQ ID NO: 83590 - RNA, 22 nt, Human
aauuucuuuagagguacugauc

SEQ ID NO: 83591 - RNA, 22 nt, Human
aauuucuuucagcugcuuuaag

SEQ ID NO: 83592 - RNA, 22 nt, Human
aauuuuagcuaaagauccaugg

SEQ ID NO: 83593 - RNA, 22 nt, Human
aauguggaguugguuuccuucc

SEQ ID NO: 83594 - RNA, 22 nt, Human
aauguuuuucaaguguggagca

SEQ ID NO: 83595 - RNA, 22 nt, Human
aaugcugugggauagggcuccu

SEQ ID NO: 83596 - RNA, 22 nt, Human
aaucaugagguguuucuuugca

SEQ ID NO: 83597 - RNA, 22 nt, Human
aauccaaacaggauuaccuauc

SEQ ID NO: 83598 - RNA, 22 nt, Human
aaugcugugauuuauuaaguau

SEQ ID NO: 83599 - RNA, 22 nt, Human
acuucuuuugcaugauucuuua

SEQ ID NO: 83600 - RNA, 22 nt, Human
acuugaagcaugaaaauaagcc

SEQ ID NO: 83601 - RNA, 22 nt, Human
acuuagaacagccuaugggaag

SEQ ID NO: 83602 - RNA, 22 nt, Human
acuuguaaaauagagauaggga

SEQ ID NO: 83603 - RNA, 22 nt, Human
acuugaugcauauggaagagca

SEQ ID NO: 83604 - RNA, 22 nt, Human
acuuguuuacaagcaguucuga

SEQ ID NO: 83605 - RNA, 22 nt, Human
acuucccacugcagugacugag

SEQ ID NO: 83606 - RNA, 23 nt, Human
acuuugaggagaagaaugucagu

SEQ ID NO: 83607 - RNA, 22 nt, Human
acuuugccuucuuacuguguug

SEQ ID NO: 83608 - RNA, 19 nt, Human
agaaacaacauucuggaga

SEQ ID NO: 83609 - RNA, 22 nt, Human
agaaaagaggcuuucuaagcau

SEQ ID NO: 83610 - RNA, 22 nt, Human
agaaacaagcccuagaaguccu

SEQ ID NO: 83611 - RNA, 22 nt, Human
agacaagagcugaggacauauu

SEQ ID NO: 83612 - RNA, 22 nt, Human
agaauacaauuguucaguaaua

SEQ ID NO: 83613 - RNA, 22 nt, Human
agaauccugagggaaauuuggc

SEQ ID NO: 83614 - RNA, 22 nt, Human
agaaucugcauuuuaacaagau

SEQ ID NO: 83615 - RNA, 22 nt, Human
agaagcagaaggaagcagggcc

SEQ ID NO: 83616 - RNA, 22 nt, Human
agaauacuaauaagggauuugc

SEQ ID NO: 83617 - RNA, 22 nt, Human
agaagguggaguagaacaagcu

SEQ ID NO: 83618 - RNA, 22 nt, Human
agaagaaugguuugaaagauuu

SEQ ID NO: 83619 - RNA, 22 nt, Human
agaagaagacccuaaggaaagg

SEQ ID NO: 83620 - RNA, 22 nt, Human
agaagaucccugugguuacgac

SEQ ID NO: 83621 - RNA, 22 nt, Human
agaaaauagguaguagacgggc

SEQ ID NO: 83622 - RNA, 22 nt, Human
acugaugacaaugugaguguuc

SEQ ID NO: 83623 - RNA, 18 nt, Human
acucugaagcuaagucac

SEQ ID NO: 83624 - RNA, 22 nt, Human
acucucugcugcugagcuuggg

SEQ ID NO: 83625 - RNA, 22 nt, Human
acucugaaaggcuacaaaugcu

SEQ ID NO: 83626 - RNA, 22 nt, Human
acucugagaugugucuugauuc

SEQ ID NO: 83627 - RNA, 23 nt, Human
acucucuguuuggaggcacuggu

SEQ ID NO: 83628 - RNA, 22 nt, Human
acuauuguccgauuucuuuacu

SEQ ID NO: 83629 - RNA, 22 nt, Human
acucaaccaucugcauuuuuga

SEQ ID NO: 83630 - RNA, 22 nt, Human
acaucuaugucugaggccuugg

SEQ ID NO: 83631 - RNA, 22 nt, Human
acagucucucaagcauauccug

SEQ ID NO: 83632 - RNA, 20 nt, Human
acgcauguauaugcaucacc

SEQ ID NO: 83633 - RNA, 22 nt, Human
agauaagaacauuaguaagccg

SEQ ID NO: 83634 - RNA, 22 nt, Human
agaguucuauccagacucaugu

SEQ ID NO: 83635 - RNA, 21 nt, Human
agaguuuucuccauuucaggc

SEQ ID NO: 83636 - RNA, 22 nt, Human
agaugacuaacauaguauugcu

SEQ ID NO: 83637 - RNA, 22 nt, Human
agauagaaggauugugacacau

SEQ ID NO: 83638 - RNA, 22 nt, Human
agauauucugccuaacagguuu

SEQ ID NO: 83639 - RNA, 22 nt, Human
agagcuauuucuuaaaagcugu

SEQ ID NO: 83640 - RNA, 22 nt, Human
agauaucuuguuggcauaaaug

SEQ ID NO: 83641 - RNA, 22 nt, Human
agaggcaugaacucccguagcc

SEQ ID NO: 83642 - RNA, 22 nt, Human
agaggcuuuccuaagauugguu

SEQ ID NO: 83643 - RNA, 22 nt, Human
agagcauagggcauuaggaagg

SEQ ID NO: 83644 - RNA, 22 nt, Human
agacacauuuucagcucugcca

SEQ ID NO: 83645 - RNA, 22 nt, Human
agagcagauggagcuggaagag

SEQ ID NO: 83646 - RNA, 19 nt, Human
agagauuuucuguuuuagu

SEQ ID NO: 83647 - RNA, 22 nt, Human
agauugaugugaccauuggaag

SEQ ID NO: 83648 - RNA, 22 nt, Human
agauuuuacggaguauuagggu

SEQ ID NO: 83649 - RNA, 19 nt, Human
agauggcaaaaugcaaaga

SEQ ID NO: 83650 - RNA, 17 nt, Human
agaucugaaggagaaca

SEQ ID NO: 83651 - RNA, 19 nt, Human
agaucaggauguauuuuug

SEQ ID NO: 83652 - RNA, 22 nt, Human
agauccuagaugugaauagcua

SEQ ID NO: 83653 - RNA, 22 nt, Human
agaugacuuuguccugagcuga

SEQ ID NO: 83654 - RNA, 22 nt, Human
agcaaggguugguuuucugaca

SEQ ID NO: 83655 - RNA, 22 nt, Human
agcaacauggaguuugugcgca

SEQ ID NO: 83656 - RNA, 22 nt, Human
agcagauuguacagugcauuag

SEQ ID NO: 83657 - RNA, 22 nt, Human
agcaaaacuaaagacacagaca

SEQ ID NO: 83658 - RNA, 22 nt, Human
agcagcaaugacaauucaacca

SEQ ID NO: 83659 - RNA, 22 nt, Human
agcacuuuagaauuuagaguug

SEQ ID NO: 83660 - RNA, 22 nt, Human
agcauuagguguguuucagagg

SEQ ID NO: 83661 - RNA, 22 nt, Human
aggcauuuucuuguuauuuuua

SEQ ID NO: 83662 - RNA, 21 nt, Human
aggcagcgauuuucauauugc

SEQ ID NO: 83663 - RNA, 22 nt, Human
aggcaauuuuuaggguuguugu

SEQ ID NO: 83664 - RNA, 22 nt, Human
aggcaacagacaggcuugguuc

SEQ ID NO: 83665 - RNA, 22 nt, Human
aggauucuccuguuucccaccc

SEQ ID NO: 83666 - RNA, 22 nt, Human
aggauuuagcaugaaaugugaa

SEQ ID NO: 83667 - RNA, 22 nt, Human
aggagcccggucgucaugguaa

SEQ ID NO: 83668 - RNA, 17 nt, Human
aggagcuagaaaggaga

SEQ ID NO: 83669 - RNA, 22 nt, Human
aggaauuuuaauaugcuugucu

SEQ ID NO: 83670 - RNA, 22 nt, Human
aggacaaaggaccagaucugga

SEQ ID NO: 83671 - RNA, 22 nt, Human
aggaagaagggacagaauuuug

SEQ ID NO: 83672 - RNA, 22 nt, Human
aggaauuucacugcguuuuuua

SEQ ID NO: 83673 - RNA, 22 nt, Human
aggaauguugagacauggcuaa

SEQ ID NO: 83674 - RNA, 22 nt, Human
aguaauuucuuacggagaccuu

SEQ ID NO: 83675 - RNA, 22 nt, Human
agguuuaggaaaacugagaguc

SEQ ID NO: 83676 - RNA, 22 nt, Human
aggugcuugcauacugcuugac

SEQ ID NO: 83677 - RNA, 20 nt, Human
agguugguuuacuagucugu

SEQ ID NO: 83678 - RNA, 22 nt, Human
aggugcuuaaagaauguguggu

SEQ ID NO: 83679 - RNA, 21 nt, Human
aggugguuccaauaaguaggu

SEQ ID NO: 83680 - RNA, 19 nt, Human
aggugaugugacucuagaa

SEQ ID NO: 83681 - RNA, 22 nt, Human
agggcucuuucauuguuaagaa

SEQ ID NO: 83682 - RNA, 22 nt, Human
agggcugggcuuggcaggcugg

SEQ ID NO: 83683 - RNA, 22 nt, Human
agggaguuccgaucugugcacc

SEQ ID NO: 83684 - RNA, 22 nt, Human
agugaagauagagccaggucug

SEQ ID NO: 83685 - RNA, 22 nt, Human
agugagcuuuuaaaauuuacca

SEQ ID NO: 83686 - RNA, 22 nt, Human
aguagaauuacagguuuucucu

SEQ ID NO: 83687 - RNA, 22 nt, Human
agugaaaacugaaucaccuucc

SEQ ID NO: 83688 - RNA, 20 nt, Human
agucuucaggugugaggauu

SEQ ID NO: 83689 - RNA, 19 nt, Human
agugggcaaggaagaugac

SEQ ID NO: 83690 - RNA, 22 nt, Human
aguggcuagaucaugagugagc

SEQ ID NO: 83691 - RNA, 22 nt, Human
agugaugauccaaaugaauuga

SEQ ID NO: 83692 - RNA, 23 nt, Human
agugaucuguguuugaagaaugc

SEQ ID NO: 83693 - RNA, 22 nt, Human
agugauguaauggugaauguga

SEQ ID NO: 83694 - RNA, 22 nt, Human
agugaugcuuuggagaagaucc

SEQ ID NO: 83695 - RNA, 22 nt, Human
aguuaggaaauaaguugaguuu

SEQ ID NO: 83696 - RNA, 22 nt, Human
aguuauuuuucacuauuaggcu

SEQ ID NO: 83697 - RNA, 23 nt, Human
aguuaucuaaugaaguucuucca

SEQ ID NO: 83698 - RNA, 22 nt, Human
aguuauggguauguauuauaau

SEQ ID NO: 83699 - RNA, 22 nt, Human
aguguucaauuugagcucaaag

SEQ ID NO: 83700 - RNA, 23 nt, Human
auaaugauaaugcuauuuuuugu

SEQ ID NO: 83701 - RNA, 22 nt, Human
auaaaaucugaagcaagaauaa

SEQ ID NO: 83702 - RNA, 22 nt, Human
auaaucuuugaguagaguugag

SEQ ID NO: 83703 - RNA, 22 nt, Human
aguuuuuaacgccauguuugaa

SEQ ID NO: 83704 - RNA, 22 nt, Human
aguuuuguuuguuuguuuguua

SEQ ID NO: 83705 - RNA, 22 nt, Human
auaaaagcacaauagaguuaug

SEQ ID NO: 83706 - RNA, 22 nt, Human
auaaaaaguggcugcuauugga

SEQ ID NO: 83707 - RNA, 22 nt, Human
auaaauuugccagcauauguuc

SEQ ID NO: 83708 - RNA, 22 nt, Human
auaaauuugacagcucuucaug

SEQ ID NO: 83709 - RNA, 22 nt, Human
auacagacacuguagguuauuu

SEQ ID NO: 83710 - RNA, 22 nt, Human
auacacauguuauuguggaagc

SEQ ID NO: 83711 - RNA, 22 nt, Human
auacaaaaaguggugaguguau

SEQ ID NO: 83712 - RNA, 22 nt, Human
auacaucuuaacgcgcucuugg

SEQ ID NO: 83713 - RNA, 22 nt, Human
aguuuaaauuguucuaucagaa

SEQ ID NO: 83714 - RNA, 22 nt, Human
aguuuggaggagaaagugcggg

SEQ ID NO: 83715 - RNA, 22 nt, Human
aguuuggauccugcuaaaccag

SEQ ID NO: 83716 - RNA, 22 nt, Human
aguuugauuugucuaucuucau

SEQ ID NO: 83717 - RNA, 21 nt, Human
aguuguacuguauagcagaug

SEQ ID NO: 83718 - RNA, 22 nt, Human
aguuuuugagaauucuucugaa

SEQ ID NO: 83719 - RNA, 22 nt, Human
aguuucaguuaguugggugaca

SEQ ID NO: 83720 - RNA, 22 nt, Human
aguuuucugccucuggaugcgu

SEQ ID NO: 83721 - RNA, 22 nt, Human
aguuucuugaagacugauguuu

SEQ ID NO: 83722 - RNA, 22 nt, Human
aguuguuuuucuuagauuuuag

SEQ ID NO: 83723 - RNA, 22 nt, Human
aguugcuaauacaaaaaguccc

SEQ ID NO: 83724 - RNA, 22 nt, Human
aguugcuucccuauucuuagca

SEQ ID NO: 83725 - RNA, 22 nt, Human
aguugugagaaugaacacugaa

SEQ ID NO: 83726 - RNA, 22 nt, Human
aguugguggaagcuaagcuucu

SEQ ID NO: 83727 - RNA, 22 nt, Human
aguugguauuuacugcaguugg

SEQ ID NO: 83728 - RNA, 22 nt, Human
aguucuggcccugaaacaggga

SEQ ID NO: 83729 - RNA, 22 nt, Human
aguuccaaauuugcaagaaaau

SEQ ID NO: 83730 - RNA, 21 nt, Human
auucugauguuucuauuguuu

SEQ ID NO: 83731 - RNA, 22 nt, Human
auucuguaggcuuuuguuaaaa

SEQ ID NO: 83732 - RNA, 21 nt, Human
auucaaagaagaggaaggccc

SEQ ID NO: 83733 - RNA, 22 nt, Human
auucaagauagaaggauuuuca

SEQ ID NO: 83734 - RNA, 22 nt, Human
auucuguugguuuaauagucaa

SEQ ID NO: 83735 - RNA, 22 nt, Human
auuccuguggcuggguaaagua

SEQ ID NO: 83736 - RNA, 22 nt, Human
auuaugaauuguguuacgaaga

SEQ ID NO: 83737 - RNA, 22 nt, Human
auuaugcagcugccuccaaggu

SEQ ID NO: 83738 - RNA, 23 nt, Human
auuaugaagaagacucgccuguu

SEQ ID NO: 83739 - RNA, 22 nt, Human
auucuccucaaaacaucugcug

SEQ ID NO: 83740 - RNA, 22 nt, Human
auucucauguuaccaaauucua

SEQ ID NO: 83741 - RNA, 22 nt, Human
auucucuauugguaaauuugac

SEQ ID NO: 83742 - RNA, 22 nt, Human
auucuacucuccuacaggucua

SEQ ID NO: 83743 - RNA, 22 nt, Human
auucuuuauuuucuguacuugc

SEQ ID NO: 83744 - RNA, 19 nt, Human
auucuucucuuccugcugu

SEQ ID NO: 83745 - RNA, 22 nt, Human
auucuuuagaguccuucaaaua

SEQ ID NO: 83746 - RNA, 22 nt, Human
auucuugauauagauaguuaau

SEQ ID NO: 83747 - RNA, 22 nt, Human
auugagaaaauucgagcaaguu

SEQ ID NO: 83748 - RNA, 22 nt, Human
auucuaugaaugacuguuagau

SEQ ID NO: 83749 - RNA, 22 nt, Human
auucuuauaaaaaguguugacu

SEQ ID NO: 83750 - RNA, 22 nt, Human
auucugaagcagaaaaggcaga

SEQ ID NO: 83751 - RNA, 22 nt, Human
auucuucauguugaagcuguca

SEQ ID NO: 83752 - RNA, 17 nt, Human
auucuuauacucuguga

SEQ ID NO: 83753 - RNA, 22 nt, Human
auugaugaaaauaguuauuuua

SEQ ID NO: 83754 - RNA, 22 nt, Human
caaaguauuuagcugacucgcu

SEQ ID NO: 83755 - RNA, 22 nt, Human
auuuuguugaaacccuuguugu

SEQ ID NO: 83756 - RNA, 22 nt, Human
auuuuugugcuuuauuggggua

SEQ ID NO: 83757 - RNA, 22 nt, Human
auuuuugguuucaccugcacgc

SEQ ID NO: 83758 - RNA, 19 nt, Human
caagagcaaagucuuauga

SEQ ID NO: 83759 - RNA, 22 nt, Human
auuuuuuuggucauaugagaua

SEQ ID NO: 83760 - RNA, 22 nt, Human
caaaaauacuugccuguaucug

SEQ ID NO: 83761 - RNA, 22 nt, Human
caaaaaauccauagaaagaggu

SEQ ID NO: 83762 - RNA, 22 nt, Human
auuuuuucaugugugguugaga

SEQ ID NO: 83763 - RNA, 22 nt, Human
auuuuacuaugauaguugagaa

SEQ ID NO: 83764 - RNA, 22 nt, Human
auuuuauuuugggaucuuuuua

SEQ ID NO: 83765 - RNA, 21 nt, Human
auuuuucagaaggaugugaua

SEQ ID NO: 83766 - RNA, 22 nt, Human
auuuuuauuugccuaugauaua

SEQ ID NO: 83767 - RNA, 22 nt, Human
auuuuuaucuaaaauccacuuu

SEQ ID NO: 83768 - RNA, 22 nt, Human
auuuuuagucuugcugcaauca

SEQ ID NO: 83769 - RNA, 22 nt, Human
auuuccugugaacuuuucugau

SEQ ID NO: 83770 - RNA, 22 nt, Human
auuuucuucauuuugauuguau

SEQ ID NO: 83771 - RNA, 22 nt, Human
auuuuuagagugaaagaauuaa

SEQ ID NO: 83772 - RNA, 22 nt, Human
auuugcuuguucaccaguacuu

SEQ ID NO: 83773 - RNA, 22 nt, Human
auuucaguuugcaguuucucuc

SEQ ID NO: 83774 - RNA, 22 nt, Human
auugauuuugugcuuuccuacg

SEQ ID NO: 83775 - RNA, 22 nt, Human
auuuaagacuguggugcaguuu

SEQ ID NO: 83776 - RNA, 22 nt, Human
auugaaguguacguuugaucua

SEQ ID NO: 83777 - RNA, 22 nt, Human
auguuuuauacacauguaucac

SEQ ID NO: 83778 - RNA, 22 nt, Human
augugcucaggucuauaucuca

SEQ ID NO: 83779 - RNA, 22 nt, Human
auguuuaauuugaaauuuuauu

SEQ ID NO: 83780 - RNA, 22 nt, Human
auguguuuccaacagagaggga

SEQ ID NO: 83781 - RNA, 22 nt, Human
auguuguuuauggguuaucaag

SEQ ID NO: 83782 - RNA, 22 nt, Human
auguuguugaacucuuugcaug

SEQ ID NO: 83783 - RNA, 22 nt, Human
augugauacuccuucuagugga

SEQ ID NO: 83784 - RNA, 19 nt, Human
augguauugcuggguuuuu

SEQ ID NO: 83785 - RNA, 22 nt, Human
auggauggaagcagccugaacu

SEQ ID NO: 83786 - RNA, 22 nt, Human
auggaggaugugcagcaugggc

SEQ ID NO: 83787 - RNA, 22 nt, Human
auggagugggaggacaugaagg

SEQ ID NO: 83788 - RNA, 22 nt, Human
auggaagagacaaugcuaucug

SEQ ID NO: 83789 - RNA, 22 nt, Human
auggaauuuaaauuuugguguc

SEQ ID NO: 83790 - RNA, 22 nt, Human
augcaugaucccgguaugugaa

SEQ ID NO: 83791 - RNA, 22 nt, Human
augauuauuugaaugaagagga

SEQ ID NO: 83792 - RNA, 18 nt, Human
augauaauguuugcauca

SEQ ID NO: 83793 - RNA, 22 nt, Human
augcacaagguagauuauuauu

SEQ ID NO: 83794 - RNA, 22 nt, Human
augaggagucaaggagucggag

SEQ ID NO: 83795 - RNA, 23 nt, Human
augcaacauugccaguaugggca

SEQ ID NO: 83796 - RNA, 22 nt, Human
augcaaaaucuuauuuuuucua

SEQ ID NO: 83797 - RNA, 22 nt, Human
aucuuuguaaguaaucaaagcu

SEQ ID NO: 83798 - RNA, 22 nt, Human
augaaaacggaccagagcuauu

SEQ ID NO: 83799 - RNA, 22 nt, Human
aucuuggccuucuccuggagug

SEQ ID NO: 83800 - RNA, 22 nt, Human
aucuuggauccuuugccagcuu

SEQ ID NO: 83801 - RNA, 22 nt, Human
augaaggauagggcaaaauuuu

SEQ ID NO: 83802 - RNA, 22 nt, Human
aucuuugauuuuggcuuuuagg

SEQ ID NO: 83803 - RNA, 22 nt, Human
augaauuaucugguguuggaaa

SEQ ID NO: 83804 - RNA, 22 nt, Human
aucucccaaauuagccucuuga

SEQ ID NO: 83805 - RNA, 22 nt, Human
aucuuugccuuuaugccucuag

SEQ ID NO: 83806 - RNA, 22 nt, Human
aucuuguuagaaggcaguaggu

SEQ ID NO: 83807 - RNA, 22 nt, Human
aucuccaguuagcaguacugau

SEQ ID NO: 83808 - RNA, 22 nt, Human
aucuucaggggcaauggagaua

SEQ ID NO: 83809 - RNA, 22 nt, Human
aucuuagcucaacucucaccaa

SEQ ID NO: 83810 - RNA, 22 nt, Human
auccuucaaaaggaauagcagg

SEQ ID NO: 83811 - RNA, 18 nt, Human
auccuuugaucaucuguc

SEQ ID NO: 83812 - RNA, 22 nt, Human
cagcuucuccauucuucuggcu

SEQ ID NO: 83813 - RNA, 22 nt, Human
cagcugcugguguaucgggucc

SEQ ID NO: 83814 - RNA, 22 nt, Human
cagggacugcaggaggacaggu

SEQ ID NO: 83815 - RNA, 22 nt, Human
caggaacucggagcccaucucu

SEQ ID NO: 83816 - RNA, 22 nt, Human
cagcuauuguucuguauaauga

SEQ ID NO: 83817 - RNA, 22 nt, Human
cagagcugagucuucaagguug

SEQ ID NO: 83818 - RNA, 22 nt, Human
cagccuggccucuggauauuug

SEQ ID NO: 83819 - RNA, 22 nt, Human
cauaucuuaaacaucaucucug

SEQ ID NO: 83820 - RNA, 22 nt, Human
caguuuuauacacugcagcucc

SEQ ID NO: 83821 - RNA, 22 nt, Human
cagucucuugcuucauuaguug

SEQ ID NO: 83822 - RNA, 22 nt, Human
caggaacagcaccaggagcuag

SEQ ID NO: 83823 - RNA, 22 nt, Human
caggaagagaacugcucagccu

SEQ ID NO: 83824 - RNA, 22 nt, Human
caggaagucugaauucugagag

SEQ ID NO: 83825 - RNA, 22 nt, Human
cagaccucucaggcuguucuug

SEQ ID NO: 83826 - RNA, 22 nt, Human
cacuguugaagauacuuccucu

SEQ ID NO: 83827 - RNA, 23 nt, Human
cagagaaaauagaauaugcugug

SEQ ID NO: 83828 - RNA, 22 nt, Human
cagaaagugauuugcuauucca

SEQ ID NO: 83829 - RNA, 22 nt, Human
cagaaguugcuugagagagagc

SEQ ID NO: 83830 - RNA, 22 nt, Human
caccaaaauaucccuuuguaca

SEQ ID NO: 83831 - RNA, 22 nt, Human
cagaaagaaguggggauagagg

SEQ ID NO: 83832 - RNA, 22 nt, Human
cagaaaaaaaugcagacuagca

SEQ ID NO: 83833 - RNA, 22 nt, Human
cacaggacuuggcuucucacag

SEQ ID NO: 83834 - RNA, 22 nt, Human
cacuguugagcaauguacagug

SEQ ID NO: 83835 - RNA, 22 nt, Human
caaaagcaaagaucuuugauug

SEQ ID NO: 83836 - RNA, 22 nt, Human
cauccuauuacugaggcucccc

SEQ ID NO: 83837 - RNA, 22 nt, Human
caucuaaaauaagccuuauaau

SEQ ID NO: 83838 - RNA, 22 nt, Human
cauccagggguacccuggagcc

SEQ ID NO: 83839 - RNA, 22 nt, Human
cauuuucugcaagucugcucaa

SEQ ID NO: 83840 - RNA, 22 nt, Human
cauuucuugugagccgcauccu

SEQ ID NO: 83841 - RNA, 22 nt, Human
caugaagugaaaagguuaauuu

SEQ ID NO: 83842 - RNA, 22 nt, Human
caugagaguaaccuagagaaga

SEQ ID NO: 83843 - RNA, 22 nt, Human
caucaauagguauuugagagac

SEQ ID NO: 83844 - RNA, 22 nt, Human
cauuccaaguauauacaugaua

SEQ ID NO: 83845 - RNA, 22 nt, Human
cauuauacaugaagacucaccc

SEQ ID NO: 83846 - RNA, 22 nt, Human
cauugcugugggcauuugcugc

SEQ ID NO: 83847 - RNA, 22 nt, Human
cauugcugccaaggugagcugg

SEQ ID NO: 83848 - RNA, 22 nt, Human
cauuccuucucagguacuggca

SEQ ID NO: 83849 - RNA, 21 nt, Human
caucaagaucaauggagggcu

SEQ ID NO: 83850 - RNA, 23 nt, Human
cauauucagaaacaccuaguggu

SEQ ID NO: 83851 - RNA, 22 nt, Human
cauaucuccagguucugcugga

SEQ ID NO: 83852 - RNA, 22 nt, Human
cauuagugaggggcugccugcu

SEQ ID NO: 83853 - RNA, 22 nt, Human
cauucauaagacuuugcucuug

SEQ ID NO: 83854 - RNA, 20 nt, Human
cauuccaugcaucuuggucc

SEQ ID NO: 83855 - RNA, 22 nt, Human
ccaaggcuguggggcugugcag

SEQ ID NO: 83856 - RNA, 21 nt, Human
caugguaaguacaaagaugac

SEQ ID NO: 83857 - RNA, 22 nt, Human
cauguauguuaguggcugcuuu

SEQ ID NO: 83858 - RNA, 22 nt, Human
ccacagcauugaaaucuauaau

SEQ ID NO: 83859 - RNA, 22 nt, Human
ccaaggcuggagggcuuaugua

SEQ ID NO: 83860 - RNA, 22 nt, Human
caugccugaucagcggccagca

SEQ ID NO: 83861 - RNA, 22 nt, Human
ccaaagaauuuggaaaaucuga

SEQ ID NO: 83862 - RNA, 22 nt, Human
cccagaaugauucagcgacagu

SEQ ID NO: 83863 - RNA, 22 nt, Human
ccacagugauucacuuuugaag

SEQ ID NO: 83864 - RNA, 22 nt, Human
ccaucuuugcucuuuuauugca

SEQ ID NO: 83865 - RNA, 19 nt, Human
ccaguuuuuuaauauucaa

SEQ ID NO: 83866 - RNA, 22 nt, Human
ccaaggcugcagccgugacgcg

SEQ ID NO: 83867 - RNA, 22 nt, Human
ccagggcuggaggaggucagga

SEQ ID NO: 83868 - RNA, 22 nt, Human
ccagcagaagcucccgcugggu

SEQ ID NO: 83869 - RNA, 22 nt, Human
cauugcuguuaauugucucuag

SEQ ID NO: 83870 - RNA, 20 nt, Human
ccagaagagaagaaaaggaa

SEQ ID NO: 83871 - RNA, 22 nt, Human
ccagaauuugaacccacaaaug

SEQ ID NO: 83872 - RNA, 22 nt, Human
ccuugguuuagcaauuuuucuu

SEQ ID NO: 83873 - RNA, 22 nt, Human
ccuuccaguucuugguuguaau

SEQ ID NO: 83874 - RNA, 22 nt, Human
ccuuuuaucgcgaagaacucca

SEQ ID NO: 83875 - RNA, 21 nt, Human
ccuuuggagacugcagcaaug

SEQ ID NO: 83876 - RNA, 22 nt, Human
ccuguguucguccucaccuugc

SEQ ID NO: 83877 - RNA, 21 nt, Human
ccuggagacaaagacagggug

SEQ ID NO: 83878 - RNA, 22 nt, Human
cggaggcugcuuucuguugcua

SEQ ID NO: 83879 - RNA, 22 nt, Human
ccucucugcgaaugcugauagu

SEQ ID NO: 83880 - RNA, 20 nt, Human
ccucucugcaugcucccuga

SEQ ID NO: 83881 - RNA, 22 nt, Human
ccuccuggaguuacuuccaaaa

SEQ ID NO: 83882 - RNA, 22 nt, Human
ccuccccugccugugcuguugg

SEQ ID NO: 83883 - RNA, 20 nt, Human
ccucaaccuccuuucucucc

SEQ ID NO: 83884 - RNA, 22 nt, Human
ccucaauucgugccucacauug

SEQ ID NO: 83885 - RNA, 22 nt, Human
ccuaggcuggcugucuucaggu

SEQ ID NO: 83886 - RNA, 22 nt, Human
ccuauauaaaugacauauagga

SEQ ID NO: 83887 - RNA, 22 nt, Human
ccuauuuucaaaauuguuuauc

SEQ ID NO: 83888 - RNA, 22 nt, Human
ccuucucuucuuggaaggaacu

SEQ ID NO: 83889 - RNA, 22 nt, Human
ccuugagacacagccaaagaug

SEQ ID NO: 83890 - RNA, 22 nt, Human
cgggagaugaggagagcuucgg

SEQ ID NO: 83891 - RNA, 22 nt, Human
cgauuccugauaagugaauaag

SEQ ID NO: 83892 - RNA, 22 nt, Human
cuagaggaacaguuucagguuu

SEQ ID NO: 83893 - RNA, 22 nt, Human
cuacuucucccuagaucagaaa

SEQ ID NO: 83894 - RNA, 22 nt, Human
cuacugaagcaugcuuauaugu

SEQ ID NO: 83895 - RNA, 18 nt, Human
cuacauucauaggaaagg

SEQ ID NO: 83896 - RNA, 22 nt, Human
cuaaacuucauauguugcuuua

SEQ ID NO: 83897 - RNA, 22 nt, Human
cucugauuuuucuaauacuuca

SEQ ID NO: 83898 - RNA, 22 nt, Human
cucuaccugcacaugccugacu

SEQ ID NO: 83899 - RNA, 22 nt, Human
cuccaggacugaggacagagcu

SEQ ID NO: 83900 - RNA, 22 nt, Human
cucagcaauuaccugugucucu

SEQ ID NO: 83901 - RNA, 22 nt, Human
cucagcacauuccuaagggaug

SEQ ID NO: 83902 - RNA, 22 nt, Human
cuauguuucagauauauauaua

SEQ ID NO: 83903 - RNA, 22 nt, Human
cuaaagucauacaaggugggag

SEQ ID NO: 83904 - RNA, 22 nt, Human
cugauguuuaucucaagaguuc

SEQ ID NO: 83905 - RNA, 20 nt, Human
cugauguucgugcuuccugg

SEQ ID NO: 83906 - RNA, 22 nt, Human
cuaugguaguggcacaggagga

SEQ ID NO: 83907 - RNA, 22 nt, Human
cuauauucuggaauguccauuu

SEQ ID NO: 83908 - RNA, 18 nt, Human
cuaguuuguuuucuacau

SEQ ID NO: 83909 - RNA, 22 nt, Human
cugcucuucccaucccuuaaau

SEQ ID NO: 83910 - RNA, 22 nt, Human
cugccuuggcccuaguucaugg

SEQ ID NO: 83911 - RNA, 22 nt, Human
cuagcacagugcuuggcacaca

SEQ ID NO: 83912 - RNA, 22 nt, Human
cuagagaaaaagcuuagguacg

SEQ ID NO: 83913 - RNA, 22 nt, Human
cuacugaugccccgcugugccu

SEQ ID NO: 83914 - RNA, 22 nt, Human
cuaagaaggaggaaaagugcca

SEQ ID NO: 83915 - RNA, 22 nt, Human
cuuauuagaaagaaaagacaug

SEQ ID NO: 83916 - RNA, 22 nt, Human
cuuaggaaauccuguacucccc

SEQ ID NO: 83917 - RNA, 22 nt, Human
cuguuucuuugcugucagagag

SEQ ID NO: 83918 - RNA, 22 nt, Human
cugaaagacgaggggaagucgg

SEQ ID NO: 83919 - RNA, 22 nt, Human
cugaaagcaaaguaauucuuaa

SEQ ID NO: 83920 - RNA, 22 nt, Human
cuguucuccacuccugacuucu

SEQ ID NO: 83921 - RNA, 22 nt, Human
cuguuccuccaccucaacaaac

SEQ ID NO: 83922 - RNA, 22 nt, Human
cucuuuuuuugucuuaagaacc

SEQ ID NO: 83923 - RNA, 22 nt, Human
cucuuauaaagaugucucuguu

SEQ ID NO: 83924 - RNA, 22 nt, Human
cucuucauguuggugcagaagc

SEQ ID NO: 83925 - RNA, 22 nt, Human
cuggugaagccuucggagaccc

SEQ ID NO: 83926 - RNA, 22 nt, Human
cugguuacuucagaucaguagu

SEQ ID NO: 83927 - RNA, 22 nt, Human
cugggaguugacgaggcuugua

SEQ ID NO: 83928 - RNA, 22 nt, Human
cugggagaugacucagagcagg

SEQ ID NO: 83929 - RNA, 22 nt, Human
cucaugagucugucagagucau

SEQ ID NO: 83930 - RNA, 22 nt, Human
cucagaagaacaaaggcucuac

SEQ ID NO: 83931 - RNA, 22 nt, Human
cuauuuucccauaugguugaca

SEQ ID NO: 83932 - RNA, 22 nt, Human
cucaaagcagacuuuucccuuu

SEQ ID NO: 83933 - RNA, 22 nt, Human
cucacauacaagagauggugga

SEQ ID NO: 83934 - RNA, 22 nt, Human
gaaaaucaugaaaguguguugu

SEQ ID NO: 83935 - RNA, 22 nt, Human
cuggugagaccgacuuccacuu

SEQ ID NO: 83936 - RNA, 22 nt, Human
cuguaaguggugaaauuaguuu

SEQ ID NO: 83937 - RNA, 22 nt, Human
gaaaauaguucaucacaaugau

SEQ ID NO: 83938 - RNA, 22 nt, Human
gaaaaugcacacauacacaccc

SEQ ID NO: 83939 - RNA, 21 nt, Human
gaaaaucuaaugugacaaugc

SEQ ID NO: 83940 - RNA, 22 nt, Human
cuguagaugucagguuaaugag

SEQ ID NO: 83941 - RNA, 19 nt, Human
cuguccacacacucgcuuc

SEQ ID NO: 83942 - RNA, 22 nt, Human
cugucucugauaagcucgaggg

SEQ ID NO: 83943 - RNA, 22 nt, Human
gaaaagcucuuuagaagagguu

SEQ ID NO: 83944 - RNA, 22 nt, Human
gaaaagaaaggaugguaugugu

SEQ ID NO: 83945 - RNA, 22 nt, Human
gaaaagaaggcaggagcccaag

SEQ ID NO: 83946 - RNA, 22 nt, Human
gaagaaggaagaucaugcuuga

SEQ ID NO: 83947 - RNA, 22 nt, Human
gaagaagagauaauggggagca

SEQ ID NO: 83948 - RNA, 22 nt, Human
gaacuuaauauacaaucaguuc

SEQ ID NO: 83949 - RNA, 21 nt, Human
cugugggaaggccugaggucu

SEQ ID NO: 83950 - RNA, 22 nt, Human
cugugguuuuauuuauuugaag

SEQ ID NO: 83951 - RNA, 22 nt, Human
gaaaucuggugauuuucuguug

SEQ ID NO: 83952 - RNA, 22 nt, Human
cugucucugucucuguuuaucc

SEQ ID NO: 83953 - RNA, 22 nt, Human
cugggggacagagagaggcggu

SEQ ID NO: 83954 - RNA, 22 nt, Human
gaaaaauggguuguuugaagau

SEQ ID NO: 83955 - RNA, 22 nt, Human
gaaaaagagaaggaguucagua

SEQ ID NO: 83956 - RNA, 22 nt, Human
cugggagaggaaccucgagggu

SEQ ID NO: 83957 - RNA, 22 nt, Human
cuuuuccuccaggaagccaagc

SEQ ID NO: 83958 - RNA, 22 nt, Human
gacaagaagaacggagguuuca

SEQ ID NO: 83959 - RNA, 19 nt, Human
cuuguggcuaugcagauac

SEQ ID NO: 83960 - RNA, 22 nt, Human
cuugugagaagaccuuccgcau

SEQ ID NO: 83961 - RNA, 22 nt, Human
gaauuccaggugagagaaggua

SEQ ID NO: 83962 - RNA, 22 nt, Human
cuuccuaaucuuggguuauuuu

SEQ ID NO: 83963 - RNA, 18 nt, Human
gaagcaacaguucugagu

SEQ ID NO: 83964 - RNA, 22 nt, Human
gagagagacugggaaaucauca

SEQ ID NO: 83965 - RNA, 22 nt, Human
gagagaaggaagugaauuuccc

SEQ ID NO: 83966 - RNA, 22 nt, Human
gagaaggagcagaaaaucuccu

SEQ ID NO: 83967 - RNA, 22 nt, Human
gagaacagauaugaugacuuca

SEQ ID NO: 83968 - RNA, 22 nt, Human
gagaaagauuguccuucagggg

SEQ ID NO: 83969 - RNA, 22 nt, Human
gagaaaacauacuuaguguccu

SEQ ID NO: 83970 - RNA, 22 nt, Human
gacuguuggcagauguuugagu

SEQ ID NO: 83971 - RNA, 22 nt, Human
cuuuugcaauagugacacugau

SEQ ID NO: 83972 - RNA, 22 nt, Human
cuuuuuaaaguaaauggcuaga

SEQ ID NO: 83973 - RNA, 22 nt, Human
gacuugcucaaaucagauuuua

SEQ ID NO: 83974 - RNA, 21 nt, Human
cuuuggcaagggagaagucac

SEQ ID NO: 83975 - RNA, 22 nt, Human
cuuucuuuuugguuucccccca

SEQ ID NO: 83976 - RNA, 22 nt, Human
gauauggaaacuugauguugug

SEQ ID NO: 83977 - RNA, 22 nt, Human
gagaaaaauuucuuugcugcac

SEQ ID NO: 83978 - RNA, 22 nt, Human
gauagaaagagaaucagaacuu

SEQ ID NO: 83979 - RNA, 22 nt, Human
gagaaauagauucaugguagau

SEQ ID NO: 83980 - RNA, 22 nt, Human
gacuuaaccacggucacauggu

SEQ ID NO: 83981 - RNA, 22 nt, Human
gacuaaauaaaagccaaacuuc

SEQ ID NO: 83982 - RNA, 22 nt, Human
gaguuucacguagaucaggguc

SEQ ID NO: 83983 - RNA, 22 nt, Human
gacucuucucucccaaaugccc

SEQ ID NO: 83984 - RNA, 22 nt, Human
gaguucuagauguauuauuaau

SEQ ID NO: 83985 - RNA, 22 nt, Human
gagucuuuuaagaugucuuacu

SEQ ID NO: 83986 - RNA, 22 nt, Human
gaccugaccucauuagcaaguu

SEQ ID NO: 83987 - RNA, 22 nt, Human
gaguauuacuaaaauucgccua

SEQ ID NO: 83988 - RNA, 22 nt, Human
gacccucucagacuuccaggca

SEQ ID NO: 83989 - RNA, 22 nt, Human
gaccagaacuucuagucuaagu

SEQ ID NO: 83990 - RNA, 22 nt, Human
gacaaguagguuauuuuuagca

SEQ ID NO: 83991 - RNA, 22 nt, Human
gacaccuucuacugacuaugga

SEQ ID NO: 83992 - RNA, 22 nt, Human
gacaguggagccacguugggag

SEQ ID NO: 83993 - RNA, 22 nt, Human
gaguaaaagaugaggcaguaga

SEQ ID NO: 83994 - RNA, 22 nt, Human
gacaggcagagaggaagagaga

SEQ ID NO: 83995 - RNA, 22 nt, Human
gaggggcucuugggcaugaagg

SEQ ID NO: 83996 - RNA, 19 nt, Human
gaauugcacgagcagaggc

SEQ ID NO: 83997 - RNA, 22 nt, Human
gaauucuaguucuguaucucug

SEQ ID NO: 83998 - RNA, 16 nt, Human
gaauuccauugcucug

SEQ ID NO: 83999 - RNA, 22 nt, Human
gagggaaaggggccaugauugg

SEQ ID NO: 84000 - RNA, 22 nt, Human
gaaugcacacgugugugcaugc

SEQ ID NO: 84001 - RNA, 22 nt, Human
gaauaagaauccacuucuggca

SEQ ID NO: 84002 - RNA, 22 nt, Human
gaaguucuuagucucauuugca

SEQ ID NO: 84003 - RNA, 22 nt, Human
gaaucucuuugucccugaguuu

SEQ ID NO: 84004 - RNA, 22 nt, Human
gaggaggagacggaggccuggg

SEQ ID NO: 84005 - RNA, 22 nt, Human
gaaggaaaagacgugcuaagua

SEQ ID NO: 84006 - RNA, 22 nt, Human
gaaggauaauuuugcuggaugu

SEQ ID NO: 84007 - RNA, 22 nt, Human
gaggaaaauggaguguaauuaa

SEQ ID NO: 84008 - RNA, 22 nt, Human
gagcuggagaaacacauaagaa

SEQ ID NO: 84009 - RNA, 18 nt, Human
gagcucuucccuuuucuc

SEQ ID NO: 84010 - RNA, 22 nt, Human
gagcuaagcccuggagaggucg

SEQ ID NO: 84011 - RNA, 22 nt, Human
gaagcuucgaaagagugauuuc

SEQ ID NO: 84012 - RNA, 22 nt, Human
gaaaaucaggauggaugugagg

SEQ ID NO: 84013 - RNA, 22 nt, Human
gagagaguaucugcugguucac

SEQ ID NO: 84014 - RNA, 22 nt, Human
gaagauucugacccugacucag

SEQ ID NO: 84015 - RNA, 22 nt, Human
uuugugguuuugagagaguugc

SEQ ID NO: 84016 - RNA, 22 nt, Human
gcaucacacgcacauacacaca

SEQ ID NO: 84017 - RNA, 22 nt, Human
gcuagagaccagaggccuugaa

SEQ ID NO: 84018 - RNA, 22 nt, Human
gcuagaaacuguuuaaucucuu

SEQ ID NO: 84019 - RNA, 22 nt, Human
gcaguauuguguguggucaugg

SEQ ID NO: 84020 - RNA, 22 nt, Human
gcaggaaugguacauaccuguu

SEQ ID NO: 84021 - RNA, 22 nt, Human
gcagauccaaauauaguucuug

SEQ ID NO: 84022 - RNA, 23 nt, Human
gcagccaacccacgugagagaag

SEQ ID NO: 84023 - RNA, 20 nt, Human
gcagcagacagacaggggac

SEQ ID NO: 84024 - RNA, 22 nt, Human
gcagaugagagugugaucuggg

SEQ ID NO: 84025 - RNA, 22 nt, Human
gcagauaguaggagcuaaucuu

SEQ ID NO: 84026 - RNA, 22 nt, Human
gcagaaguauuguacgguggga

SEQ ID NO: 84027 - RNA, 22 nt, Human
gcagagaaugucagauuuuguu

SEQ ID NO: 84028 - RNA, 21 nt, Human
gcagaaagugauuugcuauuc

SEQ ID NO: 84029 - RNA, 22 nt, Human
gcacaaaagguacuucauguag

SEQ ID NO: 84030 - RNA, 22 nt, Human
gcaauaaguuuucucuucuguc

SEQ ID NO: 84031 - RNA, 22 nt, Human
gcccuuuuaucaacuccuagaa

SEQ ID NO: 84032 - RNA, 22 nt, Human
gcaaaaacaguguagucuucug

SEQ ID NO: 84033 - RNA, 22 nt, Human
gcccuguuuucuggguuccuug

SEQ ID NO: 84034 - RNA, 22 nt, Human
gaugggaggaugaauuggaccu

SEQ ID NO: 84035 - RNA, 22 nt, Human
gaugggaaggugguaaaguuua

SEQ ID NO: 84036 - RNA, 22 nt, Human
gauccucagacccuccucuggu

SEQ ID NO: 84037 - RNA, 22 nt, Human
gauauuaguuuuggaaggaggg

SEQ ID NO: 84038 - RNA, 22 nt, Human
gcaucccagaagauucugauuu

SEQ ID NO: 84039 - RNA, 22 nt, Human
gcauaacaacagacucuguguu

SEQ ID NO: 84040 - RNA, 22 nt, Human
gaguuaaauagcuuaggauuca

SEQ ID NO: 84041 - RNA, 22 nt, Human
gaguauuuaccacuaaaugguu

SEQ ID NO: 84042 - RNA, 19 nt, Human
gaguacuuuacaaguuuuc

SEQ ID NO: 84043 - RNA, 22 nt, Human
gcaguccuguagcgacuuuuuu

SEQ ID NO: 84044 - RNA, 22 nt, Human
gcaguaaauugagagucauguu

SEQ ID NO: 84045 - RNA, 22 nt, Human
gcaggccuccccugcuggagcu

SEQ ID NO: 84046 - RNA, 18 nt, Human
gaugaagaggaagaggag

SEQ ID NO: 84047 - RNA, 22 nt, Human
gaugaaguaguccacuggaagg

SEQ ID NO: 84048 - RNA, 22 nt, Human
gaugaagaaacucaaccaagaa

SEQ ID NO: 84049 - RNA, 22 nt, Human
ggaaaaauggguggugauauga

SEQ ID NO: 84050 - RNA, 22 nt, Human
gcuuggagaacguuuucuagaa

SEQ ID NO: 84051 - RNA, 22 nt, Human
gccucaaaaguguuguagaggg

SEQ ID NO: 84052 - RNA, 22 nt, Human
ggaaaaugcugaagcaucugaa

SEQ ID NO: 84053 - RNA, 22 nt, Human
ggaaagagaaacaugaacuaga

SEQ ID NO: 84054 - RNA, 22 nt, Human
gccugaaaugaaccagaggacu

SEQ ID NO: 84055 - RNA, 22 nt, Human
gccugcagccagggaguucucu

SEQ ID NO: 84056 - RNA, 22 nt, Human
gcuucucacccuuacuaucucu

SEQ ID NO: 84057 - RNA, 22 nt, Human
gcuuagaaucagaccuggguca

SEQ ID NO: 84058 - RNA, 22 nt, Human
gcuguguucauccugcccaggu

SEQ ID NO: 84059 - RNA, 22 nt, Human
gcuguuggaggaguucagugcu

SEQ ID NO: 84060 - RNA, 22 nt, Human
gcauguucaaguuaguauauuu

SEQ ID NO: 84061 - RNA, 22 nt, Human
ggcauuccucucuguucaugga

SEQ ID NO: 84062 - RNA, 22 nt, Human
gcucuccuugcuagagguucua

SEQ ID NO: 84063 - RNA, 22 nt, Human
gcucaacuucuaggacuucagg

SEQ ID NO: 84064 - RNA, 22 nt, Human
gcucagagaaaacuggggcuug

SEQ ID NO: 84065 - RNA, 22 nt, Human
gcuagagaagagcccacaccgg

SEQ ID NO: 84066 - RNA, 22 nt, Human
gcguguauuccagaccuuaacg

SEQ ID NO: 84067 - RNA, 22 nt, Human
gcgugcauggccguguguaugc

SEQ ID NO: 84068 - RNA, 22 nt, Human
ggauaauugaugauuuauaaga

SEQ ID NO: 84069 - RNA, 22 nt, Human
ggauaaaugaaggcauacagau

SEQ ID NO: 84070 - RNA, 22 nt, Human
ggaguguuagacuaaauuggga

SEQ ID NO: 84071 - RNA, 22 nt, Human
ggaguguuaggaaguuguguuu

SEQ ID NO: 84072 - RNA, 19 nt, Human
ggaggguguccucaguguc

SEQ ID NO: 84073 - RNA, 22 nt, Human
ggagagaacguaaucuaguauu

SEQ ID NO: 84074 - RNA, 22 nt, Human
ggagcuaagagaauggacaagg

SEQ ID NO: 84075 - RNA, 22 nt, Human
ggagaaacuaguuagauccaau

SEQ ID NO: 84076 - RNA, 22 nt, Human
ggaagaggaagaugaggcagca

SEQ ID NO: 84077 - RNA, 22 nt, Human
ggaagaagagggagcuguggga

SEQ ID NO: 84078 - RNA, 22 nt, Human
ggagcucacuacgaaauaagcu

SEQ ID NO: 84079 - RNA, 22 nt, Human
ggagcucaggaguugauuauuu

SEQ ID NO: 84080 - RNA, 22 nt, Human
ggguuuuggggaggaagugagc

SEQ ID NO: 84081 - RNA, 22 nt, Human
gguaagcugcuguagggucaga

SEQ ID NO: 84082 - RNA, 22 nt, Human
ggguggaaugugagugugugug

SEQ ID NO: 84083 - RNA, 23 nt, Human
gguuggcuguacccaggcucccu

SEQ ID NO: 84084 - RNA, 22 nt, Human
ggucaaucaugggucauugucu

SEQ ID NO: 84085 - RNA, 22 nt, Human
ggauggaugugaucugccuccu

SEQ ID NO: 84086 - RNA, 22 nt, Human
ggaaguuugagcaucuguuucc

SEQ ID NO: 84087 - RNA, 22 nt, Human
ggaaaagaauuguuaguuagug

SEQ ID NO: 84088 - RNA, 22 nt, Human
ggaaauguguguaagaaaguau

SEQ ID NO: 84089 - RNA, 22 nt, Human
gggagauuuguguaggaaaacu

SEQ ID NO: 84090 - RNA, 18 nt, Human
gcuuggguggcuauguuu

SEQ ID NO: 84091 - RNA, 22 nt, Human
gggaagaaccucugcuaccaau

SEQ ID NO: 84092 - RNA, 22 nt, Human
gcuguugcaaucaaggccaugg

SEQ ID NO: 84093 - RNA, 23 nt, Human
gggaaaucaaaagauauuucuuc

SEQ ID NO: 84094 - RNA, 22 nt, Human
ggcuuuuguuauaaucaggccu

SEQ ID NO: 84095 - RNA, 22 nt, Human
ggcuucuuaacauuuggacacc

SEQ ID NO: 84096 - RNA, 22 nt, Human
gcuguguaugaugcaggcaccu

SEQ ID NO: 84097 - RNA, 22 nt, Human
gugaaaaauggccaucaggaca

SEQ ID NO: 84098 - RNA, 22 nt, Human
gucuucugacacuguuaggagg

SEQ ID NO: 84099 - RNA, 22 nt, Human
gugaagaugccucaggugaccc

SEQ ID NO: 84100 - RNA, 22 nt, Human
gugaaauuguacacucaguacc

SEQ ID NO: 84101 - RNA, 22 nt, Human
gugaguuuucgugacacuauuu

SEQ ID NO: 84102 - RNA, 22 nt, Human
gggaagugagcuggaaucaagg

SEQ ID NO: 84103 - RNA, 22 nt, Human
gggaagaacugauuucacacca

SEQ ID NO: 84104 - RNA, 22 nt, Human
gggaagaagaaaagagguggga

SEQ ID NO: 84105 - RNA, 22 nt, Human
gugaguugugugaguaagcaga

SEQ ID NO: 84106 - RNA, 22 nt, Human
ggcuuuuucccuaggguaagag

SEQ ID NO: 84107 - RNA, 20 nt, Human
gugaaguuuucugaagacag

SEQ ID NO: 84108 - RNA, 22 nt, Human
gggaaaugugucuuggcauucu

SEQ ID NO: 84109 - RNA, 22 nt, Human
gggaaaucugcuuccuagggcu

SEQ ID NO: 84110 - RNA, 22 nt, Human
gggauguauguuuguguggaga

SEQ ID NO: 84111 - RNA, 22 nt, Human
gugcucuagaaauugucagugg

SEQ ID NO: 84112 - RNA, 21 nt, Human
gggagugucuguugcaaggug

SEQ ID NO: 84113 - RNA, 22 nt, Human
gugccgaugaggccuggcauuc

SEQ ID NO: 84114 - RNA, 21 nt, Human
gggagaguagcgguagggagg

SEQ ID NO: 84115 - RNA, 22 nt, Human
gggaauguuaaccuuucuauuu

SEQ ID NO: 84116 - RNA, 22 nt, Human
gugaugaaggccugcaccuggu

SEQ ID NO: 84117 - RNA, 22 nt, Human
gugaugaagguggagaaucaga

SEQ ID NO: 84118 - RNA, 22 nt, Human
gucugcuuuuaucacaugucau

SEQ ID NO: 84119 - RNA, 22 nt, Human
gucuggugguggguguagggca

SEQ ID NO: 84120 - RNA, 22 nt, Human
gucugguggaguuguauauacu

SEQ ID NO: 84121 - RNA, 22 nt, Human
ggcuggaacuucuucuggcauu

SEQ ID NO: 84122 - RNA, 21 nt, Human
ggcugcucgugaugaacuuca

SEQ ID NO: 84123 - RNA, 22 nt, Human
gucgagaacauucauuaugcaa

SEQ ID NO: 84124 - RNA, 17 nt, Human
ggcugccaggcaacaua

SEQ ID NO: 84125 - RNA, 22 nt, Human
guccugaaaaaaaucccugagu

SEQ ID NO: 84126 - RNA, 22 nt, Human
guccccuauaugaggaagccau

SEQ ID NO: 84127 - RNA, 22 nt, Human
ggcuauuguuuuaaaaaaugag

SEQ ID NO: 84128 - RNA, 23 nt, Human
gucagcuugaccaguggagaguc

SEQ ID NO: 84129 - RNA, 22 nt, Human
guauucugugugaucaagugau

SEQ ID NO: 84130 - RNA, 22 nt, Human
guauggaguuuuguugcacuuc

SEQ ID NO: 84131 - RNA, 22 nt, Human
guaugucuuaggguucaguaac

SEQ ID NO: 84132 - RNA, 22 nt, Human
guauauuuaugagcauuagccu

SEQ ID NO: 84133 - RNA, 22 nt, Human
ggugaucucagucuagaugguu

SEQ ID NO: 84134 - RNA, 22 nt, Human
ggucgacuaauguuucauuuca

SEQ ID NO: 84135 - RNA, 22 nt, Human
guuguuaagugcugguuguuag

SEQ ID NO: 84136 - RNA, 22 nt, Human
gugcugucguggaacugggcug

SEQ ID NO: 84137 - RNA, 22 nt, Human
uaaaaucaugacagauugacau

SEQ ID NO: 84138 - RNA, 22 nt, Human
uaaauuccuagucacaaacuuc

SEQ ID NO: 84139 - RNA, 22 nt, Human
gguugaagcuacuuucuggaug

SEQ ID NO: 84140 - RNA, 22 nt, Human
uaaaaaccuuguauuuaacucu

SEQ ID NO: 84141 - RNA, 22 nt, Human
guuuuggagauguccauuuucc

SEQ ID NO: 84142 - RNA, 22 nt, Human
ggugguucagugguuagggcca

SEQ ID NO: 84143 - RNA, 22 nt, Human
guuuguuugccagcuuaguaaa

SEQ ID NO: 84144 - RNA, 22 nt, Human
ggugcuggggaaauuaggguag

SEQ ID NO: 84145 - RNA, 22 nt, Human
uacuucuuuuguaaaguauuga

SEQ ID NO: 84146 - RNA, 22 nt, Human
gucuuuguaguuuuaauuugag

SEQ ID NO: 84147 - RNA, 22 nt, Human
uaauuuugucacagugacaugc

SEQ ID NO: 84148 - RNA, 22 nt, Human
gucuggagccacugcugcugcu

SEQ ID NO: 84149 - RNA, 22 nt, Human
gucgguacuaguacugguguug

SEQ ID NO: 84150 - RNA, 22 nt, Human
uaauucuacagggaacucugga

SEQ ID NO: 84151 - RNA, 22 nt, Human
uaauucuucaauccaguguuca

SEQ ID NO: 84152 - RNA, 22 nt, Human
guagagagugucuuccagaaau

SEQ ID NO: 84153 - RNA, 22 nt, Human
guagagcagaaacauggagaaa

SEQ ID NO: 84154 - RNA, 22 nt, Human
guagagccaccaccaccauagc

SEQ ID NO: 84155 - RNA, 22 nt, Human
gucacuccuucccagagggagc

SEQ ID NO: 84156 - RNA, 22 nt, Human
gucaggugcaccuccaccaaca

SEQ ID NO: 84157 - RNA, 22 nt, Human
uaagcacuuuauaugcuuuauc

SEQ ID NO: 84158 - RNA, 22 nt, Human
ucaaaucuuuuuuccuucccug

SEQ ID NO: 84159 - RNA, 22 nt, Human
ucaacagaagugauagcuauua

SEQ ID NO: 84160 - RNA, 22 nt, Human
ucaaagaucuuugcuuuugggg

SEQ ID NO: 84161 - RNA, 22 nt, Human
guugguggaggcgagagaagaa

SEQ ID NO: 84162 - RNA, 22 nt, Human
uauuuucucugccacacuucca

SEQ ID NO: 84163 - RNA, 22 nt, Human
guugcuaugaaauuaaaauuua

SEQ ID NO: 84164 - RNA, 22 nt, Human
guucucuccugcuggugaugga

SEQ ID NO: 84165 - RNA, 22 nt, Human
guucuuagguacucauauuuaa

SEQ ID NO: 84166 - RNA, 22 nt, Human
guucuucucuuguaauggaauc

SEQ ID NO: 84167 - RNA, 22 nt, Human
guuauacuuaugugcaaaaaua

SEQ ID NO: 84168 - RNA, 22 nt, Human
uauuauggguuuuuguguaaau

SEQ ID NO: 84169 - RNA, 22 nt, Human
uauucauuuuuauuugugacug

SEQ ID NO: 84170 - RNA, 16 nt, Human
guuccuguguguacaa

SEQ ID NO: 84171 - RNA, 17 nt, Human
guucucaaacugacuga

SEQ ID NO: 84172 - RNA, 22 nt, Human
uauugguagauggagagagaca

SEQ ID NO: 84173 - RNA, 22 nt, Human
guguucuucacuguuagaaggu

SEQ ID NO: 84174 - RNA, 23 nt, Human
guguuguugauuuucgaaucuuu

SEQ ID NO: 84175 - RNA, 22 nt, Human
guguuuugagaggaugguuuua

SEQ ID NO: 84176 - RNA, 22 nt, Human
guuacagagcugcuaugugugc

SEQ ID NO: 84177 - RNA, 20 nt, Human
uaugcgaagccuuucuggac

SEQ ID NO: 84178 - RNA, 22 nt, Human
uaugccaaaaauaaguuuuaug

SEQ ID NO: 84179 - RNA, 22 nt, Human
uauggacagcuuucuuuguguu

SEQ ID NO: 84180 - RNA, 22 nt, Human
uaugcuguauucuguauguuag

SEQ ID NO: 84181 - RNA, 22 nt, Human
guguucucagcacccacuucau

SEQ ID NO: 84182 - RNA, 22 nt, Human
uauccauaccuucaaguuugcu

SEQ ID NO: 84183 - RNA, 22 nt, Human
uagugggauuuugaacaaaacc

SEQ ID NO: 84184 - RNA, 22 nt, Human
uaguaugugccuguugucucug

SEQ ID NO: 84185 - RNA, 22 nt, Human
uagucucagaauauuugcugau

SEQ ID NO: 84186 - RNA, 22 nt, Human
uaggaucaugaugguaaggcaa

SEQ ID NO: 84187 - RNA, 22 nt, Human
uaggagcagauggcagcaggug

SEQ ID NO: 84188 - RNA, 22 nt, Human
gugcugcaugagcaucacguag

SEQ ID NO: 84189 - RNA, 22 nt, Human
guggaaggaauuaacagacuag

SEQ ID NO: 84190 - RNA, 22 nt, Human
uagaagaacaugucaaacuaua

SEQ ID NO: 84191 - RNA, 22 nt, Human
gugagagugguuuauguccaug

SEQ ID NO: 84192 - RNA, 22 nt, Human
uagaacaaacagcauguuugau

SEQ ID NO: 84193 - RNA, 22 nt, Human
uagccucaagagauucagggac

SEQ ID NO: 84194 - RNA, 22 nt, Human
gugcucuauguugauuccuuga

SEQ ID NO: 84195 - RNA, 22 nt, Human
uaggaagagauuuucacauggc

SEQ ID NO: 84196 - RNA, 22 nt, Human
uagccucuggaauccuuucucu

SEQ ID NO: 84197 - RNA, 22 nt, Human
uagcucuaaggagaaucccucu

SEQ ID NO: 84198 - RNA, 22 nt, Human
uagcucuuaccagugaaguuug

SEQ ID NO: 84199 - RNA, 22 nt, Human
uaacucuagggacucgcccaga

SEQ ID NO: 84200 - RNA, 22 nt, Human
ucaguggaacacacagaguggg

SEQ ID NO: 84201 - RNA, 22 nt, Human
ucagucuucaggacuaugaaaa

SEQ ID NO: 84202 - RNA, 22 nt, Human
uaaagugaaguucagaauggcu

SEQ ID NO: 84203 - RNA, 19 nt, Human
uccaaaauacuuguuacug

SEQ ID NO: 84204 - RNA, 22 nt, Human
ucauuuuaucaggaauggaauc

SEQ ID NO: 84205 - RNA, 22 nt, Human
uaagugcuagaauuccagguuu

SEQ ID NO: 84206 - RNA, 22 nt, Human
uaaggagagaauuuagagguuu

SEQ ID NO: 84207 - RNA, 22 nt, Human
ucauuauuuggaauaugggacu

SEQ ID NO: 84208 - RNA, 22 nt, Human
ucaguuuaauuggaucuuuuuc

SEQ ID NO: 84209 - RNA, 22 nt, Human
uaagagauuuauugaggacuuc

SEQ ID NO: 84210 - RNA, 22 nt, Human
uaagcuauuccugaagaagguu

SEQ ID NO: 84211 - RNA, 22 nt, Human
ucauaucauuuugaaagcugag

SEQ ID NO: 84212 - RNA, 22 nt, Human
uccugguaaagaguaucagauu

SEQ ID NO: 84213 - RNA, 22 nt, Human
uagcagcacuauuuguuguagu

SEQ ID NO: 84214 - RNA, 22 nt, Human
uagaugcugagcuuaagagaau

SEQ ID NO: 84215 - RNA, 22 nt, Human
uagaugaacagaaagccacugu

SEQ ID NO: 84216 - RNA, 20 nt, Human
uagcacagacuuuugcuuac

SEQ ID NO: 84217 - RNA, 22 nt, Human
uccuccuggagacuuucucucu

SEQ ID NO: 84218 - RNA, 22 nt, Human
ucccuguuuccugcgcuccuuc

SEQ ID NO: 84219 - RNA, 22 nt, Human
uccucaucuuaucaucccaaga

SEQ ID NO: 84220 - RNA, 22 nt, Human
ucccucuccugucugcuucuuu

SEQ ID NO: 84221 - RNA, 23 nt, Human
uacuuuggcuagaguugucucuu

SEQ ID NO: 84222 - RNA, 22 nt, Human
uccauguugauaaucuugugaa

SEQ ID NO: 84223 - RNA, 22 nt, Human
uacugauggagauaggcuauca

SEQ ID NO: 84224 - RNA, 20 nt, Human
uacguguccgaugaucacag

SEQ ID NO: 84225 - RNA, 22 nt, Human
uccaugauauauaugugcacau

SEQ ID NO: 84226 - RNA, 22 nt, Human
uccaugaguuuuuuaguuucac

SEQ ID NO: 84227 - RNA, 22 nt, Human
uacaguauuuuuuaagaaaaaa

SEQ ID NO: 84228 - RNA, 22 nt, Human
uccacaaagucuaugagaguug

SEQ ID NO: 84229 - RNA, 22 nt, Human
uaugauuuucaugguagaguua

SEQ ID NO: 84230 - RNA, 22 nt, Human
ucugaguuaaaauuccagaggu

SEQ ID NO: 84231 - RNA, 22 nt, Human
ucugaucuuucauccuaaaugg

SEQ ID NO: 84232 - RNA, 22 nt, Human
ucugauaaggaaggauuaaaag

SEQ ID NO: 84233 - RNA, 22 nt, Human
ucugaugaccacaugugggacu

SEQ ID NO: 84234 - RNA, 22 nt, Human
ucugagugggaacucucaugac

SEQ ID NO: 84235 - RNA, 19 nt, Human
uaugacaaguacuaguucu

SEQ ID NO: 84236 - RNA, 22 nt, Human
uaugaggagaacauuccugaac

SEQ ID NO: 84237 - RNA, 22 nt, Human
uaugaccuuaggaagcaagaag

SEQ ID NO: 84238 - RNA, 19 nt, Human
uaugaaguugauaaaaguu

SEQ ID NO: 84239 - RNA, 22 nt, Human
uaugucuauugacuuaggauuu

SEQ ID NO: 84240 - RNA, 22 nt, Human
uauggcuaguguguuuguaaca

SEQ ID NO: 84241 - RNA, 22 nt, Human
uaugggaaggauuugucuuuca

SEQ ID NO: 84242 - RNA, 18 nt, Human
uauuccucuuccucuauc

SEQ ID NO: 84243 - RNA, 22 nt, Human
ucuguucacaauuacacacacu

SEQ ID NO: 84244 - RNA, 22 nt, Human
ucuguuuuccaggaaucucaua

SEQ ID NO: 84245 - RNA, 22 nt, Human
ucuguuucaggggucuggaaug

SEQ ID NO: 84246 - RNA, 22 nt, Human
ucuguuuuucagaccuuuuugg

SEQ ID NO: 84247 - RNA, 22 nt, Human
uauuaauugugguuauuguauu

SEQ ID NO: 84248 - RNA, 22 nt, Human
uauuaaaagagaaaaagccacc

SEQ ID NO: 84249 - RNA, 22 nt, Human
ucuguagucuuggagccgcaca

SEQ ID NO: 84250 - RNA, 22 nt, Human
ucugugcuggacugauuucaua

SEQ ID NO: 84251 - RNA, 20 nt, Human
ucuguggcagguggcgcuug

SEQ ID NO: 84252 - RNA, 20 nt, Human
ucugugugccaucaccuaac

SEQ ID NO: 84253 - RNA, 22 nt, Human
ucuguaaaugcaaguuuuccuc

SEQ ID NO: 84254 - RNA, 21 nt, Human
ucuggggacaagguccaggaa

SEQ ID NO: 84255 - RNA, 22 nt, Human
ucugagucgcucccuggaucca

SEQ ID NO: 84256 - RNA, 22 nt, Human
ucugagagcuguagaagccuau

SEQ ID NO: 84257 - RNA, 22 nt, Human
uaucuuugccuuggguuuuguu

SEQ ID NO: 84258 - RNA, 22 nt, Human
uaucuucaauagcccagaugug

SEQ ID NO: 84259 - RNA, 23 nt, Human
uaucccauacagagagugguaca

SEQ ID NO: 84260 - RNA, 22 nt, Human
ucucugugaauggcgucaccug

SEQ ID NO: 84261 - RNA, 22 nt, Human
ucugaaaggagaguagggcaga

SEQ ID NO: 84262 - RNA, 22 nt, Human
ucucucucucuuccagcauguu

SEQ ID NO: 84263 - RNA, 22 nt, Human
ucucuccauguuuucuguccag

SEQ ID NO: 84264 - RNA, 22 nt, Human
ucucuagaggaauuguucuagg

SEQ ID NO: 84265 - RNA, 22 nt, Human
ucucuacuuggcuuguguucac

SEQ ID NO: 84266 - RNA, 22 nt, Human
uaucacauaaaugaggaauauu

SEQ ID NO: 84267 - RNA, 22 nt, Human
uaucauuuuacugugacauuuu

SEQ ID NO: 84268 - RNA, 19 nt, Human
ucucugguggcuccaucag

SEQ ID NO: 84269 - RNA, 22 nt, Human
ucucuggcuuuuuuuccauuuu

SEQ ID NO: 84270 - RNA, 22 nt, Human
ucucucagauuguuuccauuuu

SEQ ID NO: 84271 - RNA, 22 nt, Human
uaguuuucuuuuguguuauucu

SEQ ID NO: 84272 - RNA, 22 nt, Human
uaguuuuaagcugacauuguuc

SEQ ID NO: 84273 - RNA, 23 nt, Human
uaguuucaucuccacccugcccu

SEQ ID NO: 84274 - RNA, 22 nt, Human
uaguuucuaauguugaaauuau

SEQ ID NO: 84275 - RNA, 22 nt, Human
ucucauacguuuccagguguca

SEQ ID NO: 84276 - RNA, 22 nt, Human
uauaaagaccuuauccuucaua

SEQ ID NO: 84277 - RNA, 21 nt, Human
ucucauuuuaacacagaguug

SEQ ID NO: 84278 - RNA, 22 nt, Human
ucucccaaaucuuucuagcaca

SEQ ID NO: 84279 - RNA, 22 nt, Human
ucuccucuauuucuguauguau

SEQ ID NO: 84280 - RNA, 22 nt, Human
uauaagaaaagucauuaucaaa

SEQ ID NO: 84281 - RNA, 19 nt, Human
uagcuguucuugaguguga

SEQ ID NO: 84282 - RNA, 22 nt, Human
ucuauauucuauguucuucuuu

SEQ ID NO: 84283 - RNA, 23 nt, Human
ucucaccaggauaugacugucac

SEQ ID NO: 84284 - RNA, 22 nt, Human
ugauuccugugcuuauuccagu

SEQ ID NO: 84285 - RNA, 22 nt, Human
ugauucacgcuucucuuuaaac

SEQ ID NO: 84286 - RNA, 22 nt, Human
uccaaggacucuugucagcugu

SEQ ID NO: 84287 - RNA, 22 nt, Human
ugauguuucugaagggguuacu

SEQ ID NO: 84288 - RNA, 22 nt, Human
ugauggaucuguuggcggguuu

SEQ ID NO: 84289 - RNA, 22 nt, Human
ugauguaggacauuauuauuuc

SEQ ID NO: 84290 - RNA, 22 nt, Human
ugauguaaaauaggaaguucua

SEQ ID NO: 84291 - RNA, 22 nt, Human
ucaucuauaaguagcaucuggg

SEQ ID NO: 84292 - RNA, 22 nt, Human
ucaugggcaaacuuggggauca

SEQ ID NO: 84293 - RNA, 22 nt, Human
ucaugcagaguagaaagggcaa

SEQ ID NO: 84294 - RNA, 22 nt, Human
ucauaaaggugccacucaguuu

SEQ ID NO: 84295 - RNA, 22 nt, Human
ugaggagggcuagagucuccug

SEQ ID NO: 84296 - RNA, 22 nt, Human
ugaggaaugugacaaaaccaag

SEQ ID NO: 84297 - RNA, 22 nt, Human
ucaguugauggcaguuaauguc

SEQ ID NO: 84298 - RNA, 22 nt, Human
ucagugugacccuucuauuuuu

SEQ ID NO: 84299 - RNA, 22 nt, Human
ucagucugguggaugcucauug

SEQ ID NO: 84300 - RNA, 22 nt, Human
ugagauucuguucagaaaaaug

SEQ ID NO: 84301 - RNA, 22 nt, Human
ugagcuauuucaccauauagau

SEQ ID NO: 84302 - RNA, 22 nt, Human
ugagaacacuuuucucuuugcu

SEQ ID NO: 84303 - RNA, 22 nt, Human
ugagaauuuaacuugauuagga

SEQ ID NO: 84304 - RNA, 22 nt, Human
ucuuccacuugaaccuucuguc

SEQ ID NO: 84305 - RNA, 18 nt, Human
ucagggaaacuuugccug

SEQ ID NO: 84306 - RNA, 22 nt, Human
ucuucaugaaauugauugcuua

SEQ ID NO: 84307 - RNA, 22 nt, Human
ucuucauuucuggggaauuggc

SEQ ID NO: 84308 - RNA, 22 nt, Human
ugagaagucagucuauugugaa

SEQ ID NO: 84309 - RNA, 22 nt, Human
ucaguauaugaauuugggggua

SEQ ID NO: 84310 - RNA, 22 nt, Human
ugagacuuggggggcugagggc

SEQ ID NO: 84311 - RNA, 22 nt, Human
ugagagaggugaaaugacuuuc

SEQ ID NO: 84312 - RNA, 22 nt, Human
ugagaggaagggaaagaugauu

SEQ ID NO: 84313 - RNA, 22 nt, Human
ugagagguagaacuuguagugu

SEQ ID NO: 84314 - RNA, 22 nt, Human
ucccaaguguuuggcgaggaga

SEQ ID NO: 84315 - RNA, 22 nt, Human
uccaggagucagacagauggug

SEQ ID NO: 84316 - RNA, 21 nt, Human
uccccugugccuggcauacag

SEQ ID NO: 84317 - RNA, 22 nt, Human
ugcacagagggaggcauaaaau

SEQ ID NO: 84318 - RNA, 22 nt, Human
uccgggagcccccggaggagga

SEQ ID NO: 84319 - RNA, 22 nt, Human
ucccugagagacuucuuuggcu

SEQ ID NO: 84320 - RNA, 22 nt, Human
ugcauguuauuguggcaagaau

SEQ ID NO: 84321 - RNA, 22 nt, Human
uccucaaauccuagccucaucg

SEQ ID NO: 84322 - RNA, 22 nt, Human
ugcauaagguuaaauuagcaga

SEQ ID NO: 84323 - RNA, 22 nt, Human
uccugcaugcuagugagugcuu

SEQ ID NO: 84324 - RNA, 22 nt, Human
uccucuccaggugagccgaaau

SEQ ID NO: 84325 - RNA, 22 nt, Human
uccuuuauuuaugggcagugua

SEQ ID NO: 84326 - RNA, 21 nt, Human
ugccuggccuuugcuuuuccu

SEQ ID NO: 84327 - RNA, 22 nt, Human
ugcgccuccugcugccugcccu

SEQ ID NO: 84328 - RNA, 22 nt, Human
uccuuggagaaucuuguuuuac

SEQ ID NO: 84329 - RNA, 22 nt, Human
ugccuaaaccauuccccuuccu

SEQ ID NO: 84330 - RNA, 20 nt, Human
ucuaggacaggcaaaguaca

SEQ ID NO: 84331 - RNA, 22 nt, Human
ucuaggcugugugugggcaggg

SEQ ID NO: 84332 - RNA, 22 nt, Human
ucuagggcaguacaaauucaag

SEQ ID NO: 84333 - RNA, 22 nt, Human
ucucagaagaaacaucugcugg

SEQ ID NO: 84334 - RNA, 22 nt, Human
ugcugcucaagcugcagcaaaa

SEQ ID NO: 84335 - RNA, 23 nt, Human
ucucacucauucuccucugucca

SEQ ID NO: 84336 - RNA, 22 nt, Human
ucuaguguuaaggcaaaguaaa

SEQ ID NO: 84337 - RNA, 22 nt, Human
ucuccucucugaucuugcuccg

SEQ ID NO: 84338 - RNA, 20 nt, Human
ugcugugugucuacuguggg

SEQ ID NO: 84339 - RNA, 20 nt, Human
ugcuguggguaagcuuuaua

SEQ ID NO: 84340 - RNA, 22 nt, Human
ucucccuggccagcccuuuccc

SEQ ID NO: 84341 - RNA, 22 nt, Human
ucuccuaauuacauacuugauu

SEQ ID NO: 84342 - RNA, 22 nt, Human
ugcuggaguggcacuguguggc

SEQ ID NO: 84343 - RNA, 22 nt, Human
ucugagugacguccugacagga

SEQ ID NO: 84344 - RNA, 22 nt, Human
uggaaaagaugucuuccugaau

SEQ ID NO: 84345 - RNA, 22 nt, Human
ugcuuuuggcagcaguguuuau

SEQ ID NO: 84346 - RNA, 22 nt, Human
ucugaagagaacucuuaguguu

SEQ ID NO: 84347 - RNA, 22 nt, Human
ucucuucacuuguaugcuauca

SEQ ID NO: 84348 - RNA, 22 nt, Human
ugcuugcuaucuaaguguuuca

SEQ ID NO: 84349 - RNA, 22 nt, Human
ucucucguuuuuugcagauaaa

SEQ ID NO: 84350 - RNA, 22 nt, Human
ucucugagggugaucaugagaa

SEQ ID NO: 84351 - RNA, 22 nt, Human
ucucucugcuguccagcguuau

SEQ ID NO: 84352 - RNA, 22 nt, Human
ucucuacugcuucugugaguga

SEQ ID NO: 84353 - RNA, 17 nt, Human
ucuccuggcucuaucag

SEQ ID NO: 84354 - RNA, 22 nt, Human
ugcuucuuugggggugaagaga

SEQ ID NO: 84355 - RNA, 22 nt, Human
ugcuucuuuaggauguaguuau

SEQ ID NO: 84356 - RNA, 22 nt, Human
ugcuucucucuaggaagacgcu

SEQ ID NO: 84357 - RNA, 22 nt, Human
ucuucacagaugcauauacuuc

SEQ ID NO: 84358 - RNA, 22 nt, Human
ucuucaaauacagucauauuga

SEQ ID NO: 84359 - RNA, 22 nt, Human
uggaucuugaugcuccaagagu

SEQ ID NO: 84360 - RNA, 22 nt, Human
ucuuccucuccuggggcauuug

SEQ ID NO: 84361 - RNA, 22 nt, Human
ucuucuuacauuaaguugaaac

SEQ ID NO: 84362 - RNA, 22 nt, Human
ucuuccaaacaaaaaucugugu

SEQ ID NO: 84363 - RNA, 19 nt, Human
ucuuccaucuauccuccuc

SEQ ID NO: 84364 - RNA, 22 nt, Human
uggcgacuggaauuaaucuuuu

SEQ ID NO: 84365 - RNA, 22 nt, Human
uggcauuuuguagcuguguauc

SEQ ID NO: 84366 - RNA, 22 nt, Human
ucuugcucuguucuaaaggauu

SEQ ID NO: 84367 - RNA, 22 nt, Human
uggaguagaagggcuccuggaa

SEQ ID NO: 84368 - RNA, 22 nt, Human
ucuguaauccacacagguggau

SEQ ID NO: 84369 - RNA, 22 nt, Human
ucuguaguaugguacuuauuua

SEQ ID NO: 84370 - RNA, 22 nt, Human
ucuguauuuuuuacacacaugc

SEQ ID NO: 84371 - RNA, 22 nt, Human
ucuguguguguggcuaaacaag

SEQ ID NO: 84372 - RNA, 22 nt, Human
ucuguuauaaaucacacugcau

SEQ ID NO: 84373 - RNA, 22 nt, Human
ucuggugcacucugauauuuga

SEQ ID NO: 84374 - RNA, 22 nt, Human
ucugcuggugucauuuuugcua

SEQ ID NO: 84375 - RNA, 22 nt, Human
uggaagcuagggguuucuguug

SEQ ID NO: 84376 - RNA, 22 nt, Human
uggaagcuggcugaucugacuu

SEQ ID NO: 84377 - RNA, 22 nt, Human
ucugauucucuuguugaccuag

SEQ ID NO: 84378 - RNA, 22 nt, Human
ugcaugaucucacuuacaggug

SEQ ID NO: 84379 - RNA, 23 nt, Human
ugcaugagcaucuccaccucagu

SEQ ID NO: 84380 - RNA, 22 nt, Human
ugcauguuuuaagugaagcuga

SEQ ID NO: 84381 - RNA, 22 nt, Human
ugucuuucuuucucuugacaga

SEQ ID NO: 84382 - RNA, 22 nt, Human
ugucuuugaccuuaagaaguuu

SEQ ID NO: 84383 - RNA, 22 nt, Human
ugcagagagccagcucucucgg

SEQ ID NO: 84384 - RNA, 22 nt, Human
ugcagaggagcuggaaggcugg

SEQ ID NO: 84385 - RNA, 22 nt, Human
ugcaagugccauggauucaggu

SEQ ID NO: 84386 - RNA, 20 nt, Human
ugucccuggagagcugcaga

SEQ ID NO: 84387 - RNA, 22 nt, Human
ugcaaauuuuuuuauuuuuccu

SEQ ID NO: 84388 - RNA, 22 nt, Human
uguagacaugcuuuucugauga

SEQ ID NO: 84389 - RNA, 22 nt, Human
ugaugaaguuggaaggaaaguu

SEQ ID NO: 84390 - RNA, 22 nt, Human
ugaucuuugcuuuuggcuuagu

SEQ ID NO: 84391 - RNA, 23 nt, Human
uguaaaacaccguuauugcaccu

SEQ ID NO: 84392 - RNA, 22 nt, Human
uguaauguuagaaacaauugcu

SEQ ID NO: 84393 - RNA, 22 nt, Human
ugagugacuguugucaagaugg

SEQ ID NO: 84394 - RNA, 22 nt, Human
uggugcuuuuguggaugcuaac

SEQ ID NO: 84395 - RNA, 19 nt, Human
ugagauuguaugaggagau

SEQ ID NO: 84396 - RNA, 22 nt, Human
ugagauuuagaacuggauuuca

SEQ ID NO: 84397 - RNA, 22 nt, Human
ugagauguaauguaguacuuug

SEQ ID NO: 84398 - RNA, 22 nt, Human
ugagagaauuacuaaagggcuu

SEQ ID NO: 84399 - RNA, 22 nt, Human
ugagaagaggucuuuugggaug

SEQ ID NO: 84400 - RNA, 22 nt, Human
ugagaaauauacaccagacaca

SEQ ID NO: 84401 - RNA, 22 nt, Human
ugaccuuuuuaaauuauuuuua

SEQ ID NO: 84402 - RNA, 22 nt, Human
ucuuuugaacauccaggauguc

SEQ ID NO: 84403 - RNA, 20 nt, Human
uuacugagguauuuuuauca

SEQ ID NO: 84404 - RNA, 22 nt, Human
uggaaaacgcaguuuaauuuuu

SEQ ID NO: 84405 - RNA, 21 nt, Human
ugcuuuuguugucagcugcug

SEQ ID NO: 84406 - RNA, 22 nt, Human
ugcuuuuguaucagaguauuca

SEQ ID NO: 84407 - RNA, 22 nt, Human
uuaccugagcggauuuguugca

SEQ ID NO: 84408 - RNA, 22 nt, Human
uuaccuuuucuuguuuacaagu

SEQ ID NO: 84409 - RNA, 21 nt, Human
ugcuuucugugcuuuuucugc

SEQ ID NO: 84410 - RNA, 22 nt, Human
uggaagaaaacuuggaaggcau

SEQ ID NO: 84411 - RNA, 22 nt, Human
uggaaaugcuuagaggugaucu

SEQ ID NO: 84412 - RNA, 22 nt, Human
uuagaguguguguaguagggug

SEQ ID NO: 84413 - RNA, 22 nt, Human
uuagagagguuggagugguaga

SEQ ID NO: 84414 - RNA, 22 nt, Human
uuagagagaggagagagagaga

SEQ ID NO: 84415 - RNA, 22 nt, Human
uuagagaauagacuuuacccug

SEQ ID NO: 84416 - RNA, 22 nt, Human
uggaaaguuggaagucucagga

SEQ ID NO: 84417 - RNA, 22 nt, Human
uggagagauagucauucuagag

SEQ ID NO: 84418 - RNA, 22 nt, Human
uggagauauucuauauuuuaua

SEQ ID NO: 84419 - RNA, 22 nt, Human
uuaucugcccauuguagaauug

SEQ ID NO: 84420 - RNA, 22 nt, Human
uuaucuguuuuaaugaauaauu

SEQ ID NO: 84421 - RNA, 22 nt, Human
uuauacuucugccagaggacaa

SEQ ID NO: 84422 - RNA, 23 nt, Human
uggaaguugagagucugcuuugu

SEQ ID NO: 84423 - RNA, 22 nt, Human
uggaagaaaugguugagccaug

SEQ ID NO: 84424 - RNA, 23 nt, Human
uggaagaaaaugguuuggcugug

SEQ ID NO: 84425 - RNA, 22 nt, Human
uggaagaagcuacaagcgguga

SEQ ID NO: 84426 - RNA, 22 nt, Human
uuagccuccaguuuucucauuu

SEQ ID NO: 84427 - RNA, 22 nt, Human
ugcuuacgcaaccuguguuugg

SEQ ID NO: 84428 - RNA, 22 nt, Human
uuaauguuuuagaaugagagug

SEQ ID NO: 84429 - RNA, 22 nt, Human
uuaauguugacacacuagcaca

SEQ ID NO: 84430 - RNA, 22 nt, Human
uuaauuguuagauagauuauag

SEQ ID NO: 84431 - RNA, 22 nt, Human
ugcuuggagaaucagucccagc

SEQ ID NO: 84432 - RNA, 22 nt, Human
uuaagagaagaguaucuagaac

SEQ ID NO: 84433 - RNA, 22 nt, Human
uuaaggcuguggggauuacugc

SEQ ID NO: 84434 - RNA, 23 nt, Human
uuaaggugccguguaauucaugc

SEQ ID NO: 84435 - RNA, 22 nt, Human
uuaagggauugagauggaauga

SEQ ID NO: 84436 - RNA, 22 nt, Human
ugcugugagaccauuuguugag

SEQ ID NO: 84437 - RNA, 22 nt, Human
uuaacauuguccuuagcagauu

SEQ ID NO: 84438 - RNA, 22 nt, Human
ugcugggagcugggccucgaca

SEQ ID NO: 84439 - RNA, 22 nt, Human
uuaaaauuguuaacuuugguga

SEQ ID NO: 84440 - RNA, 22 nt, Human
ugcugcuguuaucauuuuacca

SEQ ID NO: 84441 - RNA, 22 nt, Human
ugcugcuguuuccuacaucuca

SEQ ID NO: 84442 - RNA, 23 nt, Human
ugcugcuggaguaucuacaaugc

SEQ ID NO: 84443 - RNA, 22 nt, Human
ugcugcucuucaccauggccuc

SEQ ID NO: 84444 - RNA, 22 nt, Human
uguuuucuauuaccugagauug

SEQ ID NO: 84445 - RNA, 21 nt, Human
uguuugcuuuuggagcaacug

SEQ ID NO: 84446 - RNA, 22 nt, Human
uguuuguaugauggcacaucca

SEQ ID NO: 84447 - RNA, 22 nt, Human
uguuuccuaagugucucugaag

SEQ ID NO: 84448 - RNA, 22 nt, Human
uguuucaguaugauuuucccuc

SEQ ID NO: 84449 - RNA, 22 nt, Human
ugcucuuucaggcauagaccuu

SEQ ID NO: 84450 - RNA, 22 nt, Human
uguuguagacaguucacucgug

SEQ ID NO: 84451 - RNA, 22 nt, Human
ugcucuguuuuaacucuuucaa

SEQ ID NO: 84452 - RNA, 22 nt, Human
uuccuuuucuucuaccacaugu

SEQ ID NO: 84453 - RNA, 21 nt, Human
uuccuggaggcagaaacguga

SEQ ID NO: 84454 - RNA, 21 nt, Human
uuccuaaaaugcuuuugugcc

SEQ ID NO: 84455 - RNA, 22 nt, Human
uuccugaucuuuucccagaguu

SEQ ID NO: 84456 - RNA, 22 nt, Human
uuccucauuuuguuaauuuuac

SEQ ID NO: 84457 - RNA, 22 nt, Human
uuccucauucuggggcauguug

SEQ ID NO: 84458 - RNA, 22 nt, Human
uuccaugccccucuuuggguac

SEQ ID NO: 84459 - RNA, 22 nt, Human
uuaugguuuaauauccagcaca

SEQ ID NO: 84460 - RNA, 22 nt, Human
uuauggauuagaguuugauucu

SEQ ID NO: 84461 - RNA, 22 nt, Human
uuaucuuuuaaaaacacuugug

SEQ ID NO: 84462 - RNA, 22 nt, Human
uucuggaguuugaagaucaggu

SEQ ID NO: 84463 - RNA, 19 nt, Human
uucugguacauacugccug

SEQ ID NO: 84464 - RNA, 17 nt, Human
uucugcucaggaacaga

SEQ ID NO: 84465 - RNA, 19 nt, Human
uucugcucaguaacacccu

SEQ ID NO: 84466 - RNA, 22 nt, Human
ugggugccgcaucuugcuguuc

SEQ ID NO: 84467 - RNA, 22 nt, Human
uucucgaacaaccuacagggug

SEQ ID NO: 84468 - RNA, 22 nt, Human
uucucuauuugcugcaccucuc

SEQ ID NO: 84469 - RNA, 22 nt, Human
uucuauaagagaugaauacagu

SEQ ID NO: 84470 - RNA, 21 nt, Human
uucuauauugagaauuggcua

SEQ ID NO: 84471 - RNA, 22 nt, Human
uucuaggagucugguuccugcc

SEQ ID NO: 84472 - RNA, 22 nt, Human
uucuccugacuggccauucagu

SEQ ID NO: 84473 - RNA, 22 nt, Human
uucuccucuuugucacugcuuu

SEQ ID NO: 84474 - RNA, 22 nt, Human
uucuccucagcaaggcagcuuu

SEQ ID NO: 84475 - RNA, 22 nt, Human
uucuugagaacaaauuccugga

SEQ ID NO: 84476 - RNA, 22 nt, Human
uucuugcgaaagaaugagcuga

SEQ ID NO: 84477 - RNA, 22 nt, Human
uucuugcuuccggugcuccagg

SEQ ID NO: 84478 - RNA, 22 nt, Human
ugguuauggaacuggcuauggc

SEQ ID NO: 84479 - RNA, 20 nt, Human
uucuguggcccguuuaagug

SEQ ID NO: 84480 - RNA, 22 nt, Human
uucuguuuuuauucuaucucug

SEQ ID NO: 84481 - RNA, 22 nt, Human
uucugugacuccucagagauuu

SEQ ID NO: 84482 - RNA, 22 nt, Human
uggugaggacccagauuuuccu

SEQ ID NO: 84483 - RNA, 22 nt, Human
uucuuuuaauuucugucugcag

SEQ ID NO: 84484 - RNA, 22 nt, Human
uugaaaaaauguguuuaaggag

SEQ ID NO: 84485 - RNA, 22 nt, Human
ugguucugccacuuuccccuug

SEQ ID NO: 84486 - RNA, 21 nt, Human
uucuuugcugcuguuuuugua

SEQ ID NO: 84487 - RNA, 22 nt, Human
uguagcucaaggaauuguucuc

SEQ ID NO: 84488 - RNA, 22 nt, Human
uugcaugugugaaaugcacaga

SEQ ID NO: 84489 - RNA, 21 nt, Human
uugauuuagcagaucuagcug

SEQ ID NO: 84490 - RNA, 22 nt, Human
uugauuccagcguuccaucagc

SEQ ID NO: 84491 - RNA, 22 nt, Human
ugucugauccuucaggagcccc

SEQ ID NO: 84492 - RNA, 22 nt, Human
ugucugaauuguaauguugcgu

SEQ ID NO: 84493 - RNA, 22 nt, Human
uugaugagucacuuucuguaaa

SEQ ID NO: 84494 - RNA, 20 nt, Human
uugagccucauggauugucu

SEQ ID NO: 84495 - RNA, 22 nt, Human
uuguuuuaaaaagaauaacuac

SEQ ID NO: 84496 - RNA, 22 nt, Human
uuguuguuguuguuauuuaguu

SEQ ID NO: 84497 - RNA, 22 nt, Human
uuaaagaguuuauuacuuguaa

SEQ ID NO: 84498 - RNA, 22 nt, Human
uuguguuuaaucuguuccacua

SEQ ID NO: 84499 - RNA, 22 nt, Human
uuguguugaagugguuagggcg

SEQ ID NO: 84500 - RNA, 20 nt, Human
uuguuagguucaguguuucc

SEQ ID NO: 84501 - RNA, 22 nt, Human
uuaguccuaaauuuagauuuuc

SEQ ID NO: 84502 - RNA, 22 nt, Human
uuuaugguacaggaaugcuguu

SEQ ID NO: 84503 - RNA, 22 nt, Human
uuuauguuuguuuuugaaauaa

SEQ ID NO: 84504 - RNA, 22 nt, Human
uuaggcuaauagagauggaaug

SEQ ID NO: 84505 - RNA, 22 nt, Human
uuuagugagugugaaucaaaug

SEQ ID NO: 84506 - RNA, 22 nt, Human
uuuagugaagcuuugcauuuca

SEQ ID NO: 84507 - RNA, 22 nt, Human
uuagauaguaaauagcacuaag

SEQ ID NO: 84508 - RNA, 22 nt, Human
uuagaguucaagcuuuaggaaa

SEQ ID NO: 84509 - RNA, 22 nt, Human
uuagaugaaaaucggaacaugu

SEQ ID NO: 84510 - RNA, 22 nt, Human
uuagaaauguccuacuaauaug

SEQ ID NO: 84511 - RNA, 22 nt, Human
uuagaaaaaggcuguggucuua

SEQ ID NO: 84512 - RNA, 22 nt, Human
uuuagagauaaaugcucuccca

SEQ ID NO: 84513 - RNA, 19 nt, Human
uuacaugacauaugaagga

SEQ ID NO: 84514 - RNA, 22 nt, Human
uuacaagaucuuugaaggcaag

SEQ ID NO: 84515 - RNA, 18 nt, Human
uuuaauaagccuguuaug

SEQ ID NO: 84516 - RNA, 22 nt, Human
uuuaaguuaguauggguuaggu

SEQ ID NO: 84517 - RNA, 22 nt, Human
uuacuuucugggauaucaaaug

SEQ ID NO: 84518 - RNA, 22 nt, Human
uuuagaaugaaugcaagagaau

SEQ ID NO: 84519 - RNA, 22 nt, Human
uuacuuaucugaugugauuuuu

SEQ ID NO: 84520 - RNA, 22 nt, Human
uuuacuaauuaguuuuggaaca

SEQ ID NO: 84521 - RNA, 22 nt, Human
uguuuuuagcuguuuuuuggau

SEQ ID NO: 84522 - RNA, 22 nt, Human
uuguggagaggaagcaaggagg

SEQ ID NO: 84523 - RNA, 22 nt, Human
uuaaaagaauccuguuauccuc

SEQ ID NO: 84524 - RNA, 22 nt, Human
uguuuucuuuccccuucuuuuc

SEQ ID NO: 84525 - RNA, 21 nt, Human
uguuuuguaauagauacuaug

SEQ ID NO: 84526 - RNA, 22 nt, Human
uugguuuacucuggggauaucu

SEQ ID NO: 84527 - RNA, 22 nt, Human
uugguugcugaugagcuuugag

SEQ ID NO: 84528 - RNA, 22 nt, Human
uuggucaagacugauaucaaga

SEQ ID NO: 84529 - RNA, 22 nt, Human
uugguauuuguuuaaauuacac

SEQ ID NO: 84530 - RNA, 22 nt, Human
uugggugcugcacccuucaaca

SEQ ID NO: 84531 - RNA, 22 nt, Human
uguuuaagugguuaaaggauuc

SEQ ID NO: 84532 - RNA, 22 nt, Human
uuguaagacuguagaaugcaaa

SEQ ID NO: 84533 - RNA, 22 nt, Human
uugucagcuagugaugcuguuc

SEQ ID NO: 84534 - RNA, 22 nt, Human
uguuauugccucaugagacucc

SEQ ID NO: 84535 - RNA, 22 nt, Human
uuggcuguguugaaaacgugga

SEQ ID NO: 84536 - RNA, 23 nt, Human
uguuccugaugccucguccuguc

SEQ ID NO: 84537 - RNA, 22 nt, Human
uguguucuuugcuuaauuaaag

SEQ ID NO: 84538 - RNA, 22 nt, Human
ugugccuuucacuaugucauuc

SEQ ID NO: 84539 - RNA, 22 nt, Human
uuggaagacagccgucuuuauu

SEQ ID NO: 84540 - RNA, 22 nt, Human
uguguguguauacauguauaua

SEQ ID NO: 84541 - RNA, 17 nt, Human
uguguauucuccaggug

SEQ ID NO: 84542 - RNA, 22 nt, Human
uguguguguguguguaauauau

SEQ ID NO: 84543 - RNA, 22 nt, Human
uguguguuguuuugccagaaua

SEQ ID NO: 84544 - RNA, 22 nt, Human
uuuuaauaguauaucuagacac

SEQ ID NO: 84545 - RNA, 19 nt, Human
uuccucaggugugaguuag

SEQ ID NO: 84546 - RNA, 20 nt, Human
uuccuuaucuguaaagugga

SEQ ID NO: 84547 - RNA, 22 nt, Human
uuccucauuuggcacaucugag

SEQ ID NO: 84548 - RNA, 22 nt, Human
uuuguugucuucauaauacuuu

SEQ ID NO: 84549 - RNA, 22 nt, Human
uuccucauuuauaggaaagaga

SEQ ID NO: 84550 - RNA, 22 nt, Human
uuccucuugaaucugucugacu

SEQ ID NO: 84551 - RNA, 22 nt, Human
uuuuaaaagguugcuguuauaa

SEQ ID NO: 84552 - RNA, 22 nt, Human
uuccugcuggucaaaguugccu

SEQ ID NO: 84553 - RNA, 22 nt, Human
uuccagaacaauguggacguau

SEQ ID NO: 84554 - RNA, 22 nt, Human
uuccaggacuggguguuugaag

SEQ ID NO: 84555 - RNA, 22 nt, Human
uuccacauucggaauuuucuga

SEQ ID NO: 84556 - RNA, 21 nt, Human
uucauucauggcauaauauag

SEQ ID NO: 84557 - RNA, 22 nt, Human
uucauuauuaauaauagcagcu

SEQ ID NO: 84558 - RNA, 22 nt, Human
uucauccucuuuaucuaccugu

SEQ ID NO: 84559 - RNA, 22 nt, Human
uuccauuccauaucagguacag

SEQ ID NO: 84560 - RNA, 19 nt, Human
uuuguuguaucagagcuuu

SEQ ID NO: 84561 - RNA, 22 nt, Human
uuuggcuacucuucauugguga

SEQ ID NO: 84562 - RNA, 22 nt, Human
uuugcuguaaugcaugucagag

SEQ ID NO: 84563 - RNA, 22 nt, Human
uuugcugggaagccuucacucu

SEQ ID NO: 84564 - RNA, 22 nt, Human
uucagcauaggcugcucuucaa

SEQ ID NO: 84565 - RNA, 22 nt, Human
uucagaaagugaaucuuguuau

SEQ ID NO: 84566 - RNA, 22 nt, Human
uucagaagguaggaaugucccu

SEQ ID NO: 84567 - RNA, 22 nt, Human
uuaggggcuuaggcagaguuug

SEQ ID NO: 84568 - RNA, 22 nt, Human
uuuauucuuugcuagguuccau

SEQ ID NO: 84569 - RNA, 22 nt, Human
uuuauucacuuaucaggaacga

SEQ ID NO: 84570 - RNA, 22 nt, Human
uucacaauuuuaaaaaguggaa

SEQ ID NO: 84571 - RNA, 21 nt, Human
uucaaguucacacucaaaggu

SEQ ID NO: 84572 - RNA, 22 nt, Human
uuuuugggccaaauauauuuac

SEQ ID NO: 84573 - RNA, 22 nt, Human
uucuucgacuguauaaaaguau

SEQ ID NO: 84574 - RNA, 22 nt, Human
uucuuccagugaaacgugcauc

SEQ ID NO: 84575 - RNA, 22 nt, Human
uucuuggcacagaugagauucu

SEQ ID NO: 84576 - RNA, 22 nt, Human
uucuugcuucucugucugccuc

SEQ ID NO: 84577 - RNA, 22 nt, Human
uucuuuuaauagagauccugug

SEQ ID NO: 84578 - RNA, 22 nt, Human
uucuuugcucaccugccgcucc

SEQ ID NO: 84579 - RNA, 22 nt, Human
uucuuuguccuagcauucuaca

SEQ ID NO: 84580 - RNA, 22 nt, Human
uucuuucgaacaagagaaguuc

SEQ ID NO: 84581 - RNA, 22 nt, Human
uuuuuggacccaucuucuuuuu

SEQ ID NO: 84582 - RNA, 22 nt, Human
uuuuugcuuuuuugucaucuaa

SEQ ID NO: 84583 - RNA, 22 nt, Human
uuuucuaggcccuggauuaugu

SEQ ID NO: 84584 - RNA, 18 nt, Human
uucucucuggauaguagu

SEQ ID NO: 84585 - RNA, 22 nt, Human
uuuucucaguuuuuuucaaaag

SEQ ID NO: 84586 - RNA, 22 nt, Human
uuuucuugagucacuccaguga

SEQ ID NO: 84587 - RNA, 22 nt, Human
uuuuauaauacccuugacuaau

SEQ ID NO: 84588 - RNA, 22 nt, Human
uucuagacaauugaaaacuguu

SEQ ID NO: 84589 - RNA, 22 nt, Human
uuuucaguuccaucucugcucu

SEQ ID NO: 84590 - RNA, 22 nt, Human
uucuaguuacucuuaaaugcug

SEQ ID NO: 84591 - RNA, 22 nt, Human
uuuuccuuccugucucuuuauu

SEQ ID NO: 84592 - RNA, 22 nt, Human
uuuuagagacagcauggagaaa

SEQ ID NO: 84593 - RNA, 22 nt, Human
uuggggaggaagauagggugaa

SEQ ID NO: 84594 - RNA, 22 nt, Human
uuguaaguuuuagguguuucaa

SEQ ID NO: 84595 - RNA, 22 nt, Human
uugguuuuuugguguaucuuau

SEQ ID NO: 84596 - RNA, 22 nt, Human
uugugaggaugugcuuuuuagu

SEQ ID NO: 84597 - RNA, 22 nt, Human
uuguauuguuugcgucuguguu

SEQ ID NO: 84598 - RNA, 22 nt, Human
uugucaugauccuucuguuagg

SEQ ID NO: 84599 - RNA, 22 nt, Human
uugggagagaaaccuaaugccu

SEQ ID NO: 84600 - RNA, 22 nt, Human
uugggcauuucuuauguauuuu

SEQ ID NO: 84601 - RNA, 22 nt, Human
uugggagaaauaguugauccgc

SEQ ID NO: 84602 - RNA, 18 nt, Human
uucuagaggucucaucca

SEQ ID NO: 84603 - RNA, 20 nt, Human
uuggagaucacguguccagg

SEQ ID NO: 84604 - RNA, 22 nt, Human
uuggaguucuucaugcucugua

SEQ ID NO: 84605 - RNA, 22 nt, Human
uuuagcaaggagaaauaauccu

SEQ ID NO: 84606 - RNA, 18 nt, Human
uuuacgaacucacuugag

SEQ ID NO: 84607 - RNA, 22 nt, Human
uuuaggaauuugcugggcauga

SEQ ID NO: 84608 - RNA, 22 nt, Human
uuguuccuaguuguccaucaca

SEQ ID NO: 84609 - RNA, 22 nt, Human
uuguuauuauuauuuucguucu

SEQ ID NO: 84610 - RNA, 22 nt, Human
uuguuuaaagaacuucugacuu

SEQ ID NO: 84611 - RNA, 22 nt, Human
uuuaugauguagccuagagcug

SEQ ID NO: 84612 - RNA, 22 nt, Human
uuuauguugagcaaaauaccac

SEQ ID NO: 84613 - RNA, 22 nt, Human
uuuauaauuacguaaaauauuu

SEQ ID NO: 84614 - RNA, 22 nt, Human
uuuauaauuguuauguuaccca

SEQ ID NO: 84615 - RNA, 22 nt, Human
uuuauaagccagacacugcguu

SEQ ID NO: 84616 - RNA, 22 nt, Human
uuuaguugcuuuaguugagcug

SEQ ID NO: 84617 - RNA, 19 nt, Human
uuucacaaagagagcguga

SEQ ID NO: 84618 - RNA, 22 nt, Human
uuuauuuuccaugucucuaggu

SEQ ID NO: 84619 - RNA, 22 nt, Human
uuucacuucgaucagaguuuuu

SEQ ID NO: 84620 - RNA, 22 nt, Human
uuuggaggaaugaguuuaauau

SEQ ID NO: 84621 - RNA, 22 nt, Human
uuugcuuugacuuugggaguau

SEQ ID NO: 84622 - RNA, 22 nt, Human
uuugcuguccaauauucagggu

SEQ ID NO: 84623 - RNA, 22 nt, Human
uuuggaugcugucauaugcugc

SEQ ID NO: 84624 - RNA, 22 nt, Human
uuuguacuuucuaauguauuua

SEQ ID NO: 84625 - RNA, 23 nt, Human
uuugucaucccucucacuuucug

SEQ ID NO: 84626 - RNA, 22 nt, Human
uuugaagaccuuaucucuaaau

SEQ ID NO: 84627 - RNA, 22 nt, Human
uuugagaagauaggggaauacu

SEQ ID NO: 84628 - RNA, 22 nt, Human
uuugaugauuuucuagagugua

SEQ ID NO: 84629 - RNA, 23 nt, Human
uuucugaguuuuuuaaaagucca

SEQ ID NO: 84630 - RNA, 22 nt, Human
uuucuggacuaaagggagagau

SEQ ID NO: 84631 - RNA, 22 nt, Human
uuucucuuucaaucugcaguac

SEQ ID NO: 84632 - RNA, 22 nt, Human
uuucucuuguauuugaaucacu

SEQ ID NO: 84633 - RNA, 22 nt, Human
uuucuuccuucuugaucauuug

SEQ ID NO: 84634 - RNA, 22 nt, Human
uuucuuaaaagcuuuuaaaguu

SEQ ID NO: 84635 - RNA, 22 nt, Human
uuucugguuuuauucugggguu

SEQ ID NO: 84636 - RNA, 22 nt, Human
uuucuugggaaaugucagaagu

SEQ ID NO: 84637 - RNA, 22 nt, Human
uuucagagaaagcccaaagacu

SEQ ID NO: 84638 - RNA, 22 nt, Human
uuucaugauuaacuuagugaau

SEQ ID NO: 84639 - RNA, 22 nt, Human
uuucagguggaaguuuuagaug

SEQ ID NO: 84640 - RNA, 22 nt, Human
uuucagauuauguucauggguu

SEQ ID NO: 84641 - RNA, 22 nt, Human
uuucuaaguuugaggcgaagca

SEQ ID NO: 84642 - RNA, 22 nt, Human
uuucuaaaauuacugcagucgg

SEQ ID NO: 84643 - RNA, 22 nt, Human
uuuccugcagacaguuuaagca

SEQ ID NO: 84644 - RNA, 22 nt, Human
ggggcaucguugauugcauggu

SEQ ID NO: 84645 - RNA, 22 nt, Human
uccuuuauuuaugggcagugua

SEQ ID NO: 84646 - RNA, 22 nt, Human
uuggugauguagcagcaauugu

SEQ ID NO: 84647 - RNA, 22 nt, Human
ggcugggagguggcgaggaggc

SEQ ID NO: 84648 - RNA, 22 nt, Human
uuucucuuguauuugaaucacu

SEQ ID NO: 84649 - RNA, 22 nt, Human
ucuuugcugacacuuacacugu

SEQ ID NO: 84650 - RNA, 22 nt, Human
acgugugugugcacguguguau

SEQ ID NO: 84651 - RNA, 22 nt, Human
uucaugucuuugauucugauaa

SEQ ID NO: 84652 - RNA, 22 nt, Human
guacauauccuuuacguuuugu

SEQ ID NO: 84653 - RNA, 22 nt, Human
gugauggucgagcgcuuguugu

SEQ ID NO: 84654 - RNA, 22 nt, Human
caauaccucuuggugauugggc

SEQ ID NO: 84655 - RNA, 22 nt, Human
uuucacuucgaucagaguuuuu

SEQ ID NO: 84656 - RNA, 21 nt, Human
uggcaggcagcuggaagcuug

SEQ ID NO: 84657 - RNA, 22 nt, Human
acauuccugaagguaaugagaa

SEQ ID NO: 84658 - RNA, 22 nt, Human
uggguucaaauccugguuccac

SEQ ID NO: 84659 - RNA, 22 nt, Human
ucccugcugggcgaucuucucu

SEQ ID NO: 84660 - RNA, 22 nt, Human
agugagaguauuaaugugaacu

SEQ ID NO: 84661 - RNA, 22 nt, Human
uuuuguuacugauuauuaaaau

SEQ ID NO: 84662 - RNA, 22 nt, Human
agggcugggcuuggcaggcugg

SEQ ID NO: 84663 - RNA, 22 nt, Human
ucucugaccuccaccccaggag

SEQ ID NO: 84664 - RNA, 22 nt, Human
gcuguugugaggaucagcauau

SEQ ID NO: 84665 - RNA, 22 nt, Human
guugcuaugaaauuaaaauuua

SEQ ID NO: 84666 - RNA, 19 nt, Human
gauauugagcugagaauuc

SEQ ID NO: 84667 - RNA, 22 nt, Human
cauaaauuuuaccuuguaagug

SEQ ID NO: 84668 - RNA, 22 nt, Human
cuguguguauaauguuugauaa

SEQ ID NO: 84669 - RNA, 22 nt, Human
gaggaggcuggagaggccagga

SEQ ID NO: 84670 - RNA, 22 nt, Human
uggggcuccuccuggcaggagg

SEQ ID NO: 84671 - RNA, 22 nt, Human
uuucuugugauuuugaugaacu

SEQ ID NO: 84672 - RNA, 23 nt, Human
aggcugcagaagaauagggucau

SEQ ID NO: 84673 - RNA, 22 nt, Human
agcaaggguugguuuucugaca

SEQ ID NO: 84674 - RNA, 22 nt, Human
ucacuuccuugcagcuguagaa

SEQ ID NO: 84675 - RNA, 22 nt, Human
ucuugugguggaucccucauuu

SEQ ID NO: 84676 - RNA, 22 nt, Human
cuccugcuuuuucuucuuccga

SEQ ID NO: 84677 - RNA, 22 nt, Human
uagggaggguuugggguggagg

SEQ ID NO: 84678 - RNA, 22 nt, Human
caguggacacuuccucuacaau

SEQ ID NO: 84679 - RNA, 22 nt, Human
uuguuguuguuguuauuuaguu

SEQ ID NO: 84680 - RNA, 22 nt, Human
aggggcugagaguuugaugugg

SEQ ID NO: 84681 - RNA, 22 nt, Human
gaggagggagcuggaagcucuu

SEQ ID NO: 84682 - RNA, 22 nt, Human
auaguugcugucauuauuugag

SEQ ID NO: 84683 - RNA, 22 nt, Human
uuuugcuucuaguauauuuuuu

SEQ ID NO: 84684 - RNA, 22 nt, Human
uauuaaaagagaaaaagccacc

SEQ ID NO: 84685 - RNA, 22 nt, Human
gucacuuugcuugcgaugcucc

SEQ ID NO: 84686 - RNA, 22 nt, Human
agcgcucauuuuccuccugcuc

SEQ ID NO: 84687 - RNA, 22 nt, Human
ugguugauuaauuuugccaagc

SEQ ID NO: 84688 - RNA, 22 nt, Human
uuuauaauuacguaaaauauuu

SEQ ID NO: 84689 - RNA, 22 nt, Human
ggcucccccauggcugacagac

SEQ ID NO: 84690 - RNA, 20 nt, Human
uucucugcagcaggcggccc

SEQ ID NO: 84691 - RNA, 22 nt, Human
gaggccagcacccagaugcaug

SEQ ID NO: 84692 - RNA, 22 nt, Human
cauggcaggugcagauucugug

SEQ ID NO: 84693 - RNA, 22 nt, Human
ggggaggguuuggaugagaguc

SEQ ID NO: 84694 - RNA, 22 nt, Human
gggggcagguuccaggccagcu

SEQ ID NO: 84695 - RNA, 22 nt, Human
gggagccucccacugggggaag

SEQ ID NO: 84696 - RNA, 22 nt, Human
ggcagggagagcgccgccaugc

SEQ ID NO: 84697 - RNA, 22 nt, Human
gcuguggaaaaugggucuccaa

SEQ ID NO: 84698 - RNA, 22 nt, Human
gaggagcugggucagggagaca

SEQ ID NO: 84699 - RNA, 22 nt, Human
aggggaggggaguaucaggauu

SEQ ID NO: 84700 - RNA, 22 nt, Human
aagaacuagauagugguguaaa

SEQ ID NO: 84701 - RNA, 22 nt, Human
cuggaagcgucggaggaagggc

SEQ ID NO: 84702 - RNA, 22 nt, Human
cugggggacagagagaggcggu

SEQ ID NO: 84703 - RNA, 22 nt, Human
ggaggcccagaaggaagcccag

SEQ ID NO: 84704 - RNA, 19 nt, Human
agcaucuccacagaaaaag

SEQ ID NO: 84705 - RNA, 22 nt, Human
uuuucaaucaaguuuauuuaua

SEQ ID NO: 84706 - RNA, 18 nt, Human
ggccucagccuggccgga

SEQ ID NO: 84707 - RNA, 22 nt, Human
ugugaagaauuaaugugaauca

SEQ ID NO: 84708 - RNA, 22 nt, Human
auguguguaugacugaaucuau

SEQ ID NO: 84709 - RNA, 22 nt, Human
ggaggaugaggguggugguguu

SEQ ID NO: 84710 - RNA, 22 nt, Human
gcccagccucagggcaucagcu

SEQ ID NO: 84711 - RNA, 17 nt, Human
ucuguguccgcucaguc

SEQ ID NO: 84712 - RNA, 22 nt, Human
cucacugucagcugcagggcuu

SEQ ID NO: 84713 - RNA, 22 nt, Human
uggagccuugugagaccacaau

SEQ ID NO: 84714 - RNA, 21 nt, Human
agaugaggauacugaggccua

SEQ ID NO: 84715 - RNA, 22 nt, Human
cuguuaauugugaauuuuacau

SEQ ID NO: 84716 - RNA, 22 nt, Human
agauuuucuuuuccaucuuugu

SEQ ID NO: 84717 - RNA, 22 nt, Human
uucugcuuuaaagcucauguuu

SEQ ID NO: 84718 - RNA, 20 nt, Human
cuggaguguagcaguggcug

SEQ ID NO: 84719 - RNA, 22 nt, Human
ggaggaagagaccagggggcuu

SEQ ID NO: 84720 - RNA, 22 nt, Human
ccagcaggagacuagcaacaua

SEQ ID NO: 84721 - RNA, 22 nt, Human
ucuuucugaugggaagggucaa

SEQ ID NO: 84722 - RNA, 20 nt, Human
uucacagaggacucagguca

SEQ ID NO: 84723 - RNA, 22 nt, Human
agcaagggucucucauggcuug

SEQ ID NO: 84724 - RNA, 22 nt, Human
uguuuucuuuccccuucuuuuc

SEQ ID NO: 84725 - RNA, 22 nt, Human
augcuuucucuucuauuucuca

SEQ ID NO: 84726 - RNA, 22 nt, Human
agugccaucuuuaacuguccca

SEQ ID NO: 84727 - RNA, 22 nt, Human
gagggugguggcggccggcacc

SEQ ID NO: 84728 - RNA, 22 nt, Human
gcuugcuuuguaaauaucugug

SEQ ID NO: 84729 - RNA, 22 nt, Human
caagaaaaaacaugaugagugu

SEQ ID NO: 84730 - RNA, 22 nt, Human
agggcugcugcuccgggcccag

SEQ ID NO: 84731 - RNA, 22 nt, Human
cacauuuuccagaagaaucaga

SEQ ID NO: 84732 - RNA, 22 nt, Human
ggagugaguauguucugaugca

SEQ ID NO: 84733 - RNA, 22 nt, Human
agggcaguuuuacugaaaggug

SEQ ID NO: 84734 - RNA, 22 nt, Human
auggaguguggccaggcaguaa

SEQ ID NO: 84735 - RNA, 22 nt, Human
auuuuuuuggucauaugagaua

SEQ ID NO: 84736 - RNA, 22 nt, Human
cagggcagaguuaagaugcugg

SEQ ID NO: 84737 - RNA, 22 nt, Human
uggaugccuugggggaggagga

SEQ ID NO: 84738 - RNA, 22 nt, Human
uuuaauauuacacuuaccuugu

SEQ ID NO: 84739 - RNA, 22 nt, Human
ggcucagaggagcuggaacggu

SEQ ID NO: 84740 - RNA, 22 nt, Human
aagagaggcccaaguggcuggc

SEQ ID NO: 84741 - RNA, 22 nt, Human
ggacauaguugcuauggagagu

SEQ ID NO: 84742 - RNA, 22 nt, Human
aaggugggacugagaggggaca

SEQ ID NO: 84743 - RNA, 22 nt, Human
uaggauugguguauguagguuu

SEQ ID NO: 84744 - RNA, 22 nt, Human
ccauuuggccauucaguuguuc

SEQ ID NO: 84745 - RNA, 22 nt, Human
uacaagcucuuguagggggaaa

SEQ ID NO: 84746 - RNA, 22 nt, Human
uggcagccugcgugaaggagcu

SEQ ID NO: 84747 - RNA, 22 nt, Human
ucagucucuggggcuucuguuu

SEQ ID NO: 84748 - RNA, 22 nt, Human
gcagagcugucuaagucacuuc

SEQ ID NO: 84749 - RNA, 22 nt, Human
gagggagugggcccgugggcac

SEQ ID NO: 84750 - RNA, 22 nt, Human
agggaggagggacagaaagagg

SEQ ID NO: 84751 - RNA, 22 nt, Human
gggauggggagcuggaaagggg

SEQ ID NO: 84752 - RNA, 22 nt, Human
gaauucuaguucuguaucucug

SEQ ID NO: 84753 - RNA, 22 nt, Human
ccagaugggggcugugggaggg

SEQ ID NO: 84754 - RNA, 21 nt, Human
aaguuucucccuaauuguugc

SEQ ID NO: 84755 - RNA, 22 nt, Human
caggccccagggacugggcgcu

SEQ ID NO: 84756 - RNA, 22 nt, Human
aagaaggaaggcaagagauggg

SEQ ID NO: 84757 - RNA, 22 nt, Human
acauaaaccccccuuccccagg

SEQ ID NO: 84758 - RNA, 22 nt, Human
uggaagugggcaucaccaucca

SEQ ID NO: 84759 - RNA, 22 nt, Human
gcugucccccaaagaugcuccu

SEQ ID NO: 84760 - RNA, 22 nt, Human
gaggggaacaggcauucuuaag

SEQ ID NO: 84761 - RNA, 22 nt, Human
ccaggcucaccuggagccccug

SEQ ID NO: 84762 - RNA, 22 nt, Human
gggagggucugagagcugcacc

SEQ ID NO: 84763 - RNA, 22 nt, Human
ugagggaguguggauacaguag

SEQ ID NO: 84764 - RNA, 22 nt, Human
aaauauuaaugaugaagguagu

SEQ ID NO: 84765 - RNA, 22 nt, Human
aguuaggaaauaaguugaguuu

SEQ ID NO: 84766 - RNA, 22 nt, Human
aguugggaaaugcugcaguagu

SEQ ID NO: 84767 - RNA, 22 nt, Human
gcaggggguaaggggcagggcu

SEQ ID NO: 84768 - RNA, 22 nt, Human
ccaaggcuguggggcugugcag

SEQ ID NO: 84769 - RNA, 22 nt, Human
uggccccauuuuucuggagccu

SEQ ID NO: 84770 - RNA, 22 nt, Human
cugcugugcagacagacucucu

SEQ ID NO: 84771 - RNA, 22 nt, Human
cagaccagaaggaagccgacaa

SEQ ID NO: 84772 - RNA, 22 nt, Human
gcuguggagaagcugccuaugg

SEQ ID NO: 84773 - RNA, 22 nt, Human
uuuguacuuucuaauguauuua

SEQ ID NO: 84774 - RNA, 22 nt, Human
guguucuuuguagaggaucuug

SEQ ID NO: 84775 - RNA, 22 nt, Human
gccucucuggcaaagcggugau

SEQ ID NO: 84776 - RNA, 22 nt, Human
auagaaauagacaaugcaaaga

SEQ ID NO: 84777 - RNA, 23 nt, Human
uccuccccaccuuuguccccucc

SEQ ID NO: 84778 - RNA, 22 nt, Human
cagcuggggagagacauggcag

SEQ ID NO: 84779 - RNA, 22 nt, Human
agggcucacuacaacccuggga

SEQ ID NO: 84780 - RNA, 22 nt, Human
uggggcauacgugaaauaauuu

SEQ ID NO: 84781 - RNA, 22 nt, Human
gcagaggcugccgugggcagga

SEQ ID NO: 84782 - RNA, 22 nt, Human
gggggcugugugcccgcucccc

SEQ ID NO: 84783 - RNA, 22 nt, Human
aaugagaauguaagugaagaga

SEQ ID NO: 84784 - RNA, 22 nt, Human
gccagggcucgagcaggccagc

SEQ ID NO: 84785 - RNA, 22 nt, Human
ucccuguggauuaaggagaugu

SEQ ID NO: 84786 - RNA, 22 nt, Human
gcuguggacacagcucucuuca

SEQ ID NO: 84787 - RNA, 22 nt, Human
uguaaauucuauacacuuaaaa

SEQ ID NO: 84788 - RNA, 22 nt, Human
ccagcugggucccugcuggggc

SEQ ID NO: 84789 - RNA, 22 nt, Human
aggauggaaguaacuggauaau

SEQ ID NO: 84790 - RNA, 22 nt, Human
uuuauguuuguuuuugaaauaa

SEQ ID NO: 84791 - RNA, 22 nt, Human
gugguuuagccuucauuaaccu

SEQ ID NO: 84792 - RNA, 23 nt, Human
aaggugaagccaccaggugagga

SEQ ID NO: 84793 - RNA, 22 nt, Human
gaggcaggaagggaggguugug

SEQ ID NO: 84794 - RNA, 22 nt, Human
cuuuuuaaaguaaauggcuaga

SEQ ID NO: 84795 - RNA, 22 nt, Human
aggggcugugucauuuguccua

SEQ ID NO: 84796 - RNA, 22 nt, Human
aggauggauagcaaggaagccg

SEQ ID NO: 84797 - RNA, 22 nt, Human
acucacuguuuugaaauugaac

SEQ ID NO: 84798 - RNA, 18 nt, Human
ggagaagaacagaugugg

SEQ ID NO: 84799 - RNA, 21 nt, Human
gggagugaguaaugauggggg

SEQ ID NO: 84800 - RNA, 22 nt, Human
auuugcuuguucaccaguacuu

SEQ ID NO: 84801 - RNA, 22 nt, Human
auauucaaugaggucauauaag

SEQ ID NO: 84802 - RNA, 22 nt, Human
agauggaggaaagcaguuagaa

SEQ ID NO: 84803 - RNA, 22 nt, Human
gagccucaggguuuuguugaca

SEQ ID NO: 84804 - RNA, 22 nt, Human
cguuuugaguagauagccauau

SEQ ID NO: 84805 - RNA, 22 nt, Human
uggcucaggccuacgacgccuu

SEQ ID NO: 84806 - RNA, 22 nt, Human
ugggcagggauuuggggaaacu

SEQ ID NO: 84807 - RNA, 22 nt, Human
agucacuguucugucaugucaa

SEQ ID NO: 84808 - RNA, 22 nt, Human
auuagugguguauuuggcacua

SEQ ID NO: 84809 - RNA, 22 nt, Human
auauugcuuuauucuugaauau

SEQ ID NO: 84810 - RNA, 22 nt, Human
ucucucugcuguccagcguuau

SEQ ID NO: 84811 - RNA, 22 nt, Human
cccagaggcugaguugggagca

SEQ ID NO: 84812 - RNA, 22 nt, Human
ugaaguuuagaaaaagugccuu

SEQ ID NO: 84813 - RNA, 22 nt, Human
gagcagcugagcuggaaugaga

SEQ ID NO: 84814 - RNA, 22 nt, Human
uacauaauagcaaggugcuguc

SEQ ID NO: 84815 - RNA, 22 nt, Human
agagggagagauuggcaaucag

SEQ ID NO: 84816 - RNA, 22 nt, Human
gccugggguuugcggggcugca

SEQ ID NO: 84817 - RNA, 22 nt, Human
agucccugauggacuggaugag

SEQ ID NO: 84818 - RNA, 22 nt, Human
ggaaggggagcuggaaagggua

SEQ ID NO: 84819 - RNA, 22 nt, Human
auaaaaauguuuuuguguggua

SEQ ID NO: 84820 - RNA, 21 nt, Human
gggagaguagcgguagggagg

SEQ ID NO: 84821 - RNA, 18 nt, Human
auucauuugcguuuggcu

SEQ ID NO: 84822 - RNA, 22 nt, Human
aucucacuucugucauguggca

SEQ ID NO: 84823 - RNA, 22 nt, Human
uggggcuggccaggaggagucu

SEQ ID NO: 84824 - RNA, 22 nt, Human
uuauauuuuauuuaauuaaaua

SEQ ID NO: 84825 - RNA, 22 nt, Human
uucacauucauuucuuauguuu

SEQ ID NO: 84826 - RNA, 22 nt, Human
uguugaaacagcuauugacuuu

SEQ ID NO: 84827 - RNA, 22 nt, Human
aagccucaugccagauccaggu

SEQ ID NO: 84828 - RNA, 22 nt, Human
ugaggaagugguuguaugguuu

SEQ ID NO: 84829 - RNA, 22 nt, Human
cagagagcguccauccggugcc

SEQ ID NO: 84830 - RNA, 22 nt, Human
agggcaguuaugaaugucucca

SEQ ID NO: 84831 - RNA, 22 nt, Human
ugagggaggggaaugugugcag

SEQ ID NO: 84832 - RNA, 23 nt, Human
uugcuuuugccccaaaagaguua

SEQ ID NO: 84833 - RNA, 22 nt, Human
cagggggacuuguuagguuuua

SEQ ID NO: 84834 - RNA, 20 nt, Human
uuggagaucacguguccagg

SEQ ID NO: 84835 - RNA, 22 nt, Human
cucuguguguuugugugugugu

SEQ ID NO: 84836 - RNA, 22 nt, Human
ggacggggagcuggaaagggga

SEQ ID NO: 84837 - RNA, 22 nt, Human
aucuguuccccuaugcucucua

SEQ ID NO: 84838 - RNA, 22 nt, Human
cagcucugcugggaggaugcag

SEQ ID NO: 84839 - RNA, 22 nt, Human
aguaggauguuuagcccuucuu

SEQ ID NO: 84840 - RNA, 22 nt, Human
uuuacuauuaguauuucauuuu

SEQ ID NO: 84841 - RNA, 21 nt, Human
aggugaaggcgagggggacag

SEQ ID NO: 84842 - RNA, 21 nt, Human
ugcuuucugugcuuuuucugc

SEQ ID NO: 84843 - RNA, 20 nt, Human
uaguggaccuugaaggccuc

SEQ ID NO: 84844 - RNA, 22 nt, Human
ucacuguuucaccgucugaagg

SEQ ID NO: 84845 - RNA, 22 nt, Human
agaucugucaccauccuggagc

SEQ ID NO: 84846 - RNA, 22 nt, Human
gaauuagguaauagaacuagua

SEQ ID NO: 84847 - RNA, 22 nt, Human
agcagggagacagugcagcauu

SEQ ID NO: 84848 - RNA, 22 nt, Human
ugcuuuauucgacaucugguag

SEQ ID NO: 84849 - RNA, 22 nt, Human
agagacaggguuuugucguguu

SEQ ID NO: 84850 - RNA, 22 nt, Human
uuuuaggauuugaguugcugga

SEQ ID NO: 84851 - RNA, 22 nt, Human
uaucugcuggagguaauuacuc

SEQ ID NO: 84852 - RNA, 22 nt, Human
augggagggagcagugaguguu

SEQ ID NO: 84853 - RNA, 22 nt, Human
gugaaauuguacacucaguacc

SEQ ID NO: 84854 - RNA, 22 nt, Human
auguuuaauuugaaauuuuauu

SEQ ID NO: 84855 - RNA, 22 nt, Human
ccuccuuuccuguuuuccugag

SEQ ID NO: 84856 - RNA, 22 nt, Human
cugucucugauaagcucgaggg

SEQ ID NO: 84857 - RNA, 22 nt, Human
cuaaaccaauauauuuucuucc

SEQ ID NO: 84858 - RNA, 22 nt, Human
gcuguguaugaugcaggcaccu

SEQ ID NO: 84859 - RNA, 22 nt, Human
auaucuuguuuuugauuucuug

SEQ ID NO: 84860 - RNA, 22 nt, Human
uuuuaauaguauaucuagacac

SEQ ID NO: 84861 - RNA, 20 nt, Human
ucacuguaauugccuacauu

SEQ ID NO: 84862 - RNA, 22 nt, Human
cucuuucauucuguccuuguuu

SEQ ID NO: 84863 - RNA, 22 nt, Human
agcuuucuauauaugaguugcu

SEQ ID NO: 84864 - RNA, 22 nt, Human
ggggcucauuugcaggggggag

SEQ ID NO: 84865 - RNA, 22 nt, Human
uuugaagaaacagucuuaagag

SEQ ID NO: 84866 - RNA, 22 nt, Human
ggcaaggaagaaagcagaaguu

SEQ ID NO: 84867 - RNA, 22 nt, Human
cuccuugguuccggcguuggag

SEQ ID NO: 84868 - RNA, 22 nt, Human
guguugaugugucuguauucua

SEQ ID NO: 84869 - RNA, 22 nt, Human
ccaggcuccccaggaggcccuu

SEQ ID NO: 84870 - RNA, 22 nt, Human
uuuuuaagguuuguuuauauau

SEQ ID NO: 84871 - RNA, 22 nt, Human
gcucagcuggagagggacgggu

SEQ ID NO: 84872 - RNA, 21 nt, Human
acugggcuagccugacuucug

SEQ ID NO: 84873 - RNA, 22 nt, Human
cuacuucucccuagaucagaaa

SEQ ID NO: 84874 - RNA, 22 nt, Human
agugaggggagaaugaggugga

SEQ ID NO: 84875 - RNA, 20 nt, Human
ggcagagcuaugucuguugc

SEQ ID NO: 84876 - RNA, 20 nt, Human
ucagugggaaagugagagug

SEQ ID NO: 84877 - RNA, 22 nt, Human
cagguggauggcgagcccugca

SEQ ID NO: 84878 - RNA, 22 nt, Human
cugccucucaugccugcuugcu

SEQ ID NO: 84879 - RNA, 22 nt, Human
ggaggccagagaagagccaggc

SEQ ID NO: 84880 - RNA, 22 nt, Human
uuccgcuuucaauggcuuggcu

SEQ ID NO: 84881 - RNA, 22 nt, Human
uugcuuucuuuguagguuuucc

SEQ ID NO: 84882 - RNA, 22 nt, Human
acucugcaguaaggaauuguuu

SEQ ID NO: 84883 - RNA, 22 nt, Human
gucucacuucauuuucuuagcc

SEQ ID NO: 84884 - RNA, 22 nt, Human
gguuuucacgauccucccuuuu

SEQ ID NO: 84885 - RNA, 20 nt, Human
gacaugagggagcaaagagc

SEQ ID NO: 84886 - RNA, 22 nt, Human
uguguuguuuggggauguccau

SEQ ID NO: 84887 - RNA, 22 nt, Human
uguuuagcucugacuaugugau

SEQ ID NO: 84888 - RNA, 22 nt, Human
ugcccacuucaaaaucuucauu

SEQ ID NO: 84889 - RNA, 22 nt, Human
aaagggagauaaaguaauuuua

SEQ ID NO: 84890 - RNA, 22 nt, Human
augggagggugaggaggcagcu

SEQ ID NO: 84891 - RNA, 22 nt, Human
cagcuguggagauggggugcau

SEQ ID NO: 84892 - RNA, 22 nt, Human
ggcugugguggacgcgggaaac

SEQ ID NO: 84893 - RNA, 22 nt, Human
auggauggaagcagccugaacu

SEQ ID NO: 84894 - RNA, 22 nt, Human
ggcuguggcagcuggaaguggu

SEQ ID NO: 84895 - RNA, 22 nt, Human
uguguuguuggggauguuuuca

SEQ ID NO: 84896 - RNA, 22 nt, Human
guggguauauauaugugugcug

SEQ ID NO: 84897 - RNA, 22 nt, Human
ggcugcagggaacaggaugggu

SEQ ID NO: 84898 - RNA, 22 nt, Human
agagacuguaaugagagguaca

SEQ ID NO: 84899 - RNA, 22 nt, Human
auucuuuagaguccuucaaaua

SEQ ID NO: 84900 - RNA, 22 nt, Human
uacugcaguuccugcugucucc

SEQ ID NO: 84901 - RNA, 22 nt, Human
uuauuuaaguauuuauugaagu

SEQ ID NO: 84902 - RNA, 22 nt, Human
aggggaggcugcgggcugccgu

SEQ ID NO: 84903 - RNA, 22 nt, Human
ugccagcuccgaggagcugcag

SEQ ID NO: 84904 - RNA, 22 nt, Human
cauggcggcgcucucccugccu

SEQ ID NO: 84905 - RNA, 22 nt, Human
acugucuuguuguaugugagcu

SEQ ID NO: 84906 - RNA, 22 nt, Human
uaagggagcagaagcugugaaa

SEQ ID NO: 84907 - RNA, 18 nt, Human
guucaagcauuuugcucu

SEQ ID NO: 84908 - RNA, 22 nt, Human
gggcugagagcuggaaucugag

SEQ ID NO: 84909 - RNA, 22 nt, Human
ggugaguagaaguaguuggcuu

SEQ ID NO: 84910 - RNA, 22 nt, Human
uaucauuuuacugugacauuuu

SEQ ID NO: 84911 - RNA, 22 nt, Human
gggggagcuacaggucccuugg

SEQ ID NO: 84912 - RNA, 22 nt, Human
uucauggauuugugaaauuuag

SEQ ID NO: 84913 - RNA, 23 nt, Human
ucugccuccuaauuguugguguc

SEQ ID NO: 84914 - RNA, 22 nt, Human
ggagacagauggcgucucaguu

SEQ ID NO: 84915 - RNA, 22 nt, Human
ccagggcuggaggaggucagga

SEQ ID NO: 84916 - RNA, 22 nt, Human
ucagcucucucuuggugaucuc

SEQ ID NO: 84917 - RNA, 22 nt, Human
uugcuuuuugggguuuacuggg

SEQ ID NO: 84918 - RNA, 22 nt, Human
gagggaggugacaaggacauag

SEQ ID NO: 84919 - RNA, 22 nt, Human
uggguauauauguugcuacaga

SEQ ID NO: 84920 - RNA, 22 nt, Human
cuucuuucuuuucuucuucucu

SEQ ID NO: 84921 - RNA, 22 nt, Human
gucuugugaagacggcagaaag

SEQ ID NO: 84922 - RNA, 22 nt, Human
guggaaggaauuaacagacuag

SEQ ID NO: 84923 - RNA, 22 nt, Human
ggagagcuagugagcuggaggu

SEQ ID NO: 84924 - RNA, 22 nt, Human
ucaguggaacacacagaguggg

SEQ ID NO: 84925 - RNA, 23 nt, Human
ucagaccaaccucuugcuggaac

SEQ ID NO: 84926 - RNA, 22 nt, Human
cauuuugguaauguucguuugc

SEQ ID NO: 84927 - RNA, 20 nt, Human
ugccagagagcucauacccu

SEQ ID NO: 84928 - RNA, 22 nt, Human
uccucccugcacucagugaagu

SEQ ID NO: 84929 - RNA, 22 nt, Human
uuuuuaaaagaugauuuaauga

SEQ ID NO: 84930 - RNA, 22 nt, Human
uugcuuuuuuggguuuacuggg

SEQ ID NO: 84931 - RNA, 22 nt, Human
cccuguccuucccuccaucuga

SEQ ID NO: 84932 - RNA, 22 nt, Human
cuugcucugggaauaugaguuu

SEQ ID NO: 84933 - RNA, 22 nt, Human
uuauuuaagaucuuaauauaua

SEQ ID NO: 84934 - RNA, 22 nt, Human
cucugcuuguaucacauuugcu

SEQ ID NO: 84935 - RNA, 22 nt, Human
ucgcccagguuggagugcagug

SEQ ID NO: 84936 - RNA, 22 nt, Human
aggcuccucugggggccccgga

SEQ ID NO: 84937 - RNA, 22 nt, Human
gggcagagagcuggaacuccuu

SEQ ID NO: 84938 - RNA, 22 nt, Human
uguugaagcaccucugucuuuc

SEQ ID NO: 84939 - RNA, 22 nt, Human
cucuugugucaccauggauaaa

SEQ ID NO: 84940 - RNA, 22 nt, Human
ccuuuggaugucauucuuggca

SEQ ID NO: 84941 - RNA, 22 nt, Human
uggggggacagauggagaggac

SEQ ID NO: 84942 - RNA, 22 nt, Human
guuuuauaacuauagugagaau

SEQ ID NO: 84943 - RNA, 22 nt, Human
guuuggguggcuagagaaagaa

SEQ ID NO: 84944 - RNA, 22 nt, Human
cccagagggcugaggauaugaa

SEQ ID NO: 84945 - RNA, 22 nt, Human
uucuugugugaauauaauuaca

SEQ ID NO: 84946 - RNA, 22 nt, Human
gcucagagaaaacuggggcuug

SEQ ID NO: 84947 - RNA, 22 nt, Human
ggcuagggaucuagaccaggac

SEQ ID NO: 84948 - RNA, 22 nt, Human
uugauagauuuuagaggcaggc

SEQ ID NO: 84949 - RNA, 22 nt, Human
cuguuucucugccugcacacau

SEQ ID NO: 84950 - RNA, 22 nt, Human
auggagugggaggacaugaagg

SEQ ID NO: 84951 - RNA, 22 nt, Human
gaggugauuccucccauguaau

SEQ ID NO: 84952 - RNA, 22 nt, Human
cacugcacuccagccugggcaa

SEQ ID NO: 84953 - RNA, 22 nt, Human
gugugucucaguugcuccgaag

SEQ ID NO: 84954 - RNA, 22 nt, Human
caauccccaggucccagaacag

SEQ ID NO: 84955 - RNA, 22 nt, Human
augcugugccuggaaagcggcu

SEQ ID NO: 84956 - RNA, 20 nt, Human
uggguucaguuguuucuggc

SEQ ID NO: 84957 - RNA, 22 nt, Human
aggcgaagggaccagacgguag

SEQ ID NO: 84958 - RNA, 22 nt, Human
auucauucugaccucaagagaa

SEQ ID NO: 84959 - RNA, 22 nt, Human
ugggggagggagaguugauggg

SEQ ID NO: 84960 - RNA, 22 nt, Human
ugagagggagacagcucuagca

SEQ ID NO: 84961 - RNA, 22 nt, Human
uuguuauuauuauuuucguucu

SEQ ID NO: 84962 - RNA, 22 nt, Human
uggcaaggccacaggugcaguu

SEQ ID NO: 84963 - RNA, 22 nt, Human
gcagguggaagcagcagacuca

SEQ ID NO: 84964 - RNA, 22 nt, Human
aagagaggaaagggugugaggu

SEQ ID NO: 84965 - RNA, 22 nt, Human
auccugugggguauugcugcau

SEQ ID NO: 84966 - RNA, 22 nt, Human
uggaagcccagaaggaagcaga

SEQ ID NO: 84967 - RNA, 22 nt, Human
uggagccugauggauaggaacg

SEQ ID NO: 84968 - RNA, 22 nt, Human
cucucugcugucuuucgggaaa

SEQ ID NO: 84969 - RNA, 22 nt, Human
uuuguugucuucauaauacuuu

SEQ ID NO: 84970 - RNA, 22 nt, Human
ggggaggugugcaggacaccuc

SEQ ID NO: 84971 - RNA, 22 nt, Human
aagcucuuuccacuaaaccacu

SEQ ID NO: 84972 - RNA, 22 nt, Human
cacugguugccucuuucuguuc

SEQ ID NO: 84973 - RNA, 22 nt, Human
uaguggaaccuucuaaaugacg

SEQ ID NO: 84974 - RNA, 19 nt, Human
ggaggguguccucaguguc

SEQ ID NO: 84975 - RNA, 22 nt, Human
uuccugcuggucaaaguugccu

SEQ ID NO: 84976 - RNA, 22 nt, Human
ugauucacagacuucacaaggc

SEQ ID NO: 84977 - RNA, 22 nt, Human
gaguagaacagauagucaagaa

SEQ ID NO: 84978 - RNA, 22 nt, Human
agcugaggccccgcagcagggu

SEQ ID NO: 84979 - RNA, 22 nt, Human
gaaggagaggauugugaggcug

SEQ ID NO: 84980 - RNA, 18 nt, Human
aggcuggggaucacaggg

SEQ ID NO: 84981 - RNA, 19 nt, Human
acuggggcaggcugggcuu

SEQ ID NO: 84982 - RNA, 20 nt, Human
uuguacuuaugugagaagga

SEQ ID NO: 84983 - RNA, 22 nt, Human
gaggcaggcggggcccaggugg

SEQ ID NO: 84984 - RNA, 22 nt, Human
ugggcagggagcuggaaccaca

SEQ ID NO: 84985 - RNA, 22 nt, Human
uugcaagcccugaagggcugga

SEQ ID NO: 84986 - RNA, 22 nt, Human
agggaguuccgaucugugcacc

SEQ ID NO: 84987 - RNA, 23 nt, Human
caggggacaggugaccugggcuc

SEQ ID NO: 84988 - RNA, 22 nt, Human
uggcucagcgcggccuggucuu

SEQ ID NO: 84989 - RNA, 22 nt, Human
cacugcaaccuccaccucccgg

SEQ ID NO: 84990 - RNA, 22 nt, Human
agguggucccaauggcugggca

SEQ ID NO: 84991 - RNA, 22 nt, Human
ucacaucugugugauugucauu

SEQ ID NO: 84992 - RNA, 22 nt, Human
uguuuguuuuguauuuuuaauu

SEQ ID NO: 84993 - RNA, 22 nt, Human
guuuuucuuugauuuagaacca

SEQ ID NO: 84994 - RNA, 22 nt, Human
guuuuguagucuggagacuguc

SEQ ID NO: 84995 - RNA, 22 nt, Human
guuuauucuuuuauuugugaga

SEQ ID NO: 84996 - RNA, 18 nt, Human
uucucucuggauaguagu

SEQ ID NO: 84997 - RNA, 22 nt, Human
uuguuuuaguagaaguuacaug

SEQ ID NO: 84998 - RNA, 22 nt, Human
cggcugcagcggagcaggcugg

SEQ ID NO: 84999 - RNA, 22 nt, Human
gggcaagaagcuggaagcauuc

SEQ ID NO: 85000 - RNA, 22 nt, Human
cugguuuauuucauaguuuguu

SEQ ID NO: 85001 - RNA, 23 nt, Human
ucucacucauucuccucugucca

SEQ ID NO: 85002 - RNA, 22 nt, Human
ugugugcuaguuuugucaguau

SEQ ID NO: 85003 - RNA, 22 nt, Human
uuucuauuuacagugcuaggua

SEQ ID NO: 85004 - RNA, 22 nt, Human
gcccugucagcucucauggaca

SEQ ID NO: 85005 - RNA, 20 nt, Human
uucacagaucucuaacugag

SEQ ID NO: 85006 - RNA, 22 nt, Human
cacagcuggggaagcugaggcc

SEQ ID NO: 85007 - RNA, 22 nt, Human
aggauagacuucagaaggcaua

SEQ ID NO: 85008 - RNA, 19 nt, Human
agagucuccacuccacuug

SEQ ID NO: 85009 - RNA, 22 nt, Human
uuuuccuuagaaauacauugau

SEQ ID NO: 85010 - RNA, 22 nt, Human
aggcaggggagcuggaagggua

SEQ ID NO: 85011 - RNA, 22 nt, Human
aggcagagaggucuuccuggaa

SEQ ID NO: 85012 - RNA, 22 nt, Human
aagaugcuucaugagaguuggg

SEQ ID NO: 85013 - RNA, 22 nt, Human
ggcuagggagacagagggcaug

SEQ ID NO: 85014 - RNA, 22 nt, Human
agauucucccuccuggcgcugu

SEQ ID NO: 85015 - RNA, 22 nt, Human
auuuuuuuuccugucucuuuca

SEQ ID NO: 85016 - RNA, 22 nt, Human
ugaguucugacugagcaugggg

SEQ ID NO: 85017 - RNA, 22 nt, Human
cugguacuggaggaguucagag

SEQ ID NO: 85018 - RNA, 22 nt, Human
cucagcgagggaaagaggccgc

SEQ ID NO: 85019 - RNA, 22 nt, Human
agucaccuacagcucaugcuuc

SEQ ID NO: 85020 - RNA, 22 nt, Human
gaggcuugccacuguccauggc

SEQ ID NO: 85021 - RNA, 22 nt, Human
ggcagagcugugcgcccaccca

SEQ ID NO: 85022 - RNA, 22 nt, Human
uucuagcucauggugacagauc

SEQ ID NO: 85023 - RNA, 22 nt, Human
ucccuugacauuacuugggagg

SEQ ID NO: 85024 - RNA, 19 nt, Human
agcucaggcccaucguccc

SEQ ID NO: 85025 - RNA, 22 nt, Human
uuugcaggaaauguacugaaug

SEQ ID NO: 85026 - RNA, 19 nt, Human
ucaggaggucgaccuggca

SEQ ID NO: 85027 - RNA, 22 nt, Human
uugaauaguuuuggauagcaua

SEQ ID NO: 85028 - RNA, 22 nt, Human
guucaaucucucaugcauuuuc

SEQ ID NO: 85029 - RNA, 22 nt, Human
agggcaggguuggugcuggugc

SEQ ID NO: 85030 - RNA, 17 nt, Human
aaagccgaucagauguu

SEQ ID NO: 85031 - RNA, 22 nt, Human
uauuuuuacuguuugaugauuc

SEQ ID NO: 85032 - RNA, 22 nt, Human
cuguccauuuucgugccuccuu

SEQ ID NO: 85033 - RNA, 21 nt, Human
cuauaaaaaugguucuuugcg

SEQ ID NO: 85034 - RNA, 22 nt, Human
uggaggcccagcugggggccgg

SEQ ID NO: 85035 - RNA, 22 nt, Human
ugugucuuuggcgaugucugga

SEQ ID NO: 85036 - RNA, 22 nt, Human
auagggaggcggagggagcugg

SEQ ID NO: 85037 - RNA, 22 nt, Human
uacauuugauuuuugcuucuuu

SEQ ID NO: 85038 - RNA, 22 nt, Human
uucacuguucuuagagaagacc

SEQ ID NO: 85039 - RNA, 22 nt, Human
gcagggcucuggagucaggcug

SEQ ID NO: 85040 - RNA, 22 nt, Human
aagggagagggagaagguggga

SEQ ID NO: 85041 - RNA, 22 nt, Human
guccuguguaaguacuugcuca

SEQ ID NO: 85042 - RNA, 22 nt, Human
aguaggaauucaaagagacaaa

SEQ ID NO: 85043 - RNA, 22 nt, Human
augugugugcgagcgugugugu

SEQ ID NO: 85044 - RNA, 18 nt, Human
uucaggcucuugcaugaa

SEQ ID NO: 85045 - RNA, 23 nt, Human
agagggaagagcuuagaugggga

SEQ ID NO: 85046 - RNA, 22 nt, Human
uucauuuccauuuuauagauaa

SEQ ID NO: 85047 - RNA, 22 nt, Human
aaaucauagccaugaacauuug

SEQ ID NO: 85048 - RNA, 22 nt, Human
ugaauucaaacuuuuuaacaag

SEQ ID NO: 85049 - RNA, 21 nt, Human
caguucuaagugucaucuuuu

SEQ ID NO: 85050 - RNA, 22 nt, Human
uucacugugauugggguggauu

SEQ ID NO: 85051 - RNA, 22 nt, Human
gucuuucuuuuacauauuugug

SEQ ID NO: 85052 - RNA, 22 nt, Human
gggcuguggggccugcagaagg

SEQ ID NO: 85053 - RNA, 22 nt, Human
ccagggaggucauagugcuggu

SEQ ID NO: 85054 - RNA, 22 nt, Human
ccugccagaaaagagggaguuc

SEQ ID NO: 85055 - RNA, 22 nt, Human
gagcagcucgagaaggaagcag

SEQ ID NO: 85056 - RNA, 22 nt, Human
acuguugagggaagcagaugaa

SEQ ID NO: 85057 - RNA, 22 nt, Human
ugucuuugaccuuaagaaguuu

SEQ ID NO: 85058 - RNA, 22 nt, Human
ugguucuagaugagaugaugag

SEQ ID NO: 85059 - RNA, 20 nt, Human
ccugggcuccaggagccccg

SEQ ID NO: 85060 - RNA, 22 nt, Human
uuauuugcccauguuuagcaga

SEQ ID NO: 85061 - RNA, 20 nt, Human
cuccuccccucggccccacc

SEQ ID NO: 85062 - RNA, 22 nt, Human
gugcugggaggcccaggaugga

SEQ ID NO: 85063 - RNA, 22 nt, Human
gugucacuuucaggagcucuaa

SEQ ID NO: 85064 - RNA, 22 nt, Human
ggcuggggccuguugaagaugc

SEQ ID NO: 85065 - RNA, 22 nt, Human
gaggcucagagggacuuucaag

SEQ ID NO: 85066 - RNA, 22 nt, Human
cuccuuugagcaaaucuuugau

SEQ ID NO: 85067 - RNA, 22 nt, Human
auggugaugaugaugaugauaa

SEQ ID NO: 85068 - RNA, 22 nt, Human
gaggagcuucagaggaaucuua

SEQ ID NO: 85069 - RNA, 22 nt, Human
caagggcagaggcagggccccg

SEQ ID NO: 85070 - RNA, 22 nt, Human
uucuugucuuuguuauguagga

SEQ ID NO: 85071 - RNA, 22 nt, Human
uuuaacauaugaaagaauauuu

SEQ ID NO: 85072 - RNA, 20 nt, Human
aggggcuguaguuagaugac

SEQ ID NO: 85073 - RNA, 17 nt, Human
uuagagcuacauguuga

SEQ ID NO: 85074 - RNA, 22 nt, Human
uuuuuuuuacuccggacagcuc

SEQ ID NO: 85075 - RNA, 22 nt, Human
uuaggggcuuaggcagaguuug

SEQ ID NO: 85076 - RNA, 23 nt, Human
aaauaauaauuucucuguuggga

SEQ ID NO: 85077 - RNA, 22 nt, Human
uucuucuucuuccucauccuca

SEQ ID NO: 85078 - RNA, 22 nt, Human
uuuuauuuguauguugaaugua

SEQ ID NO: 85079 - RNA, 22 nt, Human
aggggaggcugggcuggggggc

SEQ ID NO: 85080 - RNA, 22 nt, Human
gcagaaguauuguacgguggga

SEQ ID NO: 85081 - RNA, 22 nt, Human
uggacacugguggauauggaau

SEQ ID NO: 85082 - RNA, 22 nt, Human
gauuuuuaaaaguaguuuugaa

SEQ ID NO: 85083 - RNA, 22 nt, Human
ucugcaugccucaggaggccug

SEQ ID NO: 85084 - RNA, 22 nt, Human
cuuggggauuuuaaagaccucu

SEQ ID NO: 85085 - RNA, 20 nt, Human
ucugugugccaucaccuaac

SEQ ID NO: 85086 - RNA, 22 nt, Human
ggcuggagcaggcugcacagug

SEQ ID NO: 85087 - RNA, 22 nt, Human
auuuucuugucucuguuguagg

SEQ ID NO: 85088 - RNA, 22 nt, Human
uucauauuguggucuugcauuc

SEQ ID NO: 85089 - RNA, 22 nt, Human
aaaauauaaaggauguggguuu

SEQ ID NO: 85090 - RNA, 22 nt, Human
gacuggggcauuagaguagcuu

SEQ ID NO: 85091 - RNA, 22 nt, Human
uucacugugauguuuaagagaa

SEQ ID NO: 85092 - RNA, 21 nt, Human
gcagcucaggauauagacuug

SEQ ID NO: 85093 - RNA, 22 nt, Human
uucccugugcaguauguuccaa

SEQ ID NO: 85094 - RNA, 22 nt, Human
agauggggccugaggacacugu

SEQ ID NO: 85095 - RNA, 22 nt, Human
augcggcugugggggaauggga

SEQ ID NO: 85096 - RNA, 19 nt, Human
uagcuguucuugaguguga

SEQ ID NO: 85097 - RNA, 22 nt, Human
guuguugucauuagcuguuuaa

SEQ ID NO: 85098 - RNA, 22 nt, Human
gaguucuagauguauuauuaau

SEQ ID NO: 85099 - RNA, 22 nt, Human
gcuuucagggucacugucaaca

SEQ ID NO: 85100 - RNA, 22 nt, Human
gccaguggucagugggagggug

SEQ ID NO: 85101 - RNA, 22 nt, Human
aaggucuucgaaccuuauguua

SEQ ID NO: 85102 - RNA, 22 nt, Human
caguggagaccugccugcugga

SEQ ID NO: 85103 - RNA, 22 nt, Human
ggagccucuaaacaguuaucaa

SEQ ID NO: 85104 - RNA, 22 nt, Human
uccagcugugcuccaggaggug

SEQ ID NO: 85105 - RNA, 22 nt, Human
uuuaucaggccaucuuaugucu

SEQ ID NO: 85106 - RNA, 22 nt, Human
gcucucuggccugggaggagga

SEQ ID NO: 85107 - RNA, 22 nt, Human
cuccucccagcccaggcgccac

SEQ ID NO: 85108 - RNA, 20 nt, Human
uuuuuuaaauagagcuguug

SEQ ID NO: 85109 - RNA, 22 nt, Human
aggccccacaaacucgccuuug

SEQ ID NO: 85110 - RNA, 22 nt, Human
acagagcucccagccaucuccu

SEQ ID NO: 85111 - RNA, 22 nt, Human
cagagcugucauuugccaguga

SEQ ID NO: 85112 - RNA, 22 nt, Human
cuguggcuaggaagcuguggga

SEQ ID NO: 85113 - RNA, 22 nt, Human
ucuccucucugaucuugcuccg

SEQ ID NO: 85114 - RNA, 22 nt, Human
cuguggcugcgcccugggggag

SEQ ID NO: 85115 - RNA, 22 nt, Human
cacuguugagcaauguacagug

SEQ ID NO: 85116 - RNA, 22 nt, Human
gugaucagaagaaccugccgaa

SEQ ID NO: 85117 - RNA, 22 nt, Human
ucccaaguguuuggcgaggaga

SEQ ID NO: 85118 - RNA, 22 nt, Human
ggagcucacuacgaaauaagcu

SEQ ID NO: 85119 - RNA, 18 nt, Human
cccagaggaaugccugga

SEQ ID NO: 85120 - RNA, 22 nt, Human
ggccugcuaccagcugugaccu

SEQ ID NO: 85121 - RNA, 22 nt, Human
uugcucuuaccauuauguguga

SEQ ID NO: 85122 - RNA, 22 nt, Human
gaaccauuuaauggagaugcuc

SEQ ID NO: 85123 - RNA, 22 nt, Human
ggggaaggaaggggagggcacg

SEQ ID NO: 85124 - RNA, 20 nt, Human
gaacauaaauaacucuuuac

SEQ ID NO: 85125 - RNA, 22 nt, Human
uggcucaguaaucgagucuccu

SEQ ID NO: 85126 - RNA, 22 nt, Human
caauggagccaagaggaggaaa

SEQ ID NO: 85127 - RNA, 22 nt, Human
gggggacagugugccuggugug

SEQ ID NO: 85128 - RNA, 22 nt, Human
aggugagaacguggaggggcgg

SEQ ID NO: 85129 - RNA, 22 nt, Human
augcagauguagauucugaaau

SEQ ID NO: 85130 - RNA, 22 nt, Human
aucauguauauuuuugcuauua

SEQ ID NO: 85131 - RNA, 22 nt, Human
aagaaauacagaaauggcagua

SEQ ID NO: 85132 - RNA, 22 nt, Human
ccucaggaauuuauucuucugu

SEQ ID NO: 85133 - RNA, 22 nt, Human
uucuccaccugcuccucccacc

SEQ ID NO: 85134 - RNA, 22 nt, Human
gagggcugccacguugggcgag

SEQ ID NO: 85135 - RNA, 22 nt, Human
uacagaccaguaguucucagcg

SEQ ID NO: 85136 - RNA, 22 nt, Human
caaaucuguuaauuucaaguug

SEQ ID NO: 85137 - RNA, 22 nt, Human
cucugugucugauucugggaag

SEQ ID NO: 85138 - RNA, 22 nt, Human
uggagcugguucuggggaagcu

SEQ ID NO: 85139 - RNA, 22 nt, Human
cuccacagccccuccaguggca

SEQ ID NO: 85140 - RNA, 22 nt, Human
gaggggacugucuggcuccgag

SEQ ID NO: 85141 - RNA, 22 nt, Human
gcagggcucagccgcucccacc

SEQ ID NO: 85142 - RNA, 22 nt, Human
cccuguccugcuaggcccuggu

SEQ ID NO: 85143 - RNA, 22 nt, Human
uucucugcgcuccggcccaguu

SEQ ID NO: 85144 - RNA, 22 nt, Human
agggagucuggccgucggcugg

SEQ ID NO: 85145 - RNA, 22 nt, Human
agggggaauccugcuuauggau

SEQ ID NO: 85146 - RNA, 22 nt, Human
ugucccaucacagaggagacua

SEQ ID NO: 85147 - RNA, 22 nt, Human
aagcucagcugguggugauugc

SEQ ID NO: 85148 - RNA, 22 nt, Human
gcucagccuuuuguucuauuca

SEQ ID NO: 85149 - RNA, 22 nt, Human
aggcucagcaucugauucauau

SEQ ID NO: 85150 - RNA, 22 nt, Human
ggcugugaaguacguugaaggu

SEQ ID NO: 85151 - RNA, 22 nt, Human
gucugcagcacugugcacgguc

SEQ ID NO: 85152 - RNA, 20 nt, Human
ccuuguggaugucuuuuuug

SEQ ID NO: 85153 - RNA, 22 nt, Human
ggcucacuguaccugccgccgc

SEQ ID NO: 85154 - RNA, 22 nt, Human
ggugucuuugauguugggcuga

SEQ ID NO: 85155 - RNA, 23 nt, Human
aaguggugacugugcuacugaga

SEQ ID NO: 85156 - RNA, 22 nt, Human
gcuggccugcgagggcaggcug

SEQ ID NO: 85157 - RNA, 22 nt, Human
uaauaaaaauuuaauucacauu

SEQ ID NO: 85158 - RNA, 22 nt, Human
uugguuuacucuggggauaucu

SEQ ID NO: 85159 - RNA, 22 nt, Human
ugggggaggaggagacagacug

SEQ ID NO: 85160 - RNA, 22 nt, Human
agccccaauuacagcugugcug

SEQ ID NO: 85161 - RNA, 22 nt, Human
uuuguauuguuuauuucauuuu

SEQ ID NO: 85162 - RNA, 22 nt, Human
gagggggaaaagggcagcagag

SEQ ID NO: 85163 - RNA, 22 nt, Human
augaggaacagcaagaauauuu

SEQ ID NO: 85164 - RNA, 22 nt, Human
uuccuuuaaccaagagcaguac

SEQ ID NO: 85165 - RNA, 22 nt, Human
uggggcugguaccguaauauau

SEQ ID NO: 85166 - RNA, 22 nt, Human
agauggaguccugaagccagaa

SEQ ID NO: 85167 - RNA, 22 nt, Human
cugcagagaccuaggucagguu

SEQ ID NO: 85168 - RNA, 22 nt, Human
uuuugaauaauucagaaacagc

SEQ ID NO: 85169 - RNA, 22 nt, Human
aagugauuuucccaccaucuac

SEQ ID NO: 85170 - RNA, 22 nt, Human
uugucaggaacuaugauuaugc

SEQ ID NO: 85171 - RNA, 22 nt, Human
acuggagcccguggaggcgcag

SEQ ID NO: 85172 - RNA, 22 nt, Human
ucugagugacguccugacagga

SEQ ID NO: 85173 - RNA, 22 nt, Human
cauaggcucuucagagaacuga

SEQ ID NO: 85174 - RNA, 22 nt, Human
ucuuuauuucccuaacuugcua

SEQ ID NO: 85175 - RNA, 22 nt, Human
uuggugaugcccaccuuuucau

SEQ ID NO: 85176 - RNA, 21 nt, Human
ugagcccaaagcuguauuggu

SEQ ID NO: 85177 - RNA, 22 nt, Human
auguacugacuguacuuuuaaa

SEQ ID NO: 85178 - RNA, 19 nt, Human
uccuacaugagacagagag

SEQ ID NO: 85179 - RNA, 22 nt, Human
agcggccucgcugccugcucag

SEQ ID NO: 85180 - RNA, 22 nt, Human
ccucccuucccggcauggcucu

SEQ ID NO: 85181 - RNA, 22 nt, Human
guucuacaugacacucaacauu

SEQ ID NO: 85182 - RNA, 22 nt, Human
gcuggggaucgaaggcagagcc

SEQ ID NO: 85183 - RNA, 22 nt, Human
aggguggaggacaggccaguga

SEQ ID NO: 85184 - RNA, 22 nt, Human
agagggagagaccuccgugccu

SEQ ID NO: 85185 - RNA, 22 nt, Human
ggcuccaggguaccccuggaug

SEQ ID NO: 85186 - RNA, 22 nt, Human
uaugggcaagagauaggugguc

SEQ ID NO: 85187 - RNA, 20 nt, Human
agaaggagagaugaggcaaa

SEQ ID NO: 85188 - RNA, 22 nt, Human
uuuaaauuucugaaucuugagg

SEQ ID NO: 85189 - RNA, 22 nt, Human
gcugcaggaggugguagggucu

SEQ ID NO: 85190 - RNA, 22 nt, Human
ugcuguugacuuuguuguucuu

SEQ ID NO: 85191 - RNA, 22 nt, Human
guauauuuaugagcauuagccu

SEQ ID NO: 85192 - RNA, 22 nt, Human
uauuuuuaccuaauuuaugaga

SEQ ID NO: 85193 - RNA, 22 nt, Human
ucccuucccaccccugccuuuu

SEQ ID NO: 85194 - RNA, 22 nt, Human
cggggcuggcguuagggaggca

SEQ ID NO: 85195 - RNA, 20 nt, Human
ugcugugugucuacuguggg

SEQ ID NO: 85196 - RNA, 21 nt, Human
guucuuaguuauauucucaau

SEQ ID NO: 85197 - RNA, 22 nt, Human
auuuauauauuuuguucuggua

SEQ ID NO: 85198 - RNA, 23 nt, Human
ccagcugugccuggcccaggagc

SEQ ID NO: 85199 - RNA, 22 nt, Human
acuuuauacuagugauaguuug

SEQ ID NO: 85200 - RNA, 21 nt, Human
uuucauuaguacaucaauuug

SEQ ID NO: 85201 - RNA, 22 nt, Human
ggcucccgugggaugguggagc

SEQ ID NO: 85202 - RNA, 22 nt, Human
ccuucugcuggucaucccagug

SEQ ID NO: 85203 - RNA, 22 nt, Human
gugucccaaagauuagaaauca

SEQ ID NO: 85204 - RNA, 22 nt, Human
caguagcuuuuugcagacaaga

SEQ ID NO: 85205 - RNA, 22 nt, Human
uguuaguauuggcaaauuuguu

SEQ ID NO: 85206 - RNA, 22 nt, Human
gggagguaaugggggugcaggg

SEQ ID NO: 85207 - RNA, 22 nt, Human
uuuuuuuaaguuuugauuuuag

SEQ ID NO: 85208 - RNA, 22 nt, Human
uuuuuuaaucaaguaggaaaca

SEQ ID NO: 85209 - RNA, 22 nt, Human
gcugcuuagaaccauauuuaaa

SEQ ID NO: 85210 - RNA, 22 nt, Human
ugcucacugcuuguguucaguu

SEQ ID NO: 85211 - RNA, 22 nt, Human
ucagccuugguuuugguguugg

SEQ ID NO: 85212 - RNA, 22 nt, Human
ggaggccgugcugugcugccag

SEQ ID NO: 85213 - RNA, 22 nt, Human
uuguuuguaaggcucuuagaau

SEQ ID NO: 85214 - RNA, 22 nt, Coxiella burnetii RSA 493
cuuguugauagcgguguguaau

SEQ ID NO: 85215 - RNA, 22 nt, Coxiella burnetii RSA 493
guaugcagcgaaguaauacggg

SEQ ID NO: 85216 - RNA, 22 nt, Coxiella burnetii RSA 493
cucgcucuuuuaguugacgccu

SEQ ID NO: 85217 - RNA, 22 nt, Coxiella burnetii RSA 493
uuuugucauuuccagauugugg

SEQ ID NO: 85218 - RNA, 22 nt, Coxiella burnetii RSA 493
uagguuuucaacaaguagcccg

SEQ ID NO: 85219 - RNA, 22 nt, Coxiella burnetii RSA 493
cugaucaucggagccgguauua

SEQ ID NO: 85220 - RNA, 22 nt, Coxiella burnetii RSA 493
uggucagcuugggcuuaauuau

SEQ ID NO: 85221 - RNA, 22 nt, Coxiella burnetii RSA 493
ccaagaucguuuggcaggcauc

SEQ ID NO: 85222 - RNA, 19 nt, Coxiella burnetii RSA 493
auuccgaaugcggaaccag

SEQ ID NO: 85223 - RNA, 22 nt, Coxiella burnetii RSA 493
cccguauuucgcuucgcucaua

SEQ ID NO: 85224 - RNA, 22 nt, Coxiella burnetii RSA 493
aagcgaaauacgggaaacaaug

SEQ ID NO: 85225 - RNA, 22 nt, Coxiella burnetii RSA 493
ccguauucguucgcugcauacg

SEQ ID NO: 85226 - RNA, 22 nt, Coxiella burnetii RSA 493
ugagcgaagcgaaauacgagga

SEQ ID NO: 85227 - RNA, 22 nt, Coxiella burnetii RSA 493
ucccaauuccucgcccgucaca

SEQ ID NO: 85228 - RNA, 22 nt, Coxiella burnetii RSA 493
ggagaauccaugacguuuaaag

SEQ ID NO: 85229 - RNA, 22 nt, Coxiella burnetii RSA 493
agcgaagcgaauacggggacgg

SEQ ID NO: 85230 - RNA, 22 nt, Coxiella burnetii RSA 493
ucccguauuucgcuucgcucca

SEQ ID NO: 85231 - RNA, 22 nt, Coxiella burnetii RSA 493
aaucauuuaucguuugacaucg

SEQ ID NO: 85232 - RNA, 22 nt, Coxiella burnetii RSA 493
aauugagcuggcuuugcuugcu

SEQ ID NO: 85233 - RNA, 22 nt, Coxiella burnetii RSA 493
gcgcuuuuuaaguaugguauuu

SEQ ID NO: 85234 - RNA, 22 nt, Coxiella burnetii RSA 493
acaaauuuguccagugagauga

SEQ ID NO: 85235 - RNA, 22 nt, Coxiella burnetii RSA 493
cagaagaacgggcuaaauuaga

SEQ ID NO: 85236 - RNA, 22 nt, Coxiella burnetii RSA 493
cccguaugagcgaagcgaaaua

SEQ ID NO: 85237 - RNA, 22 nt, Coxiella burnetii RSA 493
gcuuaaaugaaugaaaccgauc

SEQ ID NO: 85238 - RNA, 22 nt, Coxiella burnetii RSA 493
cgauuucaccaaaguucaaaag

SEQ ID NO: 85239 - RNA, 20 nt, Coxiella burnetii RSA 493
gcagcguuaugguagaugga

SEQ ID NO: 85240 - RNA, 22 nt, Coxiella burnetii RSA 493
ugcgcgucauauuuuagcauuu

SEQ ID NO: 85241 - RNA, 22 nt, Coxiella burnetii RSA 493
uccccguauuucgcuucgcuca

SEQ ID NO: 85242 - RNA, 22 nt, Coxiella burnetii RSA 493
cuggcaaaaauggucaauuauu

SEQ ID NO: 85243 - RNA, 22 nt, Coxiella burnetii RSA 493
uccauuaucaaugggguuaaua

SEQ ID NO: 85244 - RNA, 22 nt, Coxiella burnetii RSA 493
cucgccggaugaguugguuuua

SEQ ID NO: 85245 - RNA, 22 nt, Coxiella burnetii RSA 493
caauggcucgugcgcauuuagg

SEQ ID NO: 85246 - RNA, 22 nt, Coxiella burnetii RSA 493
cgcuuuguuucauacgggcuac

SEQ ID NO: 85247 - RNA, 22 nt, Coxiella burnetii RSA 493
uuccgcuucgcuucauacgggc

SEQ ID NO: 85248 - RNA, 22 nt, Coxiella burnetii RSA 493
ccguauuucgcugggcugcaua

SEQ ID NO: 85249 - RNA, 22 nt, Coxiella burnetii RSA 493
aagcgaaauacggggacgauug

SEQ ID NO: 85250 - RNA, 22 nt, Coxiella burnetii RSA 493
gcguuggauccccgccugcgcg

SEQ ID NO: 85251 - RNA, 22 nt, Coxiella burnetii RSA 493
uaucgccauuaaaauuaacgac

SEQ ID NO: 85252 - RNA, 22 nt, Coxiella burnetii RSA 493
gcuuuucucagcauuuuagccc

SEQ ID NO: 85253 - RNA, 22 nt, Coxiella burnetii RSA 493
gucuaugguggccucaugggug

SEQ ID NO: 85254 - RNA, 23 nt, Coxiella burnetii RSA 493
agcauuuuuuugacgugagguca

SEQ ID NO: 85255 - RNA, 22 nt, Coxiella burnetii RSA 493
cguauaaagcgaagcggaauac

SEQ ID NO: 85256 - RNA, 22 nt, Coxiella burnetii RSA 493
cguaugcagcgaacgaauacgg

SEQ ID NO: 85257 - RNA, 22 nt, Coxiella burnetii RSA 493
ucccguauuccgcuucgcugca

SEQ ID NO: 85258 - RNA, 22 nt, Coxiella burnetii RSA 493
cguauuucgcuucgcuccauac

SEQ ID NO: 85259 - RNA, 18 nt, Coxiella burnetii RSA 493
auaauaaaaggccugauc

SEQ ID NO: 85260 - RNA, 22 nt, Coxiella burnetii RSA 493
gguugugucgcuaugcgacaac

SEQ ID NO: 85261 - RNA, 17 nt, Coxiella burnetii RSA 493
guuuuuugauaccgaug

SEQ ID NO: 85262 - RNA, 22 nt, Coxiella burnetii RSA 493
augaagcgaagcggaauacggg

SEQ ID NO: 85263 - RNA, 22 nt, Coxiella burnetii RSA 493
gcgaagcgaaauacggggacaa

SEQ ID NO: 85264 - RNA, 22 nt, Coxiella burnetii RSA 493
gcgaagcgaaaugcggggacga

SEQ ID NO: 85265 - RNA, 22 nt, Coxiella burnetii RSA 493
ccguaugcagcccagcgaaaua

SEQ ID NO: 85266 - RNA, 22 nt, Coxiella burnetii RSA 493
uauucguuucgcuucauacggg

SEQ ID NO: 85267 - RNA, 22 nt, Coxiella burnetii RSA 493
aauaaugcuauuuuuuuaagcg

SEQ ID NO: 85268 - RNA, 22 nt, Coxiella burnetii RSA 493
uggguaaugguaggaacccguu

SEQ ID NO: 85269 - RNA, 22 nt, Coxiella burnetii RSA 493
ccguaugaagcgaagcgaaaua

SEQ ID NO: 85270 - RNA, 19 nt, Coxiella burnetii RSA 493
ugcuuucaucguucgcugg

SEQ ID NO: 85271 - RNA, 22 nt, Coxiella burnetii RSA 493
gcaaugucaugagaauaaugca

SEQ ID NO: 85272 - RNA, 22 nt, Coxiella burnetii RSA 493
guaugaagcgcggcgaaauaca

SEQ ID NO: 85273 - RNA, 22 nt, Coxiella burnetii RSA 493
uagcuguaugagcgaagugaaa

SEQ ID NO: 85274 - RNA, 22 nt, Coxiella burnetii RSA 493
aaaaguauuuugggaaucggcg

SEQ ID NO: 85275 - RNA, 22 nt, Coxiella burnetii RSA 493
uugauaagguugccuuuuagaa

SEQ ID NO: 85276 - RNA, 22 nt, Coxiella burnetii RSA 493
cuuaauguugggugaucauuau

SEQ ID NO: 85277 - RNA, 23 nt, Coxiella burnetii RSA 493
cugcaagacaugcgucgauuauu

SEQ ID NO: 85278 - RNA, 22 nt, Coxiella burnetii RSA 493
gaaaagcauuuaauccuucugu

SEQ ID NO: 85279 - RNA, 22 nt, Coxiella burnetii RSA 493
ugaggaauuacuuuauagcuuu

SEQ ID NO: 85280 - RNA, 22 nt, Coxiella burnetii RSA 493
gcaggcgggaauccagcgcgcu

SEQ ID NO: 85281 - RNA, 22 nt, Coxiella burnetii RSA 493
augguugugucgcuucgcgaca

SEQ ID NO: 85282 - RNA, 22 nt, Coxiella burnetii RSA 493
ugagcgaagcgaaauacgggaa

SEQ ID NO: 85283 - RNA, 22 nt, Coxiella burnetii RSA 493
uuuuugaauaucgugcucgacc

SEQ ID NO: 85284 - RNA, 22 nt, Coxiella burnetii RSA 493
gagacggcgcaauuucaaaaac

SEQ ID NO: 85285 - RNA, 22 nt, Coxiella burnetii RSA 493
cgaucgccgauaauuaauucac

SEQ ID NO: 85286 - RNA, 22 nt, Coxiella burnetii RSA 493
uggcgauggaagaaaagacauc

SEQ ID NO: 85287 - RNA, 22 nt, Coxiella burnetii RSA 493
ucucaacggcuguagcggcaau

SEQ ID NO: 85288 - RNA, 22 nt, Coxiella burnetii RSA 493
uauuuuugauggagguugauca

SEQ ID NO: 85289 - RNA, 22 nt, Coxiella burnetii RSA 493
gucgcgcuggugcccguagacc

SEQ ID NO: 85290 - RNA, 22 nt, Coxiella burnetii RSA 493
ucucaauaccugaaagggacaa

SEQ ID NO: 85291 - RNA, 22 nt, Coxiella burnetii RSA 493
uauggagcgaagcggaauacgg

SEQ ID NO: 85292 - RNA, 22 nt, Coxiella burnetii RSA 493
auugguuauuagugcuauuaau

SEQ ID NO: 85293 - RNA, 19 nt, Coxiella burnetii RSA 493
ugccaaaauggacgcugca

SEQ ID NO: 85294 - RNA, 22 nt, Coxiella burnetii RSA 493
gcuugaaaaccuauacuuucaa

SEQ ID NO: 85295 - RNA, 22 nt, Coxiella burnetii RSA 493
uauggagcgccagcggaauacg

SEQ ID NO: 85296 - RNA, 22 nt, Coxiella burnetii RSA 493
ucucgcuuugcuucauacgggc

SEQ ID NO: 85297 - RNA, 20 nt, Coxiella burnetii RSA 493
uauuccgcuucgcugcauac

SEQ ID NO: 85298 - RNA, 22 nt, Coxiella burnetii RSA 493
guaugcagcgaagcggaauacg

SEQ ID NO: 85299 - RNA, 22 nt, Coxiella burnetii RSA 493
agcuguuuucguuggaagaacc

SEQ ID NO: 85300 - RNA, 22 nt, Coxiella burnetii RSA 493
uauggagugaagcgaaauacgg

SEQ ID NO: 85301 - RNA, 22 nt, Coxiella burnetii RSA 493
aucaauuaauuauggccagcag

SEQ ID NO: 85302 - RNA, 22 nt, Coxiella burnetii RSA 493
ugauugggacuuggacggcgag

SEQ ID NO: 85303 - RNA, 22 nt, Coxiella burnetii RSA 493
ucgaauccaaacaaaaugguuu

SEQ ID NO: 85304 - RNA, 22 nt, Coxiella burnetii RSA 493
uuagauggauuaauaacacgag

SEQ ID NO: 85305 - RNA, 22 nt, Coxiella burnetii RSA 493
gacggcgggaccauggugguuu

SEQ ID NO: 85306 - RNA, 22 nt, Coxiella burnetii RSA 493
cugguucaugcgacggaaugcg

SEQ ID NO: 85307 - RNA, 19 nt, Coxiella burnetii RSA 493
uuuaggaaaccguucgcgc

SEQ ID NO: 85308 - RNA, 22 nt, Coxiella burnetii RSA 493
ggcuacuuagcuacucggcccc

SEQ ID NO: 85309 - RNA, 22 nt, Coxiella burnetii RSA 493
uauuuuaauaaucggcgcaggc

SEQ ID NO: 85310 - RNA, 22 nt, Coxiella burnetii RSA 493
auuucgcuucgcuucauacggg

SEQ ID NO: 85311 - RNA, 22 nt, Coxiella burnetii RSA 493
uguggcgaagccacacaaccac

SEQ ID NO: 85312 - RNA, 20 nt, Coxiella burnetii RSA 493
ucuuauuucuaacuugcgau

SEQ ID NO: 85313 - RNA, 22 nt, Coxiella burnetii RSA 493
uaugcagcgcagcgaaauacgg

SEQ ID NO: 85314 - RNA, 22 nt, Coxiella burnetii RSA 493
ucaaguuuaccucguuaauacu

SEQ ID NO: 85315 - RNA, 22 nt, Coxiella burnetii RSA 493
ccuauuuucaauaaccguucca

SEQ ID NO: 85316 - RNA, 22 nt, Coxiella burnetii RSA 493
guugcggguggaaaauaauaga

SEQ ID NO: 85317 - RNA, 22 nt, Coxiella burnetii RSA 493
gguuuuaccgauuaaaauggcu

SEQ ID NO: 85318 - RNA, 22 nt, Coxiella burnetii RSA 493
cguauguagcgaagcgaaauac

SEQ ID NO: 85319 - RNA, 22 nt, Coxiella burnetii RSA 493
ccguauuccacuucgcuucaua

SEQ ID NO: 85320 - RNA, 22 nt, Coxiella burnetii RSA 493
aguuuucuucaaacacguuuag

SEQ ID NO: 85321 - RNA, 22 nt, Coxiella burnetii RSA 493
cgaagcgaaauacgggaaauua

SEQ ID NO: 85322 - RNA, 22 nt, Coxiella burnetii RSA 493
uaugaagcgaaacgaauacggg

SEQ ID NO: 85323 - RNA, 22 nt, Coxiella burnetii RSA 493
aaucggcuuccguuuuuggcug

SEQ ID NO: 85324 - RNA, 22 nt, Coxiella burnetii RSA 493
cauuacaaauggacgaugcaga

SEQ ID NO: 85325 - RNA, 22 nt, Coxiella burnetii RSA 493
ccagcgauuaucaauuagcauu

SEQ ID NO: 85326 - RNA, 22 nt, Coxiella burnetii RSA 493
uagucauuuuauaccacgucuc

SEQ ID NO: 85327 - RNA, 22 nt, Coxiella burnetii RSA 493
gaagauauguuauuggaagaag

SEQ ID NO: 85328 - RNA, 22 nt, Coxiella burnetii RSA 493
uaucgauguuuucaauaauuau

SEQ ID NO: 85329 - RNA, 22 nt, Coxiella burnetii RSA 493
ccguaugaagcgaagcgcaaua

SEQ ID NO: 85330 - RNA, 22 nt, Coxiella burnetii RSA 493
augaaaaaagaaucaaggcguu

SEQ ID NO: 85331 - RNA, 23 nt, Coxiella burnetii RSA 493
ggguguacaagcauuauuggaug

SEQ ID NO: 85332 - RNA, 22 nt, Coxiella burnetii RSA 493
uucccguauuucgcuucgcuuc

SEQ ID NO: 85333 - RNA, 22 nt, Coxiella burnetii RSA 493
uuuuuuacccucuccuagccuc

SEQ ID NO: 85334 - RNA, 22 nt, Coxiella burnetii RSA 493
aauugccaaacgaucauccguu

SEQ ID NO: 85335 - RNA, 22 nt, Coxiella burnetii RSA 493
uucccguacuucgcuucgcuca

SEQ ID NO: 85336 - RNA, 22 nt, Coxiella burnetii RSA 493
cccguauucguucgcucauacg

SEQ ID NO: 85337 - RNA, 22 nt, Coxiella burnetii RSA 493
uccccguauuucgcuucgcugc

SEQ ID NO: 85338 - RNA, 22 nt, Coxiella burnetii RSA 493
uucuuagccuuuuagccuggau

SEQ ID NO: 85339 - RNA, 22 nt, Coxiella burnetii RSA 493
ucugcgcaggacguaaaucggc

SEQ ID NO: 85340 - RNA, 22 nt, Coxiella burnetii RSA 493
ugauuuuaugagaaauauugcu

SEQ ID NO: 85341 - RNA, 22 nt, Coxiella burnetii RSA 493
aaggccgauuuuaucugcggug

SEQ ID NO: 85342 - RNA, 22 nt, Coxiella burnetii RSA 493
uucccguauuucgcuucgcuca

SEQ ID NO: 85343 - RNA, 22 nt, Coxiella burnetii RSA 493
ccguaugaagcgcagcggaaua

SEQ ID NO: 85344 - RNA, 22 nt, Coxiella burnetii RSA 493
cauuaaugaguuugccacgcga

SEQ ID NO: 85345 - RNA, 22 nt, Coxiella burnetii RSA 493
aaugucauaaaacuauuuucga

SEQ ID NO: 85346 - RNA, 22 nt, Coxiella burnetii RSA 493
ccguauuucgcuucgcugcaua

SEQ ID NO: 85347 - RNA, 22 nt, Coxiella burnetii RSA 493
uguugggcaggauuucguuugu

SEQ ID NO: 85348 - RNA, 21 nt, Coxiella burnetii RSA 493
guuuuauuagguuuucccgcu

SEQ ID NO: 85349 - RNA, 22 nt, Coxiella burnetii RSA 493
uauuucaaccugcucagaaacu

SEQ ID NO: 85350 - RNA, 22 nt, Coxiella burnetii RSA 493
agucuguuuacaauucgcuagu

SEQ ID NO: 85351 - RNA, 22 nt, Coxiella burnetii RSA 493
caacgguugagcaauuuuaugu

SEQ ID NO: 85352 - RNA, 22 nt, Coxiella burnetii RSA 493
gaaaauugaacguugauaacag

SEQ ID NO: 85353 - RNA, 22 nt, Coxiella burnetii RSA 493
cguauuccgcugcgcugcauaa

SEQ ID NO: 85354 - RNA, 22 nt, Coxiella burnetii RSA 493
cuacgcuuucugcgaggugaaa

SEQ ID NO: 85355 - RNA, 22 nt, Coxiella burnetii RSA 493
aagcggaauacggggaauugua

SEQ ID NO: 85356 - RNA, 22 nt, Coxiella burnetii RSA 493
guauuucgcuucgcuucauacg

SEQ ID NO: 85357 - RNA, 22 nt, Coxiella burnetii RSA 493
ccguaugaagcgaagcggaaaa

SEQ ID NO: 85358 - RNA, 22 nt, Coxiella burnetii RSA 493
uauggagcgaagcggaauacag

SEQ ID NO: 85359 - RNA, 22 nt, Coxiella burnetii RSA 493
aauggaugaucacagaauaauu

SEQ ID NO: 85360 - RNA, 22 nt, Coxiella burnetii RSA 493
auggcguugaaauuaccgaucc

SEQ ID NO: 85361 - RNA, 22 nt, Coxiella burnetii RSA 493
cgcaauuuuccacuggauguuu

SEQ ID NO: 85362 - RNA, 22 nt, Coxiella burnetii RSA 493
gguuauuuggaacuugcgcaac

SEQ ID NO: 85363 - RNA, 22 nt, Coxiella burnetii RSA 493
cagaaaaagacccuucagguaa

SEQ ID NO: 85364 - RNA, 22 nt, Coxiella burnetii RSA 493
gcucuuuuuucugaugaagaua

SEQ ID NO: 85365 - RNA, 22 nt, Coxiella burnetii RSA 493
cguauuccgcuaacgccccaua

SEQ ID NO: 85366 - RNA, 22 nt, Coxiella burnetii RSA 493
uugaaauugauuaguggauacu

SEQ ID NO: 85367 - RNA, 22 nt, Coxiella burnetii RSA 493
guuuggcguacuuaaauuuauu

SEQ ID NO: 85368 - RNA, 22 nt, Coxiella burnetii RSA 493
uuuuaugcgccuguuguucuuc

SEQ ID NO: 85369 - RNA, 18 nt, Coxiella burnetii RSA 493
auggcgguugcuaauuca

SEQ ID NO: 85370 - RNA, 22 nt, Coxiella burnetii RSA 493
ccuuuaaaaaugcaauucguag

SEQ ID NO: 85371 - RNA, 22 nt, Coxiella burnetii RSA 493
agcgaagcgaaauacggggacg

SEQ ID NO: 85372 - RNA, 21 nt, Coxiella burnetii RSA 493
cguauuacgcuucgcucauac

SEQ ID NO: 85373 - RNA, 22 nt, Coxiella burnetii RSA 493
uuuuacuuggagcaaagcggau

SEQ ID NO: 85374 - RNA, 22 nt, Coxiella burnetii RSA 493
uauuucacuucgcucauacagc

SEQ ID NO: 85375 - RNA, 22 nt, Coxiella burnetii RSA 493
guaugagcgaagcggaauacgg

SEQ ID NO: 85376 - RNA, 22 nt, Coxiella burnetii RSA 493
cacguuuuuauuaguaauggcg

SEQ ID NO: 85377 - RNA, 23 nt, Coxiella burnetii RSA 493
ccaaguagcuaucgaccguugga

SEQ ID NO: 85378 - RNA, 22 nt, Coxiella burnetii RSA 493
auugcuuuuguguuagcgcugg

SEQ ID NO: 85379 - RNA, 22 nt, Coxiella burnetii RSA 493
gugcaggcgcuagcauuggccg

SEQ ID NO: 85380 - RNA, 22 nt, Coxiella burnetii RSA 493
uaugagcgaagcguaauacggg

SEQ ID NO: 85381 - RNA, 22 nt, Coxiella burnetii RSA 493
ccuuuuuaucgcgugaguccau

SEQ ID NO: 85382 - RNA, 22 nt, Coxiella burnetii RSA 493
auuccgcuucgcuucauauggg

SEQ ID NO: 85383 - RNA, 22 nt, Coxiella burnetii RSA 493
aauuggggguauucguuauagu

SEQ ID NO: 85384 - RNA, 22 nt, Coxiella burnetii RSA 493
uaagaugagcccaucggugaag

SEQ ID NO: 85385 - RNA, 22 nt, Coxiella burnetii RSA 493
uucccguauucguucgcucaua

SEQ ID NO: 85386 - RNA, 22 nt, Coxiella burnetii RSA 493
uggcgcugaugugauugcgcca

SEQ ID NO: 85387 - RNA, 19 nt, Coxiella burnetii RSA 493
gguuaugauuuuauucccg

SEQ ID NO: 85388 - RNA, 22 nt, Coxiella burnetii RSA 493
ugcagguaaauucggaacccac

SEQ ID NO: 85389 - RNA, 22 nt, Coxiella burnetii RSA 493
uccccguauuucgcuucgcuuc

SEQ ID NO: 85390 - RNA, 22 nt, Coxiella burnetii RSA 493
gaucgccguccaaauguuuuua

SEQ ID NO: 85391 - RNA, 22 nt, Coxiella burnetii RSA 493
agagaguugcauuacugaaugc

SEQ ID NO: 85392 - RNA, 22 nt, Coxiella burnetii RSA 493
ggcuacuuagcuacucggcccg

SEQ ID NO: 85393 - RNA, 22 nt, Coxiella burnetii RSA 493
gaaagucauugauaauagcgcg

SEQ ID NO: 85394 - RNA, 22 nt, Coxiella burnetii RSA 493
aguaaaauucucuuuauccaug

SEQ ID NO: 85395 - RNA, 22 nt, Coxiella burnetii RSA 493
aaccgggauuuauucgagcggc

SEQ ID NO: 85396 - RNA, 22 nt, Coxiella burnetii RSA 493
ugaauuaauggcucuacguuuu

SEQ ID NO: 85397 - RNA, 22 nt, Coxiella burnetii RSA 493
cgacgauuauugaagaugacug

SEQ ID NO: 85398 - RNA, 22 nt, Coxiella burnetii RSA 493
uucaacauuagcggcugcuuua

SEQ ID NO: 85399 - RNA, 22 nt, Coxiella burnetii RSA 493
ugauugaugaucguaucgaucg

SEQ ID NO: 85400 - RNA, 22 nt, Coxiella burnetii RSA 493
acaugaguaagccaaagauacg

SEQ ID NO: 85401 - RNA, 22 nt, Coxiella burnetii RSA 493
cccguauuacuucgcugcauac

SEQ ID NO: 85402 - RNA, 22 nt, Coxiella burnetii RSA 493
aaaccgauuuguuuuggauugg

SEQ ID NO: 85403 - RNA, 22 nt, Coxiella burnetii RSA 493
guugucuuuugcgauuccuuau

SEQ ID NO: 85404 - RNA, 22 nt, Coxiella burnetii RSA 493
uaaaguuuguucuucggaagga

SEQ ID NO: 85405 - RNA, 22 nt, Coxiella burnetii RSA 493
auugauuuauugccuccugaug

SEQ ID NO: 85406 - RNA, 22 nt, Coxiella burnetii RSA 493
cgaucagccacaaugaaagccg

SEQ ID NO: 85407 - RNA, 19 nt, Coxiella burnetii RSA 493
uugguagauaaaaccguaa

SEQ ID NO: 85408 - RNA, 22 nt, Coxiella burnetii RSA 493
auugaagucgauaugauugugc

SEQ ID NO: 85409 - RNA, 22 nt, Coxiella burnetii RSA 493
ccguaugaagcaaagcggaaua

SEQ ID NO: 85410 - RNA, 17 nt, Coxiella burnetii RSA 493
gaaauguuucuacuaaa

SEQ ID NO: 85411 - RNA, 20 nt, Coxiella burnetii RSA 493
aacgucguuaaaauucgucc

SEQ ID NO: 85412 - RNA, 22 nt, Coxiella burnetii RSA 493
uaugaagcgcagcgaaaugccg

SEQ ID NO: 85413 - RNA, 22 nt, Coxiella burnetii RSA 493
uuaacgauggucggaucgcauu

SEQ ID NO: 85414 - RNA, 22 nt, Coxiella burnetii RSA 493
aagcgaaauacgggaaaacaau

SEQ ID NO: 85415 - RNA, 22 nt, Coxiella burnetii RSA 493
agugcgcuggguccucgccuuc

SEQ ID NO: 85416 - RNA, 22 nt, Coxiella burnetii RSA 493
gcgaagcgaaacacggggacga

SEQ ID NO: 85417 - RNA, 22 nt, Coxiella burnetii RSA 493
aaaucgcuauaaucuucgacga

SEQ ID NO: 85418 - RNA, 22 nt, Coxiella burnetii RSA 493
augcagcgaagcggaauacgag

SEQ ID NO: 85419 - RNA, 22 nt, Coxiella burnetii RSA 493
aucacgaaugauaaucauauuu

SEQ ID NO: 85420 - RNA, 22 nt, Coxiella burnetii RSA 493
gugauugacgauugucuaaaac

SEQ ID NO: 85421 - RNA, 22 nt, Coxiella burnetii RSA 493
aaaauuagcauagagcgaccca

SEQ ID NO: 85422 - RNA, 22 nt, Coxiella burnetii RSA 493
cgggccgaguagcuaaguagcc

SEQ ID NO: 85423 - RNA, 22 nt, Coxiella burnetii RSA 493
aauauugccgauguggucguuu

SEQ ID NO: 85424 - RNA, 22 nt, Coxiella burnetii RSA 493
gcaggggggaauccagcgcgcu

SEQ ID NO: 85425 - RNA, 22 nt, Coxiella burnetii RSA 493
ugucgcguagcgacacaaccac

SEQ ID NO: 85426 - RNA, 22 nt, Coxiella burnetii RSA 493
cguuauuagcuuuugguggcgu

SEQ ID NO: 85427 - RNA, 22 nt, Coxiella burnetii RSA 493
aauuauuaaugaaacguauuga

SEQ ID NO: 85428 - RNA, 22 nt, Coxiella burnetii RSA 493
gucuuuuuggaagcuuuugaag

SEQ ID NO: 85429 - RNA, 22 nt, Coxiella burnetii RSA 493
guuuugcauggcagaaacgaua

SEQ ID NO: 85430 - RNA, 22 nt, Coxiella burnetii RSA 493
uucuccguauuccgcuucgcug

SEQ ID NO: 85431 - RNA, 20 nt, Coxiella burnetii RSA 493
ucccgcgccucgaugcgguu

SEQ ID NO: 85432 - RNA, 22 nt, Coxiella burnetii RSA 493
ugguugugucgcuacgcgacaa

SEQ ID NO: 85433 - RNA, 19 nt, Coxiella burnetii RSA 493
auacggugugaugguugau

SEQ ID NO: 85434 - RNA, 22 nt, Coxiella burnetii RSA 493
uauuucgcugcgcuucauacga

SEQ ID NO: 85435 - RNA, 22 nt, Coxiella burnetii RSA 493
cccguauuucgcuucgcucaga

SEQ ID NO: 85436 - RNA, 22 nt, Coxiella burnetii RSA 493
uggaccaaugcuuuuuuugcau

SEQ ID NO: 85437 - RNA, 22 nt, Coxiella burnetii RSA 493
gucuguuuacgauucuacuagu

SEQ ID NO: 85438 - RNA, 22 nt, Coxiella burnetii RSA 493
cugugcaaauucgcgugcguga

SEQ ID NO: 85439 - RNA, 22 nt, Coxiella burnetii RSA 493
gcaaugaggugcugcucaauuu

SEQ ID NO: 85440 - RNA, 22 nt, Coxiella burnetii RSA 493
caguggcgcaaugaaaaugauc

SEQ ID NO: 85441 - RNA, 22 nt, Coxiella burnetii RSA 493
ucaguuucugauauuuuccuau

SEQ ID NO: 85442 - RNA, 22 nt, Coxiella burnetii RSA 493
gauuggaaugauugccuuuagu

SEQ ID NO: 85443 - RNA, 16 nt, Coxiella burnetii RSA 493
ugaaauagugccucuc

SEQ ID NO: 85444 - RNA, 22 nt, Coxiella burnetii RSA 493
ccguauuucgcuucgcuucaua

SEQ ID NO: 85445 - RNA, 22 nt, Coxiella burnetii RSA 493
agcgaagcgaaauacgggacga

SEQ ID NO: 85446 - RNA, 22 nt, Coxiella burnetii RSA 493
cauuguuucccguauuucgcuu

SEQ ID NO: 85447 - RNA, 22 nt, Coxiella burnetii RSA 493
aaagcaauaggguuaguaacug

SEQ ID NO: 85448 - RNA, 22 nt, Coxiella burnetii RSA 493
cgcacgcucggaaauugucgaa

SEQ ID NO: 85449 - RNA, 19 nt, Coxiella burnetii RSA 493
uuuuuguuagguagaaaga

SEQ ID NO: 85450 - RNA, 22 nt, Coxiella burnetii RSA 493
uucccguauuucgcuucacucc

SEQ ID NO: 85451 - RNA, 22 nt, Coxiella burnetii RSA 493
uugcggaaaucacagacaucgc

SEQ ID NO: 85452 - RNA, 22 nt, Coxiella burnetii RSA 493
auuucagccguuucucguuuga

SEQ ID NO: 85453 - RNA, 22 nt, Coxiella burnetii RSA 493
ugaccgcgggacccagaaaauu

SEQ ID NO: 85454 - RNA, 22 nt, Coxiella burnetii RSA 493
agcuggguuggaaauaguaccc

SEQ ID NO: 85455 - RNA, 22 nt, Coxiella burnetii RSA 493
uuuuagcacuuucagcagggaa

SEQ ID NO: 85456 - RNA, 22 nt, Coxiella burnetii RSA 493
auccacgcgaugcugaggagcu

SEQ ID NO: 85457 - RNA, 22 nt, Coxiella burnetii RSA 493
guuggcggggaagcguuaauca

SEQ ID NO: 85458 - RNA, 22 nt, Coxiella burnetii RSA 493
uaaacguuuuauucucguuguc

SEQ ID NO: 85459 - RNA, 22 nt, Coxiella burnetii RSA 493
ugaguuaugcuguacuuauguu

SEQ ID NO: 85460 - RNA, 22 nt, Coxiella burnetii RSA 493
ccaaagcauuacgcgcugcuaa

SEQ ID NO: 85461 - RNA, 22 nt, Coxiella burnetii RSA 493
ugcgaaaaagauaguaauucca

SEQ ID NO: 85462 - RNA, 22 nt, Coxiella burnetii RSA 493
caagaaauagcaagcggccagu

SEQ ID NO: 85463 - RNA, 23 nt, Coxiella burnetii RSA 493
accguugccgaucgagguucguc

SEQ ID NO: 85464 - RNA, 22 nt, Coxiella burnetii RSA 493
augagcgaagcgaaauacgggg

SEQ ID NO: 85465 - RNA, 22 nt, Coxiella burnetii RSA 493
agcgaagcgaaauacgggaaaa

SEQ ID NO: 85466 - RNA, 23 nt, Coxiella burnetii RSA 493
auuuuggcauuucaugacaucgg

SEQ ID NO: 85467 - RNA, 22 nt, Coxiella burnetii RSA 493
ucccgcgccucgaugcgguuug

SEQ ID NO: 85468 - RNA, 22 nt, Coxiella burnetii RSA 493
uagcggcugauuuacaugcugu

SEQ ID NO: 85469 - RNA, 22 nt, Coxiella burnetii RSA 493
uauuauuuccuguauuccgcuu

SEQ ID NO: 85470 - RNA, 19 nt, Coxiella burnetii RSA 493
ugcuuuuuagcgaucuugg

SEQ ID NO: 85471 - RNA, 22 nt, Coxiella burnetii RSA 493
cccguauuccgcuucgcucaua

SEQ ID NO: 85472 - RNA, 22 nt, Coxiella burnetii RSA 493
uuguugaugagaaccggguuga

SEQ ID NO: 85473 - RNA, 22 nt, Coxiella burnetii RSA 493
cauuucccguauuucgcuucgc

SEQ ID NO: 85474 - RNA, 22 nt, Coxiella burnetii RSA 493
guuggcuuagauaauugaucgg

SEQ ID NO: 85475 - RNA, 22 nt, Coxiella burnetii RSA 493
uauuccgcugcgcuucauacgg

SEQ ID NO: 85476 - RNA, 22 nt, Coxiella burnetii RSA 493
auuggcauuguuauugggacuu

SEQ ID NO: 85477 - RNA, 22 nt, Coxiella burnetii RSA 493
ugauuaaaaauauuucacugac

SEQ ID NO: 85478 - RNA, 22 nt, Coxiella burnetii RSA 493
uuguccccguauuucgcuucgc

SEQ ID NO: 85479 - RNA, 22 nt, Coxiella burnetii RSA 493
gagaaagguucuugucaaguuu

SEQ ID NO: 85480 - RNA, 22 nt, Coxiella burnetii RSA 493
aagcgaaauacgggacgauaga

SEQ ID NO: 85481 - RNA, 22 nt, Coxiella burnetii RSA 493
uaaucguccguaggaagcgcgg

SEQ ID NO: 85482 - RNA, 22 nt, Coxiella burnetii RSA 493
uuucggguuuguuaugcaaaag

SEQ ID NO: 85483 - RNA, 22 nt, Coxiella burnetii RSA 493
uauuaauugaggguuaucgucg

SEQ ID NO: 85484 - RNA, 22 nt, Coxiella burnetii RSA 493
ucgccguuaaaacggaugauaa

SEQ ID NO: 85485 - RNA, 22 nt, Coxiella burnetii RSA 493
ggcgauagagcggaugcuuauu

SEQ ID NO: 85486 - RNA, 22 nt, Coxiella burnetii RSA 493
caaagcgaccuuaccuaucgau

SEQ ID NO: 85487 - RNA, 22 nt, Coxiella burnetii RSA 493
uuguuuccccguauuucgcuuc

SEQ ID NO: 85488 - RNA, 22 nt, Coxiella burnetii RSA 493
uaucggcuucaagagacguuga

SEQ ID NO: 85489 - RNA, 22 nt, Coxiella burnetii RSA 493
uaugagcgaagcgaaauacggg

SEQ ID NO: 85490 - RNA, 22 nt, Coxiella burnetii RSA 493
uucgugugcgauuagccgaggu

SEQ ID NO: 85491 - RNA, 22 nt, Coxiella burnetii RSA 493
gcugacuuucacgucuuucuac

SEQ ID NO: 85492 - RNA, 22 nt, Coxiella burnetii RSA 493
cgauggaaaaaaugaauuacgu

SEQ ID NO: 85493 - RNA, 22 nt, Coxiella burnetii RSA 493
ugaauuuugcaaucgccaucgc

SEQ ID NO: 85494 - RNA, 22 nt, Coxiella burnetii RSA 493
cccagauuagggggcuaagaaa

SEQ ID NO: 85495 - RNA, 22 nt, Coxiella burnetii RSA 493
ugcagcgaagcgaaauacggga

SEQ ID NO: 85496 - RNA, 22 nt, Coxiella burnetii RSA 493
cuucccaauuaaauauuuccuc

SEQ ID NO: 85497 - RNA, 22 nt, Coxiella burnetii RSA 493
aagcccguauggagcgaagcga

SEQ ID NO: 85498 - RNA, 19 nt, Coxiella burnetii RSA 493
aaugaugauggguaugcgu

SEQ ID NO: 85499 - RNA, 22 nt, Coxiella burnetii RSA 493
ugaagcgauuaugcucgcgacg

SEQ ID NO: 85500 - RNA, 22 nt, Coxiella burnetii RSA 493
uauuucgcugcgcugcauacgg

SEQ ID NO: 85501 - RNA, 22 nt, Coxiella burnetii RSA 493
uucuacuuccauugacaauggg

SEQ ID NO: 85502 - RNA, 22 nt, Coxiella burnetii RSA 493
ucaauggcuuuggcaacggugg

SEQ ID NO: 85503 - RNA, 22 nt, Coxiella burnetii RSA 493
gaagcgaagcgaaauacgggga

SEQ ID NO: 85504 - RNA, 22 nt, Coxiella burnetii RSA 493
cgugcuuuuccuuaaccccgcu

SEQ ID NO: 85505 - RNA, 22 nt, Coxiella burnetii RSA 493
auuucuuagagaagcgcuugaa

SEQ ID NO: 85506 - RNA, 22 nt, Coxiella burnetii RSA 493
uauuguuuggcgucacuuauuu

SEQ ID NO: 85507 - RNA, 22 nt, Coxiella burnetii RSA 493
uuuucuuaguauuguuagucug

SEQ ID NO: 85508 - RNA, 22 nt, Coxiella burnetii RSA 493
ugggccgguaggaauugcagau

SEQ ID NO: 85509 - RNA, 22 nt, Coxiella burnetii RSA 493
ucgcaaaauaauuccacugacu

SEQ ID NO: 85510 - RNA, 22 nt, Coxiella burnetii RSA 493
uauuccgcuuugcuucauacgg

SEQ ID NO: 85511 - RNA, 22 nt, Coxiella burnetii RSA 493
gcaagcucagcccaaccuacgu

SEQ ID NO: 85512 - RNA, 22 nt, Coxiella burnetii RSA 493
auagcccguaugaagcaaagcg

SEQ ID NO: 85513 - RNA, 22 nt, Coxiella burnetii RSA 493
acguaugagcgaagcgaaauac

SEQ ID NO: 85514 - RNA, 22 nt, Coxiella burnetii RSA 493
uccccuauuccgcuucgcugca

SEQ ID NO: 85515 - RNA, 22 nt, Coxiella burnetii RSA 493
uauaugaagcgcagcgaauacg

SEQ ID NO: 85516 - RNA, 22 nt, Coxiella burnetii RSA 493
caaacguguauugauggacaau

SEQ ID NO: 85517 - RNA, 22 nt, Coxiella burnetii RSA 493
ccguauuucgcugcgcuucaua

SEQ ID NO: 85518 - RNA, 22 nt, Coxiella burnetii RSA 493
cccguauuucgcuucgcuucau

SEQ ID NO: 85519 - RNA, 22 nt, Coxiella burnetii RSA 493
cagccguguaaguuuuggauua

SEQ ID NO: 85520 - RNA, 22 nt, Coxiella burnetii RSA 493
ucggccuugcuaagaugaauau

SEQ ID NO: 85521 - RNA, 22 nt, Coxiella burnetii RSA 493
aaaugcgacaaucauuuuugua

SEQ ID NO: 85522 - RNA, 22 nt, Coxiella burnetii RSA 493
auuguucgauuaaaauguucgc

SEQ ID NO: 85523 - RNA, 22 nt, Coxiella burnetii RSA 493
uuacggcagaaagaguuugcgc

SEQ ID NO: 85524 - RNA, 22 nt, Coxiella burnetii RSA 493
aaaauaauuauucacgaagcua

SEQ ID NO: 85525 - RNA, 22 nt, Coxiella burnetii RSA 493
ugcgauuguauuuagaaaaagg

SEQ ID NO: 85526 - RNA, 22 nt, Coxiella burnetii RSA 493
agcgaacgaauacgggaaaaca

SEQ ID NO: 85527 - RNA, 22 nt, Coxiella burnetii RSA 493
cccgggaauggugaagucuaaa

SEQ ID NO: 85528 - RNA, 22 nt, Coxiella burnetii RSA 493
auuaaguauauuugcaguuugc

SEQ ID NO: 85529 - RNA, 19 nt, Coxiella burnetii RSA 493
ucaaaaaaaugcugagaug

SEQ ID NO: 85530 - RNA, 22 nt, Coxiella burnetii RSA 493
auuacaaggcauuauucgcaaa

SEQ ID NO: 85531 - RNA, 22 nt, Coxiella burnetii RSA 493
aauuugaacuuuggugaaaucg

SEQ ID NO: 85532 - RNA, 22 nt, Coxiella burnetii RSA 493
uugauucugaacgagcuaauug

SEQ ID NO: 85533 - RNA, 22 nt, Coxiella burnetii RSA 493
augucguuaccuauuuaugacc

SEQ ID NO: 85534 - RNA, 22 nt, Coxiella burnetii RSA 493
uuucuuagacuuuuagccugga

SEQ ID NO: 85535 - RNA, 22 nt, Coxiella burnetii RSA 493
uccccguauuccgcugcgcuuc

SEQ ID NO: 85536 - RNA, 22 nt, Coxiella burnetii RSA 493
gggaaaauaggugucuuugauc

SEQ ID NO: 85537 - RNA, 22 nt, Coxiella burnetii RSA 493
caucauccugacccuacuauuc

SEQ ID NO: 85538 - RNA, 22 nt, Coxiella burnetii RSA 493
cggguucugauggauguugaau

SEQ ID NO: 85539 - RNA, 22 nt, Coxiella burnetii RSA 493
uuucccguauuucgcuucgcug

SEQ ID NO: 85540 - RNA, 22 nt, Coxiella burnetii RSA 493
guauuucgccgcgcuucauaca

SEQ ID NO: 85541 - RNA, 22 nt, Coxiella burnetii RSA 493
uucuuuucggcauaaacagcgg

SEQ ID NO: 85542 - RNA, 22 nt, Coxiella burnetii RSA 493
ucggcacagccaugauuguuua

SEQ ID NO: 85543 - RNA, 22 nt, Coxiella burnetii RSA 493
ugaaaucgaugacgaagcggcu

SEQ ID NO: 85544 - RNA, 22 nt, Coxiella burnetii RSA 493
uauuccgcuucgcuuuauacgu

SEQ ID NO: 85545 - RNA, 22 nt, Coxiella burnetii RSA 493
auagaaccacaugaauagugcu

SEQ ID NO: 85546 - RNA, 22 nt, Coxiella burnetii RSA 493
auuccgcuucgcuucauacggg

SEQ ID NO: 85547 - RNA, 21 nt, Coxiella burnetii RSA 493
aaauucuucuucucauugcga

SEQ ID NO: 85548 - RNA, 22 nt, Coxiella burnetii RSA 493
aguaacugagaaaaagcguuua

SEQ ID NO: 85549 - RNA, 22 nt, Coxiella burnetii RSA 493
gugaugaugggugaaaugucua

SEQ ID NO: 85550 - RNA, 22 nt, Coxiella burnetii RSA 493
ccgauauuguguggcagcgccu

SEQ ID NO: 85551 - RNA, 21 nt, Coxiella burnetii RSA 493
acaauccgccugagugauggc

SEQ ID NO: 85552 - RNA, 22 nt, Coxiella burnetii RSA 493
auugauuuuauugagacuuagu

SEQ ID NO: 85553 - RNA, 22 nt, Coxiella burnetii RSA 493
ugcagcgaagcggaauagggga

SEQ ID NO: 85554 - RNA, 22 nt, Coxiella burnetii RSA 493
uguuuucccguauuucgcuucg

SEQ ID NO: 85555 - RNA, 22 nt, Coxiella burnetii RSA 493
uauuguccccguauuucgcuuc

SEQ ID NO: 85556 - RNA, 22 nt, Coxiella burnetii RSA 493
ggucaggccuuuauuaucaggg

SEQ ID NO: 85557 - RNA, 22 nt, Coxiella burnetii RSA 493
uaugcagcgaagcgaaauacgg

SEQ ID NO: 85558 - RNA, 22 nt, Coxiella burnetii RSA 493
ugucgccaccaugcagcgagaa

SEQ ID NO: 85559 - RNA, 22 nt, Coxiella burnetii RSA 493
aaacgagcguuuacuaauuuau

SEQ ID NO: 85560 - RNA, 22 nt, Coxiella burnetii RSA 493
uugcugauaaugaucaagauca

SEQ ID NO: 85561 - RNA, 22 nt, Coxiella burnetii RSA 493
uugguuguuccacggcggcaua

SEQ ID NO: 85562 - RNA, 22 nt, Coxiella burnetii RSA 493
ugagcgaagcgaaauacgggga

SEQ ID NO: 85563 - RNA, 22 nt, Coxiella burnetii RSA 493
guugggcugagcuugcgaagcc

SEQ ID NO: 85564 - RNA, 20 nt, Coxiella burnetii RSA 493
uuuuauuugcuuuggaagca

SEQ ID NO: 85565 - RNA, 22 nt, Coxiella burnetii RSA 493
uuuaaacauauccaaugguaac

SEQ ID NO: 85566 - RNA, 22 nt, Coxiella burnetii RSA 493
ugacucaaggugaaauugaugg

SEQ ID NO: 85567 - RNA, 22 nt, Coxiella burnetii RSA 493
uauaaacaauucuuggggcguu

SEQ ID NO: 85568 - RNA, 22 nt, Coxiella burnetii RSA 493
acuucaaaguugacgacguauu

SEQ ID NO: 85569 - RNA, 22 nt, Coxiella burnetii RSA 493
gaggcgauuggaguaaagucag

SEQ ID NO: 85570 - RNA, 22 nt, Coxiella burnetii RSA 493
uaaggagaggguuuuuaaagaa

SEQ ID NO: 85571 - RNA, 22 nt, Coxiella burnetii RSA 493
auuguccccguauuucgcuucg

SEQ ID NO: 85572 - RNA, 22 nt, Coxiella burnetii RSA 493
uaugcagcgaagcggaauacgg

SEQ ID NO: 85573 - RNA, 22 nt, Coxiella burnetii RSA 493
uaugagcgaagcgaaauacgag

SEQ ID NO: 85574 - RNA, 22 nt, Coxiella burnetii RSA 493
uaugaagcgaagcgaaauacgg

SEQ ID NO: 85575 - RNA, 22 nt, Coxiella burnetii RSA 493
gaagcggaauacgggaaaacaa

SEQ ID NO: 85576 - RNA, 20 nt, Coxiella burnetii RSA 493
uaugggcacguuuuggugau

SEQ ID NO: 85577 - RNA, 22 nt, Coxiella burnetii RSA 493
uuucgcuucgcugcauacggac

SEQ ID NO: 85578 - RNA, 22 nt, Coxiella burnetii RSA 493
uucccguauucgcuucguuuca

SEQ ID NO: 85579 - RNA, 22 nt, Coxiella burnetii RSA 493
gguguucgaugaggcuuucaac

SEQ ID NO: 85580 - RNA, 22 nt, Coxiella burnetii RSA 493
agcuauuagaauauucauuuaa

SEQ ID NO: 85581 - RNA, 22 nt, Coxiella burnetii RSA 493
ugagcaaagcgaaauacgggaa

SEQ ID NO: 85582 - RNA, 18 nt, Coxiella burnetii RSA 493
auccagcucucuacgucu

SEQ ID NO: 85583 - RNA, 22 nt, Coxiella burnetii RSA 493
uuucgacgguagcuaaaggcuu

SEQ ID NO: 85584 - RNA, 22 nt, Coxiella burnetii RSA 493
auuccaaucuggaugaauucca

SEQ ID NO: 85585 - RNA, 22 nt, Coxiella burnetii RSA 493
gcagcgaagcgaaauacgggga

SEQ ID NO: 85586 - RNA, 22 nt, Coxiella burnetii RSA 493
guaggcgggaaucuagcgcgcu

SEQ ID NO: 85587 - RNA, 22 nt, Coxiella burnetii RSA 493
uuuuagucguucuuauucgcca

SEQ ID NO: 85588 - RNA, 22 nt, Coxiella burnetii RSA 493
uucccguauuccgcuucgcugc

SEQ ID NO: 85589 - RNA, 22 nt, Coxiella burnetii RSA 493
ccguauggagcgaagcggaaua

SEQ ID NO: 85590 - RNA, 20 nt, Coxiella burnetii RSA 493
ucgccgcacaagcgggcgug

SEQ ID NO: 85591 - RNA, 22 nt, Coxiella burnetii RSA 493
aaugugaguaauuaaaacuuua

SEQ ID NO: 85592 - RNA, 22 nt, Coxiella burnetii RSA 493
auuuauuuggucuggcggagau

SEQ ID NO: 85593 - RNA, 22 nt, Coxiella burnetii RSA 493
guuauuggaagucguuuuggca

SEQ ID NO: 85594 - RNA, 22 nt, Coxiella burnetii RSA 493
uucgcuaucauuuaacaccaug

SEQ ID NO: 85595 - RNA, 22 nt, Coxiella burnetii RSA 493
cgaauaaaccuuaucgaguuaa

SEQ ID NO: 85596 - RNA, 22 nt, Coxiella burnetii RSA 493
aaucugcuuagagccaccaaag

SEQ ID NO: 85597 - RNA, 22 nt, Coxiella burnetii RSA 493
auugcgcuucgcuucauacggg

SEQ ID NO: 85598 - RNA, 23 nt, Coxiella burnetii RSA 493
auuggcgauaucuugaggauuaa

SEQ ID NO: 85599 - RNA, 22 nt, Coxiella burnetii RSA 493
cguauuucgcuucgcucauacg

SEQ ID NO: 85600 - RNA, 22 nt, Coxiella burnetii RSA 493
uuacuuauggcacgauggcagc

SEQ ID NO: 85601 - RNA, 22 nt, Coxiella burnetii RSA 493
auuaaugaugaagauuuugaua

SEQ ID NO: 85602 - RNA, 22 nt, Coxiella burnetii RSA 493
cacaguuaaaagggggagaaug

SEQ ID NO: 85603 - RNA, 22 nt, Coxiella burnetii RSA 493
caaaccauuacgcucugcgguu

SEQ ID NO: 85604 - RNA, 22 nt, Coxiella burnetii RSA 493
uuauagaaaugagcuaaagcgg

SEQ ID NO: 85605 - RNA, 22 nt, Coxiella burnetii RSA 493
uauuucgcuucgcucauacgua

SEQ ID NO: 85606 - RNA, 22 nt, Coxiella burnetii RSA 493
ccuuuuucuuuagcggcguuaa

SEQ ID NO: 85607 - RNA, 21 nt, Coxiella burnetii RSA 493
ccguauuucgcuucgcucaua

SEQ ID NO: 85608 - RNA, 22 nt, Coxiella burnetii RSA 493
acaguuuucguccuuuugacug

SEQ ID NO: 85609 - RNA, 22 nt, Coxiella burnetii RSA 493
guauggagaagcagaauacggg

SEQ ID NO: 85610 - RNA, 21 nt, Coxiella burnetii RSA 493
augcuuuugcuuccauugcca

SEQ ID NO: 85611 - RNA, 22 nt, Coxiella burnetii RSA 493
augagcgaacgaaauacgggga

SEQ ID NO: 85612 - RNA, 19 nt, Coxiella burnetii RSA 493
uuaaccacacugaugccgc

SEQ ID NO: 85613 - RNA, 22 nt, Coxiella burnetii RSA 493
cccguauuccgcuucgcugcau

SEQ ID NO: 85614 - RNA, 22 nt, Coxiella burnetii RSA 493
cgguuaaaaaugugauuggcag

SEQ ID NO: 85615 - RNA, 22 nt, Coxiella burnetii RSA 493
auuagcugcaacaaccuugugg

SEQ ID NO: 85616 - RNA, 22 nt, Coxiella burnetii RSA 493
aacaaggauuguaaugagcagc

SEQ ID NO: 85617 - RNA, 22 nt, Coxiella burnetii RSA 493
ggguucuuuuguguggccaugc

SEQ ID NO: 85618 - RNA, 22 nt, Coxiella burnetii RSA 493
augcagcgaagcgaaauacggg

SEQ ID NO: 85619 - RNA, 22 nt, Coxiella burnetii RSA 493
guugauuugcauauugcgccga

SEQ ID NO: 85620 - RNA, 22 nt, Coxiella burnetii RSA 493
aucaaugaauucuggcucagcc

SEQ ID NO: 85621 - RNA, 22 nt, Coxiella burnetii RSA 493
gggaaauuguagguacgaaugc

SEQ ID NO: 85622 - RNA, 22 nt, Coxiella burnetii RSA 493
auauugguauucaucgucgccg

SEQ ID NO: 85623 - RNA, 19 nt, Coxiella burnetii RSA 493
cuuucguucaugaaugugg

SEQ ID NO: 85624 - RNA, 22 nt, Coxiella burnetii RSA 493
cccguaucucguucgcucauac

SEQ ID NO: 85625 - RNA, 22 nt, Coxiella burnetii RSA 493
gaugaucaaggaaaaauuaucu

SEQ ID NO: 85626 - RNA, 22 nt, Coxiella burnetii RSA 493
ucguccccguauuucgcuucgc

SEQ ID NO: 85627 - RNA, 22 nt, Coxiella burnetii RSA 493
guaguuaucgcucaguguuaag

SEQ ID NO: 85628 - RNA, 22 nt, Coxiella burnetii RSA 493
uuuucccaggugccauucugag

SEQ ID NO: 85629 - RNA, 22 nt, Coxiella burnetii RSA 493
cgccuuugacgaugaaguauuc

SEQ ID NO: 85630 - RNA, 22 nt, Coxiella burnetii RSA 493
uuucuuaggcuuuuagccggga

SEQ ID NO: 85631 - RNA, 22 nt, Coxiella burnetii RSA 493
uaauaaaugucugguaugcugg

SEQ ID NO: 85632 - RNA, 22 nt, Coxiella burnetii RSA 493
aaguuuuuggcgaccggcguaa

SEQ ID NO: 85633 - RNA, 22 nt, Coxiella burnetii RSA 493
cggcuugaccgcgguaucuaga

SEQ ID NO: 85634 - RNA, 19 nt, Coxiella burnetii RSA 493
auuugcaaugcagauugau

SEQ ID NO: 85635 - RNA, 22 nt, Coxiella burnetii RSA 493
ggcaguuaucgcaauagcgggu

SEQ ID NO: 85636 - RNA, 22 nt, Coxiella burnetii RSA 493
gugguuguguggcuucgccaca

SEQ ID NO: 85637 - RNA, 22 nt, Coxiella burnetii RSA 493
cccguauuucguucgcucauac

SEQ ID NO: 85638 - RNA, 22 nt, Coxiella burnetii RSA 493
uguccccguauuucgcuucgcu

SEQ ID NO: 85639 - RNA, 22 nt, Coxiella burnetii RSA 493
uaauuuuaaucgugaccaucug

SEQ ID NO: 85640 - RNA, 22 nt, Coxiella burnetii RSA 493
uguuuuucgauaucauuuaacu

SEQ ID NO: 85641 - RNA, 22 nt, Coxiella burnetii RSA 493
ggcugccacaggauuuuuaaag

SEQ ID NO: 85642 - RNA, 21 nt, Coxiella burnetii RSA 493
uauugcgcuucgcuucauacg

SEQ ID NO: 85643 - RNA, 21 nt, Coxiella burnetii RSA 493
acuuuaaugccuauagcugcu

SEQ ID NO: 85644 - RNA, 23 nt, Coxiella burnetii RSA 493
ccguauuucgcuucauacgggcu

SEQ ID NO: 85645 - RNA, 20 nt, Coxiella burnetii RSA 493
augccguuuuauuuucagac

SEQ ID NO: 85646 - RNA, 21 nt, Coxiella burnetii RSA 493
ccauccuucgccaagcuggcc

SEQ ID NO: 85647 - RNA, 22 nt, Coxiella burnetii RSA 493
ucguaugaagcgcagcgaaaua

SEQ ID NO: 85648 - RNA, 22 nt, Coxiella burnetii RSA 493
gaugaaaucacuuacguucaca

SEQ ID NO: 85649 - RNA, 22 nt, Coxiella burnetii RSA 493
gccauucucuucuccgagguuu

SEQ ID NO: 85650 - RNA, 22 nt, Coxiella burnetii RSA 493
uuaauccguugggcgauaaccg

SEQ ID NO: 85651 - RNA, 22 nt, Coxiella burnetii RSA 493
gaggaauuucgaugagcuuggu

SEQ ID NO: 85652 - RNA, 22 nt, Coxiella burnetii RSA 493
ggcuucgcaaacucagcccaac

SEQ ID NO: 85653 - RNA, 22 nt, Coxiella burnetii RSA 493
cccggauuagggggcuaagaaa

SEQ ID NO: 85654 - RNA, 22 nt, Coxiella burnetii RSA 493
acugguuuuaaacauugcgagc

SEQ ID NO: 85655 - RNA, 18 nt, Coxiella burnetii RSA 493
uuggcgaagccacacaac

SEQ ID NO: 85656 - RNA, 22 nt, Coxiella burnetii RSA 493
agcgaagcggaauacggggacg

SEQ ID NO: 85657 - RNA, 22 nt, Coxiella burnetii RSA 493
ucaggauaagggaguaaggcau

SEQ ID NO: 85658 - RNA, 22 nt, Coxiella burnetii RSA 493
aaaugaauuuaggaaagccagc

SEQ ID NO: 85659 - RNA, 22 nt, Coxiella burnetii RSA 493
aacauugcuguuggcagcacgu

SEQ ID NO: 85660 - RNA, 22 nt, Coxiella burnetii RSA 493
gugagaaaauuaauuauuuauu

SEQ ID NO: 85661 - RNA, 22 nt, Coxiella burnetii RSA 493
agugcgcuggguccccgccugc

SEQ ID NO: 85662 - RNA, 22 nt, Coxiella burnetii RSA 493
uaugcagcgaacgaauacggga

SEQ ID NO: 85663 - RNA, 22 nt, Coxiella burnetii RSA 493
ugaaaguauagguuuucaagcu

SEQ ID NO: 85664 - RNA, 22 nt, Coxiella burnetii RSA 493
cugagaaauacugucgaaagug

SEQ ID NO: 85665 - RNA, 22 nt, Coxiella burnetii RSA 493
cgaagcgaaauacgggaacgau

SEQ ID NO: 85666 - RNA, 22 nt, Coxiella burnetii RSA 493
auuguuuucccguauuucgcuu

SEQ ID NO: 85667 - RNA, 22 nt, Coxiella burnetii RSA 493
uccccguauuucgcuucgcucc

SEQ ID NO: 85668 - RNA, 22 nt, Coxiella burnetii RSA 493
aucguccccguauuucgcuucg

SEQ ID NO: 85669 - RNA, 22 nt, Coxiella burnetii RSA 493
uuagccuuuuagucuggauucc

SEQ ID NO: 85670 - RNA, 22 nt, Coxiella burnetii RSA 493
ugaugccggucuugauguuauc

SEQ ID NO: 85671 - RNA, 22 nt, Coxiella burnetii RSA 493
uuguggcgaagccacacgaaca

SEQ ID NO: 85672 - RNA, 20 nt, Coxiella burnetii RSA 493
auuuauugguuagaacgucg

SEQ ID NO: 85673 - RNA, 21 nt, Coxiella burnetii RSA 493
augcaaugaacgaagggauug

SEQ ID NO: 85674 - RNA, 22 nt, Coxiella burnetii RSA 493
ucgcaaaucauuuuuguugaaa

SEQ ID NO: 85675 - RNA, 22 nt, Coxiella burnetii RSA 493
uuugaaaacgcaccuuauccca

SEQ ID NO: 85676 - RNA, 22 nt, Coxiella burnetii RSA 493
uugcaaaaccacaucuggccag

SEQ ID NO: 85677 - RNA, 22 nt, Coxiella burnetii RSA 493
gcggguuucucauuuuuacgaa

SEQ ID NO: 85678 - RNA, 21 nt, Coxiella burnetii RSA 493
ugcaaacgaucccggcuguua

SEQ ID NO: 85679 - RNA, 22 nt, Coxiella burnetii RSA 493
cccagauuaaggggcuaagaaa

SEQ ID NO: 85680 - RNA, 23 nt, Coxiella burnetii RSA 493
ucugucuaucacccaaagcccua

SEQ ID NO: 85681 - RNA, 22 nt, Coxiella burnetii RSA 493
aaaauagcacgaucgccuggcg

SEQ ID NO: 85682 - RNA, 22 nt, Coxiella burnetii RSA 493
acuaucaaaccgcauguugcuu

SEQ ID NO: 85683 - RNA, 22 nt, Coxiella burnetii RSA 493
uuguuuucccguauuccgcuuc

SEQ ID NO: 85684 - RNA, 22 nt, Coxiella burnetii RSA 493
ccgcaaaacccacuaauuuccc

SEQ ID NO: 85685 - RNA, 22 nt, Coxiella burnetii RSA 493
auuaaucguugcaacgcaaauc

SEQ ID NO: 85686 - RNA, 22 nt, Coxiella burnetii RSA 493
cccguauuccgcuucgcuucau

SEQ ID NO: 85687 - RNA, 22 nt, Coxiella burnetii RSA 493
cauaugaagcgaagcggaauac

SEQ ID NO: 85688 - RNA, 22 nt, Coxiella burnetii RSA 493
gaagcgaaauacgggaaacaau

SEQ ID NO: 85689 - RNA, 22 nt, Coxiella burnetii RSA 493
guucaaccuucaaugacuuuuc

SEQ ID NO: 85690 - RNA, 22 nt, Coxiella burnetii RSA 493
uccgcuuuauucaaccguuuca

SEQ ID NO: 85691 - RNA, 22 nt, Coxiella burnetii RSA 493
caaaugggaauggacguguuga

SEQ ID NO: 85692 - RNA, 22 nt, Coxiella burnetii RSA 493
ccguuauccgauagaguacgag

SEQ ID NO: 85693 - RNA, 22 nt, Coxiella burnetii RSA 493
agcaauugaucaagagagauug

SEQ ID NO: 85694 - RNA, 22 nt, Coxiella burnetii RSA 493
guucccguauuucgcuucgcuc

SEQ ID NO: 85695 - RNA, 22 nt, Coxiella burnetii RSA 493
agcccuuguuuuugugcgguga

SEQ ID NO: 85696 - RNA, 22 nt, Coxiella burnetii RSA 493
uauggccuguugugaugacauc

SEQ ID NO: 85697 - RNA, 21 nt, Coxiella burnetii RSA 493
gcgauuucaccaaaguucaaa

SEQ ID NO: 85698 - RNA, 22 nt, Coxiella burnetii RSA 493
gaagcgaaauacgggaaaugau

SEQ ID NO: 85699 - RNA, 22 nt, Coxiella burnetii RSA 493
cggaauaucgccuguuccgggc

SEQ ID NO: 85700 - RNA, 22 nt, Coxiella burnetii RSA 493
gaucaaaaauaaucuuuugcuu

SEQ ID NO: 85701 - RNA, 22 nt, Coxiella burnetii RSA 493
gcccguaugaaacaaagcggaa

SEQ ID NO: 85702 - RNA, 22 nt, Coxiella burnetii RSA 493
guauucgcugcgcuucauauau

SEQ ID NO: 85703 - RNA, 22 nt, Coxiella burnetii RSA 493
cguccccguguuucgcuucgcu

SEQ ID NO: 85704 - RNA, 22 nt, Coxiella burnetii RSA 493
uucuuagccuuuuaguuuggau

SEQ ID NO: 85705 - RNA, 22 nt, Coxiella burnetii RSA 493
aggaucaaucgcuuuuguauuu

SEQ ID NO: 85706 - RNA, 22 nt, Coxiella burnetii RSA 493
aaugaacacaagagagacacuu

SEQ ID NO: 85707 - RNA, 23 nt, Coxiella burnetii RSA 493
gcucaauaagcucuuuuaauguu

SEQ ID NO: 85708 - RNA, 19 nt, Coxiella burnetii RSA 493
uguaaaaauucauuggcuu

SEQ ID NO: 85709 - RNA, 21 nt, Coxiella burnetii RSA 493
uaucgauuggagaaaauuuua

SEQ ID NO: 85710 - RNA, 22 nt, Coxiella burnetii RSA 493
uauggagcgaacgagauacggg

SEQ ID NO: 85711 - RNA, 22 nt, Coxiella burnetii RSA 493
aaagauggggaugcuaaucugc

SEQ ID NO: 85712 - RNA, 22 nt, Coxiella burnetii RSA 493
uugaucgcuuuuugaaguugcu

SEQ ID NO: 85713 - RNA, 22 nt, Coxiella burnetii RSA 493
cguccucccgcgaggucgucug

SEQ ID NO: 85714 - RNA, 22 nt, Coxiella burnetii RSA 493
uaguuuucaacaaguagcccgu

SEQ ID NO: 85715 - RNA, 22 nt, Coxiella burnetii RSA 493
uaauaaggcaaaauauacgucg

SEQ ID NO: 85716 - RNA, 22 nt, Coxiella burnetii RSA 493
auuguuuucccguauuccgcuu

SEQ ID NO: 85717 - RNA, 22 nt, Coxiella burnetii RSA 493
agcacguagguugggcugagcu

SEQ ID NO: 85718 - RNA, 22 nt, Coxiella burnetii RSA 493
guauggagcgaagcgaaauacg

SEQ ID NO: 85719 - RNA, 22 nt, Coxiella burnetii RSA 493
uaguugucgcguagcgacacaa

SEQ ID NO: 85720 - RNA, 22 nt, Coxiella burnetii RSA 493
uaugagcgaacgaauacgggga

SEQ ID NO: 85721 - RNA, 22 nt, Coxiella burnetii RSA 493
gcccguaugaagcgaaauacgg

SEQ ID NO: 85722 - RNA, 22 nt, Coxiella burnetii RSA 493
augaaaugauucgauacgcuag

SEQ ID NO: 85723 - RNA, 22 nt, Coxiella burnetii RSA 493
aagcggaauacggggacgauag

SEQ ID NO: 85724 - RNA, 22 nt, Coxiella burnetii RSA 493
aagcgaaauacggggacgauaa

SEQ ID NO: 85725 - RNA, 22 nt, Coxiella burnetii RSA 493
auauaacuucguuuuacacccu

SEQ ID NO: 85726 - RNA, 22 nt, Coxiella burnetii RSA 493
cggcuacguugaaggcaauacu

SEQ ID NO: 85727 - RNA, 22 nt, Coxiella burnetii RSA 493
ucguggcguggaaguuuuggcc

SEQ ID NO: 85728 - RNA, 22 nt, Coxiella burnetii RSA 493
uagcgagaugagcuuggugauu

SEQ ID NO: 85729 - RNA, 22 nt, Coxiella burnetii RSA 493
ucgcuucgcuccauacgggcua

SEQ ID NO: 85730 - RNA, 22 nt, Coxiella burnetii RSA 493
aaagcgcacgagauccaaggcg

SEQ ID NO: 85731 - RNA, 22 nt, Coxiella burnetii RSA 493
uuaauccacgguaauucguuag

SEQ ID NO: 85732 - RNA, 22 nt, Coxiella burnetii RSA 493
auuaaaaugggguaaccaauuu

SEQ ID NO: 85733 - RNA, 22 nt, Coxiella burnetii RSA 493
uuucuuagccccuuaaccuggg

SEQ ID NO: 85734 - RNA, 22 nt, Coxiella burnetii RSA 493
cuguuauugcgcuucugauuua

SEQ ID NO: 85735 - RNA, 22 nt, Coxiella burnetii RSA 493
ggaugcuuauuguauacuaguu

SEQ ID NO: 85736 - RNA, 22 nt, Coxiella burnetii RSA 493
caaaaaaccuucacggccgagu

SEQ ID NO: 85737 - RNA, 22 nt, Coxiella burnetii RSA 493
cccguauuccgcuucgcuccau

SEQ ID NO: 85738 - RNA, 22 nt, Coxiella burnetii RSA 493
uuuucccguauucguucgcuca

SEQ ID NO: 85739 - RNA, 22 nt, Coxiella burnetii RSA 493
ccaaauugaaaaaauagcugca

SEQ ID NO: 85740 - RNA, 22 nt, Coxiella burnetii RSA 493
gcccguaugaaacgaagcgaau

SEQ ID NO: 85741 - RNA, 22 nt, Coxiella burnetii RSA 493
cccguaugaagcgaagcgaaau

SEQ ID NO: 85742 - RNA, 22 nt, Coxiella burnetii RSA 493
uaggugucucgcgugaugcgac

SEQ ID NO: 85743 - RNA, 22 nt, Coxiella burnetii RSA 493
ugguuuaauguuuuagugggcg

SEQ ID NO: 85744 - RNA, 22 nt, Coxiella burnetii RSA 493
ucguguggcuucgccacaauua

SEQ ID NO: 85745 - RNA, 22 nt, Coxiella burnetii RSA 493
caguaccgaagaucagcuuaaa

SEQ ID NO: 85746 - RNA, 22 nt, Coxiella burnetii RSA 493
gaagcgaaauacggggacaaua

SEQ ID NO: 85747 - RNA, 21 nt, Coxiella burnetii RSA 493
uugcgcuuuuugcucgucaac

SEQ ID NO: 85748 - RNA, 22 nt, Coxiella burnetii RSA 493
uuuauucaaacacucggcgcga

SEQ ID NO: 85749 - RNA, 22 nt, Coxiella burnetii RSA 493
acgucauuuuccuuuauguugu

SEQ ID NO: 85750 - RNA, 22 nt, Coxiella burnetii RSA 493
aauguuaaaagggcuucgauca

SEQ ID NO: 85751 - RNA, 22 nt, Coxiella burnetii RSA 493
gcgaagcgaaauacggggacga

SEQ ID NO: 85752 - RNA, 22 nt, Coxiella burnetii RSA 493
aguuaaaaauugguauugaaac

SEQ ID NO: 85753 - RNA, 20 nt, Coxiella burnetii RSA 493
uauuucgcuucgcuacauac

SEQ ID NO: 85754 - RNA, 22 nt, Coxiella burnetii RSA 493
acgauugaugcuaauauugacu

SEQ ID NO: 85755 - RNA, 22 nt, Coxiella burnetii RSA 493
aauauuauuuuuagcgauaggg

SEQ ID NO: 85756 - RNA, 22 nt, Coxiella burnetii RSA 493
aagaaugucaacguucguauuc

SEQ ID NO: 85757 - RNA, 22 nt, Coxiella burnetii RSA 493
auacccaucaagaccaaguaag

SEQ ID NO: 85758 - RNA, 22 nt, Coxiella burnetii RSA 493
ggcgaauucgguguuuauaucg

SEQ ID NO: 85759 - RNA, 22 nt, Coxiella burnetii RSA 493
aauucccguauuccgcugcgcu

SEQ ID NO: 85760 - RNA, 22 nt, Coxiella burnetii RSA 493
gcccguaugcagcgaagcgaaa

SEQ ID NO: 85761 - RNA, 22 nt, Coxiella burnetii RSA 493
ggagcgaagcgaaauacgggga

SEQ ID NO: 85762 - RNA, 18 nt, Coxiella burnetii RSA 493
guugauccaaauuggcgu

SEQ ID NO: 85763 - RNA, 22 nt, Coxiella burnetii RSA 493
uaugagcgaacgaauacgggaa

SEQ ID NO: 85764 - RNA, 22 nt, Coxiella burnetii RSA 493
augcagcgaagcggaauacggg

SEQ ID NO: 85765 - RNA, 20 nt, Coxiella burnetii RSA 493
aacggcuugcuugaauuagg

SEQ ID NO: 85766 - RNA, 22 nt, Coxiella burnetii RSA 493
uaaaaucuucgcuaaugcgaua

SEQ ID NO: 85767 - RNA, 22 nt, Coxiella burnetii RSA 493
aucucguuccaagaguuguuga

SEQ ID NO: 85768 - RNA, 22 nt, Coxiella burnetii RSA 493
gguuuuggccgcuaccgugaaa

SEQ ID NO: 85769 - RNA, 22 nt, Coxiella burnetii RSA 493
acgagguaggaaugaaugucaa

SEQ ID NO: 85770 - RNA, 22 nt, Coxiella burnetii RSA 493
cggcgguaugauuuuggaagaa

SEQ ID NO: 85771 - RNA, 22 nt, Coxiella burnetii RSA 493
auaauaaauuucggcugcuagc

SEQ ID NO: 85772 - RNA, 22 nt, Coxiella burnetii RSA 493
aagcgaaauacggggacgauag

SEQ ID NO: 85773 - RNA, 22 nt, Coxiella burnetii RSA 493
guaugcagcgcagcggaauacg

SEQ ID NO: 85774 - RNA, 22 nt, Coxiella burnetii RSA 493
uggcgacguaguaaugaugaag

SEQ ID NO: 85775 - RNA, 20 nt, Coxiella burnetii RSA 493
cuuagcgaguuuauucgggc

SEQ ID NO: 85776 - RNA, 22 nt, Coxiella burnetii RSA 493
gcuaaggcagcuuuagaagcgg

SEQ ID NO: 85777 - RNA, 22 nt, Coxiella burnetii RSA 493
aauaagucgaacuggauagugc

SEQ ID NO: 85778 - RNA, 22 nt, Coxiella burnetii RSA 493
gcaaauugguuaccccauuuua

SEQ ID NO: 85779 - RNA, 22 nt, Coxiella burnetii RSA 493
uuggucggauccccuuucaugc

SEQ ID NO: 85780 - RNA, 22 nt, Coxiella burnetii RSA 493
uaucauccguuuuaacggcgac

SEQ ID NO: 85781 - RNA, 22 nt, Coxiella burnetii RSA 493
gcggagcgaaauacggggacga

SEQ ID NO: 85782 - RNA, 22 nt, Coxiella burnetii RSA 493
auuaugauggacugggguuagu

SEQ ID NO: 85783 - RNA, 22 nt, Coxiella burnetii RSA 493
cccguauuucgcuccgcucaga

SEQ ID NO: 85784 - RNA, 22 nt, Coxiella burnetii RSA 493
uuguuucccguauuucgcuucg

SEQ ID NO: 85785 - RNA, 22 nt, Coxiella burnetii RSA 493
aaaacggagggcaauuguuggg

SEQ ID NO: 85786 - RNA, 22 nt, Coxiella burnetii RSA 493
ugugguuucauccauucgauag

SEQ ID NO: 85787 - RNA, 22 nt, Coxiella burnetii RSA 493
uuguuaauaucgguuugguaau

SEQ ID NO: 85788 - RNA, 22 nt, Coxiella burnetii RSA 493
uuuccccguauuucgcuucgcu

SEQ ID NO: 85789 - RNA, 22 nt, Coxiella burnetii RSA 493
aguauuuuguccauuuugaugu

SEQ ID NO: 85790 - RNA, 22 nt, Coxiella burnetii RSA 493
auugcgcuccgaucggcaacug

SEQ ID NO: 85791 - RNA, 22 nt, Coxiella burnetii RSA 493
ugccauuggcgcuuuuauuauc

SEQ ID NO: 85792 - RNA, 22 nt, Coxiella burnetii RSA 493
uucccguauuucgcuucgcugc

SEQ ID NO: 85793 - RNA, 22 nt, Coxiella burnetii RSA 493
auuaggcgaaaaguagcaauua

SEQ ID NO: 85794 - RNA, 22 nt, Coxiella burnetii RSA 493
uuuguucccguauuucgcuuug

SEQ ID NO: 85795 - RNA, 22 nt, Coxiella burnetii RSA 493
guugugucgcuaugcgacaacu

SEQ ID NO: 85796 - RNA, 22 nt, Coxiella burnetii RSA 493
cccccguauuucgcuucgcuca

SEQ ID NO: 85797 - RNA, 22 nt, Coxiella burnetii RSA 493
aagcgaaauacggggacaauag

SEQ ID NO: 85798 - RNA, 22 nt, Coxiella burnetii RSA 493
uaaaucaaucagcguuuugcua

SEQ ID NO: 85799 - RNA, 22 nt, Coxiella burnetii RSA 493
gagagcaggcuacggauugauu

SEQ ID NO: 85800 - RNA, 22 nt, Coxiella burnetii RSA 493
gugguugugucgcuacgcgaca

SEQ ID NO: 85801 - RNA, 20 nt, Coxiella burnetii RSA 493
aucguauuagucgaugccaa

SEQ ID NO: 85802 - RNA, 22 nt, Coxiella burnetii RSA 493
cccguaugaagcgaaacgaaau

SEQ ID NO: 85803 - RNA, 21 nt, Coxiella burnetii RSA 493
gugaaaucuuacaaccuguga

SEQ ID NO: 85804 - RNA, 22 nt, Coxiella burnetii RSA 493
gcccaucgucauuauugccgga

SEQ ID NO: 85805 - RNA, 22 nt, Coxiella burnetii RSA 493
aaaacgauuaauguaauuaccu

SEQ ID NO: 85806 - RNA, 22 nt, Coxiella burnetii RSA 493
agugcgcuggguccccgccuuc

SEQ ID NO: 85807 - RNA, 22 nt, Coxiella burnetii RSA 493
cguccccguauuucgcuucgcu

SEQ ID NO: 85808 - RNA, 22 nt, Coxiella burnetii RSA 493
acuagcgaauuguaaacagacu

SEQ ID NO: 85809 - RNA, 22 nt, Coxiella burnetii RSA 493
aguggaauuaucuaucgcgcca

SEQ ID NO: 85810 - RNA, 22 nt, Coxiella burnetii RSA 493
aacggcuucaccgcaauuagcg

SEQ ID NO: 85811 - RNA, 22 nt, Coxiella burnetii RSA 493
uuagcugcuauugucuuuggua

SEQ ID NO: 85812 - RNA, 22 nt, Coxiella burnetii RSA 493
aaaaagaagacgagugaucgcu

SEQ ID NO: 85813 - RNA, 22 nt, Coxiella burnetii RSA 493
aaaauuagcauagagcgaccca

SEQ ID NO: 85814 - RNA, 22 nt, Coxiella burnetii RSA 493
aaagggacaauucuuccuuauc

SEQ ID NO: 85815 - RNA, 22 nt, Coxiella burnetii RSA 493
aaggccgauuuuaucugcggug

SEQ ID NO: 85816 - RNA, 21 nt, Coxiella burnetii RSA 493
aaauucuucuucucauugcga

SEQ ID NO: 85817 - RNA, 22 nt, Coxiella burnetii RSA 493
acauuucaaaaguagagcuuuu

SEQ ID NO: 85818 - RNA, 22 nt, Coxiella burnetii RSA 493
aauuauuaaugaaacguauuga

SEQ ID NO: 85819 - RNA, 18 nt, Coxiella burnetii RSA 493
aauggccuaauuuucgau

SEQ ID NO: 85820 - RNA, 22 nt, Coxiella burnetii RSA 493
aaugucauaaaacuauuuucga

SEQ ID NO: 85821 - RNA, 22 nt, Coxiella burnetii RSA 493
caauggcucgugcgcauuuagg

SEQ ID NO: 85822 - RNA, 22 nt, Coxiella burnetii RSA 493
cagaaaaagacccuucagguaa

SEQ ID NO: 85823 - RNA, 22 nt, Coxiella burnetii RSA 493
auuguuuucccguauuucgcuu

SEQ ID NO: 85824 - RNA, 22 nt, Coxiella burnetii RSA 493
caaaccauuacgcucugcgguu

SEQ ID NO: 85825 - RNA, 19 nt, Coxiella burnetii RSA 493
auuugcaaugcagauugau

SEQ ID NO: 85826 - RNA, 22 nt, Coxiella burnetii RSA 493
auuaaaaugggguaaccaauuu

SEQ ID NO: 85827 - RNA, 17 nt, Coxiella burnetii RSA 493
aucauggcaucccagcc

SEQ ID NO: 85828 - RNA, 22 nt, Coxiella burnetii RSA 493
aguggaauuaucuaucgcgcca

SEQ ID NO: 85829 - RNA, 22 nt, Coxiella burnetii RSA 493
aguuuucuucaaacacguuuag

SEQ ID NO: 85830 - RNA, 22 nt, Coxiella burnetii RSA 493
aguuaaaaauugguauugaaac

SEQ ID NO: 85831 - RNA, 20 nt, Coxiella burnetii RSA 493
cgccauggcuugccucgcua

SEQ ID NO: 85832 - RNA, 22 nt, Coxiella burnetii RSA 493
cgucaauuaacccugucgucgu

SEQ ID NO: 85833 - RNA, 22 nt, Coxiella burnetii RSA 493
cguccucccgcgaggucgucug

SEQ ID NO: 85834 - RNA, 22 nt, Coxiella burnetii RSA 493
gcaggggggaauccagcgcgcu

SEQ ID NO: 85835 - RNA, 22 nt, Coxiella burnetii RSA 493
ggaugcuuauuguauacuaguu

SEQ ID NO: 85836 - RNA, 22 nt, Coxiella burnetii RSA 493
gugauugacgauugucuaaaac

SEQ ID NO: 85837 - RNA, 22 nt, Coxiella burnetii RSA 493
uauuguuuggcgucacuuauuu

SEQ ID NO: 85838 - RNA, 22 nt, Coxiella burnetii RSA 493
ucaggauaagggaguaaggcau

SEQ ID NO: 85839 - RNA, 22 nt, Coxiella burnetii RSA 493
uauuucaaccugcucagaaacu

SEQ ID NO: 85840 - RNA, 20 nt, Coxiella burnetii RSA 493
ucaggcugucguugguacug

SEQ ID NO: 85841 - RNA, 22 nt, Coxiella burnetii RSA 493
uauaaacaauucuuggggcguu

SEQ ID NO: 85842 - RNA, 22 nt, Coxiella burnetii RSA 493
uaaaaucuucgcuaaugcgaua

SEQ ID NO: 85843 - RNA, 22 nt, Coxiella burnetii RSA 493
ucucacuggacaaauuugucca

SEQ ID NO: 85844 - RNA, 22 nt, Coxiella burnetii RSA 493
ucuagcauaaugacgaggaaau

SEQ ID NO: 85845 - RNA, 22 nt, Coxiella burnetii RSA 493
ucaguaccaacgacagccugaa

SEQ ID NO: 85846 - RNA, 21 nt, Coxiella burnetii RSA 493
ugugaagugcguuguuucauc

SEQ ID NO: 85847 - RNA, 22 nt, Coxiella burnetii RSA 493
ugguuucaggcaucgccuuuga

SEQ ID NO: 85848 - RNA, 22 nt, Coxiella burnetii RSA 493
ugaggaaauugaaauccucuau

SEQ ID NO: 85849 - RNA, 22 nt, Coxiella burnetii RSA 493
ugauuuuaugagaaauauugcu

SEQ ID NO: 85850 - RNA, 22 nt, Coxiella burnetii RSA 493
uuauagaaaugagcuaaagcgg

SEQ ID NO: 85851 - RNA, 22 nt, Coxiella burnetii RSA 493
ugugguuucauccauucgauag

SEQ ID NO: 85852 - RNA, 22 nt, Coxiella burnetii RSA 493
uuacuuauggcacgauggcagc

SEQ ID NO: 85853 - RNA, 22 nt, Coxiella burnetii RSA 493
aaaauaauuauucacgaagcua

SEQ ID NO: 85854 - RNA, 22 nt, Coxiella burnetii RSA 493
agagucuguuuauuguucgauu

SEQ ID NO: 85855 - RNA, 22 nt, Coxiella burnetii RSA 493
aaucauuuaucguuugacaucg

SEQ ID NO: 85856 - RNA, 23 nt, Coxiella burnetii RSA 493
agcauuuuuuugacgugagguca

SEQ ID NO: 85857 - RNA, 22 nt, Coxiella burnetii RSA 493
uuuucccaggugccauucugag

SEQ ID NO: 85858 - RNA, 20 nt, Coxiella burnetii RSA 493
uuuuauuugcuuuggaagca

SEQ ID NO: 85859 - RNA, 22 nt, Coxiella burnetii RSA 493
uuuucuuaguauuguuagucug

SEQ ID NO: 85860 - RNA, 22 nt, Coxiella burnetii RSA 493
uuuuaugcgccuguuguucuuc

SEQ ID NO: 85861 - RNA, 22 nt, Coxiella burnetii RSA 493
uuuuagucguucuuauucgcca

SEQ ID NO: 85862 - RNA, 22 nt, Coxiella burnetii RSA 493
uuucuuagacuuuuagccugga

SEQ ID NO: 85863 - RNA, 22 nt, Coxiella burnetii RSA 493
uuucauuaauccuccauagccu

SEQ ID NO: 85864 - RNA, 22 nt, Coxiella burnetii RSA 493
uuguuucccguauuucgcuucg

SEQ ID NO: 85865 - RNA, 22 nt, Coxiella burnetii RSA 493
uuguuuucccguauuccgcuuc

SEQ ID NO: 85866 - RNA, 22 nt, Coxiella burnetii RSA 493
uuuaguagaaauauguucaaag

SEQ ID NO: 85867 - RNA, 22 nt, Coxiella burnetii RSA 493
uuuaaacauauccaaugguaac

SEQ ID NO: 85868 - RNA, 22 nt, Coxiella burnetii RSA 493
uugcugauaaugaucaagauca

SEQ ID NO: 85869 - RNA, 22 nt, Coxiella burnetii RSA 493
uucuuuucggcauaaacagcgg

SEQ ID NO: 85870 - RNA, 22 nt, Coxiella burnetii RSA 493
uugauaagguugccuuuuagaa

SEQ ID NO: 85871 - RNA, 22 nt, Coxiella burnetii RSA 493
uugauucugaacgagcuaauug

SEQ ID NO: 85872 - RNA, 22 nt, Coxiella burnetii RSA 493
cauuacaaauggacgaugcaga

SEQ ID NO: 85873 - RNA, 22 nt, Coxiella burnetii RSA 493
cauuguuucccguauuucgcuu

SEQ ID NO: 85874 - RNA, 22 nt, Coxiella burnetii RSA 493
cccaguggauugaucggauugu

SEQ ID NO: 85875 - RNA, 18 nt, Coxiella burnetii RSA 493
gcagagggauagaaggcc

SEQ ID NO: 85876 - RNA, 22 nt, Coxiella burnetii RSA 493
gccugugaauuugauuauucag

SEQ ID NO: 85877 - RNA, 22 nt, Coxiella burnetii RSA 493
gguuauuuggaacuugcgcaac

SEQ ID NO: 85878 - RNA, 22 nt, Coxiella burnetii RSA 493
uacugucuaaaaaaaucguuac

SEQ ID NO: 85879 - RNA, 22 nt, Coxiella burnetii RSA 493
guugugguaauauuucaucgac

SEQ ID NO: 85880 - RNA, 22 nt, Coxiella burnetii RSA 493
uauuuuaauaaucggcgcaggc

SEQ ID NO: 85881 - RNA, 19 nt, Coxiella burnetii RSA 493
ucaaaaaaaugcugagaug

SEQ ID NO: 85882 - RNA, 22 nt, Coxiella burnetii RSA 493
ugcguccucaauuuuuauauac

SEQ ID NO: 85883 - RNA, 22 nt, Human
aaaaaauugcuggcagagcugu

SEQ ID NO: 85884 - RNA, 22 nt, Human
aaaaacuuaccccagggcaagg

SEQ ID NO: 85885 - RNA, 22 nt, Human
aaaaaggagaaagagagggaga

SEQ ID NO: 85886 - RNA, 22 nt, Human
aaaaaguaccacuuggacacuu

SEQ ID NO: 85887 - RNA, 22 nt, Human
aaaaauuucuggugaaaugccu

SEQ ID NO: 85888 - RNA, 20 nt, Human
aaaaauguguuuauggagau

SEQ ID NO: 85889 - RNA, 20 nt, Human
aaaaacaguaaugcugaaga

SEQ ID NO: 85890 - RNA, 22 nt, Human
aaaaaaacuaauuuuaaaugug

SEQ ID NO: 85891 - RNA, 22 nt, Human
aaaacuuucagggauacagaaa

SEQ ID NO: 85892 - RNA, 22 nt, Human
aaaacauuuuacugccaucuca

SEQ ID NO: 85893 - RNA, 22 nt, Human
aaaagacaaggaucuggaguga

SEQ ID NO: 85894 - RNA, 22 nt, Human
aaaagaaugaugggagcugggu

SEQ ID NO: 85895 - RNA, 22 nt, Human
aaaagauguaaacauauauuaa

SEQ ID NO: 85896 - RNA, 22 nt, Human
aaaauauguugagauacugaaa

SEQ ID NO: 85897 - RNA, 22 nt, Human
aaaccagaguucauaguauuca

SEQ ID NO: 85898 - RNA, 18 nt, Human
aaacccacguauucaggc

SEQ ID NO: 85899 - RNA, 21 nt, Human
aaacaugcagccugccaauuc

SEQ ID NO: 85900 - RNA, 22 nt, Human
aaacauaugccuucuuuuguaa

SEQ ID NO: 85901 - RNA, 22 nt, Human
aaaauauaaaggauguggguuu

SEQ ID NO: 85902 - RNA, 22 nt, Human
aaaauacuaggaaaauaaauca

SEQ ID NO: 85903 - RNA, 22 nt, Human
aaacaagagcuuacauggcugc

SEQ ID NO: 85904 - RNA, 22 nt, Human
aaaagcgaagagaacugaaguu

SEQ ID NO: 85905 - RNA, 22 nt, Human
aaaaguuguaauauuuccuuua

SEQ ID NO: 85906 - RNA, 22 nt, Human
aaaauaaccuucauuugcauug

SEQ ID NO: 85907 - RNA, 22 nt, Human
aaaaggaagaguuuucagagac

SEQ ID NO: 85908 - RNA, 22 nt, Human
aaaaggauauuuggugcaaagc

SEQ ID NO: 85909 - RNA, 21 nt, Human
aaagaaguuaguucagugguu

SEQ ID NO: 85910 - RNA, 22 nt, Human
aaacugugcagucacauaagga

SEQ ID NO: 85911 - RNA, 22 nt, Human
aaacucuaagacuaaaauugaa

SEQ ID NO: 85912 - RNA, 22 nt, Human
aaagaauuucaagauucccaca

SEQ ID NO: 85913 - RNA, 22 nt, Human
aaacuagaacagagagagaagc

SEQ ID NO: 85914 - RNA, 22 nt, Human
aaacucaucaguuuagaaaccu

SEQ ID NO: 85915 - RNA, 22 nt, Human
aaacucaugccagagaacuuaa

SEQ ID NO: 85916 - RNA, 22 nt, Human
aaacuuuaucaaguacucuuca

SEQ ID NO: 85917 - RNA, 22 nt, Human
aaagaagugucuuacucccucu

SEQ ID NO: 85918 - RNA, 22 nt, Human
aaacuuuaggcacauggaucua

SEQ ID NO: 85919 - RNA, 22 nt, Human
aaacuugaggcaaugaaggugu

SEQ ID NO: 85920 - RNA, 22 nt, Human
aaagacaauaauucucucuagc

SEQ ID NO: 85921 - RNA, 22 nt, Human
aaagaccaagagccccaaguuu

SEQ ID NO: 85922 - RNA, 22 nt, Human
aagcagugacucucagaggcag

SEQ ID NO: 85923 - RNA, 22 nt, Human
aagccuuagauuggcgaugucg

SEQ ID NO: 85924 - RNA, 22 nt, Human
aaggcugaccaguuuacacuuu

SEQ ID NO: 85925 - RNA, 22 nt, Human
aaggcgauuuaaagauguuagg

SEQ ID NO: 85926 - RNA, 22 nt, Human
aagggaauagagcagcaaaaau

SEQ ID NO: 85927 - RNA, 22 nt, Human
aagggaaacagccaggcccugu

SEQ ID NO: 85928 - RNA, 22 nt, Human
aagggaaguuugacacuuuuua

SEQ ID NO: 85929 - RNA, 22 nt, Human
aaguacugauucuguuccucaa

SEQ ID NO: 85930 - RNA, 21 nt, Human
aaguaaauuuuuacuuaggcc

SEQ ID NO: 85931 - RNA, 22 nt, Human
aagguuuuguaugaaaucucug

SEQ ID NO: 85932 - RNA, 22 nt, Human
aaggucuucgaaccuuauguua

SEQ ID NO: 85933 - RNA, 22 nt, Human
aagugguuuauuguaugguuuu

SEQ ID NO: 85934 - RNA, 22 nt, Human
aaguuaaaaaagcuggguaaaa

SEQ ID NO: 85935 - RNA, 22 nt, Human
aaguguggguaagcauuucuug

SEQ ID NO: 85936 - RNA, 22 nt, Human
aaguugaaugucuugcugaaug

SEQ ID NO: 85937 - RNA, 22 nt, Human
aaguguucucuguuuuaucuac

SEQ ID NO: 85938 - RNA, 22 nt, Human
aaguuaauugcuucuaguuaau

SEQ ID NO: 85939 - RNA, 22 nt, Human
aagucauuaucucuucuaaucu

SEQ ID NO: 85940 - RNA, 17 nt, Human
aagugggcaaagugaga

SEQ ID NO: 85941 - RNA, 18 nt, Human
aaguaguuugagauuguu

SEQ ID NO: 85942 - RNA, 22 nt, Human
aauagguaaaugaguaagaaau

SEQ ID NO: 85943 - RNA, 22 nt, Human
aauaucuagccuuuagcagcuu

SEQ ID NO: 85944 - RNA, 22 nt, Human
aauauauaugggugcaugucug

SEQ ID NO: 85945 - RNA, 22 nt, Human
aauagaguccuguacugaauga

SEQ ID NO: 85946 - RNA, 22 nt, Human
aauaggaaggaaauguuuaccu

SEQ ID NO: 85947 - RNA, 22 nt, Human
aauaaggacaugaaggguccug

SEQ ID NO: 85948 - RNA, 22 nt, Human
aauagcacauguugguugagua

SEQ ID NO: 85949 - RNA, 22 nt, Human
aauauagagcagaucuggcucu

SEQ ID NO: 85950 - RNA, 22 nt, Human
aauacagcacucacaccucccu

SEQ ID NO: 85951 - RNA, 22 nt, Human
aauacaaucagauuaugguagu

SEQ ID NO: 85952 - RNA, 22 nt, Human
aauaauacaauuggugucaugu

SEQ ID NO: 85953 - RNA, 22 nt, Human
aauacagauggcaugugaagau

SEQ ID NO: 85954 - RNA, 22 nt, Human
aaugguuacuacccugggucuu

SEQ ID NO: 85955 - RNA, 22 nt, Human
aauguacucgaaugauguuaag

SEQ ID NO: 85956 - RNA, 22 nt, Human
aauguaaauaauuguaaaauuu

SEQ ID NO: 85957 - RNA, 22 nt, Human
aaugguaauauuucauaguugu

SEQ ID NO: 85958 - RNA, 22 nt, Human
aaugguagaguauuuuaauccu

SEQ ID NO: 85959 - RNA, 22 nt, Human
aauggagaaaagacaauguuga

SEQ ID NO: 85960 - RNA, 22 nt, Human
aauggauaacaccgguucuguc

SEQ ID NO: 85961 - RNA, 22 nt, Human
aauggcagauaauuuuccagau

SEQ ID NO: 85962 - RNA, 22 nt, Human
aauggcaagccacaugcuuuuc

SEQ ID NO: 85963 - RNA, 22 nt, Human
aaugcauaaugguuugugacaa

SEQ ID NO: 85964 - RNA, 22 nt, Human
aaugccuucauuggcgaagugc

SEQ ID NO: 85965 - RNA, 22 nt, Human
aauggaaaggagccugacuaua

SEQ ID NO: 85966 - RNA, 22 nt, Human
aauuauugucuuuuuuaaaagc

SEQ ID NO: 85967 - RNA, 22 nt, Human
aauucaacagucaguuaucuca

SEQ ID NO: 85968 - RNA, 22 nt, Human
aauuacuuuaggaaaacuccuc

SEQ ID NO: 85969 - RNA, 22 nt, Human
aauuauuaagcuuucuccagug

SEQ ID NO: 85970 - RNA, 22 nt, Human
aauuagaagcuguuagcaaaau

SEQ ID NO: 85971 - RNA, 22 nt, Human
aauuauguugaaauaugagaac

SEQ ID NO: 85972 - RNA, 22 nt, Human
aauguaguuuacugugagugca

SEQ ID NO: 85973 - RNA, 22 nt, Human
aauguugaaccuuuuuggccug

SEQ ID NO: 85974 - RNA, 22 nt, Human
aauguucucuaaucuuucucuu

SEQ ID NO: 85975 - RNA, 22 nt, Human
aauguuuaguuuuauuuuagua

SEQ ID NO: 85976 - RNA, 22 nt, Human
aauguuuaagcuuuuauuuaca

SEQ ID NO: 85977 - RNA, 22 nt, Human
aauccaaacaggauuaccuauc

SEQ ID NO: 85978 - RNA, 22 nt, Human
aaucaagcugcuguuuguucua

SEQ ID NO: 85979 - RNA, 22 nt, Human
aauauuuaccuaccugucaucu

SEQ ID NO: 85980 - RNA, 22 nt, Human
aauauuuugggacugaggaauu

SEQ ID NO: 85981 - RNA, 22 nt, Human
aaucaaagccugcaaguugacu

SEQ ID NO: 85982 - RNA, 22 nt, Human
aaucuuuuugaaggaggagaga

SEQ ID NO: 85983 - RNA, 22 nt, Human
aaucuguugucaggaauccaca

SEQ ID NO: 85984 - RNA, 22 nt, Human
aaucugugaggaauaaugaguu

SEQ ID NO: 85985 - RNA, 22 nt, Human
aaugaaaaucugucaguucaag

SEQ ID NO: 85986 - RNA, 22 nt, Human
aaugaacuuucaguucagagag

SEQ ID NO: 85987 - RNA, 22 nt, Human
aaugaaacuaguagaaucuuug

SEQ ID NO: 85988 - RNA, 22 nt, Human
aaugacaguggcacagucacuu

SEQ ID NO: 85989 - RNA, 22 nt, Human
aaugaauaaauuuuaaagacag

SEQ ID NO: 85990 - RNA, 22 nt, Human
aaugaaugaaugaaugauuaug

SEQ ID NO: 85991 - RNA, 22 nt, Human
aaugaguccuuuagugccauug

SEQ ID NO: 85992 - RNA, 22 nt, Human
aaugcagaugugucuuuaauuu

SEQ ID NO: 85993 - RNA, 22 nt, Human
aaugagaauguaagugaagaga

SEQ ID NO: 85994 - RNA, 22 nt, Human
aaugauuuucugcaaacaguga

SEQ ID NO: 85995 - RNA, 22 nt, Human
aaugaguuuguucuauuauuug

SEQ ID NO: 85996 - RNA, 23 nt, Human
aaugaguugggcagcauacaggc

SEQ ID NO: 85997 - RNA, 22 nt, Human
aaugaguucaucugaauucugg

SEQ ID NO: 85998 - RNA, 22 nt, Human
aacugagugcuacauugugauu

SEQ ID NO: 85999 - RNA, 22 nt, Human
aacgggguugauuauuggaaga

SEQ ID NO: 86000 - RNA, 21 nt, Human
aacuaaugacugcagcaggaa

SEQ ID NO: 86001 - RNA, 22 nt, Human
aacucugcaaugaaaucauguu

SEQ ID NO: 86002 - RNA, 22 nt, Human
aacucgaugcaauucacuuugu

SEQ ID NO: 86003 - RNA, 22 nt, Human
aacuuaacucugcaauccagcu

SEQ ID NO: 86004 - RNA, 22 nt, Human
aagaaaagaaacauggguaugc

SEQ ID NO: 86005 - RNA, 22 nt, Human
aagaaaagguaaccgcuuaucu

SEQ ID NO: 86006 - RNA, 22 nt, Human
aagaaaagcaucuuuguaguag

SEQ ID NO: 86007 - RNA, 22 nt, Human
aacuggguuuaucuaaugugua

SEQ ID NO: 86008 - RNA, 22 nt, Human
aacuuucugaaaagcuugauca

SEQ ID NO: 86009 - RNA, 22 nt, Human
aacuuucuuugcaucuaaguuu

SEQ ID NO: 86010 - RNA, 22 nt, Human
aacuuuuaugaaggaaaucaua

SEQ ID NO: 86011 - RNA, 19 nt, Human
aagaacaguucuaauuuca

SEQ ID NO: 86012 - RNA, 22 nt, Human
aagaaagaucugaaagaagcga

SEQ ID NO: 86013 - RNA, 22 nt, Human
aacuugaagacaccccacauuc

SEQ ID NO: 86014 - RNA, 22 nt, Human
aacuuauacccagggcagaaau

SEQ ID NO: 86015 - RNA, 22 nt, Human
aagaaauacagaaauggcagua

SEQ ID NO: 86016 - RNA, 22 nt, Human
aagaaggaaggcaagagauggg

SEQ ID NO: 86017 - RNA, 22 nt, Human
aagaaugaaaugaaagaacuaa

SEQ ID NO: 86018 - RNA, 22 nt, Human
aagaacuagauagugguguaaa

SEQ ID NO: 86019 - RNA, 23 nt, Human
aagaaugcuucugaagagcugcc

SEQ ID NO: 86020 - RNA, 22 nt, Human
aacuuuuucuuaggggaaagca

SEQ ID NO: 86021 - RNA, 22 nt, Human
aagagaaaugcuuuaacuuuau

SEQ ID NO: 86022 - RNA, 22 nt, Human
aagaggcuacagcccugugucu

SEQ ID NO: 86023 - RNA, 22 nt, Human
aagaggaauaauaaaaauugca

SEQ ID NO: 86024 - RNA, 22 nt, Human
aagagaaaaaucuuaaucuagu

SEQ ID NO: 86025 - RNA, 22 nt, Human
aagauucaguugguuuuggaaa

SEQ ID NO: 86026 - RNA, 22 nt, Human
aagagaggaaagggugugaggu

SEQ ID NO: 86027 - RNA, 22 nt, Human
aagagaaacauauggccagauu

SEQ ID NO: 86028 - RNA, 22 nt, Human
aagauguuguagauuagugaga

SEQ ID NO: 86029 - RNA, 22 nt, Human
aagcagaaaaacugagcuccaa

SEQ ID NO: 86030 - RNA, 22 nt, Human
aagcacuaauauuuuggcaccu

SEQ ID NO: 86031 - RNA, 22 nt, Human
aagcaaguucuaaaguaauucu

SEQ ID NO: 86032 - RNA, 22 nt, Human
aagcagaacuguuuuguuuucu

SEQ ID NO: 86033 - RNA, 22 nt, Human
aagcauuuuagauaaagcauca

SEQ ID NO: 86034 - RNA, 22 nt, Human
aagccagccaguuccagcagcu

SEQ ID NO: 86035 - RNA, 22 nt, Human
aagauuuaccacuuuauucaag

SEQ ID NO: 86036 - RNA, 22 nt, Human
aagcaguuuagucaucgggauu

SEQ ID NO: 86037 - RNA, 22 nt, Human
aaccauauugauuauguuuuau

SEQ ID NO: 86038 - RNA, 22 nt, Human
aaccuuucucccugcacacugg

SEQ ID NO: 86039 - RNA, 22 nt, Human
aacauuguuuaaguuaaauugu

SEQ ID NO: 86040 - RNA, 22 nt, Human
aacauuuauguuuugaccaagu

SEQ ID NO: 86041 - RNA, 22 nt, Human
aaccaaaguugguauuuaauaa

SEQ ID NO: 86042 - RNA, 22 nt, Human
aaccaaucaaauuggaauugaa

SEQ ID NO: 86043 - RNA, 20 nt, Human
aaccuauuguaauauucuaa

SEQ ID NO: 86044 - RNA, 22 nt, Human
aacaucaaaggaagaaugauau

SEQ ID NO: 86045 - RNA, 22 nt, Human
aacagguucaucuuggaagcag

SEQ ID NO: 86046 - RNA, 22 nt, Human
aaccggauugauccuucuuuga

SEQ ID NO: 86047 - RNA, 22 nt, Human
aaccguguucgggaacacuugu

SEQ ID NO: 86048 - RNA, 22 nt, Human
aacgcagagaguaaugcugaac

SEQ ID NO: 86049 - RNA, 22 nt, Human
aacccacuaugauuguccucau

SEQ ID NO: 86050 - RNA, 22 nt, Human
aaccauggauuucaguucaccu

SEQ ID NO: 86051 - RNA, 22 nt, Human
aacgaugauaaauuguucucug

SEQ ID NO: 86052 - RNA, 22 nt, Human
aacgagcugggggggccggggg

SEQ ID NO: 86053 - RNA, 22 nt, Human
aaccuuauuguguaucaccaua

SEQ ID NO: 86054 - RNA, 22 nt, Human
aacgauuugaguuaguuuuuag

SEQ ID NO: 86055 - RNA, 22 nt, Human
aacuagugucuguaugauaagg

SEQ ID NO: 86056 - RNA, 21 nt, Human
aacuauuaauaccauuagcaa

SEQ ID NO: 86057 - RNA, 22 nt, Human
aaccugaggguagacaaguuca

SEQ ID NO: 86058 - RNA, 22 nt, Human
aaauuuuguugaaaaauauuuu

SEQ ID NO: 86059 - RNA, 22 nt, Human
aacaaaacauuuuacgaauaua

SEQ ID NO: 86060 - RNA, 22 nt, Human
aaauugucuuuaaucaggucau

SEQ ID NO: 86061 - RNA, 22 nt, Human
aacacuguaucagucuucaaua

SEQ ID NO: 86062 - RNA, 22 nt, Human
aacacugaaaugucuuaagauu

SEQ ID NO: 86063 - RNA, 21 nt, Human
aaauuucauauggccaaccua

SEQ ID NO: 86064 - RNA, 22 nt, Human
aaauuugggagaaaugggucau

SEQ ID NO: 86065 - RNA, 22 nt, Human
aacaguuaagaggaggcagaga

SEQ ID NO: 86066 - RNA, 22 nt, Human
aacaucugagagcccuugugca

SEQ ID NO: 86067 - RNA, 22 nt, Human
aacaguguaggagcugguuuau

SEQ ID NO: 86068 - RNA, 20 nt, Human
aacagcucucgacuuaucuu

SEQ ID NO: 86069 - RNA, 22 nt, Human
aaccagaagucaucagagcuga

SEQ ID NO: 86070 - RNA, 22 nt, Human
aacagaaaucauuuagggcucu

SEQ ID NO: 86071 - RNA, 22 nt, Human
aaauucuuccaggaggaaauac

SEQ ID NO: 86072 - RNA, 20 nt, Human
aaauugaacaagccaggcug

SEQ ID NO: 86073 - RNA, 22 nt, Human
aaauucagcagguuucaaaagc

SEQ ID NO: 86074 - RNA, 20 nt, Human
aaauucgacuaaaaccagaa

SEQ ID NO: 86075 - RNA, 22 nt, Human
aaauuaaaguuuuauuuagagc

SEQ ID NO: 86076 - RNA, 22 nt, Human
aaauguuugguggauaaaagga

SEQ ID NO: 86077 - RNA, 22 nt, Human
aaauguuucauucuauuuuuag

SEQ ID NO: 86078 - RNA, 22 nt, Human
aaaugcuuuaauugaguucaug

SEQ ID NO: 86079 - RNA, 22 nt, Human
aaauggaaguuuguucucagcc

SEQ ID NO: 86080 - RNA, 22 nt, Human
aaaugguguucuuuagaugaaa

SEQ ID NO: 86081 - RNA, 22 nt, Human
aaaucugaaggaaacagcuuca

SEQ ID NO: 86082 - RNA, 22 nt, Human
aaaugggagucacacagguuua

SEQ ID NO: 86083 - RNA, 22 nt, Human
aaauggauaaucaagauaauca

SEQ ID NO: 86084 - RNA, 22 nt, Human
aaagacuaaccaguugucaaaa

SEQ ID NO: 86085 - RNA, 22 nt, Human
aaagaccuucacuuucuggcug

SEQ ID NO: 86086 - RNA, 22 nt, Human
aaagagggaaggaaggagugaa

SEQ ID NO: 86087 - RNA, 22 nt, Human
aguaucuuccucaugaacacgu

SEQ ID NO: 86088 - RNA, 22 nt, Human
aguaucugccagaaucucaguu

SEQ ID NO: 86089 - RNA, 22 nt, Human
aguaucgcuuuguaucaugagg

SEQ ID NO: 86090 - RNA, 22 nt, Human
aguaauaaacaacucauuuugg

SEQ ID NO: 86091 - RNA, 22 nt, Human
aguaacuuaagcaauuguguau

SEQ ID NO: 86092 - RNA, 22 nt, Human
aguauagacaucaaacugaaga

SEQ ID NO: 86093 - RNA, 22 nt, Human
aguaauggucucaauaaauucu

SEQ ID NO: 86094 - RNA, 22 nt, Human
agguggcguauguguucguguu

SEQ ID NO: 86095 - RNA, 22 nt, Human
agguuaaacuuccugcagggcu

SEQ ID NO: 86096 - RNA, 22 nt, Human
agguuaauaugaacagcagaag

SEQ ID NO: 86097 - RNA, 22 nt, Human
aguaaaugaaagcaauuuuaga

SEQ ID NO: 86098 - RNA, 22 nt, Human
agguuuuugucauuuucuggua

SEQ ID NO: 86099 - RNA, 19 nt, Human
aguauuggcagguccugua

SEQ ID NO: 86100 - RNA, 22 nt, Human
aguauugguaaguguagcaaau

SEQ ID NO: 86101 - RNA, 22 nt, Human
aguauuuuaaaauacauuaucc

SEQ ID NO: 86102 - RNA, 22 nt, Human
aguauuuucuuuaguuuguuag

SEQ ID NO: 86103 - RNA, 22 nt, Human
agucaaaaaaccuagaaacacc

SEQ ID NO: 86104 - RNA, 23 nt, Human
aguauuguucaucuucaagacag

SEQ ID NO: 86105 - RNA, 22 nt, Human
aguauuuaguauucuauauuag

SEQ ID NO: 86106 - RNA, 22 nt, Human
agucaccuacagcucaugcuuc

SEQ ID NO: 86107 - RNA, 22 nt, Human
aguauaucugcuucuggguccc

SEQ ID NO: 86108 - RNA, 22 nt, Human
agucauuguguucaguaaaauc

SEQ ID NO: 86109 - RNA, 22 nt, Human
agucauuugaggcaugauuaug

SEQ ID NO: 86110 - RNA, 18 nt, Human
agucugagugaaauguag

SEQ ID NO: 86111 - RNA, 22 nt, Human
agucugaaccagauggcaaggu

SEQ ID NO: 86112 - RNA, 22 nt, Human
agucggauuucccagguuauug

SEQ ID NO: 86113 - RNA, 22 nt, Human
aguccucagauauggagaucug

SEQ ID NO: 86114 - RNA, 22 nt, Human
agugaagauagagccaggucug

SEQ ID NO: 86115 - RNA, 22 nt, Human
agucucuagagucugucccucu

SEQ ID NO: 86116 - RNA, 22 nt, Human
agggaagccggagcgacggggg

SEQ ID NO: 86117 - RNA, 22 nt, Human
aggggcugagaguuugaugugg

SEQ ID NO: 86118 - RNA, 22 nt, Human
aggggagaagcacuccuugccu

SEQ ID NO: 86119 - RNA, 22 nt, Human
aggucuacaugcuuaauauauc

SEQ ID NO: 86120 - RNA, 22 nt, Human
agguauaguuauuucugcuccc

SEQ ID NO: 86121 - RNA, 22 nt, Human
agguauuuuaugucgugugaug

SEQ ID NO: 86122 - RNA, 22 nt, Human
aggguuaugcuccuucaucuug

SEQ ID NO: 86123 - RNA, 22 nt, Human
agguaagaagugagcaaguuua

SEQ ID NO: 86124 - RNA, 22 nt, Human
aggguuuucauauauuauuagu

SEQ ID NO: 86125 - RNA, 22 nt, Human
agggaagagaaacaaagauuca

SEQ ID NO: 86126 - RNA, 22 nt, Human
aggcgguuggcuuugucugggu

SEQ ID NO: 86127 - RNA, 22 nt, Human
aggcgaagggaccagacgguag

SEQ ID NO: 86128 - RNA, 22 nt, Human
agggaagcaggaaguaugggaa

SEQ ID NO: 86129 - RNA, 22 nt, Human
agggaagaggaccagagucucu

SEQ ID NO: 86130 - RNA, 22 nt, Human
agggacuugugucuguguuuuu

SEQ ID NO: 86131 - RNA, 22 nt, Human
agggaaauuaaugugagcaaug

SEQ ID NO: 86132 - RNA, 22 nt, Human
aggccgcgguggcgaaggcguu

SEQ ID NO: 86133 - RNA, 22 nt, Human
aggaugagugaagagguaaauu

SEQ ID NO: 86134 - RNA, 19 nt, Human
agcagccaucgaccaugga

SEQ ID NO: 86135 - RNA, 22 nt, Human
agcaggaggguuuuguagaguc

SEQ ID NO: 86136 - RNA, 22 nt, Human
agcagauuguacagugcauuag

SEQ ID NO: 86137 - RNA, 22 nt, Human
agcaguuagauccugguuagcg

SEQ ID NO: 86138 - RNA, 22 nt, Human
agcaugaauugccauuuauuaa

SEQ ID NO: 86139 - RNA, 22 nt, Human
agcauuucuacugugucagaaa

SEQ ID NO: 86140 - RNA, 22 nt, Human
agcauuuuaaaacuaguuacca

SEQ ID NO: 86141 - RNA, 22 nt, Human
agcauuugcuguucuagaaagu

SEQ ID NO: 86142 - RNA, 19 nt, Human
agcagugaaaucuggugag

SEQ ID NO: 86143 - RNA, 22 nt, Human
agcaguugcuuuguauauuaaa

SEQ ID NO: 86144 - RNA, 22 nt, Human
agcaguuuauccucauaaugga

SEQ ID NO: 86145 - RNA, 22 nt, Human
agccaagucucacugagucugu

SEQ ID NO: 86146 - RNA, 22 nt, Human
agccagcauauauauaguugaa

SEQ ID NO: 86147 - RNA, 22 nt, Human
agcauucuguggucuucuaugg

SEQ ID NO: 86148 - RNA, 22 nt, Human
agcauugguggcauuugcagcu

SEQ ID NO: 86149 - RNA, 22 nt, Human
agccauggaggaugugcagcau

SEQ ID NO: 86150 - RNA, 20 nt, Human
agcauucaacuuucuauguu

SEQ ID NO: 86151 - RNA, 22 nt, Human
agcgaaaagaauggaguggagu

SEQ ID NO: 86152 - RNA, 22 nt, Human
agccgcgcuguuccugcugcug

SEQ ID NO: 86153 - RNA, 22 nt, Human
agcguucuguuccaugcuaaca

SEQ ID NO: 86154 - RNA, 22 nt, Human
agcuaaauauuuuuccugacac

SEQ ID NO: 86155 - RNA, 22 nt, Human
agcuaauguauguugaaagcac

SEQ ID NO: 86156 - RNA, 22 nt, Human
agcuaaaaugagguuuuuggau

SEQ ID NO: 86157 - RNA, 22 nt, Human
agcucugugcaggcagaggcau

SEQ ID NO: 86158 - RNA, 22 nt, Human
agcugauugucuuuuuaaaagu

SEQ ID NO: 86159 - RNA, 22 nt, Human
agcugcauucguaucauauugu

SEQ ID NO: 86160 - RNA, 22 nt, Human
agcugcauguauauucuuaaca

SEQ ID NO: 86161 - RNA, 22 nt, Human
agcugugccuauucguggcaag

SEQ ID NO: 86162 - RNA, 22 nt, Human
agcuggaaucucggcaaagcgu

SEQ ID NO: 86163 - RNA, 22 nt, Human
agcugcuuuacuggucggcugg

SEQ ID NO: 86164 - RNA, 22 nt, Human
agcuggauuaaucacagugacu

SEQ ID NO: 86165 - RNA, 22 nt, Human
agcuuucuauauaugaguugcu

SEQ ID NO: 86166 - RNA, 22 nt, Human
agcuuugucccaagugcucugg

SEQ ID NO: 86167 - RNA, 22 nt, Human
aggaaagacgcauuucuguagg

SEQ ID NO: 86168 - RNA, 22 nt, Human
aggagaaagaccagccugccga

SEQ ID NO: 86169 - RNA, 22 nt, Human
aggacuguauacucuaggugaa

SEQ ID NO: 86170 - RNA, 22 nt, Human
aggauaaaugggucauuaggca

SEQ ID NO: 86171 - RNA, 22 nt, Human
aggaaaauggaccagaguuguu

SEQ ID NO: 86172 - RNA, 22 nt, Human
aggaacaguuucaaagagugaa

SEQ ID NO: 86173 - RNA, 22 nt, Human
agcugugaccaguuacgaaauu

SEQ ID NO: 86174 - RNA, 19 nt, Human
agcuuauuuacugcaggac

SEQ ID NO: 86175 - RNA, 22 nt, Human
agcuuugcccaaugaguuaugu

SEQ ID NO: 86176 - RNA, 22 nt, Human
agcuugaaccuaaaacaauaau

SEQ ID NO: 86177 - RNA, 22 nt, Human
agcuugaugaaagugggugcuc

SEQ ID NO: 86178 - RNA, 22 nt, Human
agcuugagauaauucaagcuga

SEQ ID NO: 86179 - RNA, 22 nt, Human
aggaaaaagaagaaaagaauca

SEQ ID NO: 86180 - RNA, 22 nt, Human
aggaaaaugaaggaagugggaa

SEQ ID NO: 86181 - RNA, 22 nt, Human
agcuuugcugcuggagaagggu

SEQ ID NO: 86182 - RNA, 20 nt, Human
aggaagauccuuucuuuuaa

SEQ ID NO: 86183 - RNA, 22 nt, Human
acugaggaagccugucaucauc

SEQ ID NO: 86184 - RNA, 22 nt, Human
acuaaguagaggagugaugauu

SEQ ID NO: 86185 - RNA, 22 nt, Human
acuacucagcaaacauuugcug

SEQ ID NO: 86186 - RNA, 20 nt, Human
acuagaaagucacugggggg

SEQ ID NO: 86187 - RNA, 22 nt, Human
acuacuguaauuuauuguuaca

SEQ ID NO: 86188 - RNA, 22 nt, Human
acuggauuuugugguguaucuu

SEQ ID NO: 86189 - RNA, 22 nt, Human
acugggcaaggauaugaugggu

SEQ ID NO: 86190 - RNA, 22 nt, Human
acuggugcucuggccaccgcug

SEQ ID NO: 86191 - RNA, 18 nt, Human
acuguccucaggacguug

SEQ ID NO: 86192 - RNA, 22 nt, Human
acuguucacccagcacuagcag

SEQ ID NO: 86193 - RNA, 22 nt, Human
acuguuauugguguauguggca

SEQ ID NO: 86194 - RNA, 22 nt, Human
acugugauguaaagaaauaggc

SEQ ID NO: 86195 - RNA, 22 nt, Human
acugugcaugaaccgaaacaaa

SEQ ID NO: 86196 - RNA, 22 nt, Human
acuuuauacuagugauaguuug

SEQ ID NO: 86197 - RNA, 22 nt, Human
acuugggaaaugaaaauacaga

SEQ ID NO: 86198 - RNA, 22 nt, Human
acuuuuagccuucccacaacag

SEQ ID NO: 86199 - RNA, 22 nt, Human
acuuuuaauaguagauuuuuaa

SEQ ID NO: 86200 - RNA, 22 nt, Human
acuuuuuugccaucccuccagc

SEQ ID NO: 86201 - RNA, 22 nt, Human
agaaaagagacaauguuuuugg

SEQ ID NO: 86202 - RNA, 22 nt, Human
acuuuuaaggggccuugauuua

SEQ ID NO: 86203 - RNA, 22 nt, Human
acuuugucuugaucaaaggugu

SEQ ID NO: 86204 - RNA, 23 nt, Human
acuuugaggagaagaaugucagu

SEQ ID NO: 86205 - RNA, 22 nt, Human
agaagauucagcaguagggugg

SEQ ID NO: 86206 - RNA, 22 nt, Human
agaaauggggugaagcaaaugg

SEQ ID NO: 86207 - RNA, 22 nt, Human
agaagcaauuggaaaguacagg

SEQ ID NO: 86208 - RNA, 22 nt, Human
agaaagcacccugcacuuucug

SEQ ID NO: 86209 - RNA, 19 nt, Human
agaaacaacauucuggaga

SEQ ID NO: 86210 - RNA, 22 nt, Human
agaagaucccugugguuacgac

SEQ ID NO: 86211 - RNA, 22 nt, Human
agaagaaugguuugaaagauuu

SEQ ID NO: 86212 - RNA, 22 nt, Human
agacagaacauaauuaguacug

SEQ ID NO: 86213 - RNA, 22 nt, Human
agaaucucuagaaaugggucuc

SEQ ID NO: 86214 - RNA, 22 nt, Human
agaauccugagggaaauuuggc

SEQ ID NO: 86215 - RNA, 22 nt, Human
agaaucagagcagaaucuucau

SEQ ID NO: 86216 - RNA, 22 nt, Human
agaacaagaaacccgaaaagug

SEQ ID NO: 86217 - RNA, 22 nt, Human
agaaauuguaauaaaucugguc

SEQ ID NO: 86218 - RNA, 22 nt, Human
agaaccaauacuacagcaagua

SEQ ID NO: 86219 - RNA, 22 nt, Human
agaacaggaggaagccagcucc

SEQ ID NO: 86220 - RNA, 21 nt, Human
agaaugaagaagaggucuuug

SEQ ID NO: 86221 - RNA, 22 nt, Human
agaauguaagaaugcaaagauu

SEQ ID NO: 86222 - RNA, 22 nt, Human
agacuguuccgucagacucagu

SEQ ID NO: 86223 - RNA, 20 nt, Human
agacauugaggagagagcau

SEQ ID NO: 86224 - RNA, 22 nt, Human
agacagcggugcaauaaauggu

SEQ ID NO: 86225 - RNA, 22 nt, Human
agaccauuuuguagccagcaua

SEQ ID NO: 86226 - RNA, 22 nt, Human
agacgacucuuaaggcagaauu

SEQ ID NO: 86227 - RNA, 22 nt, Human
agacgcgcagaaggaagcggcc

SEQ ID NO: 86228 - RNA, 21 nt, Human
agacuucuacuaucuuaugac

SEQ ID NO: 86229 - RNA, 22 nt, Human
agacuuugaaugaugacagcgu

SEQ ID NO: 86230 - RNA, 22 nt, Human
agacuguuuucccaucucuugg

SEQ ID NO: 86231 - RNA, 21 nt, Human
agacugaugggaagacucugu

SEQ ID NO: 86232 - RNA, 22 nt, Human
agagacuguaaugagagguaca

SEQ ID NO: 86233 - RNA, 22 nt, Human
agagaauuugggaauauaaauc

SEQ ID NO: 86234 - RNA, 22 nt, Human
agagaaauguacuagucuaacu

SEQ ID NO: 86235 - RNA, 22 nt, Human
agagaaacauuaauugaugagg

SEQ ID NO: 86236 - RNA, 22 nt, Human
agagauuagagaagaugauaaa

SEQ ID NO: 86237 - RNA, 22 nt, Human
agagauugagcucagaagaccu

SEQ ID NO: 86238 - RNA, 22 nt, Human
agaggaauuauugaguuagauu

SEQ ID NO: 86239 - RNA, 22 nt, Human
agaggcagagcugggguuugac

SEQ ID NO: 86240 - RNA, 22 nt, Human
agagcuuuggaguaaguuuuga

SEQ ID NO: 86241 - RNA, 22 nt, Human
agaguguggaaauguucagagu

SEQ ID NO: 86242 - RNA, 22 nt, Human
agaguuaguggccucagcaggg

SEQ ID NO: 86243 - RNA, 22 nt, Human
acccuuucgagauuucugccuu

SEQ ID NO: 86244 - RNA, 22 nt, Human
accgauuucaaauggugcuaga

SEQ ID NO: 86245 - RNA, 22 nt, Human
accgcuggcacuggggacgggg

SEQ ID NO: 86246 - RNA, 20 nt, Human
acccagaguccuccccgcgc

SEQ ID NO: 86247 - RNA, 22 nt, Human
accauccaaaagcuuuucauca

SEQ ID NO: 86248 - RNA, 22 nt, Human
accauuuaucagaagagacacc

SEQ ID NO: 86249 - RNA, 22 nt, Human
accauuauagaggacauuaugu

SEQ ID NO: 86250 - RNA, 22 nt, Human
acccccacuccgcaguagaacu

SEQ ID NO: 86251 - RNA, 22 nt, Human
accucauucugcauagaacuuu

SEQ ID NO: 86252 - RNA, 22 nt, Human
accuauuuauacaacugcacca

SEQ ID NO: 86253 - RNA, 22 nt, Human
acccuauuaacuacuacguugg

SEQ ID NO: 86254 - RNA, 22 nt, Human
accuggaccugccaccuaugag

SEQ ID NO: 86255 - RNA, 22 nt, Human
accucccgacggcgcgggagaa

SEQ ID NO: 86256 - RNA, 22 nt, Human
accuccauggcccacaucuagu

SEQ ID NO: 86257 - RNA, 22 nt, Human
accucaguucaagggaguuuca

SEQ ID NO: 86258 - RNA, 22 nt, Human
accucuuucuauggauuuuuug

SEQ ID NO: 86259 - RNA, 22 nt, Human
accgauguggaaaauuucauuu

SEQ ID NO: 86260 - RNA, 22 nt, Human
accgagcaggguguuugcgcac

SEQ ID NO: 86261 - RNA, 22 nt, Human
accugcucucccucucgcaguc

SEQ ID NO: 86262 - RNA, 22 nt, Human
accuuaaacagauggcggcugg

SEQ ID NO: 86263 - RNA, 22 nt, Human
accuuagugauuuaaaaucaga

SEQ ID NO: 86264 - RNA, 22 nt, Human
accuucugaccucucggacuuc

SEQ ID NO: 86265 - RNA, 22 nt, Human
acgaggauuuccuuagaugaaa

SEQ ID NO: 86266 - RNA, 22 nt, Human
acgaaugacaugugauuugaaa

SEQ ID NO: 86267 - RNA, 22 nt, Human
accuuaagugauuaugacauau

SEQ ID NO: 86268 - RNA, 22 nt, Human
acgauuugguucagugaagaca

SEQ ID NO: 86269 - RNA, 22 nt, Human
acuaaacauaucacugcuuuac

SEQ ID NO: 86270 - RNA, 22 nt, Human
acguuauagaugcuucaugaaa

SEQ ID NO: 86271 - RNA, 22 nt, Human
acguuuuagccauguaguuucu

SEQ ID NO: 86272 - RNA, 22 nt, Human
acgggggagucuuuuacaucau

SEQ ID NO: 86273 - RNA, 22 nt, Human
accuuuuauuuucaugcuugcu

SEQ ID NO: 86274 - RNA, 22 nt, Human
acgcacuuuaugcuuuuaacaa

SEQ ID NO: 86275 - RNA, 22 nt, Human
aauucugaggccauuuauuucc

SEQ ID NO: 86276 - RNA, 22 nt, Human
aauucuaaugaguucuuaucua

SEQ ID NO: 86277 - RNA, 22 nt, Human
aauucuuuguuccucugccaag

SEQ ID NO: 86278 - RNA, 22 nt, Human
acauaaaccccccuuccccagg

SEQ ID NO: 86279 - RNA, 22 nt, Human
acauagcuuaaaugagaagaua

SEQ ID NO: 86280 - RNA, 22 nt, Human
acauggaauuucagaagagcau

SEQ ID NO: 86281 - RNA, 22 nt, Human
acaugggggugggacggcagag

SEQ ID NO: 86282 - RNA, 23 nt, Human
acauuacacgcaguaauugcccc

SEQ ID NO: 86283 - RNA, 22 nt, Human
acaucuaugucugaggccuugg

SEQ ID NO: 86284 - RNA, 22 nt, Human
acaugucagaaaauucagaggg

SEQ ID NO: 86285 - RNA, 22 nt, Human
acaugacagugacuuuauaaga

SEQ ID NO: 86286 - RNA, 22 nt, Human
acauugguauuaguguggcuga

SEQ ID NO: 86287 - RNA, 22 nt, Human
acauuucuccuacuuguuauuu

SEQ ID NO: 86288 - RNA, 22 nt, Human
acauggaaacacgcagccccaa

SEQ ID NO: 86289 - RNA, 22 nt, Human
acauuuuuggguugaugucuga

SEQ ID NO: 86290 - RNA, 22 nt, Human
accaccacugacaccagcucgg

SEQ ID NO: 86291 - RNA, 22 nt, Human
acauuauuguguagugugggca

SEQ ID NO: 86292 - RNA, 22 nt, Human
accaauaaaagcaauucacagu

SEQ ID NO: 86293 - RNA, 22 nt, Human
acauuuguuucucuagaguagg

SEQ ID NO: 86294 - RNA, 22 nt, Human
acauuguuuuugugacuucuau

SEQ ID NO: 86295 - RNA, 22 nt, Human
accaauguuuuauagaaaugcc

SEQ ID NO: 86296 - RNA, 22 nt, Human
cccccauccccugaaggagcug

SEQ ID NO: 86297 - RNA, 22 nt, Human
ccccguggcugggggacagagc

SEQ ID NO: 86298 - RNA, 22 nt, Human
ccccccaaaacuacuggccugu

SEQ ID NO: 86299 - RNA, 22 nt, Human
caucaaaugcaagagcguucuu

SEQ ID NO: 86300 - RNA, 22 nt, Human
cauauuaugcauguuguucuuu

SEQ ID NO: 86301 - RNA, 20 nt, Human
caucaacaccuugucagccu

SEQ ID NO: 86302 - RNA, 22 nt, Human
cccauuaguuguuaaucaucaa

SEQ ID NO: 86303 - RNA, 19 nt, Human
ccaguuuuuuaauauucaa

SEQ ID NO: 86304 - RNA, 22 nt, Human
cccugauaaaucagcaccucag

SEQ ID NO: 86305 - RNA, 17 nt, Human
cccugcacccuacucuc

SEQ ID NO: 86306 - RNA, 22 nt, Human
cccuaguuuauuugccuucuuu

SEQ ID NO: 86307 - RNA, 22 nt, Human
cccuuggaaaugguucuuaacu

SEQ ID NO: 86308 - RNA, 22 nt, Human
ccgaaaaacagaaucuuggaac

SEQ ID NO: 86309 - RNA, 22 nt, Human
ccaugauguugccuacacugcu

SEQ ID NO: 86310 - RNA, 22 nt, Human
ccauggaugcucagauguuagc

SEQ ID NO: 86311 - RNA, 22 nt, Human
ccgauuuauucugacaguuuau

SEQ ID NO: 86312 - RNA, 23 nt, Human
ccaugugcaggguucagcacuua

SEQ ID NO: 86313 - RNA, 22 nt, Human
ccuauuuucaaaauuguuuauc

SEQ ID NO: 86314 - RNA, 22 nt, Human
ccuaauuuuagacccacuccua

SEQ ID NO: 86315 - RNA, 22 nt, Human
ccguuugugcugcaggagaucg

SEQ ID NO: 86316 - RNA, 22 nt, Human
ccuaacagauugggugacaaua

SEQ ID NO: 86317 - RNA, 20 nt, Human
ccccagcauccuuuucaucu

SEQ ID NO: 86318 - RNA, 22 nt, Human
ccccagugguugcaacagcaga

SEQ ID NO: 86319 - RNA, 22 nt, Human
cccaucugugaaauggggcugc

SEQ ID NO: 86320 - RNA, 22 nt, Human
ccguaugacuuuuuguuguugu

SEQ ID NO: 86321 - RNA, 22 nt, Human
ccgcggcuguaguggaggugga

SEQ ID NO: 86322 - RNA, 22 nt, Human
ccgcggcugcgcggugccccuc

SEQ ID NO: 86323 - RNA, 22 nt, Human
ccggcggaaacauggcggcgcc

SEQ ID NO: 86324 - RNA, 22 nt, Human
ccgggcggcauccagccguucc

SEQ ID NO: 86325 - RNA, 22 nt, Human
ccuccuuucaggaaguaggugg

SEQ ID NO: 86326 - RNA, 22 nt, Human
ccucgugcgauaguuaugucag

SEQ ID NO: 86327 - RNA, 21 nt, Human
ccuccagccagagggucugga

SEQ ID NO: 86328 - RNA, 22 nt, Human
cccgaaaauuguuguacugcag

SEQ ID NO: 86329 - RNA, 22 nt, Human
cccuucuguaucuucugaguuu

SEQ ID NO: 86330 - RNA, 22 nt, Human
cccugcacuguguggacucugg

SEQ ID NO: 86331 - RNA, 22 nt, Human
cccuuuucuaauuuagccuguu

SEQ ID NO: 86332 - RNA, 22 nt, Human
ccucacuucuuucucuucacuu

SEQ ID NO: 86333 - RNA, 22 nt, Human
ccucaauucgugccucacauug

SEQ ID NO: 86334 - RNA, 22 nt, Human
ccgccucucgcucccagcuugc

SEQ ID NO: 86335 - RNA, 22 nt, Human
ccugcugcugaugcuguuucac

SEQ ID NO: 86336 - RNA, 22 nt, Human
ccgcaccgucugccauacacgc

SEQ ID NO: 86337 - RNA, 22 nt, Human
ccucucacucccucauggguuc

SEQ ID NO: 86338 - RNA, 22 nt, Human
cgacgacaggcgcccgaggagg

SEQ ID NO: 86339 - RNA, 22 nt, Human
cgcauugcaauucaggggauaa

SEQ ID NO: 86340 - RNA, 19 nt, Human
ccugcugaagugaugcagc

SEQ ID NO: 86341 - RNA, 22 nt, Human
ccugcugagccuggugggcagc

SEQ ID NO: 86342 - RNA, 22 nt, Human
cggccuuuggcuucuccugugu

SEQ ID NO: 86343 - RNA, 22 nt, Human
cggccuuugcccgucauucugg

SEQ ID NO: 86344 - RNA, 22 nt, Human
ccugcucuaauucauucaugcu

SEQ ID NO: 86345 - RNA, 22 nt, Human
ccugaauuuaucugaauggugg

SEQ ID NO: 86346 - RNA, 22 nt, Human
ccugaaaugaguucugcucacu

SEQ ID NO: 86347 - RNA, 22 nt, Human
cgcgcuuugggcaguguggcug

SEQ ID NO: 86348 - RNA, 22 nt, Human
ccuucaguguuacuagaaagcg

SEQ ID NO: 86349 - RNA, 20 nt, Human
ccuguucacugcgcaguuuc

SEQ ID NO: 86350 - RNA, 19 nt, Human
ccugugaguuaagcuaugu

SEQ ID NO: 86351 - RNA, 22 nt, Human
ccugugcaugccaggguacacc

SEQ ID NO: 86352 - RNA, 22 nt, Human
cggggcggcgagcgggccgggc

SEQ ID NO: 86353 - RNA, 22 nt, Human
ccuuuuaagggagacuagagau

SEQ ID NO: 86354 - RNA, 22 nt, Human
ccuuuuagagaagugcauccag

SEQ ID NO: 86355 - RNA, 22 nt, Human
ccuucccagacggcucagcugu

SEQ ID NO: 86356 - RNA, 22 nt, Human
cuaagaaggaggaaaagugcca

SEQ ID NO: 86357 - RNA, 19 nt, Human
cgacauggguaaugggaga

SEQ ID NO: 86358 - RNA, 22 nt, Human
cgaaggaaucacuuaacacuuu

SEQ ID NO: 86359 - RNA, 20 nt, Human
ccuuuuguugcuguuuggau

SEQ ID NO: 86360 - RNA, 22 nt, Human
cuaaaaauguucuaguaguuca

SEQ ID NO: 86361 - RNA, 20 nt, Human
cuaaaacaggugucuaguga

SEQ ID NO: 86362 - RNA, 22 nt, Human
cguugguggguguguggucgga

SEQ ID NO: 86363 - RNA, 22 nt, Human
cuaauugcuggcugcuggcaga

SEQ ID NO: 86364 - RNA, 22 nt, Human
cuauaauuguacuuguuuuuua

SEQ ID NO: 86365 - RNA, 22 nt, Human
cucacgguuugcaucaagagug

SEQ ID NO: 86366 - RNA, 22 nt, Human
cuauuauuauugucguuuuaca

SEQ ID NO: 86367 - RNA, 22 nt, Human
cuauugguaucacacugauuuc

SEQ ID NO: 86368 - RNA, 22 nt, Human
cucccucacaaagcauucucuu

SEQ ID NO: 86369 - RNA, 22 nt, Human
cucuauuuuuucaucuuucagg

SEQ ID NO: 86370 - RNA, 22 nt, Human
cucuaaauguggucugcagaua

SEQ ID NO: 86371 - RNA, 22 nt, Human
cucucuaacuagagacaggagu

SEQ ID NO: 86372 - RNA, 20 nt, Human
cucugggaggcuugucaccu

SEQ ID NO: 86373 - RNA, 17 nt, Human
cucugggucuccugcuu

SEQ ID NO: 86374 - RNA, 20 nt, Human
cucuuuaugagaccacuguc

SEQ ID NO: 86375 - RNA, 22 nt, Human
cucuuuuuccuaugaaaucuau

SEQ ID NO: 86376 - RNA, 20 nt, Human
cucuuucugcuuuaugccuc

SEQ ID NO: 86377 - RNA, 22 nt, Human
cugaaagacagccaggcaaagc

SEQ ID NO: 86378 - RNA, 22 nt, Human
cucuuuuuuugucuuaagaacc

SEQ ID NO: 86379 - RNA, 22 nt, Human
cugaaagcaaaguaauucuuaa

SEQ ID NO: 86380 - RNA, 22 nt, Human
cggggcaaggggggcuggugga

SEQ ID NO: 86381 - RNA, 22 nt, Human
cugaaucaaaugacuuagccau

SEQ ID NO: 86382 - RNA, 22 nt, Human
cugacacagccauuguccuugu

SEQ ID NO: 86383 - RNA, 22 nt, Human
cuuuguaaucaauaagucuuuu

SEQ ID NO: 86384 - RNA, 22 nt, Human
cuuuuaaucuaauuuuuauauu

SEQ ID NO: 86385 - RNA, 19 nt, Human
cuuugugguuuucagaacu

SEQ ID NO: 86386 - RNA, 22 nt, Human
gaaauagagacaguaagugucu

SEQ ID NO: 86387 - RNA, 22 nt, Human
gaaaugucaagauauguuugga

SEQ ID NO: 86388 - RNA, 22 nt, Human
cuguggaguccuggggaaugga

SEQ ID NO: 86389 - RNA, 22 nt, Human
gaacaaaagauagcccaaacau

SEQ ID NO: 86390 - RNA, 22 nt, Human
cuguuucuuugcugucagagag

SEQ ID NO: 86391 - RNA, 22 nt, Human
cuguuucucugccugcacacau

SEQ ID NO: 86392 - RNA, 22 nt, Human
gaacaugaguuuuaugguauuu

SEQ ID NO: 86393 - RNA, 22 nt, Human
cuguuuuugccugugacaaaaa

SEQ ID NO: 86394 - RNA, 23 nt, Human
cuuauauaaucauuagaaaccau

SEQ ID NO: 86395 - RNA, 22 nt, Human
cuuaagacaggcucaaagauua

SEQ ID NO: 86396 - RNA, 22 nt, Human
cuuacaauuuucuuggacuuuu

SEQ ID NO: 86397 - RNA, 22 nt, Human
cuuauuugcccauguuucuuua

SEQ ID NO: 86398 - RNA, 20 nt, Human
cuuauuuuggagaacuuuuc

SEQ ID NO: 86399 - RNA, 22 nt, Human
cuucucuugugauguuagcgga

SEQ ID NO: 86400 - RNA, 22 nt, Human
cuucucuuugacaguugggugu

SEQ ID NO: 86401 - RNA, 22 nt, Human
gaaggcugaauuauuuguuccu

SEQ ID NO: 86402 - RNA, 22 nt, Human
gaagcgugcagguccguauacu

SEQ ID NO: 86403 - RNA, 22 nt, Human
gaagcucaguugcuuagaucuc

SEQ ID NO: 86404 - RNA, 22 nt, Human
gaagcgucaugaaagaaaggcu

SEQ ID NO: 86405 - RNA, 22 nt, Human
cuucauuucaggcugaagaaua

SEQ ID NO: 86406 - RNA, 22 nt, Human
cuucauuacagcaaccauuuga

SEQ ID NO: 86407 - RNA, 22 nt, Human
gaauacaaauaauaccaaggug

SEQ ID NO: 86408 - RNA, 22 nt, Human
cuucuuuccauguguuuugguu

SEQ ID NO: 86409 - RNA, 21 nt, Human
gaaguagcucugagaaaagug

SEQ ID NO: 86410 - RNA, 22 nt, Human
gaaguaaugugauugcucaggg

SEQ ID NO: 86411 - RNA, 22 nt, Human
cuucuugggaggggcggagcuc

SEQ ID NO: 86412 - RNA, 22 nt, Human
cuucuucuagaagauggggaag

SEQ ID NO: 86413 - RNA, 22 nt, Human
cuucuuugacucacugguacgc

SEQ ID NO: 86414 - RNA, 22 nt, Human
gaaugcacacgugugugcaugc

SEQ ID NO: 86415 - RNA, 22 nt, Human
gaaugcauuuuuuaaaagcaua

SEQ ID NO: 86416 - RNA, 22 nt, Human
gaauggaacauagcaacaucuu

SEQ ID NO: 86417 - RNA, 22 nt, Human
cuuuuucuugugguuaauaucu

SEQ ID NO: 86418 - RNA, 22 nt, Human
cuuuuucuuaucuuuuucuaug

SEQ ID NO: 86419 - RNA, 21 nt, Human
gacuacaauauguaaucuaau

SEQ ID NO: 86420 - RNA, 22 nt, Human
gacggaggacaucagcaguguc

SEQ ID NO: 86421 - RNA, 18 nt, Human
gacaaaaguacagacaga

SEQ ID NO: 86422 - RNA, 22 nt, Human
cuuguuaacaauugguaucuuu

SEQ ID NO: 86423 - RNA, 22 nt, Human
cuuguuuggccauaggugcugg

SEQ ID NO: 86424 - RNA, 22 nt, Human
cuuuaaaaauguauuuuugugg

SEQ ID NO: 86425 - RNA, 22 nt, Human
gacugucaaauaaaucguuuac

SEQ ID NO: 86426 - RNA, 22 nt, Human
gaaaaagucuuaaaguaaggca

SEQ ID NO: 86427 - RNA, 22 nt, Human
gaaaagaaaggaugguaugugu

SEQ ID NO: 86428 - RNA, 22 nt, Human
gaaacguuguggaaaauccucu

SEQ ID NO: 86429 - RNA, 22 nt, Human
gagaauuauacaugagcuauuu

SEQ ID NO: 86430 - RNA, 22 nt, Human
gaaagcuuggaaacgacuuuau

SEQ ID NO: 86431 - RNA, 22 nt, Human
gaaagggggcuuggacacuggc

SEQ ID NO: 86432 - RNA, 22 nt, Human
gagaagugggggucugggauga

SEQ ID NO: 86433 - RNA, 22 nt, Human
gaaagcauucuggaggggcaga

SEQ ID NO: 86434 - RNA, 22 nt, Human
gagaaugagucagagcuggcug

SEQ ID NO: 86435 - RNA, 22 nt, Human
gagaggaagugccugcucccag

SEQ ID NO: 86436 - RNA, 22 nt, Human
gaaagugaauguaacauguuau

SEQ ID NO: 86437 - RNA, 22 nt, Human
gagaggugaagcuaauuaauuu

SEQ ID NO: 86438 - RNA, 22 nt, Human
gaaauaggcccuuacauggaaa

SEQ ID NO: 86439 - RNA, 22 nt, Human
gaaauuucuuuguuaucuuggu

SEQ ID NO: 86440 - RNA, 22 nt, Human
gaaaugaaacacacaugcagcu

SEQ ID NO: 86441 - RNA, 22 nt, Human
gaaaugggggcaugcguuacau

SEQ ID NO: 86442 - RNA, 22 nt, Human
gagaguuggaggguauguuagu

SEQ ID NO: 86443 - RNA, 22 nt, Human
gaacagauucaucuaguggcua

SEQ ID NO: 86444 - RNA, 22 nt, Human
gagauuugaguuccuacugagu

SEQ ID NO: 86445 - RNA, 22 nt, Human
gagcacuucagcauaaaucaca

SEQ ID NO: 86446 - RNA, 22 nt, Human
gaagaagagauaauggggagca

SEQ ID NO: 86447 - RNA, 22 nt, Human
cuucauaagauuguugugagga

SEQ ID NO: 86448 - RNA, 22 nt, Human
cuucucuuggguguggugucuu

SEQ ID NO: 86449 - RNA, 22 nt, Human
cuucuuaaaguugucacagcug

SEQ ID NO: 86450 - RNA, 22 nt, Human
cuucuuuuggggaugaaaaugg

SEQ ID NO: 86451 - RNA, 22 nt, Human
cuucuuuucuacuggccuagaa

SEQ ID NO: 86452 - RNA, 22 nt, Human
cuucuugucagugauuucuucc

SEQ ID NO: 86453 - RNA, 22 nt, Human
cugccuuggcccuaguucaugg

SEQ ID NO: 86454 - RNA, 22 nt, Human
cuugcagccuggagcucagccu

SEQ ID NO: 86455 - RNA, 22 nt, Human
cugcuuuggaucucucucugcc

SEQ ID NO: 86456 - RNA, 20 nt, Human
cuuguuaaauaugcagguag

SEQ ID NO: 86457 - RNA, 23 nt, Human
cuggacauucgcaaaguucaucu

SEQ ID NO: 86458 - RNA, 22 nt, Human
cuggaagcgucggaggaagggc

SEQ ID NO: 86459 - RNA, 22 nt, Human
cuuuauguuggggugucuuagu

SEQ ID NO: 86460 - RNA, 18 nt, Human
cuuuagcugucaucuuug

SEQ ID NO: 86461 - RNA, 22 nt, Human
cuuuaguaaaacguauuuagga

SEQ ID NO: 86462 - RNA, 22 nt, Human
cuggagaagagguaguauguag

SEQ ID NO: 86463 - RNA, 22 nt, Human
cuuuacauuaauuucuacugau

SEQ ID NO: 86464 - RNA, 22 nt, Human
cuuucuuucaaguucugcuuua

SEQ ID NO: 86465 - RNA, 22 nt, Human
cuuucuuuuugguuucccccca

SEQ ID NO: 86466 - RNA, 22 nt, Human
cuugguuugaaacauacucuac

SEQ ID NO: 86467 - RNA, 22 nt, Human
cugcugcuugauugcaggaagu

SEQ ID NO: 86468 - RNA, 23 nt, Human
cuuggcuagccacuuccacgcuc

SEQ ID NO: 86469 - RNA, 22 nt, Human
cugcuguugagguuccaggcca

SEQ ID NO: 86470 - RNA, 22 nt, Human
cuugcuuuaucugguuucucau

SEQ ID NO: 86471 - RNA, 22 nt, Human
cuuggcauguucaucugcuugg

SEQ ID NO: 86472 - RNA, 22 nt, Human
cuuggcaaaguggcaaaauuag

SEQ ID NO: 86473 - RNA, 22 nt, Human
cucucuguuaugcuuucaugaa

SEQ ID NO: 86474 - RNA, 22 nt, Human
cucugauuuuucuaauacuuca

SEQ ID NO: 86475 - RNA, 22 nt, Human
cucugcuuagacaggcuuuaag

SEQ ID NO: 86476 - RNA, 22 nt, Human
cucugguuucgcaggaaauaga

SEQ ID NO: 86477 - RNA, 22 nt, Human
cucuuuucaaaccuguuuaugg

SEQ ID NO: 86478 - RNA, 22 nt, Human
cucuucauguuggugcagaagc

SEQ ID NO: 86479 - RNA, 22 nt, Human
cuuauaucaacuggaaaaauua

SEQ ID NO: 86480 - RNA, 20 nt, Human
cuuaugcaaaauguuaggga

SEQ ID NO: 86481 - RNA, 22 nt, Human
cugagcuuuucucugcuucuua

SEQ ID NO: 86482 - RNA, 22 nt, Human
cuucacugcagucauggcucug

SEQ ID NO: 86483 - RNA, 22 nt, Human
cugauagagcauuagugugaga

SEQ ID NO: 86484 - RNA, 22 nt, Human
cucuugggggcaggagggacag

SEQ ID NO: 86485 - RNA, 22 nt, Human
cuggccuuaucacaaagcuaga

SEQ ID NO: 86486 - RNA, 22 nt, Human
cucccccugccucuccucccug

SEQ ID NO: 86487 - RNA, 22 nt, Human
cuccuauugaucaguacuauuu

SEQ ID NO: 86488 - RNA, 22 nt, Human
cuccugauuucuaggccuuauc

SEQ ID NO: 86489 - RNA, 22 nt, Human
cugggaaggaagggaaaaacag

SEQ ID NO: 86490 - RNA, 22 nt, Human
cuccuuuuuuuaaagauggauu

SEQ ID NO: 86491 - RNA, 22 nt, Human
cuccuuuuugggaccgugcagc

SEQ ID NO: 86492 - RNA, 22 nt, Human
cucgccugacucggaugggcug

SEQ ID NO: 86493 - RNA, 22 nt, Human
cuccuuuuccuacucauacuau

SEQ ID NO: 86494 - RNA, 22 nt, Human
cuccucguccucuucauccucu

SEQ ID NO: 86495 - RNA, 22 nt, Human
cuggauuaaacaguuugauacu

SEQ ID NO: 86496 - RNA, 22 nt, Human
cuggccaggugggggguagugg

SEQ ID NO: 86497 - RNA, 22 nt, Human
cuggccagccucccagguaccc

SEQ ID NO: 86498 - RNA, 22 nt, Human
cuggaugagcuucgugcgcacg

SEQ ID NO: 86499 - RNA, 22 nt, Human
cugagaaauacccaagucuggu

SEQ ID NO: 86500 - RNA, 22 nt, Human
cuggaaaaauggauccugucuu

SEQ ID NO: 86501 - RNA, 22 nt, Human
cacucaaacugaaauccuuuuu

SEQ ID NO: 86502 - RNA, 22 nt, Human
cagagaugaggcuggcgugguu

SEQ ID NO: 86503 - RNA, 22 nt, Human
cagagcagaaaccugggugauu

SEQ ID NO: 86504 - RNA, 22 nt, Human
caaucuucucuagaguauucua

SEQ ID NO: 86505 - RNA, 22 nt, Human
caaugaaaauuuaaguugcagc

SEQ ID NO: 86506 - RNA, 22 nt, Human
caauugcuuccuucuguaagua

SEQ ID NO: 86507 - RNA, 22 nt, Human
caauuuggaaagcaugcccccc

SEQ ID NO: 86508 - RNA, 22 nt, Human
cacaacaaaaaauaaguaugag

SEQ ID NO: 86509 - RNA, 22 nt, Human
cacaaggagaaauagauauuga

SEQ ID NO: 86510 - RNA, 22 nt, Human
cagauuuaauaaaaaaugcauc

SEQ ID NO: 86511 - RNA, 22 nt, Human
cagauguuugaaugcuuaccac

SEQ ID NO: 86512 - RNA, 22 nt, Human
cagauacaacagcaggaaugaa

SEQ ID NO: 86513 - RNA, 22 nt, Human
cagaggagcgaguuggacgcca

SEQ ID NO: 86514 - RNA, 21 nt, Human
cagagcuuuggagacggagga

SEQ ID NO: 86515 - RNA, 18 nt, Human
cagcauuagcagcuucca

SEQ ID NO: 86516 - RNA, 22 nt, Human
cagaaagaaguggggauagagg

SEQ ID NO: 86517 - RNA, 19 nt, Human
cagcaaacacuguaaaugg

SEQ ID NO: 86518 - RNA, 22 nt, Human
cagauggaguuaguuucuaaca

SEQ ID NO: 86519 - RNA, 22 nt, Human
cagccuggccucuggauauuug

SEQ ID NO: 86520 - RNA, 22 nt, Human
cagggggacuuguuagguuuua

SEQ ID NO: 86521 - RNA, 22 nt, Human
caggaaaauaauggugauggga

SEQ ID NO: 86522 - RNA, 22 nt, Human
cagcuuauggcuucuccaguag

SEQ ID NO: 86523 - RNA, 22 nt, Human
cagcuccaucuugcuuauacca

SEQ ID NO: 86524 - RNA, 22 nt, Human
cauccuauuacugaggcucccc

SEQ ID NO: 86525 - RNA, 22 nt, Human
caucuaaaauaagccuuauaau

SEQ ID NO: 86526 - RNA, 22 nt, Human
caugaagugaaaagguuaauuu

SEQ ID NO: 86527 - RNA, 22 nt, Human
caugaacucucggguuuggaau

SEQ ID NO: 86528 - RNA, 22 nt, Human
caugagaguaaccuagagaaga

SEQ ID NO: 86529 - RNA, 22 nt, Human
caugaauaauucuuuuucuugg

SEQ ID NO: 86530 - RNA, 22 nt, Human
caugaugagaguaauaacacag

SEQ ID NO: 86531 - RNA, 22 nt, Human
caugauucccacauugcgauca

SEQ ID NO: 86532 - RNA, 22 nt, Human
caugaugacagcauuccuuuua

SEQ ID NO: 86533 - RNA, 22 nt, Human
cauaagaauauuuaguggcagc

SEQ ID NO: 86534 - RNA, 22 nt, Human
caugcuaacacguugcucaccg

SEQ ID NO: 86535 - RNA, 21 nt, Human
caguuugcuauuuuaguauga

SEQ ID NO: 86536 - RNA, 22 nt, Human
cauaggaaauugcuguuaugga

SEQ ID NO: 86537 - RNA, 22 nt, Human
cauggcaggugcagauucugug

SEQ ID NO: 86538 - RNA, 22 nt, Human
cauggcggcgcucucccugccu

SEQ ID NO: 86539 - RNA, 22 nt, Human
caugguaaucggggccaucugu

SEQ ID NO: 86540 - RNA, 22 nt, Human
caucgagaauuggcagcuaaag

SEQ ID NO: 86541 - RNA, 22 nt, Human
cauaccuugguaagagugauca

SEQ ID NO: 86542 - RNA, 22 nt, Human
cagggccagggcuauggugaag

SEQ ID NO: 86543 - RNA, 22 nt, Human
caggccgcccucuccuguuagc

SEQ ID NO: 86544 - RNA, 22 nt, Human
caggccccagggacugggcgcu

SEQ ID NO: 86545 - RNA, 22 nt, Human
cagggacgugagccaugucagu

SEQ ID NO: 86546 - RNA, 22 nt, Human
caggcgcauggugagcagauga

SEQ ID NO: 86547 - RNA, 22 nt, Human
caguacugucuuccugauggca

SEQ ID NO: 86548 - RNA, 22 nt, Human
auuuggaaggcguuucucugua

SEQ ID NO: 86549 - RNA, 22 nt, Human
auuuggaaacaugcugaccaug

SEQ ID NO: 86550 - RNA, 22 nt, Human
auuugaaaaucuaugaugugca

SEQ ID NO: 86551 - RNA, 22 nt, Human
auuuaaagaguaauacaaucca

SEQ ID NO: 86552 - RNA, 22 nt, Human
auuuaaaggaagugggugauaa

SEQ ID NO: 86553 - RNA, 22 nt, Human
auuucagaaugaaaggaaaaau

SEQ ID NO: 86554 - RNA, 22 nt, Human
auuucacucuuaauugcuuccu

SEQ ID NO: 86555 - RNA, 22 nt, Human
auuguuuugugaaacauaguga

SEQ ID NO: 86556 - RNA, 17 nt, Human
auuguuuuuaauuugca

SEQ ID NO: 86557 - RNA, 17 nt, Human
auuuccgaguuucuuuc

SEQ ID NO: 86558 - RNA, 22 nt, Human
auuucccugcagugcuuaggaa

SEQ ID NO: 86559 - RNA, 22 nt, Human
auuucauaaaaacuuuaccuga

SEQ ID NO: 86560 - RNA, 22 nt, Human
auuuccacaaauuaagauugca

SEQ ID NO: 86561 - RNA, 22 nt, Human
auuuauuuucccucaaguaccu

SEQ ID NO: 86562 - RNA, 22 nt, Human
auuuauuugaagagccauugca

SEQ ID NO: 86563 - RNA, 22 nt, Human
auuucagcagcccauguuugga

SEQ ID NO: 86564 - RNA, 22 nt, Human
auuucaacagaguuugaaggca

SEQ ID NO: 86565 - RNA, 22 nt, Human
auuuaaaaacugguacaacagg

SEQ ID NO: 86566 - RNA, 22 nt, Human
auuuaaguuacuucucuuuccu

SEQ ID NO: 86567 - RNA, 22 nt, Human
auuuagagaaguagcaaggucc

SEQ ID NO: 86568 - RNA, 22 nt, Human
auuuaggacagugucugaauug

SEQ ID NO: 86569 - RNA, 20 nt, Human
auuaauuuuuagggcucacc

SEQ ID NO: 86570 - RNA, 22 nt, Human
auuaauguguaugauauaaauu

SEQ ID NO: 86571 - RNA, 22 nt, Human
auuagaaaugacaugugggaau

SEQ ID NO: 86572 - RNA, 22 nt, Human
auuagugguguauuuggcacua

SEQ ID NO: 86573 - RNA, 22 nt, Human
auuauaauucauuaggcuuagu

SEQ ID NO: 86574 - RNA, 22 nt, Human
auuguauugcguuugcgaaugu

SEQ ID NO: 86575 - RNA, 22 nt, Human
auuuuaccauuaguuuguaaua

SEQ ID NO: 86576 - RNA, 22 nt, Human
auuucagaguagaucguuauuu

SEQ ID NO: 86577 - RNA, 18 nt, Human
auuuguggggguuauaga

SEQ ID NO: 86578 - RNA, 22 nt, Human
auuuuagagaaacaaacguagg

SEQ ID NO: 86579 - RNA, 22 nt, Human
auuuuacuaugauaguugagaa

SEQ ID NO: 86580 - RNA, 22 nt, Human
auuugcuuguucaccaguacuu

SEQ ID NO: 86581 - RNA, 22 nt, Human
auuugacuugguaagacuuaag

SEQ ID NO: 86582 - RNA, 22 nt, Human
auuuuugugucacaucuaggaa

SEQ ID NO: 86583 - RNA, 22 nt, Human
auuuuugguuauaaaauaguuu

SEQ ID NO: 86584 - RNA, 22 nt, Human
auuuuucuuucacauuuucuua

SEQ ID NO: 86585 - RNA, 21 nt, Human
auuuguggugcaauuguggua

SEQ ID NO: 86586 - RNA, 22 nt, Human
caaagaaccuucgagacagggc

SEQ ID NO: 86587 - RNA, 22 nt, Human
caaagagaugcaccauauuucu

SEQ ID NO: 86588 - RNA, 22 nt, Human
caaagaugccaaaaggaagaca

SEQ ID NO: 86589 - RNA, 19 nt, Human
auuuugguucuuuccauuc

SEQ ID NO: 86590 - RNA, 22 nt, Human
caaagaagagauuuacagagcu

SEQ ID NO: 86591 - RNA, 22 nt, Human
auuuugcaguuuauugccaauc

SEQ ID NO: 86592 - RNA, 22 nt, Human
caaaacauucagagagcucacu

SEQ ID NO: 86593 - RNA, 22 nt, Human
caaaaaauccauagaaagaggu

SEQ ID NO: 86594 - RNA, 22 nt, Human
caaaaauacuugccuguaucug

SEQ ID NO: 86595 - RNA, 22 nt, Human
auuuuuuuggucauaugagaua

SEQ ID NO: 86596 - RNA, 22 nt, Human
auuuuucucucaugugcaacua

SEQ ID NO: 86597 - RNA, 23 nt, Human
auuuuuccacacacagacucagu

SEQ ID NO: 86598 - RNA, 22 nt, Human
caacaaguugauuucacgcugc

SEQ ID NO: 86599 - RNA, 22 nt, Human
caagagcgugugcagggcaagu

SEQ ID NO: 86600 - RNA, 22 nt, Human
caagaaaaaacaugaugagugu

SEQ ID NO: 86601 - RNA, 22 nt, Human
caagaaguugacagccagguga

SEQ ID NO: 86602 - RNA, 19 nt, Human
caagagcaaagucuuauga

SEQ ID NO: 86603 - RNA, 22 nt, Human
cacagaauuaagggagaaauau

SEQ ID NO: 86604 - RNA, 22 nt, Human
cacauuaagcccaagcauagaa

SEQ ID NO: 86605 - RNA, 22 nt, Human
caagcacaauuucuacauguua

SEQ ID NO: 86606 - RNA, 22 nt, Human
caagagcuuuagaaaugcucau

SEQ ID NO: 86607 - RNA, 22 nt, Human
cacaucaaacuuacuaagauuu

SEQ ID NO: 86608 - RNA, 22 nt, Human
cacauuuuccagaagaaucaga

SEQ ID NO: 86609 - RNA, 22 nt, Human
caaggaguuuggggaccaagga

SEQ ID NO: 86610 - RNA, 22 nt, Human
caccaaaauaucccuuuguaca

SEQ ID NO: 86611 - RNA, 22 nt, Human
caaggaaaugucagaaaggcaa

SEQ ID NO: 86612 - RNA, 22 nt, Human
caaggucagacagccaggacag

SEQ ID NO: 86613 - RNA, 22 nt, Human
caauagcuauguaaccugaaga

SEQ ID NO: 86614 - RNA, 22 nt, Human
caagugaguauguauuguguag

SEQ ID NO: 86615 - RNA, 20 nt, Human
caccggguugcugguuucuu

SEQ ID NO: 86616 - RNA, 22 nt, Human
caauggguuuucuauagagugc

SEQ ID NO: 86617 - RNA, 22 nt, Human
caaaucuguuaauuucaaguug

SEQ ID NO: 86618 - RNA, 22 nt, Human
caaaucagaucagagacaggcu

SEQ ID NO: 86619 - RNA, 22 nt, Human
caaaugaugcauggcuagugag

SEQ ID NO: 86620 - RNA, 22 nt, Human
caaauguuugguggcauuuugu

SEQ ID NO: 86621 - RNA, 22 nt, Human
caaauacaaauacgggcagcuu

SEQ ID NO: 86622 - RNA, 22 nt, Human
caaauacguuuggcuggagcac

SEQ ID NO: 86623 - RNA, 22 nt, Human
caacaagcgcucagagcaaagc

SEQ ID NO: 86624 - RNA, 22 nt, Human
caaccucuaucggucaggaagc

SEQ ID NO: 86625 - RNA, 22 nt, Human
caaggaaaacagaugaucaaca

SEQ ID NO: 86626 - RNA, 22 nt, Human
caagauauguccuguuacuaag

SEQ ID NO: 86627 - RNA, 22 nt, Human
caauaauugcuuuccagaguua

SEQ ID NO: 86628 - RNA, 22 nt, Human
caaagcuucaucuguuguuuug

SEQ ID NO: 86629 - RNA, 22 nt, Human
caaaggaaagagaaaaagucuu

SEQ ID NO: 86630 - RNA, 22 nt, Human
caaaggaauuacauguuucgga

SEQ ID NO: 86631 - RNA, 22 nt, Human
caaggggagcugguauggaugg

SEQ ID NO: 86632 - RNA, 22 nt, Human
caaguaugagaaagcuauuacc

SEQ ID NO: 86633 - RNA, 22 nt, Human
augugagcuggaugaauuuaua

SEQ ID NO: 86634 - RNA, 20 nt, Human
augucaggaagggagucagg

SEQ ID NO: 86635 - RNA, 22 nt, Human
augguuuuguccucuuugguuc

SEQ ID NO: 86636 - RNA, 22 nt, Human
auggcuguguuguuccucugaa

SEQ ID NO: 86637 - RNA, 20 nt, Human
auggcgagucagcacaaaac

SEQ ID NO: 86638 - RNA, 22 nt, Human
auguguuuugaccccugcuaaa

SEQ ID NO: 86639 - RNA, 22 nt, Human
auguguuuccaacagagaggga

SEQ ID NO: 86640 - RNA, 22 nt, Human
auguuccuuuaaaauauagauu

SEQ ID NO: 86641 - RNA, 22 nt, Human
auguuccuuaaugugcuuguag

SEQ ID NO: 86642 - RNA, 22 nt, Human
augugggugaggaggccauugu

SEQ ID NO: 86643 - RNA, 22 nt, Human
augguugugaaagagcaaagac

SEQ ID NO: 86644 - RNA, 22 nt, Human
augguuuugugaaaaugcuuug

SEQ ID NO: 86645 - RNA, 22 nt, Human
auguuagcaucuggcacuaugg

SEQ ID NO: 86646 - RNA, 22 nt, Human
auguccugguccacagaaggga

SEQ ID NO: 86647 - RNA, 22 nt, Human
auguauuuauguauguguuaua

SEQ ID NO: 86648 - RNA, 22 nt, Human
auuaaguuauuaagcuaaauau

SEQ ID NO: 86649 - RNA, 22 nt, Human
auucauuuuuacaucaccaaua

SEQ ID NO: 86650 - RNA, 22 nt, Human
auucaagauagaaggauuuuca

SEQ ID NO: 86651 - RNA, 22 nt, Human
auuaaaaaugagaguagggauu

SEQ ID NO: 86652 - RNA, 21 nt, Human
auucaaagaagaggaaggccc

SEQ ID NO: 86653 - RNA, 22 nt, Human
auuaaacuaaauuaugaauugg

SEQ ID NO: 86654 - RNA, 22 nt, Human
auuaacaggcucuguucuaguu

SEQ ID NO: 86655 - RNA, 21 nt, Human
auuaagacaauggcaaugggu

SEQ ID NO: 86656 - RNA, 22 nt, Human
auuaaagcuaguugagauuuaa

SEQ ID NO: 86657 - RNA, 22 nt, Human
auuauucaaggugaggguaaaa

SEQ ID NO: 86658 - RNA, 22 nt, Human
auuauucuuugggaaaguugaa

SEQ ID NO: 86659 - RNA, 20 nt, Human
auuauuucuucugcccaaag

SEQ ID NO: 86660 - RNA, 22 nt, Human
auuauugcaagcagugaaggga

SEQ ID NO: 86661 - RNA, 22 nt, Human
auuacagauuauaaauuugagc

SEQ ID NO: 86662 - RNA, 22 nt, Human
auuacugaggcaaaguaguuuu

SEQ ID NO: 86663 - RNA, 22 nt, Human
auuacagaagauaugcucaaca

SEQ ID NO: 86664 - RNA, 22 nt, Human
auuaauaucaauauauuauaug

SEQ ID NO: 86665 - RNA, 22 nt, Human
auuaagucugacuggauuguau

SEQ ID NO: 86666 - RNA, 18 nt, Human
auguuccugcaguuauuu

SEQ ID NO: 86667 - RNA, 22 nt, Human
auguuuucuugucuggagaagu

SEQ ID NO: 86668 - RNA, 22 nt, Human
auguuuuaaaaaacaggcuacc

SEQ ID NO: 86669 - RNA, 22 nt, Human
auguuuuauacacauguaucac

SEQ ID NO: 86670 - RNA, 22 nt, Human
auuauacauuaggagauugauu

SEQ ID NO: 86671 - RNA, 22 nt, Human
auuaaaaaaagauaaugaguua

SEQ ID NO: 86672 - RNA, 22 nt, Human
auuaugaauuguguuacgaaga

SEQ ID NO: 86673 - RNA, 22 nt, Human
auuaucugacugaguagucugu

SEQ ID NO: 86674 - RNA, 22 nt, Human
augaugauuauucauuuucugu

SEQ ID NO: 86675 - RNA, 22 nt, Human
augaugaugguuuaacuucagg

SEQ ID NO: 86676 - RNA, 22 nt, Human
augaucacagugucagucauua

SEQ ID NO: 86677 - RNA, 22 nt, Human
augcagcggucagaggaacuca

SEQ ID NO: 86678 - RNA, 22 nt, Human
augccucuugagagccagugcu

SEQ ID NO: 86679 - RNA, 22 nt, Human
augcagaaucucuuuccugagg

SEQ ID NO: 86680 - RNA, 22 nt, Human
augcgcugugcacacucuuaac

SEQ ID NO: 86681 - RNA, 22 nt, Human
augcacuacuagaugcaaaagu

SEQ ID NO: 86682 - RNA, 22 nt, Human
augcucuuaauugcuagauaag

SEQ ID NO: 86683 - RNA, 22 nt, Human
augcuacauuuugguuuauaaa

SEQ ID NO: 86684 - RNA, 22 nt, Human
augcugccuaaagcuacuuaca

SEQ ID NO: 86685 - RNA, 22 nt, Human
augcugccuccucuucagccgc

SEQ ID NO: 86686 - RNA, 22 nt, Human
augcuugcccauguuucugaag

SEQ ID NO: 86687 - RNA, 22 nt, Human
augcuaaucaaacuuucugcag

SEQ ID NO: 86688 - RNA, 18 nt, Human
augcugacacaaugugga

SEQ ID NO: 86689 - RNA, 22 nt, Human
augcugcuuguccauuuauuug

SEQ ID NO: 86690 - RNA, 22 nt, Human
aucucaaagauaugcugguaaa

SEQ ID NO: 86691 - RNA, 22 nt, Human
augaaacucuagcuuucagcac

SEQ ID NO: 86692 - RNA, 22 nt, Human
aucuggaacuucucugcauuga

SEQ ID NO: 86693 - RNA, 23 nt, Human
augaaaugauacuuuauucacug

SEQ ID NO: 86694 - RNA, 22 nt, Human
augaaacuggagcgccuggagg

SEQ ID NO: 86695 - RNA, 22 nt, Human
augaaaacgugugugugugugu

SEQ ID NO: 86696 - RNA, 20 nt, Human
aucuuaucuaucuuuuguuc

SEQ ID NO: 86697 - RNA, 22 nt, Human
aucuucaaggacgccaagaucc

SEQ ID NO: 86698 - RNA, 20 nt, Human
aucugguggggaauaacuuc

SEQ ID NO: 86699 - RNA, 22 nt, Human
augagaaauaauuguguacuga

SEQ ID NO: 86700 - RNA, 22 nt, Human
aucuucucucucaucaggauca

SEQ ID NO: 86701 - RNA, 22 nt, Human
aucuucuuucaucagccccuca

SEQ ID NO: 86702 - RNA, 22 nt, Human
augaggaacagcaagaauauuu

SEQ ID NO: 86703 - RNA, 22 nt, Human
augaucaagaauuuuguauucc

SEQ ID NO: 86704 - RNA, 22 nt, Human
augauggagaacaaagaaaauc

SEQ ID NO: 86705 - RNA, 22 nt, Human
augaauuaucugguguuggaaa

SEQ ID NO: 86706 - RNA, 22 nt, Human
auauucaaugaggucauauaag

SEQ ID NO: 86707 - RNA, 22 nt, Human
aucaacacuguuggcggggacc

SEQ ID NO: 86708 - RNA, 20 nt, Human
aucaagugucuugccaggca

SEQ ID NO: 86709 - RNA, 22 nt, Human
auauuugucuguuuuaguggca

SEQ ID NO: 86710 - RNA, 22 nt, Human
aucaaaauuuucagauacuaca

SEQ ID NO: 86711 - RNA, 22 nt, Human
aucaaaauguguagucuugauc

SEQ ID NO: 86712 - RNA, 22 nt, Human
auauuuuacagcucucguugaa

SEQ ID NO: 86713 - RNA, 22 nt, Human
auauuuuugcagaauuuuucgu

SEQ ID NO: 86714 - RNA, 22 nt, Human
aucacaaauggaaucaccuccc

SEQ ID NO: 86715 - RNA, 22 nt, Human
auauuuguuuggcagaguucag

SEQ ID NO: 86716 - RNA, 22 nt, Human
auauuuguuagcugcuuuggag

SEQ ID NO: 86717 - RNA, 22 nt, Human
auauuugcccccaugcccuggc

SEQ ID NO: 86718 - RNA, 22 nt, Human
aucauaugugauaccauaauga

SEQ ID NO: 86719 - RNA, 22 nt, Human
aucauccuagaaggaagcuagg

SEQ ID NO: 86720 - RNA, 22 nt, Human
aucaaguuauuaaguagcuuuc

SEQ ID NO: 86721 - RNA, 22 nt, Human
aucaagacaaaggaaaggcuaa

SEQ ID NO: 86722 - RNA, 22 nt, Human
aucacugcaggcauauaggggu

SEQ ID NO: 86723 - RNA, 22 nt, Human
aucaaacuaugguccaugggca

SEQ ID NO: 86724 - RNA, 22 nt, Human
aucagagcuaguacuugcaggu

SEQ ID NO: 86725 - RNA, 22 nt, Human
aucaucuaaaauuggcucagau

SEQ ID NO: 86726 - RNA, 21 nt, Human
aucagaaucucuagauuugga

SEQ ID NO: 86727 - RNA, 22 nt, Human
aucacuagaguuacauugccag

SEQ ID NO: 86728 - RNA, 22 nt, Human
aucacacaccuguuaaauugug

SEQ ID NO: 86729 - RNA, 22 nt, Human
aucauuaacagugcagggguag

SEQ ID NO: 86730 - RNA, 22 nt, Human
aucagcucuugaugccuuucuu

SEQ ID NO: 86731 - RNA, 19 nt, Human
aucagcaguuuugccugga

SEQ ID NO: 86732 - RNA, 22 nt, Human
aucauuuggaaauuuggccuaa

SEQ ID NO: 86733 - RNA, 19 nt, Human
auccuugcucacucacuga

SEQ ID NO: 86734 - RNA, 22 nt, Human
auccuucaaaaggaauagcagg

SEQ ID NO: 86735 - RNA, 22 nt, Human
aucuaaaacuacgaauacuacc

SEQ ID NO: 86736 - RNA, 22 nt, Human
aucuacuuugggaguuucucuu

SEQ ID NO: 86737 - RNA, 19 nt, Human
auccucucuagaaguggga

SEQ ID NO: 86738 - RNA, 22 nt, Human
aucauuugaacagaauuuguuu

SEQ ID NO: 86739 - RNA, 22 nt, Human
auccucucuuaugaacaacugu

SEQ ID NO: 86740 - RNA, 22 nt, Human
auccucucugugacagggaacg

SEQ ID NO: 86741 - RNA, 22 nt, Human
auccucugcucaugagaaaugu

SEQ ID NO: 86742 - RNA, 22 nt, Human
aucauguauauuuuugcuauua

SEQ ID NO: 86743 - RNA, 20 nt, Human
aucaggagucgcggggagag

SEQ ID NO: 86744 - RNA, 22 nt, Human
agugaaauaugcccauugcugu

SEQ ID NO: 86745 - RNA, 22 nt, Human
agugaaaacugaaucaccuucc

SEQ ID NO: 86746 - RNA, 23 nt, Human
auacuuuuuuucuacguuaucuc

SEQ ID NO: 86747 - RNA, 22 nt, Human
agugagaguauuaaugugaacu

SEQ ID NO: 86748 - RNA, 21 nt, Human
auacaguucagcuuuuacuau

SEQ ID NO: 86749 - RNA, 22 nt, Human
auagaugacaguuaggaagcug

SEQ ID NO: 86750 - RNA, 22 nt, Human
auagaugaggaaauucaggugc

SEQ ID NO: 86751 - RNA, 22 nt, Human
auagauuuuaucagauuuuauc

SEQ ID NO: 86752 - RNA, 22 nt, Human
auacaugacucacacauucugc

SEQ ID NO: 86753 - RNA, 22 nt, Human
auaggacuuuguaucaggauga

SEQ ID NO: 86754 - RNA, 22 nt, Human
auaccuauagcagacugagacu

SEQ ID NO: 86755 - RNA, 22 nt, Human
auagaaauagacaaugcaaaga

SEQ ID NO: 86756 - RNA, 22 nt, Human
auagacuagccaaagacuucug

SEQ ID NO: 86757 - RNA, 22 nt, Human
auagaauggcaccagcaucuac

SEQ ID NO: 86758 - RNA, 22 nt, Human
auaguuaucuguggauaagguu

SEQ ID NO: 86759 - RNA, 22 nt, Human
auaggacuguacagaauacaag

SEQ ID NO: 86760 - RNA, 22 nt, Human
auauaaugugugcuuuauugaa

SEQ ID NO: 86761 - RNA, 22 nt, Human
auaugaagaaugaucugaagua

SEQ ID NO: 86762 - RNA, 22 nt, Human
auaguuuuagauacugagaaaa

SEQ ID NO: 86763 - RNA, 22 nt, Human
auauaacccaaggcaggcugug

SEQ ID NO: 86764 - RNA, 22 nt, Human
auaguaaauguuaacagcaaca

SEQ ID NO: 86765 - RNA, 22 nt, Human
auaugagaggaggagcaucagu

SEQ ID NO: 86766 - RNA, 22 nt, Human
auauuucuacaggcugauuuua

SEQ ID NO: 86767 - RNA, 23 nt, Human
auaugucaugcaccagcacuuua

SEQ ID NO: 86768 - RNA, 22 nt, Human
auauuuguacagcuugugaguu

SEQ ID NO: 86769 - RNA, 22 nt, Human
auaucuaggcugaauguaaaau

SEQ ID NO: 86770 - RNA, 22 nt, Human
auauguuaugccauuuucaagg

SEQ ID NO: 86771 - RNA, 22 nt, Human
auauuauuaaaauagauggaua

SEQ ID NO: 86772 - RNA, 21 nt, Human
auauugguaucuuuuuaaauc

SEQ ID NO: 86773 - RNA, 22 nt, Human
auauugcuuuauucuugaauau

SEQ ID NO: 86774 - RNA, 22 nt, Human
uuuuuuuuacuccggacagcuc

SEQ ID NO: 86775 - RNA, 18 nt, Human
uuuuuuguucuguuuugu

SEQ ID NO: 86776 - RNA, 22 nt, Human
uuuuuuuagaaagaucauaguu

SEQ ID NO: 86777 - RNA, 22 nt, Human
uuuuuuuaaguuuugauuuuag

SEQ ID NO: 86778 - RNA, 22 nt, Human
uuuuuugucuugaagaaauggu

SEQ ID NO: 86779 - RNA, 22 nt, Human
uuuuuuccugguuacagauugu

SEQ ID NO: 86780 - RNA, 22 nt, Human
uuuuugggccaaauauauuuac

SEQ ID NO: 86781 - RNA, 22 nt, Human
uuuuuuaaucaaguaggaaaca

SEQ ID NO: 86782 - RNA, 20 nt, Human
uuuuuuaaauagagcuguug

SEQ ID NO: 86783 - RNA, 22 nt, Human
uuuuuguauaugcuucgaggau

SEQ ID NO: 86784 - RNA, 22 nt, Human
uuuuugggaagaauucugauau

SEQ ID NO: 86785 - RNA, 21 nt, Human
uuuuuggagggguggggagga

SEQ ID NO: 86786 - RNA, 22 nt, Human
uuuuugcccuaaagaagucauu

SEQ ID NO: 86787 - RNA, 22 nt, Human
uuuuucuccucucucuuucauu

SEQ ID NO: 86788 - RNA, 22 nt, Human
uuuuucugacugcuaacaaaaa

SEQ ID NO: 86789 - RNA, 22 nt, Human
uuuuugaauaagugcaucauca

SEQ ID NO: 86790 - RNA, 22 nt, Human
uuuuuauaagauuuaaaaugua

SEQ ID NO: 86791 - RNA, 22 nt, Human
uuuuucacacuccuuuccaguu

SEQ ID NO: 86792 - RNA, 22 nt, Human
uuuuuauguaaaauauuaaaag

SEQ ID NO: 86793 - RNA, 22 nt, Human
uuuuguagauuggaaaaucugg

SEQ ID NO: 86794 - RNA, 22 nt, Human
uuuuuaagguuuguuuauauau

SEQ ID NO: 86795 - RNA, 22 nt, Human
uuuuuaauuuuaagcuauuugu

SEQ ID NO: 86796 - RNA, 22 nt, Human
uuuuuagcauaugucaaaucag

SEQ ID NO: 86797 - RNA, 22 nt, Human
uuuuguuacugauuauuaaaau

SEQ ID NO: 86798 - RNA, 22 nt, Human
uuuugcuucuaguauauuuuuu

SEQ ID NO: 86799 - RNA, 18 nt, Human
uuuuguguuuauucugca

SEQ ID NO: 86800 - RNA, 20 nt, Human
uuuuguccaccugcaggaag

SEQ ID NO: 86801 - RNA, 22 nt, Human
uuuugucagggcaggaggaaga

SEQ ID NO: 86802 - RNA, 22 nt, Human
uuuugcuagaaaucaccaauac

SEQ ID NO: 86803 - RNA, 22 nt, Human
uuuugcaaauuacuaaauuucu

SEQ ID NO: 86804 - RNA, 22 nt, Human
uuuucuguuuaugaaauugugu

SEQ ID NO: 86805 - RNA, 22 nt, Human
uuuuccuguccuugggucugca

SEQ ID NO: 86806 - RNA, 22 nt, Human
uuuucauagccagaaacugaaa

SEQ ID NO: 86807 - RNA, 22 nt, Human
uuuuccaaaaguggagaggaau

SEQ ID NO: 86808 - RNA, 22 nt, Human
uuuucuacaaucacucuggaag

SEQ ID NO: 86809 - RNA, 22 nt, Human
uuuucucacugagagccuugau

SEQ ID NO: 86810 - RNA, 22 nt, Human
uuuucucaguuuuuuucaaaag

SEQ ID NO: 86811 - RNA, 22 nt, Human
uuuucggagaauguuaaugugu

SEQ ID NO: 86812 - RNA, 22 nt, Human
uuuucggggcgacuuagguucu

SEQ ID NO: 86813 - RNA, 22 nt, Human
uuuguuuuggugucaugcguga

SEQ ID NO: 86814 - RNA, 22 nt, Human
uuuguuugcugagugaauucaa

SEQ ID NO: 86815 - RNA, 22 nt, Human
uuuguuugcuaguauuuuguuu

SEQ ID NO: 86816 - RNA, 22 nt, Human
uuuguugucuucauaauacuuu

SEQ ID NO: 86817 - RNA, 22 nt, Human
uuuguuuccagccuuuugucuu

SEQ ID NO: 86818 - RNA, 22 nt, Human
uuuguucuagauaacugguaau

SEQ ID NO: 86819 - RNA, 19 nt, Human
uuuguuguaucagagcuuu

SEQ ID NO: 86820 - RNA, 22 nt, Human
uuuguugguugcacuggugggu

SEQ ID NO: 86821 - RNA, 22 nt, Human
uuuguugaauggcaggauuuua

SEQ ID NO: 86822 - RNA, 22 nt, Human
uuuacuuguuuugcucuuuucc

SEQ ID NO: 86823 - RNA, 19 nt, Human
uuuaaugugugcugcaauc

SEQ ID NO: 86824 - RNA, 22 nt, Human
uuuguuaugguuggaagcagga

SEQ ID NO: 86825 - RNA, 22 nt, Human
uuuuauguuccugaagcuaucu

SEQ ID NO: 86826 - RNA, 22 nt, Human
uuuucaauuuucauuugcaaga

SEQ ID NO: 86827 - RNA, 22 nt, Human
uuuucaaucaaguuuauuuaua

SEQ ID NO: 86828 - RNA, 22 nt, Human
uuuucacugacuuggucuggaa

SEQ ID NO: 86829 - RNA, 22 nt, Human
uuuuaucagagcuugcagugug

SEQ ID NO: 86830 - RNA, 22 nt, Human
uuuuaguaauacuuuggccuuu

SEQ ID NO: 86831 - RNA, 22 nt, Human
uuuuagaagcauuuaugagauu

SEQ ID NO: 86832 - RNA, 22 nt, Human
uuuuacuuuucccacuuacagc

SEQ ID NO: 86833 - RNA, 22 nt, Human
uuuuacauuuuauucguuuauu

SEQ ID NO: 86834 - RNA, 23 nt, Human
uuuuacaagagugcauuugucuc

SEQ ID NO: 86835 - RNA, 22 nt, Human
uuuuaaucagguauuugaguau

SEQ ID NO: 86836 - RNA, 23 nt, Human
uuuuaauaguaugacaugagcug

SEQ ID NO: 86837 - RNA, 22 nt, Human
uuuuaauucaacauuugcuuuu

SEQ ID NO: 86838 - RNA, 22 nt, Human
uuuuaauccucuugguaucuua

SEQ ID NO: 86839 - RNA, 22 nt, Human
uuuuaaauggcuuuuacuuuuc

SEQ ID NO: 86840 - RNA, 22 nt, Human
uuuuaaguauuuucuuuuuuua

SEQ ID NO: 86841 - RNA, 22 nt, Human
uuuuaauaguauaucuagacac

SEQ ID NO: 86842 - RNA, 22 nt, Human
uuuuaaaagguugcuguuauaa

SEQ ID NO: 86843 - RNA, 22 nt, Human
uuuuaaauaaacuacacugauu

SEQ ID NO: 86844 - RNA, 22 nt, Human
uucucuauuugcugcaccucuc

SEQ ID NO: 86845 - RNA, 22 nt, Human
uucucaauggcaacuuguugcu

SEQ ID NO: 86846 - RNA, 22 nt, Human
uucuaagaaauggaaaacgauu

SEQ ID NO: 86847 - RNA, 22 nt, Human
uucuagauagucugauauuccu

SEQ ID NO: 86848 - RNA, 22 nt, Human
uucuagccauagaaauuagauu

SEQ ID NO: 86849 - RNA, 22 nt, Human
uuuuauuuguauguugaaugua

SEQ ID NO: 86850 - RNA, 19 nt, Human
uuuucaacguccgguucau

SEQ ID NO: 86851 - RNA, 22 nt, Human
uuuucaacuuuauuuuccccca

SEQ ID NO: 86852 - RNA, 22 nt, Human
uucguucagcgcuugcgcaugc

SEQ ID NO: 86853 - RNA, 20 nt, Human
uucguuucaguguuggauca

SEQ ID NO: 86854 - RNA, 22 nt, Human
uucuaauauuaugauuucuaag

SEQ ID NO: 86855 - RNA, 22 nt, Human
uuuuauaaaaccuguuugaccu

SEQ ID NO: 86856 - RNA, 22 nt, Human
uucugaugccuggguugcuucu

SEQ ID NO: 86857 - RNA, 22 nt, Human
uucugcauaggcuauauuuguu

SEQ ID NO: 86858 - RNA, 22 nt, Human
uuuuggagaaaugggacuuaau

SEQ ID NO: 86859 - RNA, 20 nt, Human
uucuguggcccguuuaagug

SEQ ID NO: 86860 - RNA, 22 nt, Human
uucuggucucucugaccuagga

SEQ ID NO: 86861 - RNA, 22 nt, Human
uuuugaugaccauucuucuuuu

SEQ ID NO: 86862 - RNA, 23 nt, Human
uucugcuucccauagcacuuugu

SEQ ID NO: 86863 - RNA, 22 nt, Human
uugaggcugaucacuccuauaa

SEQ ID NO: 86864 - RNA, 22 nt, Human
uuuuuuuguagguguaugaaaa

SEQ ID NO: 86865 - RNA, 22 nt, Human
uugaauggaauuggaaucuuau

SEQ ID NO: 86866 - RNA, 22 nt, Human
uugaaccaggauaaacauagaa

SEQ ID NO: 86867 - RNA, 22 nt, Human
uuuuuuccuguuugucuuuggg

SEQ ID NO: 86868 - RNA, 22 nt, Human
uuuuuucuggaguuugggguuu

SEQ ID NO: 86869 - RNA, 22 nt, Human
uuuuuucuucucuaucuuaaua

SEQ ID NO: 86870 - RNA, 22 nt, Human
uugaaaaguuuguuacucacau

SEQ ID NO: 86871 - RNA, 22 nt, Human
uuuuuguuauuuagguguagag

SEQ ID NO: 86872 - RNA, 21 nt, Human
uuuuucuccagaguuuccacu

SEQ ID NO: 86873 - RNA, 19 nt, Human
uucuuuccccaccccuacc

SEQ ID NO: 86874 - RNA, 22 nt, Human
uuuuuauaagagcagcagaguu

SEQ ID NO: 86875 - RNA, 22 nt, Human
uuuuuagcuguuauuguggaag

SEQ ID NO: 86876 - RNA, 22 nt, Human
uuuuuaccugguguccagcuuc

SEQ ID NO: 86877 - RNA, 22 nt, Human
uucuguucugcuuucuccaucc

SEQ ID NO: 86878 - RNA, 22 nt, Human
uuuuguagauagggaaacagag

SEQ ID NO: 86879 - RNA, 22 nt, Human
uucuuauuuuucguaaauccug

SEQ ID NO: 86880 - RNA, 22 nt, Human
uuuuuaaaagaugauuuaauga

SEQ ID NO: 86881 - RNA, 22 nt, Human
uuuuguuuacauuaaauuuuga

SEQ ID NO: 86882 - RNA, 22 nt, Human
uuguuuucuugaugaaauuauu

SEQ ID NO: 86883 - RNA, 23 nt, Human
uuuaaacaauguggucguggugg

SEQ ID NO: 86884 - RNA, 22 nt, Human
uuuaaaauguuuuauuuauuua

SEQ ID NO: 86885 - RNA, 22 nt, Human
uuguuuguaaggcucuuagaau

SEQ ID NO: 86886 - RNA, 21 nt, Human
uugugaaaguccaggaacaac

SEQ ID NO: 86887 - RNA, 22 nt, Human
uuguuuacuugagcugcacucu

SEQ ID NO: 86888 - RNA, 22 nt, Human
uuguuucauggggacgacuggc

SEQ ID NO: 86889 - RNA, 22 nt, Human
uuuaaauuucugaaucuugagg

SEQ ID NO: 86890 - RNA, 22 nt, Human
uuuaacauaugaaagaauauuu

SEQ ID NO: 86891 - RNA, 22 nt, Human
uuuaagguacagcuagcagcau

SEQ ID NO: 86892 - RNA, 22 nt, Human
uuuaaagucaggcuguaguggu

SEQ ID NO: 86893 - RNA, 22 nt, Human
uuuaaaccuuggaagccacaua

SEQ ID NO: 86894 - RNA, 22 nt, Human
uuuaaugaugucuaugccuguu

SEQ ID NO: 86895 - RNA, 22 nt, Human
uuuaaugguuuauggucuaaga

SEQ ID NO: 86896 - RNA, 22 nt, Human
uuuaaucaauaaccuccugggu

SEQ ID NO: 86897 - RNA, 22 nt, Human
uuuaauauuacacuuaccuugu

SEQ ID NO: 86898 - RNA, 22 nt, Human
uuuaauauucucuuugaaggaa

SEQ ID NO: 86899 - RNA, 18 nt, Human
uuuaauaagccuguuaug

SEQ ID NO: 86900 - RNA, 22 nt, Human
uugucucuacagagaguaguag

SEQ ID NO: 86901 - RNA, 19 nt, Human
uugucuuagcugcauaaga

SEQ ID NO: 86902 - RNA, 22 nt, Human
uuggugauguagcagcaauugu

SEQ ID NO: 86903 - RNA, 22 nt, Human
uuggugaugcuaggaauguagu

SEQ ID NO: 86904 - RNA, 22 nt, Human
uuggugaugcccaccuuuucau

SEQ ID NO: 86905 - RNA, 19 nt, Human
uuggugaagguucacugac

SEQ ID NO: 86906 - RNA, 22 nt, Human
uuggcagagaacagaaugauuu

SEQ ID NO: 86907 - RNA, 22 nt, Human
uuggcaggcugcauguuuaugu

SEQ ID NO: 86908 - RNA, 22 nt, Human
uuggcaaaaauacuguaggccu

SEQ ID NO: 86909 - RNA, 22 nt, Human
uuggcaaagagaugcauaagga

SEQ ID NO: 86910 - RNA, 22 nt, Human
uugguauuuguuuaaauuacac

SEQ ID NO: 86911 - RNA, 22 nt, Human
uuggguaacuucccagaggguc

SEQ ID NO: 86912 - RNA, 22 nt, Human
uuggggcugcguguuuccaugu

SEQ ID NO: 86913 - RNA, 22 nt, Human
uugcugccagcgcccugcaggg

SEQ ID NO: 86914 - RNA, 22 nt, Human
uugcuuucuuuguagguuuucc

SEQ ID NO: 86915 - RNA, 22 nt, Human
uugcuugcggccuuugugccuu

SEQ ID NO: 86916 - RNA, 22 nt, Human
uugcuuaggccaaauggcgcau

SEQ ID NO: 86917 - RNA, 22 nt, Human
uugcuugaacccaggaagugga

SEQ ID NO: 86918 - RNA, 22 nt, Human
uugcugguggcucugauuucau

SEQ ID NO: 86919 - RNA, 19 nt, Human
uuggacuaugaaaaaucag

SEQ ID NO: 86920 - RNA, 23 nt, Human
uugcuuuugccccaaaagaguua

SEQ ID NO: 86921 - RNA, 22 nt, Human
uuggaaauguagaaaagcagau

SEQ ID NO: 86922 - RNA, 22 nt, Human
uuggaaaugcauuuguuauuau

SEQ ID NO: 86923 - RNA, 22 nt, Human
uuggaagacagccgucuuuauu

SEQ ID NO: 86924 - RNA, 22 nt, Human
uugcaagauaguguauuuuuca

SEQ ID NO: 86925 - RNA, 22 nt, Human
uugaguuuacauuguauuagcc

SEQ ID NO: 86926 - RNA, 22 nt, Human
uugcaucagcaggcauaauugg

SEQ ID NO: 86927 - RNA, 22 nt, Human
uugcaugauuuaagaauaucug

SEQ ID NO: 86928 - RNA, 22 nt, Human
uugcaugugugaaaugcacaga

SEQ ID NO: 86929 - RNA, 22 nt, Human
uugcagagaacuaaagggagua

SEQ ID NO: 86930 - RNA, 20 nt, Human
uugcucucuuguguugaugu

SEQ ID NO: 86931 - RNA, 22 nt, Human
uugcucaugucaccaaagcaca

SEQ ID NO: 86932 - RNA, 22 nt, Human
uugcguaauuugagauuguaaa

SEQ ID NO: 86933 - RNA, 22 nt, Human
uugccucuaauuagcucuguga

SEQ ID NO: 86934 - RNA, 22 nt, Human
uugccuagugguagugacuguu

SEQ ID NO: 86935 - RNA, 22 nt, Human
uuugguguuuucaggaauauac

SEQ ID NO: 86936 - RNA, 23 nt, Human
uuugucaucccucucacuuucug

SEQ ID NO: 86937 - RNA, 22 nt, Human
uuccaaaugacaaugggcugua

SEQ ID NO: 86938 - RNA, 22 nt, Human
uucauuuuauauuagagcuguu

SEQ ID NO: 86939 - RNA, 22 nt, Human
uuuguggaaaagagcccaggag

SEQ ID NO: 86940 - RNA, 22 nt, Human
uuugucaucuuccauauuugca

SEQ ID NO: 86941 - RNA, 22 nt, Human
uuuguccuguuggcaugaaaau

SEQ ID NO: 86942 - RNA, 22 nt, Human
uucccugggggggccgcuuucc

SEQ ID NO: 86943 - RNA, 22 nt, Human
uuuguguuuugaggucuugcaa

SEQ ID NO: 86944 - RNA, 22 nt, Human
uuccccaugugaugcuauugcu

SEQ ID NO: 86945 - RNA, 22 nt, Human
uuugggcuuuguuuuaagguau

SEQ ID NO: 86946 - RNA, 22 nt, Human
uuugauuuuguuuauagugccg

SEQ ID NO: 86947 - RNA, 22 nt, Human
uucagaccucaaauccacaugc

SEQ ID NO: 86948 - RNA, 22 nt, Human
uucagacugcccauguuugcca

SEQ ID NO: 86949 - RNA, 22 nt, Human
uucagguuuuuaaguucugccu

SEQ ID NO: 86950 - RNA, 22 nt, Human
uuuggccauuuguaugcaugau

SEQ ID NO: 86951 - RNA, 22 nt, Human
uucagguacuaagugcugauuc

SEQ ID NO: 86952 - RNA, 22 nt, Human
uuugagugccucgaguguggga

SEQ ID NO: 86953 - RNA, 22 nt, Human
uucaacaacuugguucaaaugg

SEQ ID NO: 86954 - RNA, 22 nt, Human
uucaaaccuaucuaagaaauag

SEQ ID NO: 86955 - RNA, 22 nt, Human
uucaacacaaguugugcaguaa

SEQ ID NO: 86956 - RNA, 22 nt, Human
uuugagaagauaggggaauacu

SEQ ID NO: 86957 - RNA, 23 nt, Human
uuugaaucauuguggggcuuuug

SEQ ID NO: 86958 - RNA, 18 nt, Human
uuucuuuuauuccagguc

SEQ ID NO: 86959 - RNA, 22 nt, Human
uuucuuuuucuacaccuuagcu

SEQ ID NO: 86960 - RNA, 22 nt, Human
uuauuuuuguaacacuguauag

SEQ ID NO: 86961 - RNA, 22 nt, Human
uuucuuugggcccuggcagucu

SEQ ID NO: 86962 - RNA, 22 nt, Human
uuauuuuuaggaauguagaggu

SEQ ID NO: 86963 - RNA, 22 nt, Human
uuauuuucgugugugugugugu

SEQ ID NO: 86964 - RNA, 22 nt, Human
uuugaaaggagcuuuauccaga

SEQ ID NO: 86965 - RNA, 22 nt, Human
uucaaacaguguagaauauaug

SEQ ID NO: 86966 - RNA, 22 nt, Human
uucaaacacugugcaauugggu

SEQ ID NO: 86967 - RNA, 22 nt, Human
uuauuuaagaucuuaauauaua

SEQ ID NO: 86968 - RNA, 22 nt, Human
uuauuuaaaauguagguuggga

SEQ ID NO: 86969 - RNA, 22 nt, Human
uuauuucauguaaaauuuaugu

SEQ ID NO: 86970 - RNA, 22 nt, Human
uuauuucuucucgaagcuuggg

SEQ ID NO: 86971 - RNA, 22 nt, Human
uuucugaugaaguagaaagacc

SEQ ID NO: 86972 - RNA, 22 nt, Human
uuucucuuguauuugaaucacu

SEQ ID NO: 86973 - RNA, 22 nt, Human
uuucugagccacauauaauuug

SEQ ID NO: 86974 - RNA, 22 nt, Human
uuauuuuauaaagagaagacuu

SEQ ID NO: 86975 - RNA, 22 nt, Human
uuucuuccuucuugaucauuug

SEQ ID NO: 86976 - RNA, 22 nt, Human
uuucuuccaucuggcuuuauuu

SEQ ID NO: 86977 - RNA, 22 nt, Human
uuucuuaaaagcuuuuaaaguu

SEQ ID NO: 86978 - RNA, 22 nt, Human
uuuauugaccugaguaucagca

SEQ ID NO: 86979 - RNA, 22 nt, Human
uuuauugcuaugucuugauugu

SEQ ID NO: 86980 - RNA, 22 nt, Human
uuuauuuacuuucgguucugcu

SEQ ID NO: 86981 - RNA, 22 nt, Human
uuaguuauaggugaaucagaga

SEQ ID NO: 86982 - RNA, 22 nt, Human
uuuauuuagguaaacaugaguu

SEQ ID NO: 86983 - RNA, 22 nt, Human
uuucaagccucacugcguuuug

SEQ ID NO: 86984 - RNA, 22 nt, Human
uuauaaaccgcuaacagcacuu

SEQ ID NO: 86985 - RNA, 22 nt, Human
uuuauuugugguaguguaaucu

SEQ ID NO: 86986 - RNA, 22 nt, Human
uuucacagcgucuuucucuugc

SEQ ID NO: 86987 - RNA, 22 nt, Human
uuucaaguagagggaucgcuag

SEQ ID NO: 86988 - RNA, 22 nt, Human
uuuauauauauguaggagcaca

SEQ ID NO: 86989 - RNA, 22 nt, Human
uuuaucaucuucugaauuugga

SEQ ID NO: 86990 - RNA, 22 nt, Human
uuagagauuuuauguuaaugua

SEQ ID NO: 86991 - RNA, 22 nt, Human
uuuaggauaacuccaguuuucc

SEQ ID NO: 86992 - RNA, 22 nt, Human
uuaccgagaacaugacuggaau

SEQ ID NO: 86993 - RNA, 22 nt, Human
uuacccuugaauuugugacaaa

SEQ ID NO: 86994 - RNA, 22 nt, Human
uuuacuguuuacagcuaaugca

SEQ ID NO: 86995 - RNA, 22 nt, Human
uuuacucagucugagcaggugu

SEQ ID NO: 86996 - RNA, 22 nt, Human
uguuuccuguaccacagguuuu

SEQ ID NO: 86997 - RNA, 21 nt, Human
uguuugcuuuuggagcaacug

SEQ ID NO: 86998 - RNA, 23 nt, Human
uguuugggcuaucuuuuguucuc

SEQ ID NO: 86999 - RNA, 22 nt, Human
uguuugaggugacucuggaaug

SEQ ID NO: 87000 - RNA, 19 nt, Human
uuuacuuaggccacagaau

SEQ ID NO: 87001 - RNA, 22 nt, Human
uuacucucugaggcacucaaaa

SEQ ID NO: 87002 - RNA, 20 nt, Human
uuacugagguauuuuuauca

SEQ ID NO: 87003 - RNA, 19 nt, Human
uuuagcuacugugguauua

SEQ ID NO: 87004 - RNA, 22 nt, Human
uuuaggaauuugcugggcauga

SEQ ID NO: 87005 - RNA, 22 nt, Human
uuaucugcccauuguagaauug

SEQ ID NO: 87006 - RNA, 19 nt, Human
uuauccggacuuaauuuau

SEQ ID NO: 87007 - RNA, 22 nt, Human
uuaugcaaaggggccucuuccu

SEQ ID NO: 87008 - RNA, 22 nt, Human
uuaucuguuuuaaugaauaauu

SEQ ID NO: 87009 - RNA, 21 nt, Human
uuucauuaguacaucaauuug

SEQ ID NO: 87010 - RNA, 22 nt, Human
uuucauguuggauacuguuuca

SEQ ID NO: 87011 - RNA, 22 nt, Human
uuaucaaaaaauaguacuuuga

SEQ ID NO: 87012 - RNA, 22 nt, Human
uuauaagugccucuuuauuuuc

SEQ ID NO: 87013 - RNA, 22 nt, Human
uuaguuagucuaugccugacca

SEQ ID NO: 87014 - RNA, 18 nt, Human
uuauacaauuuuuuuuca

SEQ ID NO: 87015 - RNA, 22 nt, Human
uuauaucagaaggugagauuga

SEQ ID NO: 87016 - RNA, 22 nt, Human
uuucagaaauggcacugaaauc

SEQ ID NO: 87017 - RNA, 22 nt, Human
uuucauagaggcagcggcggau

SEQ ID NO: 87018 - RNA, 22 nt, Human
uuucagguggaaguuuuagaug

SEQ ID NO: 87019 - RNA, 22 nt, Human
uuauuggcagcuccugcacaug

SEQ ID NO: 87020 - RNA, 22 nt, Human
uuauucuuagccucgguauuuc

SEQ ID NO: 87021 - RNA, 22 nt, Human
uuuccuuaauuguaaaauggag

SEQ ID NO: 87022 - RNA, 22 nt, Human
uuuccuaggaaaugauugaagu

SEQ ID NO: 87023 - RNA, 18 nt, Human
uuuccucauuugcagacu

SEQ ID NO: 87024 - RNA, 22 nt, Human
uuuccaguuguucuagaaagcu

SEQ ID NO: 87025 - RNA, 22 nt, Human
uuucuacauuuguaaccagauu

SEQ ID NO: 87026 - RNA, 22 nt, Human
uuucuauuuacagugcuaggua

SEQ ID NO: 87027 - RNA, 19 nt, Human
uuucucacugagucguuug

SEQ ID NO: 87028 - RNA, 22 nt, Human
uuauuguagcacuuuggcagug

SEQ ID NO: 87029 - RNA, 22 nt, Human
uuuccuuuguuuugguauaugu

SEQ ID NO: 87030 - RNA, 22 nt, Human
uuucuaaaauuacugcagucgg

SEQ ID NO: 87031 - RNA, 22 nt, Human
uuucgcuuguucggagugcuuu

SEQ ID NO: 87032 - RNA, 22 nt, Human
uugcuuaaaucgcuuaaacugg

SEQ ID NO: 87033 - RNA, 22 nt, Human
uguggcucugaugucauaaagg

SEQ ID NO: 87034 - RNA, 22 nt, Human
ugugcugcagcgagagcuacga

SEQ ID NO: 87035 - RNA, 22 nt, Human
uugcucuuaccauuauguguga

SEQ ID NO: 87036 - RNA, 22 nt, Human
ugugccuuucacuaugucauuc

SEQ ID NO: 87037 - RNA, 22 nt, Human
ugugcaucuggaggcaauguuu

SEQ ID NO: 87038 - RNA, 22 nt, Human
uugcuuuuuuggguuuacuggg

SEQ ID NO: 87039 - RNA, 22 nt, Human
uuggaaaagaaauacucauaua

SEQ ID NO: 87040 - RNA, 22 nt, Human
uugcuuugcuucuuuaugguca

SEQ ID NO: 87041 - RNA, 22 nt, Human
uugcuuuuugggguuuacuggg

SEQ ID NO: 87042 - RNA, 22 nt, Human
uuggcuuuucaguuuuaaguua

SEQ ID NO: 87043 - RNA, 22 nt, Human
uguguguaugagcauuuguaug

SEQ ID NO: 87044 - RNA, 22 nt, Human
uguuaaaaagucccuguuuugu

SEQ ID NO: 87045 - RNA, 22 nt, Human
uguuaacugccaggacagaucg

SEQ ID NO: 87046 - RNA, 22 nt, Human
uuggcgcuauuauuaccacauu

SEQ ID NO: 87047 - RNA, 22 nt, Human
uuggccuaggcacaggcaggug

SEQ ID NO: 87048 - RNA, 22 nt, Human
uugggagaggcagcagagucau

SEQ ID NO: 87049 - RNA, 22 nt, Human
uugggagagaaaccuaaugccu

SEQ ID NO: 87050 - RNA, 22 nt, Human
uguucuucaaacucaguuccac

SEQ ID NO: 87051 - RNA, 22 nt, Human
uguucuuacuaaguaccugaaa

SEQ ID NO: 87052 - RNA, 22 nt, Human
uguugaucucuuuccaaauucu

SEQ ID NO: 87053 - RNA, 22 nt, Human
uguugagaacaucucggggaca

SEQ ID NO: 87054 - RNA, 21 nt, Human
uguugcuugucugagacuaug

SEQ ID NO: 87055 - RNA, 21 nt, Human
uguuggccuucauucucuguc

SEQ ID NO: 87056 - RNA, 22 nt, Human
uuguacuuaaauaugcaaauag

SEQ ID NO: 87057 - RNA, 22 nt, Human
uugguugaaauguguucaugcu

SEQ ID NO: 87058 - RNA, 21 nt, Human
uguugguugugggaaggagga

SEQ ID NO: 87059 - RNA, 21 nt, Human
ugucagaaagccugugacuuu

SEQ ID NO: 87060 - RNA, 22 nt, Human
ugucacuuaagguuggugucuc

SEQ ID NO: 87061 - RNA, 22 nt, Human
uugauuaauugaugaaccucuc

SEQ ID NO: 87062 - RNA, 22 nt, Human
ugucauuggugaucugaugccu

SEQ ID NO: 87063 - RNA, 22 nt, Human
uugauuuggaauuuuuagagcu

SEQ ID NO: 87064 - RNA, 22 nt, Human
uguccuauuugugauaggugac

SEQ ID NO: 87065 - RNA, 22 nt, Human
uugauuuccauuguccagcauu

SEQ ID NO: 87066 - RNA, 22 nt, Human
uugauuugcagaagguguagag

SEQ ID NO: 87067 - RNA, 22 nt, Human
uguauugaggauucauuuuugu

SEQ ID NO: 87068 - RNA, 22 nt, Human
uguaucuguguguauguguuua

SEQ ID NO: 87069 - RNA, 22 nt, Human
uugauaacuuagcugggcugcu

SEQ ID NO: 87070 - RNA, 22 nt, Human
ugucacaccuggcgauaauggg

SEQ ID NO: 87071 - RNA, 22 nt, Human
uguauuugaagaaagagcuucu

SEQ ID NO: 87072 - RNA, 19 nt, Human
uguauuuauauuucugugc

SEQ ID NO: 87073 - RNA, 22 nt, Human
uguauuuuuucccugaaauaaa

SEQ ID NO: 87074 - RNA, 22 nt, Human
ugugauaaaggcccgcagaucc

SEQ ID NO: 87075 - RNA, 22 nt, Human
ugugauugucuucugaaaguca

SEQ ID NO: 87076 - RNA, 22 nt, Human
ugucuucuuuucccuuagcccu

SEQ ID NO: 87077 - RNA, 22 nt, Human
ugucuuuuaaaaauguguaaaa

SEQ ID NO: 87078 - RNA, 22 nt, Human
ugugaagaauuaaugugaauca

SEQ ID NO: 87079 - RNA, 22 nt, Human
ugucuuucuuucucuugacaga

SEQ ID NO: 87080 - RNA, 22 nt, Human
uugcagaauucuucccacucag

SEQ ID NO: 87081 - RNA, 22 nt, Human
uucuuuuuagcugguuguaaga

SEQ ID NO: 87082 - RNA, 22 nt, Human
ugguuuccugauggacacuugg

SEQ ID NO: 87083 - RNA, 22 nt, Human
uugaaaaaaucugaggaggacc

SEQ ID NO: 87084 - RNA, 22 nt, Human
uguaaagaaagacgcagaguua

SEQ ID NO: 87085 - RNA, 22 nt, Human
ugguugguuaaugugcccauuu

SEQ ID NO: 87086 - RNA, 22 nt, Human
ugguuuacucuguaaaccagga

SEQ ID NO: 87087 - RNA, 18 nt, Human
ugguuggugggggugaag

SEQ ID NO: 87088 - RNA, 21 nt, Human
uucuuugaagacccauuugag

SEQ ID NO: 87089 - RNA, 22 nt, Human
uucuuucgaacaagagaaguuc

SEQ ID NO: 87090 - RNA, 22 nt, Human
uugaaagaacaauucugugaug

SEQ ID NO: 87091 - RNA, 22 nt, Human
uugaaaauuaauagguguacaa

SEQ ID NO: 87092 - RNA, 22 nt, Human
uugaaaacugucaccuuuauuc

SEQ ID NO: 87093 - RNA, 22 nt, Human
uguaauuugguuagauuucuuu

SEQ ID NO: 87094 - RNA, 22 nt, Human
uguaauguuagaaacaauugcu

SEQ ID NO: 87095 - RNA, 22 nt, Human
uugaaaucuucccuccugucug

SEQ ID NO: 87096 - RNA, 22 nt, Human
uugaagaagucaaaagcugcag

SEQ ID NO: 87097 - RNA, 22 nt, Human
uguauaugucugugagcuauua

SEQ ID NO: 87098 - RNA, 22 nt, Human
uguaauucuaauccagagcugg

SEQ ID NO: 87099 - RNA, 22 nt, Human
uucuucauucccuuacuuccga

SEQ ID NO: 87100 - RNA, 22 nt, Human
uucugaaggcaggggcuaucuu

SEQ ID NO: 87101 - RNA, 22 nt, Human
uucucuuguaaaauuccuuuuu

SEQ ID NO: 87102 - RNA, 22 nt, Human
uuauuaauacaugcaccugcau

SEQ ID NO: 87103 - RNA, 22 nt, Human
uuauuguuuggguauaauuuga

SEQ ID NO: 87104 - RNA, 22 nt, Human
ugcucacugcuuguguucaguu

SEQ ID NO: 87105 - RNA, 22 nt, Human
ugcuauucuuggagcugaugga

SEQ ID NO: 87106 - RNA, 22 nt, Human
ugcuauuaagagaaagugaaca

SEQ ID NO: 87107 - RNA, 22 nt, Human
uuauuuaaguauuuauugaagu

SEQ ID NO: 87108 - RNA, 22 nt, Human
uuauuugcccauguuuagcaga

SEQ ID NO: 87109 - RNA, 22 nt, Human
uuauuucaggcauuuguaaaug

SEQ ID NO: 87110 - RNA, 22 nt, Human
uuauuugguuuuggcuuuagcu

SEQ ID NO: 87111 - RNA, 22 nt, Human
uuauuuuguagcucugaucuuu

SEQ ID NO: 87112 - RNA, 22 nt, Human
uucaauuacaucagaaucuaaa

SEQ ID NO: 87113 - RNA, 22 nt, Human
uucacaauuuuaaaaaguggaa

SEQ ID NO: 87114 - RNA, 23 nt, Human
uucaccaaugcuguccaaguacc

SEQ ID NO: 87115 - RNA, 22 nt, Human
uucaaugcaagggaggucugaa

SEQ ID NO: 87116 - RNA, 21 nt, Human
uggauauugaguaguuucuga

SEQ ID NO: 87117 - RNA, 22 nt, Human
uggaugacaaccauuggaagag

SEQ ID NO: 87118 - RNA, 22 nt, Human
uuauuuuuguuuguuaagccua

SEQ ID NO: 87119 - RNA, 22 nt, Human
uggagguagcugacuccagccc

SEQ ID NO: 87120 - RNA, 22 nt, Human
uggaguuuauuugaauucuugg

SEQ ID NO: 87121 - RNA, 22 nt, Human
uucaaaaugcagaauaguuugg

SEQ ID NO: 87122 - RNA, 21 nt, Human
uucaaccagcaauuggcagaa

SEQ ID NO: 87123 - RNA, 22 nt, Human
uggaguuuuaaucuguacagaa

SEQ ID NO: 87124 - RNA, 22 nt, Human
uggauuguauugauugguuggc

SEQ ID NO: 87125 - RNA, 23 nt, Human
uggcaaacgggaauaaaggaauu

SEQ ID NO: 87126 - RNA, 22 nt, Human
uucacuuuuuccugguccauuu

SEQ ID NO: 87127 - RNA, 22 nt, Human
uucacugacaguauugaggagg

SEQ ID NO: 87128 - RNA, 22 nt, Human
uggcagcauuuuuuccagaaca

SEQ ID NO: 87129 - RNA, 22 nt, Human
uggcaucucggugcugguucuu

SEQ ID NO: 87130 - RNA, 22 nt, Human
uucagcaagugucucuacuguc

SEQ ID NO: 87131 - RNA, 22 nt, Human
uucagaauguacugauagaaca

SEQ ID NO: 87132 - RNA, 22 nt, Human
uucaggacacauuauuuaugaa

SEQ ID NO: 87133 - RNA, 22 nt, Human
uucaggggcaaauacauuuuga

SEQ ID NO: 87134 - RNA, 19 nt, Human
uucaggcuuuucauuuuuc

SEQ ID NO: 87135 - RNA, 21 nt, Human
uggcauacugcuaaaaagugu

SEQ ID NO: 87136 - RNA, 22 nt, Human
uucagcacuggacagcgagucu

SEQ ID NO: 87137 - RNA, 22 nt, Human
uggcggcggggagguaggcaga

SEQ ID NO: 87138 - RNA, 22 nt, Human
uggcgugaagcuggaaggcgga

SEQ ID NO: 87139 - RNA, 22 nt, Human
uggcgacuggaauuaaucuuuu

SEQ ID NO: 87140 - RNA, 22 nt, Human
uggcgcgcagccugcuggugcu

SEQ ID NO: 87141 - RNA, 21 nt, Human
uucauucauggcauaauauag

SEQ ID NO: 87142 - RNA, 22 nt, Human
uucauugcuacuuaaaauacca

SEQ ID NO: 87143 - RNA, 22 nt, Human
uucauugcagaauuuggccuca

SEQ ID NO: 87144 - RNA, 22 nt, Human
uucauuauuaauaauagcagcu

SEQ ID NO: 87145 - RNA, 22 nt, Human
uggcuucagacuucugcuacgu

SEQ ID NO: 87146 - RNA, 22 nt, Human
uuccagcaaagguaguguguua

SEQ ID NO: 87147 - RNA, 22 nt, Human
uggcucaggccuacgacgccuu

SEQ ID NO: 87148 - RNA, 22 nt, Human
uuccacuguucaguucugguca

SEQ ID NO: 87149 - RNA, 22 nt, Human
uucauccucuaguacugaagug

SEQ ID NO: 87150 - RNA, 22 nt, Human
uggccucauggccuuaucuggg

SEQ ID NO: 87151 - RNA, 22 nt, Human
uggccgaugagcaugcgcugau

SEQ ID NO: 87152 - RNA, 22 nt, Human
uucaguagagguggaaauaaca

SEQ ID NO: 87153 - RNA, 22 nt, Human
uggcauuuuguagcuguguauc

SEQ ID NO: 87154 - RNA, 22 nt, Human
uggcccagaucucugaccuuga

SEQ ID NO: 87155 - RNA, 22 nt, Human
uggccauuuacucuguaagagu

SEQ ID NO: 87156 - RNA, 22 nt, Human
uggcuuuucaccugcuccucug

SEQ ID NO: 87157 - RNA, 22 nt, Human
ugggaugagcuauauagaaagu

SEQ ID NO: 87158 - RNA, 18 nt, Human
uuccauuuuucagucuuc

SEQ ID NO: 87159 - RNA, 22 nt, Human
uucccauuccagcucgaucaau

SEQ ID NO: 87160 - RNA, 22 nt, Human
ugggccaaaugucugcauaagu

SEQ ID NO: 87161 - RNA, 22 nt, Human
uuccuuuuuaauuaaucuaauu

SEQ ID NO: 87162 - RNA, 18 nt, Human
uucuaaauucuguuuuua

SEQ ID NO: 87163 - RNA, 22 nt, Human
uucguugaagcaacgacuuugg

SEQ ID NO: 87164 - RNA, 22 nt, Human
ugggggaugacuugcucuuuca

SEQ ID NO: 87165 - RNA, 20 nt, Human
ugggggugcccaucuccccu

SEQ ID NO: 87166 - RNA, 22 nt, Human
uucucuugccuucucuuuuauc

SEQ ID NO: 87167 - RNA, 20 nt, Human
ugggguucccuuuagggcuu

SEQ ID NO: 87168 - RNA, 22 nt, Human
ugugcuaauguuaggauugaau

SEQ ID NO: 87169 - RNA, 22 nt, Human
uguggcuuaggugagcauguga

SEQ ID NO: 87170 - RNA, 22 nt, Human
ugcauaaauauuguugggagua

SEQ ID NO: 87171 - RNA, 22 nt, Human
ugucuucagguuccucaccacu

SEQ ID NO: 87172 - RNA, 22 nt, Human
uguggugacuugagcuuccuaa

SEQ ID NO: 87173 - RNA, 22 nt, Human
ugugguuuguaagcaaagcaaa

SEQ ID NO: 87174 - RNA, 22 nt, Human
ugcauuuugaaggaaaaaaaug

SEQ ID NO: 87175 - RNA, 22 nt, Human
ugcauuuuuaauuuggaaaaaa

SEQ ID NO: 87176 - RNA, 22 nt, Human
ugccauuggucuuaaggcuagc

SEQ ID NO: 87177 - RNA, 22 nt, Human
ugccuuuuguguuuggcuaauc

SEQ ID NO: 87178 - RNA, 22 nt, Human
uguguuuuucauuuuaaguccu

SEQ ID NO: 87179 - RNA, 22 nt, Human
uguuaacuuagcugaccuuaaa

SEQ ID NO: 87180 - RNA, 22 nt, Human
ugccuucugccaaggacggugc

SEQ ID NO: 87181 - RNA, 22 nt, Human
ugcuacaucuacugguaagggu

SEQ ID NO: 87182 - RNA, 22 nt, Human
ugcguuuaguuucaagacacgu

SEQ ID NO: 87183 - RNA, 19 nt, Human
uguugcagcuugaucggua

SEQ ID NO: 87184 - RNA, 22 nt, Human
uguugaugaccacaauuuaugc

SEQ ID NO: 87185 - RNA, 22 nt, Human
uguucuuaacuuuuguguauau

SEQ ID NO: 87186 - RNA, 19 nt, Human
uguucuacuugcuaguauu

SEQ ID NO: 87187 - RNA, 22 nt, Human
uguuccuggggaccugccuucc

SEQ ID NO: 87188 - RNA, 22 nt, Human
uguuccacgcguaguuccugcu

SEQ ID NO: 87189 - RNA, 22 nt, Human
uguuccuuuuguuguuuuguuu

SEQ ID NO: 87190 - RNA, 22 nt, Human
ugcggaaggcagcgcagggugg

SEQ ID NO: 87191 - RNA, 22 nt, Human
uggggugccccccucgguuugc

SEQ ID NO: 87192 - RNA, 22 nt, Human
ugggguguuacacaacauugag

SEQ ID NO: 87193 - RNA, 22 nt, Human
ugacauuugagagagauauaca

SEQ ID NO: 87194 - RNA, 22 nt, Human
ugguggaggugggggguauuuu

SEQ ID NO: 87195 - RNA, 22 nt, Human
ugaggaaugugacaaaaccaag

SEQ ID NO: 87196 - RNA, 22 nt, Human
ugagcuuugguaccuucauuug

SEQ ID NO: 87197 - RNA, 22 nt, Human
ugagcuauuucaccauauagau

SEQ ID NO: 87198 - RNA, 20 nt, Human
ugguuaaagugggugagcgg

SEQ ID NO: 87199 - RNA, 22 nt, Human
ugguuucagacagacucgaacu

SEQ ID NO: 87200 - RNA, 22 nt, Human
ugguugagguugacucuauaua

SEQ ID NO: 87201 - RNA, 22 nt, Human
ugaguuuaggccaggauauggu

SEQ ID NO: 87202 - RNA, 22 nt, Human
ugaguugucacaacgucacaag

SEQ ID NO: 87203 - RNA, 22 nt, Human
ugaucauugaacaucgaguuaa

SEQ ID NO: 87204 - RNA, 22 nt, Human
uguaaaguuuccuauugcccua

SEQ ID NO: 87205 - RNA, 22 nt, Human
uguaaagugguauuuaauuuua

SEQ ID NO: 87206 - RNA, 22 nt, Human
ugauggaucuguuggcggguuu

SEQ ID NO: 87207 - RNA, 22 nt, Human
uguauugugggugucagagugc

SEQ ID NO: 87208 - RNA, 22 nt, Human
ugauuagauacuucagaugaca

SEQ ID NO: 87209 - RNA, 20 nt, Human
ugauuauuccaacaagaaug

SEQ ID NO: 87210 - RNA, 22 nt, Human
ugauguauaaaaagagugaaau

SEQ ID NO: 87211 - RNA, 22 nt, Human
ugcaaauucuuuacucugugau

SEQ ID NO: 87212 - RNA, 19 nt, Human
ugcaagcuuuuucuuguua

SEQ ID NO: 87213 - RNA, 22 nt, Human
ugcacauuucucacaauguaca

SEQ ID NO: 87214 - RNA, 22 nt, Human
ugcaaaaguuuuauacacagau

SEQ ID NO: 87215 - RNA, 22 nt, Human
ugauuccugugcuuauuccagu

SEQ ID NO: 87216 - RNA, 22 nt, Human
ugauucuuugaccaaaaaauug

SEQ ID NO: 87217 - RNA, 22 nt, Human
ugauugaauaauguuaugugaa

SEQ ID NO: 87218 - RNA, 22 nt, Human
ugauugauaaugaagacaguca

SEQ ID NO: 87219 - RNA, 22 nt, Human
uguauuuauuuuucaacuacca

SEQ ID NO: 87220 - RNA, 19 nt, Human
ucuuugcuuuucuaagagg

SEQ ID NO: 87221 - RNA, 22 nt, Human
ucuuugcugacacuuacacugu

SEQ ID NO: 87222 - RNA, 22 nt, Human
ugggaaaauugugauucuuucu

SEQ ID NO: 87223 - RNA, 22 nt, Human
ugaagacuucuuuuggucacca

SEQ ID NO: 87224 - RNA, 22 nt, Human
ugaagaauuccauggcuuccau

SEQ ID NO: 87225 - RNA, 22 nt, Human
ugggauauagaauuggcagagu

SEQ ID NO: 87226 - RNA, 22 nt, Human
ugggaaggggagcuggaaagga

SEQ ID NO: 87227 - RNA, 22 nt, Human
ugggacaugaugcauuugaaag

SEQ ID NO: 87228 - RNA, 22 nt, Human
ugggauggacuuuagagaaucg

SEQ ID NO: 87229 - RNA, 20 nt, Human
ugggauggaaucaccugcac

SEQ ID NO: 87230 - RNA, 22 nt, Human
ugaaggccagggauuugcagcc

SEQ ID NO: 87231 - RNA, 21 nt, Human
ugaagccuagagaauugggga

SEQ ID NO: 87232 - RNA, 22 nt, Human
ugggccucuguuuccucaucug

SEQ ID NO: 87233 - RNA, 22 nt, Human
ugaauaaauaaacuuuuacuac

SEQ ID NO: 87234 - RNA, 22 nt, Human
ugaauaaucuuggguauuaaua

SEQ ID NO: 87235 - RNA, 22 nt, Human
ugggccgugagacgucucuggg

SEQ ID NO: 87236 - RNA, 22 nt, Human
ugaaguuuagaaaaagugccuu

SEQ ID NO: 87237 - RNA, 22 nt, Human
uggggcugguaccguaauauau

SEQ ID NO: 87238 - RNA, 22 nt, Human
uggggcuggccaggaggagucu

SEQ ID NO: 87239 - RNA, 22 nt, Human
ugggggauauggcuccauacuu

SEQ ID NO: 87240 - RNA, 22 nt, Human
ugaaucuuguuuacugauuccu

SEQ ID NO: 87241 - RNA, 22 nt, Human
ugaaugaacugaugaacuuaac

SEQ ID NO: 87242 - RNA, 22 nt, Human
ugggggagggagaguugauggg

SEQ ID NO: 87243 - RNA, 22 nt, Human
ugacagaaaccaccccccaggu

SEQ ID NO: 87244 - RNA, 17 nt, Human
ugacagcuaaggggcuu

SEQ ID NO: 87245 - RNA, 22 nt, Human
ugacagucacagcagaaacucg

SEQ ID NO: 87246 - RNA, 22 nt, Human
ugaauuuuaacauucugcugga

SEQ ID NO: 87247 - RNA, 22 nt, Human
ucuguucucuuguucugacggu

SEQ ID NO: 87248 - RNA, 22 nt, Human
uggaguaauggguguuuuugaa

SEQ ID NO: 87249 - RNA, 21 nt, Human
uggaggcguaaucacuguuga

SEQ ID NO: 87250 - RNA, 22 nt, Human
uggagggaagcaaacacuagau

SEQ ID NO: 87251 - RNA, 22 nt, Human
ucuguucaugucuuuuuaagug

SEQ ID NO: 87252 - RNA, 22 nt, Human
uggauuagugcugaaaugaugg

SEQ ID NO: 87253 - RNA, 22 nt, Human
uggauaugaaacaaaacaagag

SEQ ID NO: 87254 - RNA, 22 nt, Human
ucuuauugguaaugauggcauu

SEQ ID NO: 87255 - RNA, 22 nt, Human
ucuuagacagagaagacuauug

SEQ ID NO: 87256 - RNA, 22 nt, Human
uggauuguuuacaucaugucug

SEQ ID NO: 87257 - RNA, 22 nt, Human
ucuucuuuccuuuugugcauuu

SEQ ID NO: 87258 - RNA, 22 nt, Human
ucuucuuugugguugcccaagg

SEQ ID NO: 87259 - RNA, 22 nt, Human
ucuuggggagacuaguguuugg

SEQ ID NO: 87260 - RNA, 22 nt, Human
ucuuuauuucccuaacuugcua

SEQ ID NO: 87261 - RNA, 22 nt, Human
uggaaagauuuaaaauaacgag

SEQ ID NO: 87262 - RNA, 22 nt, Human
uggaaauaguugugagucaggc

SEQ ID NO: 87263 - RNA, 22 nt, Human
uggaaauagauguaggaaauug

SEQ ID NO: 87264 - RNA, 22 nt, Human
uggaaauacaagaaguauguca

SEQ ID NO: 87265 - RNA, 22 nt, Human
uggaaagaagacugugguugag

SEQ ID NO: 87266 - RNA, 22 nt, Human
uggaaaugcuuagaggugaucu

SEQ ID NO: 87267 - RNA, 22 nt, Human
uggaaccuggcuucaaagggag

SEQ ID NO: 87268 - RNA, 22 nt, Human
uggaggaggagaacuuggcacu

SEQ ID NO: 87269 - RNA, 22 nt, Human
uggagagauagucauucuagag

SEQ ID NO: 87270 - RNA, 22 nt, Human
uggaaugaaagaaaaauuguag

SEQ ID NO: 87271 - RNA, 22 nt, Human
ucugggguucuuaauuuggaag

SEQ ID NO: 87272 - RNA, 22 nt, Human
uggaagaucugguguagcuccu

SEQ ID NO: 87273 - RNA, 22 nt, Human
ucgccccccgccucacccucgg

SEQ ID NO: 87274 - RNA, 23 nt, Human
ugcuaaaggcagaauauucaccu

SEQ ID NO: 87275 - RNA, 22 nt, Human
ugcguugaggaccgcgagggcg

SEQ ID NO: 87276 - RNA, 21 nt, Human
ugcguaugucuuguauuacuc

SEQ ID NO: 87277 - RNA, 22 nt, Human
ugcgucccagcauguagggcag

SEQ ID NO: 87278 - RNA, 22 nt, Human
ugcuauccagacacauaugauc

SEQ ID NO: 87279 - RNA, 22 nt, Human
ugcuccucugcaugucugcggc

SEQ ID NO: 87280 - RNA, 22 nt, Human
ugcucuuuguagcugcuuugcu

SEQ ID NO: 87281 - RNA, 22 nt, Human
ugcucuguuuuaacucuuucaa

SEQ ID NO: 87282 - RNA, 22 nt, Human
ucgggggaaccggcccgggccu

SEQ ID NO: 87283 - RNA, 20 nt, Human
ucuaaugaagugagcuuagc

SEQ ID NO: 87284 - RNA, 22 nt, Human
ucgugaagaaauguggacuuca

SEQ ID NO: 87285 - RNA, 22 nt, Human
ucuaaagcuccuuccacuaaaa

SEQ ID NO: 87286 - RNA, 22 nt, Human
ucuaaaaauuagaaauuagguc

SEQ ID NO: 87287 - RNA, 22 nt, Human
uccuaaauuuguacuagcauuu

SEQ ID NO: 87288 - RNA, 22 nt, Human
ucccuuuuuccugaucugugaa

SEQ ID NO: 87289 - RNA, 22 nt, Human
ucccuugacuucucuuuuucca

SEQ ID NO: 87290 - RNA, 22 nt, Human
ucccuuuuuaauugugucccug

SEQ ID NO: 87291 - RNA, 22 nt, Human
ucccuugauauccuuuuaaugg

SEQ ID NO: 87292 - RNA, 22 nt, Human
ugccagcuccgaggagcugcag

SEQ ID NO: 87293 - RNA, 22 nt, Human
ugcauuauaacaauaaggcuua

SEQ ID NO: 87294 - RNA, 22 nt, Human
ugccaucuuugccccuauuuua

SEQ ID NO: 87295 - RNA, 22 nt, Human
uccuuccucuuucaaauuuguu

SEQ ID NO: 87296 - RNA, 22 nt, Human
uccuuacuccuggagauucuga

SEQ ID NO: 87297 - RNA, 22 nt, Human
uccuucuguuguuuauuuuaaa

SEQ ID NO: 87298 - RNA, 22 nt, Human
uccuucuuuucgccggaguuga

SEQ ID NO: 87299 - RNA, 22 nt, Human
ucgaaugccaacaccgaaguuu

SEQ ID NO: 87300 - RNA, 22 nt, Human
ugagaaaacaguuuguaauaau

SEQ ID NO: 87301 - RNA, 22 nt, Human
ugacuuauuaaaaguuuuuauu

SEQ ID NO: 87302 - RNA, 22 nt, Human
ugagggaagguugauaauguuc

SEQ ID NO: 87303 - RNA, 22 nt, Human
ugagguuacauuaggaauaacc

SEQ ID NO: 87304 - RNA, 22 nt, Human
ugaguuagcucuauucuuuugg

SEQ ID NO: 87305 - RNA, 22 nt, Human
ugauagcaugcucucaguaaaa

SEQ ID NO: 87306 - RNA, 19 nt, Human
ugaucuccaguacagacau

SEQ ID NO: 87307 - RNA, 22 nt, Human
ucauuagcuaucagaguggaac

SEQ ID NO: 87308 - RNA, 22 nt, Human
ucauuauuuggaauaugggacu

SEQ ID NO: 87309 - RNA, 22 nt, Human
ugauauaaaagauucuuauuga

SEQ ID NO: 87310 - RNA, 22 nt, Human
ucauugguugcguaauuugauu

SEQ ID NO: 87311 - RNA, 22 nt, Human
ucauuguuucugcuuuucauga

SEQ ID NO: 87312 - RNA, 22 nt, Human
ucauuggagcauaugaugguua

SEQ ID NO: 87313 - RNA, 22 nt, Human
uccaacuuaauugggaagauua

SEQ ID NO: 87314 - RNA, 22 nt, Human
uccaaauucccaugacagaagu

SEQ ID NO: 87315 - RNA, 22 nt, Human
uccaaauagcuggaugauggug

SEQ ID NO: 87316 - RNA, 22 nt, Human
ugaucuuugcuuuuggcuuagu

SEQ ID NO: 87317 - RNA, 22 nt, Human
ucauuuaauuuggaacucagag

SEQ ID NO: 87318 - RNA, 22 nt, Human
ugaugaaguuggaaggaaaguu

SEQ ID NO: 87319 - RNA, 22 nt, Human
ugaugaucaugcagguugguuu

SEQ ID NO: 87320 - RNA, 22 nt, Human
ugcaaaaagagcgaggagcccu

SEQ ID NO: 87321 - RNA, 23 nt, Human
ugcaaaauuugcagaguucgaug

SEQ ID NO: 87322 - RNA, 22 nt, Human
ugcaaauuuuuuuauuuuuccu

SEQ ID NO: 87323 - RNA, 22 nt, Human
uccacuuaauagguauggagcc

SEQ ID NO: 87324 - RNA, 22 nt, Human
uccacgcucuuucuacuuuuca

SEQ ID NO: 87325 - RNA, 21 nt, Human
uccauucuuggugguucugca

SEQ ID NO: 87326 - RNA, 22 nt, Human
uccauuuacuauucucauaucg

SEQ ID NO: 87327 - RNA, 22 nt, Human
uccaucuacgagauuuuccaga

SEQ ID NO: 87328 - RNA, 20 nt, Human
ugcagcucccccgcaguuuc

SEQ ID NO: 87329 - RNA, 18 nt, Human
ugcagcuuugugauuggc

SEQ ID NO: 87330 - RNA, 22 nt, Human
uagucucagaauauuugcugau

SEQ ID NO: 87331 - RNA, 22 nt, Human
ucuucuuauuuuaugaucgcuu

SEQ ID NO: 87332 - RNA, 22 nt, Human
ucuucuauaucuacauaugcaa

SEQ ID NO: 87333 - RNA, 22 nt, Human
ucuucuuacauuaaguugaaac

SEQ ID NO: 87334 - RNA, 22 nt, Human
uauuggcucagucagaaguuuu

SEQ ID NO: 87335 - RNA, 22 nt, Human
uauugauuuuguugcuaccugg

SEQ ID NO: 87336 - RNA, 22 nt, Human
ucuuuaaauucuuaugagugaa

SEQ ID NO: 87337 - RNA, 22 nt, Human
uauugucuuuuucuuccaccug

SEQ ID NO: 87338 - RNA, 22 nt, Human
ucuuguuaaagguuaaagguga

SEQ ID NO: 87339 - RNA, 22 nt, Human
ucuugucacagcuugacuccua

SEQ ID NO: 87340 - RNA, 22 nt, Human
ucuuugcauggacauguguuuu

SEQ ID NO: 87341 - RNA, 22 nt, Human
ucuuuguuagucagaauugauc

SEQ ID NO: 87342 - RNA, 22 nt, Human
uauuuaggcagaaagugauauu

SEQ ID NO: 87343 - RNA, 18 nt, Human
uauuuacuguguguuacc

SEQ ID NO: 87344 - RNA, 22 nt, Human
uauuguuuuaagguguauuaau

SEQ ID NO: 87345 - RNA, 22 nt, Human
uauuuaaagucagcaacuuuuc

SEQ ID NO: 87346 - RNA, 22 nt, Human
uauuuacgcaaacaauugugca

SEQ ID NO: 87347 - RNA, 22 nt, Human
uauuucaucugaacuucccaac

SEQ ID NO: 87348 - RNA, 22 nt, Human
ucuuuugugauuuucugaagca

SEQ ID NO: 87349 - RNA, 22 nt, Human
ucuuuuaucuguuguguaacaa

SEQ ID NO: 87350 - RNA, 22 nt, Human
uauuuuaaaagcauuaauucuu

SEQ ID NO: 87351 - RNA, 22 nt, Human
uauuugauggaacucuugcuuu

SEQ ID NO: 87352 - RNA, 22 nt, Human
uauuuguauugucuuaucacuu

SEQ ID NO: 87353 - RNA, 22 nt, Human
uauuuuggcuccugagcucuga

SEQ ID NO: 87354 - RNA, 22 nt, Human
uauuuuggaugcauugagaugc

SEQ ID NO: 87355 - RNA, 22 nt, Human
uauuuucucugccacacuucca

SEQ ID NO: 87356 - RNA, 23 nt, Human
uauuuuccccuguaauauguauu

SEQ ID NO: 87357 - RNA, 22 nt, Human
ugaaauguggagaugguaagua

SEQ ID NO: 87358 - RNA, 22 nt, Human
ugaaauugaguaccucuuuaua

SEQ ID NO: 87359 - RNA, 22 nt, Human
ugaacuuacauugaggaauucu

SEQ ID NO: 87360 - RNA, 22 nt, Human
uauuuuuaccuaauuuaugaga

SEQ ID NO: 87361 - RNA, 22 nt, Human
ugaacauuuuugcuugcagcuu

SEQ ID NO: 87362 - RNA, 22 nt, Human
ugaaauuuuuuggagauaauuu

SEQ ID NO: 87363 - RNA, 22 nt, Human
ugaaccgcuucauggugccugu

SEQ ID NO: 87364 - RNA, 22 nt, Human
ucaaaaauaagauauucuggac

SEQ ID NO: 87365 - RNA, 22 nt, Human
ugaagacaguuuuacucaugag

SEQ ID NO: 87366 - RNA, 22 nt, Human
uauuuuucacagauuggugcuu

SEQ ID NO: 87367 - RNA, 22 nt, Human
ucaaauaugggccagaggaaau

SEQ ID NO: 87368 - RNA, 22 nt, Human
ucaaagaucuuugcuuuugggg

SEQ ID NO: 87369 - RNA, 22 nt, Human
ucaagaagauaaugucuagggu

SEQ ID NO: 87370 - RNA, 22 nt, Human
ucaaccagcuuaucugcaggau

SEQ ID NO: 87371 - RNA, 22 nt, Human
ucaagagauauaugcugguuua

SEQ ID NO: 87372 - RNA, 22 nt, Human
ugaagguggcuugcagcuaguc

SEQ ID NO: 87373 - RNA, 23 nt, Human
ugaagugaaauuucacaagggac

SEQ ID NO: 87374 - RNA, 21 nt, Human
ucaagcggcagagcaguuauu

SEQ ID NO: 87375 - RNA, 22 nt, Human
ugaaggggaaagucuugcuaua

SEQ ID NO: 87376 - RNA, 22 nt, Human
ugaauagucaaagcacaagagg

SEQ ID NO: 87377 - RNA, 22 nt, Human
ugaaugaagcacuguaauucuc

SEQ ID NO: 87378 - RNA, 22 nt, Human
ugaaucaaugaauugcacuuca

SEQ ID NO: 87379 - RNA, 22 nt, Human
ucaagguauuauuuuuguggug

SEQ ID NO: 87380 - RNA, 22 nt, Human
ucaauuggcuacaaauaaugua

SEQ ID NO: 87381 - RNA, 22 nt, Human
ucacaagaagaaauuaaacugu

SEQ ID NO: 87382 - RNA, 22 nt, Human
ucaccugccuggguggucaccu

SEQ ID NO: 87383 - RNA, 19 nt, Human
ucacggucaaccagagccu

SEQ ID NO: 87384 - RNA, 22 nt, Human
ucacucgccuuuucguucgccg

SEQ ID NO: 87385 - RNA, 22 nt, Human
ugaauucaaacuuuuuaacaag

SEQ ID NO: 87386 - RNA, 22 nt, Human
ugaauuauaugguauugaacau

SEQ ID NO: 87387 - RNA, 22 nt, Human
ugaauuacacugggaucagggc

SEQ ID NO: 87388 - RNA, 22 nt, Human
ugaauggugcccuagagggaug

SEQ ID NO: 87389 - RNA, 22 nt, Human
ucacuuuacaucuguaaaagga

SEQ ID NO: 87390 - RNA, 22 nt, Human
ugacacacagggggauggaguu

SEQ ID NO: 87391 - RNA, 22 nt, Human
ucacuguuucaccgucugaagg

SEQ ID NO: 87392 - RNA, 22 nt, Human
ugaauuuuggcaauuuucugug

SEQ ID NO: 87393 - RNA, 21 nt, Human
ucagaaucguuccagguagau

SEQ ID NO: 87394 - RNA, 22 nt, Human
ucagaaugaaauuucuuucaga

SEQ ID NO: 87395 - RNA, 22 nt, Human
ugacaucuagauaaaugggaca

SEQ ID NO: 87396 - RNA, 22 nt, Human
ucaggcaggaucccagggaagg

SEQ ID NO: 87397 - RNA, 22 nt, Human
ucagcgucuccaaaagagcccg

SEQ ID NO: 87398 - RNA, 22 nt, Human
uaguuggguagacaguucuaca

SEQ ID NO: 87399 - RNA, 22 nt, Human
uaguuuucaagugaguuggaag

SEQ ID NO: 87400 - RNA, 22 nt, Human
uaguuuucuuuuguguuauucu

SEQ ID NO: 87401 - RNA, 22 nt, Human
uaguuuuaagcugacauuguuc

SEQ ID NO: 87402 - RNA, 22 nt, Human
uagcauuuagaacaccuugaga

SEQ ID NO: 87403 - RNA, 22 nt, Human
gugcuaugugcugaacucaggu

SEQ ID NO: 87404 - RNA, 22 nt, Human
uaguuauuucugcacuuaauga

SEQ ID NO: 87405 - RNA, 22 nt, Human
uaguuaggauucccaggaaacc

SEQ ID NO: 87406 - RNA, 22 nt, Human
uauaagaaaagucauuaucaaa

SEQ ID NO: 87407 - RNA, 22 nt, Human
uauauaauacacaaauauguac

SEQ ID NO: 87408 - RNA, 22 nt, Human
uaucaguagaacaauggacauu

SEQ ID NO: 87409 - RNA, 22 nt, Human
uauauuaaagugcuuugcagug

SEQ ID NO: 87410 - RNA, 22 nt, Human
uaucuuagaagaaaugggucca

SEQ ID NO: 87411 - RNA, 22 nt, Human
uaucuguagucucaugguuccu

SEQ ID NO: 87412 - RNA, 22 nt, Human
gugucauuggcuucccaagucc

SEQ ID NO: 87413 - RNA, 22 nt, Human
guugagaaucucuagcuuagga

SEQ ID NO: 87414 - RNA, 22 nt, Human
guugauuuaaccucaccuuuga

SEQ ID NO: 87415 - RNA, 22 nt, Human
guugagacguguauuggaaucu

SEQ ID NO: 87416 - RNA, 22 nt, Human
uauuucuagggcaugaaaauaa

SEQ ID NO: 87417 - RNA, 22 nt, Human
uauuucaugagugaauaucuag

SEQ ID NO: 87418 - RNA, 22 nt, Human
uauuuguuucuaguggcagcaa

SEQ ID NO: 87419 - RNA, 20 nt, Human
uauuucaaugugccaaguuu

SEQ ID NO: 87420 - RNA, 22 nt, Human
uauuucaguuaagaugagguca

SEQ ID NO: 87421 - RNA, 22 nt, Human
uauuuaugcaucacuuuuuucc

SEQ ID NO: 87422 - RNA, 22 nt, Human
uauuuacuguguucaucccucu

SEQ ID NO: 87423 - RNA, 22 nt, Human
uauuuacuuugaggaaguuguu

SEQ ID NO: 87424 - RNA, 22 nt, Human
uauuggguagguccuuuggagu

SEQ ID NO: 87425 - RNA, 22 nt, Human
guguuagcauggaacagaacgc

SEQ ID NO: 87426 - RNA, 18 nt, Human
uaugugucuguuacaacu

SEQ ID NO: 87427 - RNA, 23 nt, Human
guuaccgaccugauucggcagcc

SEQ ID NO: 87428 - RNA, 22 nt, Human
guuauuuugucuuguucaugaa

SEQ ID NO: 87429 - RNA, 22 nt, Human
guuauuguuauugcguugucga

SEQ ID NO: 87430 - RNA, 22 nt, Human
uauguuaauuaccagcacugau

SEQ ID NO: 87431 - RNA, 22 nt, Human
uauuaaaagagaaaaagccacc

SEQ ID NO: 87432 - RNA, 22 nt, Human
guuauugggagagggaauggga

SEQ ID NO: 87433 - RNA, 22 nt, Human
uauucccacuccucagcaauuu

SEQ ID NO: 87434 - RNA, 21 nt, Human
ucaaguccuggcuuugcucuu

SEQ ID NO: 87435 - RNA, 22 nt, Human
ucaaggaagggguaggaauaau

SEQ ID NO: 87436 - RNA, 22 nt, Human
guuguugucauuagcuguuuaa

SEQ ID NO: 87437 - RNA, 22 nt, Human
guugcaaaugggaagaugguua

SEQ ID NO: 87438 - RNA, 22 nt, Human
uauuuuuacuguuugaugauuc

SEQ ID NO: 87439 - RNA, 22 nt, Human
guuuaaaagcaaccaacaggcu

SEQ ID NO: 87440 - RNA, 22 nt, Human
guuuagauguagauucucuggu

SEQ ID NO: 87441 - RNA, 22 nt, Human
guuguuuuuguuaaaacaguga

SEQ ID NO: 87442 - RNA, 22 nt, Human
ucaauuuauguggcuauucauu

SEQ ID NO: 87443 - RNA, 21 nt, Human
ucaagugcccaagguuuguuu

SEQ ID NO: 87444 - RNA, 21 nt, Human
ucacagggucacucuuaccac

SEQ ID NO: 87445 - RNA, 22 nt, Human
guuuauucuuuuauuugugaga

SEQ ID NO: 87446 - RNA, 22 nt, Human
ucacccagacugucugacucuu

SEQ ID NO: 87447 - RNA, 22 nt, Human
guuuauuucuuaucaucacuau

SEQ ID NO: 87448 - RNA, 22 nt, Human
ucagaaacuaaauguggauuug

SEQ ID NO: 87449 - RNA, 22 nt, Human
ucacuuccuugcagcuguagaa

SEQ ID NO: 87450 - RNA, 22 nt, Human
ucacuggaaaacaaauguuuua

SEQ ID NO: 87451 - RNA, 22 nt, Human
ucacucuuuaucuuuuaugucu

SEQ ID NO: 87452 - RNA, 22 nt, Human
ucagagacaucagguuguagca

SEQ ID NO: 87453 - RNA, 18 nt, Human
ucagaggagauaccuaaa

SEQ ID NO: 87454 - RNA, 22 nt, Human
ucagauaauccaauagagagga

SEQ ID NO: 87455 - RNA, 22 nt, Human
guuuuucuagaaaucuccuccu

SEQ ID NO: 87456 - RNA, 22 nt, Human
guuuugaagagaagcaagucug

SEQ ID NO: 87457 - RNA, 22 nt, Human
guuuugaugugauuucucaugu

SEQ ID NO: 87458 - RNA, 22 nt, Human
guuuugauggaguguguuaaau

SEQ ID NO: 87459 - RNA, 22 nt, Human
guuuuguucaugaacauugggu

SEQ ID NO: 87460 - RNA, 22 nt, Human
guuuuggagauguccauuuucc

SEQ ID NO: 87461 - RNA, 22 nt, Human
ucagaagguacugaagacaugg

SEQ ID NO: 87462 - RNA, 22 nt, Human
guuuucuaaaacacauauaagu

SEQ ID NO: 87463 - RNA, 22 nt, Human
guuuuaaucuccuuauuccuaa

SEQ ID NO: 87464 - RNA, 22 nt, Human
guuuuauaacuauagugagaau

SEQ ID NO: 87465 - RNA, 22 nt, Human
guuuuaucuauguaauuauaaa

SEQ ID NO: 87466 - RNA, 22 nt, Human
ucagccuugguuuugguguugg

SEQ ID NO: 87467 - RNA, 22 nt, Human
uaaaacuaugcaaccuacuacc

SEQ ID NO: 87468 - RNA, 22 nt, Human
uaaaaccauucauugaccuaug

SEQ ID NO: 87469 - RNA, 22 nt, Human
guuuuucuuugauuuagaacca

SEQ ID NO: 87470 - RNA, 22 nt, Human
uaaaaugcucagauaaauauau

SEQ ID NO: 87471 - RNA, 22 nt, Human
uaaaaguuagcuaggacaaagu

SEQ ID NO: 87472 - RNA, 22 nt, Human
uaaaauaccacauauggugcuc

SEQ ID NO: 87473 - RNA, 22 nt, Human
uaaaaucaugacagauugacau

SEQ ID NO: 87474 - RNA, 22 nt, Human
uaaaccuuauuugaauaccaac

SEQ ID NO: 87475 - RNA, 22 nt, Human
uaaacgaagcuucaugcuugaa

SEQ ID NO: 87476 - RNA, 22 nt, Human
uaaagaagaaaaggcuucaggc

SEQ ID NO: 87477 - RNA, 22 nt, Human
uaauuauuaauuuuagguugcu

SEQ ID NO: 87478 - RNA, 22 nt, Human
uaauucuagauugacauuuuga

SEQ ID NO: 87479 - RNA, 22 nt, Human
uacaaauuguuuugccacaaag

SEQ ID NO: 87480 - RNA, 20 nt, Human
uacaaggauguucaucagag

SEQ ID NO: 87481 - RNA, 22 nt, Human
uacaagcucuuguagggggaaa

SEQ ID NO: 87482 - RNA, 22 nt, Human
ucauugguugcauaauuugauc

SEQ ID NO: 87483 - RNA, 22 nt, Human
uaaugcucauuuggcucugcaa

SEQ ID NO: 87484 - RNA, 22 nt, Human
uaauccaaaccaggaauucccu

SEQ ID NO: 87485 - RNA, 22 nt, Human
uaauagauagggagaguugcug

SEQ ID NO: 87486 - RNA, 22 nt, Human
ucagcguuaguuuuucaucuaa

SEQ ID NO: 87487 - RNA, 22 nt, Human
uaauaauuaacagugauggguc

SEQ ID NO: 87488 - RNA, 22 nt, Human
uaagaauguuuguugaguaaau

SEQ ID NO: 87489 - RNA, 22 nt, Human
uaagagcagacacaaccugaga

SEQ ID NO: 87490 - RNA, 22 nt, Human
uaaagacaauuucgagcuguag

SEQ ID NO: 87491 - RNA, 22 nt, Human
uaaagaggagaauuaagucagc

SEQ ID NO: 87492 - RNA, 22 nt, Human
uaagaaacauuuuuaugacagu

SEQ ID NO: 87493 - RNA, 21 nt, Human
uaagaacauuaucuucuuccu

SEQ ID NO: 87494 - RNA, 22 nt, Human
uaagaaaggggaaguuccucuu

SEQ ID NO: 87495 - RNA, 22 nt, Human
ucaucuuuauaaugcaaguuuu

SEQ ID NO: 87496 - RNA, 21 nt, Human
ucauccagguccugcuucuuc

SEQ ID NO: 87497 - RNA, 22 nt, Human
uaagcacuuuauaugcuuuauc

SEQ ID NO: 87498 - RNA, 22 nt, Human
uccacuguguagucucccaagu

SEQ ID NO: 87499 - RNA, 22 nt, Human
uccagaaagccguugacuuauu

SEQ ID NO: 87500 - RNA, 22 nt, Human
uccagaaaucucuguugauugu

SEQ ID NO: 87501 - RNA, 22 nt, Human
uccagacucaaaaaccagaugg

SEQ ID NO: 87502 - RNA, 22 nt, Human
uccacuuaaaacucuuuuuguc

SEQ ID NO: 87503 - RNA, 22 nt, Human
uacucgaaaucagagagaauaa

SEQ ID NO: 87504 - RNA, 22 nt, Human
uacugaaagagugguggacucu

SEQ ID NO: 87505 - RNA, 22 nt, Human
uacuuaaaacacauuuagcauu

SEQ ID NO: 87506 - RNA, 17 nt, Human
uccauugagacaagaag

SEQ ID NO: 87507 - RNA, 22 nt, Human
uaccuagaagagacuuuucugg

SEQ ID NO: 87508 - RNA, 22 nt, Human
uccagccugaacuuuguccaga

SEQ ID NO: 87509 - RNA, 23 nt, Human
uaccauugauuuuaugguuuucu

SEQ ID NO: 87510 - RNA, 22 nt, Human
uccuuuuuagguuauuguacau

SEQ ID NO: 87511 - RNA, 22 nt, Human
ucgaaacuucucauuuaucugu

SEQ ID NO: 87512 - RNA, 22 nt, Human
uaggaucaugaugguaaggcaa

SEQ ID NO: 87513 - RNA, 22 nt, Human
ucgagcacaccagacuugcaga

SEQ ID NO: 87514 - RNA, 22 nt, Human
ucgcuguguccuuuucacuuau

SEQ ID NO: 87515 - RNA, 22 nt, Human
uagguuuugugucagaguagaa

SEQ ID NO: 87516 - RNA, 22 nt, Human
uaguaauauuccuacauuaugu

SEQ ID NO: 87517 - RNA, 22 nt, Human
uaggucugaggcugcaucuugg

SEQ ID NO: 87518 - RNA, 22 nt, Human
ucguauucagugcaagucaacg

SEQ ID NO: 87519 - RNA, 22 nt, Human
ucgucaaaguaaugucauagca

SEQ ID NO: 87520 - RNA, 21 nt, Human
ucgggcggcggcugaggcggc

SEQ ID NO: 87521 - RNA, 22 nt, Human
ucguuucuuuuucuucccugga

SEQ ID NO: 87522 - RNA, 22 nt, Human
uagucuuuguggucuuuagcua

SEQ ID NO: 87523 - RNA, 22 nt, Human
ucuaaucacccgccgccccccg

SEQ ID NO: 87524 - RNA, 20 nt, Human
uaguaugggagaagaucucc

SEQ ID NO: 87525 - RNA, 22 nt, Human
uaguauuuguaauuaucaaagc

SEQ ID NO: 87526 - RNA, 22 nt, Human
uaguauuguguuguuugacagu

SEQ ID NO: 87527 - RNA, 22 nt, Human
uagucaauuagaaagaggccuu

SEQ ID NO: 87528 - RNA, 22 nt, Human
uccuuuauuuaugggcagugua

SEQ ID NO: 87529 - RNA, 22 nt, Human
uccuuguuggaauauccuuacc

SEQ ID NO: 87530 - RNA, 22 nt, Human
uccugaaugguguaauagguuu

SEQ ID NO: 87531 - RNA, 22 nt, Human
uccucuucucuagagccggaau

SEQ ID NO: 87532 - RNA, 22 nt, Human
uagauuuaaaaagggugggaug

SEQ ID NO: 87533 - RNA, 22 nt, Human
uagccaaguguuuuucaugacc

SEQ ID NO: 87534 - RNA, 22 nt, Human
uagcauuuauugggcuagcaaa

SEQ ID NO: 87535 - RNA, 22 nt, Human
uacuucaguuacaugaagguau

SEQ ID NO: 87536 - RNA, 22 nt, Human
uacuuaauuuuaaaagcuagau

SEQ ID NO: 87537 - RNA, 22 nt, Human
uagacauuuacuuugaaaaaau

SEQ ID NO: 87538 - RNA, 21 nt, Human
uagaagagggaauuugucuuu

SEQ ID NO: 87539 - RNA, 22 nt, Human
uccggcgaccuccagauguucc

SEQ ID NO: 87540 - RNA, 22 nt, Human
uagagaaauauuuguagugcug

SEQ ID NO: 87541 - RNA, 22 nt, Human
uagagaaauuacagcuuucuuu

SEQ ID NO: 87542 - RNA, 22 nt, Human
uagagcucaagaagcaaaagcu

SEQ ID NO: 87543 - RNA, 22 nt, Human
uagaggaccacagggugcagag

SEQ ID NO: 87544 - RNA, 22 nt, Human
uagagagaaaccaggguuuggg

SEQ ID NO: 87545 - RNA, 19 nt, Human
uagagcagcuucagauucc

SEQ ID NO: 87546 - RNA, 19 nt, Human
uagaggagaauggcaaaga

SEQ ID NO: 87547 - RNA, 19 nt, Human
gugaugaugccacuccaac

SEQ ID NO: 87548 - RNA, 22 nt, Human
gugaugaagguggagaaucaga

SEQ ID NO: 87549 - RNA, 22 nt, Human
gugauggggagagcgcagcuuu

SEQ ID NO: 87550 - RNA, 22 nt, Human
uacuuaucuuagggaugcuugc

SEQ ID NO: 87551 - RNA, 22 nt, Human
uagaaauaaacacugcuaccuu

SEQ ID NO: 87552 - RNA, 19 nt, Human
gugauauuuauuauuuauu

SEQ ID NO: 87553 - RNA, 22 nt, Human
gugaugaaggccugcaccuggu

SEQ ID NO: 87554 - RNA, 22 nt, Human
uagcaaucugugaugugugugu

SEQ ID NO: 87555 - RNA, 22 nt, Human
uagcagaacaauagucaaugau

SEQ ID NO: 87556 - RNA, 22 nt, Human
uagcagcacuauuuguuguagu

SEQ ID NO: 87557 - RNA, 22 nt, Human
uagcaggagagaaguuuuaagu

SEQ ID NO: 87558 - RNA, 22 nt, Human
gugccuggugcaggauaaucac

SEQ ID NO: 87559 - RNA, 22 nt, Human
uagaugaacagaaagccacugu

SEQ ID NO: 87560 - RNA, 22 nt, Human
uacuaaagaaugaguuaaguuu

SEQ ID NO: 87561 - RNA, 22 nt, Human
uaccauaaagcaggcaaaugag

SEQ ID NO: 87562 - RNA, 22 nt, Human
uaccaugggucaguuggguuug

SEQ ID NO: 87563 - RNA, 22 nt, Human
uacagcgaaaauuuagcuugau

SEQ ID NO: 87564 - RNA, 22 nt, Human
uacugaagaugccaucacaagc

SEQ ID NO: 87565 - RNA, 22 nt, Human
uacugauggagauaggcuauca

SEQ ID NO: 87566 - RNA, 22 nt, Human
uacuuacacugaagcaaagaua

SEQ ID NO: 87567 - RNA, 22 nt, Human
gucuccuucauuuacuguuucc

SEQ ID NO: 87568 - RNA, 22 nt, Human
gucugaaauaucuuuugucuug

SEQ ID NO: 87569 - RNA, 22 nt, Human
uacaaucaggcucuagcuucuc

SEQ ID NO: 87570 - RNA, 22 nt, Human
uaauaaaaauuuaauucacauu

SEQ ID NO: 87571 - RNA, 20 nt, Human
gucagaggacccuagagcga

SEQ ID NO: 87572 - RNA, 21 nt, Human
uaauaauugggggcagggugg

SEQ ID NO: 87573 - RNA, 22 nt, Human
uaauaacuacacucagaggacc

SEQ ID NO: 87574 - RNA, 22 nt, Human
uacaaauugccugacggcaggu

SEQ ID NO: 87575 - RNA, 22 nt, Human
uaauaguugaaggucaucacua

SEQ ID NO: 87576 - RNA, 22 nt, Human
gguauccaaauaaagcagguaa

SEQ ID NO: 87577 - RNA, 23 nt, Human
gguagguggggagauuaaagucu

SEQ ID NO: 87578 - RNA, 22 nt, Human
guuuuauguuuuauagacacaa

SEQ ID NO: 87579 - RNA, 22 nt, Human
gguggcuugcugguaggugugc

SEQ ID NO: 87580 - RNA, 22 nt, Human
guuuucuccugcuauacagugc

SEQ ID NO: 87581 - RNA, 22 nt, Human
guuuucuuguuaauuuugaacg

SEQ ID NO: 87582 - RNA, 22 nt, Human
ggugggaauccaggccuucauc

SEQ ID NO: 87583 - RNA, 21 nt, Human
gguuucugcaaaccuuguaca

SEQ ID NO: 87584 - RNA, 22 nt, Human
guaaacugaauuggauacugug

SEQ ID NO: 87585 - RNA, 22 nt, Human
guaaauacuaugagauaaugaa

SEQ ID NO: 87586 - RNA, 22 nt, Human
guuuuuacuuccaaugcuauga

SEQ ID NO: 87587 - RNA, 22 nt, Human
gucagauucuuucauuugcuga

SEQ ID NO: 87588 - RNA, 22 nt, Human
guauuugcaaucacaaacaaaa

SEQ ID NO: 87589 - RNA, 21 nt, Human
uaagcuaaacauucaguuaac

SEQ ID NO: 87590 - RNA, 22 nt, Human
uaagcguuugggaguuaugaac

SEQ ID NO: 87591 - RNA, 21 nt, Human
guaucuuucuuuuaaaauauc

SEQ ID NO: 87592 - RNA, 22 nt, Human
guaucugaaaaagaauucugac

SEQ ID NO: 87593 - RNA, 22 nt, Human
uaacuuuuuauccuguuaaaug

SEQ ID NO: 87594 - RNA, 22 nt, Human
guaucaggugugagcauuuuaa

SEQ ID NO: 87595 - RNA, 22 nt, Human
uaacuuuucuguucaauuuucc

SEQ ID NO: 87596 - RNA, 22 nt, Human
uaacuugaauacauucuuuuca

SEQ ID NO: 87597 - RNA, 22 nt, Human
guaguuagaguugugcuggaga

SEQ ID NO: 87598 - RNA, 22 nt, Human
guaguuuuucuugcaagaguag

SEQ ID NO: 87599 - RNA, 22 nt, Human
guaguggaauuuagaguauaau

SEQ ID NO: 87600 - RNA, 22 nt, Human
guaaugcuuuuauuucggggaa

SEQ ID NO: 87601 - RNA, 23 nt, Human
uaaauuuuauucugauaacacag

SEQ ID NO: 87602 - RNA, 22 nt, Human
uaacauuagcuuugcucaugca

SEQ ID NO: 87603 - RNA, 22 nt, Human
guaauaggagggagucugcuuu

SEQ ID NO: 87604 - RNA, 22 nt, Human
guagccauuuucuagagaguua

SEQ ID NO: 87605 - RNA, 22 nt, Human
uaaccuugaagacugagcugac

SEQ ID NO: 87606 - RNA, 22 nt, Human
uaaccuuuuuuaaaguuuccug

SEQ ID NO: 87607 - RNA, 22 nt, Human
ggggauuucccaaugcgaagca

SEQ ID NO: 87608 - RNA, 22 nt, Human
guuaaaaugauuugugauuuau

SEQ ID NO: 87609 - RNA, 17 nt, Human
ggggcguguauuugaug

SEQ ID NO: 87610 - RNA, 22 nt, Human
guuagaauggacaaagcugaaa

SEQ ID NO: 87611 - RNA, 22 nt, Human
ggggcggcgugggcgcggugau

SEQ ID NO: 87612 - RNA, 22 nt, Human
guguugcaggaagauauagcug

SEQ ID NO: 87613 - RNA, 22 nt, Human
guguugaugugucuguauucua

SEQ ID NO: 87614 - RNA, 22 nt, Human
guguuuauguuuuugcuaggga

SEQ ID NO: 87615 - RNA, 21 nt, Human
guguugugagguugguguuag

SEQ ID NO: 87616 - RNA, 22 nt, Human
guuaucauccucagaggcaguu

SEQ ID NO: 87617 - RNA, 22 nt, Human
guuauuaaauauuuuggugauu

SEQ ID NO: 87618 - RNA, 18 nt, Human
guucaagcauuuugcucu

SEQ ID NO: 87619 - RNA, 22 nt, Human
ggguauuugacaaacugacacu

SEQ ID NO: 87620 - RNA, 22 nt, Human
gggguugauaauuagagaaaug

SEQ ID NO: 87621 - RNA, 22 nt, Human
guuauacuuaugugcaaaaaua

SEQ ID NO: 87622 - RNA, 22 nt, Human
gggguauuugguagacauuuug

SEQ ID NO: 87623 - RNA, 22 nt, Human
ggguggugagagaacuuugcag

SEQ ID NO: 87624 - RNA, 22 nt, Human
guucggcuuccuaugucaugag

SEQ ID NO: 87625 - RNA, 22 nt, Human
guuccugagcaguuccuggcca

SEQ ID NO: 87626 - RNA, 22 nt, Human
guucagauucuuucucuuucac

SEQ ID NO: 87627 - RNA, 22 nt, Human
guucaccaguagcugggcuguu

SEQ ID NO: 87628 - RNA, 22 nt, Human
guuccgcggccucgcgcugagc

SEQ ID NO: 87629 - RNA, 22 nt, Human
guucgucuguggugugaggugc

SEQ ID NO: 87630 - RNA, 22 nt, Human
guugauuuaggguuuugguuuu

SEQ ID NO: 87631 - RNA, 22 nt, Human
guugagaagaccauuuuguuca

SEQ ID NO: 87632 - RNA, 22 nt, Human
ggguuuugugauugccucugaa

SEQ ID NO: 87633 - RNA, 22 nt, Human
guucuucucuuguaauggaauc

SEQ ID NO: 87634 - RNA, 22 nt, Human
guucuuuacuucgcaucugcua

SEQ ID NO: 87635 - RNA, 22 nt, Human
ggguuuuggggaggaagugagc

SEQ ID NO: 87636 - RNA, 22 nt, Human
ggguuuuaccagauguguggug

SEQ ID NO: 87637 - RNA, 22 nt, Human
ggguuuccugcucgcggguagc

SEQ ID NO: 87638 - RNA, 22 nt, Human
ggguuguuuguauuucucugaa

SEQ ID NO: 87639 - RNA, 22 nt, Human
ggguguuuuuggugacagggag

SEQ ID NO: 87640 - RNA, 22 nt, Human
ggguuaaauggauggcauuugc

SEQ ID NO: 87641 - RNA, 22 nt, Human
gggcuguuugcauauguuuaua

SEQ ID NO: 87642 - RNA, 22 nt, Human
gggcuguggggccugcagaagg

SEQ ID NO: 87643 - RNA, 22 nt, Human
gugucuuggaacuggaauugag

SEQ ID NO: 87644 - RNA, 22 nt, Human
guguucuucacuguuagaaggu

SEQ ID NO: 87645 - RNA, 22 nt, Human
guguugaaaaguagcacugcuu

SEQ ID NO: 87646 - RNA, 22 nt, Human
ggggaaauauuucugaccugug

SEQ ID NO: 87647 - RNA, 22 nt, Human
guguuaggugcauuaaacgugg

SEQ ID NO: 87648 - RNA, 22 nt, Human
guguuaaucauuuuugauuuug

SEQ ID NO: 87649 - RNA, 22 nt, Human
gggcuuuuccaacacucuggag

SEQ ID NO: 87650 - RNA, 18 nt, Human
gggcuuuacagaguggag

SEQ ID NO: 87651 - RNA, 22 nt, Human
guggucaagaccgggaauagga

SEQ ID NO: 87652 - RNA, 22 nt, Human
gggcggccugcucuguggggag

SEQ ID NO: 87653 - RNA, 22 nt, Human
gggcgcgccaggagcugcgcgg

SEQ ID NO: 87654 - RNA, 22 nt, Human
gugggugauacugccgugggag

SEQ ID NO: 87655 - RNA, 23 nt, Human
gugguguaaaugccaaaaugaaa

SEQ ID NO: 87656 - RNA, 22 nt, Human
gugguuugcugguguacguuua

SEQ ID NO: 87657 - RNA, 22 nt, Human
guggauuucaggcuccccucag

SEQ ID NO: 87658 - RNA, 22 nt, Human
guggauaaguuguuugaccuac

SEQ ID NO: 87659 - RNA, 22 nt, Human
guggccaaggcagagaaagagc

SEQ ID NO: 87660 - RNA, 22 nt, Human
gugggugaguggggccgccuga

SEQ ID NO: 87661 - RNA, 22 nt, Human
gugggagaaugggaggaguaau

SEQ ID NO: 87662 - RNA, 22 nt, Human
ggccuugauuccggucauugaa

SEQ ID NO: 87663 - RNA, 22 nt, Human
ggaaguuaguucuuggcaaagg

SEQ ID NO: 87664 - RNA, 22 nt, Human
gccugcuugaaagcacuuucug

SEQ ID NO: 87665 - RNA, 22 nt, Human
gccuugagcucaugucccagcu

SEQ ID NO: 87666 - RNA, 21 nt, Human
ggacccuuagauuuuaucuga

SEQ ID NO: 87667 - RNA, 22 nt, Human
ggagaaacuaguuagauccaau

SEQ ID NO: 87668 - RNA, 21 nt, Human
gcgcgcucgugcucgacgcgc

SEQ ID NO: 87669 - RNA, 22 nt, Human
ggagcagaggaaagaguagcau

SEQ ID NO: 87670 - RNA, 22 nt, Human
ggagauggucacagguaaacau

SEQ ID NO: 87671 - RNA, 22 nt, Human
ggaugcugcuccacaucccaca

SEQ ID NO: 87672 - RNA, 22 nt, Human
ggaugauuuucaguuguguggg

SEQ ID NO: 87673 - RNA, 22 nt, Human
ggaugauacuuggagaaauauu

SEQ ID NO: 87674 - RNA, 22 nt, Human
ggaucgauuccaaauguagauc

SEQ ID NO: 87675 - RNA, 20 nt, Human
ggagcgggcauuuguguucc

SEQ ID NO: 87676 - RNA, 22 nt, Human
ggauugaagggaaccucagaau

SEQ ID NO: 87677 - RNA, 22 nt, Human
ggcaaagaguacaucguccugg

SEQ ID NO: 87678 - RNA, 22 nt, Human
gcggcuggcuguccaaacuggg

SEQ ID NO: 87679 - RNA, 22 nt, Human
gcuacaaauaaaaugggugacu

SEQ ID NO: 87680 - RNA, 22 nt, Human
gcuauuuagaaaggcuuggaga

SEQ ID NO: 87681 - RNA, 22 nt, Human
ggccuucuuuucaugucuuucg

SEQ ID NO: 87682 - RNA, 22 nt, Human
ggcgccuuguggaaugagagcu

SEQ ID NO: 87683 - RNA, 22 nt, Human
ggcgccugguauucuuccucuc

SEQ ID NO: 87684 - RNA, 22 nt, Human
ggcuauuguuuuaaaaaaugag

SEQ ID NO: 87685 - RNA, 22 nt, Human
ggcggcugcuccuugcccucgg

SEQ ID NO: 87686 - RNA, 23 nt, Human
gcugccguuucccaucgugguga

SEQ ID NO: 87687 - RNA, 22 nt, Human
gcucccaguucccaaagugacc

SEQ ID NO: 87688 - RNA, 22 nt, Human
ggcucccccauggcugacagac

SEQ ID NO: 87689 - RNA, 22 nt, Human
gcugcuuagaaccauauuuaaa

SEQ ID NO: 87690 - RNA, 22 nt, Human
gcuggaagggccagcuuucagg

SEQ ID NO: 87691 - RNA, 22 nt, Human
ggcugaugacgccugagucuga

SEQ ID NO: 87692 - RNA, 22 nt, Human
gcuggauuuaggguucccuccu

SEQ ID NO: 87693 - RNA, 22 nt, Human
gcuguacugucugccaagccag

SEQ ID NO: 87694 - RNA, 22 nt, Human
gcuguccugggaacaggcacua

SEQ ID NO: 87695 - RNA, 21 nt, Human
ggcuguuaauagugauuagaa

SEQ ID NO: 87696 - RNA, 22 nt, Human
ggcuuacgcgcuaacagugaau

SEQ ID NO: 87697 - RNA, 22 nt, Human
ggcuggagcaggcugcacagug

SEQ ID NO: 87698 - RNA, 22 nt, Human
gcugggccucuuacuucuuacg

SEQ ID NO: 87699 - RNA, 22 nt, Human
gcuggguuguucuccuggucca

SEQ ID NO: 87700 - RNA, 22 nt, Human
gguauagacaaauuauauaucc

SEQ ID NO: 87701 - RNA, 20 nt, Human
ggauugaacuauuucucagc

SEQ ID NO: 87702 - RNA, 22 nt, Human
ggguguuaugccucugagucag

SEQ ID NO: 87703 - RNA, 22 nt, Human
gguaauugaaaguuuguugaug

SEQ ID NO: 87704 - RNA, 22 nt, Human
ggauaauguauuuuaaaauggg

SEQ ID NO: 87705 - RNA, 19 nt, Human
ggauaagguuggagugauc

SEQ ID NO: 87706 - RNA, 22 nt, Human
ggauuugaugagacuaucuacu

SEQ ID NO: 87707 - RNA, 22 nt, Human
ggcaagauccagcacaaacaca

SEQ ID NO: 87708 - RNA, 22 nt, Human
ggugcuggggaaauuaggguag

SEQ ID NO: 87709 - RNA, 22 nt, Human
gguguaaucacaagcuggaauu

SEQ ID NO: 87710 - RNA, 22 nt, Human
ggcaggaaguaaggaugcuaca

SEQ ID NO: 87711 - RNA, 22 nt, Human
ggugaucucuggcucugcuugu

SEQ ID NO: 87712 - RNA, 22 nt, Human
guaguuuuugagcuguaaucuu

SEQ ID NO: 87713 - RNA, 22 nt, Human
guaguuuucaugguuagaaaua

SEQ ID NO: 87714 - RNA, 22 nt, Human
ggccgggcaugcgagcugagcg

SEQ ID NO: 87715 - RNA, 22 nt, Human
guacuugauucauuauugcauu

SEQ ID NO: 87716 - RNA, 22 nt, Human
guacuuccauccacauauaugu

SEQ ID NO: 87717 - RNA, 22 nt, Human
guagauaauuuuggaaagcugg

SEQ ID NO: 87718 - RNA, 22 nt, Human
gguuuuccaguagaucagaaga

SEQ ID NO: 87719 - RNA, 22 nt, Human
ggccagcuuugagcugcaggaa

SEQ ID NO: 87720 - RNA, 22 nt, Human
guaauugcucauauggcaccug

SEQ ID NO: 87721 - RNA, 22 nt, Human
gguuuucuuguucauuuuuuaa

SEQ ID NO: 87722 - RNA, 22 nt, Human
guaacuuuuuccucauuggcua

SEQ ID NO: 87723 - RNA, 22 nt, Human
guaaauuaugucugggucaguu

SEQ ID NO: 87724 - RNA, 22 nt, Human
gcuuuuaaauuaucugacaaug

SEQ ID NO: 87725 - RNA, 22 nt, Human
gcuuuguugauggugagucugu

SEQ ID NO: 87726 - RNA, 22 nt, Human
gcuuuucaaguuacaauuagcu

SEQ ID NO: 87727 - RNA, 22 nt, Human
gcuuuucucccugcuuucuucc

SEQ ID NO: 87728 - RNA, 22 nt, Human
gggcaagagaggaagagauggc

SEQ ID NO: 87729 - RNA, 22 nt, Human
ggaaaaucaaaccauuuacagu

SEQ ID NO: 87730 - RNA, 22 nt, Human
ggaaaaugcugaagcaucugaa

SEQ ID NO: 87731 - RNA, 22 nt, Human
gggauguuuugcaggcaaagaa

SEQ ID NO: 87732 - RNA, 22 nt, Human
gggauuaaaaaucaccaaagua

SEQ ID NO: 87733 - RNA, 22 nt, Human
gggcaguuucaugugguucaac

SEQ ID NO: 87734 - RNA, 22 nt, Human
ggaagugagcucauuacuuuag

SEQ ID NO: 87735 - RNA, 23 nt, Human
ggaauuucagaugugaaauaaaa

SEQ ID NO: 87736 - RNA, 22 nt, Human
ggacauagaucuagacuuuaaa

SEQ ID NO: 87737 - RNA, 22 nt, Human
ggcuccccagagcuccuuacuc

SEQ ID NO: 87738 - RNA, 22 nt, Human
ggggacuugguuuuaaugagcu

SEQ ID NO: 87739 - RNA, 22 nt, Human
ggggaauaaacacuuugucacu

SEQ ID NO: 87740 - RNA, 22 nt, Human
ggagacagugacuuagagacug

SEQ ID NO: 87741 - RNA, 22 nt, Human
ggagaggaaguuuaaagaauug

SEQ ID NO: 87742 - RNA, 22 nt, Human
ggagaggaggugagaggaagua

SEQ ID NO: 87743 - RNA, 22 nt, Human
ggagauaugugaaaaagacagc

SEQ ID NO: 87744 - RNA, 22 nt, Human
ggggauuuuucuuacucuuagg

SEQ ID NO: 87745 - RNA, 22 nt, Human
ggagaugaaugugguaaaacug

SEQ ID NO: 87746 - RNA, 22 nt, Human
ggaguucaaaucuggaccuugc

SEQ ID NO: 87747 - RNA, 22 nt, Human
ggaguucacagcaauggaacag

SEQ ID NO: 87748 - RNA, 22 nt, Human
ggauaaaugaaggcauacagau

SEQ ID NO: 87749 - RNA, 22 nt, Human
gcagccagggaccuuugacuau

SEQ ID NO: 87750 - RNA, 22 nt, Human
gcagccaugcacgucauuauga

SEQ ID NO: 87751 - RNA, 22 nt, Human
gcagccaauggcgagccccaca

SEQ ID NO: 87752 - RNA, 22 nt, Human
gcgugcauggccguguguaugc

SEQ ID NO: 87753 - RNA, 22 nt, Human
gcuaaccaaaccuguuguuugg

SEQ ID NO: 87754 - RNA, 22 nt, Human
gcguguauuccagaccuuaacg

SEQ ID NO: 87755 - RNA, 22 nt, Human
gcaguuguagcuguuucuacuc

SEQ ID NO: 87756 - RNA, 22 nt, Human
gcucaaggucacacagggguga

SEQ ID NO: 87757 - RNA, 22 nt, Human
gcucgauugucaguguuaggga

SEQ ID NO: 87758 - RNA, 23 nt, Human
gcucugauaccagcuacaucuag

SEQ ID NO: 87759 - RNA, 22 nt, Human
gcugagaguguaggauguuuac

SEQ ID NO: 87760 - RNA, 23 nt, Human
gcauuugcaggaaacuggaaaag

SEQ ID NO: 87761 - RNA, 22 nt, Human
gcauuuuaauuggggcaguuag

SEQ ID NO: 87762 - RNA, 20 nt, Human
gccaaggaggagaaacaggc

SEQ ID NO: 87763 - RNA, 22 nt, Human
gcugcgcgcagccggcgccgag

SEQ ID NO: 87764 - RNA, 22 nt, Human
gccauguuuugguaaauaccau

SEQ ID NO: 87765 - RNA, 21 nt, Human
gcuggcugucucuuacacggu

SEQ ID NO: 87766 - RNA, 22 nt, Human
gccaugguggggccucccugac

SEQ ID NO: 87767 - RNA, 22 nt, Human
gccaguuuguuuacugaugguu

SEQ ID NO: 87768 - RNA, 22 nt, Human
gcuggaaauaacuuguguagaa

SEQ ID NO: 87769 - RNA, 22 nt, Human
gauuccuuucgccugccgagcu

SEQ ID NO: 87770 - RNA, 18 nt, Human
gccgccuugcucgugaac

SEQ ID NO: 87771 - RNA, 22 nt, Human
gauguaucugagcugcuuaggu

SEQ ID NO: 87772 - RNA, 22 nt, Human
gauugcaucaauauuuagagua

SEQ ID NO: 87773 - RNA, 22 nt, Human
gauuggucacacaauaguauau

SEQ ID NO: 87774 - RNA, 22 nt, Human
gauugggagugugacauuguau

SEQ ID NO: 87775 - RNA, 22 nt, Human
gccuuuauauuacauuuggaag

SEQ ID NO: 87776 - RNA, 22 nt, Human
gccugggauuggggauuuuuug

SEQ ID NO: 87777 - RNA, 22 nt, Human
gccuggcagggagauuguaaga

SEQ ID NO: 87778 - RNA, 22 nt, Human
gcaagagaagaaagaauaguuu

SEQ ID NO: 87779 - RNA, 22 nt, Human
gcacacaagagauuguuauugc

SEQ ID NO: 87780 - RNA, 22 nt, Human
gcaaagaauugauucauuuugc

SEQ ID NO: 87781 - RNA, 22 nt, Human
gccucucagagcuguucaguuu

SEQ ID NO: 87782 - RNA, 22 nt, Human
gauuugucuauauucaaauaug

SEQ ID NO: 87783 - RNA, 22 nt, Human
gauuuuaaaagauguauaaggu

SEQ ID NO: 87784 - RNA, 21 nt, Human
gauuuuagggcagccaaacac

SEQ ID NO: 87785 - RNA, 22 nt, Human
gagguuauucuucuaucaguau

SEQ ID NO: 87786 - RNA, 22 nt, Human
gcauucuugucaguggggucag

SEQ ID NO: 87787 - RNA, 22 nt, Human
gcauugcuauuucuguuagugu

SEQ ID NO: 87788 - RNA, 22 nt, Human
gcauuagacuaguacacggcag

SEQ ID NO: 87789 - RNA, 22 nt, Human
gcauguucaaguuaguauauuu

SEQ ID NO: 87790 - RNA, 22 nt, Human
gcaugguuagacaucaauguga

SEQ ID NO: 87791 - RNA, 22 nt, Human
gauggauuuuuuauuaaaucag

SEQ ID NO: 87792 - RNA, 22 nt, Human
gaugauugaauaaauaugguca

SEQ ID NO: 87793 - RNA, 22 nt, Human
gccauggugagccaccuggugg

SEQ ID NO: 87794 - RNA, 22 nt, Human
gaugaaguaguccacuggaagg

SEQ ID NO: 87795 - RNA, 22 nt, Human
gauauuuugugaaaaaacaacu

SEQ ID NO: 87796 - RNA, 22 nt, Human
gauauucauaggcagguauuua

SEQ ID NO: 87797 - RNA, 22 nt, Human
gcagagcacccugcagugguau

SEQ ID NO: 87798 - RNA, 22 nt, Human
gcaggaaugguacauaccuguu

SEQ ID NO: 87799 - RNA, 22 nt, Human
gcaggagggggccuggagccca

SEQ ID NO: 87800 - RNA, 21 nt, Human
gcagcucaggauauagacuug

SEQ ID NO: 87801 - RNA, 22 nt, Human
gcagccugaguuuagcucgucg

SEQ ID NO: 87802 - RNA, 22 nt, Human
gcagcguguggcuaauggcucu

SEQ ID NO: 87803 - RNA, 22 nt, Human
gaggcagaggaugggacuguau

SEQ ID NO: 87804 - RNA, 22 nt, Human
gaggauuugagggucacuccac

SEQ ID NO: 87805 - RNA, 22 nt, Human
gaggaugacaaagaaggcagac

SEQ ID NO: 87806 - RNA, 22 nt, Human
gaggcuugccacuguccauggc

SEQ ID NO: 87807 - RNA, 22 nt, Human
gagggaaaggggccaugauugg

SEQ ID NO: 87808 - RNA, 22 nt, Human
gcacagaguguaaaaguuucau

SEQ ID NO: 87809 - RNA, 21 nt, Human
gcacaacucucacauucuucu

SEQ ID NO: 87810 - RNA, 22 nt, Human
gcacaaaagguacuucauguag

SEQ ID NO: 87811 - RNA, 22 nt, Human
gaggaaagcugguuuaaaguau

SEQ ID NO: 87812 - RNA, 22 nt, Human
gaggacuucaggccuggccagg

SEQ ID NO: 87813 - RNA, 22 nt, Human
gaggagaaacagccgugauagu

SEQ ID NO: 87814 - RNA, 22 nt, Human
gcaaggacagaagcccacacag

SEQ ID NO: 87815 - RNA, 22 nt, Human
gaggagagcuggccagguuucu

SEQ ID NO: 87816 - RNA, 22 nt, Human
gcaauuggaaugaauucuauuu

SEQ ID NO: 87817 - RNA, 22 nt, Human
gauguuuugaaagaagaauaca

SEQ ID NO: 87818 - RNA, 22 nt, Human
gauuaagaaagauagaugugga

SEQ ID NO: 87819 - RNA, 22 nt, Human
gauuaagauuacauauuuaagu

SEQ ID NO: 87820 - RNA, 22 nt, Human
gauucuaucauucuguauauua

SEQ ID NO: 87821 - RNA, 22 nt, Human
gauucugaaauuaacagacugg

SEQ ID NO: 87822 - RNA, 22 nt, Human
gauugauguaggugauaaaucu

SEQ ID NO: 87823 - RNA, 22 nt, Human
gagcagucuuugaaaggcacca

SEQ ID NO: 87824 - RNA, 22 nt, Human
gauuguagacauauuagacugc

SEQ ID NO: 87825 - RNA, 20 nt, Human
gauuuaacgcugcgucuguc

SEQ ID NO: 87826 - RNA, 22 nt, Human
gauugauuuaauaugagaggau

SEQ ID NO: 87827 - RNA, 22 nt, Human
gauuucuucauuuaaaaauauu

SEQ ID NO: 87828 - RNA, 22 nt, Human
gauuuucauuauagcuaguuuc

SEQ ID NO: 87829 - RNA, 22 nt, Human
gagcgcacagaaggaagcagcc

SEQ ID NO: 87830 - RNA, 22 nt, Human
gagcgacucuuuuaguccagag

SEQ ID NO: 87831 - RNA, 22 nt, Human
gauuucauaaaacgagaaacuc

SEQ ID NO: 87832 - RNA, 22 nt, Human
gauuuuuaaaaguaguuuugaa

SEQ ID NO: 87833 - RNA, 22 nt, Human
gagcguuucccugggggucugc

SEQ ID NO: 87834 - RNA, 22 nt, Human
gagcgugaggcagcuuucuaag

SEQ ID NO: 87835 - RNA, 22 nt, Human
gagcggcucaguggccauguga

SEQ ID NO: 87836 - RNA, 22 nt, Human
gagcggcggugagaaguguggg

SEQ ID NO: 87837 - RNA, 22 nt, Human
gaugucauguuggcagacaguu

SEQ ID NO: 87838 - RNA, 22 nt, Human
gagcacugagcuggaauuggag

SEQ ID NO: 87839 - RNA, 22 nt, Human
gauggguuugagauguuugggu

SEQ ID NO: 87840 - RNA, 22 nt, Human
gaugguggaggaaucgcugaag

SEQ ID NO: 87841 - RNA, 22 nt, Human
gagauggauuuuuuugccaguc

SEQ ID NO: 87842 - RNA, 22 nt, Human
gaugggaaggugguaaaguuua

SEQ ID NO: 87843 - RNA, 22 nt, Human
gagagugggagauuuccagcag

SEQ ID NO: 87844 - RNA, 22 nt, Human
gagagucuuaaguuacagaacu

SEQ ID NO: 87845 - RNA, 22 nt, Human
gaugcucuugauuggaccaggg

SEQ ID NO: 87846 - RNA, 22 nt, Human
gaugcuaauuaaugaagaggag

SEQ ID NO: 87847 - RNA, 22 nt, Human
gaugauaacagcauuucaacug

SEQ ID NO: 87848 - RNA, 22 nt, Human
gaugcauccuuucugucuucuc

SEQ ID NO: 87849 - RNA, 22 nt, Human
gagacugugucugucaagcuag

SEQ ID NO: 87850 - RNA, 22 nt, Human
gagagagacugggaaaucauca

SEQ ID NO: 87851 - RNA, 22 nt, Human
gaugauuuuguaacuggggaca

SEQ ID NO: 87852 - RNA, 22 nt, Human
gaagauuauuacucauugcagg

SEQ ID NO: 87853 - RNA, 20 nt, Human
gagaauuccagguuucugug

SEQ ID NO: 87854 - RNA, 22 nt, Human
gagcccuguagcaagucauguc

SEQ ID NO: 87855 - RNA, 22 nt, Human
aaaaccugcaagaugaaaucag

SEQ ID NO: 87856 - RNA, 22 nt, Human
aaaacauuuaggguuuuuuuua

SEQ ID NO: 87857 - RNA, 22 nt, Human
aaaagggucugacacugcuuga

SEQ ID NO: 87858 - RNA, 22 nt, Human
aaaauaauauuauaccacugcu

SEQ ID NO: 87859 - RNA, 22 nt, Human
aaaagguuauagcuuugccuug

SEQ ID NO: 87860 - RNA, 22 nt, Human
aaaagcauuauuagucugggug

SEQ ID NO: 87861 - RNA, 22 nt, Human
aaaaggaacaauaugguauuuu

SEQ ID NO: 87862 - RNA, 22 nt, Human
aaaaggacaguagccuugaggu

SEQ ID NO: 87863 - RNA, 22 nt, Human
aaacaaauccaauaauaaaauu

SEQ ID NO: 87864 - RNA, 22 nt, Human
aaacaauaauaauuaggaagga

SEQ ID NO: 87865 - RNA, 22 nt, Human
aaaaugggaaaauuuuagauua

SEQ ID NO: 87866 - RNA, 18 nt, Human
aaacgguuucaugcugua

SEQ ID NO: 87867 - RNA, 22 nt, Human
aaaaucucagaaaaguuuaggu

SEQ ID NO: 87868 - RNA, 22 nt, Human
aaaauuuccuuggaccauuuuu

SEQ ID NO: 87869 - RNA, 22 nt, Human
aaaaggucacuguaaaaugacg

SEQ ID NO: 87870 - RNA, 22 nt, Human
aaaagguauuuagcgauugcau

SEQ ID NO: 87871 - RNA, 22 nt, Human
aaaauauucuauaucaaagaua

SEQ ID NO: 87872 - RNA, 17 nt, Human
aaaaucaaaggaggugc

SEQ ID NO: 87873 - RNA, 22 nt, Human
aaaauauuuaucuagcucuuaa

SEQ ID NO: 87874 - RNA, 22 nt, Human
aaagagacaacaacaacuucua

SEQ ID NO: 87875 - RNA, 22 nt, Human
aaagaugucauacacauuaaga

SEQ ID NO: 87876 - RNA, 22 nt, Human
aaagacagccuguuggcuuucu

SEQ ID NO: 87877 - RNA, 22 nt, Human
aaagagugugcauguaccugug

SEQ ID NO: 87878 - RNA, 23 nt, Human
aaagaggugaauccaggacaagc

SEQ ID NO: 87879 - RNA, 22 nt, Human
aaagcauucuaaccgaucgacg

SEQ ID NO: 87880 - RNA, 22 nt, Human
aaagcagucuguuuuaaccuga

SEQ ID NO: 87881 - RNA, 22 nt, Human
aaagaggacgugcuauuuuuua

SEQ ID NO: 87882 - RNA, 22 nt, Human
aaacuuuugaaggaggaaaaag

SEQ ID NO: 87883 - RNA, 23 nt, Human
aaacuacauuuauaguuuuucuc

SEQ ID NO: 87884 - RNA, 22 nt, Human
aaacagcugcaguacacggccu

SEQ ID NO: 87885 - RNA, 22 nt, Human
aaagaacguuucugggaaucag

SEQ ID NO: 87886 - RNA, 21 nt, Human
aaagaagagcucagagguaga

SEQ ID NO: 87887 - RNA, 22 nt, Human
aaaggaaacuaugaaucucugg

SEQ ID NO: 87888 - RNA, 22 nt, Human
aaagccauaucuauucuauucu

SEQ ID NO: 87889 - RNA, 22 nt, Human
aaagccaagguccauguacuuu

SEQ ID NO: 87890 - RNA, 22 nt, Human
aaaggcaugugcaacuacaaau

SEQ ID NO: 87891 - RNA, 22 nt, Human
aaagggcugaaguagucucugu

SEQ ID NO: 87892 - RNA, 22 nt, Human
aaaguaaagccuauuuaauaau

SEQ ID NO: 87893 - RNA, 22 nt, Human
aaagguguagacucaguuaugc

SEQ ID NO: 87894 - RNA, 22 nt, Human
aaagaugaaguucagcgaagaa

SEQ ID NO: 87895 - RNA, 22 nt, Human
aaagaucaguuaacgccaucaa

SEQ ID NO: 87896 - RNA, 22 nt, Human
aaagccagggacagugugcaug

SEQ ID NO: 87897 - RNA, 22 nt, Human
aaagccaagucugauuuuguug

SEQ ID NO: 87898 - RNA, 22 nt, Human
aaagcaaauaguugcuuaauau

SEQ ID NO: 87899 - RNA, 22 nt, Human
aaagcaaagaucuguagcccaa

SEQ ID NO: 87900 - RNA, 22 nt, Human
aaagcagguugcaauuacagug

SEQ ID NO: 87901 - RNA, 22 nt, Human
aaagcugaaacgaaaugacaac

SEQ ID NO: 87902 - RNA, 22 nt, Human
aaaggagugaaaugagaggaaa

SEQ ID NO: 87903 - RNA, 22 nt, Human
aaagggagauaaaguaauuuua

SEQ ID NO: 87904 - RNA, 17 nt, Human
aaagccgaucagauguu

SEQ ID NO: 87905 - RNA, 22 nt, Human
aaaguguuuaacaaauugcuuu

SEQ ID NO: 87906 - RNA, 22 nt, Human
aaaguuaauucuuguuuuuuau

SEQ ID NO: 87907 - RNA, 22 nt, Human
aaaguuacacgacuauuuaugu

SEQ ID NO: 87908 - RNA, 23 nt, Human
aaaguacuuaaucugcaaaccac

SEQ ID NO: 87909 - RNA, 22 nt, Human
aaagggaugauuucugaagaua

SEQ ID NO: 87910 - RNA, 22 nt, Human
aaaggucagaugugucgaggag

SEQ ID NO: 87911 - RNA, 22 nt, Human
aaaguuacccaaucucuaugaa

SEQ ID NO: 87912 - RNA, 22 nt, Human
aaaguagaauaauaaacccuug

SEQ ID NO: 87913 - RNA, 22 nt, Human
aaauaggucaaucagacuauga

SEQ ID NO: 87914 - RNA, 22 nt, Human
aaauaggaguagugauguauua

SEQ ID NO: 87915 - RNA, 22 nt, Human
aaauagauuugacuacuuggug

SEQ ID NO: 87916 - RNA, 22 nt, Human
aaaucaaaagugguuauuuuau

SEQ ID NO: 87917 - RNA, 22 nt, Human
aaaucgcuugaacccaggaagu

SEQ ID NO: 87918 - RNA, 22 nt, Human
aaaucccacucacgaguuuugc

SEQ ID NO: 87919 - RNA, 20 nt, Human
aaauccuugggaguggugca

SEQ ID NO: 87920 - RNA, 22 nt, Human
aaauauauauaauauauauauu

SEQ ID NO: 87921 - RNA, 21 nt, Human
aaagugguaaggauuauuuug

SEQ ID NO: 87922 - RNA, 22 nt, Human
aaaguagaugagaauuuuguug

SEQ ID NO: 87923 - RNA, 22 nt, Human
aaagucgugucagaaguuggga

SEQ ID NO: 87924 - RNA, 22 nt, Human
aaaguugcauccuaugaccuca

SEQ ID NO: 87925 - RNA, 22 nt, Human
aaauauuaaugaugaagguagu

SEQ ID NO: 87926 - RNA, 22 nt, Human
aacaggaagaauccagauggug

SEQ ID NO: 87927 - RNA, 22 nt, Human
aacaaagaacuuucuuccuuug

SEQ ID NO: 87928 - RNA, 22 nt, Human
aacaugggcaacuucuuuucag

SEQ ID NO: 87929 - RNA, 22 nt, Human
aacauuuccggccuuuuguucu

SEQ ID NO: 87930 - RNA, 19 nt, Human
aacaaaauaguucuaguua

SEQ ID NO: 87931 - RNA, 22 nt, Human
aacaaagaaaagcuugagguuu

SEQ ID NO: 87932 - RNA, 21 nt, Human
aacaaaagggaagaacagcug

SEQ ID NO: 87933 - RNA, 22 nt, Human
aacagaauaucaaaagauuaug

SEQ ID NO: 87934 - RNA, 22 nt, Human
aacaaccuaguaguaucuuuca

SEQ ID NO: 87935 - RNA, 22 nt, Human
aaauuuauaacuuaaagugaau

SEQ ID NO: 87936 - RNA, 22 nt, Human
aaauugcauuuuaaagguagau

SEQ ID NO: 87937 - RNA, 22 nt, Human
aaaugucugagacuucugaacu

SEQ ID NO: 87938 - RNA, 22 nt, Human
aaauuagucacaccagugucuu

SEQ ID NO: 87939 - RNA, 22 nt, Human
aaaucuuccugaaauuuguuca

SEQ ID NO: 87940 - RNA, 22 nt, Human
aaaucuuucacauauuuuuuau

SEQ ID NO: 87941 - RNA, 22 nt, Human
aaauauuugaaugguguaagau

SEQ ID NO: 87942 - RNA, 22 nt, Human
aaauuaacuaucacuuuuguga

SEQ ID NO: 87943 - RNA, 22 nt, Human
aaauguauuagccuaugugaga

SEQ ID NO: 87944 - RNA, 22 nt, Human
aaauguaaacuguauuuauaaa

SEQ ID NO: 87945 - RNA, 22 nt, Human
aaaucaagucagcugaauucca

SEQ ID NO: 87946 - RNA, 22 nt, Human
aaaucauagccaugaacauuug

SEQ ID NO: 87947 - RNA, 22 nt, Human
aaauauuagacauaccuggaga

SEQ ID NO: 87948 - RNA, 22 nt, Human
aaauauagugacacuuauaguc

SEQ ID NO: 87949 - RNA, 22 nt, Human
aaauauauccuucuguccugcc

SEQ ID NO: 87950 - RNA, 22 nt, Human
aaugcuaaagaagaaggaguag

SEQ ID NO: 87951 - RNA, 22 nt, Human
aaucuacaaugaaaaaauguuu

SEQ ID NO: 87952 - RNA, 22 nt, Human
aauccucguagugguuagaaag

SEQ ID NO: 87953 - RNA, 22 nt, Human
aaucauaacaaaagcaauuaua

SEQ ID NO: 87954 - RNA, 22 nt, Human
aaucaugagguguuucuuugca

SEQ ID NO: 87955 - RNA, 22 nt, Human
aauggacuucucugagccuguu

SEQ ID NO: 87956 - RNA, 22 nt, Human
aauggaaaaauccacagggaac

SEQ ID NO: 87957 - RNA, 22 nt, Human
aauggaaaaagaacuguuuaaa

SEQ ID NO: 87958 - RNA, 23 nt, Human
aaugggcggaaguguuaaguugc

SEQ ID NO: 87959 - RNA, 22 nt, Human
aauggaugauuaaauggaugaa

SEQ ID NO: 87960 - RNA, 22 nt, Human
aauggcaaaaguuucggaaauu

SEQ ID NO: 87961 - RNA, 22 nt, Human
aauuaaggccuuuaaaugucuu

SEQ ID NO: 87962 - RNA, 22 nt, Human
aauguuuuucaaguguggagca

SEQ ID NO: 87963 - RNA, 22 nt, Human
aauuaaauguuugguuugagcu

SEQ ID NO: 87964 - RNA, 22 nt, Human
aauuauuauguggaagacgacg

SEQ ID NO: 87965 - RNA, 22 nt, Human
aauuauuaucauuaucuuccug

SEQ ID NO: 87966 - RNA, 22 nt, Human
aauuauguuugcuuuagaugga

SEQ ID NO: 87967 - RNA, 22 nt, Human
aaugugcugguaacugcuuugc

SEQ ID NO: 87968 - RNA, 22 nt, Human
aaugugguauuuuggcauucuu

SEQ ID NO: 87969 - RNA, 23 nt, Human
aaugugaaauugaguuuuuguua

SEQ ID NO: 87970 - RNA, 22 nt, Human
aaugugcauaacuuuauaaauu

SEQ ID NO: 87971 - RNA, 22 nt, Human
aauguauuuuuaggcagaauau

SEQ ID NO: 87972 - RNA, 22 nt, Human
aaugggauuaagaaagaucuug

SEQ ID NO: 87973 - RNA, 22 nt, Human
aauggcuagcauguaaaauauc

SEQ ID NO: 87974 - RNA, 22 nt, Human
aauuuuagcuaaagauccaugg

SEQ ID NO: 87975 - RNA, 22 nt, Human
aauuuuauuagacaggcauaau

SEQ ID NO: 87976 - RNA, 22 nt, Human
aauuuuauuuuuuccccuagau

SEQ ID NO: 87977 - RNA, 22 nt, Human
acaaaaauauuguagaagugcu

SEQ ID NO: 87978 - RNA, 18 nt, Human
acaaaaauagugcuuugg

SEQ ID NO: 87979 - RNA, 22 nt, Human
aauuucuuuagagguacugauc

SEQ ID NO: 87980 - RNA, 22 nt, Human
aauuucuuucagcugcuuuaag

SEQ ID NO: 87981 - RNA, 22 nt, Human
aauuugcuccaaugucaguucu

SEQ ID NO: 87982 - RNA, 22 nt, Human
acaacagaacuccugggauuuu

SEQ ID NO: 87983 - RNA, 22 nt, Human
acaaacugggauaggauccugu

SEQ ID NO: 87984 - RNA, 22 nt, Human
acaacccacacguuccgggugg

SEQ ID NO: 87985 - RNA, 22 nt, Human
acaaccaugucaguucaaacca

SEQ ID NO: 87986 - RNA, 22 nt, Human
acaaagugaaaagcaucgaauu

SEQ ID NO: 87987 - RNA, 22 nt, Human
aauuggagaguugugaaaggau

SEQ ID NO: 87988 - RNA, 22 nt, Human
acaaauuuaaauguugucuguu

SEQ ID NO: 87989 - RNA, 21 nt, Human
aauuauuugcauuuuucuugu

SEQ ID NO: 87990 - RNA, 22 nt, Human
aauuauucaugucugggcagcc

SEQ ID NO: 87991 - RNA, 21 nt, Human
aauugccuaauauaugggaag

SEQ ID NO: 87992 - RNA, 22 nt, Human
aauuauucucucaacugagaug

SEQ ID NO: 87993 - RNA, 22 nt, Human
aauucugcagucguacuauaau

SEQ ID NO: 87994 - RNA, 22 nt, Human
aauugaggaaccuuagggcaaa

SEQ ID NO: 87995 - RNA, 22 nt, Human
aauugcauucauuuguauauuu

SEQ ID NO: 87996 - RNA, 22 nt, Human
aauugcuuucacaaguguuaua

SEQ ID NO: 87997 - RNA, 20 nt, Human
aauuuagaguuuuaccaagg

SEQ ID NO: 87998 - RNA, 22 nt, Human
aauuuauccuuuugcuaaagca

SEQ ID NO: 87999 - RNA, 22 nt, Human
aauuucagaccaacgagucagg

SEQ ID NO: 88000 - RNA, 22 nt, Human
aauuuaauugguuuuuacuugu

SEQ ID NO: 88001 - RNA, 22 nt, Human
aauuuaaguuauugcuaaugug

SEQ ID NO: 88002 - RNA, 22 nt, Human
aauuguuagaaaugacuguuuu

SEQ ID NO: 88003 - RNA, 22 nt, Human
aauugguuugaauaaauaaaga

SEQ ID NO: 88004 - RNA, 22 nt, Human
aauugugagaguuagagagcau

SEQ ID NO: 88005 - RNA, 22 nt, Human
acaagaaaggucugggaacaau

SEQ ID NO: 88006 - RNA, 22 nt, Human
acaaggaagaaaacauuacuuu

SEQ ID NO: 88007 - RNA, 21 nt, Human
acaaugaguuugaggcaucag

SEQ ID NO: 88008 - RNA, 20 nt, Human
acaacuuaguugagagacua

SEQ ID NO: 88009 - RNA, 17 nt, Human
acaaugggcaacaauau

SEQ ID NO: 88010 - RNA, 22 nt, Human
acacuuuugcgagagcaugcag

SEQ ID NO: 88011 - RNA, 22 nt, Human
acagaucugcacagugaacaau

SEQ ID NO: 88012 - RNA, 22 nt, Human
acagacuugaccuuggagaggc

SEQ ID NO: 88013 - RNA, 22 nt, Human
acagaauugggguucuugggga

SEQ ID NO: 88014 - RNA, 22 nt, Human
acagacuuaguauccugcugcu

SEQ ID NO: 88015 - RNA, 23 nt, Human
acagcaagaggaccagaugugag

SEQ ID NO: 88016 - RNA, 22 nt, Human
acagccaacgucuuucuuacuu

SEQ ID NO: 88017 - RNA, 22 nt, Human
acagacuuuuagacuuaugagu

SEQ ID NO: 88018 - RNA, 22 nt, Human
acagcuauuuaaaggcuuuagg

SEQ ID NO: 88019 - RNA, 22 nt, Human
acagcucaggcccaucaacccc

SEQ ID NO: 88020 - RNA, 22 nt, Human
acagguuucuccccugguuauu

SEQ ID NO: 88021 - RNA, 22 nt, Human
acagguauuaugaagccuauuu

SEQ ID NO: 88022 - RNA, 22 nt, Human
acauaaauagcacugugaauuu

SEQ ID NO: 88023 - RNA, 22 nt, Human
acaguguuacuugauaguguau

SEQ ID NO: 88024 - RNA, 22 nt, Human
aaggaaaaccugacugaagaac

SEQ ID NO: 88025 - RNA, 22 nt, Human
aaggacaaaacagcuguucuaa

SEQ ID NO: 88026 - RNA, 22 nt, Human
aagggaaaagcugaaugagaug

SEQ ID NO: 88027 - RNA, 22 nt, Human
aaggcuguuugagcacuggagc

SEQ ID NO: 88028 - RNA, 22 nt, Human
aagguauaucuuuaaaagugaa

SEQ ID NO: 88029 - RNA, 22 nt, Human
aagggaggguaggaagagggag

SEQ ID NO: 88030 - RNA, 22 nt, Human
aaguagaaaaccgcacuggacu

SEQ ID NO: 88031 - RNA, 22 nt, Human
aaguaauuugugaaggcauguu

SEQ ID NO: 88032 - RNA, 19 nt, Human
aaguauagucagccuucua

SEQ ID NO: 88033 - RNA, 22 nt, Human
aaguagccuguuauguaguuca

SEQ ID NO: 88034 - RNA, 22 nt, Human
aaguccgggcagcaggaauucu

SEQ ID NO: 88035 - RNA, 22 nt, Human
aagugagaugggagucagagga

SEQ ID NO: 88036 - RNA, 22 nt, Human
aagugauauaaaucgagaggga

SEQ ID NO: 88037 - RNA, 22 nt, Human
aagugauuuagagagcucuuag

SEQ ID NO: 88038 - RNA, 22 nt, Human
aagugaagccaauuuuuuuagg

SEQ ID NO: 88039 - RNA, 22 nt, Human
aagugaaaaaagucaguacuga

SEQ ID NO: 88040 - RNA, 22 nt, Human
aagucuguucuacagcaccaga

SEQ ID NO: 88041 - RNA, 22 nt, Human
aauaaagcuugaaagcagggaa

SEQ ID NO: 88042 - RNA, 16 nt, Human
aaguuuuaucuucuca

SEQ ID NO: 88043 - RNA, 21 nt, Human
aaguuucucccuaauuguugc

SEQ ID NO: 88044 - RNA, 20 nt, Human
aauaaauauaacccauaauu

SEQ ID NO: 88045 - RNA, 21 nt, Human
aaguuuuggcuguacaguugu

SEQ ID NO: 88046 - RNA, 22 nt, Human
aauaagaguuaagaaguauauu

SEQ ID NO: 88047 - RNA, 22 nt, Human
aauaauacaugugaugagaauu

SEQ ID NO: 88048 - RNA, 22 nt, Human
aagugauuuuccuacuugcuaa

SEQ ID NO: 88049 - RNA, 22 nt, Human
aaguuuaagguagugaugauga

SEQ ID NO: 88050 - RNA, 22 nt, Human
aaguucuuauguucugaugugc

SEQ ID NO: 88051 - RNA, 22 nt, Human
aauaucuugaguuauaaauuca

SEQ ID NO: 88052 - RNA, 22 nt, Human
aauaugaugccaaauugcuaca

SEQ ID NO: 88053 - RNA, 22 nt, Human
aauagcaauuacccuucaacuc

SEQ ID NO: 88054 - RNA, 22 nt, Human
aauauuuaaauagaauuacauc

SEQ ID NO: 88055 - RNA, 22 nt, Human
aauaauuuuuuugugauuaugu

SEQ ID NO: 88056 - RNA, 22 nt, Human
aauaaugguuugauucucacau

SEQ ID NO: 88057 - RNA, 22 nt, Human
aauagcuuuuuguuugguguau

SEQ ID NO: 88058 - RNA, 22 nt, Human
aauagagacaguuuaacaauau

SEQ ID NO: 88059 - RNA, 22 nt, Human
aaucaaauuucuugugguuguu

SEQ ID NO: 88060 - RNA, 22 nt, Human
aaucacuggcuccucacggcaa

SEQ ID NO: 88061 - RNA, 22 nt, Human
aaucaauuauccauuuguuagu

SEQ ID NO: 88062 - RNA, 22 nt, Human
aauaugucacacuccuuaauag

SEQ ID NO: 88063 - RNA, 22 nt, Human
aaucaucuguuguucccuugga

SEQ ID NO: 88064 - RNA, 22 nt, Human
aauaugcaaagcguguuaucug

SEQ ID NO: 88065 - RNA, 22 nt, Human
aaucacuuagaacccaggaagu

SEQ ID NO: 88066 - RNA, 22 nt, Human
aagcaauucacaguucacuuaa

SEQ ID NO: 88067 - RNA, 22 nt, Human
aagcaaaaucgcaucuggggcc

SEQ ID NO: 88068 - RNA, 22 nt, Human
aagcaaaugguauugguauuau

SEQ ID NO: 88069 - RNA, 22 nt, Human
aagcaugagguggugagugaca

SEQ ID NO: 88070 - RNA, 22 nt, Human
aaggaaaguuaagguaaacucu

SEQ ID NO: 88071 - RNA, 22 nt, Human
aaggaaaaaauggcuugugaua

SEQ ID NO: 88072 - RNA, 22 nt, Human
aagcugcagacccccugucuca

SEQ ID NO: 88073 - RNA, 18 nt, Human
aaggaggaaugaauagca

SEQ ID NO: 88074 - RNA, 22 nt, Human
aaggaucuuucuuuuuaccauu

SEQ ID NO: 88075 - RNA, 22 nt, Human
aaggaguggugaagucagaugu

SEQ ID NO: 88076 - RNA, 22 nt, Human
aaggcgaggggcacagcugaga

SEQ ID NO: 88077 - RNA, 22 nt, Human
aaggccuaggaguugacauggg

SEQ ID NO: 88078 - RNA, 22 nt, Human
aagaaaccauauuaguuccugg

SEQ ID NO: 88079 - RNA, 22 nt, Human
aaccaauaagaggaugccauuu

SEQ ID NO: 88080 - RNA, 22 nt, Human
aagaacaacugcuuuaaaagca

SEQ ID NO: 88081 - RNA, 22 nt, Human
aagaacaugggugugggcauuc

SEQ ID NO: 88082 - RNA, 22 nt, Human
aagaaauagauagaggaauacu

SEQ ID NO: 88083 - RNA, 22 nt, Human
aagaagagaauauauuuacguc

SEQ ID NO: 88084 - RNA, 22 nt, Human
aagaagcuacugucacuaucag

SEQ ID NO: 88085 - RNA, 22 nt, Human
aagagaaagggaaaaugguaaa

SEQ ID NO: 88086 - RNA, 22 nt, Human
aagaccacaggaaucaaacagg

SEQ ID NO: 88087 - RNA, 22 nt, Human
aagaagguugaaugacuacuuu

SEQ ID NO: 88088 - RNA, 22 nt, Human
aagaggauuuuaguuugccaga

SEQ ID NO: 88089 - RNA, 20 nt, Human
aagacacuguccccacugga

SEQ ID NO: 88090 - RNA, 22 nt, Human
aagacagaaaagcagagagagg

SEQ ID NO: 88091 - RNA, 22 nt, Human
aagaugaucagagggcaagagg

SEQ ID NO: 88092 - RNA, 22 nt, Human
aagauauauaaggaaguucagu

SEQ ID NO: 88093 - RNA, 23 nt, Human
aagcaacagacuucaucagauau

SEQ ID NO: 88094 - RNA, 21 nt, Human
aagcagcugcagaauuucagu

SEQ ID NO: 88095 - RNA, 22 nt, Human
aagcagcauaugacagcaucca

SEQ ID NO: 88096 - RNA, 22 nt, Human
aagaugaguuacaaaggaguaa

SEQ ID NO: 88097 - RNA, 22 nt, Human
aagcaaaagguuacacuucugg

SEQ ID NO: 88098 - RNA, 22 nt, Human
aagcaaagucaucuagaguagu

SEQ ID NO: 88099 - RNA, 22 nt, Human
aguucugacucugaaucuggga

SEQ ID NO: 88100 - RNA, 22 nt, Human
aguucucaagguuaggaaaagu

SEQ ID NO: 88101 - RNA, 22 nt, Human
aguucccuguuuuuuuccacug

SEQ ID NO: 88102 - RNA, 22 nt, Human
aguuggcauuuuauuuaaguau

SEQ ID NO: 88103 - RNA, 22 nt, Human
aguugcuucccuauucuuagca

SEQ ID NO: 88104 - RNA, 22 nt, Human
aguugguauuuacugcaguugg

SEQ ID NO: 88105 - RNA, 22 nt, Human
aguugggaaaugcugcaguagu

SEQ ID NO: 88106 - RNA, 22 nt, Human
aguuuggauccugcuaaaccag

SEQ ID NO: 88107 - RNA, 22 nt, Human
aguuuggaggagaaagugcggg

SEQ ID NO: 88108 - RNA, 23 nt, Human
aguuuacguauucauucuuacuc

SEQ ID NO: 88109 - RNA, 22 nt, Human
aguuuuugagaauucuucugaa

SEQ ID NO: 88110 - RNA, 22 nt, Human
aguuuuuaacgccauguuugaa

SEQ ID NO: 88111 - RNA, 22 nt, Human
aguuguuuuucuuagauuuuag

SEQ ID NO: 88112 - RNA, 22 nt, Human
aguuguucucagcagaagaacu

SEQ ID NO: 88113 - RNA, 22 nt, Human
auaaguuauuuuaguaaaucag

SEQ ID NO: 88114 - RNA, 22 nt, Human
auaaggcauagugagucaucau

SEQ ID NO: 88115 - RNA, 22 nt, Human
auacaaaaaguggugaguguau

SEQ ID NO: 88116 - RNA, 22 nt, Human
auaauugaauaagagcugcagg

SEQ ID NO: 88117 - RNA, 22 nt, Human
auaccaaugacaggaguuaggg

SEQ ID NO: 88118 - RNA, 22 nt, Human
auacagacacuguagguuauuu

SEQ ID NO: 88119 - RNA, 22 nt, Human
auaaaucaagggcaguauuucc

SEQ ID NO: 88120 - RNA, 22 nt, Human
auaaauuugccagcauauguuc

SEQ ID NO: 88121 - RNA, 22 nt, Human
auaacgaaagcaauuauuuuca

SEQ ID NO: 88122 - RNA, 22 nt, Human
auaaauuugacagcucuucaug

SEQ ID NO: 88123 - RNA, 22 nt, Human
auaaaaaguggcugcuauugga

SEQ ID NO: 88124 - RNA, 22 nt, Human
aguuuuugccucgaauucugcg

SEQ ID NO: 88125 - RNA, 22 nt, Human
auaaaaauguuuuuguguggua

SEQ ID NO: 88126 - RNA, 22 nt, Human
aguuuuguuuguuuguuuguua

SEQ ID NO: 88127 - RNA, 18 nt, Human
aguuuuuuuggcaaaagg

SEQ ID NO: 88128 - RNA, 22 nt, Human
auaaggaaagugagugcuuaaa

SEQ ID NO: 88129 - RNA, 22 nt, Human
auaacccuauuaaauggugcgc

SEQ ID NO: 88130 - RNA, 22 nt, Human
auaagcuucucugcaguucagu

SEQ ID NO: 88131 - RNA, 22 nt, Human
auaaccaaaaauaguuuaguac

SEQ ID NO: 88132 - RNA, 22 nt, Human
auaaaaucugaagcaagaauaa

SEQ ID NO: 88133 - RNA, 22 nt, Human
auaaaagcacaauagaguuaug

SEQ ID NO: 88134 - RNA, 23 nt, Human
auaaugauaaugcuauuuuuugu

SEQ ID NO: 88135 - RNA, 22 nt, Human
auaaaacagaucaggagaauga

SEQ ID NO: 88136 - RNA, 20 nt, Human
auaaauaggauuuucugaca

SEQ ID NO: 88137 - RNA, 22 nt, Human
auaaaguaaugcauauaaugug

SEQ ID NO: 88138 - RNA, 22 nt, Human
aguguuaggaauuaauguaggg

SEQ ID NO: 88139 - RNA, 22 nt, Human
aguguuugggagagggugugag

SEQ ID NO: 88140 - RNA, 22 nt, Human
aguguuuuaagaaaguaauuuu

SEQ ID NO: 88141 - RNA, 22 nt, Human
aguguuuuaugugccaguuuaa

SEQ ID NO: 88142 - RNA, 22 nt, Human
aguguggcccaugaauuauugg

SEQ ID NO: 88143 - RNA, 22 nt, Human
aguuaaucuuguauuaaugguu

SEQ ID NO: 88144 - RNA, 22 nt, Human
aguuaauuauagugcuuaauau

SEQ ID NO: 88145 - RNA, 22 nt, Human
aguuacuauuacuuauuauuau

SEQ ID NO: 88146 - RNA, 23 nt, Human
aguuaucuaaugaaguucuucca

SEQ ID NO: 88147 - RNA, 22 nt, Human
aguuaaagggggcuacagugug

SEQ ID NO: 88148 - RNA, 22 nt, Human
aguuaugcaagcaaguaccacu

SEQ ID NO: 88149 - RNA, 22 nt, Human
aguuauuaagaaaauuuugcca

SEQ ID NO: 88150 - RNA, 22 nt, Human
aguuauuuuucacuauuaggcu

SEQ ID NO: 88151 - RNA, 22 nt, Human
aguucauucuagcugggagcag

SEQ ID NO: 88152 - RNA, 20 nt, Human
agugauuuguuaguacauug

SEQ ID NO: 88153 - RNA, 22 nt, Human
agugaugauccaaaugaauuga

SEQ ID NO: 88154 - RNA, 23 nt, Human
aguggccgaucaucucgggcuug

SEQ ID NO: 88155 - RNA, 20 nt, Human
agucuuaucugcauuuagaa

SEQ ID NO: 88156 - RNA, 22 nt, Human
agugaaagaaaacuguuagaac

SEQ ID NO: 88157 - RNA, 21 nt, Human
agugaagagugggcuugauca

SEQ ID NO: 88158 - RNA, 22 nt, Human
aguagaauuacagguuuucucu

SEQ ID NO: 88159 - RNA, 20 nt, Human
aguacugacaauauucugug

SEQ ID NO: 88160 - RNA, 22 nt, Human
agugaauuagccuauuuguaaa

SEQ ID NO: 88161 - RNA, 23 nt, Human
agugaagcugguuagugaugacc

SEQ ID NO: 88162 - RNA, 22 nt, Human
agugaucugcugcagugcucug

SEQ ID NO: 88163 - RNA, 20 nt, Human
agugaguuaucagcuacagu

SEQ ID NO: 88164 - RNA, 22 nt, Human
agggaugcaguaaaaacuguag

SEQ ID NO: 88165 - RNA, 22 nt, Human
agggaaauaggagaagaaagga

SEQ ID NO: 88166 - RNA, 22 nt, Human
aggcucucccacauucauuaca

SEQ ID NO: 88167 - RNA, 22 nt, Human
aggcuguagaucuagacaugua

SEQ ID NO: 88168 - RNA, 22 nt, Human
aggcuuaacuacaauuuuugcc

SEQ ID NO: 88169 - RNA, 22 nt, Human
agggcuuaggcacacugugacu

SEQ ID NO: 88170 - RNA, 20 nt, Human
aggggcuguaguuagaugac

SEQ ID NO: 88171 - RNA, 21 nt, Human
aggguccugaggaagugagau

SEQ ID NO: 88172 - RNA, 22 nt, Human
agggguuugggaaggguuaggg

SEQ ID NO: 88173 - RNA, 22 nt, Human
aggugauauuauguauuucuau

SEQ ID NO: 88174 - RNA, 22 nt, Human
agguuaaaagagugaguggaua

SEQ ID NO: 88175 - RNA, 22 nt, Human
agguuguaagcuuuauauaaau

SEQ ID NO: 88176 - RNA, 22 nt, Human
aggugggaauaauaaucaaagc

SEQ ID NO: 88177 - RNA, 22 nt, Human
agguuguugagaucaucuggcu

SEQ ID NO: 88178 - RNA, 22 nt, Human
aguaauuucuuacggagaccuu

SEQ ID NO: 88179 - RNA, 22 nt, Human
aguaagaaagaaugauaggccu

SEQ ID NO: 88180 - RNA, 19 nt, Human
aguaaagugguggcauuuu

SEQ ID NO: 88181 - RNA, 18 nt, Human
aguaaauguuaaauauug

SEQ ID NO: 88182 - RNA, 22 nt, Human
aguaaaggaaggaagggacagc

SEQ ID NO: 88183 - RNA, 22 nt, Human
agguuuuagagagccaggaugu

SEQ ID NO: 88184 - RNA, 20 nt, Human
agguuugcuguauaucaugg

SEQ ID NO: 88185 - RNA, 22 nt, Human
aggaauugucgucauguauaau

SEQ ID NO: 88186 - RNA, 22 nt, Human
aggaaauaggaccagacaaagc

SEQ ID NO: 88187 - RNA, 22 nt, Human
aggaauuucacugcguuuuuua

SEQ ID NO: 88188 - RNA, 22 nt, Human
aggaauuugggguuacaugaug

SEQ ID NO: 88189 - RNA, 22 nt, Human
aggacaaaggaccagaucugga

SEQ ID NO: 88190 - RNA, 22 nt, Human
aggaauuuuaauaugcuugucu

SEQ ID NO: 88191 - RNA, 22 nt, Human
aggaaauaagggcacuucagau

SEQ ID NO: 88192 - RNA, 22 nt, Human
agcgcuguguucccgugggcau

SEQ ID NO: 88193 - RNA, 22 nt, Human
agcggcaagguguauguggcag

SEQ ID NO: 88194 - RNA, 22 nt, Human
aggaagaagggacagaauuuug

SEQ ID NO: 88195 - RNA, 22 nt, Human
aggaaauaguuuagucccaaaa

SEQ ID NO: 88196 - RNA, 22 nt, Human
aggaacaacagccuuuauaucc

SEQ ID NO: 88197 - RNA, 22 nt, Human
aggauuuaauugcauuuuucuc

SEQ ID NO: 88198 - RNA, 22 nt, Human
aggauuuauuccagaaaugcaa

SEQ ID NO: 88199 - RNA, 22 nt, Human
aggauuagucaccauuauuauu

SEQ ID NO: 88200 - RNA, 22 nt, Human
aggagguaucuggucuccuuuu

SEQ ID NO: 88201 - RNA, 22 nt, Human
aggauaaaggucauuauuccca

SEQ ID NO: 88202 - RNA, 22 nt, Human
aggauugaaaaaacacauauau

SEQ ID NO: 88203 - RNA, 22 nt, Human
aggagguagggugugaaacagc

SEQ ID NO: 88204 - RNA, 20 nt, Human
aggauuauguacauggaugc

SEQ ID NO: 88205 - RNA, 22 nt, Human
aggauggauagcaaggaagccg

SEQ ID NO: 88206 - RNA, 22 nt, Human
aggauggaaguaacuggauaau

SEQ ID NO: 88207 - RNA, 22 nt, Human
aggauuuagcaugaaaugugaa

SEQ ID NO: 88208 - RNA, 22 nt, Human
aggauugucuccugugaugugc

SEQ ID NO: 88209 - RNA, 22 nt, Human
aggcaauuauacuagguuuugg

SEQ ID NO: 88210 - RNA, 22 nt, Human
aggauugauggcauguuuacug

SEQ ID NO: 88211 - RNA, 23 nt, Human
aggcaagaacggguuguucaccc

SEQ ID NO: 88212 - RNA, 21 nt, Human
aggcagcgauuuucauauugc

SEQ ID NO: 88213 - RNA, 23 nt, Human
aggcagaguccuggggcacagcc

SEQ ID NO: 88214 - RNA, 22 nt, Human
aggcagaugggagcuggaaguu

SEQ ID NO: 88215 - RNA, 23 nt, Human
aggcagcaugcaacaggccauuu

SEQ ID NO: 88216 - RNA, 22 nt, Human
aggcauuuucuuguuauuuuua

SEQ ID NO: 88217 - RNA, 22 nt, Human
aggccgagaugacagagccacu

SEQ ID NO: 88218 - RNA, 22 nt, Human
agcauuagguguguuucagagg

SEQ ID NO: 88219 - RNA, 22 nt, Human
agcauaacaaagggcauaauug

SEQ ID NO: 88220 - RNA, 22 nt, Human
agcagcaaugacaauucaacca

SEQ ID NO: 88221 - RNA, 22 nt, Human
agcaaaacuaaagacacagaca

SEQ ID NO: 88222 - RNA, 22 nt, Human
agcaaaauuccaaaaugcuaau

SEQ ID NO: 88223 - RNA, 22 nt, Human
agauuucaauggauauugcaag

SEQ ID NO: 88224 - RNA, 22 nt, Human
agcaauucugaaauuacuugac

SEQ ID NO: 88225 - RNA, 22 nt, Human
agcaauucagagcauggacuuu

SEQ ID NO: 88226 - RNA, 22 nt, Human
agcagauaaagguugcauuucu

SEQ ID NO: 88227 - RNA, 22 nt, Human
agcacguucuucauuacuucac

SEQ ID NO: 88228 - RNA, 22 nt, Human
agcacggugguuaagagagugg

SEQ ID NO: 88229 - RNA, 22 nt, Human
agcaacauggaguuugugcgca

SEQ ID NO: 88230 - RNA, 22 nt, Human
agcaaauaauugucuuugaggg

SEQ ID NO: 88231 - RNA, 22 nt, Human
agcaaggguugguuuucugaca

SEQ ID NO: 88232 - RNA, 22 nt, Human
agcaauguuggccuauauaccu

SEQ ID NO: 88233 - RNA, 22 nt, Human
agcgcgcggggcugcggcaggg

SEQ ID NO: 88234 - RNA, 22 nt, Human
agccuauucaucugaucuugaa

SEQ ID NO: 88235 - RNA, 22 nt, Human
agcccuuucuuguuuaacugca

SEQ ID NO: 88236 - RNA, 22 nt, Human
agccggccucggacagagggag

SEQ ID NO: 88237 - RNA, 22 nt, Human
agcgacuugacagacauguccu

SEQ ID NO: 88238 - RNA, 22 nt, Human
agccugaaccaauauagcagcc

SEQ ID NO: 88239 - RNA, 22 nt, Human
agccgauaaauuguuuucuugg

SEQ ID NO: 88240 - RNA, 22 nt, Human
agcagggagaccaucucuuccu

SEQ ID NO: 88241 - RNA, 22 nt, Human
agcaggggcaggguuuugugcu

SEQ ID NO: 88242 - RNA, 22 nt, Human
agccauggagaacagacuugaa

SEQ ID NO: 88243 - RNA, 22 nt, Human
agcaucggacggagcaccugcu

SEQ ID NO: 88244 - RNA, 22 nt, Human
agauccuagaugugaauagcua

SEQ ID NO: 88245 - RNA, 22 nt, Human
agauggaggaaagcaguuagaa

SEQ ID NO: 88246 - RNA, 22 nt, Human
agacuccuucuaagaccucauu

SEQ ID NO: 88247 - RNA, 22 nt, Human
agauguuaauaaccuuagggca

SEQ ID NO: 88248 - RNA, 22 nt, Human
agauuaagcauuauaauuauaa

SEQ ID NO: 88249 - RNA, 22 nt, Human
agaugaguaaauggagucuucc

SEQ ID NO: 88250 - RNA, 22 nt, Human
agauuuuacggaguauuagggu

SEQ ID NO: 88251 - RNA, 21 nt, Human
agaugcaguuugcaggugggu

SEQ ID NO: 88252 - RNA, 19 nt, Human
agauggcaaaaugcaaaga

SEQ ID NO: 88253 - RNA, 22 nt, Human
agauuuguauagaugugguuga

SEQ ID NO: 88254 - RNA, 22 nt, Human
agauuuucuuuuccaucuuugu

SEQ ID NO: 88255 - RNA, 22 nt, Human
agaugguucagaauuauaaaga

SEQ ID NO: 88256 - RNA, 22 nt, Human
agauggcugggagcucuguuug

SEQ ID NO: 88257 - RNA, 22 nt, Human
agauugaugugaccauuggaag

SEQ ID NO: 88258 - RNA, 22 nt, Human
agauugaacgagcuggcaugga

SEQ ID NO: 88259 - RNA, 22 nt, Human
agauuauuuaagacaggaacca

SEQ ID NO: 88260 - RNA, 22 nt, Human
agcaagggucucucauggcuug

SEQ ID NO: 88261 - RNA, 22 nt, Human
agcaaggagcugaaaccgggcu

SEQ ID NO: 88262 - RNA, 22 nt, Human
agcaaagccucuuugaaaaaaa

SEQ ID NO: 88263 - RNA, 22 nt, Human
agagauuuacaacuugggcuuu

SEQ ID NO: 88264 - RNA, 22 nt, Human
agacuauuuugugauaacuaau

SEQ ID NO: 88265 - RNA, 22 nt, Human
agagggcaggcugguugggguc

SEQ ID NO: 88266 - RNA, 22 nt, Human
agauaaacaacucuuagcuguu

SEQ ID NO: 88267 - RNA, 22 nt, Human
agaguaauguggaguuugugcu

SEQ ID NO: 88268 - RNA, 22 nt, Human
agaguuaaugcaggccaagccu

SEQ ID NO: 88269 - RNA, 22 nt, Human
agauaaucacaaucuagacuuu

SEQ ID NO: 88270 - RNA, 22 nt, Human
agaucauuaaccaccuguucug

SEQ ID NO: 88271 - RNA, 22 nt, Human
agaugaacuuuuuuaaacugga

SEQ ID NO: 88272 - RNA, 22 nt, Human
agauagaaggauugugacacau

SEQ ID NO: 88273 - RNA, 22 nt, Human
agaugacuaacauaguauugcu

SEQ ID NO: 88274 - RNA, 22 nt, Human
agauauuauuuucuauuuauca

SEQ ID NO: 88275 - RNA, 22 nt, Human
agauaagaacauuaguaagccg

SEQ ID NO: 88276 - RNA, 22 nt, Human
agauaacauguugcagauucug

SEQ ID NO: 88277 - RNA, 22 nt, Human
agauaaaucauuuauuaagcgg

SEQ ID NO: 88278 - RNA, 23 nt, Human
agauaaggaagcauuugagccag

SEQ ID NO: 88279 - RNA, 22 nt, Human
acgccuugagccuugccugaau

SEQ ID NO: 88280 - RNA, 22 nt, Human
acgcuucacaggugcgcauugu

SEQ ID NO: 88281 - RNA, 22 nt, Human
acgcggagccagaggguguggg

SEQ ID NO: 88282 - RNA, 22 nt, Human
acucaaccaucugcauuuuuga

SEQ ID NO: 88283 - RNA, 22 nt, Human
acuauuguccgauuucuuuacu

SEQ ID NO: 88284 - RNA, 22 nt, Human
acuauugcuuuagggggaaacc

SEQ ID NO: 88285 - RNA, 22 nt, Human
acucagcaccuagaaagugugc

SEQ ID NO: 88286 - RNA, 22 nt, Human
acuaucuauugucuucuucaug

SEQ ID NO: 88287 - RNA, 22 nt, Human
acuaauuuacagaaauuucuua

SEQ ID NO: 88288 - RNA, 22 nt, Human
acgguuuugugagguaguacuu

SEQ ID NO: 88289 - RNA, 22 nt, Human
acgguuuggggaggaggauccc

SEQ ID NO: 88290 - RNA, 22 nt, Human
acguugaaaugggcauuuuccg

SEQ ID NO: 88291 - RNA, 22 nt, Human
acucaguuuugaucguucuuau

SEQ ID NO: 88292 - RNA, 22 nt, Human
acuccuuuuaugugugcuaaaa

SEQ ID NO: 88293 - RNA, 21 nt, Human
acucaucuuuuuggagaccag

SEQ ID NO: 88294 - RNA, 22 nt, Human
acucaugugacuaaaacauuaa

SEQ ID NO: 88295 - RNA, 22 nt, Human
acuccuauuugguagauggaag

SEQ ID NO: 88296 - RNA, 22 nt, Human
acucauuuggauuuuggaguuu

SEQ ID NO: 88297 - RNA, 22 nt, Human
acucugaaaggcuacaaaugcu

SEQ ID NO: 88298 - RNA, 22 nt, Human
acucucaauuaucuggacugaa

SEQ ID NO: 88299 - RNA, 22 nt, Human
acucuuauuuugaaguaauaau

SEQ ID NO: 88300 - RNA, 22 nt, Human
acugcagauccucugagaaacc

SEQ ID NO: 88301 - RNA, 22 nt, Human
acugauuuuauauauuaccccg

SEQ ID NO: 88302 - RNA, 22 nt, Human
acugcauuucauaaauuacaau

SEQ ID NO: 88303 - RNA, 22 nt, Human
agaaaaggaagcuuagacugua

SEQ ID NO: 88304 - RNA, 22 nt, Human
agaagaagacccuaaggaaagg

SEQ ID NO: 88305 - RNA, 22 nt, Human
agaaggcaucugcucgcuucca

SEQ ID NO: 88306 - RNA, 22 nt, Human
agaauaagucuaauauauuggu

SEQ ID NO: 88307 - RNA, 22 nt, Human
agaacccaaggcccagggaugu

SEQ ID NO: 88308 - RNA, 22 nt, Human
agaagcaaagcaaacacauucu

SEQ ID NO: 88309 - RNA, 21 nt, Human
agaaguuauuccauggguguu

SEQ ID NO: 88310 - RNA, 22 nt, Human
agaaguagacaguuggauauaa

SEQ ID NO: 88311 - RNA, 22 nt, Human
agaagcauaagggcuuugccag

SEQ ID NO: 88312 - RNA, 16 nt, Human
agaaggcuaguaacag

SEQ ID NO: 88313 - RNA, 22 nt, Human
agaagggaagcaggagaggcau

SEQ ID NO: 88314 - RNA, 21 nt, Human
agaagcggucgaaucgcagac

SEQ ID NO: 88315 - RNA, 20 nt, Human
agaaggagagaugaggcaaa

SEQ ID NO: 88316 - RNA, 22 nt, Human
agaaucugcauuuuaacaagau

SEQ ID NO: 88317 - RNA, 22 nt, Human
agaaugcaagguauuuggaggg

SEQ ID NO: 88318 - RNA, 22 nt, Human
agaauccucuagggauggcagg

SEQ ID NO: 88319 - RNA, 22 nt, Human
agaauacaauuguucaguaaua

SEQ ID NO: 88320 - RNA, 22 nt, Human
agaaugucaagucaagaacaau

SEQ ID NO: 88321 - RNA, 22 nt, Human
agaaguuuguuauguaaacaaa

SEQ ID NO: 88322 - RNA, 22 nt, Human
agaccccugcuggggcugcugu

SEQ ID NO: 88323 - RNA, 22 nt, Human
agacaauuccauccuacguggg

SEQ ID NO: 88324 - RNA, 22 nt, Human
agaauuuguaucuacggugugc

SEQ ID NO: 88325 - RNA, 22 nt, Human
agacaagagcugaggacauauu

SEQ ID NO: 88326 - RNA, 22 nt, Human
agaaacaagcccuagaaguccu

SEQ ID NO: 88327 - RNA, 20 nt, Human
agaaaggaguaaagaagaga

SEQ ID NO: 88328 - RNA, 22 nt, Human
agaaauggccagacuugccccu

SEQ ID NO: 88329 - RNA, 22 nt, Human
agaaaagaggcuuucuaagcau

SEQ ID NO: 88330 - RNA, 22 nt, Human
acuuugaauuagaauuuugcug

SEQ ID NO: 88331 - RNA, 22 nt, Human
agaaaauagguaguagacgggc

SEQ ID NO: 88332 - RNA, 22 nt, Human
acuuugagaauuuuacuugugu

SEQ ID NO: 88333 - RNA, 22 nt, Human
acuuuaaaucuguugcuuagcu

SEQ ID NO: 88334 - RNA, 22 nt, Human
acuuuaaauaucauuugguagg

SEQ ID NO: 88335 - RNA, 22 nt, Human
acuuugccagcucccugcuggc

SEQ ID NO: 88336 - RNA, 22 nt, Human
acuuagaacagccuaugggaag

SEQ ID NO: 88337 - RNA, 22 nt, Human
acuuauaaauuuaguacacugu

SEQ ID NO: 88338 - RNA, 22 nt, Human
acuuacuuucuauucuuguagg

SEQ ID NO: 88339 - RNA, 22 nt, Human
acuugagcuugaaagguaugcu

SEQ ID NO: 88340 - RNA, 22 nt, Human
acuugaagcaugaaaauaagcc

SEQ ID NO: 88341 - RNA, 22 nt, Human
acuucauuugaaaugguugaau

SEQ ID NO: 88342 - RNA, 22 nt, Human
acuucccacugcagugacugag

SEQ ID NO: 88343 - RNA, 22 nt, Human
acuggauucucuuacacagaug

SEQ ID NO: 88344 - RNA, 22 nt, Human
gaaacauuuguugaguacuugc

SEQ ID NO: 88345 - RNA, 21 nt, Human
gaaaaucuaaugugacaaugc

SEQ ID NO: 88346 - RNA, 22 nt, Human
gagagaguaucugcugguucac

SEQ ID NO: 88347 - RNA, 22 nt, Human
gaaaaucaggauggaugugagg

SEQ ID NO: 88348 - RNA, 19 nt, Human
gagccgcucccgcagccgg

SEQ ID NO: 88349 - RNA, 22 nt, Human
gaagcuucgaaagagugauuuc

SEQ ID NO: 88350 - RNA, 22 nt, Human
gagcuaauagacagcaacauca

SEQ ID NO: 88351 - RNA, 22 nt, Human
gaagccaugauaaccagugugg

SEQ ID NO: 88352 - RNA, 22 nt, Human
gagcuuuguuccgugguggcac

SEQ ID NO: 88353 - RNA, 22 nt, Human
gaaggaaaagacgugcuaagua

SEQ ID NO: 88354 - RNA, 22 nt, Human
gaggaaaauggaguguaauuaa

SEQ ID NO: 88355 - RNA, 22 nt, Human
gaaggcagucuggggagcagcc

SEQ ID NO: 88356 - RNA, 22 nt, Human
gaggauaaugaaucugaaucau

SEQ ID NO: 88357 - RNA, 22 nt, Human
gaaguaaaacaguaacuuuguu

SEQ ID NO: 88358 - RNA, 22 nt, Human
gaagguuuuguuugcaaaucau

SEQ ID NO: 88359 - RNA, 22 nt, Human
gaaucucuuugucccugaguuu

SEQ ID NO: 88360 - RNA, 22 nt, Human
gaauacaagccugccaccugga

SEQ ID NO: 88361 - RNA, 22 nt, Human
gaauauuuaucucagcugcaga

SEQ ID NO: 88362 - RNA, 22 nt, Human
gaauagauuagaaagaguaugu

SEQ ID NO: 88363 - RNA, 22 nt, Human
gaauaauuuugaucagaaggga

SEQ ID NO: 88364 - RNA, 22 nt, Human
gaagucugacucuuuguaagcu

SEQ ID NO: 88365 - RNA, 22 nt, Human
gaauggcagaaugaagcagugu

SEQ ID NO: 88366 - RNA, 22 nt, Human
gaauuagacggcaucacauggg

SEQ ID NO: 88367 - RNA, 22 nt, Human
gaauucuaguucuguaucucug

SEQ ID NO: 88368 - RNA, 22 nt, Human
gaggggaaggguguucaauggg

SEQ ID NO: 88369 - RNA, 19 nt, Human
gaauugcacgagcagaggc

SEQ ID NO: 88370 - RNA, 22 nt, Human
gaggggcucuugggcaugaagg

SEQ ID NO: 88371 - RNA, 22 nt, Human
gaggggcugggguugacuccaa

SEQ ID NO: 88372 - RNA, 22 nt, Human
gacaggaauuaucuaaaguaga

SEQ ID NO: 88373 - RNA, 22 nt, Human
gacagcguguuuugcaugaaca

SEQ ID NO: 88374 - RNA, 22 nt, Human
gagguuuaguccauaguauuua

SEQ ID NO: 88375 - RNA, 19 nt, Human
gaguaaaacuagagagaaa

SEQ ID NO: 88376 - RNA, 22 nt, Human
gaggguuagauuuuaagaaaga

SEQ ID NO: 88377 - RNA, 20 nt, Human
gacaugagggagcaaagagc

SEQ ID NO: 88378 - RNA, 22 nt, Human
gaguauuacuaaaauucgccua

SEQ ID NO: 88379 - RNA, 22 nt, Human
gaguaucagauuggaguccuca

SEQ ID NO: 88380 - RNA, 22 nt, Human
gaguagaacagauagucaagaa

SEQ ID NO: 88381 - RNA, 22 nt, Human
gaguauucuauguauauuauug

SEQ ID NO: 88382 - RNA, 22 nt, Human
gaguuaaauagcuuaggauuca

SEQ ID NO: 88383 - RNA, 22 nt, Human
gaguuauuuuuccuguuuuuua

SEQ ID NO: 88384 - RNA, 22 nt, Human
gauaaauaguguuuggggacau

SEQ ID NO: 88385 - RNA, 22 nt, Human
gauaaugcuuuggucagacaug

SEQ ID NO: 88386 - RNA, 22 nt, Human
gauaauuauaggcuaagccacu

SEQ ID NO: 88387 - RNA, 23 nt, Human
gacuucacacucucaaccacugc

SEQ ID NO: 88388 - RNA, 20 nt, Human
gacuucaauuucuaucuuuu

SEQ ID NO: 88389 - RNA, 22 nt, Human
gagaaauagauucaugguagau

SEQ ID NO: 88390 - RNA, 22 nt, Human
gauagaaagagaaucagaacuu

SEQ ID NO: 88391 - RNA, 22 nt, Human
gauacuuuguggaauccuggau

SEQ ID NO: 88392 - RNA, 16 nt, Human
gacuuucuacgacucu

SEQ ID NO: 88393 - RNA, 22 nt, Human
gacuuguguagcuucagaauuu

SEQ ID NO: 88394 - RNA, 22 nt, Human
gauauauuucaaauucuuuugc

SEQ ID NO: 88395 - RNA, 22 nt, Human
gaucauuuucauuaauguugca

SEQ ID NO: 88396 - RNA, 19 nt, Human
gauauugagcugagaauuc

SEQ ID NO: 88397 - RNA, 22 nt, Human
gagaaggagcagaaaaucuccu

SEQ ID NO: 88398 - RNA, 22 nt, Human
gacaggaccgagguggggcggg

SEQ ID NO: 88399 - RNA, 22 nt, Human
cuuucuccagagugaagauccu

SEQ ID NO: 88400 - RNA, 22 nt, Human
cuuucugauguaaggaacuagg

SEQ ID NO: 88401 - RNA, 22 nt, Human
cuuuccaugucuucuuucucca

SEQ ID NO: 88402 - RNA, 21 nt, Human
cuuuggcaagggagaagucac

SEQ ID NO: 88403 - RNA, 22 nt, Human
cuuuggacaacugagugacguu

SEQ ID NO: 88404 - RNA, 22 nt, Human
cuuuggauuuuuugcuuuugua

SEQ ID NO: 88405 - RNA, 22 nt, Human
cuuugcaaagagagaaaguggg

SEQ ID NO: 88406 - RNA, 22 nt, Human
gacuugauugguuugucaaguu

SEQ ID NO: 88407 - RNA, 22 nt, Human
gagaaaaauuucuuugcugcac

SEQ ID NO: 88408 - RNA, 22 nt, Human
cuuuuuuucuccauauuucugg

SEQ ID NO: 88409 - RNA, 22 nt, Human
cuuuuuaaaguaaauggcuaga

SEQ ID NO: 88410 - RNA, 22 nt, Human
cuuuuucaugggugaugagugg

SEQ ID NO: 88411 - RNA, 22 nt, Human
cuuuuggcaucagccucaggaa

SEQ ID NO: 88412 - RNA, 22 nt, Human
gagaaaacauacuuaguguccu

SEQ ID NO: 88413 - RNA, 22 nt, Human
gagaaagauuguccuucagggg

SEQ ID NO: 88414 - RNA, 22 nt, Human
gagaaagggagaaaaagaucuu

SEQ ID NO: 88415 - RNA, 22 nt, Human
gagaacaaggaagagucggcag

SEQ ID NO: 88416 - RNA, 22 nt, Human
gagagaaggaagugaauuuccc

SEQ ID NO: 88417 - RNA, 22 nt, Human
gaaaaauggguuguuugaagau

SEQ ID NO: 88418 - RNA, 22 nt, Human
cuuauuagaaagaaaagacaug

SEQ ID NO: 88419 - RNA, 22 nt, Human
gaagcaagagggaucaggaucu

SEQ ID NO: 88420 - RNA, 22 nt, Human
gaagaugacaucggaucugucu

SEQ ID NO: 88421 - RNA, 21 nt, Human
cuucgcuguuccagcucuugg

SEQ ID NO: 88422 - RNA, 22 nt, Human
gaaggggacuccauggaaugau

SEQ ID NO: 88423 - RNA, 22 nt, Human
gaagguuuacugaagauuuaaa

SEQ ID NO: 88424 - RNA, 22 nt, Human
cuugcagagcccauggauguca

SEQ ID NO: 88425 - RNA, 22 nt, Human
gaagugagcauccuaguuaacc

SEQ ID NO: 88426 - RNA, 22 nt, Human
cuugagcugaguuugcagcucu

SEQ ID NO: 88427 - RNA, 22 nt, Human
gaagucaggaaggagauugaag

SEQ ID NO: 88428 - RNA, 22 nt, Human
cuugauucauuuaagguuggag

SEQ ID NO: 88429 - RNA, 22 nt, Human
cuugggguuugggggcuugacc

SEQ ID NO: 88430 - RNA, 22 nt, Human
cuuuagugaguguggagcuaga

SEQ ID NO: 88431 - RNA, 22 nt, Human
cuuucauuuuugggcaucugag

SEQ ID NO: 88432 - RNA, 22 nt, Human
gacaauuucucaauauagaaac

SEQ ID NO: 88433 - RNA, 22 nt, Human
cuugucuaguuccuggugaugu

SEQ ID NO: 88434 - RNA, 22 nt, Human
gacaagaagaacggagguuuca

SEQ ID NO: 88435 - RNA, 22 nt, Human
gacaagaugacaucauggcuuc

SEQ ID NO: 88436 - RNA, 21 nt, Human
cuuuucuagucccagccccgc

SEQ ID NO: 88437 - RNA, 22 nt, Human
cuuuucaaacaggacagguccu

SEQ ID NO: 88438 - RNA, 22 nt, Human
cuuuucauuucauggaauacaa

SEQ ID NO: 88439 - RNA, 19 nt, Human
cuuuuagagggagaggacu

SEQ ID NO: 88440 - RNA, 22 nt, Human
cuuuuaccuuaauuucgacaca

SEQ ID NO: 88441 - RNA, 22 nt, Human
cuggcuaaugugcugauagcca

SEQ ID NO: 88442 - RNA, 22 nt, Human
cuuuucuuuucuucucuuccca

SEQ ID NO: 88443 - RNA, 22 nt, Human
cuggcuuucauggcgcaguuga

SEQ ID NO: 88444 - RNA, 22 nt, Human
cuucagcgucgucaguguugcu

SEQ ID NO: 88445 - RNA, 22 nt, Human
cuggagcuucaggguucucggg

SEQ ID NO: 88446 - RNA, 22 nt, Human
cuggauagaccccuuauugcau

SEQ ID NO: 88447 - RNA, 22 nt, Human
cugggacacguugugcuuuaac

SEQ ID NO: 88448 - RNA, 22 nt, Human
cugggaugagcuguuuccuggu

SEQ ID NO: 88449 - RNA, 22 nt, Human
cuuuuugcccuugggcuuccug

SEQ ID NO: 88450 - RNA, 22 nt, Human
cuuuuugccuugaagugaccuc

SEQ ID NO: 88451 - RNA, 22 nt, Human
gaaaaagagaaggaguucagua

SEQ ID NO: 88452 - RNA, 22 nt, Human
gaaaaacucagugggggucuuu

SEQ ID NO: 88453 - RNA, 22 nt, Human
gaaaaaccacaauugguauuuu

SEQ ID NO: 88454 - RNA, 22 nt, Human
cugggugugugugaacagagau

SEQ ID NO: 88455 - RNA, 22 nt, Human
cugggugagcuggccagagggu

SEQ ID NO: 88456 - RNA, 22 nt, Human
cugggcucccucucccgccucg

SEQ ID NO: 88457 - RNA, 22 nt, Human
gaaaucuggugauuuucuguug

SEQ ID NO: 88458 - RNA, 22 nt, Human
gaaagaggcugucagggaaugg

SEQ ID NO: 88459 - RNA, 22 nt, Human
gaaauguacuuauagggagguu

SEQ ID NO: 88460 - RNA, 22 nt, Human
gaacaaggauucccaaagaaga

SEQ ID NO: 88461 - RNA, 20 nt, Human
gaacauaaauaacucuuuac

SEQ ID NO: 88462 - RNA, 22 nt, Human
gaacuuaauauacaaucaguuc

SEQ ID NO: 88463 - RNA, 22 nt, Human
gaagaggaagaggagccagagc

SEQ ID NO: 88464 - RNA, 22 nt, Human
gaagaaggaagaucaugcuuga

SEQ ID NO: 88465 - RNA, 22 nt, Human
gaacugaauguguaauguuggc

SEQ ID NO: 88466 - RNA, 22 nt, Human
gaaaagaaggcaggagcccaag

SEQ ID NO: 88467 - RNA, 22 nt, Human
cuggguuuggcugugcuugaau

SEQ ID NO: 88468 - RNA, 22 nt, Human
cuggucaauaaucauguaguac

SEQ ID NO: 88469 - RNA, 22 nt, Human
gaaaagcucuuuagaagagguu

SEQ ID NO: 88470 - RNA, 22 nt, Human
gaaaaggaggggaggcagaugg

SEQ ID NO: 88471 - RNA, 20 nt, Human
cuggugccuucugcgauuua

SEQ ID NO: 88472 - RNA, 22 nt, Human
gaaaaugcacacauacacaccc

SEQ ID NO: 88473 - RNA, 22 nt, Human
gaaaauaguucaucacaaugau

SEQ ID NO: 88474 - RNA, 22 nt, Human
gaaaaucaugaaaguguguugu

SEQ ID NO: 88475 - RNA, 22 nt, Human
gaaaaguuuaaccuuguacauu

SEQ ID NO: 88476 - RNA, 22 nt, Human
cucacauacaagagauggugga

SEQ ID NO: 88477 - RNA, 22 nt, Human
cucaaaauccauaaaaucaggu

SEQ ID NO: 88478 - RNA, 22 nt, Human
cugcuucacccugccugagaac

SEQ ID NO: 88479 - RNA, 22 nt, Human
cucagcaauuaccugugucucu

SEQ ID NO: 88480 - RNA, 22 nt, Human
cuggcuguguguuugugcaucu

SEQ ID NO: 88481 - RNA, 22 nt, Human
cucccucauaugguugcuuauc

SEQ ID NO: 88482 - RNA, 20 nt, Human
cucauugcuuucauuuucuu

SEQ ID NO: 88483 - RNA, 22 nt, Human
cucauugacagagcagcucuac

SEQ ID NO: 88484 - RNA, 22 nt, Human
cuggcgauugcgagagucgccu

SEQ ID NO: 88485 - RNA, 22 nt, Human
cugggcuuucaggcccuaaggc

SEQ ID NO: 88486 - RNA, 22 nt, Human
cuccuuuuuauaucuuucucug

SEQ ID NO: 88487 - RNA, 22 nt, Human
cugguuuauuucauaguuuguu

SEQ ID NO: 88488 - RNA, 22 nt, Human
cucuggcaacgauggugcuuau

SEQ ID NO: 88489 - RNA, 22 nt, Human
cucuuauaaagaugucucuguu

SEQ ID NO: 88490 - RNA, 22 nt, Human
cuguccuguggccugcuccggu

SEQ ID NO: 88491 - RNA, 22 nt, Human
cuguccccauugcugucccugg

SEQ ID NO: 88492 - RNA, 22 nt, Human
cuguccugauggugccacuggu

SEQ ID NO: 88493 - RNA, 22 nt, Human
cucuguggucugaagccuguga

SEQ ID NO: 88494 - RNA, 22 nt, Human
cugaaacucaagauaggaggaa

SEQ ID NO: 88495 - RNA, 22 nt, Human
cugaaacuauggggaggggagc

SEQ ID NO: 88496 - RNA, 22 nt, Human
cuguuacggaggcuuucuaguu

SEQ ID NO: 88497 - RNA, 22 nt, Human
cuguuaucaggaguuuucacgg

SEQ ID NO: 88498 - RNA, 22 nt, Human
cuguucuccacuccugacuucu

SEQ ID NO: 88499 - RNA, 20 nt, Human
cuguucucuugccacaugag

SEQ ID NO: 88500 - RNA, 20 nt, Human
cugaaaggaaagaaauuuuu

SEQ ID NO: 88501 - RNA, 23 nt, Human
cugaaauucagaugcuaaagaua

SEQ ID NO: 88502 - RNA, 22 nt, Human
cugaagaaagaaaauggccauc

SEQ ID NO: 88503 - RNA, 22 nt, Human
cuguuguucacuuugcugguga

SEQ ID NO: 88504 - RNA, 22 nt, Human
cuguuuggaugccauggucaag

SEQ ID NO: 88505 - RNA, 22 nt, Human
cuuaggcgugugcgggugaggc

SEQ ID NO: 88506 - RNA, 22 nt, Human
cuaaauuuuuuagugaaauagg

SEQ ID NO: 88507 - RNA, 22 nt, Human
cuaaugaaaugauggcuccuac

SEQ ID NO: 88508 - RNA, 22 nt, Human
cuacauaaauuuaucacagacu

SEQ ID NO: 88509 - RNA, 22 nt, Human
cuagagaaaaagcuuagguacg

SEQ ID NO: 88510 - RNA, 21 nt, Human
cuauaaaaaugguucuuugcg

SEQ ID NO: 88511 - RNA, 22 nt, Human
cuaguuuucacaaaggaagggc

SEQ ID NO: 88512 - RNA, 22 nt, Human
cuaguauuaagugugaguaaaa

SEQ ID NO: 88513 - RNA, 22 nt, Human
cuaugaaucaauuucugcaguu

SEQ ID NO: 88514 - RNA, 22 nt, Human
cugcuguuuuccccaccaucuc

SEQ ID NO: 88515 - RNA, 22 nt, Human
cuauguuucagauauauauaua

SEQ ID NO: 88516 - RNA, 22 nt, Human
cuauuaauggccaggagucaug

SEQ ID NO: 88517 - RNA, 22 nt, Human
cugcugugcagacagacucucu

SEQ ID NO: 88518 - RNA, 22 nt, Human
cugauuguagccacugugauga

SEQ ID NO: 88519 - RNA, 22 nt, Human
cugcacuggguacauagaaaca

SEQ ID NO: 88520 - RNA, 22 nt, Human
cuaaauucuauauccuugcuuc

SEQ ID NO: 88521 - RNA, 22 nt, Human
cuaaaacuuuuccaaauuaugu

SEQ ID NO: 88522 - RNA, 22 nt, Human
cugcaguaacuauuuucaauaa

SEQ ID NO: 88523 - RNA, 22 nt, Human
cguuuugaguagauagccauau

SEQ ID NO: 88524 - RNA, 22 nt, Human
cugauccuauauugguaugagg

SEQ ID NO: 88525 - RNA, 22 nt, Human
cgugaaaugcagaaaguugugg

SEQ ID NO: 88526 - RNA, 17 nt, Human
cgugaggaccaggcagc

SEQ ID NO: 88527 - RNA, 22 nt, Human
cgucauuuguaaaugaucaaga

SEQ ID NO: 88528 - RNA, 22 nt, Human
cgguuuuuaaaagucucuucua

SEQ ID NO: 88529 - RNA, 22 nt, Human
cgucagccacagcugccccggg

SEQ ID NO: 88530 - RNA, 22 nt, Human
cuaguagcccauuuuggauacc

SEQ ID NO: 88531 - RNA, 22 nt, Human
cucaauuuuuauugcuuuuuug

SEQ ID NO: 88532 - RNA, 22 nt, Human
cucaaauggguuuguagaauau

SEQ ID NO: 88533 - RNA, 22 nt, Human
cuccagcagaaagggcgagugg

SEQ ID NO: 88534 - RNA, 22 nt, Human
cuccagauuugggggauauacu

SEQ ID NO: 88535 - RNA, 22 nt, Human
cggagcgagaaggggaaagccc

SEQ ID NO: 88536 - RNA, 22 nt, Human
cuccgaaaugcaucccagggca

SEQ ID NO: 88537 - RNA, 22 nt, Human
cuaaacuucauauguugcuuua

SEQ ID NO: 88538 - RNA, 22 nt, Human
cuaccagcacgccuuccucuac

SEQ ID NO: 88539 - RNA, 22 nt, Human
cuaacuuugucuugguaauugc

SEQ ID NO: 88540 - RNA, 22 nt, Human
cuaccccaggccccucgaugcc

SEQ ID NO: 88541 - RNA, 22 nt, Human
cgaggccgcuucauggcuggca

SEQ ID NO: 88542 - RNA, 22 nt, Human
cgagguuuaugaguuuguguuc

SEQ ID NO: 88543 - RNA, 22 nt, Human
cuagaaaguaugcuuuuauaau

SEQ ID NO: 88544 - RNA, 22 nt, Human
cgggagcagcucuggggcuggg

SEQ ID NO: 88545 - RNA, 22 nt, Human
cgccuggccccgcagcgcuugu

SEQ ID NO: 88546 - RNA, 22 nt, Human
ccuucuguaccaaggccucaug

SEQ ID NO: 88547 - RNA, 22 nt, Human
ccuucuuaaacaucauuuuggc

SEQ ID NO: 88548 - RNA, 22 nt, Human
ccuuggcuuaccuucugugugg

SEQ ID NO: 88549 - RNA, 22 nt, Human
ccuugggagcgcccuguccggg

SEQ ID NO: 88550 - RNA, 22 nt, Human
ccuuuuuagaugugcgaauguu

SEQ ID NO: 88551 - RNA, 22 nt, Human
cgugaagaaguaauagguggug

SEQ ID NO: 88552 - RNA, 22 nt, Human
cgaaaaagaagugcaccauguu

SEQ ID NO: 88553 - RNA, 22 nt, Human
ccuaacaugguuauuguuaauu

SEQ ID NO: 88554 - RNA, 22 nt, Human
ccuuuuguuucccuuuauguuc

SEQ ID NO: 88555 - RNA, 22 nt, Human
ccuccuuuccuguuuuccugag

SEQ ID NO: 88556 - RNA, 22 nt, Human
cgaguagagaugugguuucuga

SEQ ID NO: 88557 - RNA, 22 nt, Human
cgggaaguaaacauuauuucag

SEQ ID NO: 88558 - RNA, 22 nt, Human
cgcuuugacuuuagaaggccaa

SEQ ID NO: 88559 - RNA, 22 nt, Human
ccagagcaccgaaacgagcuuu

SEQ ID NO: 88560 - RNA, 22 nt, Human
ccuuugcugggccucuccaucu

SEQ ID NO: 88561 - RNA, 22 nt, Human
ccuuuuaucgcgaagaacucca

SEQ ID NO: 88562 - RNA, 22 nt, Human
ccgggcuuccuuagagcaagau

SEQ ID NO: 88563 - RNA, 22 nt, Human
ccgcucuuugagacucucccga

SEQ ID NO: 88564 - RNA, 22 nt, Human
ccuugauaugcuucagagaauu

SEQ ID NO: 88565 - RNA, 22 nt, Human
cauuccuucucagguacuggca

SEQ ID NO: 88566 - RNA, 22 nt, Human
cauuuaucacuugcuaaacaua

SEQ ID NO: 88567 - RNA, 22 nt, Human
cauuuagagaagauuacaagga

SEQ ID NO: 88568 - RNA, 22 nt, Human
cauuuacauaacaguaacgcug

SEQ ID NO: 88569 - RNA, 22 nt, Human
ccagacuggggcuccuugaggg

SEQ ID NO: 88570 - RNA, 22 nt, Human
cauuggcacauguauucugggc

SEQ ID NO: 88571 - RNA, 22 nt, Human
cauuucaaacaguuacagcugc

SEQ ID NO: 88572 - RNA, 22 nt, Human
ccagccacagcuuccagcuccu

SEQ ID NO: 88573 - RNA, 22 nt, Human
ccagcaugcucagucuaaauug

SEQ ID NO: 88574 - RNA, 22 nt, Human
cauuuuccucugcugguguuca

SEQ ID NO: 88575 - RNA, 22 nt, Human
cauuucuugugagccgcauccu

SEQ ID NO: 88576 - RNA, 22 nt, Human
ccaaagaauuuggaaaaucuga

SEQ ID NO: 88577 - RNA, 22 nt, Human
ccaaagaagcaaugagaauagu

SEQ ID NO: 88578 - RNA, 22 nt, Human
cauuuuuuuuccccuccuggua

SEQ ID NO: 88579 - RNA, 22 nt, Human
ccagccuucugaugggacccuc

SEQ ID NO: 88580 - RNA, 22 nt, Human
ccagcugcugcaccgugcaugg

SEQ ID NO: 88581 - RNA, 22 nt, Human
ccaaaguauuaaaucuuagcaa

SEQ ID NO: 88582 - RNA, 21 nt, Human
ccacaauucuaguuacauaug

SEQ ID NO: 88583 - RNA, 22 nt, Human
ccaauuuuggaauuauuaggca

SEQ ID NO: 88584 - RNA, 22 nt, Human
ccauaaaagagaaucuaaauga

SEQ ID NO: 88585 - RNA, 22 nt, Human
ccauggaaaagacgggcaggcc

SEQ ID NO: 88586 - RNA, 22 nt, Human
ccaugaggcaaagacugauaua

SEQ ID NO: 88587 - RNA, 22 nt, Human
cccaaccagaaauugacagaga

SEQ ID NO: 88588 - RNA, 20 nt, Human
ccagaagagaagaaaaggaa

SEQ ID NO: 88589 - RNA, 22 nt, Human
ccacucagaagaaacaagagag

SEQ ID NO: 88590 - RNA, 22 nt, Human
ccauuuggccauucaguuguuc

SEQ ID NO: 88591 - RNA, 22 nt, Human
ccauggauacuaagguauguga

SEQ ID NO: 88592 - RNA, 22 nt, Human
ccaugugaccugugucaguugc

SEQ ID NO: 88593 - RNA, 22 nt, Human
ccaaacauuucaaauuuagaga

SEQ ID NO: 88594 - RNA, 22 nt, Human
ccaaauuguuguuguuguuguu

SEQ ID NO: 88595 - RNA, 22 nt, Human
cauuuuuccucaggcaauuuga

SEQ ID NO: 88596 - RNA, 22 nt, Human
cauuuugguccucauguguagc

SEQ ID NO: 88597 - RNA, 22 nt, Human
ccaagcguguuuaggaaaugcu

SEQ ID NO: 88598 - RNA, 22 nt, Human
ccaagagcuucccauagcuucu

SEQ ID NO: 88599 - RNA, 22 nt, Human
caugggaaauauaagaauuuuc

SEQ ID NO: 88600 - RNA, 21 nt, Human
caugguaaguacaaagaugac

SEQ ID NO: 88601 - RNA, 22 nt, Human
ccaaucaacuguguggcuuucu

SEQ ID NO: 88602 - RNA, 22 nt, Human
ccaauguuaggcucugguuuua

SEQ ID NO: 88603 - RNA, 22 nt, Human
cauuccaagaaguaguucugca

SEQ ID NO: 88604 - RNA, 22 nt, Human
cauuccaaguauauacaugaua

SEQ ID NO: 88605 - RNA, 22 nt, Human
ccacucucucccucuguagggg

SEQ ID NO: 88606 - RNA, 22 nt, Human
cauucauaagacuuugcucuug

SEQ ID NO: 88607 - RNA, 22 nt, Human
cauuauacaugaagacucaccc

SEQ ID NO: 88608 - RNA, 22 nt, Human
cauuacaagaaauagcauaaug

SEQ ID NO: 88609 - RNA, 22 nt, Human
cauucauagaaucaguuuggga

SEQ ID NO: 88610 - RNA, 22 nt, Human
caugugcaucagccaauuggag

SEQ ID NO: 88611 - RNA, 22 nt, Human
cagguuuuccuuuuaaaaggaa

SEQ ID NO: 88612 - RNA, 22 nt, Human
cauugcaaccccaaaaagaaca

SEQ ID NO: 88613 - RNA, 22 nt, Human
cauugcaaccauuccaaauggc

SEQ ID NO: 88614 - RNA, 22 nt, Human
cauugcugugggcauuugcugc

SEQ ID NO: 88615 - RNA, 22 nt, Human
caucauuuggcuuuagggccug

SEQ ID NO: 88616 - RNA, 22 nt, Human
caugaugaacugugcuguuagg

SEQ ID NO: 88617 - RNA, 22 nt, Human
caugauaacacuucuguuuaau

SEQ ID NO: 88618 - RNA, 23 nt, Human
cauuugauccucacaauaaaugg

SEQ ID NO: 88619 - RNA, 22 nt, Human
cauuuucugcaagucugcucaa

SEQ ID NO: 88620 - RNA, 22 nt, Human
cauuuugguaauguucguuugc

SEQ ID NO: 88621 - RNA, 22 nt, Human
cauuuuaucagcacacgucacu

SEQ ID NO: 88622 - RNA, 22 nt, Human
caucuuuguuuuggauauaauc

SEQ ID NO: 88623 - RNA, 22 nt, Human
cauuuacguaacaguaacgcug

SEQ ID NO: 88624 - RNA, 22 nt, Human
caaaagcaaagaucuuugauug

SEQ ID NO: 88625 - RNA, 22 nt, Human
caagccacugggagcugcacac

SEQ ID NO: 88626 - RNA, 22 nt, Human
caaacauuuguuggaaccccug

SEQ ID NO: 88627 - RNA, 22 nt, Human
caauggaguccucuuccucuuu

SEQ ID NO: 88628 - RNA, 22 nt, Human
caauggagccaagaggaggaaa

SEQ ID NO: 88629 - RNA, 22 nt, Human
caauguuuuuccuuccuuaaua

SEQ ID NO: 88630 - RNA, 22 nt, Human
caauuaccaguaauugagguuu

SEQ ID NO: 88631 - RNA, 22 nt, Human
cacuuaaaauucagggcuuaua

SEQ ID NO: 88632 - RNA, 23 nt, Human
cacuggugggguuuaaaagaagc

SEQ ID NO: 88633 - RNA, 22 nt, Human
cacuucaguacuagaggaugaa

SEQ ID NO: 88634 - RNA, 22 nt, Human
cagaaaaaaaugcagacuagca

SEQ ID NO: 88635 - RNA, 22 nt, Human
cacuugauugucagaaaaaugg

SEQ ID NO: 88636 - RNA, 22 nt, Human
cacuuguuaaaugccaauggca

SEQ ID NO: 88637 - RNA, 22 nt, Human
cagaaaacauuguguguauaag

SEQ ID NO: 88638 - RNA, 22 nt, Human
cagaaagugauuugcuauucca

SEQ ID NO: 88639 - RNA, 23 nt, Human
cagagaaaauagaauaugcugug

SEQ ID NO: 88640 - RNA, 19 nt, Human
cagagacuguaacacuuuu

SEQ ID NO: 88641 - RNA, 21 nt, Human
cacuguauagcaggagaaaac

SEQ ID NO: 88642 - RNA, 22 nt, Human
cacugcaaccuccaccucccgg

SEQ ID NO: 88643 - RNA, 22 nt, Human
cacccccaggcuccccuucugg

SEQ ID NO: 88644 - RNA, 18 nt, Human
cacgcaacuguaaaaccc

SEQ ID NO: 88645 - RNA, 22 nt, Human
cacuaaccauguucccaacagc

SEQ ID NO: 88646 - RNA, 22 nt, Human
cacgggcgacgugaucuaggac

SEQ ID NO: 88647 - RNA, 23 nt, Human
cagaccccuggcucugacccccu

SEQ ID NO: 88648 - RNA, 22 nt, Human
cagacaaauccuuaugagacug

SEQ ID NO: 88649 - RNA, 22 nt, Human
cagcauugagcacagaaggaaa

SEQ ID NO: 88650 - RNA, 22 nt, Human
cagagaggagcacaaagugaag

SEQ ID NO: 88651 - RNA, 22 nt, Human
cagacgguuaaacgauuuugcu

SEQ ID NO: 88652 - RNA, 22 nt, Human
cagaaauuggcagagaagaccu

SEQ ID NO: 88653 - RNA, 22 nt, Human
cacuugagagcugaagaagucu

SEQ ID NO: 88654 - RNA, 22 nt, Human
cacuuauuuuuccuuugugauu

SEQ ID NO: 88655 - RNA, 22 nt, Human
caggacuuccucuaugguggcg

SEQ ID NO: 88656 - RNA, 22 nt, Human
caggcacagcuaagacuggcca

SEQ ID NO: 88657 - RNA, 22 nt, Human
caggauuuaauaagauaguguu

SEQ ID NO: 88658 - RNA, 22 nt, Human
cagguuuggaagucacgaagcu

SEQ ID NO: 88659 - RNA, 22 nt, Human
caguugcuauugagagaacaca

SEQ ID NO: 88660 - RNA, 22 nt, Human
caguguuuagcacagugcuugg

SEQ ID NO: 88661 - RNA, 22 nt, Human
caguuaaugauaggaauucggu

SEQ ID NO: 88662 - RNA, 22 nt, Human
cauaguuuguucuuuuuuauug

SEQ ID NO: 88663 - RNA, 22 nt, Human
cagguaguuagaaugaccagga

SEQ ID NO: 88664 - RNA, 22 nt, Human
cauagcauguguuuauuuucuu

SEQ ID NO: 88665 - RNA, 22 nt, Human
caguuuuucaaaauuacaugau

SEQ ID NO: 88666 - RNA, 22 nt, Human
cauaaauuuuaccuuguaagug

SEQ ID NO: 88667 - RNA, 22 nt, Human
cauaaucaagggguugugaugu

SEQ ID NO: 88668 - RNA, 22 nt, Human
cagccgcucaugggcccggagc

SEQ ID NO: 88669 - RNA, 22 nt, Human
cagcuacuaccuguagacaaag

SEQ ID NO: 88670 - RNA, 22 nt, Human
cagcauucuacuuugugaacug

SEQ ID NO: 88671 - RNA, 22 nt, Human
cagcgguggcaaggugacugug

SEQ ID NO: 88672 - RNA, 19 nt, Human
caggacaguuugccaagaa

SEQ ID NO: 88673 - RNA, 22 nt, Human
caggccgccacugcagcagcug

SEQ ID NO: 88674 - RNA, 19 nt, Human
caggauuguuuaaagcuuu

SEQ ID NO: 88675 - RNA, 22 nt, Human
caggugauuuuguuuucaaaug

SEQ ID NO: 88676 - RNA, 22 nt, Human
cagcuuguucugaccugugauu

SEQ ID NO: 88677 - RNA, 22 nt, Human
auccuugacuguagugauauua

SEQ ID NO: 88678 - RNA, 22 nt, Human
aucucuguaaaccauaaauuga

SEQ ID NO: 88679 - RNA, 22 nt, Human
auacaauugcaauggaagauga

SEQ ID NO: 88680 - RNA, 19 nt, Human
auacacguguauacauaca

SEQ ID NO: 88681 - RNA, 22 nt, Human
aucguuaugauagagaaagaga

SEQ ID NO: 88682 - RNA, 22 nt, Human
aucuugaaacauauaugcauuu

SEQ ID NO: 88683 - RNA, 22 nt, Human
aucugugauuuuggcaagauuu

SEQ ID NO: 88684 - RNA, 22 nt, Human
augaauuugaacaccagguugg

SEQ ID NO: 88685 - RNA, 22 nt, Human
aucuuuuuucacaauuuauuuu

SEQ ID NO: 88686 - RNA, 22 nt, Human
augaaaacggaccagagcuauu

SEQ ID NO: 88687 - RNA, 22 nt, Human
augaaggauagggcaaaauuuu

SEQ ID NO: 88688 - RNA, 22 nt, Human
augaacuaagagucauuagugu

SEQ ID NO: 88689 - RNA, 22 nt, Human
augacagcuaaggaauguguag

SEQ ID NO: 88690 - RNA, 22 nt, Human
augacugaugcugacucauggg

SEQ ID NO: 88691 - RNA, 21 nt, Human
augagguggcuacuaaagagu

SEQ ID NO: 88692 - RNA, 22 nt, Human
aucuuugccuuuaugccucuag

SEQ ID NO: 88693 - RNA, 22 nt, Human
aucuuugauuuuggcuuuuagg

SEQ ID NO: 88694 - RNA, 19 nt, Human
augaaauagcauuuucuga

SEQ ID NO: 88695 - RNA, 23 nt, Human
augcaacauugccaguaugggca

SEQ ID NO: 88696 - RNA, 22 nt, Human
augauaucuuguuuuucaugca

SEQ ID NO: 88697 - RNA, 18 nt, Human
augauaauguuugcauca

SEQ ID NO: 88698 - RNA, 22 nt, Human
augaggauuagcaucugcaaau

SEQ ID NO: 88699 - RNA, 22 nt, Human
augcacaagguagauuauuauu

SEQ ID NO: 88700 - RNA, 19 nt, Human
augcacgugaaaugcauuu

SEQ ID NO: 88701 - RNA, 22 nt, Human
augaguaaguucugauuagauu

SEQ ID NO: 88702 - RNA, 22 nt, Human
augauuaagguacgucauuucu

SEQ ID NO: 88703 - RNA, 22 nt, Human
augauuacagcaugauguuuca

SEQ ID NO: 88704 - RNA, 22 nt, Human
augcaaaaucuuauuuuuucua

SEQ ID NO: 88705 - RNA, 22 nt, Human
augauuuguuaacagacuuaau

SEQ ID NO: 88706 - RNA, 22 nt, Human
augauuauuugaaugaagagga

SEQ ID NO: 88707 - RNA, 22 nt, Human
augcaugaucccgguaugugaa

SEQ ID NO: 88708 - RNA, 22 nt, Human
augccacuguuuaugucacuua

SEQ ID NO: 88709 - RNA, 20 nt, Human
auggaaacacgcagccccaa

SEQ ID NO: 88710 - RNA, 22 nt, Human
auggaggagcagaggguuucca

SEQ ID NO: 88711 - RNA, 22 nt, Human
auggagcgggaggauggaggag

SEQ ID NO: 88712 - RNA, 22 nt, Human
auggaagagacaaugcuaucug

SEQ ID NO: 88713 - RNA, 22 nt, Human
augggcauggauggccgagucu

SEQ ID NO: 88714 - RNA, 22 nt, Human
auggcaucuucgguuggacugc

SEQ ID NO: 88715 - RNA, 22 nt, Human
augggaggguagagugaacaga

SEQ ID NO: 88716 - RNA, 22 nt, Human
auggagugggaggacaugaagg

SEQ ID NO: 88717 - RNA, 18 nt, Human
augggggaggaggaaagg

SEQ ID NO: 88718 - RNA, 22 nt, Human
augguguaggugaagagaacau

SEQ ID NO: 88719 - RNA, 22 nt, Human
augguuagauggaugagaugug

SEQ ID NO: 88720 - RNA, 22 nt, Human
auguaaugucaaucuucagugg

SEQ ID NO: 88721 - RNA, 22 nt, Human
augggauuugaaaaguggaaau

SEQ ID NO: 88722 - RNA, 22 nt, Human
augggagggugaggaggcagcu

SEQ ID NO: 88723 - RNA, 22 nt, Human
auggggaucugcaguguugauc

SEQ ID NO: 88724 - RNA, 22 nt, Human
augguguaagacuguauuucuu

SEQ ID NO: 88725 - RNA, 22 nt, Human
auggcagcggagcuggaaauga

SEQ ID NO: 88726 - RNA, 22 nt, Human
auguuguugaacucuuugcaug

SEQ ID NO: 88727 - RNA, 22 nt, Human
augugcauguauguaucauauu

SEQ ID NO: 88728 - RNA, 22 nt, Human
auguauauauacauguauugua

SEQ ID NO: 88729 - RNA, 22 nt, Human
auguuuaauuugaaauuuuauu

SEQ ID NO: 88730 - RNA, 22 nt, Human
auguuuucauuuagaagcuaau

SEQ ID NO: 88731 - RNA, 22 nt, Human
auuaaagcaugaauaauaugua

SEQ ID NO: 88732 - RNA, 22 nt, Human
auguugagaaucucucuucuaa

SEQ ID NO: 88733 - RNA, 22 nt, Human
auguuuuuugaaaauguauuuu

SEQ ID NO: 88734 - RNA, 22 nt, Human
auugaauuagauguuguagucc

SEQ ID NO: 88735 - RNA, 19 nt, Human
auugguuugcucgggaaug

SEQ ID NO: 88736 - RNA, 22 nt, Human
auuguucuagaauuuuuuuucc

SEQ ID NO: 88737 - RNA, 22 nt, Human
auucuuuagaguccuucaaaua

SEQ ID NO: 88738 - RNA, 19 nt, Human
auucuucucuuccugcugu

SEQ ID NO: 88739 - RNA, 22 nt, Human
auugguuucuuguggguuaucc

SEQ ID NO: 88740 - RNA, 22 nt, Human
auuuaagugagucuuuaaaaua

SEQ ID NO: 88741 - RNA, 22 nt, Human
auugauuuugugcuuuccuacg

SEQ ID NO: 88742 - RNA, 23 nt, Human
auugccuguagaucuucacuuuc

SEQ ID NO: 88743 - RNA, 22 nt, Human
auugcauucaugcuccccuuag

SEQ ID NO: 88744 - RNA, 22 nt, Human
auuucauuuuagaaauaagugu

SEQ ID NO: 88745 - RNA, 22 nt, Human
auuucauccauuaagaguacuc

SEQ ID NO: 88746 - RNA, 22 nt, Human
auuuauauauuuuguucuggua

SEQ ID NO: 88747 - RNA, 22 nt, Human
auuuaucugcucuucgcguuga

SEQ ID NO: 88748 - RNA, 22 nt, Human
auuuccagcagcauauuugucu

SEQ ID NO: 88749 - RNA, 22 nt, Human
auuugaaguauaaguaauugcu

SEQ ID NO: 88750 - RNA, 22 nt, Human
auuguuuccccggaauuauuca

SEQ ID NO: 88751 - RNA, 23 nt, Human
auuugcugaucguagaugacuag

SEQ ID NO: 88752 - RNA, 22 nt, Human
auuugcaucagugagcgaugug

SEQ ID NO: 88753 - RNA, 22 nt, Human
auuuuggguguuaacaaugaaa

SEQ ID NO: 88754 - RNA, 22 nt, Human
auuuucuucauuuugauuguau

SEQ ID NO: 88755 - RNA, 22 nt, Human
auuuucuugucucuguuguagg

SEQ ID NO: 88756 - RNA, 22 nt, Human
auuuucauauggguuauuugua

SEQ ID NO: 88757 - RNA, 22 nt, Human
auuuucgcaccucgcgaguugc

SEQ ID NO: 88758 - RNA, 22 nt, Human
auuuuauuuugggaucuuuuua

SEQ ID NO: 88759 - RNA, 22 nt, Human
auuuuuagucuugcugcaauca

SEQ ID NO: 88760 - RNA, 21 nt, Human
auuuuucagaaggaugugaua

SEQ ID NO: 88761 - RNA, 22 nt, Human
auuuuucacauuuugggggaca

SEQ ID NO: 88762 - RNA, 22 nt, Human
auuuuuuuaggcugucagccgc

SEQ ID NO: 88763 - RNA, 22 nt, Human
auuuuuucaugugugguugaga

SEQ ID NO: 88764 - RNA, 22 nt, Human
auuuuuuuuccugucucuuuca

SEQ ID NO: 88765 - RNA, 22 nt, Human
auuuuugugcuuuauuggggua

SEQ ID NO: 88766 - RNA, 22 nt, Human
caaauuuuuauuuaccaucugc

SEQ ID NO: 88767 - RNA, 22 nt, Human
auuuuguugaaacccuuguugu

SEQ ID NO: 88768 - RNA, 22 nt, Human
auuuuuagagugaaagaauuaa

SEQ ID NO: 88769 - RNA, 22 nt, Human
caaaauuguugaugcugcuuug

SEQ ID NO: 88770 - RNA, 22 nt, Human
caaaccuagagaggagaggaca

SEQ ID NO: 88771 - RNA, 22 nt, Human
caaaguaggcuaagaccuucca

SEQ ID NO: 88772 - RNA, 22 nt, Human
caaaggauguguagugcaacca

SEQ ID NO: 88773 - RNA, 22 nt, Human
auuuuuauuugccuaugauaua

SEQ ID NO: 88774 - RNA, 22 nt, Human
auuuuuaucuaaaauccacuuu

SEQ ID NO: 88775 - RNA, 22 nt, Human
caaaugcaguggucgugcugga

SEQ ID NO: 88776 - RNA, 22 nt, Human
auugaugaaaauaguuauuuua

SEQ ID NO: 88777 - RNA, 22 nt, Human
auugaugccugaaaaauaugua

SEQ ID NO: 88778 - RNA, 17 nt, Human
auucuuauacucuguga

SEQ ID NO: 88779 - RNA, 22 nt, Human
auuggagacauuaagucuaaga

SEQ ID NO: 88780 - RNA, 22 nt, Human
auuggaagacgcuggaggcacu

SEQ ID NO: 88781 - RNA, 22 nt, Human
auucugcaauaaucaguccuua

SEQ ID NO: 88782 - RNA, 22 nt, Human
auugagaugcuuaaaucuucac

SEQ ID NO: 88783 - RNA, 22 nt, Human
auucuguaggcuuuuguuaaaa

SEQ ID NO: 88784 - RNA, 22 nt, Human
auucuguuuuaccauuuucuuu

SEQ ID NO: 88785 - RNA, 22 nt, Human
auucuaugaaugacuguuagau

SEQ ID NO: 88786 - RNA, 22 nt, Human
auucucauguuuuaaaaaaguu

SEQ ID NO: 88787 - RNA, 22 nt, Human
auugagaaaauucgagcaaguu

SEQ ID NO: 88788 - RNA, 22 nt, Human
auugacagaaaauuggauggca

SEQ ID NO: 88789 - RNA, 22 nt, Human
auugacuucccaucaggugagu

SEQ ID NO: 88790 - RNA, 22 nt, Human
auucuccucaaaacaucugcug

SEQ ID NO: 88791 - RNA, 22 nt, Human
auugaaguguacguuugaucua

SEQ ID NO: 88792 - RNA, 22 nt, Human
auugaagcauggagaugaggca

SEQ ID NO: 88793 - RNA, 22 nt, Human
auucuugauauagauaguuaau

SEQ ID NO: 88794 - RNA, 22 nt, Human
auucuuuauuuucuguacuugc

SEQ ID NO: 88795 - RNA, 22 nt, Human
auucuuuucucuaaaugaugaa

SEQ ID NO: 88796 - RNA, 22 nt, Human
auucuacucuccuacaggucua

SEQ ID NO: 88797 - RNA, 22 nt, Human
auugaaauuaauuucugcuuuc

SEQ ID NO: 88798 - RNA, 22 nt, Human
auucgcggcuugaucugcuugc

SEQ ID NO: 88799 - RNA, 22 nt, Human
auucucuauugguaaauuugac

SEQ ID NO: 88800 - RNA, 22 nt, Human
auucuagaguuucaauccaagg

SEQ ID NO: 88801 - RNA, 23 nt, Human
auuaugaagaagacucgccuguu

SEQ ID NO: 88802 - RNA, 22 nt, Human
auucuacucuuuaaauaugaaa

SEQ ID NO: 88803 - RNA, 22 nt, Human
auuaucuauccgccaacaguaa

SEQ ID NO: 88804 - RNA, 22 nt, Human
auuaugugagggacuuaaucau

SEQ ID NO: 88805 - RNA, 22 nt, Human
auuccuguggcuggguaaagua

SEQ ID NO: 88806 - RNA, 22 nt, Human
auguugaguggaugaacaaaca

SEQ ID NO: 88807 - RNA, 22 nt, Human
auguuuaaguguuuugccccaa

SEQ ID NO: 88808 - RNA, 22 nt, Human
auucuaauaagcguuuugucgc

SEQ ID NO: 88809 - RNA, 22 nt, Human
auucgaucacugccgaggaccu

SEQ ID NO: 88810 - RNA, 22 nt, Human
auuaaauagcagaagaaagaug

SEQ ID NO: 88811 - RNA, 22 nt, Human
auucuguugguuuaauagucaa

SEQ ID NO: 88812 - RNA, 22 nt, Human
auucuguuuaauacacgaaagg

SEQ ID NO: 88813 - RNA, 22 nt, Human
auucuuauaaaaaguguugacu

SEQ ID NO: 88814 - RNA, 19 nt, Human
auucaagugcuuagagauc

SEQ ID NO: 88815 - RNA, 22 nt, Human
auucaucuguacuucaauaucu

SEQ ID NO: 88816 - RNA, 22 nt, Human
auucaaugcacauguuuuggau

SEQ ID NO: 88817 - RNA, 22 nt, Human
auucaggacucuuccuugaaga

SEQ ID NO: 88818 - RNA, 17 nt, Human
auucaugaacauguccu

SEQ ID NO: 88819 - RNA, 18 nt, Human
auucauuugcguuuggcu

SEQ ID NO: 88820 - RNA, 22 nt, Human
auucaagauaagggucugggag

SEQ ID NO: 88821 - RNA, 22 nt, Human
auuauuugcuuaagcuggucuc

SEQ ID NO: 88822 - RNA, 23 nt, Human
auuauuucaggguuuugacuugc

SEQ ID NO: 88823 - RNA, 22 nt, Human
auucugcugccuaguuuaugaa

SEQ ID NO: 88824 - RNA, 21 nt, Human
auucugauguuucuauuguuu

SEQ ID NO: 88825 - RNA, 22 nt, Human
auucugaagcagaaaaggcaga

SEQ ID NO: 88826 - RNA, 22 nt, Human
auucaagagcccauguuuccug

SEQ ID NO: 88827 - RNA, 22 nt, Human
uuuguguuacaguccuagaacu

SEQ ID NO: 88828 - RNA, 17 nt, Human
uuugugauggcagaugc

SEQ ID NO: 88829 - RNA, 22 nt, Human
uuugugauaaguggauucaagg

SEQ ID NO: 88830 - RNA, 22 nt, Human
uuuccuguccugguacuuggca

SEQ ID NO: 88831 - RNA, 22 nt, Human
uuuccuuacuuauaaaaugggg

SEQ ID NO: 88832 - RNA, 22 nt, Human
uuuccuucccuccugggccuuc

SEQ ID NO: 88833 - RNA, 22 nt, Human
uuucgggauuucaaagagcaaa

SEQ ID NO: 88834 - RNA, 22 nt, Human
uuucuaaaaccagaguuuauaa

SEQ ID NO: 88835 - RNA, 22 nt, Human
uuucuauauucaguuucauaaa

SEQ ID NO: 88836 - RNA, 22 nt, Human
uuucagcaugacuguuaucuuu

SEQ ID NO: 88837 - RNA, 22 nt, Human
uuucaugauuaacuuagugaau

SEQ ID NO: 88838 - RNA, 22 nt, Human
uuucaucccugucagugaaggc

SEQ ID NO: 88839 - RNA, 22 nt, Human
uuucagugaaugaauggcuaac

SEQ ID NO: 88840 - RNA, 22 nt, Human
uuucuugggaaaugucagaagu

SEQ ID NO: 88841 - RNA, 22 nt, Human
uuucuugugauuuugaugaacu

SEQ ID NO: 88842 - RNA, 22 nt, Human
uuucuuugcugguuggcucucc

SEQ ID NO: 88843 - RNA, 22 nt, Human
uuugaagaaacagucuuaagag

SEQ ID NO: 88844 - RNA, 22 nt, Human
uuucugguuuuauucugggguu

SEQ ID NO: 88845 - RNA, 22 nt, Human
uuucuguugugaccugacucuu

SEQ ID NO: 88846 - RNA, 22 nt, Human
uuucuguucuguuggauucuuu

SEQ ID NO: 88847 - RNA, 22 nt, Human
uuucuguuuguaacuccagcaa

SEQ ID NO: 88848 - RNA, 22 nt, Human
uuucucuuucaaucugcaguac

SEQ ID NO: 88849 - RNA, 22 nt, Human
uuucuggauaagcagggucucu

SEQ ID NO: 88850 - RNA, 22 nt, Human
uuucuggaaacuguaaagagga

SEQ ID NO: 88851 - RNA, 23 nt, Human
uuucugaguuuuuuaaaagucca

SEQ ID NO: 88852 - RNA, 22 nt, Human
uuucugcauuuguauuggaaaa

SEQ ID NO: 88853 - RNA, 22 nt, Human
uuugaugauuuucuagagugua

SEQ ID NO: 88854 - RNA, 22 nt, Human
uuugaugagaaaugacuuaagu

SEQ ID NO: 88855 - RNA, 22 nt, Human
uuugagugcccauguuucccag

SEQ ID NO: 88856 - RNA, 22 nt, Human
uuugagaaugucaaucacaaga

SEQ ID NO: 88857 - RNA, 22 nt, Human
uuugaagaccuuaucucuaaau

SEQ ID NO: 88858 - RNA, 22 nt, Human
uuugaagauaaauauggagaaa

SEQ ID NO: 88859 - RNA, 22 nt, Human
uuugcuguaaugcaugucagag

SEQ ID NO: 88860 - RNA, 22 nt, Human
uuugcugaaaaaccacuugagu

SEQ ID NO: 88861 - RNA, 22 nt, Human
uuugauuaccuggggcccucug

SEQ ID NO: 88862 - RNA, 23 nt, Human
uuugcaaauuggacacaaccaca

SEQ ID NO: 88863 - RNA, 22 nt, Human
uuugcaaaguccauugaaguua

SEQ ID NO: 88864 - RNA, 22 nt, Human
uuugcauuaguuuagauuucaa

SEQ ID NO: 88865 - RNA, 22 nt, Human
uuugucauuuagcccauggugg

SEQ ID NO: 88866 - RNA, 22 nt, Human
uuuguauuucaaggcacucuca

SEQ ID NO: 88867 - RNA, 22 nt, Human
uuuguauuguuuauuucauuuu

SEQ ID NO: 88868 - RNA, 20 nt, Human
uuugucaacugcauccagca

SEQ ID NO: 88869 - RNA, 22 nt, Human
uuugucaggaauugaaaaguuu

SEQ ID NO: 88870 - RNA, 22 nt, Human
uuuggaugcugucauaugcugc

SEQ ID NO: 88871 - RNA, 22 nt, Human
uuuggcaagcagaugaagguag

SEQ ID NO: 88872 - RNA, 22 nt, Human
uuugcuuugacuuugggaguau

SEQ ID NO: 88873 - RNA, 22 nt, Human
uuuggcuaccugggagggaaag

SEQ ID NO: 88874 - RNA, 22 nt, Human
uuuggcuccccaggaucugaaa

SEQ ID NO: 88875 - RNA, 22 nt, Human
uuugggaaguaauuaauugcag

SEQ ID NO: 88876 - RNA, 22 nt, Human
uuuggggcucauuugcuuuugu

SEQ ID NO: 88877 - RNA, 22 nt, Human
uuuauuuuccaugucucuaggu

SEQ ID NO: 88878 - RNA, 22 nt, Human
uuuauuugggauuucucaucug

SEQ ID NO: 88879 - RNA, 19 nt, Human
uuuauuugagacaugccuu

SEQ ID NO: 88880 - RNA, 22 nt, Human
uuuaguugcuuuaguugagcug

SEQ ID NO: 88881 - RNA, 22 nt, Human
uuuauaagccagacacugcguu

SEQ ID NO: 88882 - RNA, 22 nt, Human
uuuauaaacacaagaugggcuc

SEQ ID NO: 88883 - RNA, 22 nt, Human
uuuauaauuguuauguuaccca

SEQ ID NO: 88884 - RNA, 22 nt, Human
uuuauaauuacguaaaauauuu

SEQ ID NO: 88885 - RNA, 22 nt, Human
uuuaucaggccaucuuaugucu

SEQ ID NO: 88886 - RNA, 22 nt, Human
uuuauguugagcaaaauaccac

SEQ ID NO: 88887 - RNA, 22 nt, Human
uuuauucacuuaucaggaacga

SEQ ID NO: 88888 - RNA, 22 nt, Human
uuguuuaaagaacuucugacuu

SEQ ID NO: 88889 - RNA, 22 nt, Human
uuguuguuguuguuauuuaguu

SEQ ID NO: 88890 - RNA, 22 nt, Human
uuuacaaggcaguuauuuuccu

SEQ ID NO: 88891 - RNA, 22 nt, Human
uuguguuuaaucuguuccacua

SEQ ID NO: 88892 - RNA, 20 nt, Human
uuuagcacauuguacaaaac

SEQ ID NO: 88893 - RNA, 22 nt, Human
uuuaguauaguaugugcucaaa

SEQ ID NO: 88894 - RNA, 22 nt, Human
uuuagaugcuguauguuauuuc

SEQ ID NO: 88895 - RNA, 22 nt, Human
uuuacuaauuaguuuuggaaca

SEQ ID NO: 88896 - RNA, 22 nt, Human
uuuagcaaggagaaauaauccu

SEQ ID NO: 88897 - RNA, 22 nt, Human
uuuacuauuaguauuucauuuu

SEQ ID NO: 88898 - RNA, 22 nt, Human
uuuagauguucccucuacccug

SEQ ID NO: 88899 - RNA, 22 nt, Human
uuggaggccacagucaucuuua

SEQ ID NO: 88900 - RNA, 22 nt, Human
uuggauagaauuuaaauugucu

SEQ ID NO: 88901 - RNA, 22 nt, Human
uugauggaggaaaaguuggaau

SEQ ID NO: 88902 - RNA, 20 nt, Human
uugauucacaaaaagcuuag

SEQ ID NO: 88903 - RNA, 21 nt, Human
uugauuuagcagaucuagcug

SEQ ID NO: 88904 - RNA, 22 nt, Human
uugauucauuuguucccauuuu

SEQ ID NO: 88905 - RNA, 22 nt, Human
uugggagaaaguuaacuuucua

SEQ ID NO: 88906 - RNA, 22 nt, Human
uugggacuguugucuaaaccau

SEQ ID NO: 88907 - RNA, 22 nt, Human
uugggaaauuugaaaauaaaag

SEQ ID NO: 88908 - RNA, 22 nt, Human
uugggcauuucuuauguauuuu

SEQ ID NO: 88909 - RNA, 22 nt, Human
uuggccugcuccagaacaaggg

SEQ ID NO: 88910 - RNA, 22 nt, Human
uugucaugauccuucuguuagg

SEQ ID NO: 88911 - RNA, 22 nt, Human
uugucauuuucuuaauguuccu

SEQ ID NO: 88912 - RNA, 22 nt, Human
uuguauuaauacacuccuuuuc

SEQ ID NO: 88913 - RNA, 22 nt, Human
uugugauuaauaacuuuucucu

SEQ ID NO: 88914 - RNA, 22 nt, Human
uugugcauuuuguuuuacuuau

SEQ ID NO: 88915 - RNA, 22 nt, Human
uuguggagaggaagcaaggagg

SEQ ID NO: 88916 - RNA, 22 nt, Human
uugguuuuuugguguaucuuau

SEQ ID NO: 88917 - RNA, 22 nt, Human
uuguaagacuguagaaugcaaa

SEQ ID NO: 88918 - RNA, 22 nt, Human
uuggggagaagagcuggucagg

SEQ ID NO: 88919 - RNA, 22 nt, Human
uugguguuucacuuccuugucg

SEQ ID NO: 88920 - RNA, 22 nt, Human
uuggugauugggaauggauggg

SEQ ID NO: 88921 - RNA, 22 nt, Human
uuuuagagacagcauggagaaa

SEQ ID NO: 88922 - RNA, 22 nt, Human
uuuuacaaugcaaauucuugcu

SEQ ID NO: 88923 - RNA, 22 nt, Human
uucuagaagggccuaggcauaa

SEQ ID NO: 88924 - RNA, 22 nt, Human
uucgucauuaugcagccuguga

SEQ ID NO: 88925 - RNA, 18 nt, Human
uucgucauggggaucgua

SEQ ID NO: 88926 - RNA, 22 nt, Human
uucucugaagagccagcccuua

SEQ ID NO: 88927 - RNA, 22 nt, Human
uuuucauuguuaguuucuccuu

SEQ ID NO: 88928 - RNA, 22 nt, Human
uuuuccgaccuuaggaaggaac

SEQ ID NO: 88929 - RNA, 22 nt, Human
uuuucaguuccaucucugcucu

SEQ ID NO: 88930 - RNA, 22 nt, Human
uucuauaagagaugaauacagu

SEQ ID NO: 88931 - RNA, 22 nt, Human
uuuuauaauacccuugacuaau

SEQ ID NO: 88932 - RNA, 21 nt, Human
uucuauauugagaauuggcua

SEQ ID NO: 88933 - RNA, 22 nt, Human
uuuucugauccuucuaacuuga

SEQ ID NO: 88934 - RNA, 22 nt, Human
uuuucucucacuucacauauuu

SEQ ID NO: 88935 - RNA, 22 nt, Human
uuuucucuuugcuucucuaaaa

SEQ ID NO: 88936 - RNA, 22 nt, Human
uuuucuaggcccuggauuaugu

SEQ ID NO: 88937 - RNA, 22 nt, Human
uuuuccuugagucggggcacag

SEQ ID NO: 88938 - RNA, 22 nt, Human
uuuuccuucugauacuccauuu

SEQ ID NO: 88939 - RNA, 22 nt, Human
uuuucuacaaaucuggacuuuu

SEQ ID NO: 88940 - RNA, 22 nt, Human
uuuugguuugaguauuuuuuuu

SEQ ID NO: 88941 - RNA, 22 nt, Human
uucuuaaugcauccuguguuca

SEQ ID NO: 88942 - RNA, 22 nt, Human
uucuguuuauaauuugcaguug

SEQ ID NO: 88943 - RNA, 22 nt, Human
uucuguuuuuauucuaucucug

SEQ ID NO: 88944 - RNA, 22 nt, Human
uuuuggaaaaaccaguauggaa

SEQ ID NO: 88945 - RNA, 22 nt, Human
uuuugauacaaguuguaaaaaa

SEQ ID NO: 88946 - RNA, 22 nt, Human
uuuugagucuggcaguuuuguu

SEQ ID NO: 88947 - RNA, 22 nt, Human
uuuugaauaauucagaaacagc

SEQ ID NO: 88948 - RNA, 22 nt, Human
uuuucuuggaguggcuguccuu

SEQ ID NO: 88949 - RNA, 22 nt, Human
uuuuuggacccaucuucuuuuu

SEQ ID NO: 88950 - RNA, 22 nt, Human
uuuuucugccucucucccacau

SEQ ID NO: 88951 - RNA, 22 nt, Human
uucuuuucuucccuguuuauua

SEQ ID NO: 88952 - RNA, 21 nt, Human
uucuuugcugcuguuuuugua

SEQ ID NO: 88953 - RNA, 22 nt, Human
uuuuucuuugcuuuccacuggc

SEQ ID NO: 88954 - RNA, 22 nt, Human
uuuuucuuugguaacucuuccu

SEQ ID NO: 88955 - RNA, 22 nt, Human
uucuugcuucucugucugccuc

SEQ ID NO: 88956 - RNA, 22 nt, Human
uucuugcuuccggugcuccagg

SEQ ID NO: 88957 - RNA, 22 nt, Human
uuuuuaaaauuaggacggcacg

SEQ ID NO: 88958 - RNA, 22 nt, Human
uucuugucuuuguuauguagga

SEQ ID NO: 88959 - RNA, 23 nt, Human
uucuuuccuuaucccauuuacuu

SEQ ID NO: 88960 - RNA, 22 nt, Human
uucuucuguuggcagagcauac

SEQ ID NO: 88961 - RNA, 22 nt, Human
uuuuguggacugauccgaggac

SEQ ID NO: 88962 - RNA, 22 nt, Human
uucuucuucuuccucauccuca

SEQ ID NO: 88963 - RNA, 22 nt, Human
uuuuuguaaaugaaguuuuauu

SEQ ID NO: 88964 - RNA, 21 nt, Human
uugaaguggguagcuggcggg

SEQ ID NO: 88965 - RNA, 22 nt, Human
uuuuuuccagcuucuagaggcc

SEQ ID NO: 88966 - RNA, 22 nt, Human
uugaauaaggcauaaagauacu

SEQ ID NO: 88967 - RNA, 22 nt, Human
uugaugacuaaagaaagcugcu

SEQ ID NO: 88968 - RNA, 22 nt, Human
uugaugagucacuuucuguaaa

SEQ ID NO: 88969 - RNA, 22 nt, Human
uuuuuuuccaguuauucauuuu

SEQ ID NO: 88970 - RNA, 21 nt, Human
uugagcuuuuaguacagacag

SEQ ID NO: 88971 - RNA, 22 nt, Human
uuuuuuguggcuggaagaaaaa

SEQ ID NO: 88972 - RNA, 22 nt, Human
uugagaugacuuaaaucacugu

SEQ ID NO: 88973 - RNA, 22 nt, Human
uuaguggguuccauuucuaugg

SEQ ID NO: 88974 - RNA, 22 nt, Human
uuuauuuggugguguuacuguu

SEQ ID NO: 88975 - RNA, 22 nt, Human
uuaguuaauaaauauugagugu

SEQ ID NO: 88976 - RNA, 22 nt, Human
uuagugaagaagcaucuuuagu

SEQ ID NO: 88977 - RNA, 22 nt, Human
uucagaagguaggaaugucccu

SEQ ID NO: 88978 - RNA, 22 nt, Human
uucagaaagugaaucuuguuau

SEQ ID NO: 88979 - RNA, 22 nt, Human
uucagaacugucuguccuuuuc

SEQ ID NO: 88980 - RNA, 22 nt, Human
uuugauuuuuugagcaguguau

SEQ ID NO: 88981 - RNA, 22 nt, Human
uucacauucauuucuuauguuu

SEQ ID NO: 88982 - RNA, 22 nt, Human
uuugaauauacuucaaacaaag

SEQ ID NO: 88983 - RNA, 22 nt, Human
uucacccaaaucaagcuggccu

SEQ ID NO: 88984 - RNA, 23 nt, Human
uuugccuaaugaagacuauguca

SEQ ID NO: 88985 - RNA, 22 nt, Human
uucacuguucuuagagaagacc

SEQ ID NO: 88986 - RNA, 22 nt, Human
uuuggaggaaugaguuuaauau

SEQ ID NO: 88987 - RNA, 22 nt, Human
uuuggcuacucuucauugguga

SEQ ID NO: 88988 - RNA, 22 nt, Human
uucauauuguggucuugcauuc

SEQ ID NO: 88989 - RNA, 22 nt, Human
uucccuagagagauuuuuauuc

SEQ ID NO: 88990 - RNA, 22 nt, Human
uucccgcugcuggaguuggggc

SEQ ID NO: 88991 - RNA, 22 nt, Human
uuuguguuuucaggcacauggc

SEQ ID NO: 88992 - RNA, 21 nt, Human
uuuguucaggggcaaaguuaa

SEQ ID NO: 88993 - RNA, 22 nt, Human
uuuguucaccuagcaaacuuuu

SEQ ID NO: 88994 - RNA, 20 nt, Human
uucaugcagugguugcugug

SEQ ID NO: 88995 - RNA, 22 nt, Human
uuccaaggcugcuauuuguuuc

SEQ ID NO: 88996 - RNA, 20 nt, Human
uuugugaggccagagaacag

SEQ ID NO: 88997 - RNA, 22 nt, Human
uuccagauguuuaaguucugcu

SEQ ID NO: 88998 - RNA, 19 nt, Human
uuccacugcuuagcauugc

SEQ ID NO: 88999 - RNA, 22 nt, Human
uuuuaaaacaugucaaaaugug

SEQ ID NO: 89000 - RNA, 20 nt, Human
uuccucaaaagucugaugcu

SEQ ID NO: 89001 - RNA, 22 nt, Human
uuuguuuauuuacuuugggccu

SEQ ID NO: 89002 - RNA, 20 nt, Human
uuccuuaucuguaaagugga

SEQ ID NO: 89003 - RNA, 22 nt, Human
uuccuuuaaccaagagcaguac

SEQ ID NO: 89004 - RNA, 20 nt, Human
uuccuuucuuucuuuuuuuu

SEQ ID NO: 89005 - RNA, 22 nt, Human
uuuuaaaguaauugaagcuugu

SEQ ID NO: 89006 - RNA, 22 nt, Human
uucgcggccaggcggggaggcc

SEQ ID NO: 89007 - RNA, 22 nt, Human
uuuuaacuuuaccauuucuuca

SEQ ID NO: 89008 - RNA, 22 nt, Human
uuuuaacuuuggguucucuuua

SEQ ID NO: 89009 - RNA, 22 nt, Human
uuggauugugaaaguauucucu

SEQ ID NO: 89010 - RNA, 22 nt, Human
uugcggauguccacgucacacu

SEQ ID NO: 89011 - RNA, 19 nt, Human
uguguuccauccaccaccc

SEQ ID NO: 89012 - RNA, 22 nt, Human
uuggcauuccagaugcuuuucu

SEQ ID NO: 89013 - RNA, 22 nt, Human
uuggcguuuccuguucugggug

SEQ ID NO: 89014 - RNA, 22 nt, Human
uguuauugccucaugagacucc

SEQ ID NO: 89015 - RNA, 22 nt, Human
uguuaguauuggcaaauuuguu

SEQ ID NO: 89016 - RNA, 22 nt, Human
uuggccaaggaccuuuuuggag

SEQ ID NO: 89017 - RNA, 22 nt, Human
uugucagcuagugaugcuguuc

SEQ ID NO: 89018 - RNA, 22 nt, Human
uugucaggaacuaugauuaugc

SEQ ID NO: 89019 - RNA, 22 nt, Human
uguuuaaauagaacauacugca

SEQ ID NO: 89020 - RNA, 22 nt, Human
uguuguucuuuuucuucuuguu

SEQ ID NO: 89021 - RNA, 22 nt, Human
uuggggcugcguauuuccaugu

SEQ ID NO: 89022 - RNA, 22 nt, Human
uuggucaagacugauaucaaga

SEQ ID NO: 89023 - RNA, 22 nt, Human
uugguauucaguuggauuugga

SEQ ID NO: 89024 - RNA, 22 nt, Human
uugguugcugaugagcuuugag

SEQ ID NO: 89025 - RNA, 22 nt, Human
uugguuuuauucguauuuguau

SEQ ID NO: 89026 - RNA, 21 nt, Human
uguuuuguaauagauacuaug

SEQ ID NO: 89027 - RNA, 22 nt, Human
uguuuucccacugguuuguaca

SEQ ID NO: 89028 - RNA, 22 nt, Human
uguuuucuuuccccuucuuuuc

SEQ ID NO: 89029 - RNA, 22 nt, Human
uguuuucaucucucacccagaa

SEQ ID NO: 89030 - RNA, 22 nt, Human
uugucuguacuggcugcaucga

SEQ ID NO: 89031 - RNA, 22 nt, Human
uugugacaauacagcauggaga

SEQ ID NO: 89032 - RNA, 22 nt, Human
uuaaaagaauccuguuauccuc

SEQ ID NO: 89033 - RNA, 22 nt, Human
uuguggcaggauggacagcaga

SEQ ID NO: 89034 - RNA, 22 nt, Human
uguuuuuucccccccuucuaaa

SEQ ID NO: 89035 - RNA, 22 nt, Human
uguuuuuuagagugauacuuuu

SEQ ID NO: 89036 - RNA, 22 nt, Human
uguuuuuauucuuaauguuuca

SEQ ID NO: 89037 - RNA, 18 nt, Human
uuuacgaacucacuugag

SEQ ID NO: 89038 - RNA, 22 nt, Human
uuuagaaugaaugcaagagaau

SEQ ID NO: 89039 - RNA, 22 nt, Human
uuuacuuuugguaaggucauuu

SEQ ID NO: 89040 - RNA, 22 nt, Human
uuuaauuauaucugggcaguua

SEQ ID NO: 89041 - RNA, 22 nt, Human
uuuaaugucuuggaaaaagacu

SEQ ID NO: 89042 - RNA, 22 nt, Human
uuuaccucguuguguccuuguu

SEQ ID NO: 89043 - RNA, 22 nt, Human
uuuaccugucuguagaacauaa

SEQ ID NO: 89044 - RNA, 20 nt, Human
uuuaacuggccuucuggcuc

SEQ ID NO: 89045 - RNA, 22 nt, Human
uuacaagaucuuugaaggcaag

SEQ ID NO: 89046 - RNA, 19 nt, Human
uuacaugacauaugaagga

SEQ ID NO: 89047 - RNA, 22 nt, Human
uuuaaucaguugguaauauuga

SEQ ID NO: 89048 - RNA, 22 nt, Human
uuuagcaaaaaagcucugcgua

SEQ ID NO: 89049 - RNA, 22 nt, Human
uuagaaaaaggcuguggucuua

SEQ ID NO: 89050 - RNA, 22 nt, Human
uuagaaauguccuacuaauaug

SEQ ID NO: 89051 - RNA, 22 nt, Human
uuacuuucugggauaucaaaug

SEQ ID NO: 89052 - RNA, 22 nt, Human
uuagaugaaaaucggaacaugu

SEQ ID NO: 89053 - RNA, 22 nt, Human
uuagaguucaagcuuuaggaaa

SEQ ID NO: 89054 - RNA, 20 nt, Human
uuagaggccaugucuuguuu

SEQ ID NO: 89055 - RNA, 22 nt, Human
uuagaguacaggauuguuuuaa

SEQ ID NO: 89056 - RNA, 22 nt, Human
uuuagugaagcuuugcauuuca

SEQ ID NO: 89057 - RNA, 22 nt, Human
uuuagugagugugaaucaaaug

SEQ ID NO: 89058 - RNA, 22 nt, Human
uuuauguuuguuuuugaaauaa

SEQ ID NO: 89059 - RNA, 22 nt, Human
uuuaugucaaaaguaaaaugaa

SEQ ID NO: 89060 - RNA, 22 nt, Human
uuuaugguacaggaaugcuguu

SEQ ID NO: 89061 - RNA, 22 nt, Human
uuaguauuuuuugaaugaugaa

SEQ ID NO: 89062 - RNA, 22 nt, Human
uuguuauuauuauuuucguucu

SEQ ID NO: 89063 - RNA, 22 nt, Human
uuguuauaggaucagugucacu

SEQ ID NO: 89064 - RNA, 22 nt, Human
uuaaaucaggcaucauuucagu

SEQ ID NO: 89065 - RNA, 22 nt, Human
uuaaagguacuccuaagcgggg

SEQ ID NO: 89066 - RNA, 22 nt, Human
uuaacgaauugugcauaauucc

SEQ ID NO: 89067 - RNA, 22 nt, Human
uuaaacauuuccacuugccagu

SEQ ID NO: 89068 - RNA, 22 nt, Human
uuaacccagccauuuucaauuu

SEQ ID NO: 89069 - RNA, 22 nt, Human
uuaaggcuguggggauuacugc

SEQ ID NO: 89070 - RNA, 22 nt, Human
uuaagagaagaguaucuagaac

SEQ ID NO: 89071 - RNA, 22 nt, Human
uuguuugcacuuuagagacugu

SEQ ID NO: 89072 - RNA, 22 nt, Human
uuaauaaauugugguaccagag

SEQ ID NO: 89073 - RNA, 22 nt, Human
uuaagguggcauacaacacagc

SEQ ID NO: 89074 - RNA, 22 nt, Human
uuguuuuaaaaagaauaacuac

SEQ ID NO: 89075 - RNA, 22 nt, Human
uuaauauuaagauauugagugg

SEQ ID NO: 89076 - RNA, 22 nt, Human
uuguuuuaguagaaguuacaug

SEQ ID NO: 89077 - RNA, 22 nt, Human
uuaaucuauuucauauaaggga

SEQ ID NO: 89078 - RNA, 22 nt, Human
uuguuuucuaguguuuugaaua

SEQ ID NO: 89079 - RNA, 22 nt, Human
uuuaaaacagcauuuaaaaggu

SEQ ID NO: 89080 - RNA, 22 nt, Human
uuguuuuucucuagggaaggcu

SEQ ID NO: 89081 - RNA, 22 nt, Human
uuaauucuugagcugucuuucc

SEQ ID NO: 89082 - RNA, 21 nt, Human
uuaaugcuaugcagaaaaucu

SEQ ID NO: 89083 - RNA, 22 nt, Human
uuuaaacuaacaguacacguug

SEQ ID NO: 89084 - RNA, 22 nt, Human
uuuaaauaguugguuuuuuugc

SEQ ID NO: 89085 - RNA, 22 nt, Human
uuuaaaacaguacguuuucuua

SEQ ID NO: 89086 - RNA, 22 nt, Human
uuuaaaccuaucuaagaaauag

SEQ ID NO: 89087 - RNA, 22 nt, Human
uugagauggccuuuuuuauacu

SEQ ID NO: 89088 - RNA, 22 nt, Human
uugagauuuggagguaauuccc

SEQ ID NO: 89089 - RNA, 22 nt, Human
uugaaucauauguaauugacuu

SEQ ID NO: 89090 - RNA, 22 nt, Human
uugaauuuagguuuaugugaaa

SEQ ID NO: 89091 - RNA, 22 nt, Human
uugaugacauuuagcauaauug

SEQ ID NO: 89092 - RNA, 22 nt, Human
uugaggaagggaggcaaaacug

SEQ ID NO: 89093 - RNA, 22 nt, Human
uugauuccagcguuccaucagc

SEQ ID NO: 89094 - RNA, 22 nt, Human
uugauuggguauaaugacagga

SEQ ID NO: 89095 - RNA, 20 nt, Human
uugcaaagugaauagcaauu

SEQ ID NO: 89096 - RNA, 22 nt, Human
ugucuuaaaauuuuagggcuau

SEQ ID NO: 89097 - RNA, 22 nt, Human
ugucuuaugcugcauagacuau

SEQ ID NO: 89098 - RNA, 22 nt, Human
uugccgacuggccaaggaguaa

SEQ ID NO: 89099 - RNA, 20 nt, Human
uugcaugcagccggaugcug

SEQ ID NO: 89100 - RNA, 22 nt, Human
uugcagugucaucuagacgugg

SEQ ID NO: 89101 - RNA, 22 nt, Human
uugcauauguccagccaugcau

SEQ ID NO: 89102 - RNA, 22 nt, Human
uugaaagucuaagaauagguau

SEQ ID NO: 89103 - RNA, 22 nt, Human
uguagaaguuaauugaugagua

SEQ ID NO: 89104 - RNA, 20 nt, Human
uugaaagucagggcuccagu

SEQ ID NO: 89105 - RNA, 22 nt, Human
uugaaaaaugcccagcagacaa

SEQ ID NO: 89106 - RNA, 22 nt, Human
ugguuuuuuguaggauaaacau

SEQ ID NO: 89107 - RNA, 22 nt, Human
ugguuuucuuaauuagcaguca

SEQ ID NO: 89108 - RNA, 22 nt, Human
uugaaaaaauguguuuaaggag

SEQ ID NO: 89109 - RNA, 22 nt, Human
uguaagaagaaaaccguaugga

SEQ ID NO: 89110 - RNA, 22 nt, Human
uucuuuuaauuucugucugcag

SEQ ID NO: 89111 - RNA, 22 nt, Human
uucuuuguccuagcauucuaca

SEQ ID NO: 89112 - RNA, 22 nt, Human
uucuuuuaauagagauccugug

SEQ ID NO: 89113 - RNA, 22 nt, Human
ugguuauggaacuggcuauggc

SEQ ID NO: 89114 - RNA, 22 nt, Human
uucuugcgaaagaaugagcuga

SEQ ID NO: 89115 - RNA, 22 nt, Human
uggguauauauguugcuacaga

SEQ ID NO: 89116 - RNA, 18 nt, Human
uucugcggugacagauau

SEQ ID NO: 89117 - RNA, 22 nt, Human
uggguguuccuggggugcaagg

SEQ ID NO: 89118 - RNA, 19 nt, Human
uucugcucaguaacacccu

SEQ ID NO: 89119 - RNA, 22 nt, Human
ugguaaaugucuaacaaucacu

SEQ ID NO: 89120 - RNA, 22 nt, Human
uucugcuuuaaagcucauguuu

SEQ ID NO: 89121 - RNA, 22 nt, Human
uucuggagacccagcaacaggg

SEQ ID NO: 89122 - RNA, 22 nt, Human
uucuggaguuugaagaucaggu

SEQ ID NO: 89123 - RNA, 22 nt, Human
ugguccaugcuccaggcacauu

SEQ ID NO: 89124 - RNA, 22 nt, Human
ugguaugaaggaggccggcagc

SEQ ID NO: 89125 - RNA, 22 nt, Human
uuaucuuuuaaaaacacuugug

SEQ ID NO: 89126 - RNA, 22 nt, Human
uuaugucauuugaauuaauuuu

SEQ ID NO: 89127 - RNA, 22 nt, Human
uggcugaggcuuuucuuaaaga

SEQ ID NO: 89128 - RNA, 22 nt, Human
ugggaagccaguaucagacuaa

SEQ ID NO: 89129 - RNA, 22 nt, Human
ugggaagcugagccucgaugug

SEQ ID NO: 89130 - RNA, 22 nt, Human
ugggaauuuaugagaaaauaua

SEQ ID NO: 89131 - RNA, 22 nt, Human
ugggaaaauagcuauuuugaaa

SEQ ID NO: 89132 - RNA, 22 nt, Human
uuccauuacuaaugccugcaau

SEQ ID NO: 89133 - RNA, 22 nt, Human
uggcuuuuuucuccccuuggau

SEQ ID NO: 89134 - RNA, 22 nt, Human
uggcuuauggguccucccucuu

SEQ ID NO: 89135 - RNA, 22 nt, Human
uggcuguuggagcuggaagaug

SEQ ID NO: 89136 - RNA, 22 nt, Human
uuccucauuuauaggaaagaga

SEQ ID NO: 89137 - RNA, 22 nt, Human
ugggagagaaauuuaaguuuuu

SEQ ID NO: 89138 - RNA, 22 nt, Human
uuccgcuuucaauggcuuggcu

SEQ ID NO: 89139 - RNA, 22 nt, Human
uucccuuggcuuugauuguguu

SEQ ID NO: 89140 - RNA, 22 nt, Human
uuccuuuucuucuaccacaugu

SEQ ID NO: 89141 - RNA, 22 nt, Human
uucgucaauaugcagccuguga

SEQ ID NO: 89142 - RNA, 22 nt, Human
uucgcucuucacacagugcuga

SEQ ID NO: 89143 - RNA, 22 nt, Human
uucggcagaaagucauuugucu

SEQ ID NO: 89144 - RNA, 22 nt, Human
ugcucuguucaguguaucuugu

SEQ ID NO: 89145 - RNA, 22 nt, Human
ugcucugcuaggagaagaauga

SEQ ID NO: 89146 - RNA, 22 nt, Human
ugcuccugaacacagcccuaug

SEQ ID NO: 89147 - RNA, 22 nt, Human
ugcucuuucaggcauagaccuu

SEQ ID NO: 89148 - RNA, 19 nt, Human
uguugugggccacuaacua

SEQ ID NO: 89149 - RNA, 22 nt, Human
uguuggauuuugugaaauauga

SEQ ID NO: 89150 - RNA, 22 nt, Human
uguuuccuaagugucucugaag

SEQ ID NO: 89151 - RNA, 22 nt, Human
uguuuaguuuugcaccaauaaa

SEQ ID NO: 89152 - RNA, 22 nt, Human
uguuuguaugauggcacaucca

SEQ ID NO: 89153 - RNA, 22 nt, Human
uguuugaugugcacgugugugu

SEQ ID NO: 89154 - RNA, 22 nt, Human
uguuuucuauuaccugagauug

SEQ ID NO: 89155 - RNA, 22 nt, Human
uguuuguuuuguauuuuuaauu

SEQ ID NO: 89156 - RNA, 22 nt, Human
uguuuuuagcuguuuuuuggau

SEQ ID NO: 89157 - RNA, 22 nt, Human
uguuuuucaagcauuuauuaau

SEQ ID NO: 89158 - RNA, 22 nt, Human
uuaaaauuguuaacuuugguga

SEQ ID NO: 89159 - RNA, 22 nt, Human
uuaaagaguuuauuacuuguaa

SEQ ID NO: 89160 - RNA, 22 nt, Human
uuaacauuguccuuagcagauu

SEQ ID NO: 89161 - RNA, 22 nt, Human
uuaacuaguauuuuuaguccug

SEQ ID NO: 89162 - RNA, 22 nt, Human
uuaagggauugagauggaauga

SEQ ID NO: 89163 - RNA, 22 nt, Human
ugcuugaggcuugucaucuaac

SEQ ID NO: 89164 - RNA, 22 nt, Human
uuaauuguuagauagauuauag

SEQ ID NO: 89165 - RNA, 22 nt, Human
uuaauugggugcuuuguaaaua

SEQ ID NO: 89166 - RNA, 21 nt, Human
uuaauugagggauggggguga

SEQ ID NO: 89167 - RNA, 22 nt, Human
uuaauguugacacacuagcaca

SEQ ID NO: 89168 - RNA, 22 nt, Human
uuaauguggaagaguuuggcua

SEQ ID NO: 89169 - RNA, 22 nt, Human
uuaauguuuuagaaugagagug

SEQ ID NO: 89170 - RNA, 22 nt, Human
ugcuucuuugggggugaagaga

SEQ ID NO: 89171 - RNA, 22 nt, Human
uuaaugcauguaaaugugcaaa

SEQ ID NO: 89172 - RNA, 22 nt, Human
ugcuuaaagcauuucucuuuaa

SEQ ID NO: 89173 - RNA, 22 nt, Human
uuaauauuuauugguaaucacu

SEQ ID NO: 89174 - RNA, 22 nt, Human
uuagcgcucucuccauucuuaa

SEQ ID NO: 89175 - RNA, 21 nt, Human
uuagcaguuguugauuuccag

SEQ ID NO: 89176 - RNA, 22 nt, Human
uuaggaauugcuucauguuugg

SEQ ID NO: 89177 - RNA, 22 nt, Human
uuagguuuaugaggucugcauu

SEQ ID NO: 89178 - RNA, 22 nt, Human
uuaguauuuucaccauaugagg

SEQ ID NO: 89179 - RNA, 22 nt, Human
uggaagaagcuacaagcgguga

SEQ ID NO: 89180 - RNA, 23 nt, Human
uggaagaaaaugguuuggcugug

SEQ ID NO: 89181 - RNA, 22 nt, Human
uggaagaaaugguugagccaug

SEQ ID NO: 89182 - RNA, 20 nt, Human
uuaguuacuuagugagaguc

SEQ ID NO: 89183 - RNA, 22 nt, Human
uggaauuaucugaagugauuug

SEQ ID NO: 89184 - RNA, 21 nt, Human
uggaauuggaaaccauucuau

SEQ ID NO: 89185 - RNA, 22 nt, Human
uuauauuaaaaaucgcuaacag

SEQ ID NO: 89186 - RNA, 19 nt, Human
uuauccacagggaauuuau

SEQ ID NO: 89187 - RNA, 22 nt, Human
uggagauauucuauauuuuaua

SEQ ID NO: 89188 - RNA, 22 nt, Human
uggagaaauaacauuuggauuc

SEQ ID NO: 89189 - RNA, 22 nt, Human
uggacccaccccagggccugcu

SEQ ID NO: 89190 - RNA, 22 nt, Human
uggagagcaggugaaggaaaga

SEQ ID NO: 89191 - RNA, 22 nt, Human
uuaucagggaguuguguguucu

SEQ ID NO: 89192 - RNA, 22 nt, Human
uuauauuuuauuuaauuaaaua

SEQ ID NO: 89193 - RNA, 22 nt, Human
uggaaaggaguucuguuuauuu

SEQ ID NO: 89194 - RNA, 22 nt, Human
uuagagagaggagagagagaga

SEQ ID NO: 89195 - RNA, 22 nt, Human
uuagacaucaagaagccaaugu

SEQ ID NO: 89196 - RNA, 22 nt, Human
uuacuuaucugaugugauuuuu

SEQ ID NO: 89197 - RNA, 22 nt, Human
uuacuuuuuucccccuuagaug

SEQ ID NO: 89198 - RNA, 22 nt, Human
uggaaaauuuagaaagauuuau

SEQ ID NO: 89199 - RNA, 22 nt, Human
uuagagagguuggagugguaga

SEQ ID NO: 89200 - RNA, 22 nt, Human
uuagaguguguguaguagggug

SEQ ID NO: 89201 - RNA, 22 nt, Human
uggaagaaaacuuggaaggcau

SEQ ID NO: 89202 - RNA, 22 nt, Human
uggaacuagugucugagauggg

SEQ ID NO: 89203 - RNA, 22 nt, Human
uggaacuuccucacuuucccuc

SEQ ID NO: 89204 - RNA, 22 nt, Human
uuagaugcugugauuuuucaaa

SEQ ID NO: 89205 - RNA, 21 nt, Human
ugcuuucugugcuuuuucugc

SEQ ID NO: 89206 - RNA, 22 nt, Human
ugcuuucaaugaauuguauacu

SEQ ID NO: 89207 - RNA, 20 nt, Human
uuacucaaccaggcuucuac

SEQ ID NO: 89208 - RNA, 22 nt, Human
ugcuuuggcccaacauugaugc

SEQ ID NO: 89209 - RNA, 22 nt, Human
ugcuuuuggcagcaguguuuau

SEQ ID NO: 89210 - RNA, 22 nt, Human
uggaaaagaugucuuccugaau

SEQ ID NO: 89211 - RNA, 22 nt, Human
uuacuggaauauaaagauaaga

SEQ ID NO: 89212 - RNA, 22 nt, Human
uuacuguguguaaaauaucuuu

SEQ ID NO: 89213 - RNA, 22 nt, Human
ucuuuuuaugucaaaaucgaug

SEQ ID NO: 89214 - RNA, 22 nt, Human
ugaaaaaugcuuuaaugcaugu

SEQ ID NO: 89215 - RNA, 22 nt, Human
ucuuuuucccugguuccuuuuu

SEQ ID NO: 89216 - RNA, 22 nt, Human
ugaaaaauauuuuuagaaauaa

SEQ ID NO: 89217 - RNA, 22 nt, Human
ugacguuugcgccgcgcacgac

SEQ ID NO: 89218 - RNA, 22 nt, Human
ugacuuuucuccucugaaguuu

SEQ ID NO: 89219 - RNA, 20 nt, Human
ugagaaacaagggcuggucu

SEQ ID NO: 89220 - RNA, 22 nt, Human
uggguuuaccaguguuucuucc

SEQ ID NO: 89221 - RNA, 23 nt, Human
uggguuucagugccaaugcugcc

SEQ ID NO: 89222 - RNA, 22 nt, Human
uggguuuauuguauuucccuua

SEQ ID NO: 89223 - RNA, 22 nt, Human
ugagaauuuaacuugauuagga

SEQ ID NO: 89224 - RNA, 22 nt, Human
ugguaaaguguacugaauauga

SEQ ID NO: 89225 - RNA, 22 nt, Human
ugagacaaaguuguuggauguu

SEQ ID NO: 89226 - RNA, 22 nt, Human
ugguauaaaaaaaugaguauaa

SEQ ID NO: 89227 - RNA, 22 nt, Human
ugagagaggugaaaugacuuuc

SEQ ID NO: 89228 - RNA, 22 nt, Human
ugagagggagacagcucuagca

SEQ ID NO: 89229 - RNA, 22 nt, Human
ugguauaaaaauuugugaaugu

SEQ ID NO: 89230 - RNA, 22 nt, Human
uggucaaauccuagauccuuug

SEQ ID NO: 89231 - RNA, 22 nt, Human
ugagauuuagaacuggauuuca

SEQ ID NO: 89232 - RNA, 19 nt, Human
ugagauuguaugaggagau

SEQ ID NO: 89233 - RNA, 22 nt, Human
ugagauucuguucagaaaaaug

SEQ ID NO: 89234 - RNA, 22 nt, Human
uggucugauggucccaccaccg

SEQ ID NO: 89235 - RNA, 22 nt, Human
ugguccucacccuacccagcug

SEQ ID NO: 89236 - RNA, 21 nt, Human
ugagucuuagagaacuucagg

SEQ ID NO: 89237 - RNA, 23 nt, Human
ugguuuucagaagaccuuguuag

SEQ ID NO: 89238 - RNA, 22 nt, Human
uguaaucaugguagaggcaaag

SEQ ID NO: 89239 - RNA, 23 nt, Human
uguaaaacaccguuauugcaccu

SEQ ID NO: 89240 - RNA, 20 nt, Human
ugauaggcauugacauaagg

SEQ ID NO: 89241 - RNA, 20 nt, Human
ugauaugcgguacagagagg

SEQ ID NO: 89242 - RNA, 22 nt, Human
ugaugaugccaaaauuuggcau

SEQ ID NO: 89243 - RNA, 22 nt, Human
ugauuucauaugacagcuuuuu

SEQ ID NO: 89244 - RNA, 22 nt, Human
ugauuugguauccaggauuuaa

SEQ ID NO: 89245 - RNA, 22 nt, Human
ugauuuggcaucaguguauccu

SEQ ID NO: 89246 - RNA, 22 nt, Human
ugauuuguuuaaauugcucguu

SEQ ID NO: 89247 - RNA, 22 nt, Human
ugcaacuacccccaggauuuua

SEQ ID NO: 89248 - RNA, 22 nt, Human
ugucauauagaauguucuauga

SEQ ID NO: 89249 - RNA, 22 nt, Human
ugucauuuauucucuuauucua

SEQ ID NO: 89250 - RNA, 22 nt, Human
ugcagacuguuucuugacugaa

SEQ ID NO: 89251 - RNA, 22 nt, Human
ugugagauuuuauuugauaugc

SEQ ID NO: 89252 - RNA, 22 nt, Human
ugugagccuuuauuaaccucau

SEQ ID NO: 89253 - RNA, 19 nt, Human
ugcagcacuaaaaacuuuc

SEQ ID NO: 89254 - RNA, 22 nt, Human
ugcauguuuuaagugaagcuga

SEQ ID NO: 89255 - RNA, 22 nt, Human
ugcaugguuauauacuacuagu

SEQ ID NO: 89256 - RNA, 22 nt, Human
ugcauuacuuugauaagcgucu

SEQ ID NO: 89257 - RNA, 22 nt, Human
ugccgcuuucuggcccucaguc

SEQ ID NO: 89258 - RNA, 22 nt, Human
ugcaugacaauugccgucaagu

SEQ ID NO: 89259 - RNA, 22 nt, Human
ugcagcuucucugcaacaggag

SEQ ID NO: 89260 - RNA, 22 nt, Human
ugugauuucaaagggugucuuu

SEQ ID NO: 89261 - RNA, 22 nt, Human
ugugcuauuuuugcauaugugu

SEQ ID NO: 89262 - RNA, 22 nt, Human
ugugaugagaugaacuguagac

SEQ ID NO: 89263 - RNA, 22 nt, Human
ugcagccuuuguccuugggcua

SEQ ID NO: 89264 - RNA, 22 nt, Human
ucugcuguugaucaugacuagc

SEQ ID NO: 89265 - RNA, 22 nt, Human
ucugguagauuauuuagaguac

SEQ ID NO: 89266 - RNA, 22 nt, Human
ucuguucacaauuacacacacu

SEQ ID NO: 89267 - RNA, 22 nt, Human
uggauauuuuguaugugcguuu

SEQ ID NO: 89268 - RNA, 22 nt, Human
ucuguuuuucagaccuuuuugg

SEQ ID NO: 89269 - RNA, 22 nt, Human
ucuguuuuuaucuauucuguua

SEQ ID NO: 89270 - RNA, 22 nt, Human
ucuugcucuguucuaaaggauu

SEQ ID NO: 89271 - RNA, 22 nt, Human
uggcaguugcaguaacuuguau

SEQ ID NO: 89272 - RNA, 21 nt, Human
uggccaaggaauagaagcucu

SEQ ID NO: 89273 - RNA, 22 nt, Human
ucuuugcagaauuuaacuuugc

SEQ ID NO: 89274 - RNA, 22 nt, Human
ucuucaugaaauugauugcuua

SEQ ID NO: 89275 - RNA, 22 nt, Human
ucuuccuuacucuggauguuau

SEQ ID NO: 89276 - RNA, 21 nt, Human
ucuucccaggccuuaaagggc

SEQ ID NO: 89277 - RNA, 22 nt, Human
uggauuuuggaauguuucagua

SEQ ID NO: 89278 - RNA, 22 nt, Human
uggcaaaaccugcaauuacuuu

SEQ ID NO: 89279 - RNA, 22 nt, Human
ucuucaaauacagucauauuga

SEQ ID NO: 89280 - RNA, 22 nt, Human
ugcuucucacuucuugguuucc

SEQ ID NO: 89281 - RNA, 22 nt, Human
ugcuugaacccaggaaguggag

SEQ ID NO: 89282 - RNA, 22 nt, Human
ucuccuuuacuggcuccuuuug

SEQ ID NO: 89283 - RNA, 22 nt, Human
ucuccuuuggggccucaggguu

SEQ ID NO: 89284 - RNA, 22 nt, Human
ugcuuaucuccuuaguuuuugc

SEQ ID NO: 89285 - RNA, 22 nt, Human
ugcuuacgcaaccuguguuugg

SEQ ID NO: 89286 - RNA, 22 nt, Human
ucucucugcuguccagcguuau

SEQ ID NO: 89287 - RNA, 22 nt, Human
ugcuuguuuuguggcuucagcu

SEQ ID NO: 89288 - RNA, 22 nt, Human
ugcuugggucuguuuugcaaag

SEQ ID NO: 89289 - RNA, 22 nt, Human
ucucugguggcuccaucaguag

SEQ ID NO: 89290 - RNA, 22 nt, Human
ugcuuuauucgacaucugguag

SEQ ID NO: 89291 - RNA, 22 nt, Human
ucugaauauguuuaucaucucu

SEQ ID NO: 89292 - RNA, 22 nt, Human
ucucuuuuuuuaaaacucuaug

SEQ ID NO: 89293 - RNA, 22 nt, Human
ugcuuuuguaucagaguauuca

SEQ ID NO: 89294 - RNA, 22 nt, Human
uggaaaacgcaguuuaauuuuu

SEQ ID NO: 89295 - RNA, 20 nt, Human
ucucauuuugauuucgcauu

SEQ ID NO: 89296 - RNA, 21 nt, Human
ucucauuuuaacacagaguug

SEQ ID NO: 89297 - RNA, 21 nt, Human
ucucauacauaguaggaacca

SEQ ID NO: 89298 - RNA, 22 nt, Human
ucucauaucuguacacccuugu

SEQ ID NO: 89299 - RNA, 22 nt, Human
ucucauaauuguuucccagcua

SEQ ID NO: 89300 - RNA, 22 nt, Human
ucucauacguuuccagguguca

SEQ ID NO: 89301 - RNA, 22 nt, Human
ugcugugagaccauuuguugag

SEQ ID NO: 89302 - RNA, 21 nt, Human
ucucaagguaacauuuaagau

SEQ ID NO: 89303 - RNA, 22 nt, Human
ucucaaagagcuacuggucuau

SEQ ID NO: 89304 - RNA, 22 nt, Human
ucuagagaauuuggaaauuaag

SEQ ID NO: 89305 - RNA, 22 nt, Human
ugcgcgcaccugcauauauaug

SEQ ID NO: 89306 - RNA, 22 nt, Human
uccucuccaggugagccgaaau

SEQ ID NO: 89307 - RNA, 22 nt, Human
ugccaacaggcuugccugaugu

SEQ ID NO: 89308 - RNA, 21 nt, Human
uccuccucuccaaacgcccuc

SEQ ID NO: 89309 - RNA, 22 nt, Human
ugcaucauuaagguacaguugg

SEQ ID NO: 89310 - RNA, 22 nt, Human
ugcaucccugaggcauuauccu

SEQ ID NO: 89311 - RNA, 22 nt, Human
uccucacaugcaaaaugguauu

SEQ ID NO: 89312 - RNA, 22 nt, Human
uccuagaccuacugaaucagac

SEQ ID NO: 89313 - RNA, 22 nt, Human
ugcauuguuuauggaauaaaau

SEQ ID NO: 89314 - RNA, 22 nt, Human
ugcauuuucuaccacacccacu

SEQ ID NO: 89315 - RNA, 22 nt, Human
ugccaaagauagagguuugagu

SEQ ID NO: 89316 - RNA, 22 nt, Human
ucccugccuccuggcagugcca

SEQ ID NO: 89317 - RNA, 22 nt, Human
ugcaggaacucgaaaacuauag

SEQ ID NO: 89318 - RNA, 22 nt, Human
ugcauaugcauguaccuguguu

SEQ ID NO: 89319 - RNA, 22 nt, Human
ugcaauggauaucugaacgugg

SEQ ID NO: 89320 - RNA, 22 nt, Human
ucccuacuccucuggucccucu

SEQ ID NO: 89321 - RNA, 22 nt, Human
uccccugccccccauccucugg

SEQ ID NO: 89322 - RNA, 22 nt, Human
uccccgcuccguagagaaagag

SEQ ID NO: 89323 - RNA, 22 nt, Human
uccccgcugcgcccgcugcugc

SEQ ID NO: 89324 - RNA, 22 nt, Human
ugauugggacauuuuguuuucu

SEQ ID NO: 89325 - RNA, 22 nt, Human
uccagcuccugaguucacugcu

SEQ ID NO: 89326 - RNA, 23 nt, Human
ucccaacuuugaaauauuccaca

SEQ ID NO: 89327 - RNA, 22 nt, Human
ugauuuagguauuuucuuuugu

SEQ ID NO: 89328 - RNA, 22 nt, Human
ugauugguauguauguuuguca

SEQ ID NO: 89329 - RNA, 22 nt, Human
ugauuugaaaccuuuggcaaga

SEQ ID NO: 89330 - RNA, 22 nt, Human
ugagagaauuacuaaagggcuu

SEQ ID NO: 89331 - RNA, 18 nt, Human
ucaguccuccauagagcu

SEQ ID NO: 89332 - RNA, 22 nt, Human
ucaguauuagugcauuaucagg

SEQ ID NO: 89333 - RNA, 22 nt, Human
ucuucaucucuaaaaugggaac

SEQ ID NO: 89334 - RNA, 22 nt, Human
ugagaagaggucuuuugggaug

SEQ ID NO: 89335 - RNA, 22 nt, Human
ugagaacuguuuugguuugggu

SEQ ID NO: 89336 - RNA, 22 nt, Human
ugagaaauauacaccagacaca

SEQ ID NO: 89337 - RNA, 22 nt, Human
ugagcaaacacagauaggcuua

SEQ ID NO: 89338 - RNA, 22 nt, Human
ucagucuucaggacuaugaaaa

SEQ ID NO: 89339 - RNA, 22 nt, Human
ugagccugaguguguauugaac

SEQ ID NO: 89340 - RNA, 22 nt, Human
ugaggcaguucuuacuuguauu

SEQ ID NO: 89341 - RNA, 22 nt, Human
ucauaaaggugccacucaguuu

SEQ ID NO: 89342 - RNA, 22 nt, Human
ucauccgcaaccacuuuagccu

SEQ ID NO: 89343 - RNA, 22 nt, Human
ucaucagccaaagaguccuuca

SEQ ID NO: 89344 - RNA, 22 nt, Human
ucaugagcacaggugcagggac

SEQ ID NO: 89345 - RNA, 22 nt, Human
ucaucuauaaguagcaucuggg

SEQ ID NO: 89346 - RNA, 22 nt, Human
ugauguaggacauuauuauuuc

SEQ ID NO: 89347 - RNA, 22 nt, Human
ucauuuuaucaggaauggaauc

SEQ ID NO: 89348 - RNA, 22 nt, Human
ucauuuguauucuacaaagcac

SEQ ID NO: 89349 - RNA, 22 nt, Human
ucauuugggauuuuuuauaauu

SEQ ID NO: 89350 - RNA, 22 nt, Human
ugaugaugauacauuucuucag

SEQ ID NO: 89351 - RNA, 22 nt, Human
ugaucauguucuccaaaagcgu

SEQ ID NO: 89352 - RNA, 22 nt, Human
ugauaugguaauaagauauucu

SEQ ID NO: 89353 - RNA, 22 nt, Human
ugauucacgcuucucuuuaaac

SEQ ID NO: 89354 - RNA, 23 nt, Human
ucucaccaggauaugacugucac

SEQ ID NO: 89355 - RNA, 22 nt, Human
ucucacucuuccccaugucaga

SEQ ID NO: 89356 - RNA, 22 nt, Human
ucucagaaaugacaggagguac

SEQ ID NO: 89357 - RNA, 22 nt, Human
ucuauauucuauguucuucuuu

SEQ ID NO: 89358 - RNA, 22 nt, Human
uaguugaauuuaucaguagcau

SEQ ID NO: 89359 - RNA, 22 nt, Human
ucuauuauauuuacacgagagu

SEQ ID NO: 89360 - RNA, 22 nt, Human
uaggacuugaauucagccucca

SEQ ID NO: 89361 - RNA, 22 nt, Human
uaggaaugcagaugcauaauaa

SEQ ID NO: 89362 - RNA, 22 nt, Human
uauaagaaacaaggcaaauuuu

SEQ ID NO: 89363 - RNA, 22 nt, Human
ucucccgcuuccugcuggcugc

SEQ ID NO: 89364 - RNA, 22 nt, Human
uauaaucuugcccauaguauuu

SEQ ID NO: 89365 - RNA, 22 nt, Human
uauagcaagagaaccauuacca

SEQ ID NO: 89366 - RNA, 22 nt, Human
uauaaugucuuuguugaaaucu

SEQ ID NO: 89367 - RNA, 22 nt, Human
uauacucaauaaauauuuggag

SEQ ID NO: 89368 - RNA, 22 nt, Human
ucuccuuugaaaguuaggacug

SEQ ID NO: 89369 - RNA, 22 nt, Human
ucucccaaaucuuucuagcaca

SEQ ID NO: 89370 - RNA, 22 nt, Human
uauaaagaccuuauccuucaua

SEQ ID NO: 89371 - RNA, 18 nt, Human
uauaaacacacuuagguu

SEQ ID NO: 89372 - RNA, 22 nt, Human
ucucuguacauagugaagcccg

SEQ ID NO: 89373 - RNA, 22 nt, Human
uauaugcagauuuucaucaucg

SEQ ID NO: 89374 - RNA, 22 nt, Human
uaucauuuuacugugacauuuu

SEQ ID NO: 89375 - RNA, 20 nt, Human
ucucucacccuugcugugca

SEQ ID NO: 89376 - RNA, 22 nt, Human
ucucucguuuuuugcagauaaa

SEQ ID NO: 89377 - RNA, 22 nt, Human
uauauauaugcaccacaugugu

SEQ ID NO: 89378 - RNA, 22 nt, Human
uauauauaauguguacagguga

SEQ ID NO: 89379 - RNA, 20 nt, Human
ucucuuuuucuucuuuucuc

SEQ ID NO: 89380 - RNA, 22 nt, Human
ucugaaauuuuaguuauagaaa

SEQ ID NO: 89381 - RNA, 22 nt, Human
ucugaagagaacucuuaguguu

SEQ ID NO: 89382 - RNA, 22 nt, Human
ucucuucacuuguaugcuauca

SEQ ID NO: 89383 - RNA, 21 nt, Human
uaucauuuuuuccccugagau

SEQ ID NO: 89384 - RNA, 22 nt, Human
uauccuaagguaguuuuaguuu

SEQ ID NO: 89385 - RNA, 21 nt, Human
ucugaggagaaacucuuggug

SEQ ID NO: 89386 - RNA, 22 nt, Human
ucuggguaacugaggcuaauau

SEQ ID NO: 89387 - RNA, 22 nt, Human
ucuguauuuuuuacacacaugc

SEQ ID NO: 89388 - RNA, 22 nt, Human
uauguugucuuguucagccaua

SEQ ID NO: 89389 - RNA, 22 nt, Human
uauuaauugugguuauuguauu

SEQ ID NO: 89390 - RNA, 22 nt, Human
ucuuacuguccucuguuuuucu

SEQ ID NO: 89391 - RNA, 22 nt, Human
ucuguuuugugcuuuguuuucu

SEQ ID NO: 89392 - RNA, 22 nt, Human
ucuuaaauaugaaaaggauuau

SEQ ID NO: 89393 - RNA, 22 nt, Human
ucuuauugugaugaugaagaac

SEQ ID NO: 89394 - RNA, 22 nt, Human
ucuuauucuuuuaaacaacgca

SEQ ID NO: 89395 - RNA, 20 nt, Human
ucuucagcuccaagucuggc

SEQ ID NO: 89396 - RNA, 22 nt, Human
ucuguuuuccaggaaucucaua

SEQ ID NO: 89397 - RNA, 22 nt, Human
ucuguucagaagaggugaaagu

SEQ ID NO: 89398 - RNA, 22 nt, Human
ucuguguuccuggcaccaaacu

SEQ ID NO: 89399 - RNA, 22 nt, Human
uauucauuuuuauuugugacug

SEQ ID NO: 89400 - RNA, 22 nt, Human
uauuauggguuuuuguguaaau

SEQ ID NO: 89401 - RNA, 22 nt, Human
uauuaugguuguagguuaacaa

SEQ ID NO: 89402 - RNA, 22 nt, Human
uauggcuaguguguuuguaaca

SEQ ID NO: 89403 - RNA, 20 nt, Human
uaugcgaagccuuucuggac

SEQ ID NO: 89404 - RNA, 22 nt, Human
ucuggaaauggaaguaacuaug

SEQ ID NO: 89405 - RNA, 22 nt, Human
uaugguuucuccugcagauuug

SEQ ID NO: 89406 - RNA, 22 nt, Human
uauguauguauguauguauaug

SEQ ID NO: 89407 - RNA, 22 nt, Human
uaugugaaauggaauauagaaa

SEQ ID NO: 89408 - RNA, 20 nt, Human
uaugugcaguuugguuuauc

SEQ ID NO: 89409 - RNA, 22 nt, Human
uauguggcaggugggagaucag

SEQ ID NO: 89410 - RNA, 22 nt, Human
uaugaauauaccacaauuuagg

SEQ ID NO: 89411 - RNA, 19 nt, Human
uaugacaaguacuaguucu

SEQ ID NO: 89412 - RNA, 22 nt, Human
uaugauuuucaugguagaguua

SEQ ID NO: 89413 - RNA, 22 nt, Human
uccaggcagcugcuugaugaua

SEQ ID NO: 89414 - RNA, 22 nt, Human
uacuagacugagaaucagcuga

SEQ ID NO: 89415 - RNA, 22 nt, Human
uacguaauagcuuuauuuuggg

SEQ ID NO: 89416 - RNA, 22 nt, Human
uacuuccuucugcccccucuga

SEQ ID NO: 89417 - RNA, 22 nt, Human
uacuugaaaugggcaucaagag

SEQ ID NO: 89418 - RNA, 22 nt, Human
uacuuuaauugcaaaaauaaau

SEQ ID NO: 89419 - RNA, 22 nt, Human
ucccucacacagcugggagaac

SEQ ID NO: 89420 - RNA, 22 nt, Human
ucccguuucacuccuugccagc

SEQ ID NO: 89421 - RNA, 22 nt, Human
ucccucuuccuacccucccuuu

SEQ ID NO: 89422 - RNA, 22 nt, Human
ucccugccuuauuuucauaugc

SEQ ID NO: 89423 - RNA, 22 nt, Human
uagaccuccagcggaggagauu

SEQ ID NO: 89424 - RNA, 21 nt, Human
uccuaaaggaaauacucaauu

SEQ ID NO: 89425 - RNA, 22 nt, Human
uagaacaaacagcauguuugau

SEQ ID NO: 89426 - RNA, 22 nt, Human
uagaagagcaugucaaacuaua

SEQ ID NO: 89427 - RNA, 20 nt, Human
uccugaaauuacgugauuca

SEQ ID NO: 89428 - RNA, 22 nt, Human
uccugcucucuccauuccuucc

SEQ ID NO: 89429 - RNA, 22 nt, Human
uccugcuucaaucugcugcugg

SEQ ID NO: 89430 - RNA, 22 nt, Human
uccuggccuuggggagagaagu

SEQ ID NO: 89431 - RNA, 22 nt, Human
ucaucgauggggagcucuacaa

SEQ ID NO: 89432 - RNA, 22 nt, Human
ucauauugguagagauguguaa

SEQ ID NO: 89433 - RNA, 16 nt, Human
ucauaaacugcagcuu

SEQ ID NO: 89434 - RNA, 22 nt, Human
ucauaaaaucaguguccauugu

SEQ ID NO: 89435 - RNA, 22 nt, Human
uaagucaagagcuagaaaaagc

SEQ ID NO: 89436 - RNA, 22 nt, Human
ucauggguauaauuuuagaugu

SEQ ID NO: 89437 - RNA, 22 nt, Human
uaaggagagaauuuagagguuu

SEQ ID NO: 89438 - RNA, 22 nt, Human
uaaggaaaugcaaauuuaagaa

SEQ ID NO: 89439 - RNA, 22 nt, Human
ucaugcagauaagaauaaguaa

SEQ ID NO: 89440 - RNA, 22 nt, Human
uaauauaacugccaguuaaggu

SEQ ID NO: 89441 - RNA, 20 nt, Human
ucauucagaaucaguaugca

SEQ ID NO: 89442 - RNA, 22 nt, Human
ucauuauuuugauguauuuccu

SEQ ID NO: 89443 - RNA, 22 nt, Human
uaauccaaaacugaaucugugg

SEQ ID NO: 89444 - RNA, 22 nt, Human
uaauauccaguuauuucccuca

SEQ ID NO: 89445 - RNA, 22 nt, Human
uaauuucauuuugcaaugaucu

SEQ ID NO: 89446 - RNA, 22 nt, Human
uaauugaacguucauuuuuaau

SEQ ID NO: 89447 - RNA, 22 nt, Human
uacaaaauucaaauaauguuug

SEQ ID NO: 89448 - RNA, 22 nt, Human
uacaaaugaucaucucuuugaa

SEQ ID NO: 89449 - RNA, 22 nt, Human
ucauuuaucgcugccuuuuaaa

SEQ ID NO: 89450 - RNA, 17 nt, Human
ucauuuauccucuuugg

SEQ ID NO: 89451 - RNA, 19 nt, Human
uccaaaauacuuguuacug

SEQ ID NO: 89452 - RNA, 22 nt, Human
uacaaagugauuuuggaauuga

SEQ ID NO: 89453 - RNA, 23 nt, Human
uacagccaugucgcugauuuaac

SEQ ID NO: 89454 - RNA, 22 nt, Human
uccaagacagauaccuagaaga

SEQ ID NO: 89455 - RNA, 22 nt, Human
uccaagcgcuucuggagcuccu

SEQ ID NO: 89456 - RNA, 22 nt, Human
uaaaggcaaacucuccaaggau

SEQ ID NO: 89457 - RNA, 22 nt, Human
uaaauaugcaugugguauucau

SEQ ID NO: 89458 - RNA, 22 nt, Human
uaaaugaaaugaagugaaagcu

SEQ ID NO: 89459 - RNA, 22 nt, Human
uaaaugaaaggguuuaauuuau

SEQ ID NO: 89460 - RNA, 22 nt, Human
ucaguacaagauuuucuaaauc

SEQ ID NO: 89461 - RNA, 22 nt, Human
ucagguuuuuaaggagcuagga

SEQ ID NO: 89462 - RNA, 22 nt, Human
uaaaugauaguauugaagguag

SEQ ID NO: 89463 - RNA, 22 nt, Human
uaaaggaguguauaauuguagu

SEQ ID NO: 89464 - RNA, 22 nt, Human
ucaagcaaggaauccuuuugua

SEQ ID NO: 89465 - RNA, 22 nt, Human
ucaggcgcucuucguggcugcc

SEQ ID NO: 89466 - RNA, 23 nt, Human
ucagugaaggaacaacuaaauag

SEQ ID NO: 89467 - RNA, 23 nt, Human
ucagugccaaggagaacuuggug

SEQ ID NO: 89468 - RNA, 23 nt, Human
uaacacaguccuggucuuuggcc

SEQ ID NO: 89469 - RNA, 22 nt, Human
uaaauuggaauaaugagaagug

SEQ ID NO: 89470 - RNA, 22 nt, Human
uaaauuccuagucacaaacuuc

SEQ ID NO: 89471 - RNA, 22 nt, Human
uaaauuugugaauuagcuauca

SEQ ID NO: 89472 - RNA, 22 nt, Human
uaaauguugcuugugcugcuca

SEQ ID NO: 89473 - RNA, 22 nt, Human
uaaaugcucuuuaaaagugcuu

SEQ ID NO: 89474 - RNA, 22 nt, Human
uaacuguuuugaauauuguggu

SEQ ID NO: 89475 - RNA, 22 nt, Human
uaacaguauacuacaucauauu

SEQ ID NO: 89476 - RNA, 22 nt, Human
uagcguaugcugugugaugaau

SEQ ID NO: 89477 - RNA, 22 nt, Human
uagcugucauuggaucagaagg

SEQ ID NO: 89478 - RNA, 22 nt, Human
gugcucaucuucuguaacuguu

SEQ ID NO: 89479 - RNA, 22 nt, Human
uagcccgugaggaggggcugug

SEQ ID NO: 89480 - RNA, 22 nt, Human
uagccguugggguaacuggaca

SEQ ID NO: 89481 - RNA, 17 nt, Human
uagccagcuugugauuu

SEQ ID NO: 89482 - RNA, 22 nt, Human
uagaaguagaaucauuagggcu

SEQ ID NO: 89483 - RNA, 22 nt, Human
uagaagaacaugucaaacuaua

SEQ ID NO: 89484 - RNA, 22 nt, Human
guggaaauaugggcaacaaaga

SEQ ID NO: 89485 - RNA, 22 nt, Human
guggaaauuuuaggaucaucuu

SEQ ID NO: 89486 - RNA, 22 nt, Human
gugcuuugcuaggaccgauugu

SEQ ID NO: 89487 - RNA, 22 nt, Human
uaggacuuguccauccaggaca

SEQ ID NO: 89488 - RNA, 22 nt, Human
guggagauauuugugauagggg

SEQ ID NO: 89489 - RNA, 22 nt, Human
uagugcuuaaaacagaauuuuc

SEQ ID NO: 89490 - RNA, 22 nt, Human
guggguauauauaugugugcug

SEQ ID NO: 89491 - RNA, 22 nt, Human
uaguggaaccuucuaaaugacg

SEQ ID NO: 89492 - RNA, 22 nt, Human
guggggcgggucccccgccugg

SEQ ID NO: 89493 - RNA, 22 nt, Human
gugggauaaccugagauaacau

SEQ ID NO: 89494 - RNA, 22 nt, Human
gugggaaacagccuugcuucua

SEQ ID NO: 89495 - RNA, 22 nt, Human
guggcuuauguccagcagauau

SEQ ID NO: 89496 - RNA, 22 nt, Human
guggcuuucuaccauuaaauug

SEQ ID NO: 89497 - RNA, 22 nt, Human
guggccugacagaucggaacag

SEQ ID NO: 89498 - RNA, 22 nt, Human
uaggugucuggacaacuuugua

SEQ ID NO: 89499 - RNA, 22 nt, Human
guggcagguguacagcucagcu

SEQ ID NO: 89500 - RNA, 22 nt, Human
uaugaaagguuuuuucuugaaa

SEQ ID NO: 89501 - RNA, 19 nt, Human
uaugaaguugauaaaaguu

SEQ ID NO: 89502 - RNA, 22 nt, Human
guguggcgacucagagcugccu

SEQ ID NO: 89503 - RNA, 22 nt, Human
uauccaaaggaacaaucacagc

SEQ ID NO: 89504 - RNA, 22 nt, Human
guuaaaugcagauucugacuca

SEQ ID NO: 89505 - RNA, 22 nt, Human
guuaauaugcaaaacggaugcg

SEQ ID NO: 89506 - RNA, 22 nt, Human
uauguuuugcaaauaucaaaca

SEQ ID NO: 89507 - RNA, 22 nt, Human
uaugucuauugacuuaggauuu

SEQ ID NO: 89508 - RNA, 22 nt, Human
guguucuuuguagaggaucuug

SEQ ID NO: 89509 - RNA, 22 nt, Human
guucuacaacuucgcuugcaga

SEQ ID NO: 89510 - RNA, 22 nt, Human
guucaaccaugauuaggaacug

SEQ ID NO: 89511 - RNA, 19 nt, Human
uauuagccucaucccagcc

SEQ ID NO: 89512 - RNA, 23 nt, Human
guuauugcuggugcuggccagcc

SEQ ID NO: 89513 - RNA, 22 nt, Human
uauuuguuuuuaaugcugggug

SEQ ID NO: 89514 - RNA, 22 nt, Human
guucucuuaauccuaguuggua

SEQ ID NO: 89515 - RNA, 22 nt, Human
guucuguuguugaucuuuggag

SEQ ID NO: 89516 - RNA, 22 nt, Human
guugcuucuuggcuuuuccaac

SEQ ID NO: 89517 - RNA, 22 nt, Human
uauuuuagccaacagaaugaug

SEQ ID NO: 89518 - RNA, 22 nt, Human
uauuuuauuuagguuuaguugu

SEQ ID NO: 89519 - RNA, 22 nt, Human
uauuuuuguuuaccaguuaaca

SEQ ID NO: 89520 - RNA, 22 nt, Human
uauuuuuuuaacauuuauugua

SEQ ID NO: 89521 - RNA, 22 nt, Human
guugggguuucaguggcaguca

SEQ ID NO: 89522 - RNA, 22 nt, Human
ucaacauguuuuuuaaaagaaa

SEQ ID NO: 89523 - RNA, 22 nt, Human
uaagauuuuuacaaauagagug

SEQ ID NO: 89524 - RNA, 22 nt, Human
gucacuccuucccagagggagc

SEQ ID NO: 89525 - RNA, 22 nt, Human
gucaucugagggacgagauuuc

SEQ ID NO: 89526 - RNA, 22 nt, Human
guagaacucuuuccugcguggg

SEQ ID NO: 89527 - RNA, 22 nt, Human
guagaaaauagauugucucuug

SEQ ID NO: 89528 - RNA, 22 nt, Human
guauugauuguuuuaaaagauu

SEQ ID NO: 89529 - RNA, 22 nt, Human
uaagaccuuuuugaaaucacug

SEQ ID NO: 89530 - RNA, 22 nt, Human
uaauucuucaauccaguguuca

SEQ ID NO: 89531 - RNA, 22 nt, Human
uaauucuacagggaacucugga

SEQ ID NO: 89532 - RNA, 22 nt, Human
uaauuuagugcauuuccuagua

SEQ ID NO: 89533 - RNA, 22 nt, Human
guccuuuuuuuauacccaggcc

SEQ ID NO: 89534 - RNA, 22 nt, Human
guccuuaaauacgaugaacaug

SEQ ID NO: 89535 - RNA, 22 nt, Human
guccuguguaaguacuugcuca

SEQ ID NO: 89536 - RNA, 23 nt, Human
gucauuacuguuaccuuauucuu

SEQ ID NO: 89537 - RNA, 22 nt, Human
guccccugcguguucauccugg

SEQ ID NO: 89538 - RNA, 22 nt, Human
guccaggucauuuaaaaagucc

SEQ ID NO: 89539 - RNA, 22 nt, Human
gucgagaacauucauuaugcaa

SEQ ID NO: 89540 - RNA, 22 nt, Human
uaauuuugucacagugacaugc

SEQ ID NO: 89541 - RNA, 22 nt, Human
gugaaaauaguaaccuggcuag

SEQ ID NO: 89542 - RNA, 22 nt, Human
gucuucugacacuguuaggagg

SEQ ID NO: 89543 - RNA, 22 nt, Human
uaccaauuaaauagccaaucua

SEQ ID NO: 89544 - RNA, 21 nt, Human
uacaucaguuuucuuggcuca

SEQ ID NO: 89545 - RNA, 23 nt, Human
gugaacaaugcuccaggagauac

SEQ ID NO: 89546 - RNA, 22 nt, Human
gugaaauuguacacucaguacc

SEQ ID NO: 89547 - RNA, 22 nt, Human
uacguuuuauaucuuuuggaau

SEQ ID NO: 89548 - RNA, 22 nt, Human
uacuuugucauucuaaccuucc

SEQ ID NO: 89549 - RNA, 22 nt, Human
uacuuuggugaaauuggaaaua

SEQ ID NO: 89550 - RNA, 22 nt, Human
uacuuuuuucacuucuagcccc

SEQ ID NO: 89551 - RNA, 22 nt, Human
guuugguucucauuguuuuucu

SEQ ID NO: 89552 - RNA, 22 nt, Human
guuuguuugccagcuuaguaaa

SEQ ID NO: 89553 - RNA, 22 nt, Human
ggugguucagugguuagggcca

SEQ ID NO: 89554 - RNA, 22 nt, Human
gguguggcaguggaccugugaa

SEQ ID NO: 89555 - RNA, 22 nt, Human
uaaaaaccuuguauuuaacucu

SEQ ID NO: 89556 - RNA, 22 nt, Human
uaaaaauuagauauguauuuag

SEQ ID NO: 89557 - RNA, 23 nt, Human
guuuuugcugcagcugaagaagg

SEQ ID NO: 89558 - RNA, 21 nt, Human
uaaaagaugacaagacagcuc

SEQ ID NO: 89559 - RNA, 22 nt, Human
guaaaucccucucuuuguagau

SEQ ID NO: 89560 - RNA, 22 nt, Human
uaaaguauucaaguagcuuucu

SEQ ID NO: 89561 - RNA, 22 nt, Human
gguugauuuuuaugaagccaug

SEQ ID NO: 89562 - RNA, 22 nt, Human
gguuugggaagaacuauucccu

SEQ ID NO: 89563 - RNA, 22 nt, Human
uaaagugaaguucagaauggcu

SEQ ID NO: 89564 - RNA, 22 nt, Human
gguuuuuggcucaauauuuugg

SEQ ID NO: 89565 - RNA, 22 nt, Human
gguuuucacgauccucccuuuu

SEQ ID NO: 89566 - RNA, 22 nt, Human
gguuuucagaaugcaguccugu

SEQ ID NO: 89567 - RNA, 22 nt, Human
gugcuugaguaaaaauagucuu

SEQ ID NO: 89568 - RNA, 22 nt, Human
guugggcugaagugugugcuua

SEQ ID NO: 89569 - RNA, 22 nt, Human
guuggggccuggagucucuugg

SEQ ID NO: 89570 - RNA, 22 nt, Human
guuguuaagugcugguuguuag

SEQ ID NO: 89571 - RNA, 22 nt, Human
guuguuuucagcccagcauuag

SEQ ID NO: 89572 - RNA, 22 nt, Human
guugucguucccccugcuuaaa

SEQ ID NO: 89573 - RNA, 22 nt, Human
ggugaucucagucuagaugguu

SEQ ID NO: 89574 - RNA, 22 nt, Human
ggugauaaaaagcauuuaaauu

SEQ ID NO: 89575 - RNA, 22 nt, Human
guuuccuuuugugguuuuucua

SEQ ID NO: 89576 - RNA, 22 nt, Human
guuugcagacuauguaaacuuc

SEQ ID NO: 89577 - RNA, 22 nt, Human
guuuacaacaucuuguccuuca

SEQ ID NO: 89578 - RNA, 22 nt, Human
guuuaaguuaaaauuuaccugc

SEQ ID NO: 89579 - RNA, 22 nt, Human
guuuaucagagagcagaggugg

SEQ ID NO: 89580 - RNA, 22 nt, Human
ggucuuauaauuaauuuaggcu

SEQ ID NO: 89581 - RNA, 22 nt, Human
guauauuuaugagcauuagccu

SEQ ID NO: 89582 - RNA, 22 nt, Human
guaucaggacuaaauuauggau

SEQ ID NO: 89583 - RNA, 22 nt, Human
ggcgaugaggucuuagaaucua

SEQ ID NO: 89584 - RNA, 22 nt, Human
guaucuuuauuuuaauuaagau

SEQ ID NO: 89585 - RNA, 22 nt, Human
guaugucuuaggguucaguaac

SEQ ID NO: 89586 - RNA, 22 nt, Human
guauggaguuuuguugcacuuc

SEQ ID NO: 89587 - RNA, 22 nt, Human
guauaaagaugccauacuuacu

SEQ ID NO: 89588 - RNA, 22 nt, Human
guauaaauaucuauauuguuac

SEQ ID NO: 89589 - RNA, 22 nt, Human
ggcgacuacugaaugcuugaaa

SEQ ID NO: 89590 - RNA, 22 nt, Human
gguuugauauguuugugauucu

SEQ ID NO: 89591 - RNA, 22 nt, Human
gguuuguggagcuggaaacacu

SEQ ID NO: 89592 - RNA, 22 nt, Human
gguuucuuuccucucugugccu

SEQ ID NO: 89593 - RNA, 22 nt, Human
gguuuaucuuuacaaaugaaau

SEQ ID NO: 89594 - RNA, 22 nt, Human
gguuuauucccacaaaggaagu

SEQ ID NO: 89595 - RNA, 22 nt, Human
guauucugugugaucaagugau

SEQ ID NO: 89596 - RNA, 22 nt, Human
gucaaaggcggugcaggaggag

SEQ ID NO: 89597 - RNA, 22 nt, Human
guauuuggacugccuguucauu

SEQ ID NO: 89598 - RNA, 22 nt, Human
gucacaaaugauuuagcaauca

SEQ ID NO: 89599 - RNA, 22 nt, Human
gucacuuugcuugcgaugcucc

SEQ ID NO: 89600 - RNA, 22 nt, Human
gucacuuuuaagggccuuuucu

SEQ ID NO: 89601 - RNA, 22 nt, Human
ggcuccuuguaugauauuuugu

SEQ ID NO: 89602 - RNA, 22 nt, Human
ggcugcagugcaacucuuucua

SEQ ID NO: 89603 - RNA, 22 nt, Human
guccguaauuuuugcuugcaga

SEQ ID NO: 89604 - RNA, 22 nt, Human
guccucugggagccuugagccu

SEQ ID NO: 89605 - RNA, 22 nt, Human
ggcugggagguggcgaggaggc

SEQ ID NO: 89606 - RNA, 22 nt, Human
gucuauuuauagacagauccua

SEQ ID NO: 89607 - RNA, 22 nt, Human
gucuauaaccuuuccaauuacc

SEQ ID NO: 89608 - RNA, 22 nt, Human
gggaauuuuaggaugacuccua

SEQ ID NO: 89609 - RNA, 20 nt, Human
gggacugagccuuguuugug

SEQ ID NO: 89610 - RNA, 22 nt, Human
gggagaaccagccagugcaagg

SEQ ID NO: 89611 - RNA, 22 nt, Human
gggagauuuguguaggaaaacu

SEQ ID NO: 89612 - RNA, 22 nt, Human
gugauuucagguuuuucauacu

SEQ ID NO: 89613 - RNA, 22 nt, Human
gugccaaauagcuugauuaaga

SEQ ID NO: 89614 - RNA, 22 nt, Human
gugccgaugaggccuggcauuc

SEQ ID NO: 89615 - RNA, 22 nt, Human
gggagggaggagccccggccau

SEQ ID NO: 89616 - RNA, 22 nt, Human
gggagguaaugggggugcaggg

SEQ ID NO: 89617 - RNA, 22 nt, Human
gggauguauguuuguguggaga

SEQ ID NO: 89618 - RNA, 22 nt, Human
gggauuuaaugggaaaaauaug

SEQ ID NO: 89619 - RNA, 19 nt, Human
gggauuccuggcuuuagaa

SEQ ID NO: 89620 - RNA, 22 nt, Human
ggcuucucuuggccaugguccc

SEQ ID NO: 89621 - RNA, 22 nt, Human
gggaaaaaggaaccuuauuacu

SEQ ID NO: 89622 - RNA, 22 nt, Human
gggaaauagagcuggaaccuug

SEQ ID NO: 89623 - RNA, 22 nt, Human
gggaagaaccucugcuaccaau

SEQ ID NO: 89624 - RNA, 22 nt, Human
gugaaacuggaugugaaaacaa

SEQ ID NO: 89625 - RNA, 22 nt, Human
gucuuucuuuuacauauuugug

SEQ ID NO: 89626 - RNA, 22 nt, Human
ggcuggggccuguugaagaugc

SEQ ID NO: 89627 - RNA, 22 nt, Human
gugaaaaauggccaucaggaca

SEQ ID NO: 89628 - RNA, 22 nt, Human
ggcuuaguagggacagaugcac

SEQ ID NO: 89629 - RNA, 22 nt, Human
ggccacgggguuugcugaaacu

SEQ ID NO: 89630 - RNA, 22 nt, Human
ggccaauuuccuagacauuagu

SEQ ID NO: 89631 - RNA, 20 nt, Human
ggcauuuuuuaguugagcuu

SEQ ID NO: 89632 - RNA, 22 nt, Human
ggccaaagagcacaaugaauag

SEQ ID NO: 89633 - RNA, 22 nt, Human
ggcuuuuguuauaaucaggccu

SEQ ID NO: 89634 - RNA, 22 nt, Human
gggaaaauguuucugagacaaa

SEQ ID NO: 89635 - RNA, 22 nt, Human
gggaaaugugucuuggcauucu

SEQ ID NO: 89636 - RNA, 22 nt, Human
gcuguugcaaucaaggccaugg

SEQ ID NO: 89637 - RNA, 22 nt, Human
gggaaaaaggaguuagagauaa

SEQ ID NO: 89638 - RNA, 22 nt, Human
ggcuuguccuucugguugucuu

SEQ ID NO: 89639 - RNA, 22 nt, Human
gcuuacagauaaugaggagacu

SEQ ID NO: 89640 - RNA, 21 nt, Human
gggaagagaagagaaaggagg

SEQ ID NO: 89641 - RNA, 22 nt, Human
gggaagagggagcuggaaugau

SEQ ID NO: 89642 - RNA, 18 nt, Human
gggaagaugccacaguga

SEQ ID NO: 89643 - RNA, 22 nt, Human
gggaagugagcuggaaucaagg

SEQ ID NO: 89644 - RNA, 22 nt, Human
gcuuauugcuuauagauaggaa

SEQ ID NO: 89645 - RNA, 22 nt, Human
gggaacuuggcaggaaaauuau

SEQ ID NO: 89646 - RNA, 22 nt, Human
gcuuccuccaucuggggcuugc

SEQ ID NO: 89647 - RNA, 22 nt, Human
gcuucccacagcuggacugggg

SEQ ID NO: 89648 - RNA, 22 nt, Human
gcuucccagaccaggcucccuc

SEQ ID NO: 89649 - RNA, 22 nt, Human
gcuuguauguguauauauacau

SEQ ID NO: 89650 - RNA, 22 nt, Human
gggacagcuggggguaaagcau

SEQ ID NO: 89651 - RNA, 19 nt, Human
gggagaaaaucuuuauccu

SEQ ID NO: 89652 - RNA, 22 nt, Human
gcuuucagggucacugucaaca

SEQ ID NO: 89653 - RNA, 22 nt, Human
gcuuucauuauguuguguuuuu

SEQ ID NO: 89654 - RNA, 22 nt, Human
gggagcucaccaugcucugcau

SEQ ID NO: 89655 - RNA, 22 nt, Human
gggagcugagcuggaagagaau

SEQ ID NO: 89656 - RNA, 22 nt, Human
gggauacuuuguuucccugcca

SEQ ID NO: 89657 - RNA, 22 nt, Human
gcuuuuuaauuugcuucccugg

SEQ ID NO: 89658 - RNA, 22 nt, Human
gcuuuugaauacuacaggaguu

SEQ ID NO: 89659 - RNA, 22 nt, Human
gcuuuugagaaaguguuuuccc

SEQ ID NO: 89660 - RNA, 22 nt, Human
ggaaaaauggguggugauauga

SEQ ID NO: 89661 - RNA, 22 nt, Human
ggaagacuuagaguagcaucag

SEQ ID NO: 89662 - RNA, 22 nt, Human
ggaagauagaaguucaaaaguu

SEQ ID NO: 89663 - RNA, 22 nt, Human
ggaauaaaaggagguggcgaga

SEQ ID NO: 89664 - RNA, 22 nt, Human
ggaauaauauuacagauacagu

SEQ ID NO: 89665 - RNA, 22 nt, Human
ggaauacggguuuauuuagucu

SEQ ID NO: 89666 - RNA, 22 nt, Human
gggcugagagcuggaaucugag

SEQ ID NO: 89667 - RNA, 22 nt, Human
gggccuuggaggagaaggacuu

SEQ ID NO: 89668 - RNA, 22 nt, Human
ggacucucaggcugucggcuuc

SEQ ID NO: 89669 - RNA, 23 nt, Human
ggacgugaggcgcccuuuuuccc

SEQ ID NO: 89670 - RNA, 19 nt, Human
gggcuuguuggcaaaugac

SEQ ID NO: 89671 - RNA, 22 nt, Human
ggaauuaagaggcuggacaggg

SEQ ID NO: 89672 - RNA, 22 nt, Human
ggaaugcagugagcauuagaua

SEQ ID NO: 89673 - RNA, 22 nt, Human
ggauggaugugaucugccuccu

SEQ ID NO: 89674 - RNA, 22 nt, Human
ggcaauuacguauuagucaugu

SEQ ID NO: 89675 - RNA, 20 nt, Human
ggcagcaaccauaugcuaca

SEQ ID NO: 89676 - RNA, 22 nt, Human
ggcagaggaagcuggaaguggg

SEQ ID NO: 89677 - RNA, 22 nt, Human
gguuauuucugauuauaugaua

SEQ ID NO: 89678 - RNA, 22 nt, Human
gguguuaaccagcuaaaguuug

SEQ ID NO: 89679 - RNA, 22 nt, Human
ggugcuuuucacaagcauggga

SEQ ID NO: 89680 - RNA, 22 nt, Human
ggagguaagaggcccugggccg

SEQ ID NO: 89681 - RNA, 22 nt, Human
ggagguggagcuggaaguucca

SEQ ID NO: 89682 - RNA, 22 nt, Human
ggagugaagacagagugaacuu

SEQ ID NO: 89683 - RNA, 22 nt, Human
ggaggaaauccuuaguaaggca

SEQ ID NO: 89684 - RNA, 22 nt, Human
ggaggagggaguucaggaguau

SEQ ID NO: 89685 - RNA, 21 nt, Human
gggguuuuguucuuauaaugu

SEQ ID NO: 89686 - RNA, 22 nt, Human
gggggaaaguggagguucguga

SEQ ID NO: 89687 - RNA, 22 nt, Human
ggaagaagagggagcuguggga

SEQ ID NO: 89688 - RNA, 22 nt, Human
ggaagaggaagaugaggcagca

SEQ ID NO: 89689 - RNA, 22 nt, Human
ggaaucuucagccaugccaaga

SEQ ID NO: 89690 - RNA, 22 nt, Human
ggaaugcuuggcaugagaaccu

SEQ ID NO: 89691 - RNA, 22 nt, Human
ggaauuauuuuaaauagacauu

SEQ ID NO: 89692 - RNA, 22 nt, Human
ggacuuuggauuuuauucuaaa

SEQ ID NO: 89693 - RNA, 22 nt, Human
ggacuugaaguaguuauggccu

SEQ ID NO: 89694 - RNA, 22 nt, Human
ggacauaccgugccccaaugcg

SEQ ID NO: 89695 - RNA, 22 nt, Human
ggagacagauggcgucucaguu

SEQ ID NO: 89696 - RNA, 23 nt, Human
ggagaaggaugucaucaaaagac

SEQ ID NO: 89697 - RNA, 22 nt, Human
ggagugaaugguggccguguuu

SEQ ID NO: 89698 - RNA, 22 nt, Human
ggaggcggaaguccaagcaggu

SEQ ID NO: 89699 - RNA, 22 nt, Human
ggauaauugaugauuuauaaga

SEQ ID NO: 89700 - RNA, 22 nt, Human
ggcaauauuauaagggcauuua

SEQ ID NO: 89701 - RNA, 22 nt, Human
gcgugcauguguguaugcgugu

SEQ ID NO: 89702 - RNA, 22 nt, Human
gcguggaugauuuugagucggu

SEQ ID NO: 89703 - RNA, 22 nt, Human
ggcagaaaacaauaaccauuuc

SEQ ID NO: 89704 - RNA, 22 nt, Human
gcguagaagaaagcugcugcua

SEQ ID NO: 89705 - RNA, 22 nt, Human
gcuagaaacuguuuaaucucuu

SEQ ID NO: 89706 - RNA, 22 nt, Human
ggcagcagaacuggcccuguau

SEQ ID NO: 89707 - RNA, 22 nt, Human
gcucaacuucuaggacuucagg

SEQ ID NO: 89708 - RNA, 22 nt, Human
ggcaguguggauccuggagaag

SEQ ID NO: 89709 - RNA, 22 nt, Human
gcugagcagaacaauuagaaau

SEQ ID NO: 89710 - RNA, 22 nt, Human
gcaugguuuccugcaacguucu

SEQ ID NO: 89711 - RNA, 22 nt, Human
gcauuuaaauuugaacuucaga

SEQ ID NO: 89712 - RNA, 22 nt, Human
gcugguuucucucauugucagu

SEQ ID NO: 89713 - RNA, 22 nt, Human
gcuguauaucuuuugaagugau

SEQ ID NO: 89714 - RNA, 22 nt, Human
gcuguugugaggaucagcauau

SEQ ID NO: 89715 - RNA, 22 nt, Human
gcuguugagucagacaaguuuu

SEQ ID NO: 89716 - RNA, 22 nt, Human
gcuguuucuuuggcaaacugau

SEQ ID NO: 89717 - RNA, 22 nt, Human
gcuguuuaaguggaauuuguuu

SEQ ID NO: 89718 - RNA, 22 nt, Human
gcuuagaaucagaccuggguca

SEQ ID NO: 89719 - RNA, 22 nt, Human
gcuucucacccuuacuaucucu

SEQ ID NO: 89720 - RNA, 22 nt, Human
gcuucacucugagacuuggagc

SEQ ID NO: 89721 - RNA, 21 nt, Human
gcuucaauucauccaccucuc

SEQ ID NO: 89722 - RNA, 22 nt, Human
gcuuauuagguuauuucaagga

SEQ ID NO: 89723 - RNA, 22 nt, Human
gcuuaggcgcuccuuuucacuc

SEQ ID NO: 89724 - RNA, 22 nt, Human
gcuucucauguuuauuuuuaca

SEQ ID NO: 89725 - RNA, 22 nt, Human
gccgcaacggacccugggaguc

SEQ ID NO: 89726 - RNA, 17 nt, Human
ggaagaaaaggaucauc

SEQ ID NO: 89727 - RNA, 22 nt, Human
gccugaaaugaaccagaggacu

SEQ ID NO: 89728 - RNA, 22 nt, Human
ggaaauauaagcaguuugugug

SEQ ID NO: 89729 - RNA, 22 nt, Human
ggaaaggaagggaaggagaugc

SEQ ID NO: 89730 - RNA, 22 nt, Human
ggaaaggacuggagcccagcgc

SEQ ID NO: 89731 - RNA, 18 nt, Human
gccucuguugacagaguu

SEQ ID NO: 89732 - RNA, 22 nt, Human
gccuagaagaaugagcgcaggg

SEQ ID NO: 89733 - RNA, 22 nt, Human
gcuuguuagcaaugcagaaucu

SEQ ID NO: 89734 - RNA, 22 nt, Human
gcuugcugaacaggaaccuggc

SEQ ID NO: 89735 - RNA, 22 nt, Human
gcuugaggaacucagacuugag

SEQ ID NO: 89736 - RNA, 22 nt, Human
ggaaaagccauauuauaggcaa

SEQ ID NO: 89737 - RNA, 22 nt, Human
ggaaaagaauuguuaguuagug

SEQ ID NO: 89738 - RNA, 22 nt, Human
gcuuuguucauuuaguuuuuuu

SEQ ID NO: 89739 - RNA, 18 nt, Human
gaugaagaggaagaggag

SEQ ID NO: 89740 - RNA, 22 nt, Human
gagaagucaggaguggagaaca

SEQ ID NO: 89741 - RNA, 22 nt, Human
gcaguaaauugagagucauguu

SEQ ID NO: 89742 - RNA, 22 nt, Human
gcagguuguuuaaauuaggauu

SEQ ID NO: 89743 - RNA, 22 nt, Human
gcaguaaggaggggaaggguuu

SEQ ID NO: 89744 - RNA, 22 nt, Human
gcaguagauccagcagccugca

SEQ ID NO: 89745 - RNA, 22 nt, Human
gaguaaaagaugaggcaguaga

SEQ ID NO: 89746 - RNA, 22 nt, Human
gaguaaggaaguguuggccaca

SEQ ID NO: 89747 - RNA, 22 nt, Human
gaguaauuuucuuaaaacauca

SEQ ID NO: 89748 - RNA, 22 nt, Human
gaguauuuaccacuaaaugguu

SEQ ID NO: 89749 - RNA, 22 nt, Human
gcagugccauguggaggaucuc

SEQ ID NO: 89750 - RNA, 22 nt, Human
gcaguuaccuauuuuguagaaa

SEQ ID NO: 89751 - RNA, 22 nt, Human
gagugguaaaguguacugaaua

SEQ ID NO: 89752 - RNA, 22 nt, Human
gcauaauauugagaaauuauua

SEQ ID NO: 89753 - RNA, 22 nt, Human
gagucuuuuaagaugucuuacu

SEQ ID NO: 89754 - RNA, 22 nt, Human
gcauaguuuucauagguguuuu

SEQ ID NO: 89755 - RNA, 22 nt, Human
gcaucccagaagauucugauuu

SEQ ID NO: 89756 - RNA, 22 nt, Human
gaguucaaagaucuaggaagag

SEQ ID NO: 89757 - RNA, 22 nt, Human
gaguuggggcugcguguuucca

SEQ ID NO: 89758 - RNA, 22 nt, Human
gaugaagaaacucaaccaagaa

SEQ ID NO: 89759 - RNA, 22 nt, Human
gaucuuacucacuucagcuggc

SEQ ID NO: 89760 - RNA, 22 nt, Human
gcccauggagaccucaggcugg

SEQ ID NO: 89761 - RNA, 22 nt, Human
gaugguaucugcuggcuuucag

SEQ ID NO: 89762 - RNA, 22 nt, Human
gccaucugcuuagauugcuggg

SEQ ID NO: 89763 - RNA, 22 nt, Human
gcccuggcauuucuauucaugu

SEQ ID NO: 89764 - RNA, 22 nt, Human
gauguuaauauguuucaccaaa

SEQ ID NO: 89765 - RNA, 22 nt, Human
gauucagagcugcaacaaagaa

SEQ ID NO: 89766 - RNA, 22 nt, Human
gauuaaaggucuugauuauaag

SEQ ID NO: 89767 - RNA, 22 nt, Human
gccucucagcuagaaggcaggu

SEQ ID NO: 89768 - RNA, 22 nt, Human
gauuuugcuuuagugaaggaag

SEQ ID NO: 89769 - RNA, 22 nt, Human
gauuuugaaccuuauuuggaaa

SEQ ID NO: 89770 - RNA, 22 nt, Human
gcaauuguauugucaagacaug

SEQ ID NO: 89771 - RNA, 22 nt, Human
gcagaggcugccgugggcagga

SEQ ID NO: 89772 - RNA, 23 nt, Human
gcagccaacccacgugagagaag

SEQ ID NO: 89773 - RNA, 22 nt, Human
gcagcauuaccaagacauggca

SEQ ID NO: 89774 - RNA, 22 nt, Human
gcagcaauaaaacugaaggugu

SEQ ID NO: 89775 - RNA, 22 nt, Human
gcaggaagauugcagaaggcug

SEQ ID NO: 89776 - RNA, 22 nt, Human
gcgggcgcuguggccccggccu

SEQ ID NO: 89777 - RNA, 23 nt, Human
gcgggcggagccgggaggcgggg

SEQ ID NO: 89778 - RNA, 22 nt, Human
gcgcugagcuuuucuuauugaa

SEQ ID NO: 89779 - RNA, 21 nt, Human
gcagcaugagaaagccccaaa

SEQ ID NO: 89780 - RNA, 22 nt, Human
gcaguauuguguguggucaugg

SEQ ID NO: 89781 - RNA, 22 nt, Human
gcuacauuagcuucaauggcua

SEQ ID NO: 89782 - RNA, 22 nt, Human
gcagggcucuggagucaggcug

SEQ ID NO: 89783 - RNA, 22 nt, Human
gcauauuuuaaaguguaaccug

SEQ ID NO: 89784 - RNA, 22 nt, Human
gcucccaauuccuuuuacaauu

SEQ ID NO: 89785 - RNA, 18 nt, Human
gcugaaauucuaaacaaa

SEQ ID NO: 89786 - RNA, 20 nt, Human
gcucuucuccgggucugccu

SEQ ID NO: 89787 - RNA, 22 nt, Human
gcauggaaaagggaugcuaacu

SEQ ID NO: 89788 - RNA, 23 nt, Human
uuuuccaaaucgacucucuaguu

SEQ ID NO: 89789 - RNA, 22 nt, Human
uggagccuugugagaccacaau

SEQ ID NO: 89790 - RNA, 19 nt, Human
uagaggagaauggcaaaga

SEQ ID NO: 89791 - RNA, 22 nt, Human
ugcuuucaaaacucagaggaau

SEQ ID NO: 89792 - RNA, 22 nt, Human
ggaaggggagcuggaaagggua

SEQ ID NO: 89793 - RNA, 22 nt, Human
guuuuucuuugauuuagaacca

SEQ ID NO: 89794 - RNA, 22 nt, Human
uggaagugggcaucaccaucca

SEQ ID NO: 89795 - RNA, 22 nt, Human
auacauauaugcacauuaauau

SEQ ID NO: 89796 - RNA, 22 nt, Human
acauaaaccccccuuccccagg

SEQ ID NO: 89797 - RNA, 22 nt, Human
cuuuuuuucuccauauuucugg

SEQ ID NO: 89798 - RNA, 22 nt, Human
uggccccauuuuucuggagccu

SEQ ID NO: 89799 - RNA, 22 nt, Human
uuuguuuccagccuuuugucuu

SEQ ID NO: 89800 - RNA, 22 nt, Human
gcuguggagaagcugccuaugg

SEQ ID NO: 89801 - RNA, 22 nt, Human
cagaccagaaggaagccgacaa

SEQ ID NO: 89802 - RNA, 22 nt, Human
ccagcugggucccugcuggggc

SEQ ID NO: 89803 - RNA, 22 nt, Human
uucacauucauuucuuauguuu

SEQ ID NO: 89804 - RNA, 22 nt, Human
uuauauuuuauuuaauuaaaua

SEQ ID NO: 89805 - RNA, 22 nt, Human
ggaggccgugcugugcugccag

SEQ ID NO: 89806 - RNA, 22 nt, Human
agucccugauggacuggaugag

SEQ ID NO: 89807 - RNA, 22 nt, Human
guucaaucucucaugcauuuuc

SEQ ID NO: 89808 - RNA, 19 nt, Human
acuggggcaggcugggcuu

SEQ ID NO: 89809 - RNA, 22 nt, Human
uuauuuuuguaacacuguauag

SEQ ID NO: 89810 - RNA, 22 nt, Human
aggauagacuucagaaggcaua

SEQ ID NO: 89811 - RNA, 22 nt, Human
uucacugugauugggguggauu

SEQ ID NO: 89812 - RNA, 22 nt, Human
uauuuucucugccacacuucca

SEQ ID NO: 89813 - RNA, 22 nt, Human
ucagccuugguuuugguguugg

SEQ ID NO: 89814 - RNA, 22 nt, Human
uggaguuuuaaucuguacagaa

SEQ ID NO: 89815 - RNA, 16 nt, Human
gaauuccauugcucug

SEQ ID NO: 89816 - RNA, 22 nt, Human
agagggagagaccuccgugccu

SEQ ID NO: 89817 - RNA, 22 nt, Human
ccauuucacaucccugacaugu

SEQ ID NO: 89818 - RNA, 22 nt, Human
ggugaguagaaguaguuggcuu

SEQ ID NO: 89819 - RNA, 22 nt, Human
guccuguguaaguacuugcuca

SEQ ID NO: 89820 - RNA, 22 nt, Human
auuuuacuaugauaguugagaa

SEQ ID NO: 89821 - RNA, 22 nt, Human
acucacuguuuugaaauugaac

SEQ ID NO: 89822 - RNA, 23 nt, Human
uugcuuuugccccaaaagaguua

SEQ ID NO: 89823 - RNA, 22 nt, Human
agggaguuccgaucugugcacc

SEQ ID NO: 89824 - RNA, 22 nt, Human
uuuuauaauacccuugacuaau

SEQ ID NO: 89825 - RNA, 22 nt, Human
uuuugaauaauucagaaacagc

SEQ ID NO: 89826 - RNA, 22 nt, Human
ugaggaagugguuguaugguuu

SEQ ID NO: 89827 - RNA, 22 nt, Human
ugcauucugaacguaaauguga

SEQ ID NO: 89828 - RNA, 23 nt, Human
ucugccuccuaauuguugguguc

SEQ ID NO: 89829 - RNA, 22 nt, Human
gcccugucagcucucauggaca

SEQ ID NO: 89830 - RNA, 22 nt, Human
guacauauccuuuacguuuugu

SEQ ID NO: 89831 - RNA, 22 nt, Human
uaagggagcagaagcugugaaa

SEQ ID NO: 89832 - RNA, 22 nt, Human
uuuaaauuucugaaucuugagg

SEQ ID NO: 89833 - RNA, 22 nt, Human
gcagggcucuggagucaggcug

SEQ ID NO: 89834 - RNA, 21 nt, Human
caguucuaagugucaucuuuu

SEQ ID NO: 89835 - RNA, 19 nt, Human
agcucaggcccaucguccc

SEQ ID NO: 89836 - RNA, 22 nt, Human
cagcuuguucugaccugugauu

SEQ ID NO: 89837 - RNA, 22 nt, Human
uuaucaaaaaauaguacuuuga

SEQ ID NO: 89838 - RNA, 20 nt, Human
ccuuguggaugucuuuuuug

SEQ ID NO: 89839 - RNA, 22 nt, Human
aagccucaugccagauccaggu

SEQ ID NO: 89840 - RNA, 20 nt, Human
gaacauaaauaacucuuuac

SEQ ID NO: 89841 - RNA, 22 nt, Human
aaaauauucuauaucaaagaua

SEQ ID NO: 89842 - RNA, 22 nt, Human
uagggaggguuugggguggagg

SEQ ID NO: 89843 - RNA, 22 nt, Human
uuuccuaggaaaugauugaagu

SEQ ID NO: 89844 - RNA, 22 nt, Human
agcaaaauuccaaaaugcuaau

SEQ ID NO: 89845 - RNA, 22 nt, Human
uuuaaucaguugguaauauuga

SEQ ID NO: 89846 - RNA, 22 nt, Human
agugagaguauuaaugugaacu

SEQ ID NO: 89847 - RNA, 22 nt, Human
ggggaaggaaggggagggcacg

SEQ ID NO: 89848 - RNA, 22 nt, Human
uuuuaaaagguugcuguuauaa

SEQ ID NO: 89849 - RNA, 22 nt, Human
ugaguucugacugagcaugggg

SEQ ID NO: 89850 - RNA, 22 nt, Human
uggaaaauuuagaaagauuuau

SEQ ID NO: 89851 - RNA, 22 nt, Human
ucaguggaacacacagaguggg

SEQ ID NO: 89852 - RNA, 22 nt, Human
aggcucagcaucugauucauau

SEQ ID NO: 89853 - RNA, 22 nt, Human
agugccaucuuuaacuguccca

SEQ ID NO: 89854 - RNA, 22 nt, Human
aacugcauaagcuucgggaccu

SEQ ID NO: 89855 - RNA, 22 nt, Human
uguuuuuuagagugauacuuuu

SEQ ID NO: 89856 - RNA, 22 nt, Human
uacuauuuugacaugaaauuga

SEQ ID NO: 89857 - RNA, 22 nt, Human
gccagggcucgagcaggccagc

SEQ ID NO: 89858 - RNA, 20 nt, Human
uaguggaccuugaaggccuc

SEQ ID NO: 89859 - RNA, 22 nt, Human
ugcuuucaaugaauuguauacu

SEQ ID NO: 89860 - RNA, 22 nt, Human
aguaggauguuuagcccuucuu

SEQ ID NO: 89861 - RNA, 21 nt, Human
guucuuaguuauauucucaau

SEQ ID NO: 89862 - RNA, 22 nt, Human
gucugcagcacugugcacgguc

SEQ ID NO: 89863 - RNA, 22 nt, Human
ucccuugacauuacuugggagg

SEQ ID NO: 89864 - RNA, 21 nt, Human
cuauaaaaaugguucuuugcg

SEQ ID NO: 89865 - RNA, 22 nt, Human
uuuacuguuuacagcuaaugca

SEQ ID NO: 89866 - RNA, 22 nt, Human
uuauuucauguaaaauuuaugu

SEQ ID NO: 89867 - RNA, 22 nt, Human
uauauacacgcacauauacaua

SEQ ID NO: 89868 - RNA, 22 nt, Human
gaggugauuccucccauguaau

SEQ ID NO: 89869 - RNA, 17 nt, Human
ucuguguccgcucaguc

SEQ ID NO: 89870 - RNA, 22 nt, Human
uggaugccuugggggaggagga

SEQ ID NO: 89871 - RNA, 22 nt, Human
ggcuggggccuguugaagaugc

SEQ ID NO: 89872 - RNA, 22 nt, Human
cuccuuugagcaaaucuuugau

SEQ ID NO: 89873 - RNA, 22 nt, Human
ucacucuuuaucuuuuaugucu

SEQ ID NO: 89874 - RNA, 22 nt, Human
ggcagucuuucccuugagcucu

SEQ ID NO: 89875 - RNA, 22 nt, Human
cuguuucucugccugcacacau

SEQ ID NO: 89876 - RNA, 22 nt, Human
gggagguaaugggggugcaggg

SEQ ID NO: 89877 - RNA, 22 nt, Human
uggggcauacgugaaauaauuu

SEQ ID NO: 89878 - RNA, 22 nt, Human
cugccucucaugccugcuugcu

SEQ ID NO: 89879 - RNA, 22 nt, Human
accuccauggcccacaucuagu

SEQ ID NO: 89880 - RNA, 22 nt, Human
uguacauacauagauauacaca

SEQ ID NO: 89881 - RNA, 22 nt, Human
aggcuccucugggggccccgga

SEQ ID NO: 89882 - RNA, 22 nt, Human
acauauaugugcauacaacuau

SEQ ID NO: 89883 - RNA, 22 nt, Human
uugugugugcccaccuguggcc

SEQ ID NO: 89884 - RNA, 22 nt, Human
agagacaggguuuugucguguu

SEQ ID NO: 89885 - RNA, 19 nt, Human
caggucuucuuggaggacu

SEQ ID NO: 89886 - RNA, 22 nt, Human
gcucucuggccugggaggagga

SEQ ID NO: 89887 - RNA, 22 nt, Human
uauuuuuuuaacauuuauugua

SEQ ID NO: 89888 - RNA, 22 nt, Human
cugcugugcagacagacucucu

SEQ ID NO: 89889 - RNA, 22 nt, Human
gggagccucccacugggggaag

SEQ ID NO: 89890 - RNA, 22 nt, Human
uugguuuacucuggggauaucu

SEQ ID NO: 89891 - RNA, 22 nt, Human
ccagucuuggugucuguagcac

SEQ ID NO: 89892 - RNA, 17 nt, Human
auuguuuuuaauuugca

SEQ ID NO: 89893 - RNA, 22 nt, Human
agauggaggaaagcaguuagaa

SEQ ID NO: 89894 - RNA, 22 nt, Human
aaggucuucgaaccuuauguua

SEQ ID NO: 89895 - RNA, 22 nt, Human
auauguuaugccauuuucaagg

SEQ ID NO: 89896 - RNA, 20 nt, Human
ggcagagcuaugucuguugc

SEQ ID NO: 89897 - RNA, 22 nt, Human
aaauguaaacuguauuuauaaa

SEQ ID NO: 89898 - RNA, 22 nt, Human
ugauucacagacuucacaaggc

SEQ ID NO: 89899 - RNA, 22 nt, Human
cccagagggcugaggauaugaa

SEQ ID NO: 89900 - RNA, 22 nt, Human
uucuuuuaauuucugucugcag

SEQ ID NO: 89901 - RNA, 22 nt, Human
ugagauguaauguaguacuuug

SEQ ID NO: 89902 - RNA, 22 nt, Human
gaaccauuuaauggagaugcuc

SEQ ID NO: 89903 - RNA, 22 nt, Human
ggagaggaaguuuaaagaauug

SEQ ID NO: 89904 - RNA, 22 nt, Human
gucucacuucauuuucuuagcc

SEQ ID NO: 89905 - RNA, 20 nt, Human
cuggaguguagcaguggcug

SEQ ID NO: 89906 - RNA, 22 nt, Human
ggggcaucguugauugcauggu

SEQ ID NO: 89907 - RNA, 22 nt, Human
uucaugucuuugauucugauaa

SEQ ID NO: 89908 - RNA, 22 nt, Human
uggcucaguaaucgagucuccu

SEQ ID NO: 89909 - RNA, 22 nt, Human
uugcuuucuuuguagguuuucc

SEQ ID NO: 89910 - RNA, 22 nt, Human
aggcgaagggaccagacgguag

SEQ ID NO: 89911 - RNA, 22 nt, Human
uuuuagaagcauuuaugagauu

SEQ ID NO: 89912 - RNA, 22 nt, Human
cuggaagcgucggaggaagggc

SEQ ID NO: 89913 - RNA, 22 nt, Human
cagcuguggagauggggugcau

SEQ ID NO: 89914 - RNA, 22 nt, Human
uucugcuuuaaagcucauguuu

SEQ ID NO: 89915 - RNA, 22 nt, Human
ucacuuccuugcagcuguagaa

SEQ ID NO: 89916 - RNA, 22 nt, Human
gaggaggcuggagaggccagga

SEQ ID NO: 89917 - RNA, 22 nt, Human
ggcucagaggagcuggaacggu

SEQ ID NO: 89918 - RNA, 22 nt, Human
acgugugugugcacguguguau

SEQ ID NO: 89919 - RNA, 22 nt, Human
gguuuucacgauccucccuuuu

SEQ ID NO: 89920 - RNA, 22 nt, Human
aacacuaaaggucaguuagaag

SEQ ID NO: 89921 - RNA, 22 nt, Human
uggaagcccagaaggaagcaga

SEQ ID NO: 89922 - RNA, 22 nt, Human
ucauacuuuuuugacccuugug

SEQ ID NO: 89923 - RNA, 21 nt, Human
gcagcucaggauauagacuug

SEQ ID NO: 89924 - RNA, 22 nt, Human
uggguucaaauccugguuccac

SEQ ID NO: 89925 - RNA, 22 nt, Human
acagagcucccagccaucuccu

SEQ ID NO: 89926 - RNA, 22 nt, Human
caagaaaaaacaugaugagugu

SEQ ID NO: 89927 - RNA, 22 nt, Human
cuacuucucccuagaucagaaa

SEQ ID NO: 89928 - RNA, 22 nt, Human
uucuuuuaauagagauccugug

SEQ ID NO: 89929 - RNA, 22 nt, Human
gaggcucagagggacuuucaag

SEQ ID NO: 89930 - RNA, 22 nt, Human
aagggagagggagaagguggga

SEQ ID NO: 89931 - RNA, 22 nt, Human
uucuccaccugcuccucccacc

SEQ ID NO: 89932 - RNA, 22 nt, Human
gcugcaggaggugguagggucu

SEQ ID NO: 89933 - RNA, 22 nt, Human
aauaucuugaguuauaaauuca

SEQ ID NO: 89934 - RNA, 22 nt, Human
gucuugugaagacggcagaaag

SEQ ID NO: 89935 - RNA, 22 nt, Human
gagggagugggcccgugggcac

SEQ ID NO: 89936 - RNA, 22 nt, Human
cauaaauuuuaccuuguaagug

SEQ ID NO: 89937 - RNA, 22 nt, Human
guucuucagauuccauuucagu

SEQ ID NO: 89938 - RNA, 22 nt, Human
guuuggguggcuagagaaagaa

SEQ ID NO: 89939 - RNA, 22 nt, Human
uucuucuuuccuauaauuaauu

SEQ ID NO: 89940 - RNA, 22 nt, Human
uucauuagcacauuuccuuggu

SEQ ID NO: 89941 - RNA, 22 nt, Human
uucauagaagggaguuuuuccu

SEQ ID NO: 89942 - RNA, 22 nt, Human
gagggggaaaagggcagcagag

SEQ ID NO: 89943 - RNA, 22 nt, Human
ugguucuagaugagaugaugag

SEQ ID NO: 89944 - RNA, 22 nt, Human
auuuuuuuuccugucucuuuca

SEQ ID NO: 89945 - RNA, 22 nt, Human
guucuacaugacacucaacauu

SEQ ID NO: 89946 - RNA, 22 nt, Human
agcuuucuauauaugaguugcu

SEQ ID NO: 89947 - RNA, 21 nt, Human
auauuguugggguuuucuuuu

SEQ ID NO: 89948 - RNA, 22 nt, Human
caggccccagggacugggcgcu

SEQ ID NO: 89949 - RNA, 22 nt, Human
caguggacacuuccucuacaau

SEQ ID NO: 89950 - RNA, 22 nt, Human
ggcugggagguggcgaggaggc

SEQ ID NO: 89951 - RNA, 22 nt, Human
aaauucuuccaggaggaaauac

SEQ ID NO: 89952 - RNA, 22 nt, Human
uuuuccuuagaaauacauugau

SEQ ID NO: 89953 - RNA, 22 nt, Human
ggacauaguugcuauggagagu

SEQ ID NO: 89954 - RNA, 22 nt, Human
uucuugugugaauauaauuaca

SEQ ID NO: 89955 - RNA, 22 nt, Human
auucuuuucucuaaaugaugaa

SEQ ID NO: 89956 - RNA, 22 nt, Human
auauaguacauguauauauaua

SEQ ID NO: 89957 - RNA, 22 nt, Human
uuguuauaggaucagugucacu

SEQ ID NO: 89958 - RNA, 22 nt, Human
ugcagcuuuugguuucuagaug

SEQ ID NO: 89959 - RNA, 22 nt, Human
uuguuuucuaguguuuugaaua

SEQ ID NO: 89960 - RNA, 22 nt, Human
ggagacagauggcgucucaguu

SEQ ID NO: 89961 - RNA, 22 nt, Human
ucuuuuaucuguuguguaacaa

SEQ ID NO: 89962 - RNA, 22 nt, Human
uaguuucuucaacugucccagc

SEQ ID NO: 89963 - RNA, 22 nt, Human
uuuauuuuccaugucucuaggu

SEQ ID NO: 89964 - RNA, 22 nt, Human
uuuauaauuacguaaaauauuu

SEQ ID NO: 89965 - RNA, 22 nt, Human
uuggugaugcccaccuuuucau

SEQ ID NO: 89966 - RNA, 22 nt, Human
uauuuuuacuguuugaugauuc

SEQ ID NO: 89967 - RNA, 22 nt, Human
uugaaaauuaauagguguacaa

SEQ ID NO: 89968 - RNA, 23 nt, Human
ccagcugugccuggcccaggagc

SEQ ID NO: 89969 - RNA, 22 nt, Human
uugauagauuuuagaggcaggc

SEQ ID NO: 89970 - RNA, 22 nt, Human
uauaagaaaagucauuaucaaa

SEQ ID NO: 89971 - RNA, 17 nt, Human
ugucuuuuuccuccucc

SEQ ID NO: 89972 - RNA, 22 nt, Human
aaauuuuguugaaaaauauuuu

SEQ ID NO: 89973 - RNA, 22 nt, Human
cucuuucauucuguccuuguuu

SEQ ID NO: 89974 - RNA, 22 nt, Human
agcugaggccccgcagcagggu

SEQ ID NO: 89975 - RNA, 22 nt, Human
uuuuuaaaagaugauuuaauga

SEQ ID NO: 89976 - RNA, 22 nt, Human
cugguuuauuucauaguuuguu

SEQ ID NO: 89977 - RNA, 22 nt, Human
uuguuauuauuauuuucguucu

SEQ ID NO: 89978 - RNA, 22 nt, Human
ucauuauuuugauguauuuccu

SEQ ID NO: 89979 - RNA, 23 nt, Human
ucagaccaaccucuugcuggaac

SEQ ID NO: 89980 - RNA, 22 nt, Human
ggaggccagagaagagccaggc

SEQ ID NO: 89981 - RNA, 22 nt, Human
aaaauauaaaggauguggguuu

SEQ ID NO: 89982 - RNA, 22 nt, Human
uucuucuucuuccucauccuca

SEQ ID NO: 89983 - RNA, 22 nt, Human
uugccaggagacaucuggagcc

SEQ ID NO: 89984 - RNA, 22 nt, Human
ccagggcuggaggaggucagga

SEQ ID NO: 89985 - RNA, 22 nt, Human
cuucuuaaaguugucacagcug

SEQ ID NO: 89986 - RNA, 22 nt, Human
ggagcucacuacgaaauaagcu

SEQ ID NO: 89987 - RNA, 22 nt, Human
auguuccaugacuaugcaugaa

SEQ ID NO: 89988 - RNA, 22 nt, Human
cuuuaaaaauguauuuuugugg

SEQ ID NO: 89989 - RNA, 22 nt, Human
uauuuuagccaacagaaugaug

SEQ ID NO: 89990 - RNA, 22 nt, Human
uuauuuaaaauguagguuggga

SEQ ID NO: 89991 - RNA, 22 nt, Human
ggaggcccagaaggaagcccag

SEQ ID NO: 89992 - RNA, 22 nt, Human
uuuuuuuaaguuuugauuuuag

SEQ ID NO: 89993 - RNA, 22 nt, Human
auuagugguguauuuggcacua

SEQ ID NO: 89994 - RNA, 22 nt, Human
ucuucacagaugcauauacuuc

SEQ ID NO: 89995 - RNA, 22 nt, Human
cacuguugagcaauguacagug

SEQ ID NO: 89996 - RNA, 22 nt, Human
cugcaucacagcaggaggcaca

SEQ ID NO: 89997 - RNA, 22 nt, Human
auggauggaagcagccugaacu

SEQ ID NO: 89998 - RNA, 22 nt, Human
uuuuuuaaucaaguaggaaaca

SEQ ID NO: 89999 - RNA, 20 nt, Human
uugauucacaaaaagcuuag

SEQ ID NO: 90000 - RNA, 22 nt, Human
ugaaaaauauuuuuagaaauaa

SEQ ID NO: 90001 - RNA, 22 nt, Human
agggcugcugcuccgggcccag

SEQ ID NO: 90002 - RNA, 22 nt, Human
uuuucaauuuucauuugcaaga

SEQ ID NO: 90003 - RNA, 22 nt, Human
caaauguuugguggcauuuugu

SEQ ID NO: 90004 - RNA, 21 nt, Human
uuucauuaguacaucaauuug

SEQ ID NO: 90005 - RNA, 22 nt, Human
ggcucccgugggaugguggagc

SEQ ID NO: 90006 - RNA, 21 nt, Human
ugcuuucugugcuuuuucugc

SEQ ID NO: 90007 - RNA, 22 nt, Human
gagggcugccacguugggcgag

SEQ ID NO: 90008 - RNA, 22 nt, Human
uacugcaguuccugcugucucc

SEQ ID NO: 90009 - RNA, 22 nt, Human
aggcaguguguagcuggaagag

SEQ ID NO: 90010 - RNA, 22 nt, Human
uuuucauagccagaaacugaaa

SEQ ID NO: 90011 - RNA, 22 nt, Human
uuuaaaacagcauuuaaaaggu

SEQ ID NO: 90012 - RNA, 22 nt, Human
guuguuuuuguuaaaacaguga

SEQ ID NO: 90013 - RNA, 22 nt, Human
agguggucccaauggcugggca

SEQ ID NO: 90014 - RNA, 22 nt, Human
uggggcuccuccuggcaggagg

SEQ ID NO: 90015 - RNA, 22 nt, Human
caguggagaccugccugcugga

SEQ ID NO: 90016 - RNA, 22 nt, Human
acuuuauacuagugauaguuug

SEQ ID NO: 90017 - RNA, 22 nt, Human
ccuucugcuggucaucccagug

SEQ ID NO: 90018 - RNA, 22 nt, Human
gccaguggucagugggagggug

SEQ ID NO: 90019 - RNA, 22 nt, Human
cuucuuuucuacuggccuagaa

SEQ ID NO: 90020 - RNA, 22 nt, Human
cuccuugguuccggcguuggag

SEQ ID NO: 90021 - RNA, 22 nt, Human
aaauuaaaguuuuauuuagagc

SEQ ID NO: 90022 - RNA, 22 nt, Human
gugugugucuacuuucaucucu

SEQ ID NO: 90023 - RNA, 20 nt, Human
ugccagagagcucauacccu

SEQ ID NO: 90024 - RNA, 22 nt, Human
guggguauauauaugugugcug

SEQ ID NO: 90025 - RNA, 22 nt, Human
aagcucagcugguggugauugc

SEQ ID NO: 90026 - RNA, 22 nt, Human
ucaaauaugggccagaggaaau

SEQ ID NO: 90027 - RNA, 22 nt, Human
uuacuuuuuucccccuuagaug

SEQ ID NO: 90028 - RNA, 22 nt, Human
gaggcuugccacuguccauggc

SEQ ID NO: 90029 - RNA, 22 nt, Human
ucucucugcuguccagcguuau

SEQ ID NO: 90030 - RNA, 22 nt, Human
guguucuuuguagaggaucuug

SEQ ID NO: 90031 - RNA, 22 nt, Human
ggcuagggagacagagggcaug

SEQ ID NO: 90032 - RNA, 22 nt, Human
gaguucuagauguauuauuaau

SEQ ID NO: 90033 - RNA, 22 nt, Human
guuuuguagucuggagacuguc

SEQ ID NO: 90034 - RNA, 21 nt, Human
gggagugaguaaugauggggg

SEQ ID NO: 90035 - RNA, 22 nt, Human
auauucaaugaggucauauaag

SEQ ID NO: 90036 - RNA, 22 nt, Human
ccagaugggggcugugggaggg

SEQ ID NO: 90037 - RNA, 23 nt, Human
uuucugaguuuuuuaaaagucca

SEQ ID NO: 90038 - RNA, 22 nt, Human
agcagggagacagugcagcauu

SEQ ID NO: 90039 - RNA, 22 nt, Human
cuccccuuauuccucaacauga

SEQ ID NO: 90040 - RNA, 22 nt, Human
uuuugcuucuaguauauuuuuu

SEQ ID NO: 90041 - RNA, 22 nt, Human
gggcaagaagcuggaagcauuc

SEQ ID NO: 90042 - RNA, 22 nt, Human
cagcucugcugggaggaugcag

SEQ ID NO: 90043 - RNA, 22 nt, Human
uggggcugguaccguaauauau

SEQ ID NO: 90044 - RNA, 22 nt, Human
acuggagcccguggaggcgcag

SEQ ID NO: 90045 - RNA, 22 nt, Human
gggcagagagcuggaacuccuu

SEQ ID NO: 90046 - RNA, 22 nt, Human
auagggaggcggagggagcugg

SEQ ID NO: 90047 - RNA, 22 nt, Human
uuuauguuuguuuuugaaauaa

SEQ ID NO: 90048 - RNA, 22 nt, Human
gggcuguggggccugcagaagg

SEQ ID NO: 90049 - RNA, 22 nt, Human
cucugugucugauucugggaag

SEQ ID NO: 90050 - RNA, 22 nt, Human
guuaaaaugauuugugauuuau

SEQ ID NO: 90051 - RNA, 22 nt, Human
gggauggggagcuggaaagggg

SEQ ID NO: 90052 - RNA, 22 nt, Human
uggaggcccagcugggggccgg

SEQ ID NO: 90053 - RNA, 19 nt, Human
gauauugagcugagaauuc

SEQ ID NO: 90054 - RNA, 22 nt, Human
aagaaggaaggcaagagauggg

SEQ ID NO: 90055 - RNA, 22 nt, Human
auguaugagagauucuuuuauu

SEQ ID NO: 90056 - RNA, 22 nt, Human
ccucaggaauuuauucuucugu

SEQ ID NO: 90057 - RNA, 22 nt, Human
aaauauagugacacuuauaguc

SEQ ID NO: 90058 - RNA, 22 nt, Human
auaaaaauguuuuuguguggua

SEQ ID NO: 90059 - RNA, 22 nt, Human
ucuucaugaaauugauugcuua

SEQ ID NO: 90060 - RNA, 22 nt, Human
uucucuugccuucucuuuuauc

SEQ ID NO: 90061 - RNA, 18 nt, Human
uucucucuggauaguagu

SEQ ID NO: 90062 - RNA, 22 nt, Human
aucucacuucugucauguggca

SEQ ID NO: 90063 - RNA, 22 nt, Human
ggagagcuagugagcuggaggu

SEQ ID NO: 90064 - RNA, 22 nt, Human
uucuagcucauggugacagauc

SEQ ID NO: 90065 - RNA, 22 nt, Human
agcgcucauuuuccuccugcuc

SEQ ID NO: 90066 - RNA, 22 nt, Human
gauuuuaaaagauguauaaggu

SEQ ID NO: 90067 - RNA, 22 nt, Human
auauuuuugcagaauuuuucgu

SEQ ID NO: 90068 - RNA, 23 nt, Human
uggaaguugagagucugcuuugu

SEQ ID NO: 90069 - RNA, 22 nt, Human
uauuuuaaaagcauuaauucuu

SEQ ID NO: 90070 - RNA, 22 nt, Human
aagugauuuucccaccaucuac

SEQ ID NO: 90071 - RNA, 22 nt, Human
caagggcagaggcagggccccg

SEQ ID NO: 90072 - RNA, 22 nt, Human
acucugcaguaaggaauuguuu

SEQ ID NO: 90073 - RNA, 22 nt, Human
augcuuucucuucuauuucuca

SEQ ID NO: 90074 - RNA, 22 nt, Human
cagcuggggagagacauggcag

SEQ ID NO: 90075 - RNA, 22 nt, Human
gcuguggacacagcucucuuca

SEQ ID NO: 90076 - RNA, 20 nt, Human
acuagaaagucacugggggg

SEQ ID NO: 90077 - RNA, 22 nt, Human
ugucuuuuaaaaauguguaaaa

SEQ ID NO: 90078 - RNA, 22 nt, Human
gcagaggcugccgugggcagga

SEQ ID NO: 90079 - RNA, 22 nt, Human
aagagaggcccaaguggcuggc

SEQ ID NO: 90080 - RNA, 22 nt, Human
ucuucaaauacagucauauuga

SEQ ID NO: 90081 - RNA, 22 nt, Human
uuauaucagaaggugagauuga

SEQ ID NO: 90082 - RNA, 22 nt, Human
uuuaucaggccaucuuaugucu

SEQ ID NO: 90083 - RNA, 22 nt, Human
gaggcaggaagggaggguugug

SEQ ID NO: 90084 - RNA, 22 nt, Human
gggggcugugugcccgcucccc

SEQ ID NO: 90085 - RNA, 22 nt, Human
uuaggggcuuaggcagaguuug

SEQ ID NO: 90086 - RNA, 22 nt, Human
uuucagaaauggcacugaaauc

SEQ ID NO: 90087 - RNA, 22 nt, Human
gucuuucuuuuacauauuugug

SEQ ID NO: 90088 - RNA, 22 nt, Human
gccugggguuugcggggcugca

SEQ ID NO: 90089 - RNA, 22 nt, Human
agggagucuggccgucggcugg

SEQ ID NO: 90090 - RNA, 20 nt, Human
ucugugugccaucaccuaac

SEQ ID NO: 90091 - RNA, 22 nt, Human
guugagaaucucuagcuuagga

SEQ ID NO: 90092 - RNA, 22 nt, Human
ggggaggugugcaggacaccuc

SEQ ID NO: 90093 - RNA, 22 nt, Human
aucuguuccccuaugcucucua

SEQ ID NO: 90094 - RNA, 22 nt, Human
ggcagagguagcuggaaccagg

SEQ ID NO: 90095 - RNA, 22 nt, Human
aggcauauaguguuuaaaaaaa

SEQ ID NO: 90096 - RNA, 22 nt, Human
augaaaacggaccagagcuauu

SEQ ID NO: 90097 - RNA, 22 nt, Human
cuauguuucagauauauauaua

SEQ ID NO: 90098 - RNA, 23 nt, Human
caggggacaggugaccugggcuc

SEQ ID NO: 90099 - RNA, 22 nt, Human
agggcaguuaugaaugucucca

SEQ ID NO: 90100 - RNA, 20 nt, Human
uuguacuuaugugagaagga

SEQ ID NO: 90101 - RNA, 18 nt, Human
acaaaaauagugcuuugg

SEQ ID NO: 90102 - RNA, 19 nt, Human
agcaucuccacagaaaaag

SEQ ID NO: 90103 - RNA, 22 nt, Human
uagacugugagcuccuugaggg

SEQ ID NO: 90104 - RNA, 22 nt, Human
guccccugcguguucauccugg

SEQ ID NO: 90105 - RNA, 18 nt, Human
uucaggcucuugcaugaa

SEQ ID NO: 90106 - RNA, 22 nt, Human
cuuuuuaaaguaaauggcuaga

SEQ ID NO: 90107 - RNA, 22 nt, Human
auuuucuucauuuugauuguau

SEQ ID NO: 90108 - RNA, 22 nt, Human
uauaaagaccuuauccuucaua

SEQ ID NO: 90109 - RNA, 22 nt, Human
gacuggggcauuagaguagcuu

SEQ ID NO: 90110 - RNA, 22 nt, Human
uuuuccuuccugucucuuuauu

SEQ ID NO: 90111 - RNA, 22 nt, Human
cacauuuuccagaagaaucaga

SEQ ID NO: 90112 - RNA, 22 nt, Human
aaugaauaaauuuuaaagacag

SEQ ID NO: 90113 - RNA, 22 nt, Human
gucacuuugcuugcgaugcucc

SEQ ID NO: 90114 - RNA, 22 nt, Human
uauauaauacacaaauauguac

SEQ ID NO: 90115 - RNA, 22 nt, Human
gcacaaaagguacuucauguag

SEQ ID NO: 90116 - RNA, 22 nt, Human
aggggaggcugggcuggggggc

SEQ ID NO: 90117 - RNA, 22 nt, Human
gguagacugagcuccuugagga

SEQ ID NO: 90118 - RNA, 22 nt, Human
auuguuuugugaaacauaguga

SEQ ID NO: 90119 - RNA, 22 nt, Human
aaaauaauauuauaccacugcu

SEQ ID NO: 90120 - RNA, 22 nt, Human
auuuuagagaaacaaacguagg

SEQ ID NO: 90121 - RNA, 22 nt, Human
aggauggaaguaacuggauaau

SEQ ID NO: 90122 - RNA, 22 nt, Human
uguguuguuggggauguuuuca

SEQ ID NO: 90123 - RNA, 23 nt, Human
aaggugaagccaccaggugagga

SEQ ID NO: 90124 - RNA, 22 nt, Human
auggugaugaugaugaugauaa

SEQ ID NO: 90125 - RNA, 22 nt, Human
gcucagagaaaacuggggcuug

SEQ ID NO: 90126 - RNA, 22 nt, Human
cuccaugagccaggagggcuac

SEQ ID NO: 90127 - RNA, 22 nt, Human
agggcugggcuuggcaggcugg

SEQ ID NO: 90128 - RNA, 22 nt, Human
uuucacuucgaucagaguuuuu

SEQ ID NO: 90129 - RNA, 22 nt, Human
ugagguauuuggauuuauauuu

SEQ ID NO: 90130 - RNA, 22 nt, Human
cuguguguauaauguuugauaa

SEQ ID NO: 90131 - RNA, 21 nt, Human
uggcaggcagcuggaagcuug

SEQ ID NO: 90132 - RNA, 22 nt, Human
cucucugcugucuuucgggaaa

SEQ ID NO: 90133 - RNA, 22 nt, Human
aaauguauuagccuaugugaga

SEQ ID NO: 90134 - RNA, 22 nt, Human
gugaaauuguacacucaguacc

SEQ ID NO: 90135 - RNA, 22 nt, Human
aggugagaacguggaggggcgg

SEQ ID NO: 90136 - RNA, 22 nt, Human
auagagcuggggaagaagcugg

SEQ ID NO: 90137 - RNA, 22 nt, Human
guaaauaucucacgaaugauuc

SEQ ID NO: 90138 - RNA, 22 nt, Human
aacgagcugggggggccggggg

SEQ ID NO: 90139 - RNA, 18 nt, Human
guucaagcauuuugcucu

SEQ ID NO: 90140 - RNA, 22 nt, Human
gaauuccaggugagagaaggua

SEQ ID NO: 90141 - RNA, 22 nt, Human
aauauuuugggacugaggaauu

SEQ ID NO: 90142 - RNA, 22 nt, Human
aaauguuugguggauaaaagga

SEQ ID NO: 90143 - RNA, 22 nt, Human
acauuuuaaaaacaguaccugg

SEQ ID NO: 90144 - RNA, 20 nt, Human
agaaggagagaugaggcaaa

SEQ ID NO: 90145 - RNA, 19 nt, Human
ucaggaggucgaccuggca

SEQ ID NO: 90146 - RNA, 22 nt, Human
cugucucugauaagcucgaggg

SEQ ID NO: 90147 - RNA, 22 nt, Human
agagcuccaggguuuuguagug

SEQ ID NO: 90148 - RNA, 22 nt, Human
ucucucucucuuccagcauguu

SEQ ID NO: 90149 - RNA, 22 nt, Human
gcuucuguuaggauguggcuua

SEQ ID NO: 90150 - RNA, 22 nt, Human
aguaaaugaaagcaauuuuaga

SEQ ID NO: 90151 - RNA, 22 nt, Human
uaauauaacugccaguuaaggu

SEQ ID NO: 90152 - RNA, 22 nt, Human
uggcucaggccuacgacgccuu

SEQ ID NO: 90153 - RNA, 22 nt, Human
gugucacuuucaggagcucuaa

SEQ ID NO: 90154 - RNA, 22 nt, Human
cccuguccugcuaggcccuggu

SEQ ID NO: 90155 - RNA, 22 nt, Human
uuuucacugacuuggucuggaa

SEQ ID NO: 90156 - RNA, 22 nt, Human
guguugaugugucuguauucua

SEQ ID NO: 90157 - RNA, 19 nt, Human
ggaggguguccucaguguc

SEQ ID NO: 90158 - RNA, 22 nt, Human
cuguccauuuucgugccuccuu

SEQ ID NO: 90159 - RNA, 22 nt, Human
cuccacagccccuccaguggca

SEQ ID NO: 90160 - RNA, 22 nt, Human
augggagggugaggaggcagcu

SEQ ID NO: 90161 - RNA, 19 nt, Human
augaaauagcauuuucuga

SEQ ID NO: 90162 - RNA, 20 nt, Human
aauaaauauaacccauaauu

SEQ ID NO: 90163 - RNA, 22 nt, Human
uaguauuuguaauuaucaaagc

SEQ ID NO: 90164 - RNA, 22 nt, Human
augcugugccuggaaagcggcu

SEQ ID NO: 90165 - RNA, 22 nt, Human
uugucaggaacuaugauuaugc

SEQ ID NO: 90166 - RNA, 22 nt, Human
cacugcacuccagccugggcaa

SEQ ID NO: 90167 - RNA, 22 nt, Human
aaaauacuaggaaaauaaauca

SEQ ID NO: 90168 - RNA, 20 nt, Human
ucagugggaaagugagagug

SEQ ID NO: 90169 - RNA, 22 nt, Human
ggaggaagagaccagggggcuu

SEQ ID NO: 90170 - RNA, 22 nt, Human
cuguggcuaggaagcuguggga

SEQ ID NO: 90171 - RNA, 22 nt, Human
ucauuguuuacugucuuuuuuc

SEQ ID NO: 90172 - RNA, 22 nt, Human
uguuuucuuuccccuucuuuuc

SEQ ID NO: 90173 - RNA, 22 nt, Human
auuuucauauggguuauuugua

SEQ ID NO: 90174 - RNA, 22 nt, Human
ucuccucucugaucuugcuccg

SEQ ID NO: 90175 - RNA, 22 nt, Human
ugccagcuccgaggagcugcag

SEQ ID NO: 90176 - RNA, 22 nt, Human
cucuugugucaccauggauaaa

SEQ ID NO: 90177 - RNA, 22 nt, Human
ggccugcuaccagcugugaccu

SEQ ID NO: 90178 - RNA, 22 nt, Human
cucuguguguuugugugugugu

SEQ ID NO: 90179 - RNA, 22 nt, Human
ugcuuggagaaucagucccagc

SEQ ID NO: 90180 - RNA, 22 nt, Human
aaugcuuuuugcgaaaugugca

SEQ ID NO: 90181 - RNA, 22 nt, Human
gggggcagguuccaggccagcu

SEQ ID NO: 90182 - RNA, 22 nt, Human
cuaaaccaauauauuuucuucc

SEQ ID NO: 90183 - RNA, 21 nt, Human
aggugaaggcgagggggacag

SEQ ID NO: 90184 - RNA, 22 nt, Human
uggcagccugcgugaaggagcu

SEQ ID NO: 90185 - RNA, 22 nt, Human
aggcaguguggagggcuguugc

SEQ ID NO: 90186 - RNA, 22 nt, Human
gggcugagagcuggaaucugag

SEQ ID NO: 90187 - RNA, 23 nt, Human
cagagaaaauagaauaugcugug

SEQ ID NO: 90188 - RNA, 22 nt, Human
agggcaguuuuacugaaaggug

SEQ ID NO: 90189 - RNA, 22 nt, Human
uucaaacaguguagaauauaug

SEQ ID NO: 90190 - RNA, 22 nt, Human
uccauuuacuauucucauaucg

SEQ ID NO: 90191 - RNA, 22 nt, Human
uuuucucuuugcuucucuaaaa

SEQ ID NO: 90192 - RNA, 22 nt, Human
cauaggcucuucagagaacuga

SEQ ID NO: 90193 - RNA, 22 nt, Human
aaggugggacugagaggggaca

SEQ ID NO: 90194 - RNA, 22 nt, Human
guuauuguuauugcguugucga

SEQ ID NO: 90195 - RNA, 22 nt, Human
uggggagacauggaguaaaaga

SEQ ID NO: 90196 - RNA, 22 nt, Human
gagccucaggguuuuguugaca

SEQ ID NO: 90197 - RNA, 22 nt, Human
uuggugauguagcagcaauugu

SEQ ID NO: 90198 - RNA, 22 nt, Human
uucaaaaugcagaauaguuugg

SEQ ID NO: 90199 - RNA, 22 nt, Human
uguuuuuauucuuaauguuuca

SEQ ID NO: 90200 - RNA, 22 nt, Human
ugugugcuaguuuugucaguau

SEQ ID NO: 90201 - RNA, 22 nt, Human
gcugucccccaaagaugcuccu

SEQ ID NO: 90202 - RNA, 22 nt, Human
ugcuuucagauaucuguuucaa

SEQ ID NO: 90203 - RNA, 18 nt, Human
ggccucagccuggccgga

SEQ ID NO: 90204 - RNA, 22 nt, Human
ucuuucugaugggaagggucaa

SEQ ID NO: 90205 - RNA, 23 nt, Human
ucucacucauucuccucugucca

SEQ ID NO: 90206 - RNA, 22 nt, Human
auucuuuauuuucuguacuugc

SEQ ID NO: 90207 - RNA, 22 nt, Human
agggggaauccugcuuauggau

SEQ ID NO: 90208 - RNA, 22 nt, Human
uuauuucaggcauuuguaaaug

SEQ ID NO: 90209 - RNA, 22 nt, Human
ucauuguuucugcuuuucauga

SEQ ID NO: 90210 - RNA, 22 nt, Human
uuuguacuuucuaauguauuua

SEQ ID NO: 90211 - RNA, 22 nt, Human
cauggcaggugcagauucugug

SEQ ID NO: 90212 - RNA, 22 nt, Human
uugucuuucguauggaacacua

SEQ ID NO: 90213 - RNA, 22 nt, Human
cggcugcagcggagcaggcugg

SEQ ID NO: 90214 - RNA, 20 nt, Human
agugauuuguuaguacauug

SEQ ID NO: 90215 - RNA, 22 nt, Human
ugaaguuuagaaaaagugccuu

SEQ ID NO: 90216 - RNA, 22 nt, Human
ugggcagggauuuggggaaacu

SEQ ID NO: 90217 - RNA, 22 nt, Human
auuuuugguuucaccugcacgc

SEQ ID NO: 90218 - RNA, 22 nt, Human
ccaggcucaccuggagccccug

SEQ ID NO: 90219 - RNA, 22 nt, Human
cucugcuuguaucacauuugcu

SEQ ID NO: 90220 - RNA, 22 nt, Human
uccuuucaaauuuauuugacau

SEQ ID NO: 90221 - RNA, 22 nt, Human
cuguggcugcgcccugggggag

SEQ ID NO: 90222 - RNA, 22 nt, Human
uuauuuuuguuuguuaagccua

SEQ ID NO: 90223 - RNA, 22 nt, Human
cccuguccuucccuccaucuga

SEQ ID NO: 90224 - RNA, 22 nt, Human
cagagcugucauuugccaguga

SEQ ID NO: 90225 - RNA, 22 nt, Human
uuucucuuguauuugaaucacu

SEQ ID NO: 90226 - RNA, 22 nt, Human
agauucucccuccuggcgcugu

SEQ ID NO: 90227 - RNA, 22 nt, Human
uuaucuuuuaaaaacacuugug

SEQ ID NO: 90228 - RNA, 22 nt, Human
ucagucucuggggcuucuguuu

SEQ ID NO: 90229 - RNA, 22 nt, Human
gcaggggguaaggggcagggcu

SEQ ID NO: 90230 - RNA, 22 nt, Human
uccaugaguuuuuuaguuucac

SEQ ID NO: 90231 - RNA, 20 nt, Human
cuuauuuuggagaacuuuuc

SEQ ID NO: 90232 - RNA, 22 nt, Human
agagacuguaaugagagguaca

SEQ ID NO: 90233 - RNA, 22 nt, Human
gaaggagaggauugugaggcug

SEQ ID NO: 90234 - RNA, 22 nt, Human
auuucacucuuaauugcuuccu

SEQ ID NO: 90235 - RNA, 22 nt, Human
ucccuucccaccccugccuuuu

SEQ ID NO: 90236 - RNA, 22 nt, Human
uagcacauaguaggcacaggcu

SEQ ID NO: 90237 - RNA, 22 nt, Human
agagauacugcaggccauaaau

SEQ ID NO: 90238 - RNA, 22 nt, Human
gccucucuggcaaagcggugau

SEQ ID NO: 90239 - RNA, 22 nt, Human
auuaaaaaaagauaaugaguua

SEQ ID NO: 90240 - RNA, 22 nt, Human
gcuggccugcgagggcaggcug

SEQ ID NO: 90241 - RNA, 22 nt, Human
agauggaguccugaagccagaa

SEQ ID NO: 90242 - RNA, 22 nt, Human
augcaaaaucuuauuuuuucua

SEQ ID NO: 90243 - RNA, 22 nt, Human
uauuuuauuuagguuuaguugu

SEQ ID NO: 90244 - RNA, 22 nt, Human
ggcucccccauggcugacagac

SEQ ID NO: 90245 - RNA, 22 nt, Human
ucuucaucucuaaaaugggaac

SEQ ID NO: 90246 - RNA, 22 nt, Human
caaaaaauccauagaaagaggu

SEQ ID NO: 90247 - RNA, 22 nt, Human
gagggaggugacaaggacauag

SEQ ID NO: 90248 - RNA, 22 nt, Human
uauuaaaagagaaaaagccacc

SEQ ID NO: 90249 - RNA, 22 nt, Human
uucacuguucuuagagaagacc

SEQ ID NO: 90250 - RNA, 22 nt, Human
uuuguuugcugagugaauucaa

SEQ ID NO: 90251 - RNA, 22 nt, Human
gcuggaaauaacuuguguagaa

SEQ ID NO: 90252 - RNA, 22 nt, Human
uauuucuagggcaugaaaauaa

SEQ ID NO: 90253 - RNA, 22 nt, Human
guuuaaaagcaaccaacaggcu

SEQ ID NO: 90254 - RNA, 22 nt, Human
aggcagagaggucuuccuggaa

SEQ ID NO: 90255 - RNA, 22 nt, Human
ggcagaggagcuggaaacaugg

SEQ ID NO: 90256 - RNA, 22 nt, Human
cuguuaauugugaauuuuacau

SEQ ID NO: 90257 - RNA, 22 nt, Human
gaggagcugggucagggagaca

SEQ ID NO: 90258 - RNA, 23 nt, Human
aggcugcagaagaauagggucau

SEQ ID NO: 90259 - RNA, 22 nt, Human
ggcagggagagcgccgccaugc

SEQ ID NO: 90260 - RNA, 22 nt, Human
caauggagccaagaggaggaaa

SEQ ID NO: 90261 - RNA, 21 nt, Human
agaugaggauacugaggccua

SEQ ID NO: 90262 - RNA, 22 nt, Human
agucaccuacagcucaugcuuc

SEQ ID NO: 90263 - RNA, 22 nt, Human
uuaaaagaauccuguuauccuc

SEQ ID NO: 90264 - RNA, 22 nt, Human
uacauuugauuuuugcuucuuu

SEQ ID NO: 90265 - RNA, 22 nt, Human
uuuuucuuugcuuuccacuggc

SEQ ID NO: 90266 - RNA, 22 nt, Human
auggagugggaggacaugaagg

SEQ ID NO: 90267 - RNA, 22 nt, Human
cucacugucagcugcagggcuu

SEQ ID NO: 90268 - RNA, 22 nt, Human
ucugcaugccucaggaggccug

SEQ ID NO: 90269 - RNA, 22 nt, Human
cauuuugguaauguucguuugc

SEQ ID NO: 90270 - RNA, 22 nt, Human
gaagaaggaagaucaugcuuga

SEQ ID NO: 90271 - RNA, 22 nt, Human
uuauuuaagaucuuaauauaua

SEQ ID NO: 90272 - RNA, 22 nt, Human
uggagucuugcuuugggagugc

SEQ ID NO: 90273 - RNA, 22 nt, Human
uguccuuuauauguuuuuuagu

SEQ ID NO: 90274 - RNA, 20 nt, Human
aggggcuguaguuagaugac

SEQ ID NO: 90275 - RNA, 22 nt, Human
auuuuguugaaacccuuguugu

SEQ ID NO: 90276 - RNA, 22 nt, Human
uccauguauugcuaacaaauag

SEQ ID NO: 90277 - RNA, 22 nt, Human
auuuuuuuggucauaugagaua

SEQ ID NO: 90278 - RNA, 22 nt, Human
ccuccuuuccuguuuuccugag

SEQ ID NO: 90279 - RNA, 22 nt, Human
uauuguuuuaagguguauuaau

SEQ ID NO: 90280 - RNA, 22 nt, Human
gcucagcuggagagggacgggu

SEQ ID NO: 90281 - RNA, 22 nt, Human
gagggugguggcggccggcacc

SEQ ID NO: 90282 - RNA, 22 nt, Human
uaccuggauaaauguacaaccg

SEQ ID NO: 90283 - RNA, 22 nt, Human
aggggcugagaguuugaugugg

SEQ ID NO: 90284 - RNA, 22 nt, Human
uccagcugugcuccaggaggug

SEQ ID NO: 90285 - RNA, 23 nt, Human
agagggaagagcuuagaugggga

SEQ ID NO: 90286 - RNA, 23 nt, Human
cuuauauaaucauuagaaaccau

SEQ ID NO: 90287 - RNA, 22 nt, Human
ugugucuuuggcgaugucugga

SEQ ID NO: 90288 - RNA, 22 nt, Human
uuuuaaauggcuuuuacuuuuc

SEQ ID NO: 90289 - RNA, 19 nt, Human
ccaguuuuuuaauauucaa

SEQ ID NO: 90290 - RNA, 22 nt, Human
aguaggaauucaaagagacaaa

SEQ ID NO: 90291 - RNA, 22 nt, Human
cuccugcuuuuucuucuuccga

SEQ ID NO: 90292 - RNA, 22 nt, Human
uucuugucuuuguuauguagga

SEQ ID NO: 90293 - RNA, 22 nt, Human
aucguuaugauagagaaagaga

SEQ ID NO: 90294 - RNA, 22 nt, Human
ucgcccagguuggagugcagug

SEQ ID NO: 90295 - RNA, 22 nt, Human
auuuuauuuugggaucuuuuua

SEQ ID NO: 90296 - RNA, 22 nt, Human
cuaaauucuauauccuugcuuc

SEQ ID NO: 90297 - RNA, 22 nt, Human
guuuauucuuuuauuugugaga

SEQ ID NO: 90298 - RNA, 22 nt, Human
augggagggagcagugaguguu

SEQ ID NO: 90299 - RNA, 22 nt, Human
gaggccagcacccagaugcaug

SEQ ID NO: 90300 - RNA, 22 nt, Human
aucauguauauuuuugcuauua

SEQ ID NO: 90301 - RNA, 22 nt, Human
guucuucagcccucagguccua

SEQ ID NO: 90302 - RNA, 22 nt, Human
ggcuagggaucuagaccaggac

SEQ ID NO: 90303 - RNA, 22 nt, Human
guuguuuucagcccagcauuag

SEQ ID NO: 90304 - RNA, 22 nt, Human
uauuuguauugucuuaucacuu

SEQ ID NO: 90305 - RNA, 22 nt, Human
gaggggaacaggcauucuuaag

SEQ ID NO: 90306 - RNA, 22 nt, Human
gcuguugugaggaucagcauau

SEQ ID NO: 90307 - RNA, 22 nt, Human
aagcucuuuccacuaaaccacu

SEQ ID NO: 90308 - RNA, 22 nt, Human
ucugaggacagugcugugccug

SEQ ID NO: 90309 - RNA, 22 nt, Human
uaaaugauaguauugaagguag

SEQ ID NO: 90310 - RNA, 22 nt, Human
uaggauugguguauguagguuu

SEQ ID NO: 90311 - RNA, 22 nt, Human
ugagagggagacagcucuagca

SEQ ID NO: 90312 - RNA, 22 nt, Human
acauuccugaagguaaugagaa

SEQ ID NO: 90313 - RNA, 22 nt, Human
ggagccucuaaacaguuaucaa

SEQ ID NO: 90314 - RNA, 21 nt, Human
uuccuggaggcagaaacguga

SEQ ID NO: 90315 - RNA, 22 nt, Human
uauauuaaagugcuuugcagug

SEQ ID NO: 90316 - RNA, 22 nt, Human
ucuugugguggaucccucauuu

SEQ ID NO: 90317 - RNA, 22 nt, Human
caauaccucuuggugauugggc

SEQ ID NO: 90318 - RNA, 22 nt, Human
acucauuuggauuuuggaguuu

SEQ ID NO: 90319 - RNA, 22 nt, Human
augaaaacgugugugugugugu

SEQ ID NO: 90320 - RNA, 21 nt, Human
acugggcuagccugacuucug

SEQ ID NO: 90321 - RNA, 22 nt, Human
aauguugaaccuuuuuggccug

SEQ ID NO: 90322 - RNA, 22 nt, Human
uacuuacacugaagcaaagaua

SEQ ID NO: 90323 - RNA, 22 nt, Human
aucuaaaacuacgaauacuacc

SEQ ID NO: 90324 - RNA, 20 nt, Human
ucucuuuuucuucuuuucuc

SEQ ID NO: 90325 - RNA, 22 nt, Human
gugauggucgagcgcuuguugu

SEQ ID NO: 90326 - RNA, 22 nt, Human
gaggagggagcuggaagcucuu

SEQ ID NO: 90327 - RNA, 22 nt, Human
acugucuuguuguaugugagcu

SEQ ID NO: 90328 - RNA, 22 nt, Human
cuuggggauuuuaaagaccucu

SEQ ID NO: 90329 - RNA, 22 nt, Human
agagggagagauuggcaaucag

SEQ ID NO: 90330 - RNA, 22 nt, Human
uuuuuaagguuuguuuauauau

SEQ ID NO: 90331 - RNA, 22 nt, Human
ccucccuucccggcauggcucu

SEQ ID NO: 90332 - RNA, 22 nt, Human
aaagggagauaaaguaauuuua

SEQ ID NO: 90333 - RNA, 22 nt, Human
cagcuccagcccaggcagcucc

SEQ ID NO: 90334 - RNA, 22 nt, Human
cagggggacuuguuagguuuua

SEQ ID NO: 90335 - RNA, 22 nt, Human
uuauuuucgugugugugugugu

SEQ ID NO: 90336 - RNA, 22 nt, Human
gggggagcuacaggucccuugg

SEQ ID NO: 90337 - RNA, 22 nt, Human
cucagcgagggaaagaggccgc

SEQ ID NO: 90338 - RNA, 22 nt, Human
agggaggagggacagaaagagg

SEQ ID NO: 90339 - RNA, 22 nt, Human
gugcugggaggcccaggaugga

SEQ ID NO: 90340 - RNA, 22 nt, Human
uggggcuggccaggaggagucu

SEQ ID NO: 90341 - RNA, 22 nt, Human
aacccugaacuuaguucuagga

SEQ ID NO: 90342 - RNA, 22 nt, Human
uuaacauuguccuuagcagauu

SEQ ID NO: 90343 - RNA, 22 nt, Human
gcagggcucagccgcucccacc

SEQ ID NO: 90344 - RNA, 22 nt, Human
ggcucacuguaccugccgccgc

SEQ ID NO: 90345 - RNA, 22 nt, Human
agggcucacuacaacccuggga

SEQ ID NO: 90346 - RNA, 22 nt, Human
ugguugauuaauuuugccaagc

SEQ ID NO: 90347 - RNA, 22 nt, Human
gcuucucacccuuacuaucucu

SEQ ID NO: 90348 - RNA, 20 nt, Human
ccugggcuccaggagccccg

SEQ ID NO: 90349 - RNA, 22 nt, Human
gcuguggaaaaugggucuccaa

SEQ ID NO: 90350 - RNA, 22 nt, Human
aauguaaauaauuguaaaauuu

SEQ ID NO: 90351 - RNA, 22 nt, Human
gcuggggaucgaaggcagagcc

SEQ ID NO: 90352 - RNA, 22 nt, Human
uccucccugcacucagugaagu

SEQ ID NO: 90353 - RNA, 22 nt, Human
aggcaggggagcuggaagggua

SEQ ID NO: 90354 - RNA, 22 nt, Human
aucuucuuucaucagccccuca

SEQ ID NO: 90355 - RNA, 22 nt, Human
uuauuguuuggguauaauuuga

SEQ ID NO: 90356 - RNA, 20 nt, Human
ugauuauuccaacaagaaug

SEQ ID NO: 90357 - RNA, 22 nt, Human
ugagggaguguggauacaguag

SEQ ID NO: 90358 - RNA, 20 nt, Human
cauuccaugcaucuuggucc

SEQ ID NO: 90359 - RNA, 22 nt, Human
cauggcggcgcucucccugccu

SEQ ID NO: 90360 - RNA, 22 nt, Human
gucuuuguaguuuuaauuugag

SEQ ID NO: 90361 - RNA, 22 nt, Human
gaauauuuaucucagcugcaga

SEQ ID NO: 90362 - RNA, 22 nt, Human
guggaaggaauuaacagacuag

SEQ ID NO: 90363 - RNA, 22 nt, Human
uucauuuccauuuuauagauaa

SEQ ID NO: 90364 - RNA, 22 nt, Human
aauucuguugguuagaguugga

SEQ ID NO: 90365 - RNA, 22 nt, Human
cugcagagaccuaggucagguu

SEQ ID NO: 90366 - RNA, 22 nt, Human
auuuuucuuucacauuuucuua

SEQ ID NO: 90367 - RNA, 22 nt, Human
augcggcugugggggaauggga

SEQ ID NO: 90368 - RNA, 22 nt, Human
auuaauaucaauauauuauaug

SEQ ID NO: 90369 - RNA, 22 nt, Human
ugcucacugcuuguguucaguu

SEQ ID NO: 90370 - RNA, 20 nt, Human
uggguucaguuguuucuggc

SEQ ID NO: 90371 - RNA, 22 nt, Human
gugugucucaguugcuccgaag

SEQ ID NO: 90372 - RNA, 22 nt, Human
uaugggcaagagauaggugguc

SEQ ID NO: 90373 - RNA, 22 nt, Human
uggguauauauguugcuacaga

SEQ ID NO: 90374 - RNA, 22 nt, Human
auggaguguggccaggcaguaa

SEQ ID NO: 90375 - RNA, 22 nt, Human
guuuauuucuuaucaucacuau

SEQ ID NO: 90376 - RNA, 22 nt, Human
uguuuagcucugacuaugugau

SEQ ID NO: 90377 - RNA, 22 nt, Human
cuggagaacucugugcuucacu

SEQ ID NO: 90378 - RNA, 22 nt, Human
ggcugcagggaacaggaugggu

SEQ ID NO: 90379 - RNA, 22 nt, Human
uggcaaggccacaggugcaguu

SEQ ID NO: 90380 - RNA, 22 nt, Human
uguaaauucuauacacuuaaaa

SEQ ID NO: 90381 - RNA, 22 nt, Human
ggcuccaggguaccccuggaug

SEQ ID NO: 90382 - RNA, 22 nt, Human
aggggcugugucauuuguccua

SEQ ID NO: 90383 - RNA, 22 nt, Human
cguuuugaguagauagccauau

SEQ ID NO: 90384 - RNA, 22 nt, Human
uuuuaaaguaauugaagcuugu

SEQ ID NO: 90385 - RNA, 22 nt, Human
ggagugaguauguucugaugca

SEQ ID NO: 90386 - RNA, 22 nt, Human
cccagaggcugaguugggagca

SEQ ID NO: 90387 - RNA, 22 nt, Human
uuucacugaguaggagagcacu

SEQ ID NO: 90388 - RNA, 22 nt, Human
uaaaacuaugcaaccuacuacc

SEQ ID NO: 90389 - RNA, 22 nt, Human
ggcagagcugugcgcccaccca

SEQ ID NO: 90390 - RNA, 22 nt, Human
gagcagcugagcuggaaugaga

SEQ ID NO: 90391 - RNA, 22 nt, Human
uuauuuuauaaagagaagacuu

SEQ ID NO: 90392 - RNA, 22 nt, Human
auacaucuuaacgcgcucuugg

SEQ ID NO: 90393 - RNA, 22 nt, Human
gagcagcucgagaaggaagcag

SEQ ID NO: 90394 - RNA, 22 nt, Human
ggcugugaaguacguugaaggu

SEQ ID NO: 90395 - RNA, 22 nt, Human
auagaaauagacaaugcaaaga

SEQ ID NO: 90396 - RNA, 22 nt, Human
ccugccagaaaagagggaguuc

SEQ ID NO: 90397 - RNA, 22 nt, Human
ggcuguggcagcuggaaguggu

SEQ ID NO: 90398 - RNA, 22 nt, Human
gggagggucugagagcugcacc

SEQ ID NO: 90399 - RNA, 22 nt, Human
uacaaaugaucaucucuuugaa

SEQ ID NO: 90400 - RNA, 22 nt, Human
ucacuguuucaccgucugaagg

SEQ ID NO: 90401 - RNA, 22 nt, Human
agcaagggucucucauggcuug

SEQ ID NO: 90402 - RNA, 22 nt, Human
gaauuagguaauagaacuagua

SEQ ID NO: 90403 - RNA, 22 nt, Human
aagagaggaaagggugugaggu

SEQ ID NO: 90404 - RNA, 22 nt, Human
gcuuucagggucacugucaaca

SEQ ID NO: 90405 - RNA, 22 nt, Human
gaauucuaguucuguaucucug

SEQ ID NO: 90406 - RNA, 22 nt, Human
aagugaggagaccucuucuuca

SEQ ID NO: 90407 - RNA, 22 nt, Human
ccagcaggagacuagcaacaua

SEQ ID NO: 90408 - RNA, 20 nt, Human
ugcugugugucuacuguggg

SEQ ID NO: 90409 - RNA, 22 nt, Human
cuucuuuuggggaugaaaaugg

SEQ ID NO: 90410 - RNA, 22 nt, Human
acuuuuccuggguagcuccugg

SEQ ID NO: 90411 - RNA, 22 nt, Human
ucacaucugugugauugucauu

SEQ ID NO: 90412 - RNA, 22 nt, Human
augaagguggacagauuuuuuu

SEQ ID NO: 90413 - RNA, 22 nt, Human
uuagaaauguccuacuaauaug

SEQ ID NO: 90414 - RNA, 22 nt, Human
cacagcuggggaagcugaggcc

SEQ ID NO: 90415 - RNA, 22 nt, Human
uuuuaaauaaacuacacugauu

SEQ ID NO: 90416 - RNA, 22 nt, Human
cugguacuggaggaguucagag

SEQ ID NO: 90417 - RNA, 22 nt, Human
agcggccucgcugccugcucag

SEQ ID NO: 90418 - RNA, 22 nt, Human
caguagcuuuuugcagacaaga

SEQ ID NO: 90419 - RNA, 22 nt, Human
auuuccagcagcauauuugucu

SEQ ID NO: 90420 - RNA, 22 nt, Human
gugaucagaagaaccugccgaa

SEQ ID NO: 90421 - RNA, 22 nt, Human
uugcaagcccugaagggcugga

SEQ ID NO: 90422 - RNA, 22 nt, Human
uuugcaggaaauguacugaaug

SEQ ID NO: 90423 - RNA, 22 nt, Human
aggauggauagcaaggaagccg

SEQ ID NO: 90424 - RNA, 22 nt, Human
gugucccaaagauuagaaauca

SEQ ID NO: 90425 - RNA, 17 nt, Human
ucuuuuacuuucucucc

SEQ ID NO: 90426 - RNA, 22 nt, Human
guuuucuccugcuauacagugc

SEQ ID NO: 90427 - RNA, 22 nt, Human
uggucuuuccuucauuguccag

SEQ ID NO: 90428 - RNA, 22 nt, Human
uggcucagcgcggccuggucuu

SEQ ID NO: 90429 - RNA, 22 nt, Human
aaucacuucuuugucuucuuca

SEQ ID NO: 90430 - RNA, 22 nt, Human
uuauuuaaguauuuauugaagu

SEQ ID NO: 90431 - RNA, 22 nt, Human
ucucugaccuccaccccaggag

SEQ ID NO: 90432 - RNA, 22 nt, Human
gaggagcuucagaggaaucuua

SEQ ID NO: 90433 - RNA, 20 nt, Human
uuuuuuaaauagagcuguug

SEQ ID NO: 90434 - RNA, 21 nt, Human
gggagaguagcgguagggagg

SEQ ID NO: 90435 - RNA, 22 nt, Human
ccauuuggccauucaguuguuc

SEQ ID NO: 90436 - RNA, 22 nt, Human
cagcuccaucuugcuuauacca

SEQ ID NO: 90437 - RNA, 22 nt, Human
aaggcuguuugagcacuggagc

SEQ ID NO: 90438 - RNA, 22 nt, Human
uuccgcuuucaauggcuuggcu

SEQ ID NO: 90439 - RNA, 22 nt, Human
ucccuguggauuaaggagaugu

SEQ ID NO: 90440 - RNA, 22 nt, Human
uuuaacauaugaaagaauauuu

SEQ ID NO: 90441 - RNA, 22 nt, Human
uaauuccacacucccgcaagcg

SEQ ID NO: 90442 - RNA, 22 nt, Human
ggggaggguuuggaugagaguc

SEQ ID NO: 90443 - RNA, 22 nt, Human
ggcaaggaagaaagcagaaguu

SEQ ID NO: 90444 - RNA, 19 nt, Human
agagucuccacuccacuug

SEQ ID NO: 90445 - RNA, 22 nt, Human
auucuucauguugaagcuguca

SEQ ID NO: 90446 - RNA, 22 nt, Human
aaauguuucauucuauuuuuag

SEQ ID NO: 90447 - RNA, 19 nt, Human
uccuacaugagacagagag

SEQ ID NO: 90448 - RNA, 20 nt, Human
ucacuguaauugccuacauu

SEQ ID NO: 90449 - RNA, 22 nt, Human
uucuaauauuaugauuucuaag

SEQ ID NO: 90450 - RNA, 22 nt, Human
ugucuuugaccuuaagaaguuu

SEQ ID NO: 90451 - RNA, 22 nt, Human
uuguuuuaguagaaguuacaug

SEQ ID NO: 90452 - RNA, 22 nt, Human
uuaaacauuuccacuugccagu

SEQ ID NO: 90453 - RNA, 22 nt, Human
aaaucauagccaugaacauuug

SEQ ID NO: 90454 - RNA, 22 nt, Human
caauccccaggucccagaacag

SEQ ID NO: 90455 - RNA, 22 nt, Human
gaggcaggcggggcccaggugg

SEQ ID NO: 90456 - RNA, 22 nt, Human
uaaaaucaugacagauugacau

SEQ ID NO: 90457 - RNA, 22 nt, Human
aagaggcuacagcccugugucu

SEQ ID NO: 90458 - RNA, 22 nt, Human
cuccucccagcccaggcgccac

SEQ ID NO: 90459 - RNA, 22 nt, Human
aggggaggggaguaucaggauu

SEQ ID NO: 90460 - RNA, 22 nt, Human
uuucuggacuaaagggagagau

SEQ ID NO: 90461 - RNA, 22 nt, Human
ugaauucaaacuuuuuaacaag

SEQ ID NO: 90462 - RNA, 22 nt, Human
auaaaucaagggcaguauuucc

SEQ ID NO: 90463 - RNA, 22 nt, Human
ugucccaucacagaggagacua

SEQ ID NO: 90464 - RNA, 22 nt, Human
ugagggaggggaaugugugcag

SEQ ID NO: 90465 - RNA, 22 nt, Human
aaucauaacaaaagcaauuaua

SEQ ID NO: 90466 - RNA, 22 nt, Human
uuuucauuguuaguuucuccuu

SEQ ID NO: 90467 - RNA, 22 nt, Human
agcacagugccugacauauaug

SEQ ID NO: 90468 - RNA, 22 nt, Human
agucugugguccucuguaucuc

SEQ ID NO: 90469 - RNA, 22 nt, Human
uuauuugcccauguuuagcaga

SEQ ID NO: 90470 - RNA, 22 nt, Human
cuucuucaucuuuuggaggaac

SEQ ID NO: 90471 - RNA, 22 nt, Human
ugcuuggauuuccaaaugguuu

SEQ ID NO: 90472 - RNA, 22 nt, Human
uguauuuuuucccugaaauaaa

SEQ ID NO: 90473 - RNA, 22 nt, Human
gcuuucacugcaauagaugaau

SEQ ID NO: 90474 - RNA, 22 nt, Human
gggggacagugugccuggugug

SEQ ID NO: 90475 - RNA, 22 nt, Human
ccuuuuaucgcgaagaacucca

SEQ ID NO: 90476 - RNA, 22 nt, Human
auguguguaugacugaaucuau

SEQ ID NO: 90477 - RNA, 22 nt, Human
uuuuuuuuacuccggacagcuc

SEQ ID NO: 90478 - RNA, 22 nt, Human
aagugugugugcgcaugugcau

SEQ ID NO: 90479 - RNA, 20 nt, Human
cuccuccccucggccccacc

SEQ ID NO: 90480 - RNA, 18 nt, Human
aggcuggggaucacaggg

SEQ ID NO: 90481 - RNA, 19 nt, Human
agugaacuccauaucaggu

SEQ ID NO: 90482 - RNA, 22 nt, Human
uuauuuuuaggaauguagaggu

SEQ ID NO: 90483 - RNA, 22 nt, Human
cuagcacagugcuuggcacaca

SEQ ID NO: 90484 - RNA, 23 nt, Human
aaguggugacugugcuacugaga

SEQ ID NO: 90485 - RNA, 22 nt, Human
uauuucaugagugaauaucuag

SEQ ID NO: 90486 - RNA, 22 nt, Human
uuucauguuggauacuguuuca

SEQ ID NO: 90487 - RNA, 22 nt, Human
uucacuuuuucucugcuugaga

SEQ ID NO: 90488 - RNA, 22 nt, Human
agugaggggagaaugaggugga

SEQ ID NO: 90489 - RNA, 22 nt, Human
cugggggacagagagaggcggu

SEQ ID NO: 90490 - RNA, 22 nt, Human
uuuuauuuguauguugaaugua

SEQ ID NO: 90491 - RNA, 22 nt, Human
auucauucugaccucaagagaa

SEQ ID NO: 90492 - RNA, 22 nt, Human
ccaggcuccccaggaggcccuu

SEQ ID NO: 90493 - RNA, 22 nt, Human
aggcaguggagcuggaauaggc

SEQ ID NO: 90494 - RNA, 22 nt, Human
uguuggaaucuucuagucuucc

SEQ ID NO: 90495 - RNA, 22 nt, Human
uguugaagcaccucugucuuuc

SEQ ID NO: 90496 - RNA, 22 nt, Human
ccccauggaaaacccaccuagg

SEQ ID NO: 90497 - RNA, 22 nt, Human
uccuuuauuuaugggcagugua

SEQ ID NO: 90498 - RNA, 22 nt, Human
ggacggggagcuggaaagggga

SEQ ID NO: 90499 - RNA, 22 nt, Human
uuuuuaaaauuaggacggcacg

SEQ ID NO: 90500 - RNA, 20 nt, Human
uucucugcagcaggcggccc

SEQ ID NO: 90501 - RNA, 22 nt, Human
aguuauuuuucacuauuaggcu

SEQ ID NO: 90502 - RNA, 22 nt, Human
auauuuuacagcucucguugaa

SEQ ID NO: 90503 - RNA, 22 nt, Human
auccugugggguauugcugcau

SEQ ID NO: 90504 - RNA, 20 nt, Human
uuggagaucacguguccagg

SEQ ID NO: 90505 - RNA, 22 nt, Human
agucacuguucugucaugucaa

SEQ ID NO: 90506 - RNA, 22 nt, Human
aucacuagaguuacauugccag

SEQ ID NO: 90507 - RNA, 22 nt, Human
gcagagcugucuaagucacuuc

SEQ ID NO: 90508 - RNA, 22 nt, Human
cuuucuuucaaguucugcuuua

SEQ ID NO: 90509 - RNA, 22 nt, Human
ucgagcucagcagggaggugcg

SEQ ID NO: 90510 - RNA, 22 nt, Human
auuuucuugucucuguuguagg

SEQ ID NO: 90511 - RNA, 22 nt, Human
aggccccacaaacucgccuuug

SEQ ID NO: 90512 - RNA, 22 nt, Human
aguuuccacuggagacacugug

SEQ ID NO: 90513 - RNA, 22 nt, Human
uacuuuaauugcaaaaauaaau

SEQ ID NO: 90514 - RNA, 22 nt, Human
uuuuccuucuuccugccuugcc

SEQ ID NO: 90515 - RNA, 22 nt, Human
aauuauguugaaauaugagaac

SEQ ID NO: 90516 - RNA, 22 nt, Human
uuuuaaaacaugucaaaaugug

SEQ ID NO: 90517 - RNA, 22 nt, Human
uucauaugaauuggguuuuuuu

SEQ ID NO: 90518 - RNA, 22 nt, Human
uuucuaaaaccagaguuuauaa

SEQ ID NO: 90519 - RNA, 22 nt, Human
uucuuuucuucccuguuuauua

SEQ ID NO: 90520 - RNA, 22 nt, Human
guuuccaggcuuugguaugguu

SEQ ID NO: 90521 - RNA, 22 nt, Human
cggggcuggcguuagggaggca

SEQ ID NO: 90522 - RNA, 17 nt, Human
uuagagcuacauguuga

SEQ ID NO: 90523 - RNA, 22 nt, Human
uucccugugcaguauguuccaa

SEQ ID NO: 90524 - RNA, 22 nt, Human
gcagguggaagcagcagacuca

SEQ ID NO: 90525 - RNA, 22 nt, Human
augaggaacagcaagaauauuu

SEQ ID NO: 90526 - RNA, 22 nt, Human
ggggcucauuugcaggggggag

SEQ ID NO: 90527 - RNA, 22 nt, Human
cacugguugccucuuucuguuc

SEQ ID NO: 90528 - RNA, 20 nt, Human
gacaugagggagcaaagagc

SEQ ID NO: 90529 - RNA, 22 nt, Human
uuucuugugauuuugaugaacu

SEQ ID NO: 90530 - RNA, 22 nt, Human
uuuuucuccucucucuuucauu

SEQ ID NO: 90531 - RNA, 22 nt, Human
auguacugacuguacuuuuaaa

SEQ ID NO: 90532 - RNA, 22 nt, Human
aggggaggcugcgggcugccgu

SEQ ID NO: 90533 - RNA, 22 nt, Human
gagaaaaauuucuuugcugcac

SEQ ID NO: 90534 - RNA, 22 nt, Human
ugcccacuucaaaaucuucauu

SEQ ID NO: 90535 - RNA, 22 nt, Human
auauauguauauaugugugugu

SEQ ID NO: 90536 - RNA, 22 nt, Human
augugugugcgagcgugugugu

SEQ ID NO: 90537 - RNA, 22 nt, Human
aaaacauuuaggguuuuuuuua

SEQ ID NO: 90538 - RNA, 22 nt, Human
uguguuguuuggggauguccau

SEQ ID NO: 90539 - RNA, 22 nt, Human
uaguggaaccuucuaaaugacg

SEQ ID NO: 90540 - RNA, 22 nt, Human
uacagaccaguaguucucagcg

SEQ ID NO: 90541 - RNA, 22 nt, Human
uauuuaaagucagcaacuuuuc

SEQ ID NO: 90542 - RNA, 22 nt, Human
aaugaaaaucugucaguucaag

SEQ ID NO: 90543 - RNA, 22 nt, Human
uuuucucaguuuuuuucaaaag

SEQ ID NO: 90544 - RNA, 22 nt, Human
acuguugagggaagcagaugaa

SEQ ID NO: 90545 - RNA, 22 nt, Human
gcuuauuagguuauuucaagga

SEQ ID NO: 90546 - RNA, 22 nt, Human
agcaaggguugguuuucugaca

SEQ ID NO: 90547 - RNA, 22 nt, Human
uugccaggggacaucuggagcc

SEQ ID NO: 90548 - RNA, 22 nt, Human
ucccaaguguuuggcgaggaga

SEQ ID NO: 90549 - RNA, 22 nt, Human
ggaggaugaggguggugguguu

SEQ ID NO: 90550 - RNA, 22 nt, Human
ggcugugguggacgcgggaaac

SEQ ID NO: 90551 - RNA, 22 nt, Human
ucccugcugggcgaucuucucu

SEQ ID NO: 90552 - RNA, 22 nt, Human
uuuuacaaugcaaauucuugcu

SEQ ID NO: 90553 - RNA, 22 nt, Human
cagguggauggcgagcccugca

SEQ ID NO: 90554 - RNA, 22 nt, Human
gcauaauauugagaaauuauua

SEQ ID NO: 90555 - RNA, 22 nt, Human
gcccagccucagggcaucagcu

SEQ ID NO: 90556 - RNA, 20 nt, Human
uucacagaggacucagguca

SEQ ID NO: 90557 - RNA, 22 nt, Human
agauggggccugaggacacugu

SEQ ID NO: 90558 - RNA, 22 nt, Human
guuuuaucuauguaauuauaaa

SEQ ID NO: 90559 - RNA, 18 nt, Human
auucauuugcguuuggcu

SEQ ID NO: 90560 - RNA, 22 nt, Human
uggggggacagauggagaggac

SEQ ID NO: 90561 - RNA, 22 nt, Human
uuuacaaggcaguuauuuuccu

SEQ ID NO: 90562 - RNA, 22 nt, Human
agggcaggguuggugcuggugc

SEQ ID NO: 90563 - RNA, 22 nt, Human
ucagcucucucuuggugaucuc

SEQ ID NO: 90564 - RNA, 22 nt, Human
agauuuucuuuuccaucuuugu

SEQ ID NO: 90565 - RNA, 22 nt, Human
ugggggagggagaguugauggg

SEQ ID NO: 90566 - RNA, 22 nt, Human
auuuuuauuugccuaugauaua

SEQ ID NO: 90567 - RNA, 22 nt, Human
aaauauuugaaugguguaagau

SEQ ID NO: 90568 - RNA, 22 nt, Human
ggcuggagcaggcugcacagug

SEQ ID NO: 90569 - RNA, 22 nt, Human
uuuuuuccuguuugucuuuggg

SEQ ID NO: 90570 - RNA, 22 nt, Human
uguugaaacagcuauugacuuu

SEQ ID NO: 90571 - RNA, 22 nt, Human
guuauuuugucuuguucaugaa

SEQ ID NO: 90572 - RNA, 22 nt, Human
uaauaaaaauuuaauucacauu

SEQ ID NO: 90573 - RNA, 22 nt, Human
uggacacugguggauauggaau

SEQ ID NO: 90574 - RNA, 22 nt, Human
ugugaagaauuaaugugaauca

SEQ ID NO: 90575 - RNA, 18 nt, Human
cccagaggaaugccugga

SEQ ID NO: 90576 - RNA, 22 nt, Human
uucacugugauguuuaagagaa

SEQ ID NO: 90577 - RNA, 22 nt, Human
cagagagcguccauccggugcc

SEQ ID NO: 90578 - RNA, 22 nt, Human
ugggcagggagcuggaaccaca

SEQ ID NO: 90579 - RNA, 22 nt, Human
guuuucuuguuaauuuugaacg

SEQ ID NO: 90580 - RNA, 22 nt, Human
aggguggaggacaggccaguga

SEQ ID NO: 90581 - RNA, 21 nt, Human
ugagcccaaagcuguauuggu

SEQ ID NO: 90582 - RNA, 22 nt, Human
uuuuguuuacauuaaauuuuga

SEQ ID NO: 90583 - RNA, 21 nt, Human
uccccugugccuggcauacag

SEQ ID NO: 90584 - RNA, 22 nt, Human
uagcugucauuggaucagaagg

SEQ ID NO: 90585 - RNA, 22 nt, Human
gaggggacugucuggcuccgag

SEQ ID NO: 90586 - RNA, 23 nt, Human
uucuuuccuuaucccauuuacuu

SEQ ID NO: 90587 - RNA, 17 nt, Human
auucaugaacauguccu

SEQ ID NO: 90588 - RNA, 22 nt, Human
uggagccugauggauaggaacg

SEQ ID NO: 90589 - RNA, 22 nt, Human
cauuucaaacaguuacagcugc

SEQ ID NO: 90590 - RNA, 22 nt, Human
ggugucuuugauguugggcuga

SEQ ID NO: 90591 - RNA, 22 nt, Human
uucauggauuugugaaauuuag

SEQ ID NO: 90592 - RNA, 22 nt, Human
agccccaauuacagcugugcug

SEQ ID NO: 90593 - RNA, 22 nt, Human
ucugagugacguccugacagga

SEQ ID NO: 90594 - RNA, 22 nt, Human
uuuaaaauguuuuauuuauuua

SEQ ID NO: 90595 - RNA, 22 nt, Human
aaugauuuucugcaaacaguga

SEQ ID NO: 90596 - RNA, 22 nt, Human
uucacccuucucuggcuuucag

SEQ ID NO: 90597 - RNA, 20 nt, Human
uucacagaucucuaacugag

SEQ ID NO: 90598 - RNA, 22 nt, Human
cacugcaaccuccaccucccgg

SEQ ID NO: 90599 - RNA, 22 nt, Human
caaaucuguuaauuucaaguug

SEQ ID NO: 90600 - RNA, 22 nt, Human
ugggggaggaggagacagacug

SEQ ID NO: 90601 - RNA, 22 nt, Human
ccagggaggucauagugcuggu

SEQ ID NO: 90602 - RNA, 22 nt, Human
auuuaaaaacugguacaacagg

SEQ ID NO: 90603 - RNA, 22 nt, Human
gcuguguaugaugcaggcaccu

SEQ ID NO: 90604 - RNA, 22 nt, Human
uauuuuuaccuaauuuaugaga

SEQ ID NO: 90605 - RNA, 22 nt, Human
uucucugcgcuccggcccaguu

SEQ ID NO: 90606 - RNA, 22 nt, Human
ccuaggcuggcugucuucaggu

SEQ ID NO: 90607 - RNA, 23 nt, Human
uccuccccaccuuuguccccucc

SEQ ID NO: 90608 - RNA, 22 nt, Human
gugguuuagccuucauuaaccu

SEQ ID NO: 90609 - RNA, 22 nt, Human
aaaugcuuuaauugaguucaug

SEQ ID NO: 90610 - RNA, 17 nt, Human
ccacuagauagguugug

SEQ ID NO: 90611 - RNA, 22 nt, Human
gcucagccuuuuguucuauuca

SEQ ID NO: 90612 - RNA, 22 nt, Human
ugaaauuuuuuggagauaauuu

SEQ ID NO: 90613 - RNA, 22 nt, Human
cagaccuggaaaacaggcuugc

SEQ ID NO: 90614 - RNA, 22 nt, Human
ucuuuuucccugguuccuuuuu

SEQ ID NO: 90615 - RNA, 22 nt, Human
aggaaauaggaccagacaaagc

SEQ ID NO: 90616 - RNA, 22 nt, Human
cagggcagaguuaagaugcugg

SEQ ID NO: 90617 - RNA, 22 nt, Human
auuugcuuguucaccaguacuu

SEQ ID NO: 90618 - RNA, 22 nt, Human
ccaaggcuguggggcugugcag

SEQ ID NO: 90619 - RNA, 22 nt, Human
uacaagcucuuguagggggaaa

SEQ ID NO: 90620 - RNA, 22 nt, Human
gaaacauuuguugaguacuugc

SEQ ID NO: 90621 - RNA, 22 nt, Human
agaucugucaccauccuggagc

SEQ ID NO: 90622 - RNA, 22 nt, Human
cuucuuucuuuucuucuucucu

SEQ ID NO: 90623 - RNA, 22 nt, Escherichia coli CFT073
ucucaauauggaauuucgcucg

SEQ ID NO: 90624 - RNA, 22 nt, Escherichia coli CFT073
ucaaccagaacauaucgccgcc

SEQ ID NO: 90625 - RNA, 22 nt, Escherichia coli CFT073
ugcgugccauccaccagucguu

SEQ ID NO: 90626 - RNA, 20 nt, Escherichia coli CFT073
uuacagaggauaaucaaggu

SEQ ID NO: 90627 - RNA, 22 nt, Escherichia coli CFT073
ggcgugagguuuuugacguuga

SEQ ID NO: 90628 - RNA, 22 nt, Escherichia coli CFT073
ugugcgcuguuggucagcagca

SEQ ID NO: 90629 - RNA, 22 nt, Escherichia coli CFT073
uuguuccagacaacaaucuguu

SEQ ID NO: 90630 - RNA, 22 nt, Escherichia coli CFT073
auucagcaugguucguucauug

SEQ ID NO: 90631 - RNA, 22 nt, Escherichia coli CFT073
uaaggcgaggcguuuucaucca

SEQ ID NO: 90632 - RNA, 22 nt, Escherichia coli CFT073
uugacgcgucuuauccggccua

SEQ ID NO: 90633 - RNA, 22 nt, Escherichia coli CFT073
gccggugaaacgcgcgaaauuu

SEQ ID NO: 90634 - RNA, 22 nt, Escherichia coli CFT073
aggcacauaacagcuaaguauu

SEQ ID NO: 90635 - RNA, 22 nt, Escherichia coli CFT073
uaugaugaugauggugggcaaa

SEQ ID NO: 90636 - RNA, 22 nt, Escherichia coli CFT073
agcaguuucguggcggcaccga

SEQ ID NO: 90637 - RNA, 22 nt, Escherichia coli CFT073
guuggcuuuugcuucaaucacg

SEQ ID NO: 90638 - RNA, 20 nt, Escherichia coli CFT073
uacggugcuccucaugcagu

SEQ ID NO: 90639 - RNA, 20 nt, Escherichia coli CFT073
ugccaguuacugacccacgg

SEQ ID NO: 90640 - RNA, 22 nt, Escherichia coli CFT073
gccgugaaguagaagauauuuu

SEQ ID NO: 90641 - RNA, 22 nt, Escherichia coli CFT073
gaugauccgcagguuuuugccg

SEQ ID NO: 90642 - RNA, 22 nt, Escherichia coli CFT073
ucugcguauuuaucuuuugcaa

SEQ ID NO: 90643 - RNA, 22 nt, Escherichia coli CFT073
aauucguuuauuuucgaacgua

SEQ ID NO: 90644 - RNA, 22 nt, Escherichia coli CFT073
uuggugauaaagaaauauuugg

SEQ ID NO: 90645 - RNA, 22 nt, Escherichia coli CFT073
ugguuuauuuugauaccguuga

SEQ ID NO: 90646 - RNA, 22 nt, Escherichia coli CFT073
ucugccagucggggggaggcug

SEQ ID NO: 90647 - RNA, 22 nt, Escherichia coli CFT073
uuucacagucuggucaggauau

SEQ ID NO: 90648 - RNA, 22 nt, Escherichia coli CFT073
ucgaaaauggauugccacugcg

SEQ ID NO: 90649 - RNA, 22 nt, Escherichia coli CFT073
aacguuauucggccguucacac

SEQ ID NO: 90650 - RNA, 22 nt, Escherichia coli CFT073
uauguuaucugcacuaccauug

SEQ ID NO: 90651 - RNA, 22 nt, Escherichia coli CFT073
ucguuggaucagauccgccagg

SEQ ID NO: 90652 - RNA, 22 nt, Escherichia coli CFT073
cuuaauaugggaucgucucaug

SEQ ID NO: 90653 - RNA, 22 nt, Escherichia coli CFT073
cauuacaugcgcagaguggcgg

SEQ ID NO: 90654 - RNA, 22 nt, Escherichia coli CFT073
ccaggaauugcaggguaaaauu

SEQ ID NO: 90655 - RNA, 22 nt, Escherichia coli CFT073
uugcuaucaaagaagcaaacaa

SEQ ID NO: 90656 - RNA, 22 nt, Escherichia coli CFT073
uuaacgguaaccugauccccac

SEQ ID NO: 90657 - RNA, 23 nt, Escherichia coli CFT073
agaugaucgaugccuuuuacgcc

SEQ ID NO: 90658 - RNA, 22 nt, Escherichia coli CFT073
cgcucucuaccgauuuccguaa

SEQ ID NO: 90659 - RNA, 22 nt, Escherichia coli CFT073
ugauaugaccuuuauauacuca

SEQ ID NO: 90660 - RNA, 22 nt, Escherichia coli CFT073
uaugguaauacugcgaugauua

SEQ ID NO: 90661 - RNA, 17 nt, Escherichia coli CFT073
aggaauagguaaaaaua

SEQ ID NO: 90662 - RNA, 22 nt, Escherichia coli CFT073
aucggagauuaguaauaugcga

SEQ ID NO: 90663 - RNA, 22 nt, Escherichia coli CFT073
auggcguugguuaacaaccugg

SEQ ID NO: 90664 - RNA, 22 nt, Escherichia coli CFT073
uacaauaucgcuguguguaggc

SEQ ID NO: 90665 - RNA, 17 nt, Escherichia coli CFT073
cgccagcucgcuggcga

SEQ ID NO: 90666 - RNA, 22 nt, Escherichia coli CFT073
gcgcccugaauucugguaaaaa

SEQ ID NO: 90667 - RNA, 22 nt, Escherichia coli CFT073
gcggcgauauguucugguugau

SEQ ID NO: 90668 - RNA, 22 nt, Escherichia coli CFT073
ugcaauauaaucuuuagcuucu

SEQ ID NO: 90669 - RNA, 22 nt, Escherichia coli CFT073
uccgugaugguucgaugauugg

SEQ ID NO: 90670 - RNA, 22 nt, Escherichia coli CFT073
gguuaugucuacgaugugauug

SEQ ID NO: 90671 - RNA, 22 nt, Escherichia coli CFT073
uucucggccucggugcgcagcc

SEQ ID NO: 90672 - RNA, 22 nt, Escherichia coli CFT073
agcaguuuuucaucccugaaua

SEQ ID NO: 90673 - RNA, 22 nt, Escherichia coli CFT073
auguaaaaacgcaaauccggcu

SEQ ID NO: 90674 - RNA, 22 nt, Escherichia coli CFT073
gcagaaauaaccggugacuuua

SEQ ID NO: 90675 - RNA, 22 nt, Escherichia coli CFT073
uacgccuuguugcgccaguuuc

SEQ ID NO: 90676 - RNA, 22 nt, Escherichia coli CFT073
cgcugguuucugcgccauuucc

SEQ ID NO: 90677 - RNA, 22 nt, Escherichia coli CFT073
gaagcguuggucagugguuguu

SEQ ID NO: 90678 - RNA, 22 nt, Escherichia coli CFT073
uucuucugguuauuaugccugc

SEQ ID NO: 90679 - RNA, 22 nt, Escherichia coli CFT073
gaucggcggagcagggugaaca

SEQ ID NO: 90680 - RNA, 22 nt, Escherichia coli CFT073
gucugaccaugguugaugagag

SEQ ID NO: 90681 - RNA, 22 nt, Escherichia coli CFT073
acgggccauuuguacgguuaau

SEQ ID NO: 90682 - RNA, 22 nt, Escherichia coli CFT073
gauguguucaugacuggucgca

SEQ ID NO: 90683 - RNA, 22 nt, Escherichia coli CFT073
ugcuaucuggugagagugucgg

SEQ ID NO: 90684 - RNA, 18 nt, Escherichia coli CFT073
cgguauuacgccagugcc

SEQ ID NO: 90685 - RNA, 22 nt, Escherichia coli CFT073
gaacaauuucucugcacuggcu

SEQ ID NO: 90686 - RNA, 22 nt, Escherichia coli CFT073
aaaucagcgguaucguuuccuu

SEQ ID NO: 90687 - RNA, 21 nt, Escherichia coli CFT073
ugcgacgccaugcacuuugcc

SEQ ID NO: 90688 - RNA, 22 nt, Escherichia coli CFT073
uaaggcggucguugcugcgguu

SEQ ID NO: 90689 - RNA, 22 nt, Escherichia coli CFT073
gcggaucucgguauugccuucg

SEQ ID NO: 90690 - RNA, 22 nt, Escherichia coli CFT073
uuuacuguuaaucugucaggga

SEQ ID NO: 90691 - RNA, 22 nt, Escherichia coli CFT073
uacuucuucaccccguucggaa

SEQ ID NO: 90692 - RNA, 22 nt, Escherichia coli CFT073
auggcgcugguuuccgccugua

SEQ ID NO: 90693 - RNA, 20 nt, Escherichia coli CFT073
cagcuccaccugcagcccgu

SEQ ID NO: 90694 - RNA, 22 nt, Escherichia coli CFT073
gccguggugggaucgccaguug

SEQ ID NO: 90695 - RNA, 22 nt, Escherichia coli CFT073
ucguuguuauccggaguuggag

SEQ ID NO: 90696 - RNA, 22 nt, Escherichia coli CFT073
ccgccgcuccguuaucgggugg

SEQ ID NO: 90697 - RNA, 22 nt, Escherichia coli CFT073
agcgggugucccaggucaggcu

SEQ ID NO: 90698 - RNA, 22 nt, Escherichia coli CFT073
uaaggcguuuacgccgcauccg

SEQ ID NO: 90699 - RNA, 22 nt, Escherichia coli CFT073
aagaccgccggucuuguccauu

SEQ ID NO: 90700 - RNA, 22 nt, Escherichia coli CFT073
uucucucugccugccgaggcca

SEQ ID NO: 90701 - RNA, 19 nt, Escherichia coli CFT073
cuguuuauucuguuugccc

SEQ ID NO: 90702 - RNA, 22 nt, Escherichia coli CFT073
uaagcguuuucucgcgggggau

SEQ ID NO: 90703 - RNA, 22 nt, Escherichia coli CFT073
gauggcggagguucuguucguc

SEQ ID NO: 90704 - RNA, 22 nt, Escherichia coli CFT073
cggcugauuguguaaugcacag

SEQ ID NO: 90705 - RNA, 22 nt, Escherichia coli CFT073
cgcggcuaaugagaggcuuuac

SEQ ID NO: 90706 - RNA, 22 nt, Escherichia coli CFT073
gauauacauggcucggcuaacu

SEQ ID NO: 90707 - RNA, 22 nt, Escherichia coli CFT073
aaagaaauggcgcaaauuaguu

SEQ ID NO: 90708 - RNA, 22 nt, Escherichia coli CFT073
agcgggggaucaugaugucgcg

SEQ ID NO: 90709 - RNA, 22 nt, Escherichia coli CFT073
aucugucaguacuucuggugcu

SEQ ID NO: 90710 - RNA, 22 nt, Escherichia coli CFT073
cggcuacgaaaguacagcguuu

SEQ ID NO: 90711 - RNA, 22 nt, Escherichia coli CFT073
ucgauucaccgauaugcaucag

SEQ ID NO: 90712 - RNA, 22 nt, Escherichia coli CFT073
gucuggauaugccggaaguuuc

SEQ ID NO: 90713 - RNA, 22 nt, Escherichia coli CFT073
uuguucaguucauucggguuca

SEQ ID NO: 90714 - RNA, 22 nt, Escherichia coli CFT073
cgcauggucaucggcucauuau

SEQ ID NO: 90715 - RNA, 22 nt, Escherichia coli CFT073
uucugaauucauccacuuugcc

SEQ ID NO: 90716 - RNA, 22 nt, Escherichia coli CFT073
acugcgaaucagggauuaucuu

SEQ ID NO: 90717 - RNA, 22 nt, Escherichia coli CFT073
aggauaaaacagauucggcagu

SEQ ID NO: 90718 - RNA, 22 nt, Escherichia coli CFT073
cguguugccugccgcgucggua

SEQ ID NO: 90719 - RNA, 22 nt, Escherichia coli CFT073
accaccuguguauugagccgcc

SEQ ID NO: 90720 - RNA, 22 nt, Escherichia coli CFT073
ugcugccgaugcucauucaucg

SEQ ID NO: 90721 - RNA, 23 nt, Escherichia coli CFT073
agguggugguggucagugccgac

SEQ ID NO: 90722 - RNA, 22 nt, Escherichia coli CFT073
uggccuuggaacgauguauccu

SEQ ID NO: 90723 - RNA, 22 nt, Escherichia coli CFT073
agucgcgaccaaaaucuuucuc

SEQ ID NO: 90724 - RNA, 22 nt, Escherichia coli CFT073
uuuuauauuagccaggaacuuu

SEQ ID NO: 90725 - RNA, 22 nt, Escherichia coli CFT073
ccaguacguugaauacaucacc

SEQ ID NO: 90726 - RNA, 22 nt, Escherichia coli CFT073
uuacccgcauuucaaugaagga

SEQ ID NO: 90727 - RNA, 19 nt, Escherichia coli CFT073
ugauggcgcuuauaaaccg

SEQ ID NO: 90728 - RNA, 22 nt, Escherichia coli CFT073
ggccgggcguuaucugauugaa

SEQ ID NO: 90729 - RNA, 18 nt, Escherichia coli CFT073
ggaugcuuaacguaaugc

SEQ ID NO: 90730 - RNA, 22 nt, Escherichia coli CFT073
uaaggcgcuuuguugcgcaaca

SEQ ID NO: 90731 - RNA, 22 nt, Escherichia coli CFT073
ucucgcugcugauugcuaacgu

SEQ ID NO: 90732 - RNA, 22 nt, Escherichia coli CFT073
gaaggagaucauccaauaacgg

SEQ ID NO: 90733 - RNA, 22 nt, Escherichia coli CFT073
uugcgguugguaauaaaagucu

SEQ ID NO: 90734 - RNA, 22 nt, Escherichia coli CFT073
acagagauguuuaauccuggcg

SEQ ID NO: 90735 - RNA, 22 nt, Escherichia coli CFT073
uauuaauggguugcguuguuga

SEQ ID NO: 90736 - RNA, 22 nt, Escherichia coli CFT073
auugcaggaacguuaccaccgu

SEQ ID NO: 90737 - RNA, 22 nt, Escherichia coli CFT073
uacgccgggccugcucggccca

SEQ ID NO: 90738 - RNA, 22 nt, Escherichia coli CFT073
agcaccggacuggagcuggggg

SEQ ID NO: 90739 - RNA, 22 nt, Escherichia coli CFT073
gucgcugggauuugucgucacc

SEQ ID NO: 90740 - RNA, 22 nt, Escherichia coli CFT073
agauugcauacagccauugaau

SEQ ID NO: 90741 - RNA, 22 nt, Escherichia coli CFT073
auccagacgauaauaccggcga

SEQ ID NO: 90742 - RNA, 22 nt, Escherichia coli CFT073
uguugccacugcacauggugaa

SEQ ID NO: 90743 - RNA, 22 nt, Escherichia coli CFT073
uaucaauuuaucgaccugcagc

SEQ ID NO: 90744 - RNA, 22 nt, Escherichia coli CFT073
ggcaacgaccagaauucucgca

SEQ ID NO: 90745 - RNA, 22 nt, Escherichia coli CFT073
cgugauggauaguaaagcgucg

SEQ ID NO: 90746 - RNA, 22 nt, Escherichia coli CFT073
gcuggcauuaaccaccuggccu

SEQ ID NO: 90747 - RNA, 22 nt, Escherichia coli CFT073
gaaauggcaacgauagaggcga

SEQ ID NO: 90748 - RNA, 22 nt, Escherichia coli CFT073
ucgccgggcgauguuuucccgg

SEQ ID NO: 90749 - RNA, 22 nt, Escherichia coli CFT073
gacgaucaugaugucggcaucu

SEQ ID NO: 90750 - RNA, 18 nt, Escherichia coli CFT073
aagggcagggcaaguacc

SEQ ID NO: 90751 - RNA, 22 nt, Escherichia coli CFT073
ggcgauuauagccauauguugg

SEQ ID NO: 90752 - RNA, 22 nt, Escherichia coli CFT073
aucagcaccgaaaaacuccccu

SEQ ID NO: 90753 - RNA, 22 nt, Escherichia coli CFT073
cugcgcgucuguagcccguuug

SEQ ID NO: 90754 - RNA, 22 nt, Escherichia coli CFT073
ucaguuuuucuccugaucauga

SEQ ID NO: 90755 - RNA, 22 nt, Escherichia coli CFT073
agcggcggaucacaaaauugcg

SEQ ID NO: 90756 - RNA, 22 nt, Escherichia coli CFT073
uaggccggauaaggcguuuaug

SEQ ID NO: 90757 - RNA, 22 nt, Escherichia coli CFT073
cgaccgauuucguaacgcggcu

SEQ ID NO: 90758 - RNA, 22 nt, Escherichia coli CFT073
accaaugugauuauagccaucg

SEQ ID NO: 90759 - RNA, 22 nt, Escherichia coli CFT073
aguugcgaugucgaaaucauuc

SEQ ID NO: 90760 - RNA, 22 nt, Escherichia coli CFT073
accaaccguuguaugcuggcua

SEQ ID NO: 90761 - RNA, 22 nt, Escherichia coli CFT073
aaggcauuuuuacggaugcaga

SEQ ID NO: 90762 - RNA, 22 nt, Escherichia coli CFT073
gcaacguuugucauaguggcga

SEQ ID NO: 90763 - RNA, 22 nt, Escherichia coli CFT073
auggugugcugcucccgcugau

SEQ ID NO: 90764 - RNA, 22 nt, Escherichia coli CFT073
acgaaacuggacggcacggcga

SEQ ID NO: 90765 - RNA, 22 nt, Escherichia coli CFT073
aucgcucugcaacuggaguuaa

SEQ ID NO: 90766 - RNA, 22 nt, Escherichia coli CFT073
cuggcguugaaggggggaugac

SEQ ID NO: 90767 - RNA, 22 nt, Escherichia coli CFT073
gcaggauaacgaccagcgaggc

SEQ ID NO: 90768 - RNA, 22 nt, Escherichia coli CFT073
aagcagccagaacagggagaca

SEQ ID NO: 90769 - RNA, 22 nt, Escherichia coli CFT073
gaauuuuuuccgcaaucuucgc

SEQ ID NO: 90770 - RNA, 22 nt, Escherichia coli CFT073
cguagccgugagcguuuugaca

SEQ ID NO: 90771 - RNA, 22 nt, Escherichia coli CFT073
uuggcaaagggaaauuuaugaa

SEQ ID NO: 90772 - RNA, 22 nt, Escherichia coli CFT073
ccagcuauugcugacgcugcug

SEQ ID NO: 90773 - RNA, 22 nt, Escherichia coli CFT073
uagccgcaccacgucguuguua

SEQ ID NO: 90774 - RNA, 20 nt, Escherichia coli CFT073
uaagguuuuuguguggacug

SEQ ID NO: 90775 - RNA, 22 nt, Escherichia coli CFT073
auaauucauauacuuguugucu

SEQ ID NO: 90776 - RNA, 20 nt, Escherichia coli CFT073
auuauuccugccuguacugu

SEQ ID NO: 90777 - RNA, 22 nt, Escherichia coli CFT073
uucaucuguacugguaaugucu

SEQ ID NO: 90778 - RNA, 22 nt, Escherichia coli CFT073
uugugcgucgcgaacugcgggu

SEQ ID NO: 90779 - RNA, 22 nt, Escherichia coli CFT073
acucgccagcagcacaaggccg

SEQ ID NO: 90780 - RNA, 22 nt, Escherichia coli CFT073
cguuuggucuaugaugcaguug

SEQ ID NO: 90781 - RNA, 22 nt, Escherichia coli CFT073
uggauagccaggcaggguugua

SEQ ID NO: 90782 - RNA, 22 nt, Escherichia coli CFT073
agauucagcacgguugccuuug

SEQ ID NO: 90783 - RNA, 22 nt, Escherichia coli CFT073
aucaucugguugauggaacguu

SEQ ID NO: 90784 - RNA, 22 nt, Escherichia coli CFT073
ucagcaacagcgguacccugcu

SEQ ID NO: 90785 - RNA, 22 nt, Escherichia coli CFT073
ccaggcguuacuggauaaaauu

SEQ ID NO: 90786 - RNA, 18 nt, Escherichia coli CFT073
uuguaaguccccacuuug

SEQ ID NO: 90787 - RNA, 22 nt, Escherichia coli CFT073
cuucgcgcuccagcugacggca

SEQ ID NO: 90788 - RNA, 22 nt, Escherichia coli CFT073
gcgcggaauuaaggucgcuggc

SEQ ID NO: 90789 - RNA, 22 nt, Escherichia coli CFT073
ggaaguugaugaucauaugcuc

SEQ ID NO: 90790 - RNA, 22 nt, Escherichia coli CFT073
auggcuuccugaaacaguuugg

SEQ ID NO: 90791 - RNA, 22 nt, Escherichia coli CFT073
uucaucgaugguuugcgucgug

SEQ ID NO: 90792 - RNA, 22 nt, Escherichia coli CFT073
aagaaaagguuuuagccuggua

SEQ ID NO: 90793 - RNA, 22 nt, Escherichia coli CFT073
ugacuggcucuuuuucggggcu

SEQ ID NO: 90794 - RNA, 22 nt, Escherichia coli CFT073
aucacguaggccugauaagcgu

SEQ ID NO: 90795 - RNA, 23 nt, Escherichia coli CFT073
uguggcuuuucuugccgauuaug

SEQ ID NO: 90796 - RNA, 19 nt, Escherichia coli CFT073
ugcguugccaaacauggug

SEQ ID NO: 90797 - RNA, 22 nt, Escherichia coli CFT073
cuuacgccguauuuuguuauug

SEQ ID NO: 90798 - RNA, 22 nt, Escherichia coli CFT073
uuuuugacuuacucguaagccg

SEQ ID NO: 90799 - RNA, 22 nt, Escherichia coli CFT073
uuugcaggccugauaagcguag

SEQ ID NO: 90800 - RNA, 22 nt, Escherichia coli CFT073
ggguuuauugccccgauccugc

SEQ ID NO: 90801 - RNA, 22 nt, Escherichia coli CFT073
ucugcggguauucaggcguucg

SEQ ID NO: 90802 - RNA, 22 nt, Escherichia coli CFT073
ugacgcuguacaugccguacgu

SEQ ID NO: 90803 - RNA, 22 nt, Escherichia coli CFT073
ucgcacagcgucagcuucugcu

SEQ ID NO: 90804 - RNA, 22 nt, Escherichia coli CFT073
uuuuacgauauauccacagcca

SEQ ID NO: 90805 - RNA, 22 nt, Escherichia coli CFT073
cacugaagcugaguaauaacgg

SEQ ID NO: 90806 - RNA, 22 nt, Escherichia coli CFT073
uaucgcuggcucccgcgccaau

SEQ ID NO: 90807 - RNA, 22 nt, Escherichia coli CFT073
ucaccugaucgucgccguacug

SEQ ID NO: 90808 - RNA, 22 nt, Escherichia coli CFT073
gugcugcugaauccguuuuauc

SEQ ID NO: 90809 - RNA, 22 nt, Escherichia coli CFT073
uucguugaaauuauuggucaaa

SEQ ID NO: 90810 - RNA, 22 nt, Escherichia coli CFT073
uucgcuauuaucggcguaauuu

SEQ ID NO: 90811 - RNA, 22 nt, Escherichia coli CFT073
guugccgguacucaaacggggu

SEQ ID NO: 90812 - RNA, 22 nt, Escherichia coli CFT073
gccgcagaaguggcgcuguuug

SEQ ID NO: 90813 - RNA, 22 nt, Escherichia coli CFT073
uaucguuaauuggcgugacgau

SEQ ID NO: 90814 - RNA, 22 nt, Escherichia coli CFT073
uugcacgauuuuguaggucgga

SEQ ID NO: 90815 - RNA, 22 nt, Escherichia coli CFT073
ucggcucgcccagcggaguuuc

SEQ ID NO: 90816 - RNA, 23 nt, Escherichia coli CFT073
aaacagccaaugcauuauugaua

SEQ ID NO: 90817 - RNA, 22 nt, Escherichia coli CFT073
auaaagaguacuggucgccgca

SEQ ID NO: 90818 - RNA, 22 nt, Escherichia coli CFT073
ugugccaacggguuccccucac

SEQ ID NO: 90819 - RNA, 22 nt, Escherichia coli CFT073
gcggucguuguagagauacucc

SEQ ID NO: 90820 - RNA, 22 nt, Escherichia coli CFT073
ccggcuggauuggugaaauugc

SEQ ID NO: 90821 - RNA, 22 nt, Escherichia coli CFT073
aacgccuuauccggccuacaaa

SEQ ID NO: 90822 - RNA, 19 nt, Escherichia coli CFT073
aucaaguguaugcggcguu

SEQ ID NO: 90823 - RNA, 22 nt, Escherichia coli CFT073
uugacgcugaaaaucugcgggu

SEQ ID NO: 90824 - RNA, 22 nt, Escherichia coli CFT073
cacgaugauauucaccacgccg

SEQ ID NO: 90825 - RNA, 22 nt, Escherichia coli CFT073
gugagcaaacgcaaaaagccgu

SEQ ID NO: 90826 - RNA, 22 nt, Escherichia coli CFT073
cgagcaggacgauccgcucaau

SEQ ID NO: 90827 - RNA, 22 nt, Escherichia coli CFT073
auuguucacgcuugauccacac

SEQ ID NO: 90828 - RNA, 22 nt, Escherichia coli CFT073
accugcgacugagcauccagcg

SEQ ID NO: 90829 - RNA, 22 nt, Escherichia coli CFT073
cgcgaacguucuuuuccagcug

SEQ ID NO: 90830 - RNA, 22 nt, Escherichia coli CFT073
gaucauuuucgcuauuuugccu

SEQ ID NO: 90831 - RNA, 20 nt, Escherichia coli CFT073
uggccuguggcuguaugcgc

SEQ ID NO: 90832 - RNA, 20 nt, Escherichia coli CFT073
gcgauaaccugacgguagag

SEQ ID NO: 90833 - RNA, 22 nt, Escherichia coli CFT073
gaaguaugacgaguaugaaaga

SEQ ID NO: 90834 - RNA, 22 nt, Escherichia coli CFT073
aauuacucauuguuuaaaaaga

SEQ ID NO: 90835 - RNA, 22 nt, Escherichia coli CFT073
gauaaucccugauucgcaguca

SEQ ID NO: 90836 - RNA, 22 nt, Escherichia coli CFT073
ugcacgaucuuguaggccggau

SEQ ID NO: 90837 - RNA, 22 nt, Escherichia coli CFT073
gaaugauaaaccggauuagugu

SEQ ID NO: 90838 - RNA, 22 nt, Escherichia coli CFT073
cgucuucaauaucgcguuuuuc

SEQ ID NO: 90839 - RNA, 22 nt, Escherichia coli CFT073
uaaacaaguaacauggccgccu

SEQ ID NO: 90840 - RNA, 22 nt, Escherichia coli CFT073
uaauaaagcaaauauuacacag

SEQ ID NO: 90841 - RNA, 21 nt, Escherichia coli CFT073
gucucccuguucuggcugcuu

SEQ ID NO: 90842 - RNA, 22 nt, Escherichia coli CFT073
ugagcaaugcagaugcagauac

SEQ ID NO: 90843 - RNA, 22 nt, Escherichia coli CFT073
cucagucugauccaucagggga

SEQ ID NO: 90844 - RNA, 22 nt, Escherichia coli CFT073
uucagccagaagccugggcacc

SEQ ID NO: 90845 - RNA, 22 nt, Escherichia coli CFT073
uaggcguuccguacaucaucgu

SEQ ID NO: 90846 - RNA, 22 nt, Escherichia coli CFT073
gcaucguuguaggccugauaag

SEQ ID NO: 90847 - RNA, 22 nt, Escherichia coli CFT073
uuaaaucgcgcaggaaaaugcc

SEQ ID NO: 90848 - RNA, 22 nt, Escherichia coli CFT073
uaccgauccgauucugcuaacg

SEQ ID NO: 90849 - RNA, 22 nt, Escherichia coli CFT073
gcagcgacgauggaaaaaggga

SEQ ID NO: 90850 - RNA, 22 nt, Escherichia coli CFT073
uuguugaugacgauauucaccu

SEQ ID NO: 90851 - RNA, 22 nt, Escherichia coli CFT073
guauaucaauaaaguccggcuc

SEQ ID NO: 90852 - RNA, 22 nt, Escherichia coli CFT073
ggcgauguugcuaaaagccauu

SEQ ID NO: 90853 - RNA, 22 nt, Escherichia coli CFT073
acugcgaaucgggaauuaucuu

SEQ ID NO: 90854 - RNA, 22 nt, Escherichia coli CFT073
acguuaucagcguuaauuugcu

SEQ ID NO: 90855 - RNA, 22 nt, Escherichia coli CFT073
cgcuccggugguggcgacgggu

SEQ ID NO: 90856 - RNA, 22 nt, Escherichia coli CFT073
aaccaacugcguuggcagcauu

SEQ ID NO: 90857 - RNA, 19 nt, Escherichia coli CFT073
uggccaacguuuauuacag

SEQ ID NO: 90858 - RNA, 22 nt, Escherichia coli CFT073
aacgccuuauccgaccuacgcg

SEQ ID NO: 90859 - RNA, 22 nt, Escherichia coli CFT073
gccacggcguccagcacggugg

SEQ ID NO: 90860 - RNA, 22 nt, Escherichia coli CFT073
acaugguacgguauuguugugu

SEQ ID NO: 90861 - RNA, 20 nt, Escherichia coli CFT073
aacugggcggcgagcguauc

SEQ ID NO: 90862 - RNA, 22 nt, Escherichia coli CFT073
aacagaucauucaacgccugcg

SEQ ID NO: 90863 - RNA, 22 nt, Escherichia coli CFT073
aacgacgagcaucggcgagggu

SEQ ID NO: 90864 - RNA, 22 nt, Escherichia coli CFT073
auuguugacuuccgucaugaag

SEQ ID NO: 90865 - RNA, 22 nt, Escherichia coli CFT073
gaugauguugcauuucagauua

SEQ ID NO: 90866 - RNA, 22 nt, Escherichia coli CFT073
ucagaauauccggugaagugau

SEQ ID NO: 90867 - RNA, 22 nt, Escherichia coli CFT073
aaccuguuuguuaccaggcugg

SEQ ID NO: 90868 - RNA, 22 nt, Escherichia coli CFT073
gcgagagaugauuugugaacau

SEQ ID NO: 90869 - RNA, 22 nt, Escherichia coli CFT073
caccgcuguuagucagaacugu

SEQ ID NO: 90870 - RNA, 22 nt, Escherichia coli CFT073
cgguuuaaaggcgcuaugagcg

SEQ ID NO: 90871 - RNA, 22 nt, Escherichia coli CFT073
cgggaugggauucaaaugcuuu

SEQ ID NO: 90872 - RNA, 22 nt, Escherichia coli CFT073
gaccgcucuuuucgcccgcuuu

SEQ ID NO: 90873 - RNA, 22 nt, Escherichia coli CFT073
ggcguuggguaauaucgccgcu

SEQ ID NO: 90874 - RNA, 22 nt, Escherichia coli CFT073
gagaugcggguucgucaaaggu

SEQ ID NO: 90875 - RNA, 22 nt, Escherichia coli CFT073
gccagcgaccuuaauuccgcgc

SEQ ID NO: 90876 - RNA, 22 nt, Escherichia coli CFT073
uauccguuuauugaacuguuga

SEQ ID NO: 90877 - RNA, 22 nt, Escherichia coli CFT073
ucgcgccugaaccgugcuggug

SEQ ID NO: 90878 - RNA, 22 nt, Escherichia coli CFT073
uagguggcuuucgaaauggcgg

SEQ ID NO: 90879 - RNA, 22 nt, Escherichia coli CFT073
ggcaagcgauuugugucauugc

SEQ ID NO: 90880 - RNA, 22 nt, Escherichia coli CFT073
aaaucugccaaaagaggaugcc

SEQ ID NO: 90881 - RNA, 22 nt, Escherichia coli CFT073
auggcgguauuuuuccuguugg

SEQ ID NO: 90882 - RNA, 22 nt, Escherichia coli CFT073
gcucuugaucgaagccccggua

SEQ ID NO: 90883 - RNA, 22 nt, Escherichia coli CFT073
augcucgccuguuggaucgugc

SEQ ID NO: 90884 - RNA, 22 nt, Escherichia coli CFT073
ggcgugaagaaaucagccaccg

SEQ ID NO: 90885 - RNA, 22 nt, Escherichia coli CFT073
gcucugccuauuuugaaaacgc

SEQ ID NO: 90886 - RNA, 22 nt, Escherichia coli CFT073
gggaaaaggccaaagcguuuga

SEQ ID NO: 90887 - RNA, 22 nt, Escherichia coli CFT073
gcgcacgcucagcaggugacca

SEQ ID NO: 90888 - RNA, 22 nt, Escherichia coli CFT073
ucaccguaugggucgcgguacc

SEQ ID NO: 90889 - RNA, 22 nt, Escherichia coli CFT073
guagccagguuuaaucgugcug

SEQ ID NO: 90890 - RNA, 19 nt, Escherichia coli CFT073
ugucgaugccauucgccgc

SEQ ID NO: 90891 - RNA, 22 nt, Escherichia coli CFT073
uaagcuuuguuacuucugcggu

SEQ ID NO: 90892 - RNA, 22 nt, Escherichia coli CFT073
cggaaaauguguaauaagccgu

SEQ ID NO: 90893 - RNA, 22 nt, Escherichia coli CFT073
uccccauuucugcaguguaagg

SEQ ID NO: 90894 - RNA, 22 nt, Escherichia coli CFT073
gcaacgaaaaucaugcuggggu

SEQ ID NO: 90895 - RNA, 22 nt, Escherichia coli CFT073
uuuaugcucauuuguaggucgg

SEQ ID NO: 90896 - RNA, 22 nt, Escherichia coli CFT073
acgugcagaaauauuuaccgcc

SEQ ID NO: 90897 - RNA, 22 nt, Escherichia coli CFT073
augccgcuuacucaagaagaaa

SEQ ID NO: 90898 - RNA, 22 nt, Escherichia coli CFT073
cuggucgaaaccgguggagaga

SEQ ID NO: 90899 - RNA, 19 nt, Escherichia coli CFT073
uuguaggccugauaagcgu

SEQ ID NO: 90900 - RNA, 22 nt, Escherichia coli CFT073
gcauaaguuguaucacuuccgu

SEQ ID NO: 90901 - RNA, 22 nt, Escherichia coli CFT073
ucggccucucuugcggucuggu

SEQ ID NO: 90902 - RNA, 22 nt, Escherichia coli CFT073
uugcacauuuuuguaggccgga

SEQ ID NO: 90903 - RNA, 21 nt, Escherichia coli CFT073
aggauggcuucgaugauuucu

SEQ ID NO: 90904 - RNA, 22 nt, Escherichia coli CFT073
uacgccaacucaugcgucaggc

SEQ ID NO: 90905 - RNA, 22 nt, Escherichia coli CFT073
cugacgcgucuuaucaugccua

SEQ ID NO: 90906 - RNA, 18 nt, Escherichia coli CFT073
aucugaguuuaugggaau

SEQ ID NO: 90907 - RNA, 22 nt, Escherichia coli CFT073
accacugaagccuuuaaccagc

SEQ ID NO: 90908 - RNA, 21 nt, Escherichia coli CFT073
ucguugaaaaagccaucuacg

SEQ ID NO: 90909 - RNA, 22 nt, Escherichia coli CFT073
cagccaguuguuguuggauaug

SEQ ID NO: 90910 - RNA, 22 nt, Escherichia coli CFT073
uaucuacgaagaguuuaaaggu

SEQ ID NO: 90911 - RNA, 22 nt, Escherichia coli CFT073
uagcugaaauggcaucgcgugc

SEQ ID NO: 90912 - RNA, 22 nt, Escherichia coli CFT073
guauuccauguuaagcauccac

SEQ ID NO: 90913 - RNA, 22 nt, Escherichia coli CFT073
uucuacuguuagucgccuggca

SEQ ID NO: 90914 - RNA, 22 nt, Escherichia coli CFT073
ggggcguguccugcuggagccu

SEQ ID NO: 90915 - RNA, 22 nt, Escherichia coli CFT073
acguagcguuaaaacuuuuagc

SEQ ID NO: 90916 - RNA, 22 nt, Escherichia coli CFT073
aagugcgaaggucgcaauaugc

SEQ ID NO: 90917 - RNA, 22 nt, Escherichia coli CFT073
gucggcaguucaaaaucucuau

SEQ ID NO: 90918 - RNA, 22 nt, Escherichia coli CFT073
auguuucugacaucuguaagca

SEQ ID NO: 90919 - RNA, 22 nt, Escherichia coli CFT073
auggugcugccaucaucgguca

SEQ ID NO: 90920 - RNA, 22 nt, Escherichia coli CFT073
cuccguuagcgcggcggauuga

SEQ ID NO: 90921 - RNA, 22 nt, Escherichia coli CFT073
guggggauguacguauaguucu

SEQ ID NO: 90922 - RNA, 22 nt, Escherichia coli CFT073
ccagugagaaaaugcuugauga

SEQ ID NO: 90923 - RNA, 22 nt, Escherichia coli CFT073
ccguuuauuguauucaucaccg

SEQ ID NO: 90924 - RNA, 22 nt, Escherichia coli CFT073
cgugcugcugcauaagcugccg

SEQ ID NO: 90925 - RNA, 22 nt, Escherichia coli CFT073
cagcgugagcagcgcggcagac

SEQ ID NO: 90926 - RNA, 22 nt, Escherichia coli CFT073
cugcuaacugcuuaucguuaag

SEQ ID NO: 90927 - RNA, 22 nt, Escherichia coli CFT073
uucguugcugauagccgguggu

SEQ ID NO: 90928 - RNA, 22 nt, Escherichia coli CFT073
ucgauauacccguacuuuguua

SEQ ID NO: 90929 - RNA, 22 nt, Escherichia coli CFT073
ucacugcaggacaacaguaaaa

SEQ ID NO: 90930 - RNA, 22 nt, Escherichia coli CFT073
ucucgcgcaauggcguuccaca

SEQ ID NO: 90931 - RNA, 22 nt, Escherichia coli CFT073
cagaugcuguauauucaggugg

SEQ ID NO: 90932 - RNA, 22 nt, Escherichia coli CFT073
ccgguaaugacgccuguauugc

SEQ ID NO: 90933 - RNA, 22 nt, Escherichia coli CFT073
acgcgccgucugaaaccgcuga

SEQ ID NO: 90934 - RNA, 22 nt, Escherichia coli CFT073
gcuuuucucgcguucaaguuug

SEQ ID NO: 90935 - RNA, 18 nt, Escherichia coli CFT073
ucacucuuaaucucggua

SEQ ID NO: 90936 - RNA, 22 nt, Escherichia coli CFT073
uuggccugaauaucgccacugg

SEQ ID NO: 90937 - RNA, 22 nt, Escherichia coli CFT073
ucgauauggugcagucgcugac

SEQ ID NO: 90938 - RNA, 22 nt, Escherichia coli CFT073
aaaaagaucugaucgcgcagcg

SEQ ID NO: 90939 - RNA, 22 nt, Escherichia coli CFT073
ccauugcugguucagaguuggu

SEQ ID NO: 90940 - RNA, 22 nt, Escherichia coli CFT073
uaugcauaaaaagcagcggcug

SEQ ID NO: 90941 - RNA, 22 nt, Escherichia coli CFT073
gcgcgaucacagugagcaagaa

SEQ ID NO: 90942 - RNA, 22 nt, Escherichia coli CFT073
cgugcggugaucgaacguagua

SEQ ID NO: 90943 - RNA, 23 nt, Escherichia coli CFT073
ucaccgagauaacuggcgcggcc

SEQ ID NO: 90944 - RNA, 19 nt, Escherichia coli CFT073
ugagugaagguacgaguaa

SEQ ID NO: 90945 - RNA, 22 nt, Escherichia coli CFT073
ugccagcugaucuucgaaguga

SEQ ID NO: 90946 - RNA, 22 nt, Escherichia coli CFT073
ugcugaucggcacaucgcaguu

SEQ ID NO: 90947 - RNA, 21 nt, Escherichia coli CFT073
ucuguuugccuucagcuccau

SEQ ID NO: 90948 - RNA, 22 nt, Escherichia coli CFT073
augcgauuggugaaacgccauu

SEQ ID NO: 90949 - RNA, 22 nt, Escherichia coli CFT073
cgauuaucaccuguugcccuuu

SEQ ID NO: 90950 - RNA, 22 nt, Escherichia coli CFT073
ucggcagaacggcagcuacgaa

SEQ ID NO: 90951 - RNA, 22 nt, Escherichia coli CFT073
auaugaccaccaucuugucucu

SEQ ID NO: 90952 - RNA, 22 nt, Escherichia coli CFT073
ugcugggcaagcgccugacgcc

SEQ ID NO: 90953 - RNA, 23 nt, Escherichia coli CFT073
agucaugaauucacuacguccgg

SEQ ID NO: 90954 - RNA, 22 nt, Escherichia coli CFT073
cgguuaaagauguucgcguguu

SEQ ID NO: 90955 - RNA, 22 nt, Escherichia coli CFT073
gaacgcgugcuucaggaagcgg

SEQ ID NO: 90956 - RNA, 22 nt, Escherichia coli CFT073
ucgcagauggcgcgccgcuguu

SEQ ID NO: 90957 - RNA, 23 nt, Escherichia coli CFT073
uuggcggcugaagcuuaauuagu

SEQ ID NO: 90958 - RNA, 22 nt, Escherichia coli CFT073
ggagcgaaucgacauccguucc

SEQ ID NO: 90959 - RNA, 22 nt, Escherichia coli CFT073
uuguugugaauuacuggcuuag

SEQ ID NO: 90960 - RNA, 22 nt, Escherichia coli CFT073
uauuuucagcguuaaucaggcu

SEQ ID NO: 90961 - RNA, 22 nt, Escherichia coli CFT073
aguguuccauggugcccgcgcc

SEQ ID NO: 90962 - RNA, 19 nt, Escherichia coli CFT073
gccagucuccggugcacag

SEQ ID NO: 90963 - RNA, 22 nt, Escherichia coli CFT073
uugcucuucauucaggccuuua

SEQ ID NO: 90964 - RNA, 22 nt, Escherichia coli CFT073
gcuggcagugagcgaagcacug

SEQ ID NO: 90965 - RNA, 16 nt, Escherichia coli CFT073
aaaaggagaaaacguc

SEQ ID NO: 90966 - RNA, 19 nt, Escherichia coli CFT073
ugucacuuugcuguauuuc

SEQ ID NO: 90967 - RNA, 22 nt, Escherichia coli CFT073
ugggcggcgguaacagcgaauc

SEQ ID NO: 90968 - RNA, 22 nt, Escherichia coli CFT073
uacggcuguuucugacgguaag

SEQ ID NO: 90969 - RNA, 22 nt, Escherichia coli CFT073
aacgcuuuaauaucuuucggau

SEQ ID NO: 90970 - RNA, 22 nt, Escherichia coli CFT073
aagauuucguucagcgcgugaa

SEQ ID NO: 90971 - RNA, 22 nt, Escherichia coli CFT073
uguugcugcuggguucaaggcu

SEQ ID NO: 90972 - RNA, 22 nt, Escherichia coli CFT073
ucugccgcguaaaaagucuucg

SEQ ID NO: 90973 - RNA, 22 nt, Escherichia coli CFT073
uaucacgcacuuuucccaguuc

SEQ ID NO: 90974 - RNA, 22 nt, Escherichia coli CFT073
ucaucaggcguuucauacugca

SEQ ID NO: 90975 - RNA, 22 nt, Escherichia coli CFT073
gugcugugcccaaucgucuuua

SEQ ID NO: 90976 - RNA, 20 nt, Escherichia coli CFT073
gggcgacggcaggagccagu

SEQ ID NO: 90977 - RNA, 22 nt, Escherichia coli CFT073
ugguuuuauauacaguaaagag

SEQ ID NO: 90978 - RNA, 21 nt, Escherichia coli CFT073
caaugcucuccaguccggugu

SEQ ID NO: 90979 - RNA, 22 nt, Escherichia coli CFT073
uuugcgcuuuuguaggucggau

SEQ ID NO: 90980 - RNA, 22 nt, Escherichia coli CFT073
ugguacucgaaguugucuuuau

SEQ ID NO: 90981 - RNA, 22 nt, Escherichia coli CFT073
acgcgcuuaagcgucuggaugu

SEQ ID NO: 90982 - RNA, 22 nt, Escherichia coli CFT073
caagaacugccuguccguucau

SEQ ID NO: 90983 - RNA, 22 nt, Escherichia coli CFT073
caggucuuucaguuucugcugg

SEQ ID NO: 90984 - RNA, 22 nt, Escherichia coli CFT073
auuccgcguaaaacaaugggga

SEQ ID NO: 90985 - RNA, 22 nt, Escherichia coli CFT073
auuggccgccuguuuacuguuc

SEQ ID NO: 90986 - RNA, 19 nt, Escherichia coli CFT073
ugaaaggcgcuggaugacg

SEQ ID NO: 90987 - RNA, 18 nt, Escherichia coli CFT073
cgcgcugaaccuggcuac

SEQ ID NO: 90988 - RNA, 22 nt, Escherichia coli CFT073
uuuggcauggugguggaucgug

SEQ ID NO: 90989 - RNA, 22 nt, Escherichia coli CFT073
augauaaaacucacuaaacugu

SEQ ID NO: 90990 - RNA, 22 nt, Escherichia coli CFT073
cuugagauuaaagaagaacggc

SEQ ID NO: 90991 - RNA, 22 nt, Escherichia coli CFT073
ccgcaggagacggcauugguga

SEQ ID NO: 90992 - RNA, 22 nt, Escherichia coli CFT073
ugcuggauaugaccaucgaaga

SEQ ID NO: 90993 - RNA, 22 nt, Escherichia coli CFT073
cccggaagucaucaagcaguuu

SEQ ID NO: 90994 - RNA, 22 nt, Escherichia coli CFT073
ugcuacgcgcuguuguugcagu

SEQ ID NO: 90995 - RNA, 22 nt, Escherichia coli CFT073
caugaugcugggugcggugcug

SEQ ID NO: 90996 - RNA, 22 nt, Escherichia coli CFT073
uggaaucugacgaaaauauguu

SEQ ID NO: 90997 - RNA, 20 nt, Escherichia coli CFT073
ccagaccacagagaaugccc

SEQ ID NO: 90998 - RNA, 22 nt, Escherichia coli CFT073
ucuguucagcggccuggugcuu

SEQ ID NO: 90999 - RNA, 22 nt, Escherichia coli CFT073
cgacauauaccggcgucagcaa

SEQ ID NO: 91000 - RNA, 22 nt, Escherichia coli CFT073
acggugacagaacgcuaagauu

SEQ ID NO: 91001 - RNA, 22 nt, Escherichia coli CFT073
uugcaagauuuuguaggucggg

SEQ ID NO: 91002 - RNA, 22 nt, Escherichia coli CFT073
aaucucucagguggaaaucagc

SEQ ID NO: 91003 - RNA, 22 nt, Escherichia coli CFT073
agggcgugggcaaggcacugcu

SEQ ID NO: 91004 - RNA, 22 nt, Escherichia coli CFT073
uuuggcgaauauuauucccauc

SEQ ID NO: 91005 - RNA, 22 nt, Escherichia coli CFT073
ggcggacucaaugaugacauca

SEQ ID NO: 91006 - RNA, 22 nt, Escherichia coli CFT073
agcgccgcaaaauacccuguuc

SEQ ID NO: 91007 - RNA, 22 nt, Escherichia coli CFT073
gcacauaacucauacugagcaa

SEQ ID NO: 91008 - RNA, 18 nt, Escherichia coli CFT073
caugaaacgagagacuac

SEQ ID NO: 91009 - RNA, 22 nt, Escherichia coli CFT073
uuucacggucggccaguauuug

SEQ ID NO: 91010 - RNA, 22 nt, Escherichia coli CFT073
caccgaaagauaaguauaucgu

SEQ ID NO: 91011 - RNA, 16 nt, Escherichia coli CFT073
uaaaucagaggauuaa

SEQ ID NO: 91012 - RNA, 22 nt, Escherichia coli CFT073
uaagagguagugaaauggacau

SEQ ID NO: 91013 - RNA, 22 nt, Escherichia coli CFT073
cguauucaacuguacguugcaa

SEQ ID NO: 91014 - RNA, 22 nt, Escherichia coli CFT073
ggucagauugucuauaugaacu

SEQ ID NO: 91015 - RNA, 22 nt, Escherichia coli CFT073
ugcaucacaaaccugaaaagaa

SEQ ID NO: 91016 - RNA, 20 nt, Escherichia coli CFT073
ugguauucaugacugaccuc

SEQ ID NO: 91017 - RNA, 22 nt, Escherichia coli CFT073
cugcgcaaaugcagguuguuga

SEQ ID NO: 91018 - RNA, 22 nt, Escherichia coli CFT073
uaugcgcuggggaagauggaua

SEQ ID NO: 91019 - RNA, 22 nt, Escherichia coli CFT073
uuaaacugaauauugaagcuaa

SEQ ID NO: 91020 - RNA, 22 nt, Escherichia coli CFT073
cugauauuugauaauaucgccu

SEQ ID NO: 91021 - RNA, 22 nt, Escherichia coli CFT073
ugaaacugaaacuuaccggcaa

SEQ ID NO: 91022 - RNA, 21 nt, Escherichia coli CFT073
aucaggcauuacaagggcugc

SEQ ID NO: 91023 - RNA, 22 nt, Escherichia coli CFT073
cuucacaguauauuugaaaaag

SEQ ID NO: 91024 - RNA, 22 nt, Escherichia coli CFT073
acgccgaagcauuaaaacagcc

SEQ ID NO: 91025 - RNA, 22 nt, Escherichia coli CFT073
acccaucaauuucaacucaucu

SEQ ID NO: 91026 - RNA, 21 nt, Escherichia coli CFT073
uauguguugugggaaacucgc

SEQ ID NO: 91027 - RNA, 22 nt, Escherichia coli CFT073
gcccuguggggagaucugcuuu

SEQ ID NO: 91028 - RNA, 22 nt, Escherichia coli CFT073
ugcggucagaauucagccccuu

SEQ ID NO: 91029 - RNA, 22 nt, Escherichia coli CFT073
cauguguaguaucgcaaacaua

SEQ ID NO: 91030 - RNA, 22 nt, Escherichia coli CFT073
gguaugagagccagaugcugag

SEQ ID NO: 91031 - RNA, 22 nt, Escherichia coli CFT073
ugaguuuugagcaggcgaugaa

SEQ ID NO: 91032 - RNA, 22 nt, Escherichia coli CFT073
auuccgcaacgucagugacugc

SEQ ID NO: 91033 - RNA, 23 nt, Escherichia coli CFT073
aucaaaucacugccuucgcugcc

SEQ ID NO: 91034 - RNA, 17 nt, Escherichia coli CFT073
ugucaucagcaaauccg

SEQ ID NO: 91035 - RNA, 22 nt, Escherichia coli CFT073
ugcgcugguggaacaguggcaa

SEQ ID NO: 91036 - RNA, 21 nt, Escherichia coli CFT073
ugauaguuuucgcauuccguu

SEQ ID NO: 91037 - RNA, 19 nt, Escherichia coli CFT073
ucauuacguucacugcaca

SEQ ID NO: 91038 - RNA, 22 nt, Escherichia coli CFT073
auugucaucgccgguggccagg

SEQ ID NO: 91039 - RNA, 22 nt, Escherichia coli CFT073
auuuucaggaauuucgccagug

SEQ ID NO: 91040 - RNA, 23 nt, Escherichia coli CFT073
ccguucguccaugucugaagcug

SEQ ID NO: 91041 - RNA, 22 nt, Escherichia coli CFT073
ccgcgauagugucgacauucag

SEQ ID NO: 91042 - RNA, 22 nt, Escherichia coli CFT073
cuggagcgcgucguaagcgggu

SEQ ID NO: 91043 - RNA, 22 nt, Escherichia coli CFT073
aguuaucuccuuugccaguggu

SEQ ID NO: 91044 - RNA, 22 nt, Escherichia coli CFT073
gcgcguaaguauuccagcgaac

SEQ ID NO: 91045 - RNA, 22 nt, Escherichia coli CFT073
cgcugaaauaauuuccucuccg

SEQ ID NO: 91046 - RNA, 20 nt, Escherichia coli CFT073
acgaucgucaccaucuaaca

SEQ ID NO: 91047 - RNA, 22 nt, Escherichia coli CFT073
uuuaccguggucgaugagcgca

SEQ ID NO: 91048 - RNA, 22 nt, Escherichia coli CFT073
gacgaugcucacacauacggaa

SEQ ID NO: 91049 - RNA, 22 nt, Escherichia coli CFT073
cgccguaugccccguuuagcgu

SEQ ID NO: 91050 - RNA, 22 nt, Escherichia coli CFT073
gcugcgcugacgccacugcuga

SEQ ID NO: 91051 - RNA, 22 nt, Escherichia coli CFT073
aggcuuuuuuacuggcaaauca

SEQ ID NO: 91052 - RNA, 22 nt, Escherichia coli CFT073
cacguaaaucgacgcgacuggc

SEQ ID NO: 91053 - RNA, 22 nt, Escherichia coli CFT073
cgggauugucuacaucgaugaa

SEQ ID NO: 91054 - RNA, 22 nt, Escherichia coli CFT073
accgaagcgcauccagcggcgu

SEQ ID NO: 91055 - RNA, 23 nt, Escherichia coli CFT073
uuguuguuuuaucacgguauuga

SEQ ID NO: 91056 - RNA, 22 nt, Escherichia coli CFT073
auuuuguuggucgaugcugguu

SEQ ID NO: 91057 - RNA, 22 nt, Escherichia coli CFT073
uugcacgcuugucagaaacagu

SEQ ID NO: 91058 - RNA, 22 nt, Escherichia coli CFT073
uaaaccgaugguggugaugacc

SEQ ID NO: 91059 - RNA, 22 nt, Escherichia coli CFT073
acuuucuucugcggcucaugug

SEQ ID NO: 91060 - RNA, 21 nt, Escherichia coli CFT073
ucgcguuugaugauauccagc

SEQ ID NO: 91061 - RNA, 22 nt, Escherichia coli CFT073
ccucugccauugcaagaaguga

SEQ ID NO: 91062 - RNA, 22 nt, Escherichia coli CFT073
cugcugguaaaccuggcuaucu

SEQ ID NO: 91063 - RNA, 22 nt, Escherichia coli CFT073
uuucugguagcgcaggcuggcg

SEQ ID NO: 91064 - RNA, 23 nt, Escherichia coli CFT073
ugauggugcgcuguagcugauug

SEQ ID NO: 91065 - RNA, 22 nt, Escherichia coli CFT073
cagagcauuaacgguagggucg

SEQ ID NO: 91066 - RNA, 22 nt, Escherichia coli CFT073
ggugauugaugacgauggcuac

SEQ ID NO: 91067 - RNA, 22 nt, Escherichia coli CFT073
ggcaaugaaaucagcuacuuug

SEQ ID NO: 91068 - RNA, 23 nt, Escherichia coli CFT073
agaauugagccucgaucagcagg

SEQ ID NO: 91069 - RNA, 22 nt, Escherichia coli CFT073
uaaagcaccgcggccuuuuuug

SEQ ID NO: 91070 - RNA, 23 nt, Escherichia coli CFT073
gaacugaauaccaaugaggagac

SEQ ID NO: 91071 - RNA, 22 nt, Escherichia coli CFT073
gacgaacauuacuggcuucauu

SEQ ID NO: 91072 - RNA, 22 nt, Escherichia coli CFT073
gggcgggcagcauguuaacagg

SEQ ID NO: 91073 - RNA, 22 nt, Escherichia coli CFT073
auuaucaggucaugcguaccga

SEQ ID NO: 91074 - RNA, 22 nt, Escherichia coli CFT073
uggcaggccauuggguugagaa

SEQ ID NO: 91075 - RNA, 20 nt, Escherichia coli CFT073
guuucugcaauucauugagc

SEQ ID NO: 91076 - RNA, 22 nt, Escherichia coli CFT073
uggcuuucgaauauuuuacugu

SEQ ID NO: 91077 - RNA, 22 nt, Escherichia coli CFT073
uuuggcgaugcaaucucgaagc

SEQ ID NO: 91078 - RNA, 22 nt, Escherichia coli CFT073
ugaucacaguauuaucaaugac

SEQ ID NO: 91079 - RNA, 22 nt, Escherichia coli CFT073
ugcgcuccaguucgccaugacg

SEQ ID NO: 91080 - RNA, 22 nt, Escherichia coli CFT073
uccuuuuucaaauauacuguga

SEQ ID NO: 91081 - RNA, 22 nt, Escherichia coli CFT073
ucaccuccacucccggccggau

SEQ ID NO: 91082 - RNA, 23 nt, Escherichia coli CFT073
cgguuguucaguugaaggugugc

SEQ ID NO: 91083 - RNA, 22 nt, Escherichia coli CFT073
ccacgcugacgcaucaguucac

SEQ ID NO: 91084 - RNA, 22 nt, Escherichia coli CFT073
ucggcggaugguauuguuccag

SEQ ID NO: 91085 - RNA, 22 nt, Escherichia coli CFT073
uagcaugugcauggcggccugu

SEQ ID NO: 91086 - RNA, 22 nt, Escherichia coli CFT073
uucgcguaaacgccaggcgugu

SEQ ID NO: 91087 - RNA, 22 nt, Escherichia coli CFT073
guuacggcaguugccgcgucag

SEQ ID NO: 91088 - RNA, 21 nt, Escherichia coli CFT073
gccgcuggccccuaccgguga

SEQ ID NO: 91089 - RNA, 22 nt, Escherichia coli CFT073
cugccguacuucuacauuccgg

SEQ ID NO: 91090 - RNA, 22 nt, Escherichia coli CFT073
aauuuuauccaguaacgccugg

SEQ ID NO: 91091 - RNA, 22 nt, Escherichia coli CFT073
cugaugcgacgcuggcgcgucu

SEQ ID NO: 91092 - RNA, 22 nt, Escherichia coli CFT073
aggaguuugaaggccauugucu

SEQ ID NO: 91093 - RNA, 22 nt, Escherichia coli CFT073
cagaugauguucucucccguug

SEQ ID NO: 91094 - RNA, 22 nt, Escherichia coli CFT073
guugaugccaucgggauuucuc

SEQ ID NO: 91095 - RNA, 22 nt, Escherichia coli CFT073
cuaagucaugggaaaggugcca

SEQ ID NO: 91096 - RNA, 22 nt, Escherichia coli CFT073
ugcccagcaccauagcaaacag

SEQ ID NO: 91097 - RNA, 22 nt, Escherichia coli CFT073
uacaauguggcgcgaagaaugu

SEQ ID NO: 91098 - RNA, 22 nt, Escherichia coli CFT073
aagguuaaccacaugaaaauca

SEQ ID NO: 91099 - RNA, 22 nt, Escherichia coli CFT073
ugcugcugaaguuccgagcggc

SEQ ID NO: 91100 - RNA, 22 nt, Escherichia coli CFT073
acggcguugcuggaagaaaaac

SEQ ID NO: 91101 - RNA, 22 nt, Escherichia coli CFT073
ucaacguugguaacaaacagcg

SEQ ID NO: 91102 - RNA, 22 nt, Escherichia coli CFT073
uuacggaacauagcacgaccca

SEQ ID NO: 91103 - RNA, 22 nt, Escherichia coli CFT073
ggaaucggcaauguucaugugc

SEQ ID NO: 91104 - RNA, 22 nt, Escherichia coli CFT073
acuccagcaccuguuugaucug

SEQ ID NO: 91105 - RNA, 22 nt, Escherichia coli CFT073
aucgccccuucaagagcuaagc

SEQ ID NO: 91106 - RNA, 22 nt, Escherichia coli CFT073
aaugccccgaucgguugccacg

SEQ ID NO: 91107 - RNA, 22 nt, Escherichia coli CFT073
uuccggaguuggaucaaccgga

SEQ ID NO: 91108 - RNA, 22 nt, Escherichia coli CFT073
aggcgaaaagugggugaugcca

SEQ ID NO: 91109 - RNA, 22 nt, Escherichia coli CFT073
guuuugcccaugcagccgcugc

SEQ ID NO: 91110 - RNA, 22 nt, Escherichia coli CFT073
ucuuguuuuaugugaucguggu

SEQ ID NO: 91111 - RNA, 22 nt, Escherichia coli CFT073
agcaggauacgaaggcuaugug

SEQ ID NO: 91112 - RNA, 22 nt, Escherichia coli CFT073
gcugguauuuucaaucgguacg

SEQ ID NO: 91113 - RNA, 20 nt, Escherichia coli CFT073
ggccaucgccaguuguuccu

SEQ ID NO: 91114 - RNA, 22 nt, Escherichia coli CFT073
aagaaugguuugugccuccgga

SEQ ID NO: 91115 - RNA, 22 nt, Escherichia coli CFT073
uguaaucagcagacgggauuca

SEQ ID NO: 91116 - RNA, 22 nt, Escherichia coli CFT073
agggcguauccgggcagaagau

SEQ ID NO: 91117 - RNA, 22 nt, Escherichia coli CFT073
cucuuuagccgcagccaggucu

SEQ ID NO: 91118 - RNA, 22 nt, Escherichia coli CFT073
uuuaucgacaaaggccggauug

SEQ ID NO: 91119 - RNA, 22 nt, Escherichia coli CFT073
cggugauguuggcgggaguggu

SEQ ID NO: 91120 - RNA, 22 nt, Escherichia coli CFT073
uagcgcaacaaacguuggugug

SEQ ID NO: 91121 - RNA, 22 nt, Escherichia coli CFT073
aaucuucauguaauuggaauga

SEQ ID NO: 91122 - RNA, 21 nt, Escherichia coli CFT073
aacugcuccauucguuguuga

SEQ ID NO: 91123 - RNA, 22 nt, Escherichia coli CFT073
uuaaucagcgucuguuuacccu

SEQ ID NO: 91124 - RNA, 22 nt, Escherichia coli CFT073
cggguugucugacuuacgagaa

SEQ ID NO: 91125 - RNA, 22 nt, Escherichia coli CFT073
uuaccauaaugauuuucaugug

SEQ ID NO: 91126 - RNA, 22 nt, Escherichia coli CFT073
ucuaaauuauaauguacaccau

SEQ ID NO: 91127 - RNA, 22 nt, Escherichia coli CFT073
uuuguaacguugcaggaugucg

SEQ ID NO: 91128 - RNA, 22 nt, Escherichia coli CFT073
uucaccagcgccagcgcuucug

SEQ ID NO: 91129 - RNA, 22 nt, Escherichia coli CFT073
uggucgugaucaucaucaucgc

SEQ ID NO: 91130 - RNA, 22 nt, Escherichia coli CFT073
ggcaucgcugcuguugcuguuc

SEQ ID NO: 91131 - RNA, 22 nt, Escherichia coli CFT073
uauugcugacggaagcaggaaa

SEQ ID NO: 91132 - RNA, 22 nt, Escherichia coli CFT073
auccaucggguuauggcuggcg

SEQ ID NO: 91133 - RNA, 22 nt, Escherichia coli CFT073
cgggcguugauacggcuguugg

SEQ ID NO: 91134 - RNA, 22 nt, Escherichia coli CFT073
gcauuaggugccgaucuggugu

SEQ ID NO: 91135 - RNA, 22 nt, Escherichia coli CFT073
cuggggcugacugccacgccuu

SEQ ID NO: 91136 - RNA, 22 nt, Escherichia coli CFT073
uggugccgggucagguagaaga

SEQ ID NO: 91137 - RNA, 22 nt, Escherichia coli CFT073
auccggagauuuuuucgcagac

SEQ ID NO: 91138 - RNA, 22 nt, Escherichia coli CFT073
gugcaaaugcccuugauacguc

SEQ ID NO: 91139 - RNA, 21 nt, Escherichia coli CFT073
ucaucgauguagacaaucccg

SEQ ID NO: 91140 - RNA, 22 nt, Escherichia coli CFT073
agugugucugacacgauaaagu

SEQ ID NO: 91141 - RNA, 22 nt, Escherichia coli CFT073
agugugcguugaaugccgaccu

SEQ ID NO: 91142 - RNA, 22 nt, Escherichia coli CFT073
gcccgguucuuacaacaauauc

SEQ ID NO: 91143 - RNA, 20 nt, Escherichia coli CFT073
uuguugacuggcaauccagc

SEQ ID NO: 91144 - RNA, 22 nt, Escherichia coli CFT073
aucggcccaaaugaucugguua

SEQ ID NO: 91145 - RNA, 22 nt, Escherichia coli CFT073
gccgauggaguaugaauguaca

SEQ ID NO: 91146 - RNA, 22 nt, Escherichia coli CFT073
ucacggaguuugcgagucaacu

SEQ ID NO: 91147 - RNA, 22 nt, Escherichia coli CFT073
auguguucugggaucugcagga

SEQ ID NO: 91148 - RNA, 22 nt, Escherichia coli CFT073
gaaggcaagacggguuuuaucu

SEQ ID NO: 91149 - RNA, 22 nt, Escherichia coli CFT073
uccuccuuucagagugcuccgc

SEQ ID NO: 91150 - RNA, 22 nt, Escherichia coli CFT073
cggcauagcuucaccuuuggcg

SEQ ID NO: 91151 - RNA, 19 nt, Escherichia coli CFT073
uucugguuuagauauuuau

SEQ ID NO: 91152 - RNA, 22 nt, Escherichia coli CFT073
ugugguuuuacuaaaggacacc

SEQ ID NO: 91153 - RNA, 19 nt, Escherichia coli CFT073
uggcgcuaacuggcgcgca

SEQ ID NO: 91154 - RNA, 22 nt, Escherichia coli CFT073
cugcaauugaccaucgcgguua

SEQ ID NO: 91155 - RNA, 22 nt, Escherichia coli CFT073
uggagcuggaugcggguugugc

SEQ ID NO: 91156 - RNA, 22 nt, Escherichia coli CFT073
cauccugagacacgugcagugg

SEQ ID NO: 91157 - RNA, 22 nt, Escherichia coli CFT073
gcagcgcguuggugaagugcgg

SEQ ID NO: 91158 - RNA, 22 nt, Escherichia coli CFT073
acggcuuguccgguuaaugcuc

SEQ ID NO: 91159 - RNA, 22 nt, Escherichia coli CFT073
aacggucaggcgacugcgcugg

SEQ ID NO: 91160 - RNA, 22 nt, Escherichia coli CFT073
uguagcuugucggagcugaucg

SEQ ID NO: 91161 - RNA, 22 nt, Escherichia coli CFT073
auuaauuugcuggaaauauuua

SEQ ID NO: 91162 - RNA, 22 nt, Escherichia coli CFT073
agguuaauuauuuuccugguuu

SEQ ID NO: 91163 - RNA, 22 nt, Escherichia coli CFT073
gugauagcggguuuacucauua

SEQ ID NO: 91164 - RNA, 22 nt, Escherichia coli CFT073
cagcgcguaguacgcaucgagg

SEQ ID NO: 91165 - RNA, 22 nt, Escherichia coli CFT073
auggcgaucaggugcuggcuca

SEQ ID NO: 91166 - RNA, 22 nt, Escherichia coli CFT073
cgcugccgcguaacugucugcg

SEQ ID NO: 91167 - RNA, 22 nt, Escherichia coli CFT073
ccggaucguaaaccuggaagaa

SEQ ID NO: 91168 - RNA, 22 nt, Escherichia coli CFT073
cgaagucagaacggauaucgua

SEQ ID NO: 91169 - RNA, 22 nt, Escherichia coli CFT073
gcgguuuucagguauucgcuga

SEQ ID NO: 91170 - RNA, 22 nt, Escherichia coli CFT073
aguaucaauagugauaucgcca

SEQ ID NO: 91171 - RNA, 22 nt, Escherichia coli CFT073
aggcaaucgccuguugguggua

SEQ ID NO: 91172 - RNA, 22 nt, Escherichia coli CFT073
uucgaggccgagcauuuucacc

SEQ ID NO: 91173 - RNA, 22 nt, Escherichia coli CFT073
gcguggucugguguacgccggu

SEQ ID NO: 91174 - RNA, 22 nt, Escherichia coli CFT073
acgguaaaaaaugccgugcgca

SEQ ID NO: 91175 - RNA, 22 nt, Escherichia coli CFT073
gauuuuuuugcuggcuaucaug

SEQ ID NO: 91176 - RNA, 22 nt, Escherichia coli CFT073
acguaccacugacucucgaaag

SEQ ID NO: 91177 - RNA, 22 nt, Escherichia coli CFT073
gcugggcuguugauaaugucau

SEQ ID NO: 91178 - RNA, 22 nt, Escherichia coli CFT073
uuaaauuguuuaaugguauuga

SEQ ID NO: 91179 - RNA, 22 nt, Escherichia coli CFT073
guggcggaaaauugcugccaca

SEQ ID NO: 91180 - RNA, 19 nt, Escherichia coli CFT073
aggcgcgccgucggcggag

SEQ ID NO: 91181 - RNA, 22 nt, Escherichia coli CFT073
cgcuggcacaaaugcccauuaa

SEQ ID NO: 91182 - RNA, 22 nt, Escherichia coli CFT073
ucuuuaccggaaagcucggcug

SEQ ID NO: 91183 - RNA, 22 nt, Escherichia coli CFT073
auuccaggagugaguauucagg

SEQ ID NO: 91184 - RNA, 19 nt, Escherichia coli CFT073
ugcaggguuuuuaaucgga

SEQ ID NO: 91185 - RNA, 22 nt, Escherichia coli CFT073
ucguugaaccucgcgccgaucg

SEQ ID NO: 91186 - RNA, 21 nt, Escherichia coli CFT073
uuccuggcauaguucuagccu

SEQ ID NO: 91187 - RNA, 22 nt, Escherichia coli CFT073
uggauguugauauuuaagucug

SEQ ID NO: 91188 - RNA, 22 nt, Escherichia coli CFT073
ggcguacagggcgcugcgggug

SEQ ID NO: 91189 - RNA, 22 nt, Escherichia coli CFT073
uggcugaugaugaccacuuugu

SEQ ID NO: 91190 - RNA, 22 nt, Escherichia coli CFT073
cagaccguaaaugccucgccug

SEQ ID NO: 91191 - RNA, 22 nt, Escherichia coli CFT073
uggguaucgucgaagauaaagu

SEQ ID NO: 91192 - RNA, 22 nt, Escherichia coli CFT073
ugacgguaugaauugccagacg

SEQ ID NO: 91193 - RNA, 23 nt, Escherichia coli CFT073
gcguuauagccgccaaauccugc

SEQ ID NO: 91194 - RNA, 22 nt, Escherichia coli CFT073
uuccuguucgcgcugcucuuca

SEQ ID NO: 91195 - RNA, 19 nt, Escherichia coli CFT073
uugcgggcaaggcguuaaa

SEQ ID NO: 91196 - RNA, 22 nt, Escherichia coli CFT073
gaugguugacggccuugaucua

SEQ ID NO: 91197 - RNA, 22 nt, Escherichia coli CFT073
aucauaaugguacacuuuauag

SEQ ID NO: 91198 - RNA, 22 nt, Escherichia coli CFT073
uggcguacucuuuuuccagcgc

SEQ ID NO: 91199 - RNA, 22 nt, Escherichia coli CFT073
uagucuggugcgcggcggcgau

SEQ ID NO: 91200 - RNA, 22 nt, Escherichia coli CFT073
gguucugaaacuaagauucuua

SEQ ID NO: 91201 - RNA, 22 nt, Escherichia coli CFT073
gcuauguugagaacggugaguu

SEQ ID NO: 91202 - RNA, 22 nt, Escherichia coli CFT073
cagggcgauuaccuggugggua

SEQ ID NO: 91203 - RNA, 22 nt, Escherichia coli CFT073
ggcuaaccaauaugcuuuauua

SEQ ID NO: 91204 - RNA, 22 nt, Escherichia coli CFT073
cguugugaagaaguuggcugcc

SEQ ID NO: 91205 - RNA, 22 nt, Escherichia coli CFT073
gcuguggucgagcguuugcgua

SEQ ID NO: 91206 - RNA, 22 nt, Escherichia coli CFT073
uuaccgacggugauuuacgccg

SEQ ID NO: 91207 - RNA, 22 nt, Escherichia coli CFT073
aucccuauaacaguagaacccu

SEQ ID NO: 91208 - RNA, 22 nt, Escherichia coli CFT073
aguaugcuggcgcuguugcugg

SEQ ID NO: 91209 - RNA, 20 nt, Escherichia coli CFT073
uugcccuuccagugacggua

SEQ ID NO: 91210 - RNA, 22 nt, Escherichia coli CFT073
ugucgcucaacgguuucgcugg

SEQ ID NO: 91211 - RNA, 22 nt, Escherichia coli CFT073
ucagcucugauauacucgcagg

SEQ ID NO: 91212 - RNA, 22 nt, Escherichia coli CFT073
gugcggcgcgugcaucgggauu

SEQ ID NO: 91213 - RNA, 22 nt, Escherichia coli CFT073
uagcuggugacaauagcugguu

SEQ ID NO: 91214 - RNA, 22 nt, Escherichia coli CFT073
auggguuacauuaugaucaaau

SEQ ID NO: 91215 - RNA, 22 nt, Escherichia coli CFT073
uucuguacagcacgcuucauag

SEQ ID NO: 91216 - RNA, 22 nt, Escherichia coli CFT073
ugccuggacuuuugaauugcgc

SEQ ID NO: 91217 - RNA, 22 nt, Escherichia coli CFT073
ggggcgaucgccaggcagguac

SEQ ID NO: 91218 - RNA, 22 nt, Escherichia coli CFT073
uauccggccuacaaucauugca

SEQ ID NO: 91219 - RNA, 19 nt, Escherichia coli CFT073
aagauagucgaauggugga

SEQ ID NO: 91220 - RNA, 22 nt, Escherichia coli CFT073
ugcaaguuaaugaucuaucggc

SEQ ID NO: 91221 - RNA, 22 nt, Escherichia coli CFT073
uugcugucggaacaagguauca

SEQ ID NO: 91222 - RNA, 22 nt, Escherichia coli CFT073
cauuauuacuguugcuucagca

SEQ ID NO: 91223 - RNA, 22 nt, Escherichia coli CFT073
acguucaguuguucgguucaca

SEQ ID NO: 91224 - RNA, 22 nt, Escherichia coli CFT073
acguuaaucgucaaucuugaua

SEQ ID NO: 91225 - RNA, 22 nt, Escherichia coli CFT073
cguuuuauccggccuacaauga

SEQ ID NO: 91226 - RNA, 22 nt, Escherichia coli CFT073
gggcagaaacuggcgauuaaug

SEQ ID NO: 91227 - RNA, 22 nt, Escherichia coli CFT073
gcuucgcggagguaucagagau

SEQ ID NO: 91228 - RNA, 22 nt, Escherichia coli CFT073
uugccacgcaaaucgguuuugc

SEQ ID NO: 91229 - RNA, 22 nt, Escherichia coli CFT073
gugacaauagcgccggaggaca

SEQ ID NO: 91230 - RNA, 22 nt, Escherichia coli CFT073
uuugcguuugcggcuugggauc

SEQ ID NO: 91231 - RNA, 22 nt, Escherichia coli CFT073
cgggcgagcuggcuuccuggcu

SEQ ID NO: 91232 - RNA, 22 nt, Escherichia coli CFT073
agccagcgaucucggcguggug

SEQ ID NO: 91233 - RNA, 22 nt, Escherichia coli CFT073
ggggcguaucacaucauuccgu

SEQ ID NO: 91234 - RNA, 22 nt, Escherichia coli CFT073
gugcuuauguauugcgaaugaa

SEQ ID NO: 91235 - RNA, 22 nt, Escherichia coli CFT073
aucaaacaggugcuggaguggu

SEQ ID NO: 91236 - RNA, 22 nt, Escherichia coli CFT073
aggccggauaaggcguucacgc

SEQ ID NO: 91237 - RNA, 22 nt, Escherichia coli CFT073
cgcguaggcuucgauaucgucg

SEQ ID NO: 91238 - RNA, 22 nt, Escherichia coli CFT073
cgacucuuuuucgauaaucagu

SEQ ID NO: 91239 - RNA, 22 nt, Escherichia coli CFT073
caguauuugccgccagagauga

SEQ ID NO: 91240 - RNA, 22 nt, Escherichia coli CFT073
ggcagaaagacgggcgccgccg

SEQ ID NO: 91241 - RNA, 22 nt, Escherichia coli CFT073
gcgcgccagugauuuacugaag

SEQ ID NO: 91242 - RNA, 22 nt, Escherichia coli CFT073
uggucugucauacuuuguuacc

SEQ ID NO: 91243 - RNA, 22 nt, Escherichia coli CFT073
cuaucuacccucucuaccugau

SEQ ID NO: 91244 - RNA, 22 nt, Escherichia coli CFT073
cgcagugcugauuuacaacaug

SEQ ID NO: 91245 - RNA, 22 nt, Escherichia coli CFT073
ccagcaaacaagugcuccaggg

SEQ ID NO: 91246 - RNA, 22 nt, Escherichia coli CFT073
ggcggcuuucaacgagaaucgg

SEQ ID NO: 91247 - RNA, 22 nt, Escherichia coli CFT073
ucgggcguuugauucuuggcuu

SEQ ID NO: 91248 - RNA, 21 nt, Escherichia coli CFT073
ccaggcggaaaaugaggcagc

SEQ ID NO: 91249 - RNA, 22 nt, Escherichia coli CFT073
gaugcgggugauuaucguccau

SEQ ID NO: 91250 - RNA, 20 nt, Escherichia coli CFT073
guuaugccagcccgucgcaa

SEQ ID NO: 91251 - RNA, 22 nt, Escherichia coli CFT073
aucagguuacaacguuccggca

SEQ ID NO: 91252 - RNA, 22 nt, Escherichia coli CFT073
gcugccaucugauuaaucgacg

SEQ ID NO: 91253 - RNA, 22 nt, Escherichia coli CFT073
ggcauuuuccugcgcgauuuaa

SEQ ID NO: 91254 - RNA, 22 nt, Escherichia coli CFT073
acgcugguguuugccgccgccg

SEQ ID NO: 91255 - RNA, 21 nt, Escherichia coli CFT073
uggugguacuaaugauuugga

SEQ ID NO: 91256 - RNA, 22 nt, Escherichia coli CFT073
cgacgaagcgauggcauccggu

SEQ ID NO: 91257 - RNA, 21 nt, Escherichia coli CFT073
gcgugccacaucaacgaucuc

SEQ ID NO: 91258 - RNA, 17 nt, Escherichia coli CFT073
accuuacccaacgcuuc

SEQ ID NO: 91259 - RNA, 22 nt, Escherichia coli CFT073
ucgcuucgguuaaaaaaaggca

SEQ ID NO: 91260 - RNA, 22 nt, Escherichia coli CFT073
cguuauuauugcagggcagcgc

SEQ ID NO: 91261 - RNA, 22 nt, Escherichia coli CFT073
uugugguugguacaagcccguc

SEQ ID NO: 91262 - RNA, 22 nt, Escherichia coli CFT073
ggccauccugugaaacuggaaa

SEQ ID NO: 91263 - RNA, 22 nt, Escherichia coli CFT073
uucgugauggucagguggugaa

SEQ ID NO: 91264 - RNA, 22 nt, Escherichia coli CFT073
uugccgacgcugcggcgaaauc

SEQ ID NO: 91265 - RNA, 22 nt, Escherichia coli CFT073
uacuggcgacagaaggcacuga

SEQ ID NO: 91266 - RNA, 22 nt, Escherichia coli CFT073
aggcuguuccgcuccggugcgu

SEQ ID NO: 91267 - RNA, 22 nt, Escherichia coli CFT073
gccgguuguaacgauaagggag

SEQ ID NO: 91268 - RNA, 22 nt, Escherichia coli CFT073
uucgcugaccaccggaauauca

SEQ ID NO: 91269 - RNA, 22 nt, Escherichia coli CFT073
ugcagcaugucaucugcauuuu

SEQ ID NO: 91270 - RNA, 20 nt, Escherichia coli CFT073
ugagugauauagcuuugcag

SEQ ID NO: 91271 - RNA, 22 nt, Escherichia coli CFT073
accgguguaugucuggcgagcg

SEQ ID NO: 91272 - RNA, 22 nt, Escherichia coli CFT073
ugccguccauuauuaucgcgga

SEQ ID NO: 91273 - RNA, 23 nt, Escherichia coli CFT073
uuuucggcaucaccauccgucgg

SEQ ID NO: 91274 - RNA, 19 nt, Escherichia coli CFT073
gaccgagcagcaagccaag

SEQ ID NO: 91275 - RNA, 22 nt, Escherichia coli CFT073
ggucacagacuccgcuggaaga

SEQ ID NO: 91276 - RNA, 22 nt, Escherichia coli CFT073
gauggaaaugguguugauggca

SEQ ID NO: 91277 - RNA, 22 nt, Escherichia coli CFT073
gauuuuuacuggcguuugccug

SEQ ID NO: 91278 - RNA, 22 nt, Escherichia coli CFT073
ggcauccucuuuuggcagauuu

SEQ ID NO: 91279 - RNA, 22 nt, Escherichia coli CFT073
agcgcgagguaacguacuggcu

SEQ ID NO: 91280 - RNA, 22 nt, Escherichia coli CFT073
augcauccgcuacccagguagg

SEQ ID NO: 91281 - RNA, 22 nt, Escherichia coli CFT073
ucuucgguaaaucugcugaacc

SEQ ID NO: 91282 - RNA, 22 nt, Escherichia coli CFT073
ggcuuccugcauucguucagcc

SEQ ID NO: 91283 - RNA, 22 nt, Escherichia coli CFT073
aguuucaguuuaccgguauaug

SEQ ID NO: 91284 - RNA, 22 nt, Escherichia coli CFT073
uaucuucgagagugauaacacc

SEQ ID NO: 91285 - RNA, 22 nt, Escherichia coli CFT073
uucccguucuguuaucggcuga

SEQ ID NO: 91286 - RNA, 22 nt, Escherichia coli CFT073
accaucugcggcauacuuucgc

SEQ ID NO: 91287 - RNA, 22 nt, Escherichia coli CFT073
ccgcugguugcgcgaagccugg

SEQ ID NO: 91288 - RNA, 22 nt, Escherichia coli CFT073
uauuuuuacuuuguuccugcgc

SEQ ID NO: 91289 - RNA, 22 nt, Escherichia coli CFT073
acacuaguucuaauuuugagau

SEQ ID NO: 91290 - RNA, 22 nt, Escherichia coli CFT073
ucauugacagaaagcagcggag

SEQ ID NO: 91291 - RNA, 22 nt, Escherichia coli CFT073
cauggucauauuggcgauaugg

SEQ ID NO: 91292 - RNA, 22 nt, Escherichia coli CFT073
cgggcgaaaagccagcguggca

SEQ ID NO: 91293 - RNA, 20 nt, Escherichia coli CFT073
agugaaauccaacaguagcc

SEQ ID NO: 91294 - RNA, 22 nt, Escherichia coli CFT073
uuagcgccgcaaaaacgggcgc

SEQ ID NO: 91295 - RNA, 22 nt, Escherichia coli CFT073
cuacgcuuaucaggccugcaaa

SEQ ID NO: 91296 - RNA, 22 nt, Escherichia coli CFT073
gaacuaaugacauacugcuguu

SEQ ID NO: 91297 - RNA, 22 nt, Escherichia coli CFT073
cagcgacgcgccagcaggaaag

SEQ ID NO: 91298 - RNA, 22 nt, Escherichia coli CFT073
caccgucaggguacggaaagua

SEQ ID NO: 91299 - RNA, 22 nt, Escherichia coli CFT073
uggcgacauguuuccggcgaaa

SEQ ID NO: 91300 - RNA, 22 nt, Escherichia coli CFT073
uguuaugacuuacgcuuuccag

SEQ ID NO: 91301 - RNA, 22 nt, Escherichia coli CFT073
ugcgugcucagccauucgccaa

SEQ ID NO: 91302 - RNA, 22 nt, Escherichia coli CFT073
uagaacuggugcgucagcagcu

SEQ ID NO: 91303 - RNA, 20 nt, Escherichia coli CFT073
auuccgcggcgugcgucugu

SEQ ID NO: 91304 - RNA, 22 nt, Escherichia coli CFT073
cucagcacucauuaacuaccgg

SEQ ID NO: 91305 - RNA, 22 nt, Escherichia coli CFT073
cuuccgcugagguaauaccagg

SEQ ID NO: 91306 - RNA, 22 nt, Escherichia coli CFT073
acuggugcuuuaaaguguucuu

SEQ ID NO: 91307 - RNA, 22 nt, Escherichia coli CFT073
acugacguugguuuuuggugaa

SEQ ID NO: 91308 - RNA, 22 nt, Escherichia coli CFT073
ugguuuaaccaggaugaagucg

SEQ ID NO: 91309 - RNA, 22 nt, Escherichia coli CFT073
aauggugcugccugccggagca

SEQ ID NO: 91310 - RNA, 22 nt, Escherichia coli CFT073
cugacagauaugguacuucccg

SEQ ID NO: 91311 - RNA, 18 nt, Escherichia coli CFT073
uucuguagaaccgccgcc

SEQ ID NO: 91312 - RNA, 22 nt, Escherichia coli CFT073
ccgccggacugauuuuguuguu

SEQ ID NO: 91313 - RNA, 22 nt, Escherichia coli CFT073
aaaaugcauuauacgguucugg

SEQ ID NO: 91314 - RNA, 22 nt, Escherichia coli CFT073
ugugcugauaucagcggugugg

SEQ ID NO: 91315 - RNA, 22 nt, Escherichia coli CFT073
ugcugauugcgcacguuugcgg

SEQ ID NO: 91316 - RNA, 18 nt, Escherichia coli CFT073
gauaccgguaugucauuc

SEQ ID NO: 91317 - RNA, 22 nt, Escherichia coli CFT073
uuuggcuucagcguuuugcagg

SEQ ID NO: 91318 - RNA, 22 nt, Escherichia coli CFT073
gguauucgcuuugcuuuuacga

SEQ ID NO: 91319 - RNA, 22 nt, Escherichia coli CFT073
aguggagaugcgguaaauauug

SEQ ID NO: 91320 - RNA, 22 nt, Escherichia coli CFT073
ucagguauuuuuacgccucuga

SEQ ID NO: 91321 - RNA, 22 nt, Escherichia coli CFT073
agugggucgccgacugccagca

SEQ ID NO: 91322 - RNA, 22 nt, Escherichia coli CFT073
uugcagucacugcgugaugcac

SEQ ID NO: 91323 - RNA, 22 nt, Escherichia coli CFT073
ggaagucaugugccauccggcg

SEQ ID NO: 91324 - RNA, 22 nt, Escherichia coli CFT073
augaugguuggcacuauucugg

SEQ ID NO: 91325 - RNA, 22 nt, Escherichia coli CFT073
gcguuugcacuaccagacccca

SEQ ID NO: 91326 - RNA, 22 nt, Escherichia coli CFT073
gaugauauugcuccagauguug

SEQ ID NO: 91327 - RNA, 22 nt, Escherichia coli CFT073
agcgcuuauacaccgacauuga

SEQ ID NO: 91328 - RNA, 20 nt, Escherichia coli CFT073
aaaaugucaaugacacugua

SEQ ID NO: 91329 - RNA, 22 nt, Escherichia coli CFT073
accgcgacgcagaccgucggag

SEQ ID NO: 91330 - RNA, 22 nt, Escherichia coli CFT073
acguugaaagcguucaccuauu

SEQ ID NO: 91331 - RNA, 22 nt, Escherichia coli CFT073
ucggugucuucuucucacgcuu

SEQ ID NO: 91332 - RNA, 22 nt, Escherichia coli CFT073
aucagacagggagguagauacg

SEQ ID NO: 91333 - RNA, 22 nt, Escherichia coli CFT073
acggcgaauuugcuggugcagg

SEQ ID NO: 91334 - RNA, 20 nt, Escherichia coli CFT073
ugauggccaccacauucuca

SEQ ID NO: 91335 - RNA, 22 nt, Escherichia coli CFT073
cgauuuuauucaggucaaugcg

SEQ ID NO: 91336 - RNA, 22 nt, Escherichia coli CFT073
uuacugauguugcgaaaacgcu

SEQ ID NO: 91337 - RNA, 22 nt, Escherichia coli CFT073
uguugguaugucguaucacuua

SEQ ID NO: 91338 - RNA, 22 nt, Escherichia coli CFT073
ucucccgcuaugccuguuaccu

SEQ ID NO: 91339 - RNA, 23 nt, Escherichia coli CFT073
ggucuuccagcucaaucacuucc

SEQ ID NO: 91340 - RNA, 22 nt, Escherichia coli CFT073
uacgcaccaaaacgagcggguc

SEQ ID NO: 91341 - RNA, 22 nt, Escherichia coli CFT073
gaaagauauuauuguccgcggc

SEQ ID NO: 91342 - RNA, 19 nt, Escherichia coli CFT073
cagcaguuuuuucgcacag

SEQ ID NO: 91343 - RNA, 21 nt, Escherichia coli CFT073
cuaccgccaagcgcagggagu

SEQ ID NO: 91344 - RNA, 22 nt, Escherichia coli CFT073
cgcuuauaugguggcauauauc

SEQ ID NO: 91345 - RNA, 22 nt, Escherichia coli CFT073
auaaccugugucaccguguccu

SEQ ID NO: 91346 - RNA, 22 nt, Escherichia coli CFT073
uucgcgacuggacagcggucgg

SEQ ID NO: 91347 - RNA, 22 nt, Escherichia coli CFT073
agguggcaaaauuugggacaaa

SEQ ID NO: 91348 - RNA, 22 nt, Escherichia coli CFT073
aacuggaacacaaaacucgucg

SEQ ID NO: 91349 - RNA, 23 nt, Escherichia coli CFT073
ugacgaaacgcuguuugaguucu

SEQ ID NO: 91350 - RNA, 22 nt, Escherichia coli CFT073
ggcggcgaugggugugcugugu

SEQ ID NO: 91351 - RNA, 20 nt, Escherichia coli CFT073
gugcgagucgccugaacagu

SEQ ID NO: 91352 - RNA, 22 nt, Escherichia coli CFT073
ugcaaccuaucguaacaacgac

SEQ ID NO: 91353 - RNA, 22 nt, Escherichia coli CFT073
ucaguuugcccugauauucguc

SEQ ID NO: 91354 - RNA, 22 nt, Escherichia coli CFT073
cagggugcggaccugcugguga

SEQ ID NO: 91355 - RNA, 19 nt, Escherichia coli CFT073
gccgaagucgcucauagcg

SEQ ID NO: 91356 - RNA, 22 nt, Escherichia coli CFT073
cgagguuucaugggcgugauua

SEQ ID NO: 91357 - RNA, 22 nt, Escherichia coli CFT073
aguauggcuuccgggucuucca

SEQ ID NO: 91358 - RNA, 22 nt, Escherichia coli CFT073
ucgaucgucaggagcgucuggu

SEQ ID NO: 91359 - RNA, 22 nt, Escherichia coli CFT073
agaucggcccagcuggugacag

SEQ ID NO: 91360 - RNA, 22 nt, Escherichia coli CFT073
uuguuucugcaauguuugaggg

SEQ ID NO: 91361 - RNA, 22 nt, Escherichia coli CFT073
gcugccagcgcuguuucacggc

SEQ ID NO: 91362 - RNA, 22 nt, Escherichia coli CFT073
ugcaacuggaguuaauuucguu

SEQ ID NO: 91363 - RNA, 22 nt, Escherichia coli CFT073
ucaucaaauucaagauggggaa

SEQ ID NO: 91364 - RNA, 22 nt, Escherichia coli CFT073
ugccaggcccaacccuuucaua

SEQ ID NO: 91365 - RNA, 22 nt, Escherichia coli CFT073
gccgcagacaacgacuuauugc

SEQ ID NO: 91366 - RNA, 22 nt, Escherichia coli CFT073
aucaacuguugcugggggcacg

SEQ ID NO: 91367 - RNA, 22 nt, Escherichia coli CFT073
cgugguugcggaaauuguguug

SEQ ID NO: 91368 - RNA, 22 nt, Escherichia coli CFT073
uaaagcggccgugaaaguguug

SEQ ID NO: 91369 - RNA, 22 nt, Escherichia coli CFT073
acuuucggguuaucgauaagga

SEQ ID NO: 91370 - RNA, 22 nt, Escherichia coli CFT073
cgcuggaaguugugaaaaagua

SEQ ID NO: 91371 - RNA, 22 nt, Escherichia coli CFT073
cugcaagguauagccgcucacc

SEQ ID NO: 91372 - RNA, 22 nt, Escherichia coli CFT073
ugucauuaaccgauuguccgau

SEQ ID NO: 91373 - RNA, 22 nt, Escherichia coli CFT073
uucuucauuuuguaaggcgaac

SEQ ID NO: 91374 - RNA, 22 nt, Escherichia coli CFT073
uguugaaacuguagcccguucc

SEQ ID NO: 91375 - RNA, 22 nt, Escherichia coli CFT073
aagaacgaacuacaugcucaau

SEQ ID NO: 91376 - RNA, 23 nt, Escherichia coli CFT073
acguuucgcuuccauggcucgcg

SEQ ID NO: 91377 - RNA, 22 nt, Escherichia coli CFT073
cguaggccaaucaggggguuua

SEQ ID NO: 91378 - RNA, 22 nt, Escherichia coli CFT073
gucagggauaguaaagcgcguu

SEQ ID NO: 91379 - RNA, 22 nt, Escherichia coli CFT073
gcugagcgccagauuuuugucc

SEQ ID NO: 91380 - RNA, 22 nt, Escherichia coli CFT073
gguguagcccagccgagaucac

SEQ ID NO: 91381 - RNA, 22 nt, Escherichia coli CFT073
ucgccagcauucugcggcuggg

SEQ ID NO: 91382 - RNA, 22 nt, Escherichia coli CFT073
uaagggaaagacucgucagcca

SEQ ID NO: 91383 - RNA, 23 nt, Escherichia coli CFT073
caguaagaaucagaauauugcug

SEQ ID NO: 91384 - RNA, 22 nt, Escherichia coli CFT073
uguggcauauguucgcgcaugg

SEQ ID NO: 91385 - RNA, 22 nt, Escherichia coli CFT073
gcaggaaggucgcgaugccgau

SEQ ID NO: 91386 - RNA, 22 nt, Escherichia coli CFT073
auggcgucgauaauagcgcggg

SEQ ID NO: 91387 - RNA, 22 nt, Escherichia coli CFT073
auacagaaagcuuauaaugcga

SEQ ID NO: 91388 - RNA, 22 nt, Escherichia coli CFT073
aggucgauaccaaagcaauuga

SEQ ID NO: 91389 - RNA, 22 nt, Escherichia coli CFT073
caggccgucgaugacaaaaaua

SEQ ID NO: 91390 - RNA, 22 nt, Escherichia coli CFT073
guaccggaaaaauuaugcguga

SEQ ID NO: 91391 - RNA, 22 nt, Escherichia coli CFT073
guagacagccagugugcgggug

SEQ ID NO: 91392 - RNA, 22 nt, Escherichia coli CFT073
gagggcgguaauucuacggcaa

SEQ ID NO: 91393 - RNA, 22 nt, Escherichia coli CFT073
uuacugaugcgucugguagugg

SEQ ID NO: 91394 - RNA, 22 nt, Escherichia coli CFT073
cgugcgucuucuauucagggga

SEQ ID NO: 91395 - RNA, 22 nt, Escherichia coli CFT073
uccuggcguaaguaaucgcgga

SEQ ID NO: 91396 - RNA, 22 nt, Escherichia coli CFT073
uugcccguuggagacggcuuca

SEQ ID NO: 91397 - RNA, 22 nt, Escherichia coli CFT073
cagaaagugacuacgcgugcac

SEQ ID NO: 91398 - RNA, 22 nt, Escherichia coli CFT073
uggcaacccguuccugcaugau

SEQ ID NO: 91399 - RNA, 22 nt, Escherichia coli CFT073
uacgguguuggguucgauuuua

SEQ ID NO: 91400 - RNA, 22 nt, Escherichia coli CFT073
aaggaaacaguaugaaccuguu

SEQ ID NO: 91401 - RNA, 23 nt, Escherichia coli CFT073
cuuuuucauucacgcggcgcugg

SEQ ID NO: 91402 - RNA, 23 nt, Escherichia coli CFT073
acgaugaagccuuccugcaacag

SEQ ID NO: 91403 - RNA, 22 nt, Escherichia coli CFT073
uugccaguuuggcgacaguuga

SEQ ID NO: 91404 - RNA, 22 nt, Escherichia coli CFT073
uaucaggccuacaugauuucug

SEQ ID NO: 91405 - RNA, 22 nt, Escherichia coli CFT073
uugcagcgaacguguaggccug

SEQ ID NO: 91406 - RNA, 22 nt, Escherichia coli CFT073
ccugcgguccaggaguagaaag

SEQ ID NO: 91407 - RNA, 22 nt, Escherichia coli CFT073
agccgggacuuugcccugcucu

SEQ ID NO: 91408 - RNA, 22 nt, Escherichia coli CFT073
uuggugaugauuuaccggauca

SEQ ID NO: 91409 - RNA, 22 nt, Escherichia coli CFT073
cacuuuggugccauugguuaaa

SEQ ID NO: 91410 - RNA, 22 nt, Escherichia coli CFT073
aucuggcaccgccugcugcauu

SEQ ID NO: 91411 - RNA, 22 nt, Escherichia coli CFT073
cggcaaugucaguaaggggaug

SEQ ID NO: 91412 - RNA, 22 nt, Escherichia coli CFT073
gcgucuggaagaagaacgccgu

SEQ ID NO: 91413 - RNA, 22 nt, Escherichia coli CFT073
aauggggucuggcugguuuuuc

SEQ ID NO: 91414 - RNA, 22 nt, Escherichia coli CFT073
cagcgggcugcaauugagcaag

SEQ ID NO: 91415 - RNA, 20 nt, Escherichia coli CFT073
cugccgugggacaguuugcu

SEQ ID NO: 91416 - RNA, 22 nt, Escherichia coli CFT073
cugggaggccaguggcaagaaa

SEQ ID NO: 91417 - RNA, 20 nt, Escherichia coli CFT073
cauuggcugguuguuggggc

SEQ ID NO: 91418 - RNA, 22 nt, Escherichia coli CFT073
agaauggcguaucggagcggug

SEQ ID NO: 91419 - RNA, 22 nt, Escherichia coli CFT073
aguuugcuguugaccaggaaaa

SEQ ID NO: 91420 - RNA, 22 nt, Escherichia coli CFT073
gagaucgauccgcccgugcaug

SEQ ID NO: 91421 - RNA, 19 nt, Escherichia coli CFT073
aaaaacucacucgcagguc

SEQ ID NO: 91422 - RNA, 22 nt, Escherichia coli CFT073
guccgacaugaaaguguccgaa

SEQ ID NO: 91423 - RNA, 22 nt, Escherichia coli CFT073
ugggcguggauguucgucgguu

SEQ ID NO: 91424 - RNA, 22 nt, Escherichia coli CFT073
ugaugucgaugcugcguuugug

SEQ ID NO: 91425 - RNA, 20 nt, Escherichia coli CFT073
ccguuacugggguuuugugc

SEQ ID NO: 91426 - RNA, 22 nt, Escherichia coli CFT073
ccuguagacggacguucgcggc

SEQ ID NO: 91427 - RNA, 22 nt, Escherichia coli CFT073
gauacgcugaaugaaaucgaac

SEQ ID NO: 91428 - RNA, 22 nt, Escherichia coli CFT073
cggacucagccaugauggaguu

SEQ ID NO: 91429 - RNA, 23 nt, Escherichia coli CFT073
gaugucguacagggcauugccca

SEQ ID NO: 91430 - RNA, 22 nt, Escherichia coli CFT073
aagauacagugauggggauugu

SEQ ID NO: 91431 - RNA, 22 nt, Escherichia coli CFT073
ucaguaaucagcgucaauguug

SEQ ID NO: 91432 - RNA, 22 nt, Escherichia coli CFT073
uccagaacaagaagguaagaau

SEQ ID NO: 91433 - RNA, 22 nt, Escherichia coli CFT073
cugauuucccagcgacaacaua

SEQ ID NO: 91434 - RNA, 22 nt, Escherichia coli CFT073
gacguuaucugccuuuugauga

SEQ ID NO: 91435 - RNA, 22 nt, Escherichia coli CFT073
uuucaacauagucuucuccuuu

SEQ ID NO: 91436 - RNA, 22 nt, Escherichia coli CFT073
ccuuuaccgcucugauagagau

SEQ ID NO: 91437 - RNA, 23 nt, Escherichia coli CFT073
ucagcuggaauaccugcucugca

SEQ ID NO: 91438 - RNA, 22 nt, Escherichia coli CFT073
gacuucauggagucgaguugca

SEQ ID NO: 91439 - RNA, 22 nt, Escherichia coli CFT073
uacgcuggcaucacaggcgucg

SEQ ID NO: 91440 - RNA, 22 nt, Escherichia coli CFT073
uacgcgauugcaucuucaucau

SEQ ID NO: 91441 - RNA, 22 nt, Escherichia coli CFT073
cagacgguucauuuuguagcgc

SEQ ID NO: 91442 - RNA, 22 nt, Escherichia coli CFT073
ggauaaggcguuuacgccgcau

SEQ ID NO: 91443 - RNA, 22 nt, Escherichia coli CFT073
auugcccguuuuacagcguuac

SEQ ID NO: 91444 - RNA, 23 nt, Escherichia coli CFT073
cgcccgcgauuuguucugauugg

SEQ ID NO: 91445 - RNA, 22 nt, Escherichia coli CFT073
uggggcggguaugaaucguuga

SEQ ID NO: 91446 - RNA, 22 nt, Escherichia coli CFT073
aaagcggugaccgcuaugucga

SEQ ID NO: 91447 - RNA, 22 nt, Escherichia coli CFT073
aagaaugucaucacccgcguua

SEQ ID NO: 91448 - RNA, 22 nt, Escherichia coli CFT073
agucaauauuuauucauggaau

SEQ ID NO: 91449 - RNA, 22 nt, Escherichia coli CFT073
ucaccgguauuuggggcuguuu

SEQ ID NO: 91450 - RNA, 22 nt, Escherichia coli CFT073
ucagugguggcgucgguuguuu

SEQ ID NO: 91451 - RNA, 22 nt, Escherichia coli CFT073
aagcgguugacguguucgucuu

SEQ ID NO: 91452 - RNA, 22 nt, Escherichia coli CFT073
ugggcuacuucucuucugaccg

SEQ ID NO: 91453 - RNA, 22 nt, Escherichia coli CFT073
agcugccggaagcagacagcag

SEQ ID NO: 91454 - RNA, 22 nt, Escherichia coli CFT073
uuuuuggaucaugccagacacc

SEQ ID NO: 91455 - RNA, 22 nt, Escherichia coli CFT073
ugcugguacuuaaucgcaccua

SEQ ID NO: 91456 - RNA, 22 nt, Escherichia coli CFT073
ggucaaggaaggcguuaucggc

SEQ ID NO: 91457 - RNA, 22 nt, Escherichia coli CFT073
gcggccagccggagcuggcaag

SEQ ID NO: 91458 - RNA, 22 nt, Escherichia coli CFT073
accugucuggcaauauuacugg

SEQ ID NO: 91459 - RNA, 22 nt, Escherichia coli CFT073
ugcuucuguuagcggcucuuca

SEQ ID NO: 91460 - RNA, 22 nt, Escherichia coli CFT073
agaaauaccaucaaaaucguga

SEQ ID NO: 91461 - RNA, 22 nt, Escherichia coli CFT073
gagcgucaggaagaguggaccg

SEQ ID NO: 91462 - RNA, 22 nt, Escherichia coli CFT073
gcugcggugauaaacaguuuug

SEQ ID NO: 91463 - RNA, 18 nt, Escherichia coli CFT073
aaauaugcuggccauugu

SEQ ID NO: 91464 - RNA, 21 nt, Escherichia coli CFT073
uuauguacagaucuugcgcca

SEQ ID NO: 91465 - RNA, 23 nt, Escherichia coli CFT073
cauucaugaaacugucagccuuc

SEQ ID NO: 91466 - RNA, 22 nt, Escherichia coli CFT073
ugcaauggcuggcauccggcgu

SEQ ID NO: 91467 - RNA, 22 nt, Escherichia coli CFT073
agacaacaguuggaugcucauu

SEQ ID NO: 91468 - RNA, 20 nt, Escherichia coli CFT073
acuugcgcaccuugugcgcc

SEQ ID NO: 91469 - RNA, 22 nt, Escherichia coli CFT073
acaaugguuagcauacuuuucc

SEQ ID NO: 91470 - RNA, 22 nt, Escherichia coli CFT073
uguucucugguggugcucucag

SEQ ID NO: 91471 - RNA, 22 nt, Escherichia coli CFT073
gcagaaaaucccucccgcuggu

SEQ ID NO: 91472 - RNA, 19 nt, Escherichia coli CFT073
aggugauugaaaccgaucu

SEQ ID NO: 91473 - RNA, 22 nt, Escherichia coli CFT073
aggauaaaacggauucggcagc

SEQ ID NO: 91474 - RNA, 23 nt, Escherichia coli CFT073
cugcaagguauuuuugugcucgc

SEQ ID NO: 91475 - RNA, 22 nt, Escherichia coli CFT073
cuaucaauauuuugcguauuca

SEQ ID NO: 91476 - RNA, 22 nt, Escherichia coli CFT073
cuggcggaaaaaggcauuccuu

SEQ ID NO: 91477 - RNA, 22 nt, Escherichia coli CFT073
acugccuacaacauggaugcac

SEQ ID NO: 91478 - RNA, 22 nt, Escherichia coli CFT073
agauuggugucaaucauguguu

SEQ ID NO: 91479 - RNA, 22 nt, Escherichia coli CFT073
uugccgucaguaagucgauguu

SEQ ID NO: 91480 - RNA, 22 nt, Escherichia coli CFT073
guucggugagcgccugagcguc

SEQ ID NO: 91481 - RNA, 22 nt, Escherichia coli CFT073
ccagcaguaugcaucagccgau

SEQ ID NO: 91482 - RNA, 22 nt, Escherichia coli CFT073
gcagggcgcggaaauggccccg

SEQ ID NO: 91483 - RNA, 22 nt, Escherichia coli CFT073
guaauuuucuguuucauguugc

SEQ ID NO: 91484 - RNA, 22 nt, Escherichia coli CFT073
ggcauaggaggccucggugcag

SEQ ID NO: 91485 - RNA, 22 nt, Escherichia coli CFT073
uacuguguauucguaagcauca

SEQ ID NO: 91486 - RNA, 22 nt, Escherichia coli CFT073
cugaauguugaaaaugcgcgcc

SEQ ID NO: 91487 - RNA, 22 nt, Escherichia coli CFT073
guauuauuucugcggcagguuu

SEQ ID NO: 91488 - RNA, 22 nt, Escherichia coli CFT073
uacggcaaagauaccggucauu

SEQ ID NO: 91489 - RNA, 20 nt, Escherichia coli CFT073
uaauggcgauuacauuguug

SEQ ID NO: 91490 - RNA, 20 nt, Escherichia coli CFT073
ugugcgcguaacuugucgau

SEQ ID NO: 91491 - RNA, 22 nt, Escherichia coli CFT073
ugccaucgaugugguuucuauc

SEQ ID NO: 91492 - RNA, 22 nt, Escherichia coli CFT073
ccugcucgaugaagccagacga

SEQ ID NO: 91493 - RNA, 22 nt, Escherichia coli CFT073
accgccuguaugugcagaacgg

SEQ ID NO: 91494 - RNA, 22 nt, Escherichia coli CFT073
uaucucaauuucucgcccuauc

SEQ ID NO: 91495 - RNA, 22 nt, Escherichia coli CFT073
cguuucgccaucgcggaucucu

SEQ ID NO: 91496 - RNA, 22 nt, Escherichia coli CFT073
ucgguacuguucgagacggcgg

SEQ ID NO: 91497 - RNA, 22 nt, Escherichia coli CFT073
acuggguuaugucugagccgau

SEQ ID NO: 91498 - RNA, 22 nt, Escherichia coli CFT073
uguucucuuauaccggcagcgc

SEQ ID NO: 91499 - RNA, 22 nt, Escherichia coli CFT073
uggcgucguguagcgaugacca

SEQ ID NO: 91500 - RNA, 22 nt, Escherichia coli CFT073
augcaggcggccauguuacuug

SEQ ID NO: 91501 - RNA, 22 nt, Escherichia coli CFT073
ucugaaugaagccaguaauguu

SEQ ID NO: 91502 - RNA, 22 nt, Escherichia coli CFT073
gggcugaucuuacguggaccac

SEQ ID NO: 91503 - RNA, 22 nt, Escherichia coli CFT073
uaacggcagugaagauucgugg

SEQ ID NO: 91504 - RNA, 22 nt, Escherichia coli CFT073
ugcuuaacaguuugaccggcgc

SEQ ID NO: 91505 - RNA, 22 nt, Escherichia coli CFT073
ucagcagguugaaacggugggu

SEQ ID NO: 91506 - RNA, 22 nt, Escherichia coli CFT073
uuucaaaaugauaacuucgcaa

SEQ ID NO: 91507 - RNA, 22 nt, Escherichia coli CFT073
agaccgauauucaaauagagcg

SEQ ID NO: 91508 - RNA, 22 nt, Escherichia coli CFT073
uaggugaguucgcugguguucc

SEQ ID NO: 91509 - RNA, 22 nt, Escherichia coli CFT073
auugagcauaacuuuaaugcgc

SEQ ID NO: 91510 - RNA, 22 nt, Escherichia coli CFT073
ucggcaacaugcacaaccuguu

SEQ ID NO: 91511 - RNA, 22 nt, Escherichia coli CFT073
ggggaaauugucggucugcugg

SEQ ID NO: 91512 - RNA, 22 nt, Escherichia coli CFT073
caccguggccuuuuccgguaua

SEQ ID NO: 91513 - RNA, 22 nt, Escherichia coli CFT073
ggugaaggguauuacacacacg

SEQ ID NO: 91514 - RNA, 22 nt, Escherichia coli CFT073
acggcuggcgcuaucaggaaca

SEQ ID NO: 91515 - RNA, 22 nt, Escherichia coli CFT073
ucgccaaccugcaguuuauagu

SEQ ID NO: 91516 - RNA, 22 nt, Escherichia coli CFT073
gccgugauggugaucuucguca

SEQ ID NO: 91517 - RNA, 22 nt, Escherichia coli CFT073
uaucgucugauuaugaagagcg

SEQ ID NO: 91518 - RNA, 22 nt, Escherichia coli CFT073
aagagaugucauuacugaugcu

SEQ ID NO: 91519 - RNA, 22 nt, Escherichia coli CFT073
uccgcaaagacgguuuucgcuu

SEQ ID NO: 91520 - RNA, 22 nt, Escherichia coli CFT073
uuaacgcgucuuaucaggccua

SEQ ID NO: 91521 - RNA, 22 nt, Escherichia coli CFT073
ugccgacaggguggcugugcga

SEQ ID NO: 91522 - RNA, 22 nt, Escherichia coli CFT073
ccucaacaaaauccgccaguug

SEQ ID NO: 91523 - RNA, 22 nt, Escherichia coli CFT073
caacgccuuccacaacggcgcu

SEQ ID NO: 91524 - RNA, 22 nt, Escherichia coli CFT073
ucgcucauaaucagaucuaaaa

SEQ ID NO: 91525 - RNA, 22 nt, Escherichia coli CFT073
cugucuccggcugcgcugauga

SEQ ID NO: 91526 - RNA, 22 nt, Escherichia coli CFT073
auguaggguuacgcgcaguuuc

SEQ ID NO: 91527 - RNA, 22 nt, Escherichia coli CFT073
acuggaagaucaagagaaaguu

SEQ ID NO: 91528 - RNA, 22 nt, Escherichia coli CFT073
uuaaucgucaugguuuauggaa

SEQ ID NO: 91529 - RNA, 22 nt, Escherichia coli CFT073
ggaacagaucgccagcaaauuu

SEQ ID NO: 91530 - RNA, 22 nt, Escherichia coli CFT073
cgcaauuugugcagucggugca

SEQ ID NO: 91531 - RNA, 22 nt, Escherichia coli CFT073
aucggagaauugcagcguaccu

SEQ ID NO: 91532 - RNA, 22 nt, Escherichia coli CFT073
ugagcggacuggaugcggcaau

SEQ ID NO: 91533 - RNA, 22 nt, Escherichia coli CFT073
agguuagcgugcuugugcuuaa

SEQ ID NO: 91534 - RNA, 22 nt, Escherichia coli CFT073
auauugaugagcgugagguuau

SEQ ID NO: 91535 - RNA, 22 nt, Escherichia coli CFT073
cgcacaggauuauuacggugug

SEQ ID NO: 91536 - RNA, 18 nt, Escherichia coli CFT073
agcagcggcgcaauggca

SEQ ID NO: 91537 - RNA, 22 nt, Escherichia coli CFT073
aaggguauuuucgcaaaucagg

SEQ ID NO: 91538 - RNA, 22 nt, Escherichia coli CFT073
aauggaccagucuguuuauucu

SEQ ID NO: 91539 - RNA, 22 nt, Escherichia coli CFT073
uuuuucaaaucccacuacgaag

SEQ ID NO: 91540 - RNA, 22 nt, Escherichia coli CFT073
accagcagcagcguauucaguu

SEQ ID NO: 91541 - RNA, 22 nt, Escherichia coli CFT073
uguugcggaacaucugguugcu

SEQ ID NO: 91542 - RNA, 22 nt, Escherichia coli CFT073
augcgucgcugucgcgucuuau

SEQ ID NO: 91543 - RNA, 19 nt, Escherichia coli CFT073
gcgauacuuucuggugggc

SEQ ID NO: 91544 - RNA, 23 nt, Escherichia coli CFT073
ugaaauccuuaugaaacaaagua

SEQ ID NO: 91545 - RNA, 22 nt, Escherichia coli CFT073
guuuugugaaaucgucaaccgc

SEQ ID NO: 91546 - RNA, 22 nt, Escherichia coli CFT073
cgacguagacaacgguacugaa

SEQ ID NO: 91547 - RNA, 22 nt, Escherichia coli CFT073
agccacauguucccgcuuuggg

SEQ ID NO: 91548 - RNA, 21 nt, Escherichia coli CFT073
acgcaucauccgaaucaccag

SEQ ID NO: 91549 - RNA, 22 nt, Escherichia coli CFT073
cgucuggcugauggcggcguag

SEQ ID NO: 91550 - RNA, 22 nt, Escherichia coli CFT073
agcgggcaauuuucgguggugc

SEQ ID NO: 91551 - RNA, 19 nt, Escherichia coli CFT073
agcaucguuuauucccuau

SEQ ID NO: 91552 - RNA, 23 nt, Escherichia coli CFT073
uuuuacugaugucuggcggucgg

SEQ ID NO: 91553 - RNA, 22 nt, Escherichia coli CFT073
agcaggccaucacgaccuugcu

SEQ ID NO: 91554 - RNA, 22 nt, Escherichia coli CFT073
aucucgaacgggccuggaggua

SEQ ID NO: 91555 - RNA, 22 nt, Escherichia coli CFT073
uaucuggugugcccguaaaugu

SEQ ID NO: 91556 - RNA, 22 nt, Escherichia coli CFT073
cguaccggcaucaaggacgacg

SEQ ID NO: 91557 - RNA, 22 nt, Escherichia coli CFT073
aguuucucgucaacauacugcu

SEQ ID NO: 91558 - RNA, 22 nt, Escherichia coli CFT073
ggaacggaugucgauucgcucc

SEQ ID NO: 91559 - RNA, 23 nt, Escherichia coli CFT073
cgucgccagaaguugaggaggau

SEQ ID NO: 91560 - RNA, 22 nt, Escherichia coli CFT073
ugagaaugcgcgggcuggcgug

SEQ ID NO: 91561 - RNA, 22 nt, Escherichia coli CFT073
uauuuauuuuuccugguucgcg

SEQ ID NO: 91562 - RNA, 22 nt, Escherichia coli CFT073
uugcggaaguuuaucuggcgau

SEQ ID NO: 91563 - RNA, 22 nt, Escherichia coli CFT073
uggguggugauuaccagcgccu

SEQ ID NO: 91564 - RNA, 22 nt, Escherichia coli CFT073
aucgcaggcgguauuggcggaa

SEQ ID NO: 91565 - RNA, 22 nt, Escherichia coli CFT073
ugcugcgcaaaacccacuucga

SEQ ID NO: 91566 - RNA, 22 nt, Escherichia coli CFT073
aagucgauuuccgcuuccugcg

SEQ ID NO: 91567 - RNA, 22 nt, Escherichia coli CFT073
gcgcauuccaguauugcugacg

SEQ ID NO: 91568 - RNA, 22 nt, Escherichia coli CFT073
ugcaggucuugucuaaaagcga

SEQ ID NO: 91569 - RNA, 22 nt, Escherichia coli CFT073
uucaguguaaugguauuggucc

SEQ ID NO: 91570 - RNA, 22 nt, Escherichia coli CFT073
acggucugcacggugguggugg

SEQ ID NO: 91571 - RNA, 21 nt, Escherichia coli CFT073
uucauguuaauacgcaacguu

SEQ ID NO: 91572 - RNA, 22 nt, Escherichia coli CFT073
aacuuacuuuacugcagauuuu

SEQ ID NO: 91573 - RNA, 22 nt, Escherichia coli CFT073
uauuauguguuggguauacguc

SEQ ID NO: 91574 - RNA, 22 nt, Escherichia coli CFT073
gaugcgucuuauccgaccuacg

SEQ ID NO: 91575 - RNA, 22 nt, Escherichia coli CFT073
auggcgauauagucuuucacgc

SEQ ID NO: 91576 - RNA, 22 nt, Escherichia coli CFT073
uagccgauagcggcgaugccgu

SEQ ID NO: 91577 - RNA, 22 nt, Escherichia coli CFT073
acaaguauaugaauuaucggag

SEQ ID NO: 91578 - RNA, 22 nt, Escherichia coli CFT073
uccguuuauuuugggcguuguc

SEQ ID NO: 91579 - RNA, 21 nt, Escherichia coli CFT073
uuugcguugccgccugccaca

SEQ ID NO: 91580 - RNA, 22 nt, Escherichia coli CFT073
uuucaugagguguugauaucug

SEQ ID NO: 91581 - RNA, 22 nt, Escherichia coli CFT073
uaugcgucauaacuucacguau

SEQ ID NO: 91582 - RNA, 22 nt, Escherichia coli CFT073
ggauguuaauggcauuagauau

SEQ ID NO: 91583 - RNA, 22 nt, Escherichia coli CFT073
gaucgccgccugcauucagaug

SEQ ID NO: 91584 - RNA, 22 nt, Escherichia coli CFT073
caugauguuuucgauuauguga

SEQ ID NO: 91585 - RNA, 20 nt, Escherichia coli CFT073
aucaaaaggcagauaacguc

SEQ ID NO: 91586 - RNA, 19 nt, Escherichia coli CFT073
uuccgcagcgcguguuuua

SEQ ID NO: 91587 - RNA, 22 nt, Escherichia coli CFT073
cauugcaccaauauggugcuua

SEQ ID NO: 91588 - RNA, 22 nt, Escherichia coli CFT073
gucaucguuacgcgugucagca

SEQ ID NO: 91589 - RNA, 22 nt, Escherichia coli CFT073
cggguaugguucugaccguaga

SEQ ID NO: 91590 - RNA, 20 nt, Escherichia coli CFT073
uacgugcccaauaucggugc

SEQ ID NO: 91591 - RNA, 22 nt, Escherichia coli CFT073
ucacugaugagccagguucugg

SEQ ID NO: 91592 - RNA, 22 nt, Escherichia coli CFT073
cucugcugucggggaaucgcgu

SEQ ID NO: 91593 - RNA, 22 nt, Escherichia coli CFT073
aacugggcuugaguuaccgcau

SEQ ID NO: 91594 - RNA, 22 nt, Escherichia coli CFT073
gggagucauugcaucgucaacu

SEQ ID NO: 91595 - RNA, 22 nt, Escherichia coli CFT073
acuguauaaaaacccuauacug

SEQ ID NO: 91596 - RNA, 22 nt, Escherichia coli CFT073
uggcggagaaguccaugccgca

SEQ ID NO: 91597 - RNA, 22 nt, Escherichia coli CFT073
cugguuacagaaagagauugau

SEQ ID NO: 91598 - RNA, 22 nt, Escherichia coli CFT073
uggucuucucugcuggcgcugc

SEQ ID NO: 91599 - RNA, 22 nt, Escherichia coli CFT073
uucggguaaucgcaacuuuggu

SEQ ID NO: 91600 - RNA, 22 nt, Escherichia coli CFT073
ucaaacucccuuuacuuaccuu

SEQ ID NO: 91601 - RNA, 22 nt, Escherichia coli CFT073
uccugaauuggaagaauaucaa

SEQ ID NO: 91602 - RNA, 22 nt, Escherichia coli CFT073
ugucuguuauucaacaauuuag

SEQ ID NO: 91603 - RNA, 22 nt, Escherichia coli CFT073
gauggccuuuuuucuggugaug

SEQ ID NO: 91604 - RNA, 22 nt, Escherichia coli CFT073
uaacggcgaucgcgccagcgga

SEQ ID NO: 91605 - RNA, 22 nt, Escherichia coli CFT073
acgugcauuugccgcuuaaccu

SEQ ID NO: 91606 - RNA, 22 nt, Escherichia coli CFT073
cugccagacgcuacugaaucac

SEQ ID NO: 91607 - RNA, 22 nt, Escherichia coli CFT073
ucuuaagcguaguaauuuuagc

SEQ ID NO: 91608 - RNA, 22 nt, Escherichia coli CFT073
gcugcgcgauccaggucugcac

SEQ ID NO: 91609 - RNA, 22 nt, Escherichia coli CFT073
uccguuuauucuguugaucagg

SEQ ID NO: 91610 - RNA, 22 nt, Escherichia coli CFT073
agggcgcugauucaucgaccag

SEQ ID NO: 91611 - RNA, 22 nt, Escherichia coli CFT073
auaaacgccuggcuggcugguu

SEQ ID NO: 91612 - RNA, 22 nt, Escherichia coli CFT073
cggggauugguuuuauaaaccu

SEQ ID NO: 91613 - RNA, 22 nt, Escherichia coli CFT073
guguaaguaaggugguaagguc

SEQ ID NO: 91614 - RNA, 22 nt, Escherichia coli CFT073
aaccgggugaaucagcguuuau

SEQ ID NO: 91615 - RNA, 22 nt, Escherichia coli CFT073
agaucgcacaauccgggcugag

SEQ ID NO: 91616 - RNA, 22 nt, Escherichia coli CFT073
acgccaguaucgugauucaugu

SEQ ID NO: 91617 - RNA, 22 nt, Escherichia coli CFT073
auuuguguauugucuugccggu

SEQ ID NO: 91618 - RNA, 22 nt, Escherichia coli CFT073
agaaauauuugcccggcgcguu

SEQ ID NO: 91619 - RNA, 22 nt, Escherichia coli CFT073
agcugcugacgcaccaguucua

SEQ ID NO: 91620 - RNA, 22 nt, Escherichia coli CFT073
uggaugaacccgaaugaacuga

SEQ ID NO: 91621 - RNA, 21 nt, Escherichia coli CFT073
ugcacaauuaagggauacguc

SEQ ID NO: 91622 - RNA, 22 nt, Escherichia coli CFT073
gcgcgccaguuggcgaucuaca

SEQ ID NO: 91623 - RNA, 22 nt, Escherichia coli CFT073
augcugcauuuugcugaccgga

SEQ ID NO: 91624 - RNA, 22 nt, Escherichia coli CFT073
gcuucgagauugcaucgccaaa

SEQ ID NO: 91625 - RNA, 22 nt, Escherichia coli CFT073
uaaccgggcuuugcacgccggg

SEQ ID NO: 91626 - RNA, 22 nt, Escherichia coli CFT073
cugggcagagcgcgacauggca

SEQ ID NO: 91627 - RNA, 22 nt, Escherichia coli CFT073
aaugagcguacuuuucuggcgu

SEQ ID NO: 91628 - RNA, 19 nt, Escherichia coli CFT073
uugcuucugaauauaucua

SEQ ID NO: 91629 - RNA, 22 nt, Escherichia coli CFT073
uaaucgugauuuuuugugcgcg

SEQ ID NO: 91630 - RNA, 22 nt, Escherichia coli CFT073
ucaccuuguagcguuuggcgau

SEQ ID NO: 91631 - RNA, 22 nt, Escherichia coli CFT073
uaaauuucccuuugccaaaggc

SEQ ID NO: 91632 - RNA, 22 nt, Escherichia coli CFT073
cgccgcucaaaauccugaugcu

SEQ ID NO: 91633 - RNA, 22 nt, Escherichia coli CFT073
uuuuccgguuaucaacuggccu

SEQ ID NO: 91634 - RNA, 22 nt, Escherichia coli CFT073
ucgccgcagccaacucuucuuc

SEQ ID NO: 91635 - RNA, 22 nt, Escherichia coli CFT073
accaguauugucgauaaauuau

SEQ ID NO: 91636 - RNA, 19 nt, Escherichia coli CFT073
cuguuucgccaucgccaga

SEQ ID NO: 91637 - RNA, 22 nt, Escherichia coli CFT073
gccgugauggcuccacugauau

SEQ ID NO: 91638 - RNA, 22 nt, Escherichia coli CFT073
uugguguaugugcgcacugcua

SEQ ID NO: 91639 - RNA, 22 nt, Escherichia coli CFT073
gcauuagguaugggauuugaua

SEQ ID NO: 91640 - RNA, 22 nt, Escherichia coli CFT073
gcacagaagugguauaugcguu

SEQ ID NO: 91641 - RNA, 22 nt, Escherichia coli CFT073
ugguuuggcgcugacgucauua

SEQ ID NO: 91642 - RNA, 19 nt, Escherichia coli CFT073
uggucgcguccguggccug

SEQ ID NO: 91643 - RNA, 22 nt, Escherichia coli CFT073
gaguaaguuauuaucaguagcc

SEQ ID NO: 91644 - RNA, 22 nt, Escherichia coli CFT073
ugcaaccugcgacgguuucuuc

SEQ ID NO: 91645 - RNA, 22 nt, Escherichia coli CFT073
uggcgggcgacuggugcggcug

SEQ ID NO: 91646 - RNA, 22 nt, Escherichia coli CFT073
gauaagguauagucacaaaaua

SEQ ID NO: 91647 - RNA, 23 nt, Escherichia coli CFT073
ucuugcccgguguagcgauagau

SEQ ID NO: 91648 - RNA, 22 nt, Escherichia coli CFT073
uauugaugagcguggagcacug

SEQ ID NO: 91649 - RNA, 22 nt, Escherichia coli CFT073
cuuuuucgaaaggcagaaaugc

SEQ ID NO: 91650 - RNA, 22 nt, Escherichia coli CFT073
ggaguacaucgugcgcggcagu

SEQ ID NO: 91651 - RNA, 23 nt, Escherichia coli CFT073
gggugagugcaucgggcaucagc

SEQ ID NO: 91652 - RNA, 22 nt, Escherichia coli CFT073
auggguuccuggggugcggagu

SEQ ID NO: 91653 - RNA, 22 nt, Escherichia coli CFT073
uucugcugauugugcgccgucu

SEQ ID NO: 91654 - RNA, 21 nt, Escherichia coli CFT073
ccucgcuggucguuauccugc

SEQ ID NO: 91655 - RNA, 22 nt, Escherichia coli CFT073
ucaucguggugguagcgucagu

SEQ ID NO: 91656 - RNA, 22 nt, Escherichia coli CFT073
ccugcgaauccagcucgacgcu

SEQ ID NO: 91657 - RNA, 22 nt, Escherichia coli CFT073
agcggugugugaaauugucagu

SEQ ID NO: 91658 - RNA, 22 nt, Escherichia coli CFT073
ccuguaggccggauaaggcguu

SEQ ID NO: 91659 - RNA, 22 nt, Escherichia coli CFT073
aucacgucaccucgacgcuguu

SEQ ID NO: 91660 - RNA, 20 nt, Escherichia coli CFT073
agacuuuuuaccgcuguaau

SEQ ID NO: 91661 - RNA, 22 nt, Escherichia coli CFT073
ggcaggcucuggcgaaacaggg

SEQ ID NO: 91662 - RNA, 22 nt, Escherichia coli CFT073
cugguaugacucaaauggguug

SEQ ID NO: 91663 - RNA, 22 nt, Escherichia coli CFT073
uaucgacggcucagaagugucu

SEQ ID NO: 91664 - RNA, 22 nt, Escherichia coli CFT073
cuuaccagcggaaaaaaagaug

SEQ ID NO: 91665 - RNA, 22 nt, Escherichia coli CFT073
uucagcgacauguacuuacugg

SEQ ID NO: 91666 - RNA, 22 nt, Escherichia coli CFT073
cuuaucaggccuacaagggaac

SEQ ID NO: 91667 - RNA, 18 nt, Escherichia coli CFT073
uuucacacaacaugccgc

SEQ ID NO: 91668 - RNA, 22 nt, Escherichia coli CFT073
uaauggaguauggcgucaguuu

SEQ ID NO: 91669 - RNA, 22 nt, Escherichia coli CFT073
ccggugagucuuauuucacaag

SEQ ID NO: 91670 - RNA, 22 nt, Escherichia coli CFT073
gacucguccauuuuguugacga

SEQ ID NO: 91671 - RNA, 22 nt, Escherichia coli CFT073
auuugcgugucaaucaaggguu

SEQ ID NO: 91672 - RNA, 22 nt, Escherichia coli CFT073
ugaauugauuaaagauaagcca

SEQ ID NO: 91673 - RNA, 22 nt, Escherichia coli CFT073
ccguuuucauggcaucgucaua

SEQ ID NO: 91674 - RNA, 20 nt, Escherichia coli CFT073
ugaugaauuaaccguacugg

SEQ ID NO: 91675 - RNA, 22 nt, Escherichia coli CFT073
cugugggaugcaaugccgaagc

SEQ ID NO: 91676 - RNA, 22 nt, Escherichia coli CFT073
gccguuuggcuguuucacgccg

SEQ ID NO: 91677 - RNA, 22 nt, Escherichia coli CFT073
uugccggugucugggggcauag

SEQ ID NO: 91678 - RNA, 22 nt, Escherichia coli CFT073
aaaagcgaucgcgcguuaauau

SEQ ID NO: 91679 - RNA, 22 nt, Escherichia coli CFT073
cgcagacugaccauccugcgcu

SEQ ID NO: 91680 - RNA, 22 nt, Escherichia coli CFT073
cgucaguagcgguaugaaaggc

SEQ ID NO: 91681 - RNA, 22 nt, Escherichia coli CFT073
cagggcgucacggaaggccgga

SEQ ID NO: 91682 - RNA, 22 nt, Escherichia coli CFT073
uggcucaucgcuuucguugugu

SEQ ID NO: 91683 - RNA, 22 nt, Escherichia coli CFT073
acuggcgugccacccaugcuuu

SEQ ID NO: 91684 - RNA, 22 nt, Escherichia coli CFT073
aaccgguugugcacuggucgcc

SEQ ID NO: 91685 - RNA, 22 nt, Escherichia coli CFT073
cuggcgcaacguuauccucccu

SEQ ID NO: 91686 - RNA, 20 nt, Escherichia coli CFT073
ucacgcggacggugguacgu

SEQ ID NO: 91687 - RNA, 22 nt, Escherichia coli CFT073
guugccguuccccagcuggaua

SEQ ID NO: 91688 - RNA, 16 nt, Escherichia coli CFT073
uuuggcagcgaucgcc

SEQ ID NO: 91689 - RNA, 22 nt, Escherichia coli CFT073
ucuucacgccagaguuuuugca

SEQ ID NO: 91690 - RNA, 20 nt, Escherichia coli CFT073
uauggcaucgucaucgaccg

SEQ ID NO: 91691 - RNA, 22 nt, Escherichia coli CFT073
aaugcgcugguugaaguguuac

SEQ ID NO: 91692 - RNA, 22 nt, Escherichia coli CFT073
aagcgguuguacacgugccggu

SEQ ID NO: 91693 - RNA, 22 nt, Escherichia coli CFT073
gaggucaguuuguuucacauug

SEQ ID NO: 91694 - RNA, 22 nt, Escherichia coli CFT073
auucccuucauggucgauagcg

SEQ ID NO: 91695 - RNA, 22 nt, Escherichia coli CFT073
gcguuuugugucgucguugccc

SEQ ID NO: 91696 - RNA, 22 nt, Escherichia coli CFT073
ugguaagcgcggcaugacguau

SEQ ID NO: 91697 - RNA, 23 nt, Escherichia coli CFT073
uugcucucauuucgcacaucgcg

SEQ ID NO: 91698 - RNA, 23 nt, Escherichia coli CFT073
agauugguguagugaaacaggau

SEQ ID NO: 91699 - RNA, 18 nt, Escherichia coli CFT073
ucguuggucaccaugcgg

SEQ ID NO: 91700 - RNA, 22 nt, Escherichia coli CFT073
ucuuucagacugagcuggaacc

SEQ ID NO: 91701 - RNA, 22 nt, Escherichia coli CFT073
gccaggagucauuuauugguuu

SEQ ID NO: 91702 - RNA, 22 nt, Escherichia coli CFT073
gcgcugaugugggcaguacugg

SEQ ID NO: 91703 - RNA, 22 nt, Escherichia coli CFT073
ugguugugacaacuuugugauu

SEQ ID NO: 91704 - RNA, 18 nt, Escherichia coli CFT073
auggugaugaucgauuuc

SEQ ID NO: 91705 - RNA, 22 nt, Escherichia coli CFT073
cguauguguuuggagagcaacu

SEQ ID NO: 91706 - RNA, 22 nt, Escherichia coli CFT073
uuguuaauuccugauucaggug

SEQ ID NO: 91707 - RNA, 22 nt, Escherichia coli CFT073
ucgcuuucaucaguucaaaggc

SEQ ID NO: 91708 - RNA, 22 nt, Escherichia coli CFT073
ucguaggccggauaagacgcgg

SEQ ID NO: 91709 - RNA, 19 nt, Escherichia coli CFT073
agauccggaagaggguggu

SEQ ID NO: 91710 - RNA, 22 nt, Escherichia coli CFT073
uuucgucgugaaauggcuuaug

SEQ ID NO: 91711 - RNA, 22 nt, Escherichia coli CFT073
aaucauccacuuccuggggggu

SEQ ID NO: 91712 - RNA, 22 nt, Escherichia coli CFT073
gcucgucgagaauauacagcgu

SEQ ID NO: 91713 - RNA, 20 nt, Escherichia coli CFT073
gcucagcguuguauguguua

SEQ ID NO: 91714 - RNA, 22 nt, Escherichia coli CFT073
ucuucuucgacauguuccaggc

SEQ ID NO: 91715 - RNA, 22 nt, Escherichia coli CFT073
aagcgucccguuucgaucuuag

SEQ ID NO: 91716 - RNA, 18 nt, Escherichia coli CFT073
uugugguacucaccgaua

SEQ ID NO: 91717 - RNA, 22 nt, Escherichia coli CFT073
aaggcuuauuaguuaucgauau

SEQ ID NO: 91718 - RNA, 22 nt, Escherichia coli CFT073
cguugaugucaucggcacagag

SEQ ID NO: 91719 - RNA, 22 nt, Escherichia coli CFT073
gccggauacaaaacauugccga

SEQ ID NO: 91720 - RNA, 22 nt, Escherichia coli CFT073
cgugcaggcgcaguaaggggua

SEQ ID NO: 91721 - RNA, 21 nt, Escherichia coli CFT073
ucagucggcagugcuacgcgc

SEQ ID NO: 91722 - RNA, 22 nt, Escherichia coli CFT073
aagcauuacuggucauugcaga

SEQ ID NO: 91723 - RNA, 22 nt, Escherichia coli CFT073
ccguuaacggggaucauucugg

SEQ ID NO: 91724 - RNA, 22 nt, Escherichia coli CFT073
cggguuaugcuauugacguugc

SEQ ID NO: 91725 - RNA, 22 nt, Escherichia coli CFT073
ggacugaccaaugaauuucacc

SEQ ID NO: 91726 - RNA, 22 nt, Escherichia coli CFT073
cgauuccgguaggcggucguua

SEQ ID NO: 91727 - RNA, 22 nt, Escherichia coli CFT073
gaugucuguuugguuucaggcg

SEQ ID NO: 91728 - RNA, 22 nt, Escherichia coli CFT073
cgccguugaugacacauaucaa

SEQ ID NO: 91729 - RNA, 22 nt, Escherichia coli CFT073
augcgucugcugguggcggccu

SEQ ID NO: 91730 - RNA, 22 nt, Escherichia coli CFT073
ugauccgccgccaugacaaagc

SEQ ID NO: 91731 - RNA, 22 nt, Escherichia coli CFT073
caggccuacaucguuccugcaa

SEQ ID NO: 91732 - RNA, 22 nt, Escherichia coli CFT073
acggcugagagcaccaccagag

SEQ ID NO: 91733 - RNA, 22 nt, Escherichia coli CFT073
ccugauggaucagacugagauc

SEQ ID NO: 91734 - RNA, 22 nt, Escherichia coli CFT073
cugugucauuuucgccgugucu

SEQ ID NO: 91735 - RNA, 22 nt, Escherichia coli CFT073
auagacacaggcuuuggaacga

SEQ ID NO: 91736 - RNA, 22 nt, Escherichia coli CFT073
acguuucccaggugaugcauau

SEQ ID NO: 91737 - RNA, 22 nt, Escherichia coli CFT073
gaugagcguuucccgcauccgc

SEQ ID NO: 91738 - RNA, 22 nt, Escherichia coli CFT073
gucuggcguuaaucguauuggg

SEQ ID NO: 91739 - RNA, 22 nt, Escherichia coli CFT073
uugcacgauuuuguaggccgga

SEQ ID NO: 91740 - RNA, 22 nt, Escherichia coli CFT073
agugaacgaacugaucgccgca

SEQ ID NO: 91741 - RNA, 22 nt, Escherichia coli CFT073
ugcuggcauggcaccuuuuucc

SEQ ID NO: 91742 - RNA, 22 nt, Escherichia coli CFT073
cgccauccacgccgagauggaa

SEQ ID NO: 91743 - RNA, 22 nt, Escherichia coli CFT073
gggacugaaguuggucagacgc

SEQ ID NO: 91744 - RNA, 22 nt, Escherichia coli CFT073
ggacaucaugcccgaggucgcg

SEQ ID NO: 91745 - RNA, 22 nt, Escherichia coli CFT073
cugauuagugcagaguggaacu

SEQ ID NO: 91746 - RNA, 22 nt, Escherichia coli CFT073
cugacggaaguggugcagcguc

SEQ ID NO: 91747 - RNA, 22 nt, Escherichia coli CFT073
ugcagauguaguagugauuggu

SEQ ID NO: 91748 - RNA, 22 nt, Escherichia coli CFT073
aagccucaguuucuaugcaaau

SEQ ID NO: 91749 - RNA, 22 nt, Escherichia coli CFT073
gcugauggcgcagguagcgccu

SEQ ID NO: 91750 - RNA, 22 nt, Escherichia coli CFT073
ugcuuugacgaauucuacgacg

SEQ ID NO: 91751 - RNA, 22 nt, Escherichia coli CFT073
agugggauugcagagaaacagu

SEQ ID NO: 91752 - RNA, 22 nt, Escherichia coli CFT073
aagcaauugauuuuuaucaucg

SEQ ID NO: 91753 - RNA, 22 nt, Escherichia coli CFT073
ugcgauguccaucaccccuucg

SEQ ID NO: 91754 - RNA, 22 nt, Escherichia coli CFT073
ccaguuugauuugcuccgguuu

SEQ ID NO: 91755 - RNA, 22 nt, Escherichia coli CFT073
ugcuucgcucacugccagccac

SEQ ID NO: 91756 - RNA, 22 nt, Escherichia coli CFT073
cguuuauuacgugcugucgaug

SEQ ID NO: 91757 - RNA, 22 nt, Escherichia coli CFT073
ccgaaaaauugcagcaggcggu

SEQ ID NO: 91758 - RNA, 22 nt, Escherichia coli CFT073
ugagaacggacguuugucgcgc

SEQ ID NO: 91759 - RNA, 22 nt, Escherichia coli CFT073
caccaaagcgcugguggaaggu

SEQ ID NO: 91760 - RNA, 22 nt, Escherichia coli CFT073
uucacugccgcuggcggguggu

SEQ ID NO: 91761 - RNA, 22 nt, Escherichia coli CFT073
uugggugaguuauggcguggcg

SEQ ID NO: 91762 - RNA, 22 nt, Escherichia coli CFT073
ugugguacauggggaaagugau

SEQ ID NO: 91763 - RNA, 22 nt, Escherichia coli CFT073
aacgucggcaucgcggaaggcu

SEQ ID NO: 91764 - RNA, 22 nt, Escherichia coli CFT073
uucuucaaucugacgcaucagg

SEQ ID NO: 91765 - RNA, 22 nt, Escherichia coli CFT073
aauggcggaguguugcucaaaa

SEQ ID NO: 91766 - RNA, 22 nt, Escherichia coli CFT073
aaaacugucugaaguggauuuu

SEQ ID NO: 91767 - RNA, 22 nt, Escherichia coli CFT073
uauugcgcuuuaugucgcgugg

SEQ ID NO: 91768 - RNA, 22 nt, Escherichia coli CFT073
gugcugggcggguacauuguua

SEQ ID NO: 91769 - RNA, 22 nt, Escherichia coli CFT073
ucgcuuuuacucuucagauugu

SEQ ID NO: 91770 - RNA, 22 nt, Escherichia coli CFT073
uggugguuauugaugaucaaca

SEQ ID NO: 91771 - RNA, 22 nt, Escherichia coli CFT073
aggcguuugcccgugcggcaau

SEQ ID NO: 91772 - RNA, 21 nt, Escherichia coli CFT073
uguuacucgauuuccugccug

SEQ ID NO: 91773 - RNA, 22 nt, Escherichia coli CFT073
uaccagccuggugaacugguca

SEQ ID NO: 91774 - RNA, 22 nt, Escherichia coli CFT073
ugucggcgauuucaccacgucg

SEQ ID NO: 91775 - RNA, 22 nt, Escherichia coli CFT073
aacagguuacggucgccguaaa

SEQ ID NO: 91776 - RNA, 22 nt, Escherichia coli CFT073
ggaagggaauaaaguucgcgag

SEQ ID NO: 91777 - RNA, 22 nt, Escherichia coli CFT073
gcguugauacuauguauggggu

SEQ ID NO: 91778 - RNA, 22 nt, Escherichia coli CFT073
caaauugccgagaagcugcugc

SEQ ID NO: 91779 - RNA, 22 nt, Escherichia coli CFT073
uaaucgggucaccaaauaugaa

SEQ ID NO: 91780 - RNA, 22 nt, Escherichia coli CFT073
uugaugucaucagccagcuuac

SEQ ID NO: 91781 - RNA, 22 nt, Escherichia coli CFT073
uccuuauuugcaagagguggcg

SEQ ID NO: 91782 - RNA, 22 nt, Escherichia coli CFT073
aggccggauaagcgaagcgcau

SEQ ID NO: 91783 - RNA, 22 nt, Escherichia coli CFT073
gcagaauuuuguccgauagugg

SEQ ID NO: 91784 - RNA, 22 nt, Escherichia coli CFT073
ugucggcuuuaaccucucuuua

SEQ ID NO: 91785 - RNA, 22 nt, Escherichia coli CFT073
cgaugauaugcaucaccuggga

SEQ ID NO: 91786 - RNA, 22 nt, Escherichia coli CFT073
gcuugaucaccagcaccgguau

SEQ ID NO: 91787 - RNA, 22 nt, Escherichia coli CFT073
uugcucauauagauaauuuacu

SEQ ID NO: 91788 - RNA, 22 nt, Escherichia coli CFT073
cggcgauuagcgucgaauuugu

SEQ ID NO: 91789 - RNA, 22 nt, Escherichia coli CFT073
ccgcuguacgucaaugcggcag

SEQ ID NO: 91790 - RNA, 20 nt, Escherichia coli CFT073
ucucccuguugucuggcuga

SEQ ID NO: 91791 - RNA, 21 nt, Escherichia coli CFT073
gcugccguaugccguggcucc

SEQ ID NO: 91792 - RNA, 22 nt, Escherichia coli CFT073
auuacagacugcccgcuugugg

SEQ ID NO: 91793 - RNA, 22 nt, Escherichia coli CFT073
gcacauugauuuccugaaaguu

SEQ ID NO: 91794 - RNA, 22 nt, Escherichia coli CFT073
ugcgcggauaauuauuuuguga

SEQ ID NO: 91795 - RNA, 22 nt, Escherichia coli CFT073
ccggcgugccaacaggcguaac

SEQ ID NO: 91796 - RNA, 22 nt, Escherichia coli CFT073
uaauaucaaaaagugcuuaagg

SEQ ID NO: 91797 - RNA, 22 nt, Escherichia coli CFT073
aguaaacaggcggccaaugugu

SEQ ID NO: 91798 - RNA, 23 nt, Escherichia coli CFT073
ugcaggacgugacuuuuucguca

SEQ ID NO: 91799 - RNA, 22 nt, Escherichia coli CFT073
cccgaugaugacagcagccgga

SEQ ID NO: 91800 - RNA, 22 nt, Escherichia coli CFT073
ggcgauaaucgacgugauggca

SEQ ID NO: 91801 - RNA, 22 nt, Escherichia coli CFT073
uuucccagcuggaaauggugcu

SEQ ID NO: 91802 - RNA, 22 nt, Escherichia coli CFT073
ugaauacacggagcaaugucgc

SEQ ID NO: 91803 - RNA, 22 nt, Escherichia coli CFT073
agcgacgcauaaaucgaugggg

SEQ ID NO: 91804 - RNA, 22 nt, Escherichia coli CFT073
ggggcaauacugucaccaucga

SEQ ID NO: 91805 - RNA, 22 nt, Escherichia coli CFT073
auuuaauuacaguccagagcug

SEQ ID NO: 91806 - RNA, 22 nt, Escherichia coli CFT073
caggugguuagagcgcaccccu

SEQ ID NO: 91807 - RNA, 22 nt, Escherichia coli CFT073
aaugaaacuggcagcgcaguua

SEQ ID NO: 91808 - RNA, 22 nt, Escherichia coli CFT073
uuguaaauuuccucuuugcuaa

SEQ ID NO: 91809 - RNA, 22 nt, Escherichia coli CFT073
aaacgucgauggcuuuugcgau

SEQ ID NO: 91810 - RNA, 22 nt, Escherichia coli CFT073
aucacugaggaugucguuauca

SEQ ID NO: 91811 - RNA, 22 nt, Escherichia coli CFT073
cgggaugagaaaccgaugcuca

SEQ ID NO: 91812 - RNA, 22 nt, Escherichia coli CFT073
agggcgaucagauauucaugaa

SEQ ID NO: 91813 - RNA, 22 nt, Escherichia coli CFT073
agcaggaaaaaccgauuuagcg

SEQ ID NO: 91814 - RNA, 22 nt, Escherichia coli CFT073
auucucgcguuucagugauuug

SEQ ID NO: 91815 - RNA, 22 nt, Escherichia coli CFT073
acgcacgcuugaagaugauguu

SEQ ID NO: 91816 - RNA, 22 nt, Escherichia coli CFT073
aggaguugguguuaccauugca

SEQ ID NO: 91817 - RNA, 22 nt, Escherichia coli CFT073
gcuaugaacaugcaaaucacca

SEQ ID NO: 91818 - RNA, 22 nt, Escherichia coli CFT073
aauauuugugguuuaccuucug

SEQ ID NO: 91819 - RNA, 22 nt, Escherichia coli CFT073
cagggauaucguggcggaauga

SEQ ID NO: 91820 - RNA, 22 nt, Escherichia coli CFT073
caccaacguuggggcuggauua

SEQ ID NO: 91821 - RNA, 22 nt, Escherichia coli CFT073
aaucaucuccguucaccagucc

SEQ ID NO: 91822 - RNA, 22 nt, Escherichia coli CFT073
ugagcauuuauuaaaaccgcua

SEQ ID NO: 91823 - RNA, 22 nt, Escherichia coli CFT073
auggcaauugccgguucgcugg

SEQ ID NO: 91824 - RNA, 22 nt, Escherichia coli CFT073
ugcaaauaguaaugagaacgac

SEQ ID NO: 91825 - RNA, 22 nt, Escherichia coli CFT073
acuauuaauaugguaagugaca

SEQ ID NO: 91826 - RNA, 22 nt, Escherichia coli CFT073
cgcgacuucggucagggugucg

SEQ ID NO: 91827 - RNA, 22 nt, Escherichia coli CFT073
aggcggcuaacauaaaaagcca

SEQ ID NO: 91828 - RNA, 22 nt, Escherichia coli CFT073
gaggcggagaaugaugccacag

SEQ ID NO: 91829 - RNA, 21 nt, Escherichia coli CFT073
gcgaaagacaaaggaaauuua

SEQ ID NO: 91830 - RNA, 22 nt, Escherichia coli CFT073
auuagcgacaacauucgugcca

SEQ ID NO: 91831 - RNA, 22 nt, Escherichia coli CFT073
gauagcguacaacuggacgagc

SEQ ID NO: 91832 - RNA, 22 nt, Escherichia coli CFT073
aaugcaguagucgcagcggaag

SEQ ID NO: 91833 - RNA, 23 nt, Escherichia coli CFT073
agauuucuucaaaaccacgacca

SEQ ID NO: 91834 - RNA, 22 nt, Escherichia coli CFT073
ggcaugcaggagaacaauggcu

SEQ ID NO: 91835 - RNA, 22 nt, Escherichia coli CFT073
cuggcgucuugucguaauguuu

SEQ ID NO: 91836 - RNA, 22 nt, Escherichia coli CFT073
uucgcguuguauaacaugguga

SEQ ID NO: 91837 - RNA, 22 nt, Escherichia coli CFT073
cacccggacacgauccuuggca

SEQ ID NO: 91838 - RNA, 22 nt, Escherichia coli CFT073
gacgaacggcaguauugcuucc

SEQ ID NO: 91839 - RNA, 22 nt, Escherichia coli CFT073
ggucgccugcggcaacggcuuu

SEQ ID NO: 91840 - RNA, 22 nt, Escherichia coli CFT073
aucuggcgaaugcguccuggau

SEQ ID NO: 91841 - RNA, 22 nt, Escherichia coli CFT073
uugcugaauaucggcgaagugc

SEQ ID NO: 91842 - RNA, 22 nt, Escherichia coli CFT073
agugccauuuacgaacauuaag

SEQ ID NO: 91843 - RNA, 22 nt, Escherichia coli CFT073
uggggauguuaagcuggaguug

SEQ ID NO: 91844 - RNA, 22 nt, Escherichia coli CFT073
augagacacgguuguagccuga

SEQ ID NO: 91845 - RNA, 19 nt, Escherichia coli CFT073
ugcaucguguuauuuucug

SEQ ID NO: 91846 - RNA, 22 nt, Escherichia coli CFT073
gcgagcagcaucagacgcuugc

SEQ ID NO: 91847 - RNA, 22 nt, Escherichia coli CFT073
acagccuggaaggcaacgcggu

SEQ ID NO: 91848 - RNA, 22 nt, Escherichia coli CFT073
gaugauuauguuguugauaucc

SEQ ID NO: 91849 - RNA, 22 nt, Escherichia coli CFT073
cauaccaacguacuggcucugc

SEQ ID NO: 91850 - RNA, 22 nt, Escherichia coli CFT073
cagaccaugaucgcgacauuaa

SEQ ID NO: 91851 - RNA, 22 nt, Escherichia coli CFT073
gaugcgacgcugacgcgucuua

SEQ ID NO: 91852 - RNA, 22 nt, Escherichia coli CFT073
aaaaguggaaacagguuauccc

SEQ ID NO: 91853 - RNA, 22 nt, Escherichia coli CFT073
ugcacguuacggaaggcaaaaa

SEQ ID NO: 91854 - RNA, 22 nt, Escherichia coli CFT073
uauggcaaucaucgacaaacgu

SEQ ID NO: 91855 - RNA, 22 nt, Escherichia coli CFT073
uucggcgcaaugaugggcgcac

SEQ ID NO: 91856 - RNA, 22 nt, Escherichia coli CFT073
uuggcagucaggccaggaugcu

SEQ ID NO: 91857 - RNA, 22 nt, Escherichia coli CFT073
cggcggaaugggaaugggcauu

SEQ ID NO: 91858 - RNA, 22 nt, Escherichia coli CFT073
ucaaggagagcuauaucgcagc

SEQ ID NO: 91859 - RNA, 22 nt, Escherichia coli CFT073
ccggaaaccaauggucagguag

SEQ ID NO: 91860 - RNA, 22 nt, Escherichia coli CFT073
uguaauuaaaaccuggcucaua

SEQ ID NO: 91861 - RNA, 22 nt, Escherichia coli CFT073
uuacugcgucagggaaaaccag

SEQ ID NO: 91862 - RNA, 22 nt, Escherichia coli CFT073
cggagcgaaacggcacaaccau

SEQ ID NO: 91863 - RNA, 22 nt, Escherichia coli CFT073
uggcgaaucagcgauuuuugcu

SEQ ID NO: 91864 - RNA, 22 nt, Escherichia coli CFT073
caaagugugucgucggcauggu

SEQ ID NO: 91865 - RNA, 16 nt, Escherichia coli CFT073
ggcagcuggugccauu

SEQ ID NO: 91866 - RNA, 22 nt, Escherichia coli CFT073
gaagccaugcuauacgguucca

SEQ ID NO: 91867 - RNA, 22 nt, Escherichia coli CFT073
guguuuuaucuggccuacaaug

SEQ ID NO: 91868 - RNA, 22 nt, Escherichia coli CFT073
ucauugcauaucaugaagguau

SEQ ID NO: 91869 - RNA, 22 nt, Escherichia coli CFT073
acgauuuguccgcagcgaguuu

SEQ ID NO: 91870 - RNA, 22 nt, Escherichia coli CFT073
cgugauaacuaucgucugguug

SEQ ID NO: 91871 - RNA, 22 nt, Escherichia coli CFT073
cgugcugcggcuggaugcuauu

SEQ ID NO: 91872 - RNA, 22 nt, Escherichia coli CFT073
guuggugcuggggcuacaugcc

SEQ ID NO: 91873 - RNA, 22 nt, Escherichia coli CFT073
cggcgcaucguggagcacggca

SEQ ID NO: 91874 - RNA, 22 nt, Escherichia coli CFT073
guuuaccguuuuauagaugaca

SEQ ID NO: 91875 - RNA, 22 nt, Escherichia coli CFT073
guaaaagguauguaacagacca

SEQ ID NO: 91876 - RNA, 22 nt, Escherichia coli CFT073
cgcgauguugugugcagcaagc

SEQ ID NO: 91877 - RNA, 20 nt, Escherichia coli CFT073
ugaauuguuuggucgucagc

SEQ ID NO: 91878 - RNA, 22 nt, Escherichia coli CFT073
aaaaccuuacauuaacgcuggu

SEQ ID NO: 91879 - RNA, 22 nt, Escherichia coli CFT073
uuucuuguagauagucggcaaa

SEQ ID NO: 91880 - RNA, 22 nt, Escherichia coli CFT073
agcagacaaacagcgucgaggu

SEQ ID NO: 91881 - RNA, 22 nt, Escherichia coli CFT073
aacgacgaacgcaaacugaaug

SEQ ID NO: 91882 - RNA, 22 nt, Escherichia coli CFT073
ccuggcugcaggaacaccaugu

SEQ ID NO: 91883 - RNA, 22 nt, Escherichia coli CFT073
uugaggaucgccaccaagucgu

SEQ ID NO: 91884 - RNA, 22 nt, Escherichia coli CFT073
uucuccgcgagaauguaaccag

SEQ ID NO: 91885 - RNA, 22 nt, Escherichia coli CFT073
caggauaaugaauacagagggg

SEQ ID NO: 91886 - RNA, 22 nt, Escherichia coli CFT073
aacgaugaacuuuuuugccauu

SEQ ID NO: 91887 - RNA, 22 nt, Escherichia coli CFT073
gaucgguaucgucaaacagcga

SEQ ID NO: 91888 - RNA, 22 nt, Escherichia coli CFT073
aaaucgucugcgcuaucuggua

SEQ ID NO: 91889 - RNA, 21 nt, Escherichia coli CFT073
cccgugauguugucaggugca

SEQ ID NO: 91890 - RNA, 22 nt, Escherichia coli CFT073
caggccuacgaucuucuugcaa

SEQ ID NO: 91891 - RNA, 19 nt, Escherichia coli CFT073
aacugcccgcuuccgcuuc

SEQ ID NO: 91892 - RNA, 22 nt, Escherichia coli CFT073
uuccuucguugauggaguaggu

SEQ ID NO: 91893 - RNA, 22 nt, Escherichia coli CFT073
gcuuuccagcaugacaguuugg

SEQ ID NO: 91894 - RNA, 22 nt, Escherichia coli CFT073
gcguaauaccgaacaguucaac

SEQ ID NO: 91895 - RNA, 22 nt, Escherichia coli CFT073
uguuaauucugcgacgauuacc

SEQ ID NO: 91896 - RNA, 22 nt, Escherichia coli CFT073
ugaaaaugacucugucggguuu

SEQ ID NO: 91897 - RNA, 18 nt, Escherichia coli CFT073
uuugcugaaacaucgcua

SEQ ID NO: 91898 - RNA, 22 nt, Escherichia coli CFT073
ggugauguugauaaggcguuaa

SEQ ID NO: 91899 - RNA, 22 nt, Escherichia coli CFT073
aucgugugaaagcaggggaacu

SEQ ID NO: 91900 - RNA, 22 nt, Escherichia coli CFT073
cucuaacgccagcugcgaagug

SEQ ID NO: 91901 - RNA, 22 nt, Escherichia coli CFT073
acaugaagauaaccugaucguu

SEQ ID NO: 91902 - RNA, 22 nt, Escherichia coli CFT073
ucagggguugagaaaugcguaa

SEQ ID NO: 91903 - RNA, 22 nt, Escherichia coli CFT073
uccggccuacaaagucuugcua

SEQ ID NO: 91904 - RNA, 22 nt, Escherichia coli CFT073
aggguugacgugauagagguuu

SEQ ID NO: 91905 - RNA, 22 nt, Escherichia coli CFT073
cguauugcguaaucgucuggac

SEQ ID NO: 91906 - RNA, 22 nt, Escherichia coli CFT073
auguuuuaagcucugugagcga

SEQ ID NO: 91907 - RNA, 22 nt, Escherichia coli CFT073
ucaugaaaucgacauguacgca

SEQ ID NO: 91908 - RNA, 20 nt, Escherichia coli CFT073
acugcacgugucucaggaug

SEQ ID NO: 91909 - RNA, 22 nt, Escherichia coli CFT073
agcaacugacgcuucggauccc

SEQ ID NO: 91910 - RNA, 22 nt, Escherichia coli CFT073
gugugcaaagacugauagccgu

SEQ ID NO: 91911 - RNA, 22 nt, Escherichia coli CFT073
uucuggucuucuuuacugacgc

SEQ ID NO: 91912 - RNA, 22 nt, Escherichia coli CFT073
augugccuuauuccguauucau

SEQ ID NO: 91913 - RNA, 22 nt, Escherichia coli CFT073
augccuuauccggccuacaaag

SEQ ID NO: 91914 - RNA, 22 nt, Escherichia coli CFT073
agcgccaagguugagagagucg

SEQ ID NO: 91915 - RNA, 22 nt, Escherichia coli CFT073
ucugccgccgcaggaagggcgc

SEQ ID NO: 91916 - RNA, 22 nt, Escherichia coli CFT073
auggcauuuggcaacauaugac

SEQ ID NO: 91917 - RNA, 22 nt, Escherichia coli CFT073
ccagccaggcuuucaucgccgc

SEQ ID NO: 91918 - RNA, 19 nt, Escherichia coli CFT073
accuuauccauauuuacgc

SEQ ID NO: 91919 - RNA, 22 nt, Escherichia coli CFT073
caucacuuuugaccagcuggug

SEQ ID NO: 91920 - RNA, 22 nt, Escherichia coli CFT073
cggaaugcuggacuuguugugu

SEQ ID NO: 91921 - RNA, 22 nt, Escherichia coli CFT073
gcccggaaagacagaugagcac

SEQ ID NO: 91922 - RNA, 22 nt, Escherichia coli CFT073
ugggcaaugcccuguacgacau

SEQ ID NO: 91923 - RNA, 19 nt, Escherichia coli CFT073
gcgaacacuucaucuuuac

SEQ ID NO: 91924 - RNA, 22 nt, Escherichia coli CFT073
accaaugaaaaugaucaggugg

SEQ ID NO: 91925 - RNA, 22 nt, Escherichia coli CFT073
cgccagcaaaauggcgacggcg

SEQ ID NO: 91926 - RNA, 22 nt, Escherichia coli CFT073
ugguaauucacucccuguucgc

SEQ ID NO: 91927 - RNA, 22 nt, Escherichia coli CFT073
cuucgcuggugggggcuacgcg

SEQ ID NO: 91928 - RNA, 22 nt, Escherichia coli CFT073
uccugauugcggugcucggaua

SEQ ID NO: 91929 - RNA, 22 nt, Escherichia coli CFT073
uuuuaucaguaauaccgugaau

SEQ ID NO: 91930 - RNA, 23 nt, Escherichia coli CFT073
aagaguugauaaaaaucgacagg

SEQ ID NO: 91931 - RNA, 22 nt, Escherichia coli CFT073
uguaggccggauaaggcguuua

SEQ ID NO: 91932 - RNA, 22 nt, Escherichia coli CFT073
augguugaugacgaagagcugc

SEQ ID NO: 91933 - RNA, 22 nt, Escherichia coli CFT073
aggaagaugccucucaguugcg

SEQ ID NO: 91934 - RNA, 22 nt, Escherichia coli CFT073
uggcgcaugaaguacguaaucc

SEQ ID NO: 91935 - RNA, 22 nt, Escherichia coli CFT073
accgauguaggaagucacuucg

SEQ ID NO: 91936 - RNA, 22 nt, Escherichia coli CFT073
uuaugguuuuauaugggauaag

SEQ ID NO: 91937 - RNA, 22 nt, Escherichia coli CFT073
agaaacuggcggcagaugacga

SEQ ID NO: 91938 - RNA, 22 nt, Escherichia coli CFT073
cugcaacuggcugauggcagca

SEQ ID NO: 91939 - RNA, 22 nt, Escherichia coli CFT073
uauccgcucuguucauugauug

SEQ ID NO: 91940 - RNA, 22 nt, Escherichia coli CFT073
gcgagaaacaggaugaggugaa

SEQ ID NO: 91941 - RNA, 22 nt, Escherichia coli CFT073
uagauacugacgauuacguaau

SEQ ID NO: 91942 - RNA, 23 nt, Escherichia coli CFT073
uccgccugccaguaggcaaugaa

SEQ ID NO: 91943 - RNA, 22 nt, Escherichia coli CFT073
gucgcggauaugcugcaucgca

SEQ ID NO: 91944 - RNA, 22 nt, Escherichia coli CFT073
uucaauguugcaugccgcaucu

SEQ ID NO: 91945 - RNA, 22 nt, Escherichia coli CFT073
caggaguuggcgaugaaugacc

SEQ ID NO: 91946 - RNA, 22 nt, Escherichia coli CFT073
aucacaaucgcuguuaucaaca

SEQ ID NO: 91947 - RNA, 22 nt, Escherichia coli CFT073
aucaggaguuuaccugccagcc

SEQ ID NO: 91948 - RNA, 22 nt, Escherichia coli CFT073
ucacccguguacgucugcaacu

SEQ ID NO: 91949 - RNA, 22 nt, Escherichia coli CFT073
guuuguugauuggcgcagaggu

SEQ ID NO: 91950 - RNA, 22 nt, Escherichia coli CFT073
uagcaugugauucaauguaagc

SEQ ID NO: 91951 - RNA, 22 nt, Escherichia coli CFT073
cggaauaaacgauacaacccag

SEQ ID NO: 91952 - RNA, 22 nt, Escherichia coli CFT073
augauguucuuaucaaugcaga

SEQ ID NO: 91953 - RNA, 22 nt, Escherichia coli CFT073
guuaaugacuaacacaccggca

SEQ ID NO: 91954 - RNA, 22 nt, Escherichia coli CFT073
acuaugugacccaucaacacgc

SEQ ID NO: 91955 - RNA, 22 nt, Escherichia coli CFT073
auugcaucaugcaaacaugcgu

SEQ ID NO: 91956 - RNA, 22 nt, Escherichia coli CFT073
uacgcagugguaucccgcgcgu

SEQ ID NO: 91957 - RNA, 22 nt, Escherichia coli CFT073
auuugcaaugauuguaggccgg

SEQ ID NO: 91958 - RNA, 22 nt, Escherichia coli CFT073
guugugcucguuacccgcguaa

SEQ ID NO: 91959 - RNA, 22 nt, Escherichia coli CFT073
cucguucacguaucaccgcauc

SEQ ID NO: 91960 - RNA, 22 nt, Escherichia coli CFT073
acggauaaucguuugcaugaug

SEQ ID NO: 91961 - RNA, 23 nt, Escherichia coli CFT073
ucuggcaucacuucuuuguucgg

SEQ ID NO: 91962 - RNA, 22 nt, Escherichia coli CFT073
guuaucgacguauuccagacgg

SEQ ID NO: 91963 - RNA, 22 nt, Escherichia coli CFT073
aaacugcucaauccguugcagg

SEQ ID NO: 91964 - RNA, 22 nt, Escherichia coli CFT073
guggcgauuauugucguacucg

SEQ ID NO: 91965 - RNA, 22 nt, Escherichia coli CFT073
caguuccgcagaagauugaucg

SEQ ID NO: 91966 - RNA, 22 nt, Escherichia coli CFT073
cuguaauaucuuaaucucuggu

SEQ ID NO: 91967 - RNA, 21 nt, Escherichia coli CFT073
ugcccugagcgaguuuaccgg

SEQ ID NO: 91968 - RNA, 22 nt, Escherichia coli CFT073
gguacagguacguggcaauacc

SEQ ID NO: 91969 - RNA, 22 nt, Escherichia coli CFT073
uuaucgcugcgacuaaccgucc

SEQ ID NO: 91970 - RNA, 22 nt, Escherichia coli CFT073
aacggucaucaagaaaucacau

SEQ ID NO: 91971 - RNA, 22 nt, Escherichia coli CFT073
guuaaugucgcgaucauggucu

SEQ ID NO: 91972 - RNA, 22 nt, Escherichia coli CFT073
gccagccgcuacugcgguuuuc

SEQ ID NO: 91973 - RNA, 20 nt, Escherichia coli CFT073
agauaucaacgccgcugaaa

SEQ ID NO: 91974 - RNA, 22 nt, Escherichia coli CFT073
uuggcggcacaaagugagugcc

SEQ ID NO: 91975 - RNA, 22 nt, Escherichia coli CFT073
cacugacugaaacguuuuugcc

SEQ ID NO: 91976 - RNA, 22 nt, Escherichia coli CFT073
ggcagcgcguagaauuuaccuu

SEQ ID NO: 91977 - RNA, 17 nt, Escherichia coli CFT073
uuuguaggccggauaag

SEQ ID NO: 91978 - RNA, 23 nt, Escherichia coli CFT073
ggcugcugucaucaucgggcggg

SEQ ID NO: 91979 - RNA, 22 nt, Escherichia coli CFT073
aucgcuucgcggauaauuuccc

SEQ ID NO: 91980 - RNA, 22 nt, Escherichia coli CFT073
cgauggaagcgcguaacuaugg

SEQ ID NO: 91981 - RNA, 23 nt, Escherichia coli CFT073
agggugaaaauacguugauaggc

SEQ ID NO: 91982 - RNA, 22 nt, Escherichia coli CFT073
aaucgcuacauguuaacacaca

SEQ ID NO: 91983 - RNA, 20 nt, Escherichia coli CFT073
ucaccagcaucacggagcug

SEQ ID NO: 91984 - RNA, 22 nt, Escherichia coli CFT073
ccgccacaccgcuuugaucgcc

SEQ ID NO: 91985 - RNA, 22 nt, Escherichia coli CFT073
cuaucgguggucgucgagcaac

SEQ ID NO: 91986 - RNA, 22 nt, Escherichia coli CFT073
ggucaucggcaugugcagcaga

SEQ ID NO: 91987 - RNA, 22 nt, Escherichia coli CFT073
ucaccauuugagcagugaggag

SEQ ID NO: 91988 - RNA, 22 nt, Escherichia coli CFT073
acaccagcaaacaggaggguua

SEQ ID NO: 91989 - RNA, 22 nt, Escherichia coli CFT073
gcuucggcauugcaucccacag

SEQ ID NO: 91990 - RNA, 22 nt, Escherichia coli CFT073
uguuagcuaugacggcgauugu

SEQ ID NO: 91991 - RNA, 22 nt, Escherichia coli CFT073
uggcaccuucauucuuaauggc

SEQ ID NO: 91992 - RNA, 22 nt, Escherichia coli CFT073
uacgccuuucuggcgcaccaug

SEQ ID NO: 91993 - RNA, 22 nt, Escherichia coli CFT073
ggcguuaugccgcugguuauca

SEQ ID NO: 91994 - RNA, 22 nt, Escherichia coli CFT073
gcgccacguuguagggcguuaa

SEQ ID NO: 91995 - RNA, 22 nt, Escherichia coli CFT073
ugaggcugcgcagcagucgcca

SEQ ID NO: 91996 - RNA, 22 nt, Escherichia coli CFT073
uggugucggcacacaguaaaaa

SEQ ID NO: 91997 - RNA, 22 nt, Escherichia coli CFT073
ugaauacacagugcaguguuua

SEQ ID NO: 91998 - RNA, 22 nt, Escherichia coli CFT073
gcccuuuuuuacuuaguagaga

SEQ ID NO: 91999 - RNA, 22 nt, Escherichia coli CFT073
ggccuguaugagcuuuuccccg

SEQ ID NO: 92000 - RNA, 22 nt, Escherichia coli CFT073
aaugagcgccgccuguuuuucu

SEQ ID NO: 92001 - RNA, 22 nt, Escherichia coli CFT073
ccguaagccgcuggaugagauu

SEQ ID NO: 92002 - RNA, 22 nt, Escherichia coli CFT073
acagcggaggugaugaugaaag

SEQ ID NO: 92003 - RNA, 22 nt, Escherichia coli CFT073
gguauugcucacuggcagaccg

SEQ ID NO: 92004 - RNA, 22 nt, Escherichia coli CFT073
ugccgugucgccggugguugcu

SEQ ID NO: 92005 - RNA, 22 nt, Escherichia coli CFT073
auccggccgggaguggagguga

SEQ ID NO: 92006 - RNA, 22 nt, Escherichia coli CFT073
cgaagccggauuccugcaagaa

SEQ ID NO: 92007 - RNA, 22 nt, Escherichia coli CFT073
guacgaugaacggcgguaaaga

SEQ ID NO: 92008 - RNA, 19 nt, Escherichia coli CFT073
gcauuauugguagcgccuu

SEQ ID NO: 92009 - RNA, 22 nt, Escherichia coli CFT073
cagcuucgauggcgcuauugag

SEQ ID NO: 92010 - RNA, 22 nt, Escherichia coli CFT073
ugauuuuggacaaguaucaaaa

SEQ ID NO: 92011 - RNA, 20 nt, Escherichia coli CFT073
uuuugaccaacagugcuggc

SEQ ID NO: 92012 - RNA, 22 nt, Escherichia coli CFT073
aucagcaacgcauuguggcggu

SEQ ID NO: 92013 - RNA, 22 nt, Escherichia coli CFT073
uaucggugaugcuugacgccuu

SEQ ID NO: 92014 - RNA, 22 nt, Escherichia coli CFT073
ccaguuugucucagguacggcu

SEQ ID NO: 92015 - RNA, 22 nt, Escherichia coli CFT073
ugcaugagcuggcuuucgcuga

SEQ ID NO: 92016 - RNA, 22 nt, Escherichia coli CFT073
gauccgggcuaucugcgcuggu

SEQ ID NO: 92017 - RNA, 22 nt, Escherichia coli CFT073
guaaacauugcaccagcgccca

SEQ ID NO: 92018 - RNA, 22 nt, Escherichia coli CFT073
caggccuacgaaaacucugcaa

SEQ ID NO: 92019 - RNA, 19 nt, Escherichia coli CFT073
guaccgaucgcguguaucu

SEQ ID NO: 92020 - RNA, 22 nt, Escherichia coli CFT073
gguaugcguggcgcgcguguuc

SEQ ID NO: 92021 - RNA, 22 nt, Escherichia coli CFT073
ugccaguacgcagcuucuugcu

SEQ ID NO: 92022 - RNA, 22 nt, Escherichia coli CFT073
uugagugugauggccugcuuau

SEQ ID NO: 92023 - RNA, 22 nt, Escherichia coli CFT073
guuagauaauugcaauggcagu

SEQ ID NO: 92024 - RNA, 19 nt, Escherichia coli CFT073
ggauuugaagcacuauuaa

SEQ ID NO: 92025 - RNA, 20 nt, Escherichia coli CFT073
cuuagccgugugucucgcgu

SEQ ID NO: 92026 - RNA, 22 nt, Escherichia coli CFT073
ugcucaguccgguuggugauuu

SEQ ID NO: 92027 - RNA, 22 nt, Escherichia coli CFT073
gugacgaaguugagaauaccgc

SEQ ID NO: 92028 - RNA, 22 nt, Escherichia coli CFT073
cgcaaaacgcuccauggagaug

SEQ ID NO: 92029 - RNA, 22 nt, Escherichia coli CFT073
acaucgacaggaagcgucaguc

SEQ ID NO: 92030 - RNA, 22 nt, Escherichia coli CFT073
aagcaucaaugcaggcgguaag

SEQ ID NO: 92031 - RNA, 22 nt, Escherichia coli CFT073
agagcgaaucgaaaagcguggg

SEQ ID NO: 92032 - RNA, 16 nt, Escherichia coli CFT073
ugcuggaacaaccgga

SEQ ID NO: 92033 - RNA, 22 nt, Escherichia coli CFT073
uaaacgauguuguucugcugca

SEQ ID NO: 92034 - RNA, 22 nt, Escherichia coli CFT073
guauuacucagcaucgauuuca

SEQ ID NO: 92035 - RNA, 22 nt, Escherichia coli CFT073
ugccauuaaccguuucagccuc

SEQ ID NO: 92036 - RNA, 22 nt, Escherichia coli CFT073
gcuggguuggggagaaauaagc

SEQ ID NO: 92037 - RNA, 20 nt, Escherichia coli CFT073
gcgcaauccgacuaaaaggu

SEQ ID NO: 92038 - RNA, 22 nt, Escherichia coli CFT073
acuggcucuggaagcggguuug

SEQ ID NO: 92039 - RNA, 22 nt, Escherichia coli CFT073
gaucuucuucacagauuauagc

SEQ ID NO: 92040 - RNA, 22 nt, Escherichia coli CFT073
ucaccagcaacagacggcgaau

SEQ ID NO: 92041 - RNA, 22 nt, Escherichia coli CFT073
gaccggucguuucguuaucggu

SEQ ID NO: 92042 - RNA, 22 nt, Escherichia coli CFT073
gacgagcugcaggaacguaugg

SEQ ID NO: 92043 - RNA, 22 nt, Escherichia coli CFT073
ucgguaucgggauuauuuauca

SEQ ID NO: 92044 - RNA, 22 nt, Escherichia coli CFT073
aaacgcaucgguaugauugcgc

SEQ ID NO: 92045 - RNA, 22 nt, Escherichia coli CFT073
caacacuuuuugcugauugccg

SEQ ID NO: 92046 - RNA, 20 nt, Escherichia coli CFT073
aauggcuguaggguggggaa

SEQ ID NO: 92047 - RNA, 22 nt, Escherichia coli CFT073
uggcaaugugccggagcuggcg

SEQ ID NO: 92048 - RNA, 19 nt, Escherichia coli CFT073
agcucagacggggaguggu

SEQ ID NO: 92049 - RNA, 22 nt, Escherichia coli CFT073
agaaccgguuuugaaucagcgg

SEQ ID NO: 92050 - RNA, 22 nt, Escherichia coli CFT073
aggccgaagcgaucgauaagcu

SEQ ID NO: 92051 - RNA, 22 nt, Escherichia coli CFT073
gcgcguugaaucuccucuguau

SEQ ID NO: 92052 - RNA, 22 nt, Escherichia coli CFT073
uugaugcucagucugcugauca

SEQ ID NO: 92053 - RNA, 22 nt, Escherichia coli CFT073
ucaucguuauucauuaacggca

SEQ ID NO: 92054 - RNA, 22 nt, Escherichia coli CFT073
ugacagguuugccauccagcaa

SEQ ID NO: 92055 - RNA, 22 nt, Escherichia coli CFT073
aaccgggugauaaagaccguga

SEQ ID NO: 92056 - RNA, 22 nt, Escherichia coli CFT073
gcugcgaugcuucagguuucau

SEQ ID NO: 92057 - RNA, 22 nt, Escherichia coli CFT073
aggcggaaauacucgccgcgga

SEQ ID NO: 92058 - RNA, 22 nt, Escherichia coli CFT073
uuucaucgccugcucaaaacuc

SEQ ID NO: 92059 - RNA, 22 nt, Escherichia coli CFT073
gcgacaguaaugauucaucgcc

SEQ ID NO: 92060 - RNA, 22 nt, Escherichia coli CFT073
guuucacuccaaccuguucaag

SEQ ID NO: 92061 - RNA, 22 nt, Escherichia coli CFT073
gcgucaugcagucacgguugaa

SEQ ID NO: 92062 - RNA, 22 nt, Escherichia coli CFT073
ugcauccgccugcaguacacca

SEQ ID NO: 92063 - RNA, 22 nt, Escherichia coli CFT073
auugcugggagaaggcagacgu

SEQ ID NO: 92064 - RNA, 22 nt, Escherichia coli CFT073
cgucacgcugguggaucagggc

SEQ ID NO: 92065 - RNA, 22 nt, Escherichia coli CFT073
gagugaugauccgcuuuuugcc

SEQ ID NO: 92066 - RNA, 22 nt, Escherichia coli CFT073
ccgugcucuuucacugcguucg

SEQ ID NO: 92067 - RNA, 22 nt, Escherichia coli CFT073
uccgaaaauaaagccgaguaug

SEQ ID NO: 92068 - RNA, 22 nt, Escherichia coli CFT073
aucguuguagaguuugaucagg

SEQ ID NO: 92069 - RNA, 22 nt, Escherichia coli CFT073
aagcaaccagcguauggcggac

SEQ ID NO: 92070 - RNA, 23 nt, Escherichia coli CFT073
cagcguuauuaccggagagacgc

SEQ ID NO: 92071 - RNA, 22 nt, Escherichia coli CFT073
cgcugauaucagcacaggauga

SEQ ID NO: 92072 - RNA, 22 nt, Escherichia coli CFT073
auuuuccgaacaucagugauaa

SEQ ID NO: 92073 - RNA, 22 nt, Escherichia coli CFT073
guguaauggcugaaugcagcac

SEQ ID NO: 92074 - RNA, 22 nt, Escherichia coli CFT073
ucaccacguuucaggacaaacg

SEQ ID NO: 92075 - RNA, 22 nt, Escherichia coli CFT073
acggcaugagguugucacguac

SEQ ID NO: 92076 - RNA, 22 nt, Escherichia coli CFT073
ugggccguuguuaucgccgugc

SEQ ID NO: 92077 - RNA, 22 nt, Escherichia coli CFT073
auuuagaccucuaucucggugu

SEQ ID NO: 92078 - RNA, 22 nt, Escherichia coli CFT073
cguaauugccggaugcgacgca

SEQ ID NO: 92079 - RNA, 22 nt, Escherichia coli CFT073
acagcgccaauaagcgcgccga

SEQ ID NO: 92080 - RNA, 22 nt, Escherichia coli CFT073
gagguugcuacaagaucuuuua

SEQ ID NO: 92081 - RNA, 22 nt, Escherichia coli CFT073
gguggcguauauuaagguuuuu

SEQ ID NO: 92082 - RNA, 22 nt, Escherichia coli CFT073
uuuguugaaagcaagaaagcuu

SEQ ID NO: 92083 - RNA, 22 nt, Escherichia coli CFT073
ugccgacaauauugucagccuc

SEQ ID NO: 92084 - RNA, 22 nt, Escherichia coli CFT073
gugcauaaagguaaucaggcag

SEQ ID NO: 92085 - RNA, 22 nt, Escherichia coli CFT073
ucgugcuggcugguuuuaugcg

SEQ ID NO: 92086 - RNA, 22 nt, Escherichia coli CFT073
uuccgccagcggcacgcuuuuu

SEQ ID NO: 92087 - RNA, 22 nt, Escherichia coli CFT073
cuggguuguaucguuuauuccg

SEQ ID NO: 92088 - RNA, 21 nt, Escherichia coli CFT073
ggucauggucgcacaagacau

SEQ ID NO: 92089 - RNA, 22 nt, Escherichia coli CFT073
cagcgguaacgucugacuauac

SEQ ID NO: 92090 - RNA, 22 nt, Escherichia coli CFT073
uucaucacuguggcguugauug

SEQ ID NO: 92091 - RNA, 22 nt, Escherichia coli CFT073
cauuaggacgcaauggcguaca

SEQ ID NO: 92092 - RNA, 22 nt, Escherichia coli CFT073
guuucucugauugcaggcguau

SEQ ID NO: 92093 - RNA, 22 nt, Escherichia coli CFT073
guuggccgcaucagauuuauca

SEQ ID NO: 92094 - RNA, 19 nt, Escherichia coli CFT073
cgugaugcuggcuaacaaa

SEQ ID NO: 92095 - RNA, 22 nt, Escherichia coli CFT073
uggccagccagaugccacgcau

SEQ ID NO: 92096 - RNA, 22 nt, Escherichia coli CFT073
uuucgcgacaaucuggcguuuu

SEQ ID NO: 92097 - RNA, 22 nt, Escherichia coli CFT073
ucgcgccuggcugccagugccg

SEQ ID NO: 92098 - RNA, 22 nt, Escherichia coli CFT073
agagcggcggucugaucacccg

SEQ ID NO: 92099 - RNA, 22 nt, Escherichia coli CFT073
uaucagccugcaguucggcgau

SEQ ID NO: 92100 - RNA, 22 nt, Escherichia coli CFT073
ucgucguuauugcuuuacgcau

SEQ ID NO: 92101 - RNA, 22 nt, Escherichia coli CFT073
gcgugcauuugaacguucgcgg

SEQ ID NO: 92102 - RNA, 22 nt, Escherichia coli CFT073
ucgugguguaacucaggcagcg

SEQ ID NO: 92103 - RNA, 22 nt, Escherichia coli CFT073
uguggcguggguaaugcuuugc

SEQ ID NO: 92104 - RNA, 22 nt, Escherichia coli CFT073
ccgaugccgaugugaucauuga

SEQ ID NO: 92105 - RNA, 22 nt, Escherichia coli CFT073
auaggguggauggaggugaugu

SEQ ID NO: 92106 - RNA, 22 nt, Escherichia coli CFT073
ucaggaugccgaaguggaugau

SEQ ID NO: 92107 - RNA, 22 nt, Escherichia coli CFT073
cagugguuugagauugaucugu

SEQ ID NO: 92108 - RNA, 22 nt, Escherichia coli CFT073
gggucgaugaugcgcagacguu

SEQ ID NO: 92109 - RNA, 22 nt, Escherichia coli CFT073
uuucgcaucuuuguuaugcuau

SEQ ID NO: 92110 - RNA, 22 nt, Escherichia coli CFT073
caucauguauggcuuuacguag

SEQ ID NO: 92111 - RNA, 22 nt, Escherichia coli CFT073
gacuuucucguugcuuuucaga

SEQ ID NO: 92112 - RNA, 22 nt, Escherichia coli CFT073
uuauggcaaaacauuucacucc

SEQ ID NO: 92113 - RNA, 22 nt, Escherichia coli CFT073
gccgccguuuuaccggugccug

SEQ ID NO: 92114 - RNA, 22 nt, Escherichia coli CFT073
cgagcuggaaaccuuccugcug

SEQ ID NO: 92115 - RNA, 22 nt, Escherichia coli CFT073
gccugccagucaauauguuccg

SEQ ID NO: 92116 - RNA, 22 nt, Escherichia coli CFT073
uggcuuggcgaauggcugagca

SEQ ID NO: 92117 - RNA, 22 nt, Escherichia coli CFT073
gcgcacgauuguacgguaggua

SEQ ID NO: 92118 - RNA, 22 nt, Escherichia coli CFT073
aacuggcgcgcaauguuggggg

SEQ ID NO: 92119 - RNA, 22 nt, Escherichia coli CFT073
ucgacgaauuugcuauauuugc

SEQ ID NO: 92120 - RNA, 22 nt, Escherichia coli CFT073
cggcgggaaccagaaaucgucg

SEQ ID NO: 92121 - RNA, 22 nt, Escherichia coli CFT073
cgaagcugaacaguuuaucggg

SEQ ID NO: 92122 - RNA, 22 nt, Escherichia coli CFT073
ucaacguaagcgucacgcagau

SEQ ID NO: 92123 - RNA, 22 nt, Escherichia coli CFT073
gcugcuggcaacccacgcugau

SEQ ID NO: 92124 - RNA, 22 nt, Escherichia coli CFT073
ugguacgcacguuauguacgug

SEQ ID NO: 92125 - RNA, 22 nt, Escherichia coli CFT073
gcgucggaguuuguugauguaa

SEQ ID NO: 92126 - RNA, 22 nt, Escherichia coli CFT073
ucagugacugacuuaaccggga

SEQ ID NO: 92127 - RNA, 22 nt, Escherichia coli CFT073
auccgcgaauuguuaccgcgug

SEQ ID NO: 92128 - RNA, 22 nt, Escherichia coli CFT073
uuccgguaccuggagcgcgaaa

SEQ ID NO: 92129 - RNA, 22 nt, Escherichia coli CFT073
aucuuuauaaaggugguaaacg

SEQ ID NO: 92130 - RNA, 22 nt, Escherichia coli CFT073
uggcggcacaaaagcagaugaa

SEQ ID NO: 92131 - RNA, 22 nt, Escherichia coli CFT073
gguguugauuaacccaagcguu

SEQ ID NO: 92132 - RNA, 22 nt, Escherichia coli CFT073
agcaugauuucuccggugguca

SEQ ID NO: 92133 - RNA, 22 nt, Escherichia coli CFT073
gaagcgcugggccugucgcagc

SEQ ID NO: 92134 - RNA, 20 nt, Escherichia coli CFT073
ucggcgcugucaucaccggg

SEQ ID NO: 92135 - RNA, 22 nt, Escherichia coli CFT073
acgugaggaagcggugaagggg

SEQ ID NO: 92136 - RNA, 22 nt, Escherichia coli CFT073
auugggauuaugccgcagcacg

SEQ ID NO: 92137 - RNA, 22 nt, Escherichia coli CFT073
uggucguaaaguuugucauggc

SEQ ID NO: 92138 - RNA, 22 nt, Escherichia coli CFT073
ucgaucucuauuccgacguuga

SEQ ID NO: 92139 - RNA, 22 nt, Escherichia coli CFT073
acaggcuaaaccaucggaugag

SEQ ID NO: 92140 - RNA, 22 nt, Escherichia coli CFT073
ucgccgugagagcugcuaaugu

SEQ ID NO: 92141 - RNA, 22 nt, Escherichia coli CFT073
auccaauggcaguagauaaacu

SEQ ID NO: 92142 - RNA, 22 nt, Escherichia coli CFT073
ccugggaagauguaagccgcca

SEQ ID NO: 92143 - RNA, 22 nt, Escherichia coli CFT073
ugucacgauugagauuuuuuaa

SEQ ID NO: 92144 - RNA, 22 nt, Escherichia coli CFT073
ggauuuucgcugugguugcugg

SEQ ID NO: 92145 - RNA, 22 nt, Escherichia coli CFT073
agguacugcaaacgcugcagaa

SEQ ID NO: 92146 - RNA, 22 nt, Escherichia coli CFT073
guugauugagcgagugggcgag

SEQ ID NO: 92147 - RNA, 22 nt, Escherichia coli CFT073
ucuuugaugcggugccagcucu

SEQ ID NO: 92148 - RNA, 22 nt, Escherichia coli CFT073
gugcgccggguuuaucaagauu

SEQ ID NO: 92149 - RNA, 22 nt, Escherichia coli CFT073
cugcgacgagccugcgugacca

SEQ ID NO: 92150 - RNA, 22 nt, Escherichia coli CFT073
caguuuagugaguuuuaucaug

SEQ ID NO: 92151 - RNA, 22 nt, Escherichia coli CFT073
uauugcuaaugcauuggcgagu

SEQ ID NO: 92152 - RNA, 22 nt, Escherichia coli CFT073
uuguaggugcgaauuggccaau

SEQ ID NO: 92153 - RNA, 22 nt, Escherichia coli CFT073
uaggccggauaaggcguucacg

SEQ ID NO: 92154 - RNA, 22 nt, Escherichia coli CFT073
uauugcuggugugaaggucugg

SEQ ID NO: 92155 - RNA, 22 nt, Escherichia coli CFT073
uggcgcugccgcugcauccgga

SEQ ID NO: 92156 - RNA, 22 nt, Escherichia coli CFT073
gguaaaggaguucgagaaaaau

SEQ ID NO: 92157 - RNA, 22 nt, Escherichia coli CFT073
caaacgcaguucuggcaacugg

SEQ ID NO: 92158 - RNA, 22 nt, Escherichia coli CFT073
aagaauuagcugacccagcguu

SEQ ID NO: 92159 - RNA, 22 nt, Escherichia coli CFT073
cuaucgauuacgcuauuaacgg

SEQ ID NO: 92160 - RNA, 22 nt, Escherichia coli CFT073
ccaacugugaggcaagcuguuc

SEQ ID NO: 92161 - RNA, 22 nt, Escherichia coli CFT073
ccaguaaucaagacaguaccag

SEQ ID NO: 92162 - RNA, 22 nt, Escherichia coli CFT073
aauguugucggucgccauauaa

SEQ ID NO: 92163 - RNA, 22 nt, Escherichia coli CFT073
aacgguuaaggaucaauacggc

SEQ ID NO: 92164 - RNA, 22 nt, Escherichia coli CFT073
ggcgcuaagaaucaucauugac

SEQ ID NO: 92165 - RNA, 22 nt, Escherichia coli CFT073
cgccagagugcuuauugcuucc

SEQ ID NO: 92166 - RNA, 22 nt, Escherichia coli CFT073
ucgaagcgggcaacaagccgaa

SEQ ID NO: 92167 - RNA, 22 nt, Escherichia coli CFT073
uaaugaaacgacgcgcaguucc

SEQ ID NO: 92168 - RNA, 22 nt, Escherichia coli CFT073
ugacaacguuucgcggcuauuc

SEQ ID NO: 92169 - RNA, 22 nt, Escherichia coli CFT073
uagcggacgucgacuacuggaa

SEQ ID NO: 92170 - RNA, 21 nt, Escherichia coli CFT073
uugaccauugacgccgcugcg

SEQ ID NO: 92171 - RNA, 20 nt, Escherichia coli CFT073
ugacggccccgacauccauc

SEQ ID NO: 92172 - RNA, 22 nt, Escherichia coli CFT073
ucguuauucagauguacguuuc

SEQ ID NO: 92173 - RNA, 22 nt, Escherichia coli CFT073
gugauguggaacgagucgaucu

SEQ ID NO: 92174 - RNA, 20 nt, Escherichia coli CFT073
acagcacugccgcaggaggu

SEQ ID NO: 92175 - RNA, 22 nt, Escherichia coli CFT073
gguagcccuggauggagaguua

SEQ ID NO: 92176 - RNA, 22 nt, Escherichia coli CFT073
gcguggcggccuguggucuggc

SEQ ID NO: 92177 - RNA, 22 nt, Escherichia coli CFT073
uucgcggcauguguucgcugau

SEQ ID NO: 92178 - RNA, 22 nt, Escherichia coli CFT073
ccuccuuuauucugaucuccgc

SEQ ID NO: 92179 - RNA, 22 nt, Escherichia coli CFT073
ucugcugcgucuggcucauacc

SEQ ID NO: 92180 - RNA, 22 nt, Escherichia coli CFT073
uagccauaauaugccucuuuua

SEQ ID NO: 92181 - RNA, 19 nt, Escherichia coli CFT073
agcgcaccgaaaguggucg

SEQ ID NO: 92182 - RNA, 22 nt, Escherichia coli CFT073
uccuggugauguaucuguucuu

SEQ ID NO: 92183 - RNA, 22 nt, Escherichia coli CFT073
uauuucugccccgcaggucugg

SEQ ID NO: 92184 - RNA, 22 nt, Escherichia coli CFT073
ugaaauccuucacgcgcugcgu

SEQ ID NO: 92185 - RNA, 22 nt, Escherichia coli CFT073
uggacgcugauuuucugcgccc

SEQ ID NO: 92186 - RNA, 22 nt, Escherichia coli CFT073
gugcugccgaauccguuuuauc

SEQ ID NO: 92187 - RNA, 22 nt, Escherichia coli CFT073
gcguuggucaucgcuucacugc

SEQ ID NO: 92188 - RNA, 22 nt, Escherichia coli CFT073
ucacgauaaacagcccugcguu

SEQ ID NO: 92189 - RNA, 22 nt, Escherichia coli CFT073
uggcgcguggccacaucaucaa

SEQ ID NO: 92190 - RNA, 22 nt, Escherichia coli CFT073
ugacaauuauuccuucaaguca

SEQ ID NO: 92191 - RNA, 17 nt, Escherichia coli CFT073
uccggugucaucaucaa

SEQ ID NO: 92192 - RNA, 22 nt, Escherichia coli CFT073
gcgguauagaaguuauugguac

SEQ ID NO: 92193 - RNA, 22 nt, Escherichia coli CFT073
uuaauagucuucaaucuguauc

SEQ ID NO: 92194 - RNA, 22 nt, Escherichia coli CFT073
cuugccgugacaaauaaugaug

SEQ ID NO: 92195 - RNA, 22 nt, Escherichia coli CFT073
cucgaacagaauggccgugguc

SEQ ID NO: 92196 - RNA, 22 nt, Escherichia coli CFT073
aucgauuauaugcaggguuauc

SEQ ID NO: 92197 - RNA, 22 nt, Escherichia coli CFT073
acugcggucugacuggucguaa

SEQ ID NO: 92198 - RNA, 22 nt, Escherichia coli CFT073
aacgucgauuccuucuuggcaa

SEQ ID NO: 92199 - RNA, 20 nt, Escherichia coli CFT073
agaucggcacgauaucgagg

SEQ ID NO: 92200 - RNA, 22 nt, Escherichia coli CFT073
ucgauuuuuauaccaacgugcu

SEQ ID NO: 92201 - RNA, 23 nt, Escherichia coli CFT073
accagcggcaaccagccagacua

SEQ ID NO: 92202 - RNA, 22 nt, Escherichia coli CFT073
aaugcgucagcauuaugcucaa

SEQ ID NO: 92203 - RNA, 21 nt, Escherichia coli CFT073
uggcugagaagaagauucugc

SEQ ID NO: 92204 - RNA, 18 nt, Escherichia coli CFT073
ugcauaauccuucugagc

SEQ ID NO: 92205 - RNA, 19 nt, Escherichia coli CFT073
uguuggcaucaccaguggu

SEQ ID NO: 92206 - RNA, 22 nt, Escherichia coli CFT073
agggcggugaaaaugguuugau

SEQ ID NO: 92207 - RNA, 22 nt, Escherichia coli CFT073
guuugaucagaauacgaucguu

SEQ ID NO: 92208 - RNA, 22 nt, Escherichia coli CFT073
uauugcaaccguuuuugaggau

SEQ ID NO: 92209 - RNA, 22 nt, Escherichia coli CFT073
aagcguugucguugucuuccgg

SEQ ID NO: 92210 - RNA, 22 nt, Escherichia coli CFT073
ucggcagcggcggcgacaggga

SEQ ID NO: 92211 - RNA, 22 nt, Escherichia coli CFT073
augcugggcgauauauuuuuuc

SEQ ID NO: 92212 - RNA, 22 nt, Escherichia coli CFT073
ucugcguauugcaguugacguc

SEQ ID NO: 92213 - RNA, 22 nt, Escherichia coli CFT073
gagccggaaacugguuauuacg

SEQ ID NO: 92214 - RNA, 22 nt, Escherichia coli CFT073
gugaguucucugucggcaguga

SEQ ID NO: 92215 - RNA, 22 nt, Escherichia coli CFT073
gcugccuacacaaugccugaug

SEQ ID NO: 92216 - RNA, 22 nt, Escherichia coli CFT073
uauguacaauaauaagcgaaau

SEQ ID NO: 92217 - RNA, 22 nt, Escherichia coli CFT073
gaugaacuguaggcugcugcgg

SEQ ID NO: 92218 - RNA, 22 nt, Escherichia coli CFT073
auaucguugcuaauaauucuaa

SEQ ID NO: 92219 - RNA, 22 nt, Escherichia coli CFT073
ccuuuuuucugguaugccgcuc

SEQ ID NO: 92220 - RNA, 22 nt, Escherichia coli CFT073
guacugaguagggugaucgcgu

SEQ ID NO: 92221 - RNA, 22 nt, Escherichia coli CFT073
uauugcugggcaaucaggcgcu

SEQ ID NO: 92222 - RNA, 22 nt, Escherichia coli CFT073
cgggaucuucgcaaguuuagcu

SEQ ID NO: 92223 - RNA, 22 nt, Escherichia coli CFT073
uaaacacugcacuguguauuca

SEQ ID NO: 92224 - RNA, 22 nt, Escherichia coli CFT073
gcgcuucacaggaugaaugucc

SEQ ID NO: 92225 - RNA, 21 nt, Escherichia coli CFT073
gcguggaucuggaguucagca

SEQ ID NO: 92226 - RNA, 22 nt, Escherichia coli CFT073
ugcauugaagcuagccugugcg

SEQ ID NO: 92227 - RNA, 22 nt, Escherichia coli CFT073
uacacaccugugaugccguauu

SEQ ID NO: 92228 - RNA, 22 nt, Escherichia coli CFT073
aucuuaaaauaagagguaggcu

SEQ ID NO: 92229 - RNA, 22 nt, Escherichia coli CFT073
uaugcaaaacugcggcgcauua

SEQ ID NO: 92230 - RNA, 23 nt, Escherichia coli CFT073
uuccagccacucaaacucaauca

SEQ ID NO: 92231 - RNA, 22 nt, Escherichia coli CFT073
aucaacaagaacaugcugcuau

SEQ ID NO: 92232 - RNA, 22 nt, Escherichia coli CFT073
ucugaugggucgacaccggcug

SEQ ID NO: 92233 - RNA, 22 nt, Escherichia coli CFT073
ccgcaacuggcaacccgacugg

SEQ ID NO: 92234 - RNA, 23 nt, Escherichia coli CFT073
gcgaggggaccguucguacacgg

SEQ ID NO: 92235 - RNA, 22 nt, Escherichia coli CFT073
augggcggauucuugcgacagg

SEQ ID NO: 92236 - RNA, 18 nt, Escherichia coli CFT073
gaaaccgcaaugaaagcc

SEQ ID NO: 92237 - RNA, 22 nt, Escherichia coli CFT073
gagcgucuuuccggcgaggugg

SEQ ID NO: 92238 - RNA, 22 nt, Escherichia coli CFT073
cuguugcuggcagguuuuggcc

SEQ ID NO: 92239 - RNA, 22 nt, Escherichia coli CFT073
acggaagcucccccgccuguga

SEQ ID NO: 92240 - RNA, 22 nt, Escherichia coli CFT073
uuauucacacucccuucacuua

SEQ ID NO: 92241 - RNA, 22 nt, Escherichia coli CFT073
agcgaacugucgcugcuggaag

SEQ ID NO: 92242 - RNA, 21 nt, Escherichia coli CFT073
uaccggacaccugaauggcac

SEQ ID NO: 92243 - RNA, 18 nt, Escherichia coli CFT073
gccguuuuuuuaugugua

SEQ ID NO: 92244 - RNA, 22 nt, Escherichia coli CFT073
aggaucgcggcuggcugacgug

SEQ ID NO: 92245 - RNA, 22 nt, Escherichia coli CFT073
cgagcgcaucgauccgacaugg

SEQ ID NO: 92246 - RNA, 22 nt, Escherichia coli CFT073
ggguauuuuaucugcgauuuca

SEQ ID NO: 92247 - RNA, 22 nt, Escherichia coli CFT073
aauuucaaucgcgucgcccagc

SEQ ID NO: 92248 - RNA, 22 nt, Escherichia coli CFT073
ggucgcgccgggauccugguga

SEQ ID NO: 92249 - RNA, 22 nt, Escherichia coli CFT073
gguagauuguuuugccggugac

SEQ ID NO: 92250 - RNA, 22 nt, Escherichia coli CFT073
uugcugagauugauaaacugau

SEQ ID NO: 92251 - RNA, 22 nt, Escherichia coli CFT073
augccuuaucaggccuacaaau

SEQ ID NO: 92252 - RNA, 22 nt, Escherichia coli CFT073
cgggugcaguaauaucgcccug

SEQ ID NO: 92253 - RNA, 22 nt, Escherichia coli CFT073
caaugcucaugaaggugaagaa

SEQ ID NO: 92254 - RNA, 22 nt, Escherichia coli CFT073
cugagaagugaugcugucagca

SEQ ID NO: 92255 - RNA, 22 nt, Escherichia coli CFT073
aagaaauauucguuguugcgga

SEQ ID NO: 92256 - RNA, 22 nt, Escherichia coli CFT073
aggcugggcgcuaauaggagau

SEQ ID NO: 92257 - RNA, 22 nt, Escherichia coli CFT073
aagguuuucccugagcaaauuu

SEQ ID NO: 92258 - RNA, 22 nt, Escherichia coli CFT073
gcgcagaauggugcaaacggug

SEQ ID NO: 92259 - RNA, 20 nt, Escherichia coli CFT073
ucucgccagcgacucgccuc

SEQ ID NO: 92260 - RNA, 21 nt, Escherichia coli CFT073
cggcauggcgaauuuauuugu

SEQ ID NO: 92261 - RNA, 22 nt, Escherichia coli CFT073
ucgucuguugauaacagcgauu

SEQ ID NO: 92262 - RNA, 22 nt, Escherichia coli CFT073
acguaaaaacgcaaauccgacu

SEQ ID NO: 92263 - RNA, 22 nt, Escherichia coli CFT073
gugugaccaucuaaugaucgac

SEQ ID NO: 92264 - RNA, 20 nt, Escherichia coli CFT073
cgcugaugcggugcuuauca

SEQ ID NO: 92265 - RNA, 22 nt, Escherichia coli CFT073
ugggauauuccagaggagguca

SEQ ID NO: 92266 - RNA, 22 nt, Escherichia coli CFT073
aggugcgaugcucgccgucaau

SEQ ID NO: 92267 - RNA, 22 nt, Escherichia coli CFT073
ucugauuaaaucugcccguguu

SEQ ID NO: 92268 - RNA, 22 nt, Escherichia coli CFT073
uuacggugagcuuuuuacgugg

SEQ ID NO: 92269 - RNA, 18 nt, Escherichia coli CFT073
guauccacugccugugcu

SEQ ID NO: 92270 - RNA, 22 nt, Escherichia coli CFT073
ugcagaugcucauauucucgcc

SEQ ID NO: 92271 - RNA, 22 nt, Escherichia coli CFT073
ucuggcggcacucucugucccu

SEQ ID NO: 92272 - RNA, 22 nt, Escherichia coli CFT073
gguugcagacaggucguuguug

SEQ ID NO: 92273 - RNA, 22 nt, Escherichia coli CFT073
cgcugcccuacacaaugccuga

SEQ ID NO: 92274 - RNA, 18 nt, Escherichia coli CFT073
uguucuggaaaccggcga

SEQ ID NO: 92275 - RNA, 22 nt, Escherichia coli CFT073
gcuuauugucuucauuauacuu

SEQ ID NO: 92276 - RNA, 21 nt, Escherichia coli CFT073
gggcggcgcaaaucugguggc

SEQ ID NO: 92277 - RNA, 22 nt, Escherichia coli CFT073
ugcaggaccacguaggccugau

SEQ ID NO: 92278 - RNA, 22 nt, Escherichia coli CFT073
ccgcacacaacauuucaaaaga

SEQ ID NO: 92279 - RNA, 22 nt, Escherichia coli CFT073
ggcgcgcagggcaucaucgacc

SEQ ID NO: 92280 - RNA, 22 nt, Escherichia coli CFT073
uggcgucugcugcacggcgagu

SEQ ID NO: 92281 - RNA, 23 nt, Escherichia coli CFT073
uucugcucgcuaccugcuguggc

SEQ ID NO: 92282 - RNA, 22 nt, Escherichia coli CFT073
uaaggcgaaauaugacgaguau

SEQ ID NO: 92283 - RNA, 22 nt, Escherichia coli CFT073
gauuucaccaauuaagccgagg

SEQ ID NO: 92284 - RNA, 22 nt, Escherichia coli CFT073
aucacggagugcuccugcaggu

SEQ ID NO: 92285 - RNA, 22 nt, Escherichia coli CFT073
uggaggucugccagccguucug

SEQ ID NO: 92286 - RNA, 22 nt, Escherichia coli CFT073
ugcuggagcuuggcaccagcga

SEQ ID NO: 92287 - RNA, 20 nt, Escherichia coli CFT073
aggucgaugccgagaucauc

SEQ ID NO: 92288 - RNA, 22 nt, Escherichia coli CFT073
ugcuaccgacugcuuuuuuggc

SEQ ID NO: 92289 - RNA, 22 nt, Escherichia coli CFT073
gguugccgguccaguuauggaa

SEQ ID NO: 92290 - RNA, 22 nt, Escherichia coli CFT073
gauguaguaucauuccucggcg

SEQ ID NO: 92291 - RNA, 22 nt, Escherichia coli CFT073
uacugguugcccgguggagcug

SEQ ID NO: 92292 - RNA, 22 nt, Escherichia coli CFT073
aucuucuucuuccagggcguug

SEQ ID NO: 92293 - RNA, 22 nt, Escherichia coli CFT073
uagugagcuauuaguguuuggu

SEQ ID NO: 92294 - RNA, 22 nt, Escherichia coli CFT073
ucggugagaucuuacaugucgg

SEQ ID NO: 92295 - RNA, 20 nt, Escherichia coli CFT073
cacgaauauuaucgacguaa

SEQ ID NO: 92296 - RNA, 22 nt, Escherichia coli CFT073
gaggcuguaacgaucaauuucu

SEQ ID NO: 92297 - RNA, 18 nt, Escherichia coli CFT073
ugcuuguauacucacgag

SEQ ID NO: 92298 - RNA, 22 nt, Escherichia coli CFT073
uugccguugcaagggaagggcu

SEQ ID NO: 92299 - RNA, 22 nt, Escherichia coli CFT073
ucaacuucucgcuguuccaguc

SEQ ID NO: 92300 - RNA, 22 nt, Escherichia coli CFT073
ccagcuccggcacauugccaac

SEQ ID NO: 92301 - RNA, 22 nt, Escherichia coli CFT073
aacgaguuaaucaauaucacaa

SEQ ID NO: 92302 - RNA, 20 nt, Escherichia coli CFT073
aaucggcguuaucccuggcc

SEQ ID NO: 92303 - RNA, 22 nt, Escherichia coli CFT073
guugugaugggguucaccggga

SEQ ID NO: 92304 - RNA, 20 nt, Escherichia coli CFT073
accugauuaaaaauaucggc

SEQ ID NO: 92305 - RNA, 22 nt, Escherichia coli CFT073
uuguuaaugccgaugauuuugg

SEQ ID NO: 92306 - RNA, 22 nt, Escherichia coli CFT073
uacagaaaaaguuuggcaucuu

SEQ ID NO: 92307 - RNA, 22 nt, Escherichia coli CFT073
uuagcgggugacggauucggua

SEQ ID NO: 92308 - RNA, 22 nt, Escherichia coli CFT073
cugcgcggcaauaauuugguug

SEQ ID NO: 92309 - RNA, 22 nt, Escherichia coli CFT073
caaugugaucuuugucuucgcu

SEQ ID NO: 92310 - RNA, 22 nt, Escherichia coli CFT073
gaugcagcgcgaugcccgucag

SEQ ID NO: 92311 - RNA, 22 nt, Escherichia coli CFT073
ugggcgaagauuauauccgcac

SEQ ID NO: 92312 - RNA, 21 nt, Escherichia coli CFT073
aucauucaccuguuguaacuc

SEQ ID NO: 92313 - RNA, 22 nt, Escherichia coli CFT073
guaaaguccagccuuccguaug

SEQ ID NO: 92314 - RNA, 22 nt, Escherichia coli CFT073
acggauggucggcucgacgugg

SEQ ID NO: 92315 - RNA, 22 nt, Escherichia coli CFT073
uuccgguggaaaugcuugagcg

SEQ ID NO: 92316 - RNA, 22 nt, Escherichia coli CFT073
cggucagcagcaggcugccuuu

SEQ ID NO: 92317 - RNA, 22 nt, Escherichia coli CFT073
ucugcgguacacccgggaucau

SEQ ID NO: 92318 - RNA, 22 nt, Escherichia coli CFT073
gccagugucgaucauaucaucg

SEQ ID NO: 92319 - RNA, 22 nt, Escherichia coli CFT073
cgcauccgacaucuuuugccug

SEQ ID NO: 92320 - RNA, 22 nt, Escherichia coli CFT073
acgcggugguuuuguucguucu

SEQ ID NO: 92321 - RNA, 22 nt, Escherichia coli CFT073
ugaaccgaacaacugaacguca

SEQ ID NO: 92322 - RNA, 22 nt, Escherichia coli CFT073
auuucuggcagguugaggaaga

SEQ ID NO: 92323 - RNA, 22 nt, Escherichia coli CFT073
uuguagcaggcguucuacagcc

SEQ ID NO: 92324 - RNA, 22 nt, Escherichia coli CFT073
ugcuuaaaucgagagccuccua

SEQ ID NO: 92325 - RNA, 22 nt, Escherichia coli CFT073
agugccgggauguuaaucggcu

SEQ ID NO: 92326 - RNA, 22 nt, Escherichia coli CFT073
auggccgccccgguuggggacg

SEQ ID NO: 92327 - RNA, 22 nt, Escherichia coli CFT073
uaucgugcagcaaaacugcgca

SEQ ID NO: 92328 - RNA, 22 nt, Escherichia coli CFT073
gguggugguguauuuggcguuc

SEQ ID NO: 92329 - RNA, 16 nt, Escherichia coli CFT073
ugacguugauuauuga

SEQ ID NO: 92330 - RNA, 22 nt, Escherichia coli CFT073
uguucgcaguggaaguaccguu

SEQ ID NO: 92331 - RNA, 22 nt, Escherichia coli CFT073
gcggcgaugaaagccuggcugg

SEQ ID NO: 92332 - RNA, 23 nt, Escherichia coli CFT073
gcaggucugaucuuguauauugc

SEQ ID NO: 92333 - RNA, 19 nt, Escherichia coli CFT073
gccagcaaaaaaaucagcc

SEQ ID NO: 92334 - RNA, 22 nt, Escherichia coli CFT073
caccagguugaagcguggccgu

SEQ ID NO: 92335 - RNA, 22 nt, Escherichia coli CFT073
caccggguauacuaucuccagg

SEQ ID NO: 92336 - RNA, 22 nt, Escherichia coli CFT073
acguucauuaccggcgcauaca

SEQ ID NO: 92337 - RNA, 22 nt, Escherichia coli CFT073
cgaaaccguugagcgacagcaa

SEQ ID NO: 92338 - RNA, 22 nt, Escherichia coli CFT073
ugaaugguuauuuaucggcauc

SEQ ID NO: 92339 - RNA, 21 nt, Escherichia coli CFT073
acugaaauugcugggagucau

SEQ ID NO: 92340 - RNA, 22 nt, Escherichia coli CFT073
uccggguguguacuucgccaug

SEQ ID NO: 92341 - RNA, 22 nt, Escherichia coli CFT073
gucugguuuauucugcauuuuu

SEQ ID NO: 92342 - RNA, 22 nt, Escherichia coli CFT073
uggugucguuugccuucaacgu

SEQ ID NO: 92343 - RNA, 22 nt, Escherichia coli CFT073
acggcgguauacaucgcgguga

SEQ ID NO: 92344 - RNA, 22 nt, Escherichia coli CFT073
ucgguggucgcuaaauagccgu

SEQ ID NO: 92345 - RNA, 19 nt, Escherichia coli CFT073
auuuucuggcucagucucg

SEQ ID NO: 92346 - RNA, 22 nt, Escherichia coli CFT073
cggagacgaaacagucaggcgc

SEQ ID NO: 92347 - RNA, 23 nt, Escherichia coli CFT073
aagguaaacgucgucugguuauc

SEQ ID NO: 92348 - RNA, 22 nt, Escherichia coli CFT073
uaucaggcauuguguagggcag

SEQ ID NO: 92349 - RNA, 22 nt, Escherichia coli CFT073
caaugaaagcguucgucgugac

SEQ ID NO: 92350 - RNA, 22 nt, Escherichia coli CFT073
uccgcguuguacgacaccgaac

SEQ ID NO: 92351 - RNA, 22 nt, Escherichia coli CFT073
agcuggucagagucgcuccgcu

SEQ ID NO: 92352 - RNA, 22 nt, Escherichia coli CFT073
cguuauaacgcacgaggugacu

SEQ ID NO: 92353 - RNA, 22 nt, Escherichia coli CFT073
cagaggaaagcuguugggacug

SEQ ID NO: 92354 - RNA, 22 nt, Escherichia coli CFT073
agugggggcuaccgacguucgc

SEQ ID NO: 92355 - RNA, 22 nt, Escherichia coli CFT073
uuggcuguaagcccccagaugg

SEQ ID NO: 92356 - RNA, 22 nt, Escherichia coli CFT073
gcugcugggaugcgcuguacag

SEQ ID NO: 92357 - RNA, 22 nt, Escherichia coli CFT073
uucucgaaaauaucgugcaugu

SEQ ID NO: 92358 - RNA, 22 nt, Escherichia coli CFT073
ggugauuggcagugggauuuug

SEQ ID NO: 92359 - RNA, 22 nt, Escherichia coli CFT073
ucuuacggucgauuucaacaga

SEQ ID NO: 92360 - RNA, 22 nt, Escherichia coli CFT073
uucucguugaaaaauacgcgcu

SEQ ID NO: 92361 - RNA, 22 nt, Escherichia coli CFT073
auaucaccaccagcccauugag

SEQ ID NO: 92362 - RNA, 22 nt, Escherichia coli CFT073
gaguucgaauaugacauucugg

SEQ ID NO: 92363 - RNA, 22 nt, Escherichia coli CFT073
ccuggcgagcaucccccacaau

SEQ ID NO: 92364 - RNA, 22 nt, Escherichia coli CFT073
ucuggggguaacaauucguaaa

SEQ ID NO: 92365 - RNA, 23 nt, Escherichia coli CFT073
uguuggcgagcagauggugaauc

SEQ ID NO: 92366 - RNA, 22 nt, Escherichia coli CFT073
gcccgucugcuggugcaaucau

SEQ ID NO: 92367 - RNA, 22 nt, Escherichia coli CFT073
uaaaguuccgcguauugcguuc

SEQ ID NO: 92368 - RNA, 22 nt, Escherichia coli CFT073
uuucguuggaaucgugugcugc

SEQ ID NO: 92369 - RNA, 22 nt, Escherichia coli CFT073
cugguuuucaaugcgcguauca

SEQ ID NO: 92370 - RNA, 22 nt, Escherichia coli CFT073
acggcugccaccggagcgugaa

SEQ ID NO: 92371 - RNA, 22 nt, Escherichia coli CFT073
uuaucacuugugcguuauaacg

SEQ ID NO: 92372 - RNA, 22 nt, Escherichia coli CFT073
gacauugaggaacacuuccaga

SEQ ID NO: 92373 - RNA, 22 nt, Escherichia coli CFT073
cgcgucgucauaugcgcacccu

SEQ ID NO: 92374 - RNA, 22 nt, Escherichia coli CFT073
guccggcaguaaccgugauguc

SEQ ID NO: 92375 - RNA, 18 nt, Escherichia coli CFT073
uaagugaagggaguguga

SEQ ID NO: 92376 - RNA, 22 nt, Escherichia coli CFT073
uuuuugauauguugaaaggcgg

SEQ ID NO: 92377 - RNA, 22 nt, Escherichia coli CFT073
ggaauauugccaccuucguuuu

SEQ ID NO: 92378 - RNA, 22 nt, Escherichia coli CFT073
uuuuuacuggcauuugccugaa

SEQ ID NO: 92379 - RNA, 22 nt, Escherichia coli CFT073
cgauccgcagguguugaucaag

SEQ ID NO: 92380 - RNA, 22 nt, Escherichia coli CFT073
ugaaacagcgcuggcagcagca

SEQ ID NO: 92381 - RNA, 22 nt, Escherichia coli CFT073
uccggcaacagguagucgcgca

SEQ ID NO: 92382 - RNA, 22 nt, Escherichia coli CFT073
uguacuggcuguacgcaauaau

SEQ ID NO: 92383 - RNA, 22 nt, Escherichia coli CFT073
ccggauugauuuuguccuuuuc

SEQ ID NO: 92384 - RNA, 22 nt, Escherichia coli CFT073
cccgcguaauuuauccggcagg

SEQ ID NO: 92385 - RNA, 22 nt, Escherichia coli CFT073
aucggugucuaucuugggcaau

SEQ ID NO: 92386 - RNA, 22 nt, Escherichia coli CFT073
gaaguggcagcgcagcagguuu

SEQ ID NO: 92387 - RNA, 22 nt, Escherichia coli CFT073
uccggcaucuuuccuaacgccg

SEQ ID NO: 92388 - RNA, 22 nt, Escherichia coli CFT073
ggugagaaugugguggccauca

SEQ ID NO: 92389 - RNA, 22 nt, Escherichia coli CFT073
cggugccggacaucggauuuuu

SEQ ID NO: 92390 - RNA, 22 nt, Escherichia coli CFT073
ucuggaguaguguagucaaugg

SEQ ID NO: 92391 - RNA, 22 nt, Escherichia coli CFT073
cguaauguuaacuggggcuuuu

SEQ ID NO: 92392 - RNA, 22 nt, Escherichia coli CFT073
gcaccggaggauugcguuucgg

SEQ ID NO: 92393 - RNA, 22 nt, Escherichia coli CFT073
ucgugauguucgcacuggaccc

SEQ ID NO: 92394 - RNA, 22 nt, Escherichia coli CFT073
aaaggccaucauugcggucaua

SEQ ID NO: 92395 - RNA, 22 nt, Escherichia coli CFT073
aggccuacaaggggaauugcaa

SEQ ID NO: 92396 - RNA, 22 nt, Escherichia coli CFT073
cugaugaggaucgcgaugcacu

SEQ ID NO: 92397 - RNA, 22 nt, Escherichia coli CFT073
ucaggucguucugccacgaacu

SEQ ID NO: 92398 - RNA, 22 nt, Escherichia coli CFT073
cagauuugcgcgacgagcucua

SEQ ID NO: 92399 - RNA, 23 nt, Escherichia coli CFT073
cgagugauuuugccaucuccagc

SEQ ID NO: 92400 - RNA, 22 nt, Escherichia coli CFT073
gucauagcauucgccguugaug

SEQ ID NO: 92401 - RNA, 22 nt, Escherichia coli CFT073
gauaaggcguuuacgccgcauc

SEQ ID NO: 92402 - RNA, 22 nt, Escherichia coli CFT073
uuccugaaauaucugacggcuc

SEQ ID NO: 92403 - RNA, 22 nt, Escherichia coli CFT073
ugaccacugguagugucuggcu

SEQ ID NO: 92404 - RNA, 22 nt, Escherichia coli CFT073
ccguaaaacgcaaucaaaauga

SEQ ID NO: 92405 - RNA, 20 nt, Escherichia coli CFT073
uugaugaauuugcuguaaga

SEQ ID NO: 92406 - RNA, 22 nt, Escherichia coli CFT073
acguuggcuggugaaauuacuu

SEQ ID NO: 92407 - RNA, 22 nt, Escherichia coli CFT073
gggcaacauugauacccaccau

SEQ ID NO: 92408 - RNA, 22 nt, Escherichia coli CFT073
acugugcaaaaucgugcagcau

SEQ ID NO: 92409 - RNA, 22 nt, Escherichia coli CFT073
gucagaaagagaugcugaaucu

SEQ ID NO: 92410 - RNA, 21 nt, Escherichia coli CFT073
auuuucgcaaucaccuuacau

SEQ ID NO: 92411 - RNA, 22 nt, Escherichia coli CFT073
auaacgcugaaccaggcaguau

SEQ ID NO: 92412 - RNA, 22 nt, Escherichia coli CFT073
cggaugaugcuguaggcgguaa

SEQ ID NO: 92413 - RNA, 22 nt, Escherichia coli CFT073
cggcguaucaucggugagauca

SEQ ID NO: 92414 - RNA, 22 nt, Escherichia coli CFT073
ugucacgcgaggucacauugau

SEQ ID NO: 92415 - RNA, 23 nt, Escherichia coli CFT073
ggcuagauucuacguaugaugau

SEQ ID NO: 92416 - RNA, 22 nt, Escherichia coli CFT073
auccagcaugaacaaagcgcgc

SEQ ID NO: 92417 - RNA, 22 nt, Escherichia coli CFT073
acaggcaguugcguagauuucu

SEQ ID NO: 92418 - RNA, 18 nt, Escherichia coli CFT073
ucaugcaguggaagcgug

SEQ ID NO: 92419 - RNA, 22 nt, Escherichia coli CFT073
gauuaacgguauucguaguuau

SEQ ID NO: 92420 - RNA, 22 nt, Escherichia coli CFT073
acguuucugaccagguuccggc

SEQ ID NO: 92421 - RNA, 22 nt, Escherichia coli CFT073
cugccccggugaugacagcgcc

SEQ ID NO: 92422 - RNA, 20 nt, Escherichia coli CFT073
guuugcuucuuugauagcaa

SEQ ID NO: 92423 - RNA, 22 nt, Escherichia coli CFT073
ugcaggggcuauguaggccuga

SEQ ID NO: 92424 - RNA, 22 nt, Escherichia coli CFT073
ucgcuguugauaaauacuuccg

SEQ ID NO: 92425 - RNA, 20 nt, Escherichia coli CFT073
uggcguaggcaagugaaauc

SEQ ID NO: 92426 - RNA, 22 nt, Escherichia coli CFT073
aguuucuugagugguaagggaa

SEQ ID NO: 92427 - RNA, 22 nt, Escherichia coli CFT073
gggcgaggacgcuggcaggugc

SEQ ID NO: 92428 - RNA, 21 nt, Escherichia coli CFT073
auacucucgcgucgugguauc

SEQ ID NO: 92429 - RNA, 22 nt, Escherichia coli CFT073
uaguguggacugaugcucugcu

SEQ ID NO: 92430 - RNA, 22 nt, Escherichia coli CFT073
gcgacuguucucccgacguucc

SEQ ID NO: 92431 - RNA, 18 nt, Escherichia coli CFT073
gagauuguugaagaauuc

SEQ ID NO: 92432 - RNA, 22 nt, Escherichia coli CFT073
cucgggauaucagcuaaaacau

SEQ ID NO: 92433 - RNA, 21 nt, Escherichia coli CFT073
ucgucgccuccggcauguuga

SEQ ID NO: 92434 - RNA, 22 nt, Escherichia coli CFT073
gugucgaugaacaacguugugg

SEQ ID NO: 92435 - RNA, 22 nt, Escherichia coli CFT073
ccggccuacaaaaaucuugcca

SEQ ID NO: 92436 - RNA, 22 nt, Escherichia coli CFT073
uuaauguucguaaauggcacug

SEQ ID NO: 92437 - RNA, 22 nt, Escherichia coli CFT073
ucagcgguaucauacagcgccg

SEQ ID NO: 92438 - RNA, 22 nt, Escherichia coli CFT073
gcgguugguuacggcaccgaac

SEQ ID NO: 92439 - RNA, 22 nt, Escherichia coli CFT073
uugcuuguacaggucaacgaaa

SEQ ID NO: 92440 - RNA, 22 nt, Escherichia coli CFT073
cacgcaguagcuuuccuguccu

SEQ ID NO: 92441 - RNA, 22 nt, Escherichia coli CFT073
gcuacuggaugauagccaacau

SEQ ID NO: 92442 - RNA, 22 nt, Escherichia coli CFT073
uuacuguacgauuucagucaaa

SEQ ID NO: 92443 - RNA, 22 nt, Escherichia coli CFT073
accugcuucagcucugcgucug

SEQ ID NO: 92444 - RNA, 20 nt, Escherichia coli CFT073
uucuggauuuugccaucaau

SEQ ID NO: 92445 - RNA, 22 nt, Escherichia coli CFT073
cccgcuguuuacgcuaacugcu

SEQ ID NO: 92446 - RNA, 22 nt, Escherichia coli CFT073
gcagcaccgguccgucugggag

SEQ ID NO: 92447 - RNA, 22 nt, Escherichia coli CFT073
guccgccauacgcugguugcuu

SEQ ID NO: 92448 - RNA, 22 nt, Escherichia coli CFT073
ucugaugcuggaguuacaggaa

SEQ ID NO: 92449 - RNA, 22 nt, Escherichia coli CFT073
cgcuuuuugaacgacgucaccg

SEQ ID NO: 92450 - RNA, 22 nt, Escherichia coli CFT073
auagauguugaacugacggaga

SEQ ID NO: 92451 - RNA, 22 nt, Escherichia coli CFT073
ucaggcaucgaucucuuauuuu

SEQ ID NO: 92452 - RNA, 22 nt, Escherichia coli CFT073
cucaugguaucugagcguaucu

SEQ ID NO: 92453 - RNA, 22 nt, Escherichia coli CFT073
ggucuuuuuccugcuggcggca

SEQ ID NO: 92454 - RNA, 22 nt, Escherichia coli CFT073
gcgcggcggaucugcgucugau

SEQ ID NO: 92455 - RNA, 22 nt, Escherichia coli CFT073
ggucagaugguagguauuugcg

SEQ ID NO: 92456 - RNA, 22 nt, Escherichia coli CFT073
uuuaaagauuccuuuguugcuc

SEQ ID NO: 92457 - RNA, 22 nt, Escherichia coli CFT073
gccacgcgcaguugcccaaagg

SEQ ID NO: 92458 - RNA, 22 nt, Escherichia coli CFT073
cugaaugcagaauaggucagac

SEQ ID NO: 92459 - RNA, 22 nt, Escherichia coli CFT073
uugaccccgcugaguugaauaa

SEQ ID NO: 92460 - RNA, 19 nt, Escherichia coli CFT073
ggcagcugucaggugugcg

SEQ ID NO: 92461 - RNA, 22 nt, Escherichia coli CFT073
ugauggaugucggggccgucag

SEQ ID NO: 92462 - RNA, 22 nt, Escherichia coli CFT073
agcuugacaaagugcgggaucg

SEQ ID NO: 92463 - RNA, 22 nt, Escherichia coli CFT073
aauauucagguuggcaucgguc

SEQ ID NO: 92464 - RNA, 22 nt, Escherichia coli CFT073
aaccggcugaaauccuggcaga

SEQ ID NO: 92465 - RNA, 22 nt, Escherichia coli CFT073
uucggggaggcacuggcggaag

SEQ ID NO: 92466 - RNA, 22 nt, Escherichia coli CFT073
ucaaacgguucaaucagaacag

SEQ ID NO: 92467 - RNA, 22 nt, Escherichia coli CFT073
ucgguagccaccagggaggaua

SEQ ID NO: 92468 - RNA, 22 nt, Escherichia coli CFT073
cggaauauuaagccgcuggcga

SEQ ID NO: 92469 - RNA, 22 nt, Escherichia coli CFT073
cguuccguaugaccgacgccaa

SEQ ID NO: 92470 - RNA, 22 nt, Escherichia coli CFT073
cgcgaagaaaccagucgcgggu

SEQ ID NO: 92471 - RNA, 22 nt, Escherichia coli CFT073
gcgagugccaugcucagucagg

SEQ ID NO: 92472 - RNA, 22 nt, Escherichia coli CFT073
aaugaacugguugcguaauuuu

SEQ ID NO: 92473 - RNA, 22 nt, Escherichia coli CFT073
caccagcaacuggggggccgcu

SEQ ID NO: 92474 - RNA, 18 nt, Escherichia coli CFT073
cugaaggucaugccauag

SEQ ID NO: 92475 - RNA, 22 nt, Escherichia coli CFT073
accguuggcgugcuguuccugc

SEQ ID NO: 92476 - RNA, 22 nt, Escherichia coli CFT073
gccaaccacggucaugccauuu

SEQ ID NO: 92477 - RNA, 22 nt, Escherichia coli CFT073
gcguaucaucaacccgaugcgc

SEQ ID NO: 92478 - RNA, 22 nt, Escherichia coli CFT073
ccgcaggcucggugcugcgagu

SEQ ID NO: 92479 - RNA, 22 nt, Escherichia coli CFT073
acacgguagcgcgaccugcaac

SEQ ID NO: 92480 - RNA, 22 nt, Escherichia coli CFT073
aacagccguugcauacgccguu

SEQ ID NO: 92481 - RNA, 22 nt, Escherichia coli CFT073
ucgccguguucugcgaaggacg

SEQ ID NO: 92482 - RNA, 22 nt, Escherichia coli CFT073
agcugcgcccgauaaugacggu

SEQ ID NO: 92483 - RNA, 22 nt, Escherichia coli CFT073
auggaaggaucuggauucugga

SEQ ID NO: 92484 - RNA, 20 nt, Escherichia coli CFT073
aaaucguucggggaaaccuu

SEQ ID NO: 92485 - RNA, 22 nt, Escherichia coli CFT073
gaugaccgguuuccgcguagcg

SEQ ID NO: 92486 - RNA, 22 nt, Escherichia coli CFT073
aaggccgugaccgcgaaacugg

SEQ ID NO: 92487 - RNA, 22 nt, Escherichia coli CFT073
guugaugcgcuggauuuguucg

SEQ ID NO: 92488 - RNA, 22 nt, Escherichia coli CFT073
ggucgagcgucaguguccgcgu

SEQ ID NO: 92489 - RNA, 22 nt, Escherichia coli CFT073
cguauuaacagauuaugucaga

SEQ ID NO: 92490 - RNA, 22 nt, Escherichia coli CFT073
cguagcacagcaggacgauuug

SEQ ID NO: 92491 - RNA, 22 nt, Escherichia coli CFT073
ccucccuugccacgcaguaguu

SEQ ID NO: 92492 - RNA, 22 nt, Escherichia coli CFT073
ugguuugcggugaaagccugca

SEQ ID NO: 92493 - RNA, 22 nt, Escherichia coli CFT073
agguggcgaagcacaacguuaa

SEQ ID NO: 92494 - RNA, 22 nt, Escherichia coli CFT073
aaaccgcugccgcuucgucgca

SEQ ID NO: 92495 - RNA, 22 nt, Escherichia coli CFT073
ccguagcgguugcggcuuggca

SEQ ID NO: 92496 - RNA, 22 nt, Escherichia coli CFT073
ccgcugauugaaaggaugcguu

SEQ ID NO: 92497 - RNA, 22 nt, Escherichia coli CFT073
uaguaucacuuuaucagccaag

SEQ ID NO: 92498 - RNA, 22 nt, Escherichia coli CFT073
uuuaacucccagggcuugaacg

SEQ ID NO: 92499 - RNA, 22 nt, Escherichia coli CFT073
guggcggcgcuggcgacauuaa

SEQ ID NO: 92500 - RNA, 22 nt, Escherichia coli CFT073
gaagaagccuuuaaaggccgug

SEQ ID NO: 92501 - RNA, 22 nt, Escherichia coli CFT073
gcugguggcgcugucuuuguca

SEQ ID NO: 92502 - RNA, 22 nt, Escherichia coli CFT073
agaaaaucauaucgccaucuug

SEQ ID NO: 92503 - RNA, 22 nt, Escherichia coli CFT073
uggcuggcgaucaaucugguua

SEQ ID NO: 92504 - RNA, 19 nt, Escherichia coli CFT073
guuaucucugcaccaugcg

SEQ ID NO: 92505 - RNA, 22 nt, Escherichia coli CFT073
ugggucugcggauggaugccuu

SEQ ID NO: 92506 - RNA, 22 nt, Escherichia coli CFT073
uugcgauucuccucaacgugau

SEQ ID NO: 92507 - RNA, 22 nt, Escherichia coli CFT073
uccggaugcagcggcagcgcca

SEQ ID NO: 92508 - RNA, 22 nt, Escherichia coli CFT073
auguugaaauaaugaaagcggc

SEQ ID NO: 92509 - RNA, 22 nt, Escherichia coli CFT073
gcuguggucgucuuuaaucugc

SEQ ID NO: 92510 - RNA, 22 nt, Escherichia coli CFT073
ggaaagaauaugcgccaggcgu

SEQ ID NO: 92511 - RNA, 22 nt, Escherichia coli CFT073
ucuaugauuaugaggcgaagua

SEQ ID NO: 92512 - RNA, 22 nt, Escherichia coli CFT073
ucaccugcauuuccgaacgcac

SEQ ID NO: 92513 - RNA, 23 nt, Escherichia coli CFT073
uuaccgaugaauuuauucguggu

SEQ ID NO: 92514 - RNA, 22 nt, Escherichia coli CFT073
cugggcacgaccguucagcugc

SEQ ID NO: 92515 - RNA, 22 nt, Escherichia coli CFT073
ugcguugcgcaguugcgucaau

SEQ ID NO: 92516 - RNA, 20 nt, Escherichia coli CFT073
cuaccgguacuuuaaucgug

SEQ ID NO: 92517 - RNA, 22 nt, Escherichia coli CFT073
aauggcuggcagguaauuuugc

SEQ ID NO: 92518 - RNA, 22 nt, Escherichia coli CFT073
uaucuugugcuuguggcugauc

SEQ ID NO: 92519 - RNA, 22 nt, Escherichia coli CFT073
gcgguaguuggugcccagacaa

SEQ ID NO: 92520 - RNA, 22 nt, Escherichia coli CFT073
caucacgcggucuacguaguca

SEQ ID NO: 92521 - RNA, 22 nt, Escherichia coli CFT073
cgucgcacaagggguggaugcg

SEQ ID NO: 92522 - RNA, 22 nt, Escherichia coli CFT073
ucgguugcuguucccgccacug

SEQ ID NO: 92523 - RNA, 22 nt, Escherichia coli CFT073
cacagcuaaaguccagccaggu

SEQ ID NO: 92524 - RNA, 22 nt, Escherichia coli CFT073
agguugaacaacugaugacgcu

SEQ ID NO: 92525 - RNA, 22 nt, Escherichia coli CFT073
uuugauuuguuaaaacaccuug

SEQ ID NO: 92526 - RNA, 20 nt, Escherichia coli CFT073
agauugucguacauagcguu

SEQ ID NO: 92527 - RNA, 22 nt, Escherichia coli CFT073
ggcgcagugccaggguuuugau

SEQ ID NO: 92528 - RNA, 23 nt, Escherichia coli CFT073
auuguugcgucguggcugguggc

SEQ ID NO: 92529 - RNA, 22 nt, Escherichia coli CFT073
ucaccguauuauugccggaugg

SEQ ID NO: 92530 - RNA, 22 nt, Escherichia coli CFT073
aucugcauuaucaguuuuagcc

SEQ ID NO: 92531 - RNA, 22 nt, Escherichia coli CFT073
acgcggcggugguggaagucau

SEQ ID NO: 92532 - RNA, 22 nt, Escherichia coli CFT073
aacagcauggggaaugaucaga

SEQ ID NO: 92533 - RNA, 22 nt, Escherichia coli CFT073
ugaaagagcuggggaugcauuc

SEQ ID NO: 92534 - RNA, 22 nt, Escherichia coli CFT073
cguaugcucggucagaugagca

SEQ ID NO: 92535 - RNA, 22 nt, Escherichia coli CFT073
agcagcaacgcuggcuggagca

SEQ ID NO: 92536 - RNA, 22 nt, Escherichia coli CFT073
ugaggcguaaauucucgcgcgu

SEQ ID NO: 92537 - RNA, 20 nt, Escherichia coli CFT073
uggucgggauugccguuguu

SEQ ID NO: 92538 - RNA, 19 nt, Escherichia coli CFT073
ccgcgcgcaggcugguugc

SEQ ID NO: 92539 - RNA, 22 nt, Escherichia coli CFT073
cugaugcgacgcugacgcgucu

SEQ ID NO: 92540 - RNA, 22 nt, Escherichia coli CFT073
cgcgucuuaucaugccuacagg

SEQ ID NO: 92541 - RNA, 22 nt, Escherichia coli CFT073
aucuggugcagccguuugugga

SEQ ID NO: 92542 - RNA, 22 nt, Escherichia coli CFT073
uggagccgucguuaacgcaaau

SEQ ID NO: 92543 - RNA, 20 nt, Escherichia coli CFT073
aacgcuggaguaucagcggu

SEQ ID NO: 92544 - RNA, 22 nt, Escherichia coli CFT073
ugucgcaucgcuaucuggcuga

SEQ ID NO: 92545 - RNA, 22 nt, Escherichia coli CFT073
ggcgugagacguuacggcaacu

SEQ ID NO: 92546 - RNA, 22 nt, Escherichia coli CFT073
ucugcuuaaccagaacgacguu

SEQ ID NO: 92547 - RNA, 22 nt, Escherichia coli CFT073
cgcaccgaccuggcuuggguua

SEQ ID NO: 92548 - RNA, 22 nt, Escherichia coli CFT073
uuccguuugucgcagcauaucu

SEQ ID NO: 92549 - RNA, 22 nt, Escherichia coli CFT073
cggaagacgaacuugccagcga

SEQ ID NO: 92550 - RNA, 22 nt, Escherichia coli CFT073
gcgugggcgguguuuuucggug

SEQ ID NO: 92551 - RNA, 22 nt, Escherichia coli CFT073
aucacuucuucucggauuucac

SEQ ID NO: 92552 - RNA, 22 nt, Escherichia coli CFT073
gugaaauugaaaucugagguug

SEQ ID NO: 92553 - RNA, 22 nt, Escherichia coli CFT073
aaggacaaaaucaauccggugg

SEQ ID NO: 92554 - RNA, 22 nt, Escherichia coli CFT073
gccauugccgagcgcagugaau

SEQ ID NO: 92555 - RNA, 22 nt, Escherichia coli CFT073
gaugcaacgcuguguaaagguu

SEQ ID NO: 92556 - RNA, 22 nt, Escherichia coli CFT073
gugaugcggauggguaaugucc

SEQ ID NO: 92557 - RNA, 22 nt, Escherichia coli CFT073
gucgagaaaacgggauagcaca

SEQ ID NO: 92558 - RNA, 22 nt, Escherichia coli CFT073
ucaucgguuucaaugacuuucg

SEQ ID NO: 92559 - RNA, 22 nt, Escherichia coli CFT073
guuuugccgagaagcacggcgu

SEQ ID NO: 92560 - RNA, 22 nt, Escherichia coli CFT073
caugcugcgcguuggcgaucug

SEQ ID NO: 92561 - RNA, 22 nt, Escherichia coli CFT073
ugucggucaggacuaucgccuc

SEQ ID NO: 92562 - RNA, 15 nt, Escherichia coli CFT073
uaucaauggcuggcu

SEQ ID NO: 92563 - RNA, 22 nt, Escherichia coli CFT073
aucuguuaccguuucaucagua

SEQ ID NO: 92564 - RNA, 22 nt, Escherichia coli CFT073
cgccauccacaccgagauggaa

SEQ ID NO: 92565 - RNA, 22 nt, Escherichia coli CFT073
uagcgacccauuuugccgguuc

SEQ ID NO: 92566 - RNA, 22 nt, Escherichia coli CFT073
aguuugaucgcaaagguauggu

SEQ ID NO: 92567 - RNA, 22 nt, Escherichia coli CFT073
ggaugaugaggguuauacggua

SEQ ID NO: 92568 - RNA, 22 nt, Escherichia coli CFT073
uuuuuuaccacuggccuucugc

SEQ ID NO: 92569 - RNA, 19 nt, Escherichia coli CFT073
ugcgcgcguuuuauucauc

SEQ ID NO: 92570 - RNA, 21 nt, Escherichia coli CFT073
ccaccaucagcgcgucguggc

SEQ ID NO: 92571 - RNA, 22 nt, Escherichia coli CFT073
cggaguauuucauggggaauuu

SEQ ID NO: 92572 - RNA, 22 nt, Escherichia coli CFT073
aaccgcacgaccugaccguucc

SEQ ID NO: 92573 - RNA, 22 nt, Escherichia coli CFT073
cguuuugccucgccccaauaua

SEQ ID NO: 92574 - RNA, 22 nt, Escherichia coli CFT073
ccuugcugacacagcgcgcuca

SEQ ID NO: 92575 - RNA, 22 nt, Escherichia coli CFT073
guccggguaaaccagcggcgga

SEQ ID NO: 92576 - RNA, 22 nt, Escherichia coli CFT073
agacggauuuaaccgauugucc

SEQ ID NO: 92577 - RNA, 22 nt, Escherichia coli CFT073
auguguuuuacagcgugaugga

SEQ ID NO: 92578 - RNA, 22 nt, Escherichia coli CFT073
caauugcuucuuaccugcugaa

SEQ ID NO: 92579 - RNA, 23 nt, Escherichia coli CFT073
gcgcaugaaagaagaggucgcca

SEQ ID NO: 92580 - RNA, 23 nt, Escherichia coli CFT073
ucauuuucauugguuaacucggc

SEQ ID NO: 92581 - RNA, 22 nt, Escherichia coli CFT073
ucagauguuuucgacaguguua

SEQ ID NO: 92582 - RNA, 22 nt, Escherichia coli CFT073
augaauauuuagacuaaagagu

SEQ ID NO: 92583 - RNA, 21 nt, Escherichia coli CFT073
ucgguggcugaccaguuuggu

SEQ ID NO: 92584 - RNA, 22 nt, Escherichia coli CFT073
ccgcuggcgagcuuguauuacu

SEQ ID NO: 92585 - RNA, 22 nt, Escherichia coli CFT073
ugaugcgauugcucauggaaaa

SEQ ID NO: 92586 - RNA, 22 nt, Escherichia coli CFT073
uuauccgauacagcguucaguu

SEQ ID NO: 92587 - RNA, 22 nt, Escherichia coli CFT073
augcgccgcugucgcgucuuau

SEQ ID NO: 92588 - RNA, 22 nt, Escherichia coli CFT073
uguuuuugaagagaugacgguc

SEQ ID NO: 92589 - RNA, 22 nt, Escherichia coli CFT073
caguucgacaacaccguuaauu

SEQ ID NO: 92590 - RNA, 22 nt, Escherichia coli CFT073
aaucgcuggcuggcgucgcggc

SEQ ID NO: 92591 - RNA, 22 nt, Escherichia coli CFT073
uuuaucacccgcaugaugaugc

SEQ ID NO: 92592 - RNA, 23 nt, Escherichia coli CFT073
agguuugaccguucuccaugacc

SEQ ID NO: 92593 - RNA, 22 nt, Escherichia coli CFT073
gcgcgguugcccaaguucgucg

SEQ ID NO: 92594 - RNA, 22 nt, Escherichia coli CFT073
augaaugaucaaggccuggcau

SEQ ID NO: 92595 - RNA, 22 nt, Escherichia coli CFT073
uccgggaaguagugcagcaugu

SEQ ID NO: 92596 - RNA, 22 nt, Escherichia coli CFT073
uugugggguauaaaacgcggcg

SEQ ID NO: 92597 - RNA, 22 nt, Escherichia coli CFT073
ugcaacuuacguuucggaucga

SEQ ID NO: 92598 - RNA, 22 nt, Escherichia coli CFT073
gagcugcaccaaggucgacaac

SEQ ID NO: 92599 - RNA, 22 nt, Escherichia coli CFT073
agcauugaggaacagcguaauc

SEQ ID NO: 92600 - RNA, 22 nt, Escherichia coli CFT073
auuugcguuugacuuccgccau

SEQ ID NO: 92601 - RNA, 22 nt, Escherichia coli CFT073
cgccugaaucaaacgguucguc

SEQ ID NO: 92602 - RNA, 22 nt, Escherichia coli CFT073
ccugacuauugccgcagcgauu

SEQ ID NO: 92603 - RNA, 22 nt, Escherichia coli CFT073
uacagaauauccaucagcggcu

SEQ ID NO: 92604 - RNA, 22 nt, Escherichia coli CFT073
acaggucaauguuaucguuuau

SEQ ID NO: 92605 - RNA, 22 nt, Escherichia coli CFT073
agggcgagagcguuugguuuuc

SEQ ID NO: 92606 - RNA, 20 nt, Escherichia coli CFT073
guguucguuccuuuucugac

SEQ ID NO: 92607 - RNA, 22 nt, Escherichia coli CFT073
gaaccgcccgcagaaaaaacgu

SEQ ID NO: 92608 - RNA, 21 nt, Escherichia coli CFT073
uggguuaauggagcuuuugua

SEQ ID NO: 92609 - RNA, 22 nt, Escherichia coli CFT073
gucgguauugaugagugggcgu

SEQ ID NO: 92610 - RNA, 22 nt, Escherichia coli CFT073
cuguucaucagggacuauggug

SEQ ID NO: 92611 - RNA, 22 nt, Escherichia coli CFT073
gcacguuccagaaucggauuaa

SEQ ID NO: 92612 - RNA, 22 nt, Escherichia coli CFT073
ugugcguuggcaaacaccaucg

SEQ ID NO: 92613 - RNA, 20 nt, Escherichia coli CFT073
ucuggcgcauuccgggcugu

SEQ ID NO: 92614 - RNA, 22 nt, Escherichia coli CFT073
aggucaaugcguuugagaaugu

SEQ ID NO: 92615 - RNA, 22 nt, Escherichia coli CFT073
ucgcggguggugguagucgaua

SEQ ID NO: 92616 - RNA, 22 nt, Escherichia coli CFT073
aacggcuggcuugaugacgaag

SEQ ID NO: 92617 - RNA, 22 nt, Escherichia coli CFT073
uugcugaugcgcugccaggcgu

SEQ ID NO: 92618 - RNA, 22 nt, Escherichia coli CFT073
ggaucguagauaaaggucaggu

SEQ ID NO: 92619 - RNA, 22 nt, Escherichia coli CFT073
cuuugcuaucagucucaagggc

SEQ ID NO: 92620 - RNA, 22 nt, Escherichia coli CFT073
gacucggugucguugcuugccg

SEQ ID NO: 92621 - RNA, 21 nt, Escherichia coli CFT073
gcugauccugguaaaugcucg

SEQ ID NO: 92622 - RNA, 22 nt, Escherichia coli CFT073
gaaaucagccuauaggaggaaa

SEQ ID NO: 92623 - RNA, 22 nt, Escherichia coli CFT073
cauugauaucgauaagcugcga

SEQ ID NO: 92624 - RNA, 22 nt, Escherichia coli CFT073
ugaucucuuccugcugagcuuu

SEQ ID NO: 92625 - RNA, 22 nt, Escherichia coli CFT073
uuucaauacuuaucgauuccuu

SEQ ID NO: 92626 - RNA, 22 nt, Escherichia coli CFT073
acuaauuagccaucgauaaaaa

SEQ ID NO: 92627 - RNA, 22 nt, Escherichia coli CFT073
auaacggcuacaggcauuuucc

SEQ ID NO: 92628 - RNA, 22 nt, Escherichia coli CFT073
uucgcgcauugaugauaucgau

SEQ ID NO: 92629 - RNA, 22 nt, Escherichia coli CFT073
aggccguugcuguuggucaagc

SEQ ID NO: 92630 - RNA, 22 nt, Escherichia coli CFT073
gccgaccugugacugccggaug

SEQ ID NO: 92631 - RNA, 21 nt, Escherichia coli CFT073
guuaguggaauggcuggaaaa

SEQ ID NO: 92632 - RNA, 21 nt, Escherichia coli CFT073
caguaaaacgcaccauacugu

SEQ ID NO: 92633 - RNA, 22 nt, Escherichia coli CFT073
uggcgacugcugcgcagccuca

SEQ ID NO: 92634 - RNA, 22 nt, Escherichia coli CFT073
aacgauggugucagguuuaaau

SEQ ID NO: 92635 - RNA, 22 nt, Escherichia coli CFT073
ugugguguaagcacaguaguag

SEQ ID NO: 92636 - RNA, 22 nt, Escherichia coli CFT073
cuacgcuuaucaggccuacggg

SEQ ID NO: 92637 - RNA, 20 nt, Escherichia coli CFT073
augaaucagagaaaaaguga

SEQ ID NO: 92638 - RNA, 22 nt, Escherichia coli CFT073
cagccaaagacuggaaacuggu

SEQ ID NO: 92639 - RNA, 22 nt, Escherichia coli CFT073
augcguuucgcuuaucugaccu

SEQ ID NO: 92640 - RNA, 22 nt, Escherichia coli CFT073
ugcgcgaucgcgggcauacggu

SEQ ID NO: 92641 - RNA, 22 nt, Escherichia coli CFT073
gccggacauucucucuuuuggu

SEQ ID NO: 92642 - RNA, 22 nt, Escherichia coli CFT073
gcgcugauggugauguccugcu

SEQ ID NO: 92643 - RNA, 22 nt, Escherichia coli CFT073
uauuaaauaugaaaaguuauga

SEQ ID NO: 92644 - RNA, 22 nt, Escherichia coli CFT073
gauguuauccacacccagguaa

SEQ ID NO: 92645 - RNA, 22 nt, Escherichia coli CFT073
caugaugggcaugaaugucaua

SEQ ID NO: 92646 - RNA, 22 nt, Escherichia coli CFT073
gacguuccgggucgauagucag

SEQ ID NO: 92647 - RNA, 22 nt, Escherichia coli CFT073
ucgcgccauuauggaacgcuug

SEQ ID NO: 92648 - RNA, 20 nt, Escherichia coli CFT073
acggcaguuugacguucggc

SEQ ID NO: 92649 - RNA, 22 nt, Escherichia coli CFT073
guacagcgcacugauuuucgca

SEQ ID NO: 92650 - RNA, 22 nt, Escherichia coli CFT073
guucaauggauucagugauggc

SEQ ID NO: 92651 - RNA, 22 nt, Escherichia coli CFT073
aagcaccaggcuugcccgccga

SEQ ID NO: 92652 - RNA, 22 nt, Escherichia coli CFT073
gcaaauccugaccaaucgcgau

SEQ ID NO: 92653 - RNA, 21 nt, Escherichia coli CFT073
ccugugguguauuuauuggcg

SEQ ID NO: 92654 - RNA, 22 nt, Escherichia coli CFT073
accggaggaggcgaauacuggc

SEQ ID NO: 92655 - RNA, 22 nt, Escherichia coli CFT073
aagccaguugcuggcauuuugu

SEQ ID NO: 92656 - RNA, 22 nt, Escherichia coli CFT073
ucacugguuacaggaugguaau

SEQ ID NO: 92657 - RNA, 22 nt, Escherichia coli CFT073
ggcggcgcccgucuuucugcca

SEQ ID NO: 92658 - RNA, 22 nt, Escherichia coli CFT073
uuauucacuccgcgugguggau

SEQ ID NO: 92659 - RNA, 22 nt, Escherichia coli CFT073
uccugauagacggugccgaugc

SEQ ID NO: 92660 - RNA, 22 nt, Escherichia coli CFT073
cgugaugcauugcucugaaagc

SEQ ID NO: 92661 - RNA, 22 nt, Escherichia coli CFT073
cuuuacuaucguuuaggugcgc

SEQ ID NO: 92662 - RNA, 23 nt, Escherichia coli CFT073
acugacuggcggucaggcgcugc

SEQ ID NO: 92663 - RNA, 22 nt, Escherichia coli CFT073
accauuuuuaucgauggcuaau

SEQ ID NO: 92664 - RNA, 22 nt, Escherichia coli CFT073
cugaugaucgagaaucgcuaug

SEQ ID NO: 92665 - RNA, 22 nt, Escherichia coli CFT073
ccggaagguuaauugauggggu

SEQ ID NO: 92666 - RNA, 22 nt, Escherichia coli CFT073
ggugcacuacgaauuggcgcaa

SEQ ID NO: 92667 - RNA, 22 nt, Escherichia coli CFT073
accgcgagaugccaggcuuugg

SEQ ID NO: 92668 - RNA, 22 nt, Escherichia coli CFT073
uaaagccgcagaagaguugggu

SEQ ID NO: 92669 - RNA, 22 nt, Escherichia coli CFT073
ccgagcagcuuaaacgcaauau

SEQ ID NO: 92670 - RNA, 22 nt, Escherichia coli CFT073
cagccuacagaacgcugcaauu

SEQ ID NO: 92671 - RNA, 22 nt, Escherichia coli CFT073
cgcuggaugauggcgagcugga

SEQ ID NO: 92672 - RNA, 19 nt, Escherichia coli CFT073
uauccggccuccauaagag

SEQ ID NO: 92673 - RNA, 22 nt, Escherichia coli CFT073
uucuuugcgcuuggcggucauu

SEQ ID NO: 92674 - RNA, 22 nt, Escherichia coli CFT073
gccggaaugggggcguuacugg

SEQ ID NO: 92675 - RNA, 22 nt, Escherichia coli CFT073
cggcgguacguuaggugcggcg

SEQ ID NO: 92676 - RNA, 22 nt, Escherichia coli CFT073
aguuuacaacgcauuguuaaag

SEQ ID NO: 92677 - RNA, 22 nt, Escherichia coli CFT073
aaugguuuacccaugcagguag

SEQ ID NO: 92678 - RNA, 22 nt, Escherichia coli CFT073
uggcggcgguugcaggaauuau

SEQ ID NO: 92679 - RNA, 22 nt, Escherichia coli CFT073
gaaaaucaguuugcuucgcgcu

SEQ ID NO: 92680 - RNA, 22 nt, Escherichia coli CFT073
guuggauuaggaagggaaacau

SEQ ID NO: 92681 - RNA, 22 nt, Escherichia coli CFT073
gcucaaggauaccgaugauuuu

SEQ ID NO: 92682 - RNA, 22 nt, Escherichia coli CFT073
cuucgaucucguaaccgucgca

SEQ ID NO: 92683 - RNA, 22 nt, Escherichia coli CFT073
ugccgcucuucuuuaccgguug

SEQ ID NO: 92684 - RNA, 22 nt, Escherichia coli CFT073
ccgcaaauacgcagucagcaga

SEQ ID NO: 92685 - RNA, 22 nt, Escherichia coli CFT073
ucauuacgauccguuuaucguc

SEQ ID NO: 92686 - RNA, 22 nt, Escherichia coli CFT073
uggugcguuccuuggcaaagug

SEQ ID NO: 92687 - RNA, 23 nt, Escherichia coli CFT073
gguuacucuguucauugcugacc

SEQ ID NO: 92688 - RNA, 22 nt, Escherichia coli CFT073
gaucgacccugugggguguugg

SEQ ID NO: 92689 - RNA, 22 nt, Escherichia coli CFT073
uaacgauaaccggcaaacccag

SEQ ID NO: 92690 - RNA, 22 nt, Escherichia coli CFT073
ugaauaaaccaucaugauuuuu

SEQ ID NO: 92691 - RNA, 22 nt, Escherichia coli CFT073
aaacugaggcugaugccagcgu

SEQ ID NO: 92692 - RNA, 20 nt, Escherichia coli CFT073
ucgacggcaaauuugugcag

SEQ ID NO: 92693 - RNA, 22 nt, Escherichia coli CFT073
gccaacuggaaugcacugacaa

SEQ ID NO: 92694 - RNA, 22 nt, Escherichia coli CFT073
ugcgagaauucuggucguugcc

SEQ ID NO: 92695 - RNA, 22 nt, Escherichia coli CFT073
gucuccccucgcccgcaugaca

SEQ ID NO: 92696 - RNA, 22 nt, Escherichia coli CFT073
uugagcaagcguugacgcagca

SEQ ID NO: 92697 - RNA, 22 nt, Escherichia coli CFT073
ccagaagggguaaugccaguca

SEQ ID NO: 92698 - RNA, 22 nt, Escherichia coli CFT073
uaugcaguucuucuuccgacca

SEQ ID NO: 92699 - RNA, 22 nt, Escherichia coli CFT073
ccagggcgucaaacagccggau

SEQ ID NO: 92700 - RNA, 22 nt, Escherichia coli CFT073
ggugcagacauggucuuuauug

SEQ ID NO: 92701 - RNA, 22 nt, Escherichia coli CFT073
uggcggcgcugaccauuuauga

SEQ ID NO: 92702 - RNA, 22 nt, Escherichia coli CFT073
uucagcgcggugauguucuggu

SEQ ID NO: 92703 - RNA, 22 nt, Escherichia coli CFT073
gaagguuaacccgcugggcggc

SEQ ID NO: 92704 - RNA, 22 nt, Escherichia coli CFT073
gauaaaguccuaugccaucaau

SEQ ID NO: 92705 - RNA, 22 nt, Escherichia coli CFT073
gaacaggaagauaagccacuga

SEQ ID NO: 92706 - RNA, 23 nt, Escherichia coli CFT073
aacgccuggggucgacaucugcc

SEQ ID NO: 92707 - RNA, 21 nt, Escherichia coli CFT073
gaaccgugaccugacuggcga

SEQ ID NO: 92708 - RNA, 19 nt, Escherichia coli CFT073
uccugaccgaagaauuugc

SEQ ID NO: 92709 - RNA, 22 nt, Escherichia coli CFT073
ucgcucaauguuggggcguaag

SEQ ID NO: 92710 - RNA, 22 nt, Escherichia coli CFT073
uugcuuuugguuauuaucugca

SEQ ID NO: 92711 - RNA, 22 nt, Escherichia coli CFT073
gcgcugccggucgauauugaug

SEQ ID NO: 92712 - RNA, 22 nt, Escherichia coli CFT073
gagaauguugaugccgcauugc

SEQ ID NO: 92713 - RNA, 22 nt, Escherichia coli CFT073
ucgauauuguauuuuauuaaga

SEQ ID NO: 92714 - RNA, 22 nt, Escherichia coli CFT073
gucgaaauggaagcguuaaccg

SEQ ID NO: 92715 - RNA, 22 nt, Escherichia coli CFT073
gcugacuggcagauugcggcaa

SEQ ID NO: 92716 - RNA, 23 nt, Escherichia coli CFT073
uugucgcuggaagguauuggcgc

SEQ ID NO: 92717 - RNA, 22 nt, Escherichia coli CFT073
gugcugauacucuucuucgcag

SEQ ID NO: 92718 - RNA, 22 nt, Escherichia coli CFT073
uguuguaccacugguuacgggc

SEQ ID NO: 92719 - RNA, 22 nt, Escherichia coli CFT073
caggggauaggcggcgcaauga

SEQ ID NO: 92720 - RNA, 22 nt, Escherichia coli CFT073
aagguuuuguacaacugcgggu

SEQ ID NO: 92721 - RNA, 22 nt, Escherichia coli CFT073
gauaauuuuauuaaucgcccag

SEQ ID NO: 92722 - RNA, 19 nt, Escherichia coli CFT073
aagugcgcucgacgugaca

SEQ ID NO: 92723 - RNA, 22 nt, Escherichia coli CFT073
ucgacacgcugcagaacacgca

SEQ ID NO: 92724 - RNA, 22 nt, Escherichia coli CFT073
ucaggcaaaugccaguaaaaac

SEQ ID NO: 92725 - RNA, 16 nt, Escherichia coli CFT073
aggcguuucagucaug

SEQ ID NO: 92726 - RNA, 22 nt, Escherichia coli CFT073
uuccaucugcggguuggugcug

SEQ ID NO: 92727 - RNA, 20 nt, Escherichia coli CFT073
uugaacagaacgcggaagcc

SEQ ID NO: 92728 - RNA, 22 nt, Escherichia coli CFT073
uugguguaguuguucacaacga

SEQ ID NO: 92729 - RNA, 22 nt, Escherichia coli CFT073
cgucggcuggcuucaccgcaga

SEQ ID NO: 92730 - RNA, 22 nt, Escherichia coli CFT073
ugugauacagcacgaugucagc

SEQ ID NO: 92731 - RNA, 22 nt, Escherichia coli CFT073
cgauaugucgcguucacguaag

SEQ ID NO: 92732 - RNA, 22 nt, Escherichia coli CFT073
agcagcgagagcgcgcaucaca

SEQ ID NO: 92733 - RNA, 22 nt, Escherichia coli CFT073
uuugccugauucgacgugcuca

SEQ ID NO: 92734 - RNA, 22 nt, Escherichia coli CFT073
ucuuauuucaucgguucaugug

SEQ ID NO: 92735 - RNA, 23 nt, Escherichia coli CFT073
ucggcggugcgacggucgaauuu

SEQ ID NO: 92736 - RNA, 22 nt, Escherichia coli CFT073
gucgggcguuggccgggcgaca

SEQ ID NO: 92737 - RNA, 22 nt, Escherichia coli CFT073
cugguguuuggucagccgagcg

SEQ ID NO: 92738 - RNA, 22 nt, Escherichia coli CFT073
aaacacuguugcggugagcgga

SEQ ID NO: 92739 - RNA, 22 nt, Escherichia coli CFT073
cguuugguaaugaagccucuac

SEQ ID NO: 92740 - RNA, 22 nt, Escherichia coli CFT073
gauugauagacaugccgaucau

SEQ ID NO: 92741 - RNA, 22 nt, Escherichia coli CFT073
uuuuuuaucugaauguucugga

SEQ ID NO: 92742 - RNA, 22 nt, Escherichia coli CFT073
uggguauuuaucaaccgcagau

SEQ ID NO: 92743 - RNA, 22 nt, Escherichia coli CFT073
aaucggucacuuaugauauugc

SEQ ID NO: 92744 - RNA, 22 nt, Escherichia coli CFT073
auccacuugcagcacuacgcgg

SEQ ID NO: 92745 - RNA, 19 nt, Escherichia coli CFT073
uauuucuccggauuuuuga

SEQ ID NO: 92746 - RNA, 23 nt, Escherichia coli CFT073
acguaucaagggcauuugcacca

SEQ ID NO: 92747 - RNA, 22 nt, Escherichia coli CFT073
uucgaguugaucgucagagaug

SEQ ID NO: 92748 - RNA, 17 nt, Escherichia coli CFT073
cagcaccguuacgugaa

SEQ ID NO: 92749 - RNA, 22 nt, Escherichia coli CFT073
aacgaguaaaaaugacucgccu

SEQ ID NO: 92750 - RNA, 22 nt, Escherichia coli CFT073
uuugaucuccuugccccacagc

SEQ ID NO: 92751 - RNA, 22 nt, Escherichia coli CFT073
aaacuucugccauuuugugugg

SEQ ID NO: 92752 - RNA, 22 nt, Escherichia coli CFT073
aucuucucugcuuuuggcuggg

SEQ ID NO: 92753 - RNA, 22 nt, Escherichia coli CFT073
ugaaaaacggcugcggaauuag

SEQ ID NO: 92754 - RNA, 22 nt, Escherichia coli CFT073
acgucgacuucgauuggcagug

SEQ ID NO: 92755 - RNA, 22 nt, Escherichia coli CFT073
guucuguucauggucagcgugc

SEQ ID NO: 92756 - RNA, 22 nt, Escherichia coli CFT073
uuuauggucaggaucgcucgcg

SEQ ID NO: 92757 - RNA, 22 nt, Escherichia coli CFT073
auaucugaacggucacucugac

SEQ ID NO: 92758 - RNA, 22 nt, Escherichia coli CFT073
gcggaucugauuuucagcuacu

SEQ ID NO: 92759 - RNA, 22 nt, Escherichia coli CFT073
gcguuuuaucggugaugucugc

SEQ ID NO: 92760 - RNA, 22 nt, Escherichia coli CFT073
uugccagccucgaguucaucac

SEQ ID NO: 92761 - RNA, 22 nt, Escherichia coli CFT073
ucgguucuucuggugguguaaa

SEQ ID NO: 92762 - RNA, 18 nt, Escherichia coli CFT073
ccaguuccggcaccacag

SEQ ID NO: 92763 - RNA, 22 nt, Escherichia coli CFT073
uggacgccgauaucuacggccc

SEQ ID NO: 92764 - RNA, 22 nt, Escherichia coli CFT073
gaugugguucagcuuuacgcca

SEQ ID NO: 92765 - RNA, 22 nt, Escherichia coli CFT073
guuagcaaagaggaaauuuaca

SEQ ID NO: 92766 - RNA, 22 nt, Escherichia coli CFT073
uugcguugguagguuugugcau

SEQ ID NO: 92767 - RNA, 22 nt, Escherichia coli CFT073
uaucugggaagugccuggcggu

SEQ ID NO: 92768 - RNA, 22 nt, Escherichia coli CFT073
ugcuggggaaaacauggucgau

SEQ ID NO: 92769 - RNA, 22 nt, Escherichia coli CFT073
cgcaggucaccuuuaucugccu

SEQ ID NO: 92770 - RNA, 22 nt, Escherichia coli CFT073
ucggucacccagaccuggugau

SEQ ID NO: 92771 - RNA, 22 nt, Escherichia coli CFT073
ucauuaucucaaucaggccggg

SEQ ID NO: 92772 - RNA, 22 nt, Escherichia coli CFT073
cagguguuuccagauugcugga

SEQ ID NO: 92773 - RNA, 22 nt, Escherichia coli CFT073
ugucugucucugggccuugaua

SEQ ID NO: 92774 - RNA, 22 nt, Escherichia coli CFT073
gccggaggucaucaccagcggg

SEQ ID NO: 92775 - RNA, 22 nt, Escherichia coli CFT073
ggauaugggcgucguauucguc

SEQ ID NO: 92776 - RNA, 22 nt, Escherichia coli CFT073
guaagcggauugagauguggac

SEQ ID NO: 92777 - RNA, 22 nt, Escherichia coli CFT073
caugguguucucuauguugcug

SEQ ID NO: 92778 - RNA, 22 nt, Escherichia coli CFT073
uaugcacugugaagauccgggc

SEQ ID NO: 92779 - RNA, 22 nt, Escherichia coli CFT073
uuuagcuuuugucguuggaaaa

SEQ ID NO: 92780 - RNA, 22 nt, Escherichia coli CFT073
cguuccugcuccugcuccaucc

SEQ ID NO: 92781 - RNA, 22 nt, Escherichia coli CFT073
gcuggugcacugguugaagcgu

SEQ ID NO: 92782 - RNA, 22 nt, Escherichia coli CFT073
gugauuauggaugaaccgacuu

SEQ ID NO: 92783 - RNA, 22 nt, Escherichia coli CFT073
uggguguuauuuuaaggccgca

SEQ ID NO: 92784 - RNA, 20 nt, Escherichia coli CFT073
aaagcuaaccaguuauuuuu

SEQ ID NO: 92785 - RNA, 22 nt, Escherichia coli CFT073
aucgauaucggcgggcauagca

SEQ ID NO: 92786 - RNA, 23 nt, Escherichia coli CFT073
aaagccggugcgcauccgcuuga

SEQ ID NO: 92787 - RNA, 22 nt, Escherichia coli CFT073
aucggcugaugcauacugcugg

SEQ ID NO: 92788 - RNA, 22 nt, Escherichia coli CFT073
guguuucuggugcgcguuggcu

SEQ ID NO: 92789 - RNA, 23 nt, Escherichia coli CFT073
aucgugacagguucaacugacaa

SEQ ID NO: 92790 - RNA, 22 nt, Escherichia coli CFT073
gaagggauugaagagccgcugg

SEQ ID NO: 92791 - RNA, 22 nt, Escherichia coli CFT073
agcguuuuacaucugauggacg

SEQ ID NO: 92792 - RNA, 22 nt, Escherichia coli CFT073
gcuggcagguccagucguugac

SEQ ID NO: 92793 - RNA, 22 nt, Escherichia coli CFT073
ugauuuuccgaaucaggcugcu

SEQ ID NO: 92794 - RNA, 22 nt, Escherichia coli CFT073
agauggugauuggcagcggcga

SEQ ID NO: 92795 - RNA, 20 nt, Escherichia coli CFT073
cacgccugcggcaguuccag

SEQ ID NO: 92796 - RNA, 22 nt, Escherichia coli CFT073
ucguuaucgcgauaguucaggc

SEQ ID NO: 92797 - RNA, 22 nt, Escherichia coli CFT073
uugcuguuuauagcagaugcca

SEQ ID NO: 92798 - RNA, 22 nt, Escherichia coli CFT073
cgcuauguuuauuugacccgca

SEQ ID NO: 92799 - RNA, 22 nt, Escherichia coli CFT073
uauagcaaccgaccauauuggu

SEQ ID NO: 92800 - RNA, 22 nt, Escherichia coli CFT073
aagguacgacccggcggaaaga

SEQ ID NO: 92801 - RNA, 22 nt, Escherichia coli CFT073
ccgugcgucagcuggaagagug

SEQ ID NO: 92802 - RNA, 23 nt, Escherichia coli CFT073
ugaagcugguaauaacguggcga

SEQ ID NO: 92803 - RNA, 22 nt, Escherichia coli CFT073
cgcuggugcuaaagccggggca

SEQ ID NO: 92804 - RNA, 22 nt, Escherichia coli CFT073
gucgucucuauuuaugaugccg

SEQ ID NO: 92805 - RNA, 20 nt, Escherichia coli CFT073
uggacaggaucggcgguuuu

SEQ ID NO: 92806 - RNA, 22 nt, Escherichia coli CFT073
uucuucaaccugcguaaaacca

SEQ ID NO: 92807 - RNA, 22 nt, Escherichia coli CFT073
aguguuucauuuuuaccaugug

SEQ ID NO: 92808 - RNA, 22 nt, Escherichia coli CFT073
agcagauacagaagguucaggu

SEQ ID NO: 92809 - RNA, 22 nt, Escherichia coli CFT073
ugccguuacgcugcggugccag

SEQ ID NO: 92810 - RNA, 22 nt, Escherichia coli CFT073
ucacuggugagaagcaguauca

SEQ ID NO: 92811 - RNA, 22 nt, Escherichia coli CFT073
uccagcguuuugguguguucgc

SEQ ID NO: 92812 - RNA, 22 nt, Escherichia coli CFT073
ggcuggcaguucaccauugccc

SEQ ID NO: 92813 - RNA, 22 nt, Escherichia coli CFT073
guggcuguguaagaauccggaa

SEQ ID NO: 92814 - RNA, 22 nt, Escherichia coli CFT073
guuuugugugauucugccaggc

SEQ ID NO: 92815 - RNA, 22 nt, Escherichia coli CFT073
augcggcguaaacgccuuaucu

SEQ ID NO: 92816 - RNA, 22 nt, Escherichia coli CFT073
aggcgugucaucagcauggagc

SEQ ID NO: 92817 - RNA, 22 nt, Escherichia coli CFT073
ggaccgcaugggugcgaacuuc

SEQ ID NO: 92818 - RNA, 22 nt, Escherichia coli CFT073
uauacgcugccgccauauucaa

SEQ ID NO: 92819 - RNA, 22 nt, Escherichia coli CFT073
guugauggcgcaaaaccgaacg

SEQ ID NO: 92820 - RNA, 22 nt, Escherichia coli CFT073
acugaugggcgugcugccagug

SEQ ID NO: 92821 - RNA, 22 nt, Escherichia coli CFT073
accugcgaaccaacauugaucc

SEQ ID NO: 92822 - RNA, 22 nt, Escherichia coli CFT073
guggggaaccagguucgccuuc

SEQ ID NO: 92823 - RNA, 22 nt, Escherichia coli CFT073
uggguaaaaaccucggcgacgg

SEQ ID NO: 92824 - RNA, 18 nt, Escherichia coli CFT073
aucugcucaaugcuggug

SEQ ID NO: 92825 - RNA, 22 nt, Escherichia coli CFT073
uucagaauuuggcgaucugaaa

SEQ ID NO: 92826 - RNA, 18 nt, Escherichia coli CFT073
cgcugguuguuauggcga

SEQ ID NO: 92827 - RNA, 22 nt, Escherichia coli CFT073
ugccgcgcugcucacgcuguuu

SEQ ID NO: 92828 - RNA, 22 nt, Escherichia coli CFT073
cggacugauguacugcaauggu

SEQ ID NO: 92829 - RNA, 22 nt, Escherichia coli CFT073
ccgguaagaccaccacuuucua

SEQ ID NO: 92830 - RNA, 22 nt, Escherichia coli CFT073
ggcuaucccuuaauugugcaug

SEQ ID NO: 92831 - RNA, 22 nt, Escherichia coli CFT073
guccacaucaagaucguguccg

SEQ ID NO: 92832 - RNA, 22 nt, Escherichia coli CFT073
ugaccguuaugugaauauggcc

SEQ ID NO: 92833 - RNA, 23 nt, Escherichia coli CFT073
gccugauguacaugucuucaacc

SEQ ID NO: 92834 - RNA, 22 nt, Escherichia coli CFT073
acaguauaggguuuuuauacag

SEQ ID NO: 92835 - RNA, 22 nt, Escherichia coli CFT073
aucuaugugaauaaacaugacg

SEQ ID NO: 92836 - RNA, 22 nt, Escherichia coli CFT073
cgcacguugaccgauguugagg

SEQ ID NO: 92837 - RNA, 22 nt, Escherichia coli CFT073
ugccgccgcgucuguaucaucg

SEQ ID NO: 92838 - RNA, 22 nt, Escherichia coli CFT073
acgcugcgcauaaaacuggcac

SEQ ID NO: 92839 - RNA, 22 nt, Escherichia coli CFT073
gcgggcgaggcgcauagacguu

SEQ ID NO: 92840 - RNA, 22 nt, Escherichia coli CFT073
cgccagauggagaauuagcgca

SEQ ID NO: 92841 - RNA, 22 nt, Escherichia coli CFT073
agccugcuguaucuggcaaccu

SEQ ID NO: 92842 - RNA, 22 nt, Escherichia coli CFT073
ggcaugaccacuacucugguau

SEQ ID NO: 92843 - RNA, 22 nt, Escherichia coli CFT073
gaaacgcucgaaaaacuggcag

SEQ ID NO: 92844 - RNA, 22 nt, Escherichia coli CFT073
aagccaguuacugacgggcgcu

SEQ ID NO: 92845 - RNA, 18 nt, Escherichia coli CFT073
uccgcuggacucccugaa

SEQ ID NO: 92846 - RNA, 22 nt, Escherichia coli CFT073
gccgcuccaccgucgggcugac

SEQ ID NO: 92847 - RNA, 22 nt, Escherichia coli CFT073
uaucuccaguccaaaagagcug

SEQ ID NO: 92848 - RNA, 22 nt, Escherichia coli CFT073
auccguuuccagucgccgcucu

SEQ ID NO: 92849 - RNA, 22 nt, Escherichia coli CFT073
acugucaucaaucaucuugaca

SEQ ID NO: 92850 - RNA, 22 nt, Escherichia coli CFT073
aucgagcgucaaguuucugaga

SEQ ID NO: 92851 - RNA, 22 nt, Escherichia coli CFT073
uucguugcgugagguugcuggc

SEQ ID NO: 92852 - RNA, 22 nt, Escherichia coli CFT073
accuuuuaccagacgcugcauc

SEQ ID NO: 92853 - RNA, 22 nt, Escherichia coli CFT073
cacuuucugccaguaaccgcug

SEQ ID NO: 92854 - RNA, 22 nt, Escherichia coli CFT073
auauggcacuggcugacagugu

SEQ ID NO: 92855 - RNA, 22 nt, Escherichia coli CFT073
caugguuucaccgguacccugg

SEQ ID NO: 92856 - RNA, 22 nt, Escherichia coli CFT073
ugcaguuaagugcgguuucgau

SEQ ID NO: 92857 - RNA, 22 nt, Escherichia coli CFT073
uggaugcuggcaaccgguacag

SEQ ID NO: 92858 - RNA, 20 nt, Escherichia coli CFT073
cacgcggcuagucaguuuag

SEQ ID NO: 92859 - RNA, 22 nt, Escherichia coli CFT073
cuggaagucaaagacagugaga

SEQ ID NO: 92860 - RNA, 22 nt, Escherichia coli CFT073
ugguuucugcccgagauagccg

SEQ ID NO: 92861 - RNA, 22 nt, Escherichia coli CFT073
gcauaagaagcuuucauuucag

SEQ ID NO: 92862 - RNA, 22 nt, Escherichia coli CFT073
ggcugcugaagguguucugcgc

SEQ ID NO: 92863 - RNA, 22 nt, Escherichia coli CFT073
gccagcacaccgucaaaacgcu

SEQ ID NO: 92864 - RNA, 22 nt, Escherichia coli CFT073
caggcugcguucaaggugaugg

SEQ ID NO: 92865 - RNA, 22 nt, Escherichia coli CFT073
cguuuaggaagauuugaaauug

SEQ ID NO: 92866 - RNA, 22 nt, Escherichia coli CFT073
auauuacguaacaccgcuggcg

SEQ ID NO: 92867 - RNA, 22 nt, Escherichia coli CFT073
gcgcacuugaaucgcgggaucg

SEQ ID NO: 92868 - RNA, 19 nt, Escherichia coli CFT073
aguauucuuaagggaagga

SEQ ID NO: 92869 - RNA, 22 nt, Escherichia coli CFT073
cguuccauuuucuauaucaccu

SEQ ID NO: 92870 - RNA, 22 nt, Escherichia coli CFT073
caagccuuccauuacgcugacc

SEQ ID NO: 92871 - RNA, 22 nt, Escherichia coli CFT073
uaacugaggugauuaugggcuu

SEQ ID NO: 92872 - RNA, 22 nt, Escherichia coli CFT073
gcuuccucauauucuuccugug

SEQ ID NO: 92873 - RNA, 22 nt, Escherichia coli CFT073
ugccaucacgucgauuaucgcc

SEQ ID NO: 92874 - RNA, 22 nt, Escherichia coli CFT073
agugaagcaaucaucgaaacca

SEQ ID NO: 92875 - RNA, 22 nt, Escherichia coli CFT073
cuacguugagaugcuggcgcgu

SEQ ID NO: 92876 - RNA, 22 nt, Escherichia coli CFT073
gauggggcagguguggaucagc

SEQ ID NO: 92877 - RNA, 22 nt, Escherichia coli CFT073
ucagauuuggcgggcuuaucuu

SEQ ID NO: 92878 - RNA, 22 nt, Escherichia coli CFT073
uccgcgauaauaauggacggca

SEQ ID NO: 92879 - RNA, 22 nt, Escherichia coli CFT073
caucgcuuuucuggauuauuug

SEQ ID NO: 92880 - RNA, 22 nt, Escherichia coli CFT073
ucaggcauuguguaggcagcag

SEQ ID NO: 92881 - RNA, 22 nt, Escherichia coli CFT073
aacguuugcguauuuucaugga

SEQ ID NO: 92882 - RNA, 19 nt, Escherichia coli CFT073
cuugcggugaagaagcggu

SEQ ID NO: 92883 - RNA, 19 nt, Escherichia coli CFT073
accgcguggguuggcuggc

SEQ ID NO: 92884 - RNA, 22 nt, Escherichia coli CFT073
ugccgcauccggcgauuuucau

SEQ ID NO: 92885 - RNA, 22 nt, Escherichia coli CFT073
uuccagccagucagccugacga

SEQ ID NO: 92886 - RNA, 22 nt, Escherichia coli CFT073
gucgccagcaauucauccagug

SEQ ID NO: 92887 - RNA, 22 nt, Escherichia coli CFT073
gggaaucaauaucggauugauu

SEQ ID NO: 92888 - RNA, 22 nt, Escherichia coli CFT073
uugaagcgcuuagcagcaccgc

SEQ ID NO: 92889 - RNA, 22 nt, Escherichia coli CFT073
cgucauccuggugguuuucacc

SEQ ID NO: 92890 - RNA, 22 nt, Escherichia coli CFT073
agggcgagcagcugcgcgugac

SEQ ID NO: 92891 - RNA, 21 nt, Escherichia coli CFT073
uuguccgcuaucuggcggcac

SEQ ID NO: 92892 - RNA, 22 nt, Escherichia coli CFT073
gccuguccgacaugagagagca

SEQ ID NO: 92893 - RNA, 22 nt, Escherichia coli CFT073
auaugcgguucaucagaugcau

SEQ ID NO: 92894 - RNA, 22 nt, Escherichia coli CFT073
uggugacguaacgcgccaccag

SEQ ID NO: 92895 - RNA, 23 nt, Escherichia coli CFT073
uggcggcaaccgggauccugaaa

SEQ ID NO: 92896 - RNA, 22 nt, Escherichia coli CFT073
uuuccauauugucuuccagauc

SEQ ID NO: 92897 - RNA, 22 nt, Escherichia coli CFT073
uucagucugaauucagccuugc

SEQ ID NO: 92898 - RNA, 22 nt, Escherichia coli CFT073
aaugcguugguagugcguaaca

SEQ ID NO: 92899 - RNA, 22 nt, Escherichia coli CFT073
uugccgccagugcgcuuggacu

SEQ ID NO: 92900 - RNA, 22 nt, Escherichia coli CFT073
ucgucauucauuaucagaugcc

SEQ ID NO: 92901 - RNA, 22 nt, Escherichia coli CFT073
augucagacgcagacuaagcgg

SEQ ID NO: 92902 - RNA, 22 nt, Escherichia coli CFT073
gacauguucaaugacggucugg

SEQ ID NO: 92903 - RNA, 22 nt, Escherichia coli CFT073
aacguuuacaguaauaccgcgu

SEQ ID NO: 92904 - RNA, 22 nt, Escherichia coli CFT073
cgaaagacggcugguuauucac

SEQ ID NO: 92905 - RNA, 22 nt, Escherichia coli CFT073
gugucgguguauucgucagcga

SEQ ID NO: 92906 - RNA, 22 nt, Escherichia coli CFT073
uccgcuucgccucgaccaucgc

SEQ ID NO: 92907 - RNA, 22 nt, Escherichia coli CFT073
gugucgcugccgaaaaagaugc

SEQ ID NO: 92908 - RNA, 22 nt, Escherichia coli CFT073
aaguggaugacuuugccgccag

SEQ ID NO: 92909 - RNA, 22 nt, Escherichia coli CFT073
aggucagauaagcgaaacgcau

SEQ ID NO: 92910 - RNA, 22 nt, Escherichia coli CFT073
aaugaccaguaaugcuuugccc

SEQ ID NO: 92911 - RNA, 22 nt, Escherichia coli CFT073
uggcgaaugugcuggagccaga

SEQ ID NO: 92912 - RNA, 22 nt, Escherichia coli CFT073
aguaaguucuaugacgcaucgu

SEQ ID NO: 92913 - RNA, 22 nt, Escherichia coli CFT073
gaggcgaaagccgggcgcagcu

SEQ ID NO: 92914 - RNA, 22 nt, Escherichia coli CFT073
uuugguagcuaugucgcguuua

SEQ ID NO: 92915 - RNA, 22 nt, Escherichia coli CFT073
ucugcguuauccagcgaaccgu

SEQ ID NO: 92916 - RNA, 21 nt, Escherichia coli CFT073
gccuggacagcagcugucugc

SEQ ID NO: 92917 - RNA, 22 nt, Escherichia coli CFT073
ccgaucuucuucaugguaauac

SEQ ID NO: 92918 - RNA, 23 nt, Escherichia coli CFT073
ucuggcuuguuucugcucaccgu

SEQ ID NO: 92919 - RNA, 22 nt, Escherichia coli CFT073
gcagcacguugcggcugcguuu

SEQ ID NO: 92920 - RNA, 22 nt, Escherichia coli CFT073
ugcgaaaugagaacaacgauga

SEQ ID NO: 92921 - RNA, 22 nt, Escherichia coli CFT073
uucccuggcaauauccgcuuca

SEQ ID NO: 92922 - RNA, 22 nt, Escherichia coli CFT073
gguucacuggugguuuuacugg

SEQ ID NO: 92923 - RNA, 22 nt, Escherichia coli CFT073
uuggaucauaguuucuggaacu

SEQ ID NO: 92924 - RNA, 23 nt, Escherichia coli CFT073
auuaccccaaacgaacaggcaag

SEQ ID NO: 92925 - RNA, 22 nt, Escherichia coli CFT073
auaagccuaauggagcgaauua

SEQ ID NO: 92926 - RNA, 22 nt, Escherichia coli CFT073
cauugcgcagguuuggagugau

SEQ ID NO: 92927 - RNA, 22 nt, Escherichia coli CFT073
acacgcagcauacugacccgcg

SEQ ID NO: 92928 - RNA, 22 nt, Escherichia coli CFT073
uucuggcagugaucgucccugc

SEQ ID NO: 92929 - RNA, 22 nt, Escherichia coli CFT073
aaauugguuuucguacccgcua

SEQ ID NO: 92930 - RNA, 22 nt, Escherichia coli CFT073
agauggaugguuuugaagguaa

SEQ ID NO: 92931 - RNA, 22 nt, Escherichia coli CFT073
cgaacuggaacgggcguugagu

SEQ ID NO: 92932 - RNA, 22 nt, Escherichia coli CFT073
uaaagugaucuucuaagcccgc

SEQ ID NO: 92933 - RNA, 22 nt, Escherichia coli CFT073
uggcaggagguucucguucagg

SEQ ID NO: 92934 - RNA, 22 nt, Escherichia coli CFT073
cugccagcuacuuugugucagu

SEQ ID NO: 92935 - RNA, 19 nt, Escherichia coli CFT073
aguugucguuccucaacuc

SEQ ID NO: 92936 - RNA, 22 nt, Escherichia coli CFT073
gcugguuaucggaagagaugaa

SEQ ID NO: 92937 - RNA, 22 nt, Escherichia coli CFT073
cgugguaugcacgcauggugcg

SEQ ID NO: 92938 - RNA, 22 nt, Escherichia coli CFT073
ugcagcguucuguaggcuggau

SEQ ID NO: 92939 - RNA, 22 nt, Escherichia coli CFT073
aaggcguuauuauuaauugccg

SEQ ID NO: 92940 - RNA, 22 nt, Escherichia coli CFT073
cauccugagaagcuugcaguga

SEQ ID NO: 92941 - RNA, 22 nt, Escherichia coli CFT073
uacuggguguuugauuucguug

SEQ ID NO: 92942 - RNA, 22 nt, Escherichia coli CFT073
caggccuacacguucgcugcaa

SEQ ID NO: 92943 - RNA, 22 nt, Escherichia coli CFT073
cgauaaaaccaauuucaccuuc

SEQ ID NO: 92944 - RNA, 22 nt, Escherichia coli CFT073
ggcgcgucgcgggagauauccc

SEQ ID NO: 92945 - RNA, 22 nt, Escherichia coli CFT073
uauugguggugcacauaacgca

SEQ ID NO: 92946 - RNA, 21 nt, Escherichia coli CFT073
guuuggcaucgcuuaucaguc

SEQ ID NO: 92947 - RNA, 22 nt, Escherichia coli CFT073
ugguagauaucgcgcaggaagc

SEQ ID NO: 92948 - RNA, 22 nt, Escherichia coli CFT073
gcgggaucaacaucgacaaccg

SEQ ID NO: 92949 - RNA, 22 nt, Escherichia coli CFT073
uguuuuccuguaugaaaaacca

SEQ ID NO: 92950 - RNA, 22 nt, Escherichia coli CFT073
uguccggcagggcggguuacgc

SEQ ID NO: 92951 - RNA, 22 nt, Escherichia coli CFT073
ggcuuugucuucaccaaguugu

SEQ ID NO: 92952 - RNA, 22 nt, Escherichia coli CFT073
gggcgcagaaaaucagcgucca

SEQ ID NO: 92953 - RNA, 20 nt, Escherichia coli CFT073
gcauccucgcacuggguggu

SEQ ID NO: 92954 - RNA, 22 nt, Escherichia coli CFT073
augcagagcagguauuccagcu

SEQ ID NO: 92955 - RNA, 22 nt, Escherichia coli CFT073
uuggcacuacgcuuucuggcua

SEQ ID NO: 92956 - RNA, 22 nt, Escherichia coli CFT073
acgaugcguauccugauauuga

SEQ ID NO: 92957 - RNA, 19 nt, Escherichia coli CFT073
ccgucagguaguaaaaccu

SEQ ID NO: 92958 - RNA, 22 nt, Escherichia coli CFT073
uauuggauuuaucucgcgaaaa

SEQ ID NO: 92959 - RNA, 22 nt, Escherichia coli CFT073
uuacugcgcgcuuauccucgua

SEQ ID NO: 92960 - RNA, 22 nt, Escherichia coli CFT073
gccuugaagggggugaucguua

SEQ ID NO: 92961 - RNA, 19 nt, Escherichia coli CFT073
aucacccgcauaaagacgc

SEQ ID NO: 92962 - RNA, 22 nt, Escherichia coli CFT073
ucuggcgguggcacugucgaug

SEQ ID NO: 92963 - RNA, 22 nt, Escherichia coli CFT073
ucagcaagaguaucgcgccugu

SEQ ID NO: 92964 - RNA, 22 nt, Escherichia coli CFT073
ucauaaugggaguuuugauacu

SEQ ID NO: 92965 - RNA, 22 nt, Escherichia coli CFT073
ucagaagaguaagaucaauauu

SEQ ID NO: 92966 - RNA, 22 nt, Escherichia coli CFT073
uacugaaaacaaccgaugguaa

SEQ ID NO: 92967 - RNA, 22 nt, Escherichia coli CFT073
cagguuguugaacucguacgcc

SEQ ID NO: 92968 - RNA, 22 nt, Escherichia coli CFT073
uacuggagguggaagggaugaa

SEQ ID NO: 92969 - RNA, 22 nt, Escherichia coli CFT073
aauccgguguuugcauuuuuga

SEQ ID NO: 92970 - RNA, 19 nt, Escherichia coli CFT073
ccagguuggcguccagcug

SEQ ID NO: 92971 - RNA, 22 nt, Escherichia coli CFT073
gcgaugauaugguugcuggcgg

SEQ ID NO: 92972 - RNA, 22 nt, Escherichia coli CFT073
gcacgucuucgacuucgagaau

SEQ ID NO: 92973 - RNA, 22 nt, Escherichia coli CFT073
gguguuggagcgguaggccgga

SEQ ID NO: 92974 - RNA, 22 nt, Escherichia coli CFT073
gcugguuaagcguauuagccaa

SEQ ID NO: 92975 - RNA, 22 nt, Escherichia coli CFT073
uugcgggagagcuuaucgauau

SEQ ID NO: 92976 - RNA, 22 nt, Escherichia coli CFT073
augugugaagcaacagccgcca

SEQ ID NO: 92977 - RNA, 22 nt, Escherichia coli CFT073
gugcugguucuugucgauggug

SEQ ID NO: 92978 - RNA, 22 nt, Escherichia coli CFT073
uccggcacuguuuugaggcuua

SEQ ID NO: 92979 - RNA, 22 nt, Escherichia coli CFT073
cuggauuggcagcgcguggguc

SEQ ID NO: 92980 - RNA, 22 nt, Escherichia coli CFT073
ugcaacauuugucgccgcagga

SEQ ID NO: 92981 - RNA, 22 nt, Escherichia coli CFT073
uuacgcagcaguuccaggugcg

SEQ ID NO: 92982 - RNA, 22 nt, Escherichia coli CFT073
gcagacgaugaugcagauaacc

SEQ ID NO: 92983 - RNA, 22 nt, Escherichia coli CFT073
ucugacgauagauuaauguggu

SEQ ID NO: 92984 - RNA, 22 nt, Escherichia coli CFT073
ucuguaauuacaaacaacagug

SEQ ID NO: 92985 - RNA, 22 nt, Escherichia coli CFT073
uaugugggaagggaucggcgca

SEQ ID NO: 92986 - RNA, 22 nt, Escherichia coli CFT073
cgcugauugcuuucuuucacgg

SEQ ID NO: 92987 - RNA, 22 nt, Escherichia coli CFT073
cgauggcugaaugucuggcagc

SEQ ID NO: 92988 - RNA, 22 nt, Escherichia coli CFT073
ccuaccuggcggaugacgccau

SEQ ID NO: 92989 - RNA, 22 nt, Escherichia coli CFT073
agccgcuauaucaccaguucug

SEQ ID NO: 92990 - RNA, 22 nt, Escherichia coli CFT073
auguuaauccugcguggucagg

SEQ ID NO: 92991 - RNA, 22 nt, Escherichia coli CFT073
uacccguugcagcggucaguga

SEQ ID NO: 92992 - RNA, 23 nt, Escherichia coli CFT073
ugcuaccgcuaucguccugacgc

SEQ ID NO: 92993 - RNA, 22 nt, Escherichia coli CFT073
uugugcuggaugaaguaccaga

SEQ ID NO: 92994 - RNA, 22 nt, Escherichia coli CFT073
ggcgguggaacuggcuucuaug

SEQ ID NO: 92995 - RNA, 22 nt, Escherichia coli CFT073
ggauaaggcguucacgccgcau

SEQ ID NO: 92996 - RNA, 22 nt, Escherichia coli CFT073
ggccuuaacgauaagcaguuag

SEQ ID NO: 92997 - RNA, 22 nt, Escherichia coli CFT073
gcugccagccugccauccggcg

SEQ ID NO: 92998 - RNA, 23 nt, Escherichia coli CFT073
ucgcugguuaaguauucaugugc

SEQ ID NO: 92999 - RNA, 22 nt, Escherichia coli CFT073
ugucgcuaugguagugcaggua

SEQ ID NO: 93000 - RNA, 22 nt, Escherichia coli CFT073
guggcucgccgugcaucacuuu

SEQ ID NO: 93001 - RNA, 22 nt, Escherichia coli CFT073
auggcgcaauuuagcggguugg

SEQ ID NO: 93002 - RNA, 22 nt, Escherichia coli CFT073
uuuguaggccggauaaggcguu

SEQ ID NO: 93003 - RNA, 22 nt, Escherichia coli CFT073
agcauucaguugaugaaaucgc

SEQ ID NO: 93004 - RNA, 22 nt, Escherichia coli CFT073
aucacgccaauacgugaucgca

SEQ ID NO: 93005 - RNA, 19 nt, Escherichia coli CFT073
aacaccauuacggaugaac

SEQ ID NO: 93006 - RNA, 22 nt, Escherichia coli CFT073
uggccugaugcgucagauugaa

SEQ ID NO: 93007 - RNA, 22 nt, Escherichia coli CFT073
ucgauaaagcgauggccgacca

SEQ ID NO: 93008 - RNA, 18 nt, Escherichia coli CFT073
agcuuaucugagacaaug

SEQ ID NO: 93009 - RNA, 23 nt, Escherichia coli CFT073
caggcccagcgcccagguggugc

SEQ ID NO: 93010 - RNA, 22 nt, Escherichia coli CFT073
cuggaugauugaugaguguuua

SEQ ID NO: 93011 - RNA, 20 nt, Escherichia coli CFT073
uuugcuaucguugauaccaa

SEQ ID NO: 93012 - RNA, 22 nt, Escherichia coli CFT073
cagcgaggcaccaucauugaga

SEQ ID NO: 93013 - RNA, 22 nt, Escherichia coli CFT073
aaaagugauauuacggucucgu

SEQ ID NO: 93014 - RNA, 22 nt, Escherichia coli CFT073
uugcaagcuucgggcggucuug

SEQ ID NO: 93015 - RNA, 22 nt, Escherichia coli CFT073
uucuggcguuuucaugucgggc

SEQ ID NO: 93016 - RNA, 22 nt, Escherichia coli CFT073
agcgccgcuuccauguccugga

SEQ ID NO: 93017 - RNA, 22 nt, Escherichia coli CFT073
ucccggugucgaucgacuggau

SEQ ID NO: 93018 - RNA, 22 nt, Escherichia coli CFT073
ugguuugcugauuacgccgugg

SEQ ID NO: 93019 - RNA, 22 nt, Escherichia coli CFT073
gcugacgcgucuuaucaggccu

SEQ ID NO: 93020 - RNA, 22 nt, Escherichia coli CFT073
ucgcuauaacagcgcauggaac

SEQ ID NO: 93021 - RNA, 21 nt, Escherichia coli CFT073
cgguggaagcauuugaacugg

SEQ ID NO: 93022 - RNA, 22 nt, Escherichia coli CFT073
accuuguaaaaaugcguugcug

SEQ ID NO: 93023 - RNA, 22 nt, Escherichia coli CFT073
gcgcaauucuggggucgaugga

SEQ ID NO: 93024 - RNA, 22 nt, Escherichia coli CFT073
ugaauuuccgaaguaucucgcg

SEQ ID NO: 93025 - RNA, 21 nt, Escherichia coli CFT073
ucaaugauggugccucgcugu

SEQ ID NO: 93026 - RNA, 23 nt, Escherichia coli CFT073
uggugcacggacaagaaucagcg

SEQ ID NO: 93027 - RNA, 22 nt, Escherichia coli CFT073
gugacgucuuccucgcuuucgc

SEQ ID NO: 93028 - RNA, 22 nt, Escherichia coli CFT073
gcgggugaugacauucuugcug

SEQ ID NO: 93029 - RNA, 22 nt, Escherichia coli CFT073
gcccgcuguuuacgcuaacugc

SEQ ID NO: 93030 - RNA, 22 nt, Escherichia coli CFT073
gucgcggaagagcuuguggaga

SEQ ID NO: 93031 - RNA, 22 nt, Escherichia coli CFT073
aaguuugccguggcaguggcga

SEQ ID NO: 93032 - RNA, 22 nt, Escherichia coli CFT073
ggcgcguuuccacaacguuaca

SEQ ID NO: 93033 - RNA, 22 nt, Escherichia coli CFT073
cagcggcucgccuuuugccgug

SEQ ID NO: 93034 - RNA, 22 nt, Escherichia coli CFT073
ugaccguaaaggucgucgugaa

SEQ ID NO: 93035 - RNA, 22 nt, Escherichia coli CFT073
ggcuacugaaacugaugacaaa

SEQ ID NO: 93036 - RNA, 22 nt, Escherichia coli CFT073
uucugcgguaaaugcgauugaa

SEQ ID NO: 93037 - RNA, 22 nt, Escherichia coli CFT073
ugguuccggcgcgcagaacgca

SEQ ID NO: 93038 - RNA, 22 nt, Escherichia coli CFT073
uaauguuauuuaaauaccauug

SEQ ID NO: 93039 - RNA, 23 nt, Escherichia coli CFT073
gcagauuauucugcugaucagag

SEQ ID NO: 93040 - RNA, 22 nt, Escherichia coli CFT073
uccaggcaaacgccaguaaaaa

SEQ ID NO: 93041 - RNA, 22 nt, Escherichia coli CFT073
ugcagcagcaaaauaucuucug

SEQ ID NO: 93042 - RNA, 22 nt, Escherichia coli CFT073
uggcagcguuaauucaaaaccu

SEQ ID NO: 93043 - RNA, 22 nt, Escherichia coli CFT073
ggcaaugcucaaugaggcacga

SEQ ID NO: 93044 - RNA, 22 nt, Escherichia coli CFT073
ggcgccgcucaauauggggauu

SEQ ID NO: 93045 - RNA, 20 nt, Escherichia coli CFT073
augagagaaaaguuauggau

SEQ ID NO: 93046 - RNA, 22 nt, Escherichia coli CFT073
cacguuuuuauugaucacuacg

SEQ ID NO: 93047 - RNA, 22 nt, Escherichia coli CFT073
accucgacagcaugagcccgga

SEQ ID NO: 93048 - RNA, 22 nt, Escherichia coli CFT073
ccguaggucggauaaggcgcuc

SEQ ID NO: 93049 - RNA, 22 nt, Escherichia coli CFT073
aaucacaguagucgaaguuuuu

SEQ ID NO: 93050 - RNA, 22 nt, Escherichia coli CFT073
cgccucggagaagcaccugauu

SEQ ID NO: 93051 - RNA, 22 nt, Escherichia coli CFT073
cucugcgacgggaagcggugcu

SEQ ID NO: 93052 - RNA, 22 nt, Escherichia coli CFT073
uugaugaaccacucggugcgcu

SEQ ID NO: 93053 - RNA, 22 nt, Escherichia coli CFT073
auugucggugucagcgugucac

SEQ ID NO: 93054 - RNA, 22 nt, Escherichia coli CFT073
aaccgcaagauuacaacgaaca

SEQ ID NO: 93055 - RNA, 22 nt, Escherichia coli CFT073
cugcuguacauggcugccgcug

SEQ ID NO: 93056 - RNA, 22 nt, Escherichia coli CFT073
ccugauguuugacgaguauuua

SEQ ID NO: 93057 - RNA, 22 nt, Escherichia coli CFT073
ucaagcgaugcgccaaguuuua

SEQ ID NO: 93058 - RNA, 19 nt, Escherichia coli CFT073
ggucgugacaaguuagcgc

SEQ ID NO: 93059 - RNA, 17 nt, Escherichia coli CFT073
auuucugcucauccagc

SEQ ID NO: 93060 - RNA, 22 nt, Escherichia coli CFT073
gauauuuuacgcgcaauaacug

SEQ ID NO: 93061 - RNA, 22 nt, Escherichia coli CFT073
gucgccauuauccguccagccu

SEQ ID NO: 93062 - RNA, 20 nt, Escherichia coli CFT073
aaggcgauugcaggaagcag

SEQ ID NO: 93063 - RNA, 18 nt, Escherichia coli CFT073
gcuugcugugaucgucaa

SEQ ID NO: 93064 - RNA, 22 nt, Escherichia coli CFT073
ccgugcagcaacuugauccgau

SEQ ID NO: 93065 - RNA, 22 nt, Escherichia coli CFT073
uccgcaucggcauugaacugga

SEQ ID NO: 93066 - RNA, 22 nt, Escherichia coli CFT073
uguuggcaaucugcugcgccgu

SEQ ID NO: 93067 - RNA, 22 nt, Escherichia coli CFT073
ugaagcacuauauuggugcaac

SEQ ID NO: 93068 - RNA, 22 nt, Escherichia coli CFT073
auaagacgcgucagcgucgcau

SEQ ID NO: 93069 - RNA, 22 nt, Escherichia coli CFT073
caugccaaaagcugggagccga

SEQ ID NO: 93070 - RNA, 22 nt, Escherichia coli CFT073
auucuuuggccugggugcguac

SEQ ID NO: 93071 - RNA, 22 nt, Escherichia coli CFT073
uguuaccgcgggauuuacgccg

SEQ ID NO: 93072 - RNA, 22 nt, Escherichia coli CFT073
ucauacucgucauacuucaucg

SEQ ID NO: 93073 - RNA, 22 nt, Escherichia coli CFT073
uuuuucagaaagaaugugauga

SEQ ID NO: 93074 - RNA, 22 nt, Escherichia coli CFT073
gguaaagugcuuuccuguggca

SEQ ID NO: 93075 - RNA, 18 nt, Escherichia coli CFT073
cugucguuuccuuucuuu

SEQ ID NO: 93076 - RNA, 22 nt, Escherichia coli CFT073
aacuuacugaugaucaaugcgc

SEQ ID NO: 93077 - RNA, 22 nt, Escherichia coli CFT073
ugacugugaaugaaagguuauu

SEQ ID NO: 93078 - RNA, 22 nt, Escherichia coli CFT073
cuuuucuaccgucaucguaccg

SEQ ID NO: 93079 - RNA, 22 nt, Escherichia coli CFT073
gaugaacccguuuugugugguu

SEQ ID NO: 93080 - RNA, 22 nt, Escherichia coli CFT073
ggauauugguucccgucuggua

SEQ ID NO: 93081 - RNA, 22 nt, Escherichia coli CFT073
ccgacuugcauaagauaaacga

SEQ ID NO: 93082 - RNA, 22 nt, Escherichia coli CFT073
gccgaagaaaaagucggagcau

SEQ ID NO: 93083 - RNA, 23 nt, Escherichia coli CFT073
augucuguucccugcugccggac

SEQ ID NO: 93084 - RNA, 22 nt, Escherichia coli CFT073
acgaagaucgucagccggaacu

SEQ ID NO: 93085 - RNA, 22 nt, Escherichia coli CFT073
cagaacuggugauauagcggcu

SEQ ID NO: 93086 - RNA, 22 nt, Escherichia coli CFT073
aucgucacccacgauccgcagg

SEQ ID NO: 93087 - RNA, 22 nt, Escherichia coli CFT073
augcgcuucgcuuauccggccu

SEQ ID NO: 93088 - RNA, 22 nt, Escherichia coli CFT073
acuucccguaugugcugaugaa

SEQ ID NO: 93089 - RNA, 22 nt, Escherichia coli CFT073
guuguuguugucgggaugcguu

SEQ ID NO: 93090 - RNA, 22 nt, Escherichia coli CFT073
cagcuacaggccguucccugga

SEQ ID NO: 93091 - RNA, 22 nt, Escherichia coli CFT073
ucuguuggcggggaagugaucg

SEQ ID NO: 93092 - RNA, 22 nt, Escherichia coli CFT073
cuaaguuucguaaugacccacu

SEQ ID NO: 93093 - RNA, 22 nt, Escherichia coli CFT073
gccgcacguucaugccuggcau

SEQ ID NO: 93094 - RNA, 22 nt, Escherichia coli CFT073
uucgccaggcggaauauugaaa

SEQ ID NO: 93095 - RNA, 22 nt, Escherichia coli CFT073
uugcgguuaacgugggucggca

SEQ ID NO: 93096 - RNA, 22 nt, Escherichia coli CFT073
ggcagcaagugcagcucgcugg

SEQ ID NO: 93097 - RNA, 22 nt, Escherichia coli CFT073
uggaguacuucaacaucacgcu

SEQ ID NO: 93098 - RNA, 22 nt, Escherichia coli CFT073
uaacaugcgcgcacgaucacuc

SEQ ID NO: 93099 - RNA, 22 nt, Escherichia coli CFT073
acuggugaaaucggcguauuaa

SEQ ID NO: 93100 - RNA, 22 nt, Escherichia coli CFT073
uuagcggcaagcgacgcgacau

SEQ ID NO: 93101 - RNA, 22 nt, Escherichia coli CFT073
ucaccugacgagcaaacugucg

SEQ ID NO: 93102 - RNA, 22 nt, Escherichia coli CFT073
ugagaaugucaucuucagugac

SEQ ID NO: 93103 - RNA, 22 nt, Escherichia coli CFT073
caggccuacugggugaguugca

SEQ ID NO: 93104 - RNA, 22 nt, Escherichia coli CFT073
uuaacugcugagccggugcguu

SEQ ID NO: 93105 - RNA, 22 nt, Escherichia coli CFT073
uaagcucaccacugcacgaaaa

SEQ ID NO: 93106 - RNA, 22 nt, Escherichia coli CFT073
cugcugugcagucgcggucaua

SEQ ID NO: 93107 - RNA, 22 nt, Escherichia coli CFT073
aaggcuggauuuaucaguucca

SEQ ID NO: 93108 - RNA, 22 nt, Escherichia coli CFT073
gcgucguuugccaugcgaaggu

SEQ ID NO: 93109 - RNA, 18 nt, Escherichia coli CFT073
gcauggucagcggccugc

SEQ ID NO: 93110 - RNA, 22 nt, Escherichia coli CFT073
auccugauuugcucucucauua

SEQ ID NO: 93111 - RNA, 21 nt, Escherichia coli CFT073
agcguuauggcguacgucugc

SEQ ID NO: 93112 - RNA, 22 nt, Escherichia coli CFT073
ccugaacaaagcgcucggagug

SEQ ID NO: 93113 - RNA, 21 nt, Escherichia coli CFT073
caucuggaauaugcaucagcg

SEQ ID NO: 93114 - RNA, 21 nt, Escherichia coli CFT073
augggcaucaaccuguuccgc

SEQ ID NO: 93115 - RNA, 22 nt, Escherichia coli CFT073
ucacugaauuuaugggggacgc

SEQ ID NO: 93116 - RNA, 22 nt, Escherichia coli CFT073
ccggaauugagugaccaauaua

SEQ ID NO: 93117 - RNA, 20 nt, Escherichia coli CFT073
aguuuggccgagaggauuug

SEQ ID NO: 93118 - RNA, 23 nt, Escherichia coli CFT073
ggccauugacgcaucgcccgguu

SEQ ID NO: 93119 - RNA, 22 nt, Escherichia coli CFT073
gaccaguugcaggagaucguua

SEQ ID NO: 93120 - RNA, 22 nt, Escherichia coli CFT073
agaaaggaaacgacaggugcug

SEQ ID NO: 93121 - RNA, 22 nt, Escherichia coli CFT073
cgguuuauaagcgccaucagug

SEQ ID NO: 93122 - RNA, 21 nt, Escherichia coli CFT073
ucguuuugauauuauuaugca

SEQ ID NO: 93123 - RNA, 22 nt, Escherichia coli CFT073
guuuuuucgcgaauguucugug

SEQ ID NO: 93124 - RNA, 20 nt, Escherichia coli CFT073
aaaacgugauuuuuacuggc

SEQ ID NO: 93125 - RNA, 22 nt, Escherichia coli CFT073
uugggccaggaaagcauaacuu

SEQ ID NO: 93126 - RNA, 22 nt, Escherichia coli CFT073
uauucccauaaacucagaucua

SEQ ID NO: 93127 - RNA, 22 nt, Escherichia coli CFT073
uggguuuugaagcgccgggaga

SEQ ID NO: 93128 - RNA, 22 nt, Escherichia coli CFT073
agcgaaagccagcucaugcagg

SEQ ID NO: 93129 - RNA, 22 nt, Escherichia coli CFT073
auucaguugauacugauuuucc

SEQ ID NO: 93130 - RNA, 22 nt, Escherichia coli CFT073
agugauuaacgucucuuucaga

SEQ ID NO: 93131 - RNA, 22 nt, Escherichia coli CFT073
gcugauggucugucguagagcc

SEQ ID NO: 93132 - RNA, 22 nt, Escherichia coli CFT073
cggcaucuggaucgcccgguuu

SEQ ID NO: 93133 - RNA, 22 nt, Escherichia coli CFT073
aaauacagccuggcggaacuga

SEQ ID NO: 93134 - RNA, 22 nt, Escherichia coli CFT073
uguaggucggauaagacgcaua

SEQ ID NO: 93135 - RNA, 22 nt, Escherichia coli CFT073
gguuggacgcccacugcuggca

SEQ ID NO: 93136 - RNA, 22 nt, Escherichia coli CFT073
aggucaaucaucuguucacuau

SEQ ID NO: 93137 - RNA, 22 nt, Escherichia coli CFT073
uuugcuguuuucgccuucgcac

SEQ ID NO: 93138 - RNA, 19 nt, Escherichia coli CFT073
ucaacuggcgcaaaacugg

SEQ ID NO: 93139 - RNA, 22 nt, Escherichia coli CFT073
cagauucaucagguaaugccag

SEQ ID NO: 93140 - RNA, 22 nt, Escherichia coli CFT073
uuacccgaccgagccgcgccau

SEQ ID NO: 93141 - RNA, 22 nt, Escherichia coli CFT073
ucaucugcgcaucgcuuaacgu

SEQ ID NO: 93142 - RNA, 22 nt, Escherichia coli CFT073
guuaaacagacugagguagguc

SEQ ID NO: 93143 - RNA, 22 nt, Escherichia coli CFT073
cuuuuucucugauucaucaaau

SEQ ID NO: 93144 - RNA, 22 nt, Escherichia coli CFT073
uuuucgugaagagguuuuguaa

SEQ ID NO: 93145 - RNA, 20 nt, Escherichia coli CFT073
gcuuccauugcaucacaaua

SEQ ID NO: 93146 - RNA, 22 nt, Escherichia coli CFT073
aacucucuguuccagccgugcu

SEQ ID NO: 93147 - RNA, 20 nt, Escherichia coli CFT073
ugaguacgcgcuuaccacug

SEQ ID NO: 93148 - RNA, 22 nt, Escherichia coli CFT073
uuaucucggugcgggaacaucc

SEQ ID NO: 93149 - RNA, 22 nt, Escherichia coli CFT073
cuggcuacucaggcgauacagu

SEQ ID NO: 93150 - RNA, 22 nt, Escherichia coli CFT073
cgucggcacugugcggcacucg

SEQ ID NO: 93151 - RNA, 22 nt, Escherichia coli CFT073
agcguugaccuuccugauugcg

SEQ ID NO: 93152 - RNA, 22 nt, Escherichia coli CFT073
cgugcagcaagaaccguauuga

SEQ ID NO: 93153 - RNA, 22 nt, Escherichia coli CFT073
cccgggcgugaguuaaugcuga

SEQ ID NO: 93154 - RNA, 22 nt, Escherichia coli CFT073
uuugaacgguuuguaggccgga

SEQ ID NO: 93155 - RNA, 22 nt, Escherichia coli CFT073
gcgccgagcgucagugggaauu

SEQ ID NO: 93156 - RNA, 22 nt, Escherichia coli CFT073
gauauguuuaccaucaucggug

SEQ ID NO: 93157 - RNA, 22 nt, Escherichia coli CFT073
cagcaguucgcgaauacgcugc

SEQ ID NO: 93158 - RNA, 22 nt, Escherichia coli CFT073
cagguuaucuucauguuccacg

SEQ ID NO: 93159 - RNA, 23 nt, Escherichia coli CFT073
ugcgugguuaaugcugaugaugc

SEQ ID NO: 93160 - RNA, 22 nt, Escherichia coli CFT073
aagaccaacuguucaguauuug

SEQ ID NO: 93161 - RNA, 22 nt, Escherichia coli CFT073
aagcagcaaauaucgaugauga

SEQ ID NO: 93162 - RNA, 22 nt, Escherichia coli CFT073
auguuuuaagaacauuccguaa

SEQ ID NO: 93163 - RNA, 22 nt, Escherichia coli CFT073
gcgcggcauauucugcaaguau

SEQ ID NO: 93164 - RNA, 22 nt, Escherichia coli CFT073
cguggcuacauuggcauuggug

SEQ ID NO: 93165 - RNA, 22 nt, Escherichia coli CFT073
ugggauggugguaacgucacau

SEQ ID NO: 93166 - RNA, 22 nt, Escherichia coli CFT073
guacaggccggaacagacggaa

SEQ ID NO: 93167 - RNA, 22 nt, Escherichia coli CFT073
augucguucggcgaggugguga

SEQ ID NO: 93168 - RNA, 22 nt, Escherichia coli CFT073
ccagccgugcggaucuggucuu

SEQ ID NO: 93169 - RNA, 22 nt, Escherichia coli CFT073
gccggugcuaacccgugaacca

SEQ ID NO: 93170 - RNA, 22 nt, Escherichia coli CFT073
accguuucuugauggcgaguau

SEQ ID NO: 93171 - RNA, 22 nt, Escherichia coli CFT073
ggccauugucgcagccuguccg

SEQ ID NO: 93172 - RNA, 21 nt, Escherichia coli CFT073
gagcgcaggcggaauggcggc

SEQ ID NO: 93173 - RNA, 22 nt, Escherichia coli CFT073
gcauguacaugcagcugauaau

SEQ ID NO: 93174 - RNA, 19 nt, Escherichia coli CFT073
ggauuagagaccugucaga

SEQ ID NO: 93175 - RNA, 19 nt, Escherichia coli CFT073
uuccgguuucggacacuca

SEQ ID NO: 93176 - RNA, 19 nt, Escherichia coli CFT073
acguuuauuaagugaugau

SEQ ID NO: 93177 - RNA, 22 nt, Escherichia coli CFT073
ugaugccgugguuaaguacuca

SEQ ID NO: 93178 - RNA, 22 nt, Escherichia coli CFT073
aggccgcaucaucgcuugcgau

SEQ ID NO: 93179 - RNA, 22 nt, Escherichia coli CFT073
uaaucccgauugaagagaaguu

SEQ ID NO: 93180 - RNA, 19 nt, Escherichia coli CFT073
agcuggguuuggauuugau

SEQ ID NO: 93181 - RNA, 22 nt, Escherichia coli CFT073
cgcgucuuaucuggccuacgaa

SEQ ID NO: 93182 - RNA, 22 nt, Escherichia coli CFT073
uauugacuauacuuacgccauu

SEQ ID NO: 93183 - RNA, 22 nt, Escherichia coli CFT073
accgggugaugcaaaaguagcc

SEQ ID NO: 93184 - RNA, 20 nt, Escherichia coli CFT073
uuagguaauaucucggcuua

SEQ ID NO: 93185 - RNA, 19 nt, Escherichia coli CFT073
gcugcgcccggcuuucgcc

SEQ ID NO: 93186 - RNA, 22 nt, Escherichia coli CFT073
uccaguucgauuucccgcggau

SEQ ID NO: 93187 - RNA, 22 nt, Escherichia coli CFT073
cgaaucugcuccgccagauuuu

SEQ ID NO: 93188 - RNA, 22 nt, Escherichia coli CFT073
gcugcggaggucgcagaacgua

SEQ ID NO: 93189 - RNA, 22 nt, Escherichia coli CFT073
cuggggaucugacgaccauuga

SEQ ID NO: 93190 - RNA, 22 nt, Escherichia coli CFT073
ucuggccauguucaguuguauc

SEQ ID NO: 93191 - RNA, 22 nt, Escherichia coli CFT073
cgcggucuucguuggcguaggc

SEQ ID NO: 93192 - RNA, 22 nt, Escherichia coli CFT073
ugcucgauaauuuuggcugcgc

SEQ ID NO: 93193 - RNA, 22 nt, Escherichia coli CFT073
gcaguacgugccuaaaaugcug

SEQ ID NO: 93194 - RNA, 22 nt, Escherichia coli CFT073
ugagcgguccguuagguggucg

SEQ ID NO: 93195 - RNA, 22 nt, Escherichia coli CFT073
ggaagucauugagcccgagauc

SEQ ID NO: 93196 - RNA, 22 nt, Escherichia coli CFT073
uggagcauggcaauauuuugcc

SEQ ID NO: 93197 - RNA, 22 nt, Escherichia coli CFT073
cucagaaagaaaggccagcuca

SEQ ID NO: 93198 - RNA, 21 nt, Escherichia coli CFT073
ccggagaugugauugcccgga

SEQ ID NO: 93199 - RNA, 22 nt, Escherichia coli CFT073
augacggugaauggccuggcac

SEQ ID NO: 93200 - RNA, 20 nt, Escherichia coli CFT073
cugaccggacuggagcguau

SEQ ID NO: 93201 - RNA, 22 nt, Escherichia coli CFT073
gggugauuaugcgcaaggauca

SEQ ID NO: 93202 - RNA, 22 nt, Escherichia coli CFT073
uccggccuacaaaccguucaaa

SEQ ID NO: 93203 - RNA, 23 nt, Escherichia coli CFT073
acugcggucguugggauuacauc

SEQ ID NO: 93204 - RNA, 22 nt, Escherichia coli CFT073
auucuggguggaaccgccgcgu

SEQ ID NO: 93205 - RNA, 22 nt, Escherichia coli CFT073
cagaaagucgagucgcuguggc

SEQ ID NO: 93206 - RNA, 22 nt, Escherichia coli CFT073
cgcgauauacguguacguugau

SEQ ID NO: 93207 - RNA, 21 nt, Escherichia coli CFT073
gcuggccuucagccgcuacgc

SEQ ID NO: 93208 - RNA, 22 nt, Escherichia coli CFT073
caugaaaacaguguuauguugu

SEQ ID NO: 93209 - RNA, 22 nt, Escherichia coli CFT073
aucguuuuuaucuggauagcau

SEQ ID NO: 93210 - RNA, 22 nt, Escherichia coli CFT073
auuagcccccgugauguuguca

SEQ ID NO: 93211 - RNA, 22 nt, Escherichia coli CFT073
ggcauguucccaagccagaugu

SEQ ID NO: 93212 - RNA, 22 nt, Escherichia coli CFT073
uggucggugcggcugcacaaua

SEQ ID NO: 93213 - RNA, 21 nt, Escherichia coli CFT073
ccagcgaaccggcaauugcca

SEQ ID NO: 93214 - RNA, 22 nt, Escherichia coli CFT073
uggcggcaaucggugcugcgau

SEQ ID NO: 93215 - RNA, 20 nt, Escherichia coli CFT073
acagcgcugucuuuguggcc

SEQ ID NO: 93216 - RNA, 22 nt, Escherichia coli CFT073
gguugcggcagcaaggauucau

SEQ ID NO: 93217 - RNA, 22 nt, Escherichia coli CFT073
ggacuggugacggucgaagaua

SEQ ID NO: 93218 - RNA, 22 nt, Escherichia coli CFT073
uaggccaguuugaugaucgaaa

SEQ ID NO: 93219 - RNA, 22 nt, Escherichia coli CFT073
ucugguuguggccuuccacguc

SEQ ID NO: 93220 - RNA, 22 nt, Escherichia coli CFT073
uguguacucauguuuaacuaua

SEQ ID NO: 93221 - RNA, 23 nt, Escherichia coli CFT073
uguuacggugguacucacggcgc

SEQ ID NO: 93222 - RNA, 22 nt, Escherichia coli CFT073
uguuugguaucguuauuguuaa

SEQ ID NO: 93223 - RNA, 22 nt, Escherichia coli CFT073
auggcuuugacaguaucaguca

SEQ ID NO: 93224 - RNA, 22 nt, Escherichia coli CFT073
auaguuacuggugucugcuucu

SEQ ID NO: 93225 - RNA, 22 nt, Escherichia coli CFT073
aaugccgcaguggcugcucggu

SEQ ID NO: 93226 - RNA, 23 nt, Escherichia coli CFT073
caaaaccguauucccgcagcacc

SEQ ID NO: 93227 - RNA, 22 nt, Escherichia coli CFT073
gcgcuucugguagauucgggau

SEQ ID NO: 93228 - RNA, 22 nt, Escherichia coli CFT073
caccugauaaccguucucuucg

SEQ ID NO: 93229 - RNA, 22 nt, Escherichia coli CFT073
ugguucaaugauuucugaugaa

SEQ ID NO: 93230 - RNA, 22 nt, Escherichia coli CFT073
aauuuguuccuggcuauggaug

SEQ ID NO: 93231 - RNA, 22 nt, Escherichia coli CFT073
cuacgcuuaucaggccuacgag

SEQ ID NO: 93232 - RNA, 22 nt, Escherichia coli CFT073
aggugcguaauaagcugguggc

SEQ ID NO: 93233 - RNA, 22 nt, Escherichia coli CFT073
gcggaucugcggaggcgcgguu

SEQ ID NO: 93234 - RNA, 22 nt, Escherichia coli CFT073
agcauugcuacugcccgcugca

SEQ ID NO: 93235 - RNA, 22 nt, Escherichia coli CFT073
gguggauuuaccggagccugau

SEQ ID NO: 93236 - RNA, 22 nt, Escherichia coli CFT073
cugggauacugguugcucauug

SEQ ID NO: 93237 - RNA, 22 nt, Escherichia coli CFT073
augcagcacgucacggcgugga

SEQ ID NO: 93238 - RNA, 22 nt, Escherichia coli CFT073
guuugucggacguaggucggau

SEQ ID NO: 93239 - RNA, 20 nt, Escherichia coli CFT073
agccgggauucagcgcagga

SEQ ID NO: 93240 - RNA, 20 nt, Escherichia coli CFT073
uguagagcagggccaugauc

SEQ ID NO: 93241 - RNA, 20 nt, Escherichia coli CFT073
ugugcugccccguggcuuuu

SEQ ID NO: 93242 - RNA, 22 nt, Escherichia coli CFT073
caacaaagacguuguucgcgaa

SEQ ID NO: 93243 - RNA, 22 nt, Escherichia coli CFT073
ccauucgcgcagacgaaaauuc

SEQ ID NO: 93244 - RNA, 22 nt, Escherichia coli CFT073
uugcugacuaucggaacuuuuu

SEQ ID NO: 93245 - RNA, 17 nt, Escherichia coli CFT073
ugguuucucugccguuc

SEQ ID NO: 93246 - RNA, 22 nt, Escherichia coli CFT073
acuuaaugcguuuguaauaaau

SEQ ID NO: 93247 - RNA, 22 nt, Escherichia coli CFT073
gacgcgacuuaucaggccuacg

SEQ ID NO: 93248 - RNA, 22 nt, Escherichia coli CFT073
ccggugccaucaagguuuguca

SEQ ID NO: 93249 - RNA, 21 nt, Escherichia coli CFT073
aaauuuaacuacugaugauug

SEQ ID NO: 93250 - RNA, 22 nt, Escherichia coli CFT073
gcgacauugcuccguguauuca

SEQ ID NO: 93251 - RNA, 22 nt, Escherichia coli CFT073
uggauccgucguuaacgcaaau

SEQ ID NO: 93252 - RNA, 22 nt, Escherichia coli CFT073
uccgagugguuccggcaaaacc

SEQ ID NO: 93253 - RNA, 22 nt, Escherichia coli CFT073
aaaaaguggcggagaucccgga

SEQ ID NO: 93254 - RNA, 22 nt, Escherichia coli CFT073
uugguaucaacgauagcaaaua

SEQ ID NO: 93255 - RNA, 22 nt, Escherichia coli CFT073
ggcgacaauuguugguuauggg

SEQ ID NO: 93256 - RNA, 22 nt, Escherichia coli CFT073
uggguuugccgguuaucguuaa

SEQ ID NO: 93257 - RNA, 22 nt, Escherichia coli CFT073
ucgccgcaccacaacugucagc

SEQ ID NO: 93258 - RNA, 22 nt, Escherichia coli CFT073
ugcaucgguaaacagguugcca

SEQ ID NO: 93259 - RNA, 22 nt, Escherichia coli CFT073
auuuuauggcggaacggcguug

SEQ ID NO: 93260 - RNA, 22 nt, Escherichia coli CFT073
gaggaugacucacuggcgcucg

SEQ ID NO: 93261 - RNA, 22 nt, Escherichia coli CFT073
uuuccaguugcucaaccagguu

SEQ ID NO: 93262 - RNA, 22 nt, Escherichia coli CFT073
gugccguuguugcgugacgacg

SEQ ID NO: 93263 - RNA, 18 nt, Escherichia coli CFT073
cgaauuuuccugccguug

SEQ ID NO: 93264 - RNA, 22 nt, Escherichia coli CFT073
gugcaguugacguaauucauga

SEQ ID NO: 93265 - RNA, 22 nt, Escherichia coli CFT073
gaucgcugacgccaagcgccug

SEQ ID NO: 93266 - RNA, 22 nt, Escherichia coli CFT073
auauguccacacuccggcggau

SEQ ID NO: 93267 - RNA, 22 nt, Escherichia coli CFT073
uuuauaugaguguuguuauuac

SEQ ID NO: 93268 - RNA, 22 nt, Escherichia coli CFT073
gacgauggggauauucgucugu

SEQ ID NO: 93269 - RNA, 22 nt, Escherichia coli CFT073
uccgcuuuccggguuuauuccc

SEQ ID NO: 93270 - RNA, 22 nt, Escherichia coli CFT073
acgcgaucagcaucgcggcgua

SEQ ID NO: 93271 - RNA, 22 nt, Escherichia coli CFT073
ugauacagcacauggacguaau

SEQ ID NO: 93272 - RNA, 17 nt, Escherichia coli CFT073
ucgacgaucggguugaa

SEQ ID NO: 93273 - RNA, 22 nt, Escherichia coli CFT073
ucgacguaguaagugacaccac

SEQ ID NO: 93274 - RNA, 19 nt, Escherichia coli CFT073
gugggcgaaacgaugcauc

SEQ ID NO: 93275 - RNA, 22 nt, Escherichia coli CFT073
uuauguuacccagcauaucgga

SEQ ID NO: 93276 - RNA, 22 nt, Escherichia coli CFT073
ugcaguugcugugucagugauu

SEQ ID NO: 93277 - RNA, 22 nt, Escherichia coli CFT073
gcgcguaucagcccgugggcca

SEQ ID NO: 93278 - RNA, 22 nt, Escherichia coli CFT073
guuuaucacgcggugguugauu

SEQ ID NO: 93279 - RNA, 20 nt, Escherichia coli CFT073
uaucgugauuuguaaucgcc

SEQ ID NO: 93280 - RNA, 22 nt, Escherichia coli CFT073
acuggcaauugccagccacggu

SEQ ID NO: 93281 - RNA, 23 nt, Escherichia coli CFT073
auccgauaaaacauccggcacac

SEQ ID NO: 93282 - RNA, 22 nt, Escherichia coli CFT073
uggacacuguauggucuggucu

SEQ ID NO: 93283 - RNA, 22 nt, Escherichia coli CFT073
ugaacgccuuaucuggccuacg

SEQ ID NO: 93284 - RNA, 22 nt, Escherichia coli CFT073
ugaaguauagccaagacaaccc

SEQ ID NO: 93285 - RNA, 20 nt, Escherichia coli CFT073
ugguuuucuucgaucagucc

SEQ ID NO: 93286 - RNA, 23 nt, Escherichia coli CFT073
aacagguugauaacgguagagcc

SEQ ID NO: 93287 - RNA, 22 nt, Escherichia coli CFT073
caagauacgaaacgggugcuga

SEQ ID NO: 93288 - RNA, 23 nt, Escherichia coli CFT073
guuuacccaaugaagaugcgccg

SEQ ID NO: 93289 - RNA, 22 nt, Escherichia coli CFT073
uuggugaaaauaaagaugccug

SEQ ID NO: 93290 - RNA, 22 nt, Escherichia coli CFT073
ucguuaauauucacuucgcagc

SEQ ID NO: 93291 - RNA, 22 nt, Escherichia coli CFT073
augguugugccguuucgcuccg

SEQ ID NO: 93292 - RNA, 22 nt, Escherichia coli CFT073
uuuacgcauugcucaccucuca

SEQ ID NO: 93293 - RNA, 22 nt, Escherichia coli CFT073
ucgccgauaaucuguacauguu

SEQ ID NO: 93294 - RNA, 22 nt, Escherichia coli CFT073
agucagccaguugauaaaccgg

SEQ ID NO: 93295 - RNA, 22 nt, Escherichia coli CFT073
ugucaguggcgguucaaugcgg

SEQ ID NO: 93296 - RNA, 22 nt, Escherichia coli CFT073
ucauugcugagacaggcucugu

SEQ ID NO: 93297 - RNA, 22 nt, Escherichia coli CFT073
aggcaacaaucaacgaggccac

SEQ ID NO: 93298 - RNA, 22 nt, Escherichia coli CFT073
ucaucauucuggcagcaugggc

SEQ ID NO: 93299 - RNA, 22 nt, Escherichia coli CFT073
ggugaaaaaacuugaugcacgu

SEQ ID NO: 93300 - RNA, 22 nt, Escherichia coli CFT073
cguggagagcacaaucugcuug

SEQ ID NO: 93301 - RNA, 22 nt, Escherichia coli CFT073
caaacugcuuuccccggaguuu

SEQ ID NO: 93302 - RNA, 22 nt, Escherichia coli CFT073
gaagagaaucuguuggcauuua

SEQ ID NO: 93303 - RNA, 22 nt, Escherichia coli CFT073
uuuuuggauggucucauuaucc

SEQ ID NO: 93304 - RNA, 23 nt, Escherichia coli CFT073
uucaguggugucauucagugcga

SEQ ID NO: 93305 - RNA, 22 nt, Escherichia coli CFT073
uaaggcguucacgccgcaucug

SEQ ID NO: 93306 - RNA, 22 nt, Escherichia coli CFT073
gcaaccaaccugacucgcggug

SEQ ID NO: 93307 - RNA, 21 nt, Escherichia coli CFT073
uuaggguugucauuagucgcg

SEQ ID NO: 93308 - RNA, 22 nt, Escherichia coli CFT073
gucaggugguuucccgugagca

SEQ ID NO: 93309 - RNA, 22 nt, Escherichia coli CFT073
acugcggguguaugacacugau

SEQ ID NO: 93310 - RNA, 22 nt, Escherichia coli CFT073
aaaggccaucauugcggucaua

SEQ ID NO: 93311 - RNA, 22 nt, Escherichia coli CFT073
aaagaaauggcgcaaauuaguu

SEQ ID NO: 93312 - RNA, 22 nt, Escherichia coli CFT073
aacagcauggggaaugaucaga

SEQ ID NO: 93313 - RNA, 22 nt, Escherichia coli CFT073
aagcgucccguuucgaucuuag

SEQ ID NO: 93314 - RNA, 22 nt, Escherichia coli CFT073
aacaucuauccgguacgccagg

SEQ ID NO: 93315 - RNA, 22 nt, Escherichia coli CFT073
aagguuuucccugagcaaauuu

SEQ ID NO: 93316 - RNA, 22 nt, Escherichia coli CFT073
aagguuuuguacaacugcgggu

SEQ ID NO: 93317 - RNA, 22 nt, Escherichia coli CFT073
aagucgauuuccgcuuccugcg

SEQ ID NO: 93318 - RNA, 22 nt, Escherichia coli CFT073
aaguggaugacuuugccgccag

SEQ ID NO: 93319 - RNA, 22 nt, Escherichia coli CFT073
acagagccugucucagcaauga

SEQ ID NO: 93320 - RNA, 22 nt, Escherichia coli CFT073
accaaugugauuauagccaucg

SEQ ID NO: 93321 - RNA, 22 nt, Escherichia coli CFT073
accaccuguguauugagccgcc

SEQ ID NO: 93322 - RNA, 22 nt, Escherichia coli CFT073
acugucaucaaucaucuugaca

SEQ ID NO: 93323 - RNA, 22 nt, Escherichia coli CFT073
acugcgaaucgggaauuaucuu

SEQ ID NO: 93324 - RNA, 22 nt, Escherichia coli CFT073
aguguuucauuuuuaccaugug

SEQ ID NO: 93325 - RNA, 22 nt, Escherichia coli CFT073
aguuccuuauaauauucaauga

SEQ ID NO: 93326 - RNA, 22 nt, Escherichia coli CFT073
aguuccuuauaguauucaauga

SEQ ID NO: 93327 - RNA, 22 nt, Escherichia coli CFT073
aguuugaucgcaaagguauggu

SEQ ID NO: 93328 - RNA, 22 nt, Escherichia coli CFT073
aguuucuugagugguaagggaa

SEQ ID NO: 93329 - RNA, 22 nt, Escherichia coli CFT073
auaacgcugaaccaggcaguau

SEQ ID NO: 93330 - RNA, 22 nt, Escherichia coli CFT073
auacagaaagcuuauaaugcga

SEQ ID NO: 93331 - RNA, 22 nt, Escherichia coli CFT073
agugggucgccgacugccagca

SEQ ID NO: 93332 - RNA, 22 nt, Escherichia coli CFT073
agugauuaacgucucuuucaga

SEQ ID NO: 93333 - RNA, 20 nt, Escherichia coli CFT073
agugaaauccaacaguagcc

SEQ ID NO: 93334 - RNA, 22 nt, Escherichia coli CFT073
agucaauauuuauucauggaau

SEQ ID NO: 93335 - RNA, 22 nt, Escherichia coli CFT073
agguacugcaaacgcugcagaa

SEQ ID NO: 93336 - RNA, 22 nt, Escherichia coli CFT073
aggucaaucaucuguucacuau

SEQ ID NO: 93337 - RNA, 22 nt, Escherichia coli CFT073
aggcucaguacgcagcugaaga

SEQ ID NO: 93338 - RNA, 22 nt, Escherichia coli CFT073
aggcuuuuuuacuggcaaauca

SEQ ID NO: 93339 - RNA, 22 nt, Escherichia coli CFT073
agaaauaccaucaaaaucguga

SEQ ID NO: 93340 - RNA, 22 nt, Escherichia coli CFT073
agaaauauuugcccggcgcguu

SEQ ID NO: 93341 - RNA, 21 nt, Escherichia coli CFT073
aucauucaccuguuguaacuc

SEQ ID NO: 93342 - RNA, 22 nt, Escherichia coli CFT073
auccugauuugcucucucauua

SEQ ID NO: 93343 - RNA, 22 nt, Escherichia coli CFT073
auccuucccgaaaaauauguau

SEQ ID NO: 93344 - RNA, 22 nt, Escherichia coli CFT073
aucacaaucgcuguuaucaaca

SEQ ID NO: 93345 - RNA, 22 nt, Escherichia coli CFT073
aucacuucuucucggauuucac

SEQ ID NO: 93346 - RNA, 22 nt, Escherichia coli CFT073
aucagccucucucugaggguga

SEQ ID NO: 93347 - RNA, 22 nt, Escherichia coli CFT073
aucaggaguuuaccugccagcc

SEQ ID NO: 93348 - RNA, 22 nt, Escherichia coli CFT073
auaguauguuuguuauggaaug

SEQ ID NO: 93349 - RNA, 22 nt, Escherichia coli CFT073
auaauucauauacuuguugucu

SEQ ID NO: 93350 - RNA, 22 nt, Escherichia coli CFT073
auaucguugcuaauaauucuaa

SEQ ID NO: 93351 - RNA, 20 nt, Escherichia coli CFT073
aucaaaaggcagauaacguc

SEQ ID NO: 93352 - RNA, 22 nt, Escherichia coli CFT073
aucuggcaccgccugcugcauu

SEQ ID NO: 93353 - RNA, 22 nt, Escherichia coli CFT073
aucauaaugguacacuuuauag

SEQ ID NO: 93354 - RNA, 22 nt, Escherichia coli CFT073
aucuguuaccguuucaucagua

SEQ ID NO: 93355 - RNA, 22 nt, Escherichia coli CFT073
aucuucucugcuuuuggcuggg

SEQ ID NO: 93356 - RNA, 22 nt, Escherichia coli CFT073
aucuucuucuuccagggcguug

SEQ ID NO: 93357 - RNA, 22 nt, Escherichia coli CFT073
aucuuuauaaaggugguaaacg

SEQ ID NO: 93358 - RNA, 22 nt, Escherichia coli CFT073
aucuuucaccagauuaauggug

SEQ ID NO: 93359 - RNA, 20 nt, Escherichia coli CFT073
augaaucagagaaaaaguga

SEQ ID NO: 93360 - RNA, 22 nt, Escherichia coli CFT073
augauaaaacucacuaaacugu

SEQ ID NO: 93361 - RNA, 22 nt, Escherichia coli CFT073
augcagagcagguauuccagcu

SEQ ID NO: 93362 - RNA, 22 nt, Escherichia coli CFT073
augccuuaucaggccuacaaau

SEQ ID NO: 93363 - RNA, 22 nt, Escherichia coli CFT073
augccuuauccggccuacaaag

SEQ ID NO: 93364 - RNA, 22 nt, Escherichia coli CFT073
augcugcauuuugcugaccgga

SEQ ID NO: 93365 - RNA, 22 nt, Escherichia coli CFT073
auguuucugacaucuguaagca

SEQ ID NO: 93366 - RNA, 22 nt, Escherichia coli CFT073
auguuuuaagcucugugagcga

SEQ ID NO: 93367 - RNA, 22 nt, Escherichia coli CFT073
auguguucugggaucugcagga

SEQ ID NO: 93368 - RNA, 22 nt, Escherichia coli CFT073
auggcuuugacaguaucaguca

SEQ ID NO: 93369 - RNA, 22 nt, Escherichia coli CFT073
auuaauuugcuggaaauauuua

SEQ ID NO: 93370 - RNA, 22 nt, Escherichia coli CFT073
auuguugacuuccgucaugaag

SEQ ID NO: 93371 - RNA, 22 nt, Escherichia coli CFT073
auugcaggaacguuaccaccgu

SEQ ID NO: 93372 - RNA, 22 nt, Escherichia coli CFT073
cagaaagucgagucgcuguggc

SEQ ID NO: 93373 - RNA, 22 nt, Escherichia coli CFT073
cagauuugcgcgacgagcucua

SEQ ID NO: 93374 - RNA, 20 nt, Escherichia coli CFT073
cagcuccaccugcagcccgu

SEQ ID NO: 93375 - RNA, 22 nt, Escherichia coli CFT073
caggaguuggcgaugaaugacc

SEQ ID NO: 93376 - RNA, 22 nt, Escherichia coli CFT073
ugauuuuccgaaucaggcugcu

SEQ ID NO: 93377 - RNA, 22 nt, Escherichia coli CFT073
uggcaggccauuggguugagaa

SEQ ID NO: 93378 - RNA, 22 nt, Escherichia coli CFT073
uggccagccagaugccacgcau

SEQ ID NO: 93379 - RNA, 22 nt, Escherichia coli CFT073
ugagcauuuauuaaaaccgcua

SEQ ID NO: 93380 - RNA, 22 nt, Escherichia coli CFT073
ucuucuucgacauguuccaggc

SEQ ID NO: 93381 - RNA, 21 nt, Escherichia coli CFT073
ugauaguuuucgcauuccguu

SEQ ID NO: 93382 - RNA, 22 nt, Escherichia coli CFT073
ugauaugaccuuuauauacuca

SEQ ID NO: 93383 - RNA, 22 nt, Escherichia coli CFT073
ugaucucuuccugcugagcuuu

SEQ ID NO: 93384 - RNA, 22 nt, Escherichia coli CFT073
ugucgcuaugguagugcaggua

SEQ ID NO: 93385 - RNA, 22 nt, Escherichia coli CFT073
ugucgcaucgcuaucuggcuga

SEQ ID NO: 93386 - RNA, 22 nt, Escherichia coli CFT073
ugguucaaugauuucugaugaa

SEQ ID NO: 93387 - RNA, 20 nt, Escherichia coli CFT073
uguagagcagggccaugauc

SEQ ID NO: 93388 - RNA, 22 nt, Escherichia coli CFT073
ucaucauucuggcagcaugggc

SEQ ID NO: 93389 - RNA, 22 nt, Escherichia coli CFT073
ucccacaaugccaauacacuug

SEQ ID NO: 93390 - RNA, 22 nt, Escherichia coli CFT073
uccggaugcagcggcagcgcca

SEQ ID NO: 93391 - RNA, 22 nt, Escherichia coli CFT073
uccagaacaagaagguaagaau

SEQ ID NO: 93392 - RNA, 22 nt, Escherichia coli CFT073
uccuccuuucagagugcuccgc

SEQ ID NO: 93393 - RNA, 22 nt, Escherichia coli CFT073
uccugauugcggugcucggaua

SEQ ID NO: 93394 - RNA, 20 nt, Escherichia coli CFT073
ucucccuguugucuggcuga

SEQ ID NO: 93395 - RNA, 22 nt, Escherichia coli CFT073
ucucuuuucuggaauuugguac

SEQ ID NO: 93396 - RNA, 22 nt, Escherichia coli CFT073
ucugccagucggggggaggcug

SEQ ID NO: 93397 - RNA, 22 nt, Escherichia coli CFT073
ucuggaguaguguagucaaugg

SEQ ID NO: 93398 - RNA, 22 nt, Escherichia coli CFT073
ucuggccauguucaguuguauc

SEQ ID NO: 93399 - RNA, 22 nt, Escherichia coli CFT073
ucuggcggcacucucugucccu

SEQ ID NO: 93400 - RNA, 22 nt, Escherichia coli CFT073
uaaacacugcacuguguauuca

SEQ ID NO: 93401 - RNA, 22 nt, Escherichia coli CFT073
guuuuuucgcgaauguucugug

SEQ ID NO: 93402 - RNA, 22 nt, Escherichia coli CFT073
uaaagugaucuucuaagcccgc

SEQ ID NO: 93403 - RNA, 22 nt, Escherichia coli CFT073
uaaaguuccgcguauugcguuc

SEQ ID NO: 93404 - RNA, 20 nt, Escherichia coli CFT073
uaagguuuuuguguggacug

SEQ ID NO: 93405 - RNA, 22 nt, Escherichia coli CFT073
uaaguaaagggaguuugauaug

SEQ ID NO: 93406 - RNA, 22 nt, Escherichia coli CFT073
uaauaucaaaaagugcuuaagg

SEQ ID NO: 93407 - RNA, 22 nt, Escherichia coli CFT073
uagguggcuuucgaaauggcgg

SEQ ID NO: 93408 - RNA, 18 nt, Escherichia coli CFT073
uaagugaagggaguguga

SEQ ID NO: 93409 - RNA, 22 nt, Escherichia coli CFT073
uaagcuuuguuacuucugcggu

SEQ ID NO: 93410 - RNA, 22 nt, Escherichia coli CFT073
ucagggguugagaaaugcguaa

SEQ ID NO: 93411 - RNA, 22 nt, Escherichia coli CFT073
uauuuauuuuuccugguucgcg

SEQ ID NO: 93412 - RNA, 22 nt, Escherichia coli CFT073
ucaggaugccgaaguggaugau

SEQ ID NO: 93413 - RNA, 22 nt, Escherichia coli CFT073
ucaggcauuguguaggcagcag

SEQ ID NO: 93414 - RNA, 22 nt, Escherichia coli CFT073
uauucccauaaacucagaucua

SEQ ID NO: 93415 - RNA, 22 nt, Escherichia coli CFT073
uauuaaauaugaaaaguuauga

SEQ ID NO: 93416 - RNA, 21 nt, Escherichia coli CFT073
uauguguugugggaaacucgc

SEQ ID NO: 93417 - RNA, 22 nt, Escherichia coli CFT073
uauccuuuugccugggcagaaa

SEQ ID NO: 93418 - RNA, 22 nt, Escherichia coli CFT073
uaucguuaauuggcgugacgau

SEQ ID NO: 93419 - RNA, 22 nt, Escherichia coli CFT073
uaucugggaagugccuggcggu

SEQ ID NO: 93420 - RNA, 22 nt, Escherichia coli CFT073
ggcuggcaguucaccauugccc

SEQ ID NO: 93421 - RNA, 22 nt, Escherichia coli CFT073
ggcugcugaagguguucugcgc

SEQ ID NO: 93422 - RNA, 22 nt, Escherichia coli CFT073
gggcgaggacgcuggcaggugc

SEQ ID NO: 93423 - RNA, 22 nt, Escherichia coli CFT073
ggggcguguccugcuggagccu

SEQ ID NO: 93424 - RNA, 18 nt, Escherichia coli CFT073
ggaugcuuaacguaaugc

SEQ ID NO: 93425 - RNA, 16 nt, Escherichia coli CFT073
ggcagcuggugccauu

SEQ ID NO: 93426 - RNA, 19 nt, Escherichia coli CFT073
ggcagcugucaggugugcg

SEQ ID NO: 93427 - RNA, 22 nt, Escherichia coli CFT073
ggauuuucgcugugguugcugg

SEQ ID NO: 93428 - RNA, 22 nt, Escherichia coli CFT073
ggcauccucuuuuggcagauuu

SEQ ID NO: 93429 - RNA, 22 nt, Escherichia coli CFT073
gcuuccucauauucuuccugug

SEQ ID NO: 93430 - RNA, 19 nt, Escherichia coli CFT073
gccgaagucgcucauagcg

SEQ ID NO: 93431 - RNA, 22 nt, Escherichia coli CFT073
gccggaggucaucaccagcggg

SEQ ID NO: 93432 - RNA, 22 nt, Escherichia coli CFT073
gcagggcgcggaaauggccccg

SEQ ID NO: 93433 - RNA, 22 nt, Escherichia coli CFT073
gacgagcugcaggaacguaugg

SEQ ID NO: 93434 - RNA, 22 nt, Escherichia coli CFT073
gaauuuuuuccgcaaucuucgc

SEQ ID NO: 93435 - RNA, 19 nt, Escherichia coli CFT073
gccagcaaaaaaaucagcc

SEQ ID NO: 93436 - RNA, 22 nt, Escherichia coli CFT073
cgucuccaccaacgugauugcc

SEQ ID NO: 93437 - RNA, 22 nt, Escherichia coli CFT073
cguuccugcuccugcuccaucc

SEQ ID NO: 93438 - RNA, 22 nt, Escherichia coli CFT073
cgccagagugcuuauugcuucc

SEQ ID NO: 93439 - RNA, 22 nt, Escherichia coli CFT073
cgccagcaaaauggcgacggcg

SEQ ID NO: 93440 - RNA, 17 nt, Escherichia coli CFT073
cgccagcucgcuggcga

SEQ ID NO: 93441 - RNA, 22 nt, Escherichia coli CFT073
cgcacaggauuauuacggugug

SEQ ID NO: 93442 - RNA, 22 nt, Escherichia coli CFT073
cgauggcugaaugucuggcagc

SEQ ID NO: 93443 - RNA, 22 nt, Escherichia coli CFT073
cgagcuggaaaccuuccugcug

SEQ ID NO: 93444 - RNA, 22 nt, Escherichia coli CFT073
caggccuacacguucgcugcaa

SEQ ID NO: 93445 - RNA, 22 nt, Escherichia coli CFT073
caggccuacaucguuccugcaa

SEQ ID NO: 93446 - RNA, 22 nt, Escherichia coli CFT073
caggccuacgaaaacucugcaa

SEQ ID NO: 93447 - RNA, 22 nt, Escherichia coli CFT073
caggccuacgaucuucuugcaa

SEQ ID NO: 93448 - RNA, 22 nt, Escherichia coli CFT073
caguaccagcaucagcugucgg

SEQ ID NO: 93449 - RNA, 22 nt, Escherichia coli CFT073
caguauuugccgccagagauga

SEQ ID NO: 93450 - RNA, 19 nt, Escherichia coli CFT073
cuguuuauucuguuugccc

SEQ ID NO: 93451 - RNA, 22 nt, Escherichia coli CFT073
cuuucccuuugacguauugcag

SEQ ID NO: 93452 - RNA, 22 nt, Escherichia coli CFT073
gaaacgcucgaaaaacuggcag

SEQ ID NO: 93453 - RNA, 22 nt, Escherichia coli CFT073
gaaacuuugucgcguggaccca

SEQ ID NO: 93454 - RNA, 22 nt, Escherichia coli CFT073
cucagaaagaaaggccagcuca

SEQ ID NO: 93455 - RNA, 22 nt, Escherichia coli CFT073
cucagucugauccaucagggga

SEQ ID NO: 93456 - RNA, 22 nt, Escherichia coli CFT073
cuaaguuucguaaugacccacu

SEQ ID NO: 93457 - RNA, 22 nt, Escherichia coli CFT073
cguuuauuacgugcugucgaug

SEQ ID NO: 93458 - RNA, 22 nt, Escherichia coli CFT073
cguuuuauccggccuacaauga

SEQ ID NO: 93459 - RNA, 22 nt, Escherichia coli CFT073
cucugcgacgggaagcggugcu

SEQ ID NO: 93460 - RNA, 22 nt, Escherichia coli CFT073
cugauuucccagcgacaacaua

SEQ ID NO: 93461 - RNA, 22 nt, Escherichia coli CFT073
cugagaagugaugcugucagca

SEQ ID NO: 93462 - RNA, 22 nt, Escherichia coli CFT073
uguugccacugcacauggugaa

SEQ ID NO: 93463 - RNA, 22 nt, Escherichia coli CFT073
uguugaaacuguagcccguucc

SEQ ID NO: 93464 - RNA, 22 nt, Escherichia coli CFT073
ugugguguaagcacaguaguag

SEQ ID NO: 93465 - RNA, 22 nt, Escherichia coli CFT073
uguucucugguggugcucucag

SEQ ID NO: 93466 - RNA, 20 nt, Escherichia coli CFT073
ugugcugccccguggcuuuu

SEQ ID NO: 93467 - RNA, 22 nt, Escherichia coli CFT073
aaaagugauauuacggucucgu

SEQ ID NO: 93468 - RNA, 22 nt, Escherichia coli CFT073
aaaaagaucugaucgcgcagcg

SEQ ID NO: 93469 - RNA, 22 nt, Escherichia coli CFT073
aacguuugcguauuuucaugga

SEQ ID NO: 93470 - RNA, 22 nt, Escherichia coli CFT073
aacuuacugaugaucaaugcgc

SEQ ID NO: 93471 - RNA, 22 nt, Escherichia coli CFT073
aagaauuagcugacccagcguu

SEQ ID NO: 93472 - RNA, 22 nt, Escherichia coli CFT073
aagaccaacuguucaguauuug

SEQ ID NO: 93473 - RNA, 22 nt, Escherichia coli CFT073
aaguuugccguggcaguggcga

SEQ ID NO: 93474 - RNA, 22 nt, Escherichia coli CFT073
aagccucaguuucuaugcaaau

SEQ ID NO: 93475 - RNA, 22 nt, Escherichia coli CFT073
agcaggaaaaaccgauuuagcg

SEQ ID NO: 93476 - RNA, 22 nt, Escherichia coli CFT073
agcaguuucguggcggcaccga

SEQ ID NO: 93477 - RNA, 22 nt, Escherichia coli CFT073
agcaguuuuucaucccugaaua

SEQ ID NO: 93478 - RNA, 22 nt, Escherichia coli CFT073
agcaggauacgaaggcuaugug

SEQ ID NO: 93479 - RNA, 22 nt, Escherichia coli CFT073
aggaagaugccucucaguugcg

SEQ ID NO: 93480 - RNA, 22 nt, Escherichia coli CFT073
aggaagcaucacuuucugccca

SEQ ID NO: 93481 - RNA, 22 nt, Escherichia coli CFT073
aggccgaagcgaucgauaagcu

SEQ ID NO: 93482 - RNA, 19 nt, Escherichia coli CFT073
agcucagacggggaguggu

SEQ ID NO: 93483 - RNA, 22 nt, Escherichia coli CFT073
aaucaucuccguucaccagucc

SEQ ID NO: 93484 - RNA, 22 nt, Escherichia coli CFT073
accauuuuuaucgauggcuaau

SEQ ID NO: 93485 - RNA, 22 nt, Escherichia coli CFT073
agauccuccuguuugauagugu

SEQ ID NO: 93486 - RNA, 22 nt, Escherichia coli CFT073
agauggugauuggcagcggcga

SEQ ID NO: 93487 - RNA, 22 nt, Escherichia coli CFT073
agagcggcggucugaucacccg

SEQ ID NO: 93488 - RNA, 22 nt, Escherichia coli CFT073
acuacuucauuaugagcaaacu

SEQ ID NO: 93489 - RNA, 22 nt, Escherichia coli CFT073
agacaacaguuggaugcucauu

SEQ ID NO: 93490 - RNA, 22 nt, Escherichia coli CFT073
uuuuuuaucugaauguucugga

SEQ ID NO: 93491 - RNA, 22 nt, Escherichia coli CFT073
uuuuucaaaucccacuacgaag

SEQ ID NO: 93492 - RNA, 22 nt, Escherichia coli CFT073
uuuuucugccuguaguaccuga

SEQ ID NO: 93493 - RNA, 22 nt, Escherichia coli CFT073
uuucaaaaugauaacuucgcaa

SEQ ID NO: 93494 - RNA, 22 nt, Escherichia coli CFT073
uuucaauacuuaucgauuccuu

SEQ ID NO: 93495 - RNA, 22 nt, Escherichia coli CFT073
uuucacagucuggucaggauau

SEQ ID NO: 93496 - RNA, 22 nt, Escherichia coli CFT073
uuucacggucggccaguauuug

SEQ ID NO: 93497 - RNA, 22 nt, Escherichia coli CFT073
uuuuauauuagccaggaacuuu

SEQ ID NO: 93498 - RNA, 22 nt, Escherichia coli CFT073
uuugccugauucgacgugcuca

SEQ ID NO: 93499 - RNA, 20 nt, Escherichia coli CFT073
uuugcuaucguugauaccaa

SEQ ID NO: 93500 - RNA, 22 nt, Escherichia coli CFT073
uuugcaggccugauaagcguag

SEQ ID NO: 93501 - RNA, 20 nt, Escherichia coli CFT073
uugaugaauuugcuguaaga

SEQ ID NO: 93502 - RNA, 22 nt, Escherichia coli CFT073
uugaugcucagucugcugauca

SEQ ID NO: 93503 - RNA, 22 nt, Escherichia coli CFT073
uugcaagcuucgggcggucuug

SEQ ID NO: 93504 - RNA, 19 nt, Escherichia coli CFT073
uugcuucugaauauaucua

SEQ ID NO: 93505 - RNA, 23 nt, Escherichia coli CFT073
uugcucucauuucgcacaucgcg

SEQ ID NO: 93506 - RNA, 22 nt, Escherichia coli CFT073
uuggugauaaagaaauauuugg

SEQ ID NO: 93507 - RNA, 22 nt, Escherichia coli CFT073
uuguagcaggcguucuacagcc

SEQ ID NO: 93508 - RNA, 22 nt, Escherichia coli CFT073
uuguugugaauuacuggcuuag

SEQ ID NO: 93509 - RNA, 22 nt, Escherichia coli CFT073
uuuaaagauuccuuuguugcuc

SEQ ID NO: 93510 - RNA, 22 nt, Escherichia coli CFT073
uuuaucacccgcaugaugaugc

SEQ ID NO: 93511 - RNA, 22 nt, Escherichia coli CFT073
uuuauggucaggaucgcucgcg

SEQ ID NO: 93512 - RNA, 22 nt, Escherichia coli CFT073
uuguuucugcaauguuugaggg

SEQ ID NO: 93513 - RNA, 22 nt, Escherichia coli CFT073
uuauggcaaaacauuucacucc

SEQ ID NO: 93514 - RNA, 22 nt, Escherichia coli CFT073
uuauucacacucccuucacuua

SEQ ID NO: 93515 - RNA, 22 nt, Escherichia coli CFT073
uuaucacuugugcguuauaacg

SEQ ID NO: 93516 - RNA, 22 nt, Escherichia coli CFT073
uggggauguuaagcuggaguug

SEQ ID NO: 93517 - RNA, 20 nt, Escherichia coli CFT073
uucuggauuuugccaucaau

SEQ ID NO: 93518 - RNA, 22 nt, Escherichia coli CFT073
uucuguacagcacgcuucauag

SEQ ID NO: 93519 - RNA, 22 nt, Escherichia coli CFT073
uucuguagacaacguuguugcg

SEQ ID NO: 93520 - RNA, 22 nt, Escherichia coli CFT073
uucuucaaucugacgcaucagg

SEQ ID NO: 93521 - RNA, 22 nt, Escherichia coli CFT073
uucuucauuuuguaaggcgaac

SEQ ID NO: 93522 - RNA, 22 nt, Escherichia coli CFT073
uucuucugguuauuaugccugc

SEQ ID NO: 93523 - RNA, 22 nt, Escherichia coli CFT073
uuccguuugucgcagcauaucu

SEQ ID NO: 93524 - RNA, 22 nt, Escherichia coli CFT073
uucuccuucaacaaacagugcg

SEQ ID NO: 93525 - RNA, 22 nt, Escherichia coli CFT073
uucugaauucauccacuuugcc

SEQ ID NO: 93526 - RNA, 22 nt, Escherichia coli CFT073
uucaguguaaugguauuggucc

SEQ ID NO: 93527 - RNA, 22 nt, Escherichia coli CFT073
uucaucuguacugguaaugucu

SEQ ID NO: 93528 - RNA, 22 nt, Escherichia coli CFT073
uucauuguuaaaaaaugauauu

SEQ ID NO: 93529 - RNA, 23 nt, Escherichia coli CFT073
uuccagccacucaaacucaauca

SEQ ID NO: 93530 - RNA, 22 nt, Escherichia coli CFT073
ugcuaucuggugagagugucgg

SEQ ID NO: 93531 - RNA, 22 nt, Escherichia coli CFT073
ugcuucuguuagcggcucuuca

SEQ ID NO: 93532 - RNA, 22 nt, Escherichia coli CFT073
uggagcauggcaauauuuugcc

SEQ ID NO: 93533 - RNA, 22 nt, Escherichia coli CFT073
uggagccgucguuaacgcaaau

SEQ ID NO: 93534 - RNA, 22 nt, Escherichia coli CFT073
ugcugcgcaaaacccacuucga

SEQ ID NO: 93535 - RNA, 22 nt, Escherichia coli CFT073
ugcuggggaaaacauggucgau

SEQ ID NO: 93536 - RNA, 23 nt, Escherichia coli CFT073
ugaagcugguaauaacguggcga

SEQ ID NO: 93537 - RNA, 22 nt, Escherichia coli CFT073
ugaaguauagccaagacaaccc

SEQ ID NO: 93538 - RNA, 22 nt, Escherichia coli CFT073
ugaauaaaccaucaugauuuuu

SEQ ID NO: 93539 - RNA, 22 nt, Escherichia coli CFT073
ugaauacacagugcaguguuua

SEQ ID NO: 93540 - RNA, 22 nt, Escherichia coli CFT073
ugacaauuauuccuucaaguca

SEQ ID NO: 93541 - RNA, 22 nt, Escherichia coli CFT073
ugcaggggcuauguaggccuga

SEQ ID NO: 93542 - RNA, 19 nt, Escherichia coli CFT073
uauuucuccggauuuuuga

SEQ ID NO: 93543 - RNA, 22 nt, Escherichia coli CFT073
uaggccaguuugaugaucgaaa

SEQ ID NO: 93544 - RNA, 22 nt, Escherichia coli CFT073
uauuuuuacuuuguuccugcgc

SEQ ID NO: 93545 - RNA, 22 nt, Escherichia coli CFT073
ucaaggagagcuauaucgcagc

SEQ ID NO: 93546 - RNA, 22 nt, Escherichia coli CFT073
ucaccagcaacagacggcgaau

SEQ ID NO: 93547 - RNA, 22 nt, Escherichia coli CFT073
ucaccuccacucccggccggau

SEQ ID NO: 93548 - RNA, 22 nt, Escherichia coli CFT073
ucagaagaguaagaucaauauu

SEQ ID NO: 93549 - RNA, 23 nt, Escherichia coli CFT073
ucagcuggaauaccugcucugca

SEQ ID NO: 93550 - RNA, 22 nt, Escherichia coli CFT073
ugaaagagcuggggaugcauuc

SEQ ID NO: 93551 - RNA, 22 nt, Escherichia coli CFT073
ucuuucagacugagcuggaacc

SEQ ID NO: 93552 - RNA, 22 nt, Escherichia coli CFT073
ucguuauucagauguacguuuc

SEQ ID NO: 93553 - RNA, 22 nt, Escherichia coli CFT073
uccuuuuucaaauauacuguga

SEQ ID NO: 93554 - RNA, 22 nt, Escherichia coli CFT073
ucgccagcauucugcggcuggg

SEQ ID NO: 93555 - RNA, 22 nt, Escherichia coli CFT073
guuuaucacgcggugguugauu

SEQ ID NO: 93556 - RNA, 22 nt, Escherichia coli CFT073
guuucacuccaaccuguucaag

SEQ ID NO: 93557 - RNA, 22 nt, Escherichia coli CFT073
uacaauguggcgcgaagaaugu

SEQ ID NO: 93558 - RNA, 22 nt, Escherichia coli CFT073
uacacaccugugaugccguauu

SEQ ID NO: 93559 - RNA, 22 nt, Escherichia coli CFT073
uagaagacucggucacucaggu

SEQ ID NO: 93560 - RNA, 22 nt, Escherichia coli CFT073
uacagaaaaaguuuggcaucuu

SEQ ID NO: 93561 - RNA, 21 nt, Escherichia coli CFT073
gucucccuguucuggcugcuu

SEQ ID NO: 93562 - RNA, 22 nt, Escherichia coli CFT073
guaauuuucuguuucauguugc

SEQ ID NO: 93563 - RNA, 22 nt, Escherichia coli CFT073
ggacuggugacggucgaagaua

SEQ ID NO: 93564 - RNA, 23 nt, Escherichia coli CFT073
ggucuuccagcucaaucacuucc

SEQ ID NO: 93565 - RNA, 22 nt, Escherichia coli CFT073
ggucuuuuuccugcuggcggca

SEQ ID NO: 93566 - RNA, 22 nt, Escherichia coli CFT073
ggugauugaugacgauggcuac

SEQ ID NO: 93567 - RNA, 22 nt, Escherichia coli CFT073
ggugagaaugugguggccauca

SEQ ID NO: 93568 - RNA, 22 nt, Escherichia coli CFT073
ggaacagaucgccagcaaauuu

SEQ ID NO: 93569 - RNA, 22 nt, Escherichia coli CFT073
ggaagggaauaaaguucgcgag

SEQ ID NO: 93570 - RNA, 22 nt, Escherichia coli CFT073
gccuguccgacaugagagagca

SEQ ID NO: 93571 - RNA, 22 nt, Escherichia coli CFT073
gcagaauuuuguccgauagugg

SEQ ID NO: 93572 - RNA, 22 nt, Escherichia coli CFT073
gaugucuguuugguuucaggcg

SEQ ID NO: 93573 - RNA, 22 nt, Escherichia coli CFT073
gauuuuuacuggcguuugccug

SEQ ID NO: 93574 - RNA, 22 nt, Escherichia coli CFT073
gaugagcguuucccgcauccgc

SEQ ID NO: 93575 - RNA, 22 nt, Escherichia coli CFT073
cugucuccggcugcgcugauga

SEQ ID NO: 93576 - RNA, 22 nt, Escherichia coli CFT073
cugggauacugguugcucauug

SEQ ID NO: 93577 - RNA, 22 nt, Escherichia coli CFT073
gaguucgaauaugacauucugg

SEQ ID NO: 93578 - RNA, 22 nt, Escherichia coli CFT073
gaucauuuucgcuauuuugccu

SEQ ID NO: 93579 - RNA, 22 nt, Escherichia coli CFT073
gaggcggagaaugaugccacag

SEQ ID NO: 93580 - RNA, 22 nt, Escherichia coli CFT073
gaggcuguaacgaucaauuucu

SEQ ID NO: 93581 - RNA, 22 nt, Escherichia coli CFT073
gagcgucaggaagaguggaccg

SEQ ID NO: 93582 - RNA, 22 nt, Escherichia coli CFT073
gagcugcaccaaggucgacaac

SEQ ID NO: 93583 - RNA, 22 nt, Escherichia coli CFT073
gaggcgaaagccgggcgcagcu

SEQ ID NO: 93584 - RNA, 22 nt, Escherichia coli CFT073
ccagcaaacaagugcuccaggg

SEQ ID NO: 93585 - RNA, 22 nt, Escherichia coli CFT073
ccagcuccggcacauugccaac

SEQ ID NO: 93586 - RNA, 22 nt, Escherichia coli CFT073
ccagaauucagguugcauccgu

SEQ ID NO: 93587 - RNA, 20 nt, Escherichia coli CFT073
ccagaccacagagaaugccc

SEQ ID NO: 93588 - RNA, 22 nt, Escherichia coli CFT073
aggccggauaagcgaagcgcau

SEQ ID NO: 93589 - RNA, 22 nt, Escherichia coli CFT073
aggccggauaaggcguucacgc

SEQ ID NO: 93590 - RNA, 22 nt, Escherichia coli CFT073
aggaguugguguuaccauugca

SEQ ID NO: 93591 - RNA, 22 nt, Escherichia coli CFT073
aggcgugucaucagcauggagc

SEQ ID NO: 93592 - RNA, 22 nt, Escherichia coli CFT073
caugaugggcaugaaugucaua

SEQ ID NO: 93593 - RNA, 22 nt, Escherichia coli CFT073
caugcugcgcguuggcgaucug

SEQ ID NO: 93594 - RNA, 22 nt, Escherichia coli CFT073
ccuaccuggcggaugacgccau

SEQ ID NO: 93595 - RNA, 21 nt, Escherichia coli CFT073
ccucgcuggucguuauccugc

SEQ ID NO: 93596 - RNA, 22 nt, Escherichia coli CFT073
ccucccuugccacgcaguaguu

SEQ ID NO: 93597 - RNA, 22 nt, Escherichia coli CFT073
ccucugccauugcaagaaguga

SEQ ID NO: 93598 - RNA, 22 nt, Escherichia coli CFT073
ccuggcugcaggaacaccaugu

SEQ ID NO: 93599 - RNA, 22 nt, Escherichia coli CFT073
ccugggaagauguaagccgcca

SEQ ID NO: 93600 - RNA, 22 nt, Escherichia coli CFT073
ccccccuauaguauauugcaug

SEQ ID NO: 93601 - RNA, 22 nt, Escherichia coli CFT073
ccggccuacaaaaaucuugcca

SEQ ID NO: 93602 - RNA, 22 nt, Escherichia coli CFT073
cggcccagcuuuucccucucuc

SEQ ID NO: 93603 - RNA, 22 nt, Escherichia coli CFT073
cgcucucuaccgauuuccguaa

SEQ ID NO: 93604 - RNA, 22 nt, Escherichia coli CFT073
cgaagcugaacaguuuaucggg

SEQ ID NO: 93605 - RNA, 22 nt, Human
aaaaaaacuaauuuuaaaugug

SEQ ID NO: 93606 - RNA, 22 nt, Human
aaaaaauugcuggcagagcugu

SEQ ID NO: 93607 - RNA, 22 nt, Human
aaaaacuuaccccagggcaagg

SEQ ID NO: 93608 - RNA, 20 nt, Human
aaaaacaguaaugcugaaga

SEQ ID NO: 93609 - RNA, 22 nt, Human
aaaagauguaaacauauauuaa

SEQ ID NO: 93610 - RNA, 22 nt, Human
aaaagacaaggaucuggaguga

SEQ ID NO: 93611 - RNA, 22 nt, Human
aaaacauuuuacugccaucuca

SEQ ID NO: 93612 - RNA, 22 nt, Human
aaaaccugcaagaugaaaucag

SEQ ID NO: 93613 - RNA, 22 nt, Human
aaaacauuuaggguuuuuuuua

SEQ ID NO: 93614 - RNA, 22 nt, Human
aaaaaguaccacuuggacacuu

SEQ ID NO: 93615 - RNA, 22 nt, Human
aaacuugaggcaaugaaggugu

SEQ ID NO: 93616 - RNA, 22 nt, Human
aaacugugcagucacauaagga

SEQ ID NO: 93617 - RNA, 22 nt, Human
aaagaagugucuuacucccucu

SEQ ID NO: 93618 - RNA, 22 nt, Human
aaacucaugccagagaacuuaa

SEQ ID NO: 93619 - RNA, 22 nt, Human
aaacugcuuucucugccuuucc

SEQ ID NO: 93620 - RNA, 22 nt, Human
aaacugacugaugugaucuuau

SEQ ID NO: 93621 - RNA, 21 nt, Human
aaagaaguuaguucagugguu

SEQ ID NO: 93622 - RNA, 20 nt, Human
aaacucuuuucuuacauuuu

SEQ ID NO: 93623 - RNA, 22 nt, Human
aaaauaaccuucauuugcauug

SEQ ID NO: 93624 - RNA, 22 nt, Human
aaaagcgaagagaacugaaguu

SEQ ID NO: 93625 - RNA, 22 nt, Human
aaaaggaacaauaugguauuuu

SEQ ID NO: 93626 - RNA, 22 nt, Human
aaaagcucucuucuucggcuuu

SEQ ID NO: 93627 - RNA, 22 nt, Human
aaacaauaauaauuaggaagga

SEQ ID NO: 93628 - RNA, 22 nt, Human
aaaauauguugagauacugaaa

SEQ ID NO: 93629 - RNA, 22 nt, Human
aaaauauaaaggauguggguuu

SEQ ID NO: 93630 - RNA, 22 nt, Human
aaaauacuaggaaaauaaauca

SEQ ID NO: 93631 - RNA, 21 nt, Human
aaacaugcagccugccaauuc

SEQ ID NO: 93632 - RNA, 22 nt, Human
aaacccaggguuuugucuuccc

SEQ ID NO: 93633 - RNA, 22 nt, Human
aaacccacauuccugcuuaggc

SEQ ID NO: 93634 - RNA, 22 nt, Human
aaaccagaguucauaguauuca

SEQ ID NO: 93635 - RNA, 22 nt, Human
aaacauguagugcaugaggauc

SEQ ID NO: 93636 - RNA, 22 nt, Human
aaacagguuugaacuucuuaac

SEQ ID NO: 93637 - RNA, 22 nt, Human
aaacauaugccuucuuuuguaa

SEQ ID NO: 93638 - RNA, 22 nt, Human
aaacccuagcguuguuuauuga

SEQ ID NO: 93639 - RNA, 23 nt, Human
aaagaggugaauccaggacaagc

SEQ ID NO: 93640 - RNA, 22 nt, Human
aaagaccuucacuuucuggcug

SEQ ID NO: 93641 - RNA, 22 nt, Human
aaagacuaaccaguugucaaaa

SEQ ID NO: 93642 - RNA, 22 nt, Human
aaagacucaauuguucccuaau

SEQ ID NO: 93643 - RNA, 22 nt, Human
aaagaccaagagccccaaguuu

SEQ ID NO: 93644 - RNA, 23 nt, Human
aaagacuagaagccguggcugca

SEQ ID NO: 93645 - RNA, 22 nt, Human
aaauggauaaucaagauaauca

SEQ ID NO: 93646 - RNA, 17 nt, Human
aaaugguccuagggauu

SEQ ID NO: 93647 - RNA, 22 nt, Human
aaauggaaguuuguucucagcc

SEQ ID NO: 93648 - RNA, 22 nt, Human
aaaugcuuuaauugaguucaug

SEQ ID NO: 93649 - RNA, 22 nt, Human
aaagaucaguuaacgccaucaa

SEQ ID NO: 93650 - RNA, 22 nt, Human
aaauguguagaggggagagccg

SEQ ID NO: 93651 - RNA, 22 nt, Human
aaauuaaaguuuuauuuagagc

SEQ ID NO: 93652 - RNA, 22 nt, Human
aaaugucugagacuucugaacu

SEQ ID NO: 93653 - RNA, 22 nt, Human
aaauguuucauucuauuuuuag

SEQ ID NO: 93654 - RNA, 22 nt, Human
aaauucggggaguuuugaggau

SEQ ID NO: 93655 - RNA, 22 nt, Human
aaauguuugguggauaaaagga

SEQ ID NO: 93656 - RNA, 22 nt, Human
aaauucagauggcuuucuuuuc

SEQ ID NO: 93657 - RNA, 22 nt, Human
aaauucagcagguuucaaaagc

SEQ ID NO: 93658 - RNA, 20 nt, Human
aaauugaacaagccaggcug

SEQ ID NO: 93659 - RNA, 22 nt, Human
aacacuguaucagucuucaaua

SEQ ID NO: 93660 - RNA, 22 nt, Human
aacaggcuaaauuguccauuuc

SEQ ID NO: 93661 - RNA, 22 nt, Human
aacaucugagagcccuugugca

SEQ ID NO: 93662 - RNA, 22 nt, Human
aacaguaugugagauuuacaca

SEQ ID NO: 93663 - RNA, 22 nt, Human
aacaguuaagaggaggcagaga

SEQ ID NO: 93664 - RNA, 22 nt, Human
aacaucaaaggaagaaugauau

SEQ ID NO: 93665 - RNA, 22 nt, Human
aacagaaaucauuuagggcucu

SEQ ID NO: 93666 - RNA, 21 nt, Human
aacagguuuccuaccacuugc

SEQ ID NO: 93667 - RNA, 22 nt, Human
aacagguucaucuuggaagcag

SEQ ID NO: 93668 - RNA, 22 nt, Human
aaauuugggagaaaugggucau

SEQ ID NO: 93669 - RNA, 21 nt, Human
aaauuucauauggccaaccua

SEQ ID NO: 93670 - RNA, 22 nt, Human
aacacugaaaugucuuaagauu

SEQ ID NO: 93671 - RNA, 22 nt, Human
aacacaguuucucuaugagagu

SEQ ID NO: 93672 - RNA, 22 nt, Human
aaauuuuguugaaaaauauuuu

SEQ ID NO: 93673 - RNA, 22 nt, Human
aaccucuuugugaaugucauga

SEQ ID NO: 93674 - RNA, 22 nt, Human
aaccuggguguacauuaugguc

SEQ ID NO: 93675 - RNA, 22 nt, Human
aacgucugagaccccuccucuc

SEQ ID NO: 93676 - RNA, 21 nt, Human
aacuauuaauaccauuagcaa

SEQ ID NO: 93677 - RNA, 22 nt, Human
aacuacucugggguggcagguu

SEQ ID NO: 93678 - RNA, 22 nt, Human
aacucaggagagaguaacaggg

SEQ ID NO: 93679 - RNA, 22 nt, Human
aaccuuauuguguaucaccaua

SEQ ID NO: 93680 - RNA, 22 nt, Human
aacgagcugggggggccggggg

SEQ ID NO: 93681 - RNA, 22 nt, Human
aacgaugauaaauuguucucug

SEQ ID NO: 93682 - RNA, 22 nt, Human
aacccugaacuuaguucuagga

SEQ ID NO: 93683 - RNA, 22 nt, Human
aacgcagagaguaaugcugaac

SEQ ID NO: 93684 - RNA, 22 nt, Human
aacgcugugcacuggguccagg

SEQ ID NO: 93685 - RNA, 22 nt, Human
aacgccgggacucgcagggagc

SEQ ID NO: 93686 - RNA, 22 nt, Human
aaccggauugauccuucuuuga

SEQ ID NO: 93687 - RNA, 22 nt, Human
aaccucuuuaaaagggauauug

SEQ ID NO: 93688 - RNA, 22 nt, Human
aaccucgggcugcacuuggcac

SEQ ID NO: 93689 - RNA, 22 nt, Human
aacccguagaucaguucuaggu

SEQ ID NO: 93690 - RNA, 22 nt, Human
aacaugggcaacuucuuuucag

SEQ ID NO: 93691 - RNA, 22 nt, Human
aaccguguucgggaacacuugu

SEQ ID NO: 93692 - RNA, 22 nt, Human
aaccauggauuucaguucaccu

SEQ ID NO: 93693 - RNA, 22 nt, Human
aacccaagacaagcacuggcca

SEQ ID NO: 93694 - RNA, 22 nt, Human
aaccaggcgagagagcggucag

SEQ ID NO: 93695 - RNA, 22 nt, Human
aaccaguacuucucuauucagu

SEQ ID NO: 93696 - RNA, 22 nt, Human
aacagguucaagccuugcagca

SEQ ID NO: 93697 - RNA, 22 nt, Human
aaccagaagucaucagagcuga

SEQ ID NO: 93698 - RNA, 22 nt, Human
aacaguguaggagcugguuuau

SEQ ID NO: 93699 - RNA, 20 nt, Human
aaccuauuguaauauucuaa

SEQ ID NO: 93700 - RNA, 22 nt, Human
aaccaaucaaauuggaauugaa

SEQ ID NO: 93701 - RNA, 22 nt, Human
aaccaagcucaauggucugagu

SEQ ID NO: 93702 - RNA, 22 nt, Human
aaccaaaguugguauuuaauaa

SEQ ID NO: 93703 - RNA, 22 nt, Human
aaccaauaagaggaugccauuu

SEQ ID NO: 93704 - RNA, 22 nt, Human
aacauuuauguuuugaccaagu

SEQ ID NO: 93705 - RNA, 22 nt, Human
aacauuuccggccuuuuguucu

SEQ ID NO: 93706 - RNA, 22 nt, Human
aacauuguuuaaguuaaauugu

SEQ ID NO: 93707 - RNA, 22 nt, Human
aaccuggaggaccuuaugcuaa

SEQ ID NO: 93708 - RNA, 22 nt, Human
aaccugaggguagacaaguuca

SEQ ID NO: 93709 - RNA, 22 nt, Human
aagcauaucaaguuuuaugugc

SEQ ID NO: 93710 - RNA, 22 nt, Human
aagcaugagguggugagugaca

SEQ ID NO: 93711 - RNA, 22 nt, Human
aagauuuaccacuuuauucaag

SEQ ID NO: 93712 - RNA, 22 nt, Human
aagcaaaagguuacacuucugg

SEQ ID NO: 93713 - RNA, 22 nt, Human
aagauuugaaaguggugcauuu

SEQ ID NO: 93714 - RNA, 22 nt, Human
aagcauuuuagauaaagcauca

SEQ ID NO: 93715 - RNA, 22 nt, Human
aagccgagggaggugauggaga

SEQ ID NO: 93716 - RNA, 22 nt, Human
aagcaaguucuaaaguaauucu

SEQ ID NO: 93717 - RNA, 22 nt, Human
aagcagaaaaacugagcuccaa

SEQ ID NO: 93718 - RNA, 22 nt, Human
aagauguuguagauuagugaga

SEQ ID NO: 93719 - RNA, 22 nt, Human
aagaggaggcuggaauccuaaa

SEQ ID NO: 93720 - RNA, 22 nt, Human
aagaggauuuuaguuugccaga

SEQ ID NO: 93721 - RNA, 22 nt, Human
aagagaggcccaaguggcuggc

SEQ ID NO: 93722 - RNA, 22 nt, Human
aagagaaaugcuuuaacuuuau

SEQ ID NO: 93723 - RNA, 22 nt, Human
aagagcuuguuaugcugcucuu

SEQ ID NO: 93724 - RNA, 21 nt, Human
aagacguaguuggguggacca

SEQ ID NO: 93725 - RNA, 22 nt, Human
aagagugaguagcuugguuggu

SEQ ID NO: 93726 - RNA, 22 nt, Human
aagaggaauaauaaaaauugca

SEQ ID NO: 93727 - RNA, 22 nt, Human
aagaggcuacagcccugugucu

SEQ ID NO: 93728 - RNA, 21 nt, Human
aagagcgccgggcagggcuga

SEQ ID NO: 93729 - RNA, 23 nt, Human
aagaaugcuucugaagagcugcc

SEQ ID NO: 93730 - RNA, 22 nt, Human
aagaagguugaaugacuacuuu

SEQ ID NO: 93731 - RNA, 22 nt, Human
aagaacaugggugugggcauuc

SEQ ID NO: 93732 - RNA, 22 nt, Human
aagaaauacagaaauggcagua

SEQ ID NO: 93733 - RNA, 22 nt, Human
aacuucuggaaacuuccaugug

SEQ ID NO: 93734 - RNA, 22 nt, Human
aagaaagaucugaaagaagcga

SEQ ID NO: 93735 - RNA, 22 nt, Human
aagaaaccauauuaguuccugg

SEQ ID NO: 93736 - RNA, 22 nt, Human
aagaaaggagauauucuuuuag

SEQ ID NO: 93737 - RNA, 19 nt, Human
aagaacaguucuaauuuca

SEQ ID NO: 93738 - RNA, 22 nt, Human
aagaacaacugcuuuaaaagca

SEQ ID NO: 93739 - RNA, 22 nt, Human
aacuuuuaugaaggaaaucaua

SEQ ID NO: 93740 - RNA, 20 nt, Human
aacuuugagugcaugacuuu

SEQ ID NO: 93741 - RNA, 21 nt, Human
aacuuucccaauccagauuug

SEQ ID NO: 93742 - RNA, 22 nt, Human
aacuuucuuugcaucuaaguuu

SEQ ID NO: 93743 - RNA, 22 nt, Human
aacuuucugaaaagcuugauca

SEQ ID NO: 93744 - RNA, 22 nt, Human
aacuuucagaauccuaugcauu

SEQ ID NO: 93745 - RNA, 22 nt, Human
aacucugacgcugucaaauaca

SEQ ID NO: 93746 - RNA, 22 nt, Human
aacuggguuuaucuaaugugua

SEQ ID NO: 93747 - RNA, 22 nt, Human
aagaaaagguaaccgcuuaucu

SEQ ID NO: 93748 - RNA, 22 nt, Human
aagaaaagaaacauggguaugc

SEQ ID NO: 93749 - RNA, 22 nt, Human
aacugguaauuuaguauuacug

SEQ ID NO: 93750 - RNA, 22 nt, Human
aacuugaagacaccccacauuc

SEQ ID NO: 93751 - RNA, 22 nt, Human
aacuguugucacgaauguggcu

SEQ ID NO: 93752 - RNA, 19 nt, Human
aacuacagcgcacuguccu

SEQ ID NO: 93753 - RNA, 22 nt, Human
aacuagugucuguaugauaagg

SEQ ID NO: 93754 - RNA, 22 nt, Human
aacucugagaaacuugcaguug

SEQ ID NO: 93755 - RNA, 22 nt, Human
aacuuuacagacuagagcuuuc

SEQ ID NO: 93756 - RNA, 22 nt, Human
aacucugcaaugaaaucauguu

SEQ ID NO: 93757 - RNA, 19 nt, Human
aacucugccgaggcaagcc

SEQ ID NO: 93758 - RNA, 22 nt, Human
aacugaaguuuucagauuuugc

SEQ ID NO: 93759 - RNA, 22 nt, Human
aacgugcuuuacaaaugaccuu

SEQ ID NO: 93760 - RNA, 22 nt, Human
aacgggguugauuauuggaaga

SEQ ID NO: 93761 - RNA, 23 nt, Human
aacugcaagguugcugggaagua

SEQ ID NO: 93762 - RNA, 22 nt, Human
aacugggugauucaggcuguuu

SEQ ID NO: 93763 - RNA, 22 nt, Human
aacugcauaagcuucgggaccu

SEQ ID NO: 93764 - RNA, 23 nt, Human
aacucuggcuagcauagaauaga

SEQ ID NO: 93765 - RNA, 22 nt, Human
aacgcaacaacuggagcuguag

SEQ ID NO: 93766 - RNA, 22 nt, Human
aacucgaugcaauucacuuugu

SEQ ID NO: 93767 - RNA, 23 nt, Human
aaugaguugggcagcauacaggc

SEQ ID NO: 93768 - RNA, 22 nt, Human
aaugagauggaggacucuuaau

SEQ ID NO: 93769 - RNA, 22 nt, Human
aaugagauaagaaaaccuuugc

SEQ ID NO: 93770 - RNA, 22 nt, Human
aaugcauaaugguuugugacaa

SEQ ID NO: 93771 - RNA, 22 nt, Human
aaugcauacguguuuguggcaa

SEQ ID NO: 93772 - RNA, 22 nt, Human
aaugaguuuguucuauuauuug

SEQ ID NO: 93773 - RNA, 22 nt, Human
aaugauuuucugcaaacaguga

SEQ ID NO: 93774 - RNA, 22 nt, Human
aaugcagaugugucuuuaauuu

SEQ ID NO: 93775 - RNA, 22 nt, Human
aaugaguucaucugaauucugg

SEQ ID NO: 93776 - RNA, 22 nt, Human
aaugagaauguaagugaagaga

SEQ ID NO: 93777 - RNA, 22 nt, Human
aaugacagccuauacugucugc

SEQ ID NO: 93778 - RNA, 22 nt, Human
aaugaaacuaguagaaucuuug

SEQ ID NO: 93779 - RNA, 22 nt, Human
aaugaacuuucaguucagagag

SEQ ID NO: 93780 - RNA, 22 nt, Human
aaugaaaaucugucaguucaag

SEQ ID NO: 93781 - RNA, 22 nt, Human
aaugaacuuugaagauggugaa

SEQ ID NO: 93782 - RNA, 22 nt, Human
aaugaaugaaugaaugauuaug

SEQ ID NO: 93783 - RNA, 22 nt, Human
aaugacaguggcacagucacuu

SEQ ID NO: 93784 - RNA, 22 nt, Human
aaucugugaggaauaaugaguu

SEQ ID NO: 93785 - RNA, 22 nt, Human
aaucugugugugagaaauggca

SEQ ID NO: 93786 - RNA, 22 nt, Human
aaucuuuuugaaggaggagaga

SEQ ID NO: 93787 - RNA, 22 nt, Human
aaucugacaaaauauuuccagu

SEQ ID NO: 93788 - RNA, 22 nt, Human
aaucugaccguggagaucucca

SEQ ID NO: 93789 - RNA, 22 nt, Human
aaucuguugucaggaauccaca

SEQ ID NO: 93790 - RNA, 22 nt, Human
aaucuuguucaacauuaucugu

SEQ ID NO: 93791 - RNA, 22 nt, Human
aaugaauaaauuuuaaagacag

SEQ ID NO: 93792 - RNA, 22 nt, Human
aaucaaagccugcaaguugacu

SEQ ID NO: 93793 - RNA, 22 nt, Human
aauauuuaccuaccugucaucu

SEQ ID NO: 93794 - RNA, 19 nt, Human
aaucacaagcaauaggggu

SEQ ID NO: 93795 - RNA, 22 nt, Human
aaucaugguacaaguaagcacg

SEQ ID NO: 93796 - RNA, 23 nt, Human
aaucacuggauuugagcaugagg

SEQ ID NO: 93797 - RNA, 22 nt, Human
aauccaaacaggauuaccuauc

SEQ ID NO: 93798 - RNA, 22 nt, Human
aaucauguguaaugggcagacc

SEQ ID NO: 93799 - RNA, 22 nt, Human
aauccucguagugguuagaaag

SEQ ID NO: 93800 - RNA, 22 nt, Human
aaucucguuaugaagaugguug

SEQ ID NO: 93801 - RNA, 22 nt, Human
aaucucuugggaagagugagug

SEQ ID NO: 93802 - RNA, 22 nt, Human
aauguuuaagcuuuuauuuaca

SEQ ID NO: 93803 - RNA, 22 nt, Human
aauguuuaguuuuauuuuagua

SEQ ID NO: 93804 - RNA, 22 nt, Human
aauguuuaacuguggucagcag

SEQ ID NO: 93805 - RNA, 23 nt, Human
aauguugaggguggguuuuuaac

SEQ ID NO: 93806 - RNA, 22 nt, Human
aauguuguaaauauucuuugag

SEQ ID NO: 93807 - RNA, 22 nt, Human
aauguugaaccuuuuuggccug

SEQ ID NO: 93808 - RNA, 22 nt, Human
aauguucucuaaucuuucucuu

SEQ ID NO: 93809 - RNA, 22 nt, Human
aauguugacguuggccagggcc

SEQ ID NO: 93810 - RNA, 22 nt, Human
aauguaguuuacugugagugca

SEQ ID NO: 93811 - RNA, 22 nt, Human
aauguauuuuuaggcagaauau

SEQ ID NO: 93812 - RNA, 22 nt, Human
aauuauguugaaauaugagaac

SEQ ID NO: 93813 - RNA, 22 nt, Human
aauuauguuugcuuuagaugga

SEQ ID NO: 93814 - RNA, 22 nt, Human
aauuagaagcuguuagcaaaau

SEQ ID NO: 93815 - RNA, 22 nt, Human
aauuacuuuaggaaaacuccuc

SEQ ID NO: 93816 - RNA, 22 nt, Human
aauuauuaagcuuucuccagug

SEQ ID NO: 93817 - RNA, 22 nt, Human
aauuauucuugccuagguuuaa

SEQ ID NO: 93818 - RNA, 22 nt, Human
aauucaggacaaauguuuucaa

SEQ ID NO: 93819 - RNA, 21 nt, Human
aauuauuugcauuuuucuugu

SEQ ID NO: 93820 - RNA, 22 nt, Human
aauucaacagucaguuaucuca

SEQ ID NO: 93821 - RNA, 22 nt, Human
aauucagguuauauuugcaacu

SEQ ID NO: 93822 - RNA, 22 nt, Human
aauggaccuuaaauugcuucag

SEQ ID NO: 93823 - RNA, 22 nt, Human
aaugccuucauuggcgaagugc

SEQ ID NO: 93824 - RNA, 22 nt, Human
aauggaaaaauccacagggaac

SEQ ID NO: 93825 - RNA, 22 nt, Human
aaugcuaaagaagaaggaguag

SEQ ID NO: 93826 - RNA, 22 nt, Human
aaugcgcagaguggugugugca

SEQ ID NO: 93827 - RNA, 22 nt, Human
aauggcaagccacaugcuuuuc

SEQ ID NO: 93828 - RNA, 22 nt, Human
aauggauaacaccgguucuguc

SEQ ID NO: 93829 - RNA, 22 nt, Human
aauggagaaaagacaauguuga

SEQ ID NO: 93830 - RNA, 22 nt, Human
aauggcaaaaguuucggaaauu

SEQ ID NO: 93831 - RNA, 22 nt, Human
aaugguaauauuucauaguugu

SEQ ID NO: 93832 - RNA, 22 nt, Human
aaugguggaugucuguucugac

SEQ ID NO: 93833 - RNA, 22 nt, Human
aauggugaggagugcauugaga

SEQ ID NO: 93834 - RNA, 22 nt, Human
aaugggauaggucuucaggaau

SEQ ID NO: 93835 - RNA, 22 nt, Human
aaugguccagaaucuuuuggac

SEQ ID NO: 93836 - RNA, 22 nt, Human
aauguacucgaaugauguuaag

SEQ ID NO: 93837 - RNA, 22 nt, Human
aauguaaauaauuguaaaauuu

SEQ ID NO: 93838 - RNA, 22 nt, Human
aaugguuacuacccugggucuu

SEQ ID NO: 93839 - RNA, 22 nt, Human
aauacagauggcaugugaagau

SEQ ID NO: 93840 - RNA, 22 nt, Human
aauaagaguuaagaaguauauu

SEQ ID NO: 93841 - RNA, 22 nt, Human
aauacaaucagauuaugguagu

SEQ ID NO: 93842 - RNA, 22 nt, Human
aauaauuuuuuugugauuaugu

SEQ ID NO: 93843 - RNA, 22 nt, Human
aauacagcacucacaccucccu

SEQ ID NO: 93844 - RNA, 22 nt, Human
aaguugacuguuuuacuuaugu

SEQ ID NO: 93845 - RNA, 22 nt, Human
aauaagacugucauggaguaaa

SEQ ID NO: 93846 - RNA, 22 nt, Human
aauauagagcagaucuggcucu

SEQ ID NO: 93847 - RNA, 22 nt, Human
aauaggaaggaaauguuuaccu

SEQ ID NO: 93848 - RNA, 22 nt, Human
aauagcuuuuuguuugguguau

SEQ ID NO: 93849 - RNA, 22 nt, Human
aauauauaugggugcaugucug

SEQ ID NO: 93850 - RNA, 22 nt, Human
aauaucuugaguuauaaauuca

SEQ ID NO: 93851 - RNA, 22 nt, Human
aauaugcaaagcguguuaucug

SEQ ID NO: 93852 - RNA, 22 nt, Human
aauaugaugccaaauugcuaca

SEQ ID NO: 93853 - RNA, 22 nt, Human
aauaucuagccuuuagcagcuu

SEQ ID NO: 93854 - RNA, 22 nt, Human
aauaguggcuuggacuaaauau

SEQ ID NO: 93855 - RNA, 22 nt, Human
aagucgccuaaacaaaguaucu

SEQ ID NO: 93856 - RNA, 22 nt, Human
aaguauuccccaaguauucugg

SEQ ID NO: 93857 - RNA, 23 nt, Human
aaguggucaucuaucccaugguu

SEQ ID NO: 93858 - RNA, 23 nt, Human
aaguggugacugugcuacugaga

SEQ ID NO: 93859 - RNA, 22 nt, Human
aaguggcaggggaaggguugga

SEQ ID NO: 93860 - RNA, 22 nt, Human
aaguggugagacccugcugaaa

SEQ ID NO: 93861 - RNA, 17 nt, Human
aagugggcaaagugaga

SEQ ID NO: 93862 - RNA, 22 nt, Human
aaguggcccuaauugggccaaa

SEQ ID NO: 93863 - RNA, 22 nt, Human
aaguuaauugcuucuaguuaau

SEQ ID NO: 93864 - RNA, 22 nt, Human
aaguguucucuguuuuaucuac

SEQ ID NO: 93865 - RNA, 22 nt, Human
aaguucaccugcauuuacuaaa

SEQ ID NO: 93866 - RNA, 22 nt, Human
aaguugaaugucuugcugaaug

SEQ ID NO: 93867 - RNA, 22 nt, Human
aaguuccuaaagucagggguca

SEQ ID NO: 93868 - RNA, 20 nt, Human
aaguugaaguuacuucaugg

SEQ ID NO: 93869 - RNA, 22 nt, Human
aaguguggguaagcauuucuug

SEQ ID NO: 93870 - RNA, 22 nt, Human
aagugugugugcgcaugugcau

SEQ ID NO: 93871 - RNA, 22 nt, Human
aagugguuuauuguaugguuuu

SEQ ID NO: 93872 - RNA, 22 nt, Human
aagugugugagaaggggucgca

SEQ ID NO: 93873 - RNA, 22 nt, Human
aagguguaaguagcugguucau

SEQ ID NO: 93874 - RNA, 22 nt, Human
aagguuuuguaugaaaucucug

SEQ ID NO: 93875 - RNA, 22 nt, Human
aaguaaaucuuaugucagggag

SEQ ID NO: 93876 - RNA, 22 nt, Human
aagguuuuguuuucgguuuuuu

SEQ ID NO: 93877 - RNA, 21 nt, Human
aaguaaauuuuuacuuaggcc

SEQ ID NO: 93878 - RNA, 22 nt, Human
aaguaauuugugaaggcauguu

SEQ ID NO: 93879 - RNA, 22 nt, Human
aagggaaacagccaggcccugu

SEQ ID NO: 93880 - RNA, 22 nt, Human
aagggaaaagcugaaugagaug

SEQ ID NO: 93881 - RNA, 22 nt, Human
aaggcugugaacuuuucgggaa

SEQ ID NO: 93882 - RNA, 22 nt, Human
aagggaggguaggaagagggag

SEQ ID NO: 93883 - RNA, 23 nt, Human
aagggcgauuaacauucgcucga

SEQ ID NO: 93884 - RNA, 22 nt, Human
aagggcuucucgccugugugca

SEQ ID NO: 93885 - RNA, 22 nt, Human
aagggaaggaugggcauuuaca

SEQ ID NO: 93886 - RNA, 22 nt, Human
aagggaauagagcagcaaaaau

SEQ ID NO: 93887 - RNA, 22 nt, Human
aagggaaguuugacacuuuuua

SEQ ID NO: 93888 - RNA, 22 nt, Human
aagguauaaauaacucgggagg

SEQ ID NO: 93889 - RNA, 22 nt, Human
aaggucaggggcuuuugaaaca

SEQ ID NO: 93890 - RNA, 22 nt, Human
aaggcgauuuaaagauguuagg

SEQ ID NO: 93891 - RNA, 22 nt, Human
aaggcgccacagugauugcaaa

SEQ ID NO: 93892 - RNA, 22 nt, Human
aaggcggcggcggcggcugcgg

SEQ ID NO: 93893 - RNA, 22 nt, Human
aaggcuuugugcugaguugucg

SEQ ID NO: 93894 - RNA, 22 nt, Human
aaggcacuugcccagagcugca

SEQ ID NO: 93895 - RNA, 22 nt, Human
aaggccuaggaguugacauggg

SEQ ID NO: 93896 - RNA, 22 nt, Human
aaggcaggagaguaggaggugg

SEQ ID NO: 93897 - RNA, 22 nt, Human
aaggcaguuaauuuggcuagaa

SEQ ID NO: 93898 - RNA, 22 nt, Human
aagcaugaaauaauguccuugu

SEQ ID NO: 93899 - RNA, 22 nt, Human
aaggagcuuucauuacagccuu

SEQ ID NO: 93900 - RNA, 18 nt, Human
aaggaggaaugaauagca

SEQ ID NO: 93901 - RNA, 22 nt, Human
aagcgcaaggugucagcagguu

SEQ ID NO: 93902 - RNA, 22 nt, Human
aagcaggaaaugaaaugcuugc

SEQ ID NO: 93903 - RNA, 22 nt, Human
aagcaguuuagucaucgggauu

SEQ ID NO: 93904 - RNA, 22 nt, Human
accaauguuuuauagaaaugcc

SEQ ID NO: 93905 - RNA, 20 nt, Human
accagacagcuguuggggug

SEQ ID NO: 93906 - RNA, 22 nt, Human
accacguccugguggcuguugg

SEQ ID NO: 93907 - RNA, 22 nt, Human
accaccacauaguaggcacuua

SEQ ID NO: 93908 - RNA, 22 nt, Human
acauuguuauuccucaggaguu

SEQ ID NO: 93909 - RNA, 22 nt, Human
acauuuuaaaaacaguaccugg

SEQ ID NO: 93910 - RNA, 22 nt, Human
acauuugauauggaguugugua

SEQ ID NO: 93911 - RNA, 22 nt, Human
acauuuuaccaucuguggauga

SEQ ID NO: 93912 - RNA, 22 nt, Human
acauuuugggagaaaguuguua

SEQ ID NO: 93913 - RNA, 22 nt, Human
acauuuccaaagaugccaguca

SEQ ID NO: 93914 - RNA, 22 nt, Human
acauuucuccuacuuguuauuu

SEQ ID NO: 93915 - RNA, 22 nt, Human
accaauaaaagcaauucacagu

SEQ ID NO: 93916 - RNA, 22 nt, Human
accaauguucaaccuugacugc

SEQ ID NO: 93917 - RNA, 22 nt, Human
acauuauuguguagugugggca

SEQ ID NO: 93918 - RNA, 22 nt, Human
accaacacgucugaguauuucc

SEQ ID NO: 93919 - RNA, 22 nt, Human
acauuuuuggguugaugucuga

SEQ ID NO: 93920 - RNA, 22 nt, Human
acauuuuguuuauggaaaagau

SEQ ID NO: 93921 - RNA, 21 nt, Human
acauguacacauguaugcaca

SEQ ID NO: 93922 - RNA, 22 nt, Human
acaugucagaaaauucagaggg

SEQ ID NO: 93923 - RNA, 22 nt, Human
acaugguguggcacuaggggcu

SEQ ID NO: 93924 - RNA, 22 nt, Human
accaccacugacaccagcucgg

SEQ ID NO: 93925 - RNA, 22 nt, Human
accagccacacacauuagucac

SEQ ID NO: 93926 - RNA, 22 nt, Human
accagccacccugccgcguccg

SEQ ID NO: 93927 - RNA, 22 nt, Human
accaguucuauguagauaauga

SEQ ID NO: 93928 - RNA, 22 nt, Human
accaggcagcaccaaagccggu

SEQ ID NO: 93929 - RNA, 22 nt, Human
accagcgcguuuucaguuucau

SEQ ID NO: 93930 - RNA, 18 nt, Human
acccauuauauuuguagc

SEQ ID NO: 93931 - RNA, 22 nt, Human
accaaucugguauauuccagaa

SEQ ID NO: 93932 - RNA, 22 nt, Human
accaugacugucacauuauuau

SEQ ID NO: 93933 - RNA, 19 nt, Human
accauggguguguuaagaa

SEQ ID NO: 93934 - RNA, 22 nt, Human
accaguuuuuugaccaugggug

SEQ ID NO: 93935 - RNA, 22 nt, Human
accaguuaaagaauaugaggcc

SEQ ID NO: 93936 - RNA, 22 nt, Human
acauggaauuucagaagagcau

SEQ ID NO: 93937 - RNA, 22 nt, Human
acauggaccucagauccuggcc

SEQ ID NO: 93938 - RNA, 22 nt, Human
acauuguuuuugugacuucuau

SEQ ID NO: 93939 - RNA, 22 nt, Human
acauuuguuucucuagaguagg

SEQ ID NO: 93940 - RNA, 22 nt, Human
acauggcaugaauaauguguac

SEQ ID NO: 93941 - RNA, 20 nt, Human
acauggagaagcgagguagg

SEQ ID NO: 93942 - RNA, 22 nt, Human
acaugggcaaucgcuuuauuca

SEQ ID NO: 93943 - RNA, 22 nt, Human
acauugguauuaguguggcuga

SEQ ID NO: 93944 - RNA, 22 nt, Human
acauucucuuuuagaaagcugu

SEQ ID NO: 93945 - RNA, 22 nt, Human
acaucuucuauggagguucgga

SEQ ID NO: 93946 - RNA, 22 nt, Human
acauugcagcuccuaccuuguc

SEQ ID NO: 93947 - RNA, 22 nt, Human
acauguggaggaggcgagggua

SEQ ID NO: 93948 - RNA, 23 nt, Human
acauuacacgcaguaauugcccc

SEQ ID NO: 93949 - RNA, 22 nt, Human
acauguuuacaaaccucaagcc

SEQ ID NO: 93950 - RNA, 22 nt, Human
acauccagcagauuguccagag

SEQ ID NO: 93951 - RNA, 22 nt, Human
acauauggcagguugaucaaug

SEQ ID NO: 93952 - RNA, 22 nt, Human
acauggguuaaagaagauggaa

SEQ ID NO: 93953 - RNA, 22 nt, Human
acauauaugugcauacaacuau

SEQ ID NO: 93954 - RNA, 22 nt, Human
acaucacuugguuaaugugguc

SEQ ID NO: 93955 - RNA, 22 nt, Human
acaugcuucauauuauaaccaa

SEQ ID NO: 93956 - RNA, 22 nt, Human
acauggggaaaaaggccugcuc

SEQ ID NO: 93957 - RNA, 22 nt, Human
acaguuuucugagaaucacagg

SEQ ID NO: 93958 - RNA, 22 nt, Human
acaguuuuccuugguauagaac

SEQ ID NO: 93959 - RNA, 22 nt, Human
aauucuuuguuccucugccaag

SEQ ID NO: 93960 - RNA, 22 nt, Human
aauugauauuagauuugucuca

SEQ ID NO: 93961 - RNA, 22 nt, Human
aauugccaagaauuagugauac

SEQ ID NO: 93962 - RNA, 22 nt, Human
acaugaggaacucaggagucac

SEQ ID NO: 93963 - RNA, 22 nt, Human
aauucuguugguuagaguugga

SEQ ID NO: 93964 - RNA, 22 nt, Human
acauggaaacacgcagccccaa

SEQ ID NO: 93965 - RNA, 22 nt, Human
acagugugcaagaaauggggga

SEQ ID NO: 93966 - RNA, 22 nt, Human
aauucugaggccauuuauuucc

SEQ ID NO: 93967 - RNA, 22 nt, Human
aauucgcugcauuccaucuagg

SEQ ID NO: 93968 - RNA, 23 nt, Human
acgcagacacauguaugggccuc

SEQ ID NO: 93969 - RNA, 22 nt, Human
acgcuucacaggugcgcauugu

SEQ ID NO: 93970 - RNA, 22 nt, Human
acggagggagagagggaggaga

SEQ ID NO: 93971 - RNA, 23 nt, Human
acgggaggcggggcagggcugag

SEQ ID NO: 93972 - RNA, 20 nt, Human
acgaacauauugcaggguuu

SEQ ID NO: 93973 - RNA, 22 nt, Human
accuuguuguagguacaaaaga

SEQ ID NO: 93974 - RNA, 22 nt, Human
acgauaacaauaguagcaugua

SEQ ID NO: 93975 - RNA, 22 nt, Human
acgagguaaucaauuggucuug

SEQ ID NO: 93976 - RNA, 22 nt, Human
acgauacaaucauauaguaccu

SEQ ID NO: 93977 - RNA, 23 nt, Human
acgaccuugcccucauuccaaag

SEQ ID NO: 93978 - RNA, 22 nt, Human
acgaaugacaugugauuugaaa

SEQ ID NO: 93979 - RNA, 22 nt, Human
acggguuccuugagggcaggau

SEQ ID NO: 93980 - RNA, 22 nt, Human
acggugagacuggcgaaggaaa

SEQ ID NO: 93981 - RNA, 22 nt, Human
acguuuuagccauguaguuucu

SEQ ID NO: 93982 - RNA, 22 nt, Human
acgguguuucucguucaggguu

SEQ ID NO: 93983 - RNA, 22 nt, Human
acuaaacauaucacugcuuuac

SEQ ID NO: 93984 - RNA, 22 nt, Human
acuaaagcagcucagacgagaa

SEQ ID NO: 93985 - RNA, 22 nt, Human
acuaaccacuuuacaccuggug

SEQ ID NO: 93986 - RNA, 22 nt, Human
acgauuugguucagugaagaca

SEQ ID NO: 93987 - RNA, 22 nt, Human
acgcaacacugcuauuuuuuuc

SEQ ID NO: 93988 - RNA, 22 nt, Human
accugcucucccucucgcaguc

SEQ ID NO: 93989 - RNA, 22 nt, Human
accuguagcccaaucauggcag

SEQ ID NO: 93990 - RNA, 23 nt, Human
accuggucccaugggugggccug

SEQ ID NO: 93991 - RNA, 21 nt, Human
accuggugaugaaugggaggc

SEQ ID NO: 93992 - RNA, 22 nt, Human
accuggauauuuucaguugcau

SEQ ID NO: 93993 - RNA, 22 nt, Human
accuucguuuaguacucauuuu

SEQ ID NO: 93994 - RNA, 22 nt, Human
accuuaaacagauggcggcugg

SEQ ID NO: 93995 - RNA, 19 nt, Human
accuguucaaccucgugcu

SEQ ID NO: 93996 - RNA, 22 nt, Human
accuucugaccucucggacuuc

SEQ ID NO: 93997 - RNA, 22 nt, Human
accuugauggagugaugaauga

SEQ ID NO: 93998 - RNA, 22 nt, Human
acgaaauaaaauuaaagcccua

SEQ ID NO: 93999 - RNA, 22 nt, Human
accuuuggaggacuagggucau

SEQ ID NO: 94000 - RNA, 22 nt, Human
accucaguacugcaguuugguu

SEQ ID NO: 94001 - RNA, 22 nt, Human
accugguuucuuacccaagaga

SEQ ID NO: 94002 - RNA, 23 nt, Human
accgccgcugccgccgcccccgc

SEQ ID NO: 94003 - RNA, 22 nt, Human
accugauuuuauggauuuugag

SEQ ID NO: 94004 - RNA, 22 nt, Human
accugcagguguuuccacacuu

SEQ ID NO: 94005 - RNA, 22 nt, Human
accgcuggcacuggggacgggg

SEQ ID NO: 94006 - RNA, 22 nt, Human
accggucucaccaaacgcccca

SEQ ID NO: 94007 - RNA, 22 nt, Human
accgauguggaaaauuucauuu

SEQ ID NO: 94008 - RNA, 22 nt, Human
accucauucugcauagaacuuu

SEQ ID NO: 94009 - RNA, 22 nt, Human
accugaucugagaaguggaggg

SEQ ID NO: 94010 - RNA, 22 nt, Human
accucuuuuugaauauagcauu

SEQ ID NO: 94011 - RNA, 22 nt, Human
accuauuguccagagccaggcc

SEQ ID NO: 94012 - RNA, 22 nt, Human
accuauuuauacaacugcacca

SEQ ID NO: 94013 - RNA, 22 nt, Human
accuggaccugccaccuaugag

SEQ ID NO: 94014 - RNA, 22 nt, Human
accugaccagguggcuucccaa

SEQ ID NO: 94015 - RNA, 22 nt, Human
accuggcccugggucuccugac

SEQ ID NO: 94016 - RNA, 22 nt, Human
accugguaaccugccugacuaa

SEQ ID NO: 94017 - RNA, 21 nt, Human
accugguuuacugaucccagg

SEQ ID NO: 94018 - RNA, 22 nt, Human
acccugacggugggcagcuuga

SEQ ID NO: 94019 - RNA, 22 nt, Human
accucagauuguggcuccgcug

SEQ ID NO: 94020 - RNA, 21 nt, Human
accgucaguacuaguauugac

SEQ ID NO: 94021 - RNA, 22 nt, Human
accccagcucugagccacacca

SEQ ID NO: 94022 - RNA, 22 nt, Human
acccaucauuagucuuucagga

SEQ ID NO: 94023 - RNA, 22 nt, Human
accgucagguuagaaugagcac

SEQ ID NO: 94024 - RNA, 22 nt, Human
accauuauagaggacauuaugu

SEQ ID NO: 94025 - RNA, 22 nt, Human
accauuuaucagaagagacacc

SEQ ID NO: 94026 - RNA, 22 nt, Human
accauccaaaagcuuuucauca

SEQ ID NO: 94027 - RNA, 22 nt, Human
accaggguacuucuaggugggg

SEQ ID NO: 94028 - RNA, 22 nt, Human
accgggcagcucugccccugcc

SEQ ID NO: 94029 - RNA, 19 nt, Human
acccaugcucuguggacuu

SEQ ID NO: 94030 - RNA, 22 nt, Human
accgauuucaaauggugcuaga

SEQ ID NO: 94031 - RNA, 22 nt, Human
acccuuucgagauuucugccuu

SEQ ID NO: 94032 - RNA, 22 nt, Human
accgaauucuauucccaauacc

SEQ ID NO: 94033 - RNA, 22 nt, Human
accgagcaggguguuugcgcac

SEQ ID NO: 94034 - RNA, 22 nt, Human
agaguuaguggccucagcaggg

SEQ ID NO: 94035 - RNA, 22 nt, Human
agauaacauguugcagauucug

SEQ ID NO: 94036 - RNA, 21 nt, Human
agagugugugcaucauauuug

SEQ ID NO: 94037 - RNA, 22 nt, Human
agaguguguggggcugagguca

SEQ ID NO: 94038 - RNA, 22 nt, Human
agaguuaaugcaggccaagccu

SEQ ID NO: 94039 - RNA, 22 nt, Human
agauaaucacaaucuagacuuu

SEQ ID NO: 94040 - RNA, 22 nt, Human
agaguacagaagcauuucagau

SEQ ID NO: 94041 - RNA, 22 nt, Human
agaggugcuuaugcucaugguu

SEQ ID NO: 94042 - RNA, 22 nt, Human
agagggagagaccuccgugccu

SEQ ID NO: 94043 - RNA, 22 nt, Human
agagcagcuuuucggaaccacu

SEQ ID NO: 94044 - RNA, 22 nt, Human
agagcuauuucuuaaaagcugu

SEQ ID NO: 94045 - RNA, 22 nt, Human
agagcugggacuuggacucaau

SEQ ID NO: 94046 - RNA, 22 nt, Human
agaggcagagcugggguuugac

SEQ ID NO: 94047 - RNA, 22 nt, Human
agaguucaccccacugaugagu

SEQ ID NO: 94048 - RNA, 22 nt, Human
agaggagaauguaaauuuguca

SEQ ID NO: 94049 - RNA, 22 nt, Human
agagcuuagaggaccuucgugc

SEQ ID NO: 94050 - RNA, 22 nt, Human
agagcuuuggaguaaguuuuga

SEQ ID NO: 94051 - RNA, 22 nt, Human
agagcagcaaucuuugaaauua

SEQ ID NO: 94052 - RNA, 22 nt, Human
agagaaacauuaauugaugagg

SEQ ID NO: 94053 - RNA, 22 nt, Human
agagaaauguacuagucuaacu

SEQ ID NO: 94054 - RNA, 20 nt, Human
agagaacaguuuggucacag

SEQ ID NO: 94055 - RNA, 21 nt, Human
agacuucuacuaucuuaugac

SEQ ID NO: 94056 - RNA, 22 nt, Human
agagaguagaagggacaguauu

SEQ ID NO: 94057 - RNA, 22 nt, Human
agacuugguaacuagugaagaa

SEQ ID NO: 94058 - RNA, 22 nt, Human
agagcaauggugcuuuaauucu

SEQ ID NO: 94059 - RNA, 22 nt, Human
agagauuagagaagaugauaaa

SEQ ID NO: 94060 - RNA, 22 nt, Human
agagauugagcucagaagaccu

SEQ ID NO: 94061 - RNA, 22 nt, Human
agagauacugcaggccauaaau

SEQ ID NO: 94062 - RNA, 22 nt, Human
agagaauuugggaauauaaauc

SEQ ID NO: 94063 - RNA, 22 nt, Human
agagacaggguuuugucguguu

SEQ ID NO: 94064 - RNA, 22 nt, Human
agagacaagggaccucuggaga

SEQ ID NO: 94065 - RNA, 21 nt, Human
agagaccuaagcugagauucc

SEQ ID NO: 94066 - RNA, 22 nt, Human
agagagggaugguguccagaga

SEQ ID NO: 94067 - RNA, 22 nt, Human
agagauggugaugaggaaaaau

SEQ ID NO: 94068 - RNA, 22 nt, Human
agagaguacuuucaucagggaa

SEQ ID NO: 94069 - RNA, 21 nt, Human
agacugaugggaagacucugu

SEQ ID NO: 94070 - RNA, 22 nt, Human
agacucuggcaugcuaacuagu

SEQ ID NO: 94071 - RNA, 22 nt, Human
agacuggagucuccuuuggagc

SEQ ID NO: 94072 - RNA, 19 nt, Human
agacugaagggcccgaguc

SEQ ID NO: 94073 - RNA, 22 nt, Human
agagaaccauggcauccaggua

SEQ ID NO: 94074 - RNA, 22 nt, Human
agacuguuuucccaucucuugg

SEQ ID NO: 94075 - RNA, 22 nt, Human
agacuguuccgucagacucagu

SEQ ID NO: 94076 - RNA, 22 nt, Human
agagaagaauccccugguggag

SEQ ID NO: 94077 - RNA, 22 nt, Human
agagacuguaaugagagguaca

SEQ ID NO: 94078 - RNA, 22 nt, Human
agagaccugaaugaguugaaca

SEQ ID NO: 94079 - RNA, 22 nt, Human
agagacugauggaucaccaaau

SEQ ID NO: 94080 - RNA, 22 nt, Human
agacuuugaaugaugacagcgu

SEQ ID NO: 94081 - RNA, 22 nt, Human
agacuaauaucccauuucugac

SEQ ID NO: 94082 - RNA, 22 nt, Human
agagaacaggcagcuggugccg

SEQ ID NO: 94083 - RNA, 22 nt, Human
agacuuuggcagggccaguggu

SEQ ID NO: 94084 - RNA, 22 nt, Human
agacuagccaaaggacuuuaua

SEQ ID NO: 94085 - RNA, 22 nt, Human
agacugugagaagauggcugcg

SEQ ID NO: 94086 - RNA, 22 nt, Human
agacuucucuuggcuauauuau

SEQ ID NO: 94087 - RNA, 22 nt, Human
agacagcggugcaauaaauggu

SEQ ID NO: 94088 - RNA, 22 nt, Human
agacauauuggcuugcuuuaau

SEQ ID NO: 94089 - RNA, 22 nt, Human
agaccagugaguaggccuuaga

SEQ ID NO: 94090 - RNA, 21 nt, Human
agaaugaagaagaggucuuug

SEQ ID NO: 94091 - RNA, 22 nt, Human
agacauuuggugugaagggagg

SEQ ID NO: 94092 - RNA, 20 nt, Human
agacauugaggagagagcau

SEQ ID NO: 94093 - RNA, 22 nt, Human
agaaccaauacuacagcaagua

SEQ ID NO: 94094 - RNA, 22 nt, Human
agaaauuguaauaaaucugguc

SEQ ID NO: 94095 - RNA, 22 nt, Human
agaaucagagcagaaucuucau

SEQ ID NO: 94096 - RNA, 22 nt, Human
agaaucucuagaaaugggucuc

SEQ ID NO: 94097 - RNA, 22 nt, Human
agacagaacauaauuaguacug

SEQ ID NO: 94098 - RNA, 22 nt, Human
agaaggcagaaaagcuuuacaa

SEQ ID NO: 94099 - RNA, 22 nt, Human
agaagaaugguuugaaagauuu

SEQ ID NO: 94100 - RNA, 22 nt, Human
agaagaucccugugguuacgac

SEQ ID NO: 94101 - RNA, 22 nt, Human
agaaagcacccugcacuuucug

SEQ ID NO: 94102 - RNA, 20 nt, Human
agaaaggaguaaagaagaga

SEQ ID NO: 94103 - RNA, 19 nt, Human
agaaauagccuuccuuguc

SEQ ID NO: 94104 - RNA, 22 nt, Human
agaagcagaaggaagcagggcc

SEQ ID NO: 94105 - RNA, 22 nt, Human
agaagcauaagggcuuugccag

SEQ ID NO: 94106 - RNA, 21 nt, Human
agaagcggucgaaucgcagac

SEQ ID NO: 94107 - RNA, 22 nt, Human
agaaauggggugaagcaaaugg

SEQ ID NO: 94108 - RNA, 22 nt, Human
agaagauucagcaguagggugg

SEQ ID NO: 94109 - RNA, 22 nt, Human
agaagcaaagcaaacacauucu

SEQ ID NO: 94110 - RNA, 22 nt, Human
acuuggucguggugcagcaugg

SEQ ID NO: 94111 - RNA, 22 nt, Human
acuuugaauuagaauuuugcug

SEQ ID NO: 94112 - RNA, 22 nt, Human
acuuuggugcgaagucacuuua

SEQ ID NO: 94113 - RNA, 22 nt, Human
acuuugugaauagaacuggaug

SEQ ID NO: 94114 - RNA, 22 nt, Human
agaaaagagacaauguuuuugg

SEQ ID NO: 94115 - RNA, 22 nt, Human
acuuuuuugccaucccuccagc

SEQ ID NO: 94116 - RNA, 22 nt, Human
agaacaagaaacccgaaaagug

SEQ ID NO: 94117 - RNA, 22 nt, Human
acuuuuaauaguagauuuuuaa

SEQ ID NO: 94118 - RNA, 22 nt, Human
agaacaggaggaagccagcucc

SEQ ID NO: 94119 - RNA, 22 nt, Human
acuuuuccuggguagcuccugg

SEQ ID NO: 94120 - RNA, 22 nt, Human
acuugguccacaguaagugcuu

SEQ ID NO: 94121 - RNA, 22 nt, Human
acuuuuagccuucccacaacag

SEQ ID NO: 94122 - RNA, 22 nt, Human
acuuugucuugaucaaaggugu

SEQ ID NO: 94123 - RNA, 20 nt, Human
acuuucacaugaacauuuaa

SEQ ID NO: 94124 - RNA, 22 nt, Human
acuugauggaguuucacuguau

SEQ ID NO: 94125 - RNA, 22 nt, Human
acuugcauuguguaguguuuuu

SEQ ID NO: 94126 - RNA, 22 nt, Human
acuugcaucuuagagacucacc

SEQ ID NO: 94127 - RNA, 22 nt, Human
acuucuuuugcaugauucuuua

SEQ ID NO: 94128 - RNA, 22 nt, Human
acuugaagcaugaaaauaagcc

SEQ ID NO: 94129 - RNA, 22 nt, Human
acugugacugugucuucugggc

SEQ ID NO: 94130 - RNA, 22 nt, Human
acugugauuuguuuuuguguuu

SEQ ID NO: 94131 - RNA, 18 nt, Human
acuguggcucagaguugc

SEQ ID NO: 94132 - RNA, 22 nt, Human
acuguuauugguguauguggca

SEQ ID NO: 94133 - RNA, 22 nt, Human
acuguugugaauaaugaaaugc

SEQ ID NO: 94134 - RNA, 22 nt, Human
acugugaagagcauucuggcug

SEQ ID NO: 94135 - RNA, 22 nt, Human
acuuccuuuuuuggggauagca

SEQ ID NO: 94136 - RNA, 22 nt, Human
acuucaggacggcaguggaggg

SEQ ID NO: 94137 - RNA, 22 nt, Human
acugugcaugaaccgaaacaaa

SEQ ID NO: 94138 - RNA, 22 nt, Human
acuuacuuucuauucuuguagg

SEQ ID NO: 94139 - RNA, 22 nt, Human
acuguugagggaagcagaugaa

SEQ ID NO: 94140 - RNA, 22 nt, Human
acuguggcugcuacccuggcuc

SEQ ID NO: 94141 - RNA, 22 nt, Human
acugugcccccucuacugcuga

SEQ ID NO: 94142 - RNA, 22 nt, Human
acugugauguaaagaaauaggc

SEQ ID NO: 94143 - RNA, 22 nt, Human
acugucauuaaugaauguaaua

SEQ ID NO: 94144 - RNA, 22 nt, Human
acuggugcucuggccaccgcug

SEQ ID NO: 94145 - RNA, 22 nt, Human
acugguuucaaguuggacugaa

SEQ ID NO: 94146 - RNA, 19 nt, Human
acuggggcaggcugggcuu

SEQ ID NO: 94147 - RNA, 22 nt, Human
acuggguuguuugucucaugag

SEQ ID NO: 94148 - RNA, 18 nt, Human
acuguccucaggacguug

SEQ ID NO: 94149 - RNA, 22 nt, Human
acuggggaggucuggauggauc

SEQ ID NO: 94150 - RNA, 22 nt, Human
acuggggcaggaaaguaugcug

SEQ ID NO: 94151 - RNA, 22 nt, Human
acuggcuuggaaauggguauuu

SEQ ID NO: 94152 - RNA, 22 nt, Human
acugggacuguaugugcuggac

SEQ ID NO: 94153 - RNA, 22 nt, Human
acugggcaaggauaugaugggu

SEQ ID NO: 94154 - RNA, 19 nt, Human
acugggaugggcagugcca

SEQ ID NO: 94155 - RNA, 22 nt, Human
acugucaggauugagucucugg

SEQ ID NO: 94156 - RNA, 15 nt, Human
acugggaaggaguau

SEQ ID NO: 94157 - RNA, 21 nt, Human
acugggcuagccugacuucug

SEQ ID NO: 94158 - RNA, 22 nt, Human
acugguagcugauuaaguauag

SEQ ID NO: 94159 - RNA, 22 nt, Human
acuggggauugguucuucaaca

SEQ ID NO: 94160 - RNA, 22 nt, Human
acuggcaugauagaccauaaca

SEQ ID NO: 94161 - RNA, 22 nt, Human
acuggcuuauuguuguggagcu

SEQ ID NO: 94162 - RNA, 22 nt, Human
acuggauuuugugguguaucuu

SEQ ID NO: 94163 - RNA, 22 nt, Human
acuggagcccguggaggcgcag

SEQ ID NO: 94164 - RNA, 22 nt, Human
acuggauucucuuacacagaug

SEQ ID NO: 94165 - RNA, 22 nt, Human
acugcacuccagcccgagcaac

SEQ ID NO: 94166 - RNA, 22 nt, Human
acugcuguugugauggguauuu

SEQ ID NO: 94167 - RNA, 22 nt, Human
acugcguuucuaaaguagcaua

SEQ ID NO: 94168 - RNA, 22 nt, Human
acuacuguaauuuauuguuaca

SEQ ID NO: 94169 - RNA, 20 nt, Human
acugcaagagacagaugaaa

SEQ ID NO: 94170 - RNA, 20 nt, Human
acuaccaugcaauuccgcuu

SEQ ID NO: 94171 - RNA, 22 nt, Human
acuaauuguuuaaggauaggaa

SEQ ID NO: 94172 - RNA, 22 nt, Human
acgugugugugcacguguguau

SEQ ID NO: 94173 - RNA, 22 nt, Human
acuaagucugcaaaaguacuga

SEQ ID NO: 94174 - RNA, 22 nt, Human
acugaucuguguaauauguuac

SEQ ID NO: 94175 - RNA, 22 nt, Human
acugccuugcaccauggcuuuu

SEQ ID NO: 94176 - RNA, 21 nt, Human
acugccaugcaggagccucca

SEQ ID NO: 94177 - RNA, 22 nt, Human
acugagaacuuggggacagagg

SEQ ID NO: 94178 - RNA, 22 nt, Human
acugacuucugguauuuuuagu

SEQ ID NO: 94179 - RNA, 22 nt, Human
acugacucacauuuugguuugc

SEQ ID NO: 94180 - RNA, 18 nt, Human
acugagcccaggacacac

SEQ ID NO: 94181 - RNA, 22 nt, Human
acugagcaaaacugauccuguu

SEQ ID NO: 94182 - RNA, 20 nt, Human
aggaagauccuuucuuuuaa

SEQ ID NO: 94183 - RNA, 22 nt, Human
aggaagaagggacagaauuuug

SEQ ID NO: 94184 - RNA, 20 nt, Human
aggaacuggaagggaggaaa

SEQ ID NO: 94185 - RNA, 22 nt, Human
agcuuugcugcuggagaagggu

SEQ ID NO: 94186 - RNA, 22 nt, Human
agcuuugucccaagugcucugg

SEQ ID NO: 94187 - RNA, 22 nt, Human
agcuugaugaaagugggugcuc

SEQ ID NO: 94188 - RNA, 22 nt, Human
agcuugaaccuaaaacaauaau

SEQ ID NO: 94189 - RNA, 22 nt, Human
agcuuucuauauaugaguugcu

SEQ ID NO: 94190 - RNA, 22 nt, Human
agcuuggcaagcacuguuugag

SEQ ID NO: 94191 - RNA, 20 nt, Human
agcuuucaccaguacuucca

SEQ ID NO: 94192 - RNA, 19 nt, Human
agcuuauuuacugcaggac

SEQ ID NO: 94193 - RNA, 20 nt, Human
agcugucccugacacuagga

SEQ ID NO: 94194 - RNA, 22 nt, Human
agcugugaccaguuacgaaauu

SEQ ID NO: 94195 - RNA, 22 nt, Human
agcugugaccuucaagagcuac

SEQ ID NO: 94196 - RNA, 22 nt, Human
agcugugccuauucguggcaag

SEQ ID NO: 94197 - RNA, 22 nt, Human
aggaacaguuucaaagagugaa

SEQ ID NO: 94198 - RNA, 22 nt, Human
aggaaauaguuuagucccaaaa

SEQ ID NO: 94199 - RNA, 22 nt, Human
aggaaauaagggcacuucagau

SEQ ID NO: 94200 - RNA, 22 nt, Human
aggaaaguugagcugucuguag

SEQ ID NO: 94201 - RNA, 22 nt, Human
aggaaaggcucugugguuccua

SEQ ID NO: 94202 - RNA, 22 nt, Human
aggaaaauggaccagaguuguu

SEQ ID NO: 94203 - RNA, 22 nt, Human
aggaaagacgcauuucuguagg

SEQ ID NO: 94204 - RNA, 22 nt, Human
aggaaaguugcuuguagugcug

SEQ ID NO: 94205 - RNA, 22 nt, Human
aggaagucucucaaaacuggaa

SEQ ID NO: 94206 - RNA, 23 nt, Human
aggaagucugacacuacagcguu

SEQ ID NO: 94207 - RNA, 20 nt, Human
aggaaggagaaucugagcaa

SEQ ID NO: 94208 - RNA, 22 nt, Human
aggaagagcuggaccagaggac

SEQ ID NO: 94209 - RNA, 22 nt, Human
aggacauuugcuuuuuuucuuu

SEQ ID NO: 94210 - RNA, 19 nt, Human
aggaaggggauaaguaaca

SEQ ID NO: 94211 - RNA, 22 nt, Human
aggaagccuggaguccugccca

SEQ ID NO: 94212 - RNA, 22 nt, Human
aggauagacuucagaaggcaua

SEQ ID NO: 94213 - RNA, 22 nt, Human
aggagaaagaccagccugccga

SEQ ID NO: 94214 - RNA, 22 nt, Human
aggacuggucucuuuucuccaa

SEQ ID NO: 94215 - RNA, 22 nt, Human
aggagagaacaagaguauccug

SEQ ID NO: 94216 - RNA, 22 nt, Human
aggagacaguuuggacguguag

SEQ ID NO: 94217 - RNA, 22 nt, Human
aggaauguugagacauggcuaa

SEQ ID NO: 94218 - RNA, 22 nt, Human
aggagcacugggcaugucaccc

SEQ ID NO: 94219 - RNA, 22 nt, Human
aggaaguucuggaauuacuagg

SEQ ID NO: 94220 - RNA, 22 nt, Human
agcugcuuuacuggucggcugg

SEQ ID NO: 94221 - RNA, 19 nt, Human
agcugcugauugguggagg

SEQ ID NO: 94222 - RNA, 22 nt, Human
agcugaugucucaccuguuaga

SEQ ID NO: 94223 - RNA, 22 nt, Human
agcuuucaagaaauugucacaa

SEQ ID NO: 94224 - RNA, 22 nt, Human
aggaaaaugaaggaagugggaa

SEQ ID NO: 94225 - RNA, 22 nt, Human
aggaaaaagaagaaaagaauca

SEQ ID NO: 94226 - RNA, 22 nt, Human
agcuggauuaaucacagugacu

SEQ ID NO: 94227 - RNA, 22 nt, Human
agcuggaaucucggcaaagcgu

SEQ ID NO: 94228 - RNA, 22 nt, Human
agcuugagauaauucaagcuga

SEQ ID NO: 94229 - RNA, 22 nt, Human
agcuugcccuuguaccagccag

SEQ ID NO: 94230 - RNA, 22 nt, Human
agcuugauggauugcugaggca

SEQ ID NO: 94231 - RNA, 22 nt, Human
agcuguugaccuucccuuucag

SEQ ID NO: 94232 - RNA, 22 nt, Human
agcuucuucugccuugucccug

SEQ ID NO: 94233 - RNA, 22 nt, Human
agcuuccaaagaccaggauuga

SEQ ID NO: 94234 - RNA, 22 nt, Human
agcuucccaggagaucuccgcc

SEQ ID NO: 94235 - RNA, 22 nt, Human
agcugcauguauauucuuaaca

SEQ ID NO: 94236 - RNA, 22 nt, Human
agcugcauucguaucauauugu

SEQ ID NO: 94237 - RNA, 22 nt, Human
agcugaccugauugcuuuucag

SEQ ID NO: 94238 - RNA, 22 nt, Human
agcugaggccccgcagcagggu

SEQ ID NO: 94239 - RNA, 22 nt, Human
agcugcuggcggauguuggacu

SEQ ID NO: 94240 - RNA, 22 nt, Human
agcugcugcaaguggugcuaac

SEQ ID NO: 94241 - RNA, 22 nt, Human
agcugauugucuuuuuaaaagu

SEQ ID NO: 94242 - RNA, 22 nt, Human
agcucuucugacucuaggcuca

SEQ ID NO: 94243 - RNA, 20 nt, Human
agcugaauaguuuugugaaa

SEQ ID NO: 94244 - RNA, 22 nt, Human
agcugacagugcauggagggac

SEQ ID NO: 94245 - RNA, 22 nt, Human
agcucagugugucuaugaggua

SEQ ID NO: 94246 - RNA, 19 nt, Human
agcucaggcccaucguccc

SEQ ID NO: 94247 - RNA, 22 nt, Human
agcucugcuucuugggaagaug

SEQ ID NO: 94248 - RNA, 22 nt, Human
agcucugugcaggcagaggcau

SEQ ID NO: 94249 - RNA, 22 nt, Human
agcucggcuguccugugccccu

SEQ ID NO: 94250 - RNA, 22 nt, Human
agcggcucaggccccgugggcu

SEQ ID NO: 94251 - RNA, 22 nt, Human
agcggcgcgucuccgagcugga

SEQ ID NO: 94252 - RNA, 22 nt, Human
agcuaauguauguugaaagcac

SEQ ID NO: 94253 - RNA, 22 nt, Human
agcguucuguuccaugcuaaca

SEQ ID NO: 94254 - RNA, 22 nt, Human
agcgucaugugaccagcgcgcc

SEQ ID NO: 94255 - RNA, 22 nt, Human
agcuccugcgcacggugcacac

SEQ ID NO: 94256 - RNA, 22 nt, Human
agcucccaauugacuugaacua

SEQ ID NO: 94257 - RNA, 22 nt, Human
agcgcggccuuacacccagggg

SEQ ID NO: 94258 - RNA, 22 nt, Human
agcgacuguaagagggccccgg

SEQ ID NO: 94259 - RNA, 22 nt, Human
agcgcaguuaccgcgcggggcu

SEQ ID NO: 94260 - RNA, 22 nt, Human
agcggaggaggcggagcaggga

SEQ ID NO: 94261 - RNA, 22 nt, Human
agcguaugaauauuugaagaga

SEQ ID NO: 94262 - RNA, 22 nt, Human
agcggugacauccuucugugcu

SEQ ID NO: 94263 - RNA, 22 nt, Human
agcggccucgcugccugcucag

SEQ ID NO: 94264 - RNA, 22 nt, Human
agcggcaggacgucuucuucga

SEQ ID NO: 94265 - RNA, 22 nt, Human
agcggcaggaagcgcgcaagcg

SEQ ID NO: 94266 - RNA, 22 nt, Human
agccgcgcagccucauuaagga

SEQ ID NO: 94267 - RNA, 22 nt, Human
agcccuuucuuguuuaacugca

SEQ ID NO: 94268 - RNA, 22 nt, Human
agcccugugugcuuguguuccu

SEQ ID NO: 94269 - RNA, 22 nt, Human
agccuguuacuguccugugcca

SEQ ID NO: 94270 - RNA, 22 nt, Human
agccugugacucugugaaacca

SEQ ID NO: 94271 - RNA, 22 nt, Human
agccuguacuuagagggauuaa

SEQ ID NO: 94272 - RNA, 22 nt, Human
agcgaaaagaauggaguggagu

SEQ ID NO: 94273 - RNA, 22 nt, Human
agccuuucugcgcacucuuccg

SEQ ID NO: 94274 - RNA, 22 nt, Human
agcgcccguugagucgcgcggu

SEQ ID NO: 94275 - RNA, 22 nt, Human
agcgagccugugcacuucuaac

SEQ ID NO: 94276 - RNA, 22 nt, Human
agcgacuugacagacauguccu

SEQ ID NO: 94277 - RNA, 22 nt, Human
agccauggaggaugugcagcau

SEQ ID NO: 94278 - RNA, 22 nt, Human
agcaugucuaacucuucagggu

SEQ ID NO: 94279 - RNA, 22 nt, Human
agcauugguggcauuugcagcu

SEQ ID NO: 94280 - RNA, 22 nt, Human
agcauuucuacugugucagaaa

SEQ ID NO: 94281 - RNA, 22 nt, Human
agccugggucgagagacgagaa

SEQ ID NO: 94282 - RNA, 22 nt, Human
agcauuugcuguucuagaaagu

SEQ ID NO: 94283 - RNA, 22 nt, Human
agccagcauauauauaguugaa

SEQ ID NO: 94284 - RNA, 22 nt, Human
agccaagucucacugagucugu

SEQ ID NO: 94285 - RNA, 22 nt, Human
agccagauuuuuugagaggcga

SEQ ID NO: 94286 - RNA, 22 nt, Human
agcaguuuauccucauaaugga

SEQ ID NO: 94287 - RNA, 22 nt, Human
agcaguuagauccugguuagcg

SEQ ID NO: 94288 - RNA, 18 nt, Human
agcaguugucucucucca

SEQ ID NO: 94289 - RNA, 22 nt, Human
agcaugaauugccauuuauuaa

SEQ ID NO: 94290 - RNA, 19 nt, Human
agcaucuccacagaaaaag

SEQ ID NO: 94291 - RNA, 22 nt, Human
agcaguugcuuuguauauuaaa

SEQ ID NO: 94292 - RNA, 22 nt, Human
agcaguucucugucuagcuaga

SEQ ID NO: 94293 - RNA, 19 nt, Human
agcaguggagccaugccug

SEQ ID NO: 94294 - RNA, 18 nt, Human
agcagugcggaucauuuu

SEQ ID NO: 94295 - RNA, 19 nt, Human
agcagugaaaucuggugag

SEQ ID NO: 94296 - RNA, 22 nt, Human
agcagucagaucguggggaaaa

SEQ ID NO: 94297 - RNA, 22 nt, Human
agcaggauggaguaacgugaaa

SEQ ID NO: 94298 - RNA, 22 nt, Human
agccacagucuguagccagcuu

SEQ ID NO: 94299 - RNA, 22 nt, Human
agcauuuuaaaacuaguuacca

SEQ ID NO: 94300 - RNA, 22 nt, Human
agcauucuguggucuucuaugg

SEQ ID NO: 94301 - RNA, 22 nt, Human
agcauucccuuugcagugucau

SEQ ID NO: 94302 - RNA, 22 nt, Human
agcagggugugggugugagugu

SEQ ID NO: 94303 - RNA, 21 nt, Human
agcaucugaggcaguuuccua

SEQ ID NO: 94304 - RNA, 22 nt, Human
agcaucuaucuucaaugugugu

SEQ ID NO: 94305 - RNA, 22 nt, Human
agcauauaugcaugagugugca

SEQ ID NO: 94306 - RNA, 22 nt, Human
agcaucggacggagcaccugcu

SEQ ID NO: 94307 - RNA, 22 nt, Human
agcaggaggagagccuggcggu

SEQ ID NO: 94308 - RNA, 21 nt, Human
agcagucugcggccggugcgg

SEQ ID NO: 94309 - RNA, 22 nt, Human
agcaggucagugguaaucaaaa

SEQ ID NO: 94310 - RNA, 22 nt, Human
agcaggccuuucaccucugucc

SEQ ID NO: 94311 - RNA, 22 nt, Human
agcaggaggguuuuguagaguc

SEQ ID NO: 94312 - RNA, 22 nt, Human
agcagguucaagggcaaagcug

SEQ ID NO: 94313 - RNA, 22 nt, Human
agcagggagaccaucucuuccu

SEQ ID NO: 94314 - RNA, 22 nt, Human
agauagccagauauaaauaguc

SEQ ID NO: 94315 - RNA, 22 nt, Human
agcagcaggugaccucgaugcc

SEQ ID NO: 94316 - RNA, 22 nt, Human
agcagcaggcugggaugagucu

SEQ ID NO: 94317 - RNA, 22 nt, Human
agauagaaggauugugacacau

SEQ ID NO: 94318 - RNA, 22 nt, Human
agcagccgccgccgccgcgcac

SEQ ID NO: 94319 - RNA, 22 nt, Human
agcacggugguuaagagagugg

SEQ ID NO: 94320 - RNA, 17 nt, Human
agcagcuggguugaucu

SEQ ID NO: 94321 - RNA, 22 nt, Human
aggaugagugaagagguaaauu

SEQ ID NO: 94322 - RNA, 22 nt, Human
aggauggaaguaacuggauaau

SEQ ID NO: 94323 - RNA, 22 nt, Human
agcucuccuacucucuuucuag

SEQ ID NO: 94324 - RNA, 22 nt, Human
aggaggcaaaugagagggcuca

SEQ ID NO: 94325 - RNA, 22 nt, Human
aggaggcguuugcuaaacgggc

SEQ ID NO: 94326 - RNA, 22 nt, Human
aggccgcgguggcgaaggcguu

SEQ ID NO: 94327 - RNA, 22 nt, Human
aggcgaagggaccagacgguag

SEQ ID NO: 94328 - RNA, 22 nt, Human
aggccugcuccucuucucaucc

SEQ ID NO: 94329 - RNA, 22 nt, Human
aggcucagcaucugauucauau

SEQ ID NO: 94330 - RNA, 22 nt, Human
aggcuaagugauuagugacaua

SEQ ID NO: 94331 - RNA, 22 nt, Human
aggccagggacaaugaggcaga

SEQ ID NO: 94332 - RNA, 22 nt, Human
aggcgguuggcuuugucugggu

SEQ ID NO: 94333 - RNA, 22 nt, Human
agggaaauaggagaagaaagga

SEQ ID NO: 94334 - RNA, 19 nt, Human
agggagagucccaagagaa

SEQ ID NO: 94335 - RNA, 22 nt, Human
agggaugcaguaaaaacuguag

SEQ ID NO: 94336 - RNA, 22 nt, Human
agggaggagggacagaaagagg

SEQ ID NO: 94337 - RNA, 22 nt, Human
agggaguagggagccaugggug

SEQ ID NO: 94338 - RNA, 22 nt, Human
aggcugucucaccucaggaggg

SEQ ID NO: 94339 - RNA, 18 nt, Human
aggcuggggaucacaggg

SEQ ID NO: 94340 - RNA, 22 nt, Human
agggaagaggaccagagucucu

SEQ ID NO: 94341 - RNA, 22 nt, Human
aggcugaagcacacucaugcag

SEQ ID NO: 94342 - RNA, 23 nt, Human
aggcugccacucagggugaggcu

SEQ ID NO: 94343 - RNA, 22 nt, Human
aggcugccuaugaaggcagaag

SEQ ID NO: 94344 - RNA, 23 nt, Human
aggcugcagaagaauagggucau

SEQ ID NO: 94345 - RNA, 22 nt, Human
aggcugcuggcaggcguggacg

SEQ ID NO: 94346 - RNA, 22 nt, Human
aggccugcccuuggggagccuu

SEQ ID NO: 94347 - RNA, 22 nt, Human
aggccgcuggggcagcgcccga

SEQ ID NO: 94348 - RNA, 22 nt, Human
aggccgguggaggagguggagg

SEQ ID NO: 94349 - RNA, 22 nt, Human
aggccugaggaccagauaaaug

SEQ ID NO: 94350 - RNA, 22 nt, Human
aggcgagcgcggccggugcccc

SEQ ID NO: 94351 - RNA, 22 nt, Human
agggaagagaaacaaagauuca

SEQ ID NO: 94352 - RNA, 22 nt, Human
aggcguggcuucugcuggguug

SEQ ID NO: 94353 - RNA, 22 nt, Human
aggguuugugaagacuuggcca

SEQ ID NO: 94354 - RNA, 22 nt, Human
aggggcaaacuuguucuagggu

SEQ ID NO: 94355 - RNA, 22 nt, Human
aggggauggagcuggaaggcag

SEQ ID NO: 94356 - RNA, 22 nt, Human
aggggguugcgcaggggcuccc

SEQ ID NO: 94357 - RNA, 22 nt, Human
agguaguggaaccaaggcauca

SEQ ID NO: 94358 - RNA, 22 nt, Human
agguaguacuuuuuagagugca

SEQ ID NO: 94359 - RNA, 22 nt, Human
aggguggcuggaguggucuggu

SEQ ID NO: 94360 - RNA, 22 nt, Human
aggguuacuuauuuuggauagu

SEQ ID NO: 94361 - RNA, 22 nt, Human
aggguuaugcuccuucaucuug

SEQ ID NO: 94362 - RNA, 22 nt, Human
aggguuucucuccaguguggac

SEQ ID NO: 94363 - RNA, 22 nt, Human
aggguuuucauauauuauuagu

SEQ ID NO: 94364 - RNA, 21 nt, Human
agguagauagccccaggaagg

SEQ ID NO: 94365 - RNA, 22 nt, Human
agguagaaggaccagaauuuau

SEQ ID NO: 94366 - RNA, 22 nt, Human
agguaagaagugagcaaguuua

SEQ ID NO: 94367 - RNA, 22 nt, Human
agguaugucccccgagugcagc

SEQ ID NO: 94368 - RNA, 22 nt, Human
aggucuacaugcuuaauauauc

SEQ ID NO: 94369 - RNA, 22 nt, Human
aggucggcuuuuuuccuuucac

SEQ ID NO: 94370 - RNA, 22 nt, Human
aggggagaagcacuccuugccu

SEQ ID NO: 94371 - RNA, 22 nt, Human
aggggaguuauuagacagggag

SEQ ID NO: 94372 - RNA, 22 nt, Human
aggggaagagugagguuuuggu

SEQ ID NO: 94373 - RNA, 22 nt, Human
agggcguacuuucgccccuccu

SEQ ID NO: 94374 - RNA, 22 nt, Human
agggcuuacaucccacaguuag

SEQ ID NO: 94375 - RNA, 20 nt, Human
aggggcuguaguuagaugac

SEQ ID NO: 94376 - RNA, 22 nt, Human
aggggagaguuaaugugaaugu

SEQ ID NO: 94377 - RNA, 22 nt, Human
aggggaggggaguaucaggauu

SEQ ID NO: 94378 - RNA, 22 nt, Human
aggggauucgggugccccuagu

SEQ ID NO: 94379 - RNA, 22 nt, Human
aggggcugugucauuuguccua

SEQ ID NO: 94380 - RNA, 22 nt, Human
agggggaauccugcuuauggau

SEQ ID NO: 94381 - RNA, 17 nt, Human
agggaaguagggugggc

SEQ ID NO: 94382 - RNA, 22 nt, Human
agggaaauuaaugugagcaaug

SEQ ID NO: 94383 - RNA, 22 nt, Human
agggacuugugucuguguuuuu

SEQ ID NO: 94384 - RNA, 22 nt, Human
agggaaguucuagggagucugg

SEQ ID NO: 94385 - RNA, 22 nt, Human
agggagcugcucugcuuccgug

SEQ ID NO: 94386 - RNA, 22 nt, Human
agggcaguuaugaaugucucca

SEQ ID NO: 94387 - RNA, 22 nt, Human
agggcgugguggugcuggagca

SEQ ID NO: 94388 - RNA, 22 nt, Human
agggcggucccugagacucucc

SEQ ID NO: 94389 - RNA, 20 nt, Human
agucuuaucugcauuuagaa

SEQ ID NO: 94390 - RNA, 22 nt, Human
agugaagauagagccaggucug

SEQ ID NO: 94391 - RNA, 21 nt, Human
agugaagagugggcuugauca

SEQ ID NO: 94392 - RNA, 22 nt, Human
agucuauguuuuuguucuuauu

SEQ ID NO: 94393 - RNA, 22 nt, Human
agucuagcuguguuuugagcug

SEQ ID NO: 94394 - RNA, 22 nt, Human
agucccugauggacuggaugag

SEQ ID NO: 94395 - RNA, 22 nt, Human
agucugugguccucuguaucuc

SEQ ID NO: 94396 - RNA, 19 nt, Human
agucugugacaaggagugg

SEQ ID NO: 94397 - RNA, 22 nt, Human
agucggauuucccagguuauug

SEQ ID NO: 94398 - RNA, 22 nt, Human
agucugaaccagauggcaaggu

SEQ ID NO: 94399 - RNA, 18 nt, Human
agucauguuuuagucacu

SEQ ID NO: 94400 - RNA, 22 nt, Human
agucaggggaucuagacuugaa

SEQ ID NO: 94401 - RNA, 22 nt, Human
agucauuugucauuuuuuugag

SEQ ID NO: 94402 - RNA, 22 nt, Human
agucauuguguucaguaaaauc

SEQ ID NO: 94403 - RNA, 22 nt, Human
agucauuugaggcaugauuaug

SEQ ID NO: 94404 - RNA, 22 nt, Human
agucaguaucuucugggcggua

SEQ ID NO: 94405 - RNA, 22 nt, Human
agucaguguagaaagcccaggc

SEQ ID NO: 94406 - RNA, 22 nt, Human
agucaggacagauuuucugggg

SEQ ID NO: 94407 - RNA, 22 nt, Human
agucaccuacagcucaugcuuc

SEQ ID NO: 94408 - RNA, 22 nt, Human
agucagaaggugucagaucuug

SEQ ID NO: 94409 - RNA, 22 nt, Human
agucacuguuuaaucuagcuaa

SEQ ID NO: 94410 - RNA, 20 nt, Human
agucacagacccucagguag

SEQ ID NO: 94411 - RNA, 22 nt, Human
agucacacagccugacaaugga

SEQ ID NO: 94412 - RNA, 22 nt, Human
agucaguaugacuuauaguucu

SEQ ID NO: 94413 - RNA, 22 nt, Human
agucacuguucugucaugucaa

SEQ ID NO: 94414 - RNA, 21 nt, Human
agucaagcugccugcuuggca

SEQ ID NO: 94415 - RNA, 22 nt, Human
aguauuuaguauucuauauuag

SEQ ID NO: 94416 - RNA, 22 nt, Human
aguauugguaaguguagcaaau

SEQ ID NO: 94417 - RNA, 22 nt, Human
agucaaaaaaccuagaaacacc

SEQ ID NO: 94418 - RNA, 22 nt, Human
agucaacauuugagaugcaaug

SEQ ID NO: 94419 - RNA, 22 nt, Human
aguauuuucuuuaguuuguuag

SEQ ID NO: 94420 - RNA, 22 nt, Human
aguauuuuaaaauacauuaucc

SEQ ID NO: 94421 - RNA, 22 nt, Human
aguauuggauauaaucuaggaa

SEQ ID NO: 94422 - RNA, 22 nt, Human
agguuuuagagagccaggaugu

SEQ ID NO: 94423 - RNA, 22 nt, Human
agguuuuacuuuuuuuggaggu

SEQ ID NO: 94424 - RNA, 22 nt, Human
aguaaaugaaagcaauuuuaga

SEQ ID NO: 94425 - RNA, 22 nt, Human
agguuaaaagagugaguggaua

SEQ ID NO: 94426 - RNA, 22 nt, Human
agguuaugcacugcacaacccu

SEQ ID NO: 94427 - RNA, 22 nt, Human
agguuagcuguaugucuguaaa

SEQ ID NO: 94428 - RNA, 22 nt, Human
agguuguaagcuuuauauaaau

SEQ ID NO: 94429 - RNA, 22 nt, Human
agguuguugagaucaucuggcu

SEQ ID NO: 94430 - RNA, 18 nt, Human
agguuguguaaaaagaag

SEQ ID NO: 94431 - RNA, 22 nt, Human
aggugcuuaaagaauguguggu

SEQ ID NO: 94432 - RNA, 21 nt, Human
aggugaaggcgagggggacag

SEQ ID NO: 94433 - RNA, 22 nt, Human
aggucuugguaggccagagucu

SEQ ID NO: 94434 - RNA, 22 nt, Human
aggucugcccaggaugcugcuu

SEQ ID NO: 94435 - RNA, 22 nt, Human
aggugcauuuacuuggggcccu

SEQ ID NO: 94436 - RNA, 22 nt, Human
aguaagaaagaaugauaggccu

SEQ ID NO: 94437 - RNA, 22 nt, Human
aguauagacaucaaacugaaga

SEQ ID NO: 94438 - RNA, 22 nt, Human
aguagaauuacagguuuucucu

SEQ ID NO: 94439 - RNA, 22 nt, Human
aguacuuugacuagaggcagcu

SEQ ID NO: 94440 - RNA, 22 nt, Human
aguauaucugcuucuggguccc

SEQ ID NO: 94441 - RNA, 22 nt, Human
aguaucgcuuuguaucaugagg

SEQ ID NO: 94442 - RNA, 22 nt, Human
aguaucugccagaaucucaguu

SEQ ID NO: 94443 - RNA, 22 nt, Human
aguaugcuggcaccuuugagug

SEQ ID NO: 94444 - RNA, 22 nt, Human
aguaucuuccucaugaacacgu

SEQ ID NO: 94445 - RNA, 23 nt, Human
aguaucuugguguggugcagaga

SEQ ID NO: 94446 - RNA, 19 nt, Human
aguauuggcagguccugua

SEQ ID NO: 94447 - RNA, 22 nt, Human
aguauggaauuuuuaaugacag

SEQ ID NO: 94448 - RNA, 22 nt, Human
aguauucaguuagugagcuaag

SEQ ID NO: 94449 - RNA, 22 nt, Human
aguaucuauaucaaaaauggcu

SEQ ID NO: 94450 - RNA, 22 nt, Human
auauugcuuuauucuugaauau

SEQ ID NO: 94451 - RNA, 22 nt, Human
auauuauuaaaauagauggaua

SEQ ID NO: 94452 - RNA, 22 nt, Human
auauccugguucuaucaaaagg

SEQ ID NO: 94453 - RNA, 22 nt, Human
auaucugaugacgugacuaugu

SEQ ID NO: 94454 - RNA, 22 nt, Human
auauaugcaacaagaaagcaua

SEQ ID NO: 94455 - RNA, 22 nt, Human
auauaguuggguuucauucuac

SEQ ID NO: 94456 - RNA, 22 nt, Human
auauaaugugugcuuuauugaa

SEQ ID NO: 94457 - RNA, 21 nt, Human
auauggauauuauuuuguguc

SEQ ID NO: 94458 - RNA, 22 nt, Human
auauuugcccccaugcccuggc

SEQ ID NO: 94459 - RNA, 22 nt, Human
auauuucuacaggcugauuuua

SEQ ID NO: 94460 - RNA, 22 nt, Human
auaugagaggaggagcaucagu

SEQ ID NO: 94461 - RNA, 22 nt, Human
auaucuuguuuuugauuucuug

SEQ ID NO: 94462 - RNA, 22 nt, Human
auauuguagcaucacugucuug

SEQ ID NO: 94463 - RNA, 23 nt, Human
auaugucaugcaccagcacuuua

SEQ ID NO: 94464 - RNA, 22 nt, Human
auauugagagagugagguguag

SEQ ID NO: 94465 - RNA, 22 nt, Human
auauggugauuuuaugcaggaa

SEQ ID NO: 94466 - RNA, 22 nt, Human
auaugaagaaugaucugaagua

SEQ ID NO: 94467 - RNA, 22 nt, Human
auaugcagaaaauaaaggaauu

SEQ ID NO: 94468 - RNA, 22 nt, Human
auaugcacauguacauguauau

SEQ ID NO: 94469 - RNA, 22 nt, Human
auaggcauaacacugauguccu

SEQ ID NO: 94470 - RNA, 22 nt, Human
auaggaguuauggaaugagccc

SEQ ID NO: 94471 - RNA, 22 nt, Human
auaggcggagccauaucaucca

SEQ ID NO: 94472 - RNA, 22 nt, Human
auauaacccaaggcaggcugug

SEQ ID NO: 94473 - RNA, 22 nt, Human
auaguuuuagauacugagaaaa

SEQ ID NO: 94474 - RNA, 22 nt, Human
auauaagauaauaacuuuuuua

SEQ ID NO: 94475 - RNA, 22 nt, Human
auauauacuuugacacauucug

SEQ ID NO: 94476 - RNA, 22 nt, Human
auauauguauauacacauauau

SEQ ID NO: 94477 - RNA, 22 nt, Human
auagcuauuauuauuucuguua

SEQ ID NO: 94478 - RNA, 22 nt, Human
auauaggcugaaaaauagaauu

SEQ ID NO: 94479 - RNA, 19 nt, Human
auagcagaagucauuuuca

SEQ ID NO: 94480 - RNA, 22 nt, Human
auaucuaggcugaauguaaaau

SEQ ID NO: 94481 - RNA, 22 nt, Human
auauauguauauaugugugugu

SEQ ID NO: 94482 - RNA, 22 nt, Human
auagaugacaguuaggaagcug

SEQ ID NO: 94483 - RNA, 22 nt, Human
auagauuuuaucagauuuuauc

SEQ ID NO: 94484 - RNA, 22 nt, Human
auauaguacauguauauauaua

SEQ ID NO: 94485 - RNA, 22 nt, Human
auaguuaucuguggauaagguu

SEQ ID NO: 94486 - RNA, 22 nt, Human
auaguguguaaagugcagugau

SEQ ID NO: 94487 - RNA, 22 nt, Human
auaguccuucuuuaacuuagau

SEQ ID NO: 94488 - RNA, 23 nt, Human
auagucaggaacuguuggugugu

SEQ ID NO: 94489 - RNA, 20 nt, Human
auagaguggugugucacauu

SEQ ID NO: 94490 - RNA, 22 nt, Human
auagaauggcaccagcaucuac

SEQ ID NO: 94491 - RNA, 22 nt, Human
auagacauuuauagagaaugac

SEQ ID NO: 94492 - RNA, 22 nt, Human
auagagcuggggaagaagcugg

SEQ ID NO: 94493 - RNA, 22 nt, Human
auacuucaccuaacccaguuuc

SEQ ID NO: 94494 - RNA, 22 nt, Human
auaccuauagcagacugagacu

SEQ ID NO: 94495 - RNA, 22 nt, Human
auacuacaucacagccaagaag

SEQ ID NO: 94496 - RNA, 22 nt, Human
auagcacuuaauaugaaacagu

SEQ ID NO: 94497 - RNA, 22 nt, Human
auaggaguauaaggcaguaacu

SEQ ID NO: 94498 - RNA, 22 nt, Human
auaguaaauguuaacagcaaca

SEQ ID NO: 94499 - RNA, 22 nt, Human
auagcaguauuaugagauaacu

SEQ ID NO: 94500 - RNA, 22 nt, Human
auacaugacucacacauucugc

SEQ ID NO: 94501 - RNA, 21 nt, Human
auaccaaaagaacaccuuguu

SEQ ID NO: 94502 - RNA, 22 nt, Human
auaccaaugaaucccugagaau

SEQ ID NO: 94503 - RNA, 22 nt, Human
auagaguucucuuuggaggagu

SEQ ID NO: 94504 - RNA, 22 nt, Human
auagauugcucauauauuacuu

SEQ ID NO: 94505 - RNA, 22 nt, Human
auagaugaggaaauucaggugc

SEQ ID NO: 94506 - RNA, 22 nt, Human
auagauguauucauuguuuggc

SEQ ID NO: 94507 - RNA, 22 nt, Human
auacauauaugcacauuaauau

SEQ ID NO: 94508 - RNA, 22 nt, Human
agugaggggagaaugaggugga

SEQ ID NO: 94509 - RNA, 23 nt, Human
auacuuuuuuucuacguuaucuc

SEQ ID NO: 94510 - RNA, 22 nt, Human
auagaaauagacaaugcaaaga

SEQ ID NO: 94511 - RNA, 22 nt, Human
auagacacagcuaugauuugag

SEQ ID NO: 94512 - RNA, 18 nt, Human
auagacaggaaaaaugga

SEQ ID NO: 94513 - RNA, 20 nt, Human
auacuuguuuucaggcuuuu

SEQ ID NO: 94514 - RNA, 22 nt, Human
auagaagugaaaagggaugacu

SEQ ID NO: 94515 - RNA, 22 nt, Human
agugaaagaaaacuguuagaac

SEQ ID NO: 94516 - RNA, 21 nt, Human
agugagauuuaugccugguuc

SEQ ID NO: 94517 - RNA, 22 nt, Human
agugaauuagccuauuuguaaa

SEQ ID NO: 94518 - RNA, 22 nt, Human
agugagcauuagugcuuauauu

SEQ ID NO: 94519 - RNA, 22 nt, Human
aucauugaaaauuuaugcauuu

SEQ ID NO: 94520 - RNA, 22 nt, Human
auccacccugcaggccaacucu

SEQ ID NO: 94521 - RNA, 22 nt, Human
aucauuuuuauuagcugggguu

SEQ ID NO: 94522 - RNA, 22 nt, Human
aucaucccuuucucccagugaa

SEQ ID NO: 94523 - RNA, 22 nt, Human
auccaggggucugaauggauau

SEQ ID NO: 94524 - RNA, 22 nt, Human
aucaucuaaaauuggcucagau

SEQ ID NO: 94525 - RNA, 22 nt, Human
aucauguauauuuuugcuauua

SEQ ID NO: 94526 - RNA, 22 nt, Human
aucauguauaugcagcguuugu

SEQ ID NO: 94527 - RNA, 22 nt, Human
aucaugugacuagguuuggcca

SEQ ID NO: 94528 - RNA, 22 nt, Human
auccaggguuggggucacgagu

SEQ ID NO: 94529 - RNA, 22 nt, Human
auccucaaggaauuaaauaggg

SEQ ID NO: 94530 - RNA, 22 nt, Human
auccuccuuugcccugagauca

SEQ ID NO: 94531 - RNA, 22 nt, Human
auccucugcucaugagaaaugu

SEQ ID NO: 94532 - RNA, 22 nt, Human
auccucucugugacagggaacg

SEQ ID NO: 94533 - RNA, 22 nt, Human
aucauuaacagugcagggguag

SEQ ID NO: 94534 - RNA, 22 nt, Human
aucauuugaacagaauuuguuu

SEQ ID NO: 94535 - RNA, 22 nt, Human
aucauugcuaguaaggaucuug

SEQ ID NO: 94536 - RNA, 22 nt, Human
auccucucuuaugaacaacugu

SEQ ID NO: 94537 - RNA, 22 nt, Human
aucuacuuugggaguuucucuu

SEQ ID NO: 94538 - RNA, 22 nt, Human
aucuaaaacuacgaauacuacc

SEQ ID NO: 94539 - RNA, 22 nt, Human
aucguggcacgucgccgcagcg

SEQ ID NO: 94540 - RNA, 23 nt, Human
aucgcccggguccagucccggcu

SEQ ID NO: 94541 - RNA, 19 nt, Human
auccuugcucacucacuga

SEQ ID NO: 94542 - RNA, 22 nt, Human
aucauguuauguacaaauauga

SEQ ID NO: 94543 - RNA, 22 nt, Human
auccugauggaaacugguauga

SEQ ID NO: 94544 - RNA, 20 nt, Human
auccuggucuuuggaagcuu

SEQ ID NO: 94545 - RNA, 22 nt, Human
auccugugggguauugcugcau

SEQ ID NO: 94546 - RNA, 22 nt, Human
aucccacaccccuacaacauau

SEQ ID NO: 94547 - RNA, 18 nt, Human
auccuucggccuagugga

SEQ ID NO: 94548 - RNA, 22 nt, Human
aucagcucuugaugccuuucuu

SEQ ID NO: 94549 - RNA, 17 nt, Human
aucagaggauaggacaa

SEQ ID NO: 94550 - RNA, 22 nt, Human
aucagagcuaguacuugcaggu

SEQ ID NO: 94551 - RNA, 20 nt, Human
aucaugugcacugcugacag

SEQ ID NO: 94552 - RNA, 22 nt, Human
aucacacaccuguuaaauugug

SEQ ID NO: 94553 - RNA, 22 nt, Human
aucacauggauuuuaucuuuug

SEQ ID NO: 94554 - RNA, 21 nt, Human
aucagaaucucuagauuugga

SEQ ID NO: 94555 - RNA, 22 nt, Human
aucagaagaaauggaugugacu

SEQ ID NO: 94556 - RNA, 22 nt, Human
aucaugcugacacaguuuaucu

SEQ ID NO: 94557 - RNA, 22 nt, Human
aucaugcgguuaaggagugugu

SEQ ID NO: 94558 - RNA, 19 nt, Human
aucagcaguuuugccugga

SEQ ID NO: 94559 - RNA, 22 nt, Human
aucacugcaggcauauaggggu

SEQ ID NO: 94560 - RNA, 22 nt, Human
aucaaaauuuucagauacuaca

SEQ ID NO: 94561 - RNA, 22 nt, Human
aucaacacuguuggcggggacc

SEQ ID NO: 94562 - RNA, 22 nt, Human
aucaacucacagugugcuggca

SEQ ID NO: 94563 - RNA, 22 nt, Human
aucaaguuauuaaguagcuuuc

SEQ ID NO: 94564 - RNA, 22 nt, Human
aucaauaaccauagugguuaca

SEQ ID NO: 94565 - RNA, 22 nt, Human
aucauccuagaaggaagcuagg

SEQ ID NO: 94566 - RNA, 22 nt, Human
aucagugcacgcgaugggcaga

SEQ ID NO: 94567 - RNA, 21 nt, Human
auauuguugggguuuucuuuu

SEQ ID NO: 94568 - RNA, 22 nt, Human
auauuugucuguuuuaguggca

SEQ ID NO: 94569 - RNA, 22 nt, Human
auauuuguacagcuugugaguu

SEQ ID NO: 94570 - RNA, 22 nt, Human
auauuuguuagcugcuuuggag

SEQ ID NO: 94571 - RNA, 22 nt, Human
auauuuguuuggcagaguucag

SEQ ID NO: 94572 - RNA, 22 nt, Human
aucaaugggucaaagagaaggu

SEQ ID NO: 94573 - RNA, 22 nt, Human
aucacuagaguuacauugccag

SEQ ID NO: 94574 - RNA, 22 nt, Human
auauuuuugcagaauuuuucgu

SEQ ID NO: 94575 - RNA, 22 nt, Human
aucaaaauguguagucuugauc

SEQ ID NO: 94576 - RNA, 22 nt, Human
auauuuuacagcucucguugaa

SEQ ID NO: 94577 - RNA, 22 nt, Human
aucaaacuaugguccaugggca

SEQ ID NO: 94578 - RNA, 20 nt, Human
aucaagugucuugccaggca

SEQ ID NO: 94579 - RNA, 22 nt, Human
auauguuaugccauuuucaagg

SEQ ID NO: 94580 - RNA, 22 nt, Human
auauucaaugaggucauauaag

SEQ ID NO: 94581 - RNA, 21 nt, Human
auauugguaucuuuuuaaauc

SEQ ID NO: 94582 - RNA, 22 nt, Human
augaauuaucugguguuggaaa

SEQ ID NO: 94583 - RNA, 22 nt, Human
augauguuggaauuuuaacuua

SEQ ID NO: 94584 - RNA, 22 nt, Human
augauuaagguacgucauuucu

SEQ ID NO: 94585 - RNA, 22 nt, Human
augauuacagcaugauguuuca

SEQ ID NO: 94586 - RNA, 22 nt, Human
augauggagaacaaagaaaauc

SEQ ID NO: 94587 - RNA, 20 nt, Human
augaaugcuccccacguuuc

SEQ ID NO: 94588 - RNA, 22 nt, Human
augaagugcccugggggccaga

SEQ ID NO: 94589 - RNA, 22 nt, Human
augaucacagugucagucauua

SEQ ID NO: 94590 - RNA, 22 nt, Human
augcacuccucagcuguucugg

SEQ ID NO: 94591 - RNA, 22 nt, Human
augauaucuuguuuuucaugca

SEQ ID NO: 94592 - RNA, 22 nt, Human
augcacuaugaugagcuagucu

SEQ ID NO: 94593 - RNA, 22 nt, Human
augcagaaucucuuuccugagg

SEQ ID NO: 94594 - RNA, 22 nt, Human
augcacuugacucuauuccaca

SEQ ID NO: 94595 - RNA, 22 nt, Human
augacugaugcugacucauggg

SEQ ID NO: 94596 - RNA, 22 nt, Human
augacuauaaauaggagauugu

SEQ ID NO: 94597 - RNA, 22 nt, Human
augagaguuagccugcauaguu

SEQ ID NO: 94598 - RNA, 22 nt, Human
augacagcucuagcacacagua

SEQ ID NO: 94599 - RNA, 22 nt, Human
augagaaauaauuguguacuga

SEQ ID NO: 94600 - RNA, 22 nt, Human
augaggaacagcaagaauauuu

SEQ ID NO: 94601 - RNA, 19 nt, Human
augagccccaguucguucc

SEQ ID NO: 94602 - RNA, 22 nt, Human
augagcucuaaguacaugccca

SEQ ID NO: 94603 - RNA, 22 nt, Human
augagcuaagcagaaagcacac

SEQ ID NO: 94604 - RNA, 22 nt, Human
augacuguuaugaggugggugg

SEQ ID NO: 94605 - RNA, 20 nt, Human
aucugugaugagaacgguuu

SEQ ID NO: 94606 - RNA, 22 nt, Human
aucugucagaccuuggucacag

SEQ ID NO: 94607 - RNA, 22 nt, Human
aucuucaaggacgccaagaucc

SEQ ID NO: 94608 - RNA, 22 nt, Human
aucuucaggggcaauggagaua

SEQ ID NO: 94609 - RNA, 22 nt, Human
augaaaacgugugugugugugu

SEQ ID NO: 94610 - RNA, 22 nt, Human
augaaacuggagcgccuggagg

SEQ ID NO: 94611 - RNA, 19 nt, Human
augaaauagcauuuucuga

SEQ ID NO: 94612 - RNA, 22 nt, Human
aucugcugccuaggguuugucu

SEQ ID NO: 94613 - RNA, 22 nt, Human
auggccuuucucaguggugcuu

SEQ ID NO: 94614 - RNA, 22 nt, Human
augcugugccuggaaagcggcu

SEQ ID NO: 94615 - RNA, 22 nt, Human
augcuuuauuggagacagucau

SEQ ID NO: 94616 - RNA, 22 nt, Human
augcuugcccauguuucugaag

SEQ ID NO: 94617 - RNA, 18 nt, Human
augcugacacaaugugga

SEQ ID NO: 94618 - RNA, 22 nt, Human
augcugccuaaagcuacuuaca

SEQ ID NO: 94619 - RNA, 22 nt, Human
augcucuuaauugcuagauaag

SEQ ID NO: 94620 - RNA, 22 nt, Human
auggaguguggccaggcaguaa

SEQ ID NO: 94621 - RNA, 22 nt, Human
auggagugggaggacaugaagg

SEQ ID NO: 94622 - RNA, 22 nt, Human
augcucuggucucuucuuuccu

SEQ ID NO: 94623 - RNA, 22 nt, Human
augcucggcuuucuuucuuucu

SEQ ID NO: 94624 - RNA, 22 nt, Human
augcuugaaaguuauuucauuu

SEQ ID NO: 94625 - RNA, 22 nt, Human
augccucuugagagccagugcu

SEQ ID NO: 94626 - RNA, 22 nt, Human
augcauaucuccuaucuccuca

SEQ ID NO: 94627 - RNA, 22 nt, Human
augcugcuuguccauuuauuug

SEQ ID NO: 94628 - RNA, 22 nt, Human
augcuaaucaaacuuucugcag

SEQ ID NO: 94629 - RNA, 22 nt, Human
augcagcggucagaggaacuca

SEQ ID NO: 94630 - RNA, 22 nt, Human
augcugacaacaaagaaggaag

SEQ ID NO: 94631 - RNA, 22 nt, Human
augcuagaaaauuucauauuau

SEQ ID NO: 94632 - RNA, 22 nt, Human
augcaggcuaagaguaaagacg

SEQ ID NO: 94633 - RNA, 22 nt, Human
augcacuacuagaugcaaaagu

SEQ ID NO: 94634 - RNA, 22 nt, Human
augcggcugugggggaauggga

SEQ ID NO: 94635 - RNA, 21 nt, Human
augcgcgguggagugagcgaa

SEQ ID NO: 94636 - RNA, 22 nt, Human
augcgcugugcacacucuuaac

SEQ ID NO: 94637 - RNA, 22 nt, Human
augccugggcuuuaggguucuc

SEQ ID NO: 94638 - RNA, 22 nt, Human
augccugcugucaggaacucuu

SEQ ID NO: 94639 - RNA, 22 nt, Human
augcccugggagugcuguacca

SEQ ID NO: 94640 - RNA, 22 nt, Human
augccgggguggcuccagcacc

SEQ ID NO: 94641 - RNA, 22 nt, Human
augcagauguagauucugaaau

SEQ ID NO: 94642 - RNA, 22 nt, Human
augcagagacugugggaaagca

SEQ ID NO: 94643 - RNA, 22 nt, Human
augaucaagaauuuuguauucc

SEQ ID NO: 94644 - RNA, 22 nt, Human
augaugaugguuuaacuucagg

SEQ ID NO: 94645 - RNA, 22 nt, Human
augaugauuauucauuuucugu

SEQ ID NO: 94646 - RNA, 22 nt, Human
auuaucugacugaguagucugu

SEQ ID NO: 94647 - RNA, 22 nt, Human
auuaugaauuguguuacgaaga

SEQ ID NO: 94648 - RNA, 22 nt, Human
auuauaguuuugcccuuaagaa

SEQ ID NO: 94649 - RNA, 22 nt, Human
auuaaaaaaagauaaugaguua

SEQ ID NO: 94650 - RNA, 21 nt, Human
auuauagugacuaaauugaua

SEQ ID NO: 94651 - RNA, 22 nt, Human
auuauacauuaggagauugauu

SEQ ID NO: 94652 - RNA, 22 nt, Human
auuauaauucauuaggcuuagu

SEQ ID NO: 94653 - RNA, 22 nt, Human
auguuuuauacacauguaucac

SEQ ID NO: 94654 - RNA, 22 nt, Human
auguuuucuugucuggagaagu

SEQ ID NO: 94655 - RNA, 22 nt, Human
auguuuugaguuuuuuuacacc

SEQ ID NO: 94656 - RNA, 18 nt, Human
auguuccugcaguuauuu

SEQ ID NO: 94657 - RNA, 22 nt, Human
auguuccaugacuaugcaugaa

SEQ ID NO: 94658 - RNA, 22 nt, Human
auguucccaaaaucccuguaga

SEQ ID NO: 94659 - RNA, 22 nt, Human
auguuugugauugcugaaaaga

SEQ ID NO: 94660 - RNA, 19 nt, Human
auguucugaauuacuguaa

SEQ ID NO: 94661 - RNA, 22 nt, Human
auuaauaucaauauauuauaug

SEQ ID NO: 94662 - RNA, 22 nt, Human
auuacugaggcaaaguaguuuu

SEQ ID NO: 94663 - RNA, 22 nt, Human
auuacagauuauaaauuugagc

SEQ ID NO: 94664 - RNA, 22 nt, Human
auuagaaaugacaugugggaau

SEQ ID NO: 94665 - RNA, 22 nt, Human
auuauugcaagcagugaaggga

SEQ ID NO: 94666 - RNA, 22 nt, Human
auuauggacuuucuuguuuggg

SEQ ID NO: 94667 - RNA, 22 nt, Human
auuauucaaggugaggguaaaa

SEQ ID NO: 94668 - RNA, 22 nt, Human
auuaugcagcugccuccaaggu

SEQ ID NO: 94669 - RNA, 22 nt, Human
auuaaagcuaguugagauuuaa

SEQ ID NO: 94670 - RNA, 22 nt, Human
auuaaauagcagaagaaagaug

SEQ ID NO: 94671 - RNA, 21 nt, Human
auuaagacaauggcaaugggu

SEQ ID NO: 94672 - RNA, 22 nt, Human
auuaaagcaugaauaauaugua

SEQ ID NO: 94673 - RNA, 21 nt, Human
auucaaagaagaggaaggccc

SEQ ID NO: 94674 - RNA, 22 nt, Human
auuaagucugacuggauuguau

SEQ ID NO: 94675 - RNA, 19 nt, Human
auucaagugcuuagagauc

SEQ ID NO: 94676 - RNA, 22 nt, Human
auucaguucuaaggucagugcc

SEQ ID NO: 94677 - RNA, 22 nt, Human
auucauauagcgcuuacagccu

SEQ ID NO: 94678 - RNA, 22 nt, Human
auucauuuuuacaucaccaaua

SEQ ID NO: 94679 - RNA, 17 nt, Human
auucaugaacauguccu

SEQ ID NO: 94680 - RNA, 22 nt, Human
auucaucuguacuucaauaucu

SEQ ID NO: 94681 - RNA, 22 nt, Human
auguauuuauguauguguuaua

SEQ ID NO: 94682 - RNA, 22 nt, Human
auguaaauauuuauauaugcau

SEQ ID NO: 94683 - RNA, 20 nt, Human
augucaggaagggagucagg

SEQ ID NO: 94684 - RNA, 22 nt, Human
augugaaagagguguucagugg

SEQ ID NO: 94685 - RNA, 22 nt, Human
augguuuuguccucuuugguuc

SEQ ID NO: 94686 - RNA, 22 nt, Human
augugcauguauguaucauauu

SEQ ID NO: 94687 - RNA, 22 nt, Human
augugcacuggugugugcguuc

SEQ ID NO: 94688 - RNA, 22 nt, Human
augugaaauuugggcucuggga

SEQ ID NO: 94689 - RNA, 22 nt, Human
auguugaguggaugaacaaaca

SEQ ID NO: 94690 - RNA, 22 nt, Human
auguuccuuaaugugcuuguag

SEQ ID NO: 94691 - RNA, 22 nt, Human
auguuccuuuaaaauauagauu

SEQ ID NO: 94692 - RNA, 22 nt, Human
auguucucagguuguauuuauu

SEQ ID NO: 94693 - RNA, 22 nt, Human
augugggguaggaggggggaau

SEQ ID NO: 94694 - RNA, 22 nt, Human
auguguuuugaccccugcuaaa

SEQ ID NO: 94695 - RNA, 22 nt, Human
auguuagcaucuggcacuaugg

SEQ ID NO: 94696 - RNA, 21 nt, Human
auguguucugauagugcuugc

SEQ ID NO: 94697 - RNA, 22 nt, Human
augugugugcgagcgugugugu

SEQ ID NO: 94698 - RNA, 22 nt, Human
auggcuucugucuuggaaauuu

SEQ ID NO: 94699 - RNA, 22 nt, Human
auggcucugcugggcaaagcaa

SEQ ID NO: 94700 - RNA, 19 nt, Human
augggaagcggccagcgga

SEQ ID NO: 94701 - RNA, 22 nt, Human
auggccuguuuccucugaaaga

SEQ ID NO: 94702 - RNA, 22 nt, Human
auggcuguguuguuccucugaa

SEQ ID NO: 94703 - RNA, 18 nt, Human
auggcuccagugucuucc

SEQ ID NO: 94704 - RNA, 20 nt, Human
auggcgagucagcacaaaac

SEQ ID NO: 94705 - RNA, 22 nt, Human
augguugugaaagagcaaagac

SEQ ID NO: 94706 - RNA, 22 nt, Human
augguuagcuauuuuucucuca

SEQ ID NO: 94707 - RNA, 22 nt, Human
augguuagauggaugagaugug

SEQ ID NO: 94708 - RNA, 22 nt, Human
augguuuugugaaaaugcuuug

SEQ ID NO: 94709 - RNA, 22 nt, Human
augguugggggaugucagcagg

SEQ ID NO: 94710 - RNA, 22 nt, Human
auauaaugcaguaggugauuaa

SEQ ID NO: 94711 - RNA, 22 nt, Human
auguaugagagauucuuuuauu

SEQ ID NO: 94712 - RNA, 22 nt, Human
auguauguauguauauacacac

SEQ ID NO: 94713 - RNA, 22 nt, Human
augguugccugagauaagacug

SEQ ID NO: 94714 - RNA, 22 nt, Human
augugacaagugugggcagggc

SEQ ID NO: 94715 - RNA, 22 nt, Human
caagguugugacccaaugacca

SEQ ID NO: 94716 - RNA, 22 nt, Human
caaggucagacagccaggacag

SEQ ID NO: 94717 - RNA, 22 nt, Human
caaggggagcugguauggaugg

SEQ ID NO: 94718 - RNA, 22 nt, Human
caaggaagguugguugaaggua

SEQ ID NO: 94719 - RNA, 22 nt, Human
caaaggaauuacauguuucgga

SEQ ID NO: 94720 - RNA, 22 nt, Human
caaaggagcccuuugccggguu

SEQ ID NO: 94721 - RNA, 22 nt, Human
caauaauugcuuuccagaguua

SEQ ID NO: 94722 - RNA, 22 nt, Human
caauaccucuuggugauugggc

SEQ ID NO: 94723 - RNA, 22 nt, Human
caagauauguccuguuacuaag

SEQ ID NO: 94724 - RNA, 22 nt, Human
auuaguccuaguucauucugag

SEQ ID NO: 94725 - RNA, 22 nt, Human
caagaaguugacagccagguga

SEQ ID NO: 94726 - RNA, 22 nt, Human
caagaaaaaacaugaugagugu

SEQ ID NO: 94727 - RNA, 22 nt, Human
caagaaccuagcgaucagguaa

SEQ ID NO: 94728 - RNA, 22 nt, Human
caaagaugccaaaaggaagaca

SEQ ID NO: 94729 - RNA, 22 nt, Human
caagcgcgccgcuuccuuccgc

SEQ ID NO: 94730 - RNA, 22 nt, Human
caaagaagagauuuacagagcu

SEQ ID NO: 94731 - RNA, 22 nt, Human
caaagagaugcaccauauuucu

SEQ ID NO: 94732 - RNA, 22 nt, Human
caaccucuaucggucaggaagc

SEQ ID NO: 94733 - RNA, 22 nt, Human
caacacaucaguucagucuuga

SEQ ID NO: 94734 - RNA, 22 nt, Human
caacaagcgcucagagcaaagc

SEQ ID NO: 94735 - RNA, 22 nt, Human
caauuaccaguaauugagguuu

SEQ ID NO: 94736 - RNA, 22 nt, Human
cacaacaaaaaauaaguaugag

SEQ ID NO: 94737 - RNA, 22 nt, Human
cacaauuuccauugagcagcag

SEQ ID NO: 94738 - RNA, 22 nt, Human
cacacacacacacacucucaca

SEQ ID NO: 94739 - RNA, 22 nt, Human
caaaguauuuagcugacucgcu

SEQ ID NO: 94740 - RNA, 22 nt, Human
caaucuucucuagaguauucua

SEQ ID NO: 94741 - RNA, 22 nt, Human
caaugccaggaaccugggggaa

SEQ ID NO: 94742 - RNA, 22 nt, Human
caaauguuugguggcauuuugu

SEQ ID NO: 94743 - RNA, 22 nt, Human
caaauggggaauagaugauggg

SEQ ID NO: 94744 - RNA, 22 nt, Human
caaaugcaguggucgugcugga

SEQ ID NO: 94745 - RNA, 22 nt, Human
caaaucagaucagagacaggcu

SEQ ID NO: 94746 - RNA, 22 nt, Human
caccuuccgcccacugaccgcc

SEQ ID NO: 94747 - RNA, 22 nt, Human
caccuggaggcagcaccgggcu

SEQ ID NO: 94748 - RNA, 22 nt, Human
cacccugacuggcccugcagga

SEQ ID NO: 94749 - RNA, 22 nt, Human
caccgaacuuugcaaaugcaau

SEQ ID NO: 94750 - RNA, 22 nt, Human
caccgagagccacuuccggaac

SEQ ID NO: 94751 - RNA, 22 nt, Human
caaguaugagaaagcuauuacc

SEQ ID NO: 94752 - RNA, 22 nt, Human
cacccgacugaggacgccgccc

SEQ ID NO: 94753 - RNA, 23 nt, Human
caccaugacaugccuauagggga

SEQ ID NO: 94754 - RNA, 22 nt, Human
caauagcuauguaaccugaaga

SEQ ID NO: 94755 - RNA, 22 nt, Human
caaguugcaugugcuugaaaua

SEQ ID NO: 94756 - RNA, 22 nt, Human
caaggguguacagauaugagag

SEQ ID NO: 94757 - RNA, 22 nt, Human
caagguauugaggccagugucc

SEQ ID NO: 94758 - RNA, 22 nt, Human
caccacauguccgaaauucagc

SEQ ID NO: 94759 - RNA, 22 nt, Human
caccacuuggcccugagguccu

SEQ ID NO: 94760 - RNA, 22 nt, Human
caaggaaaugucagaaaggcaa

SEQ ID NO: 94761 - RNA, 22 nt, Human
caccaaaauaucccuuuguaca

SEQ ID NO: 94762 - RNA, 22 nt, Human
cacaucaaacuuacuaagauuu

SEQ ID NO: 94763 - RNA, 22 nt, Human
cacaucucagggcuacaggcag

SEQ ID NO: 94764 - RNA, 22 nt, Human
caagagguaugagccgggauga

SEQ ID NO: 94765 - RNA, 22 nt, Human
cacagucugagcccagccuugu

SEQ ID NO: 94766 - RNA, 22 nt, Human
cacaguuuuaucuuauacugau

SEQ ID NO: 94767 - RNA, 22 nt, Human
cacagcuggggaagcugaggcc

SEQ ID NO: 94768 - RNA, 22 nt, Human
caagaugcaagaccagucaggc

SEQ ID NO: 94769 - RNA, 22 nt, Human
cacauuaagcccaagcauagaa

SEQ ID NO: 94770 - RNA, 22 nt, Human
cacauguguaccugccucucug

SEQ ID NO: 94771 - RNA, 22 nt, Human
caaggaaaacagaugaucaaca

SEQ ID NO: 94772 - RNA, 22 nt, Human
cacaucugaaggcggcucuagg

SEQ ID NO: 94773 - RNA, 22 nt, Human
cacacguuuagcuucuggcggc

SEQ ID NO: 94774 - RNA, 22 nt, Human
cacagcagcaucauuuaucugg

SEQ ID NO: 94775 - RNA, 22 nt, Human
cacagccaagacuuggccccau

SEQ ID NO: 94776 - RNA, 18 nt, Human
cacagcauccaaguuaug

SEQ ID NO: 94777 - RNA, 22 nt, Human
cacagcaggcagaacgugggca

SEQ ID NO: 94778 - RNA, 19 nt, Human
caagagcaaagucuuauga

SEQ ID NO: 94779 - RNA, 22 nt, Human
caagagcucccagaccugggca

SEQ ID NO: 94780 - RNA, 20 nt, Human
cacagcugacgaguauccaa

SEQ ID NO: 94781 - RNA, 22 nt, Human
caacaaguugauuucacgcugc

SEQ ID NO: 94782 - RNA, 22 nt, Human
caacauuucaaggucuuuagga

SEQ ID NO: 94783 - RNA, 22 nt, Human
caaagcuucaucuguuguuuug

SEQ ID NO: 94784 - RNA, 22 nt, Human
caacuucuauucagucugcagu

SEQ ID NO: 94785 - RNA, 22 nt, Human
auuuuuuuaggcugucagccgc

SEQ ID NO: 94786 - RNA, 22 nt, Human
caaccaguagcugaguucaaaa

SEQ ID NO: 94787 - RNA, 22 nt, Human
auuuuucucucaugugcaacua

SEQ ID NO: 94788 - RNA, 22 nt, Human
auuuuucuuucacauuuucuua

SEQ ID NO: 94789 - RNA, 22 nt, Human
caaauacaaauacgggcagcuu

SEQ ID NO: 94790 - RNA, 22 nt, Human
auuuuuuuggucauaugagaua

SEQ ID NO: 94791 - RNA, 22 nt, Human
caaaaaauccauagaaagaggu

SEQ ID NO: 94792 - RNA, 22 nt, Human
caaaacauucagagagcucacu

SEQ ID NO: 94793 - RNA, 22 nt, Human
caaaacccaagugcuauugcaa

SEQ ID NO: 94794 - RNA, 22 nt, Human
auuuugcaguuuauugccaauc

SEQ ID NO: 94795 - RNA, 22 nt, Human
caaagccuggggagaguaagga

SEQ ID NO: 94796 - RNA, 21 nt, Human
auuuguggugcaauuguggua

SEQ ID NO: 94797 - RNA, 22 nt, Human
auuuggucuguaauuacaugga

SEQ ID NO: 94798 - RNA, 22 nt, Human
auuuuugugucacaucuaggaa

SEQ ID NO: 94799 - RNA, 22 nt, Human
auuuucuucauuuugauuguau

SEQ ID NO: 94800 - RNA, 22 nt, Human
auuuucuugucucuguuguagg

SEQ ID NO: 94801 - RNA, 22 nt, Human
auuuuugugcuuuauuggggua

SEQ ID NO: 94802 - RNA, 22 nt, Human
auuugaaguauaaguaauugcu

SEQ ID NO: 94803 - RNA, 22 nt, Human
auuugccaguuacucacaccac

SEQ ID NO: 94804 - RNA, 22 nt, Human
auuuaagacuguggugcaguuu

SEQ ID NO: 94805 - RNA, 22 nt, Human
auuugaaaaucuaugaugugca

SEQ ID NO: 94806 - RNA, 18 nt, Human
auuuguggggguuauaga

SEQ ID NO: 94807 - RNA, 22 nt, Human
auuucagaguagaucguuauuu

SEQ ID NO: 94808 - RNA, 22 nt, Human
auuuuaccauuaguuuguaaua

SEQ ID NO: 94809 - RNA, 22 nt, Human
auuguuacuggguuaauuugga

SEQ ID NO: 94810 - RNA, 22 nt, Human
auugugaaugccugucagucuu

SEQ ID NO: 94811 - RNA, 22 nt, Human
auuagugguguauuuggcacua

SEQ ID NO: 94812 - RNA, 22 nt, Human
auuagguaguauaaucuuuguu

SEQ ID NO: 94813 - RNA, 22 nt, Human
auuagaagagcuuuuuacucuu

SEQ ID NO: 94814 - RNA, 22 nt, Human
auuaauguguaugauauaaauu

SEQ ID NO: 94815 - RNA, 20 nt, Human
auuaauuuuuagggcucacc

SEQ ID NO: 94816 - RNA, 22 nt, Human
auuacagaagauaugcucaaca

SEQ ID NO: 94817 - RNA, 22 nt, Human
auuuaggacagugucugaauug

SEQ ID NO: 94818 - RNA, 22 nt, Human
auugaguauuguaaauaaaaca

SEQ ID NO: 94819 - RNA, 22 nt, Human
auuuaaaaacugguacaacagg

SEQ ID NO: 94820 - RNA, 22 nt, Human
auuuaaagaguaauacaaucca

SEQ ID NO: 94821 - RNA, 22 nt, Human
auugacagagguguaguugaga

SEQ ID NO: 94822 - RNA, 22 nt, Human
auugaaauuugcuuccucacug

SEQ ID NO: 94823 - RNA, 17 nt, Human
auuguuuuuaauuugca

SEQ ID NO: 94824 - RNA, 22 nt, Human
auucuuuucucuaaaugaugaa

SEQ ID NO: 94825 - RNA, 22 nt, Human
auuucagcagcccauguuugga

SEQ ID NO: 94826 - RNA, 22 nt, Human
auuuauuugaagagccauugca

SEQ ID NO: 94827 - RNA, 22 nt, Human
auuuauuuucccucaaguaccu

SEQ ID NO: 94828 - RNA, 22 nt, Human
auuucacucuuaauugcuuccu

SEQ ID NO: 94829 - RNA, 22 nt, Human
auuuccacaaauuaagauugca

SEQ ID NO: 94830 - RNA, 22 nt, Human
auuucauuuuagaaauaagugu

SEQ ID NO: 94831 - RNA, 22 nt, Human
auuucauaaaaacuuuaccuga

SEQ ID NO: 94832 - RNA, 22 nt, Human
auuucccugcagugcuuaggaa

SEQ ID NO: 94833 - RNA, 19 nt, Human
auuuccuggcauauaucac

SEQ ID NO: 94834 - RNA, 22 nt, Human
auuucagaaugaaaggaaaaau

SEQ ID NO: 94835 - RNA, 22 nt, Human
auuucaacagaguuugaaggca

SEQ ID NO: 94836 - RNA, 22 nt, Human
auuuaaaggaagugggugauaa

SEQ ID NO: 94837 - RNA, 22 nt, Human
auuuggaaacaugcugaccaug

SEQ ID NO: 94838 - RNA, 22 nt, Human
auuuccugugaacuuuucugau

SEQ ID NO: 94839 - RNA, 22 nt, Human
auuuggggacagagugggggua

SEQ ID NO: 94840 - RNA, 21 nt, Human
auuuggucaaugucugcguga

SEQ ID NO: 94841 - RNA, 22 nt, Human
caguacugucuuccugauggca

SEQ ID NO: 94842 - RNA, 22 nt, Human
caguaguucucauaacucauga

SEQ ID NO: 94843 - RNA, 22 nt, Human
caggucauaacuaugcaugaac

SEQ ID NO: 94844 - RNA, 22 nt, Human
caggucagcacuuggaggugca

SEQ ID NO: 94845 - RNA, 22 nt, Human
caggcagggagcuggaaaggau

SEQ ID NO: 94846 - RNA, 22 nt, Human
caggccagcuggaggggcagcu

SEQ ID NO: 94847 - RNA, 22 nt, Human
caguccaugaugacuuuugcuc

SEQ ID NO: 94848 - RNA, 22 nt, Human
caggcgcauggugagcagauga

SEQ ID NO: 94849 - RNA, 22 nt, Human
cagggacugcaggaggacaggu

SEQ ID NO: 94850 - RNA, 22 nt, Human
caggccccagggacugggcgcu

SEQ ID NO: 94851 - RNA, 22 nt, Human
caggccgccacugcagcagcug

SEQ ID NO: 94852 - RNA, 20 nt, Human
caggccuucaggauggcugg

SEQ ID NO: 94853 - RNA, 22 nt, Human
cagggcuugaaucaaggaaguc

SEQ ID NO: 94854 - RNA, 22 nt, Human
cagggcuuuuuccuccucuuug

SEQ ID NO: 94855 - RNA, 22 nt, Human
caguuuuauacacugcagcucc

SEQ ID NO: 94856 - RNA, 22 nt, Human
cagggcaucucugaaucuucac

SEQ ID NO: 94857 - RNA, 22 nt, Human
cagggcagaguuaagaugcugg

SEQ ID NO: 94858 - RNA, 22 nt, Human
cagggagguuggauuggggccu

SEQ ID NO: 94859 - RNA, 22 nt, Human
cauaccuugguaagagugauca

SEQ ID NO: 94860 - RNA, 22 nt, Human
caggguugaugaauugucugua

SEQ ID NO: 94861 - RNA, 22 nt, Human
cauaauuggugcuuauuaaaug

SEQ ID NO: 94862 - RNA, 22 nt, Human
caggguaguaauuuaauacaag

SEQ ID NO: 94863 - RNA, 22 nt, Human
cagggugaagaugcgccuccug

SEQ ID NO: 94864 - RNA, 22 nt, Human
caggggacacuccugcuugggc

SEQ ID NO: 94865 - RNA, 22 nt, Human
caggggcuuuccuguuuaugga

SEQ ID NO: 94866 - RNA, 19 nt, Human
caggggcuuaugcgaccuc

SEQ ID NO: 94867 - RNA, 22 nt, Human
caggguaagagagagugacauu

SEQ ID NO: 94868 - RNA, 22 nt, Human
cagggggacuuguuagguuuua

SEQ ID NO: 94869 - RNA, 22 nt, Human
caggugauuuuguuuucaaaug

SEQ ID NO: 94870 - RNA, 22 nt, Human
cauagacauugauagguuauau

SEQ ID NO: 94871 - RNA, 22 nt, Human
cauacauguuagcaguagccuu

SEQ ID NO: 94872 - RNA, 22 nt, Human
cagguauaugugugucuaauac

SEQ ID NO: 94873 - RNA, 22 nt, Human
cagguauuugaaggcaguggga

SEQ ID NO: 94874 - RNA, 22 nt, Human
cauccagggguacccuggagcc

SEQ ID NO: 94875 - RNA, 22 nt, Human
cauccagagcugccugaccccg

SEQ ID NO: 94876 - RNA, 22 nt, Human
caguaucucccauucacagugu

SEQ ID NO: 94877 - RNA, 22 nt, Human
caguaucucuaaaauuacucuu

SEQ ID NO: 94878 - RNA, 22 nt, Human
caguaugagcacagugccugga

SEQ ID NO: 94879 - RNA, 21 nt, Human
caguagcgcgacaugguuagc

SEQ ID NO: 94880 - RNA, 22 nt, Human
caguaaccaguaguuuuggaaa

SEQ ID NO: 94881 - RNA, 22 nt, Human
caucaaaugcaagagcguucuu

SEQ ID NO: 94882 - RNA, 22 nt, Human
cagguuguugacugcauauagg

SEQ ID NO: 94883 - RNA, 23 nt, Human
cauauucagaaacaccuaguggu

SEQ ID NO: 94884 - RNA, 22 nt, Human
caugguaccuagccucauggau

SEQ ID NO: 94885 - RNA, 22 nt, Human
cauguauguuaguggcugcuuu

SEQ ID NO: 94886 - RNA, 22 nt, Human
caugguacugccacagaagagu

SEQ ID NO: 94887 - RNA, 19 nt, Human
cauggcgguaaagaggcug

SEQ ID NO: 94888 - RNA, 22 nt, Human
cauggcggcgcucucccugccu

SEQ ID NO: 94889 - RNA, 22 nt, Human
cauggcaggugcagauucugug

SEQ ID NO: 94890 - RNA, 22 nt, Human
cauagcguuuacauguggauua

SEQ ID NO: 94891 - RNA, 22 nt, Human
cauaaucaagggguugugaugu

SEQ ID NO: 94892 - RNA, 22 nt, Human
cauaacuugguguuggaaacug

SEQ ID NO: 94893 - RNA, 21 nt, Human
caguuugcuauuuuaguauga

SEQ ID NO: 94894 - RNA, 22 nt, Human
caguugcuauugagagaacaca

SEQ ID NO: 94895 - RNA, 22 nt, Human
caguugcagagugauguguuug

SEQ ID NO: 94896 - RNA, 22 nt, Human
caguuuuggaagaaacaaggaa

SEQ ID NO: 94897 - RNA, 22 nt, Human
caugcagcagaauaaugacuau

SEQ ID NO: 94898 - RNA, 22 nt, Human
caugccugaucagcggccagca

SEQ ID NO: 94899 - RNA, 22 nt, Human
caugccaguagccggcuugacu

SEQ ID NO: 94900 - RNA, 22 nt, Human
cauggcacagaagaugucguuu

SEQ ID NO: 94901 - RNA, 22 nt, Human
cauggcacuuuugugucuaaau

SEQ ID NO: 94902 - RNA, 22 nt, Human
caugaugaacugugcuguuagg

SEQ ID NO: 94903 - RNA, 22 nt, Human
caguuaaugauaggaauucggu

SEQ ID NO: 94904 - RNA, 22 nt, Human
caugauucccacauugcgauca

SEQ ID NO: 94905 - RNA, 22 nt, Human
caugaugagaguaauaacacag

SEQ ID NO: 94906 - RNA, 17 nt, Human
cagugcuguuuuagaaa

SEQ ID NO: 94907 - RNA, 22 nt, Human
caguggacacuuccucuacaau

SEQ ID NO: 94908 - RNA, 22 nt, Human
caugaggauccuccaggggaaa

SEQ ID NO: 94909 - RNA, 22 nt, Human
caguggaugucucauaguguga

SEQ ID NO: 94910 - RNA, 22 nt, Human
caguggggaggccaggauagaa

SEQ ID NO: 94911 - RNA, 22 nt, Human
caguucaagauuguugcuuucu

SEQ ID NO: 94912 - RNA, 22 nt, Human
caugagaguaaccuagagaaga

SEQ ID NO: 94913 - RNA, 22 nt, Human
caugaacucucggguuuggaau

SEQ ID NO: 94914 - RNA, 22 nt, Human
caucuccaagucuguaagcagu

SEQ ID NO: 94915 - RNA, 22 nt, Human
cagugcuggaggggugcuugca

SEQ ID NO: 94916 - RNA, 22 nt, Human
caucucagguuuguucugagac

SEQ ID NO: 94917 - RNA, 22 nt, Human
cagucaaauuugaaaacuuuga

SEQ ID NO: 94918 - RNA, 20 nt, Human
cagugcccguggaaaagaug

SEQ ID NO: 94919 - RNA, 22 nt, Human
cagugccggccaggaccuccug

SEQ ID NO: 94920 - RNA, 22 nt, Human
caggcagggcugccuucugcuu

SEQ ID NO: 94921 - RNA, 22 nt, Human
caggaggaaaguuccacucaac

SEQ ID NO: 94922 - RNA, 22 nt, Human
caggccacagcuaaagaggauu

SEQ ID NO: 94923 - RNA, 22 nt, Human
caggcagagagggcagugugga

SEQ ID NO: 94924 - RNA, 22 nt, Human
caggcaggagaaaaggcgcggg

SEQ ID NO: 94925 - RNA, 22 nt, Human
cagcuuauggcuucuccaguag

SEQ ID NO: 94926 - RNA, 23 nt, Human
caggggacaggugaccugggcuc

SEQ ID NO: 94927 - RNA, 22 nt, Human
caggggaagccagcugccaugu

SEQ ID NO: 94928 - RNA, 22 nt, Human
cagggcacaguuauggaggugg

SEQ ID NO: 94929 - RNA, 22 nt, Human
cagggccagggcuauggugaag

SEQ ID NO: 94930 - RNA, 22 nt, Human
caggaaaauaauggugauggga

SEQ ID NO: 94931 - RNA, 22 nt, Human
cagguaguuagaaugaccagga

SEQ ID NO: 94932 - RNA, 22 nt, Human
cagggggcagcguagaaaauga

SEQ ID NO: 94933 - RNA, 22 nt, Human
cagccuggccucuggauauuug

SEQ ID NO: 94934 - RNA, 22 nt, Human
cagccuacaucagaauaccaau

SEQ ID NO: 94935 - RNA, 22 nt, Human
caggaagagaacugcucagccu

SEQ ID NO: 94936 - RNA, 22 nt, Human
caggaacucuucugggugcuug

SEQ ID NO: 94937 - RNA, 22 nt, Human
cagcuuguucugaccugugauu

SEQ ID NO: 94938 - RNA, 22 nt, Human
cagcuuuugcagacuucuugcc

SEQ ID NO: 94939 - RNA, 22 nt, Human
cagccagaucgccuuccgccuc

SEQ ID NO: 94940 - RNA, 22 nt, Human
cagccauucuaacacugccagu

SEQ ID NO: 94941 - RNA, 22 nt, Human
cagcuugcccugauguggaaga

SEQ ID NO: 94942 - RNA, 22 nt, Human
cagauuuagcacugauaggacu

SEQ ID NO: 94943 - RNA, 19 nt, Human
cagcaaacacuguaaaugg

SEQ ID NO: 94944 - RNA, 22 nt, Human
cagcacugcccuaccccuccac

SEQ ID NO: 94945 - RNA, 20 nt, Human
cagaucuuauguuuuucugu

SEQ ID NO: 94946 - RNA, 22 nt, Human
cagaugccauagguauaguaua

SEQ ID NO: 94947 - RNA, 22 nt, Human
cagauguuugaaugcuuaccac

SEQ ID NO: 94948 - RNA, 22 nt, Human
cagauggagaaagagugaaugg

SEQ ID NO: 94949 - RNA, 22 nt, Human
cagcuguauuucucugguuaga

SEQ ID NO: 94950 - RNA, 22 nt, Human
cagcuggggagagacauggcag

SEQ ID NO: 94951 - RNA, 20 nt, Human
cagcagucagcucuccaaug

SEQ ID NO: 94952 - RNA, 22 nt, Human
cagaaagaaguggggauagagg

SEQ ID NO: 94953 - RNA, 22 nt, Human
cagacacgucccuguugaccug

SEQ ID NO: 94954 - RNA, 22 nt, Human
cagaaaacauuguguguauaag

SEQ ID NO: 94955 - RNA, 22 nt, Human
cagaaacacuguauuuagggaa

SEQ ID NO: 94956 - RNA, 22 nt, Human
cagcauggagacaaagugggca

SEQ ID NO: 94957 - RNA, 22 nt, Human
cagacagagucuucccaucagu

SEQ ID NO: 94958 - RNA, 18 nt, Human
cagcauuagcagcuucca

SEQ ID NO: 94959 - RNA, 22 nt, Human
cagcaugguggagcugcucuuu

SEQ ID NO: 94960 - RNA, 23 nt, Human
cagagaaaauagaauaugcugug

SEQ ID NO: 94961 - RNA, 22 nt, Human
cagagaagaggucuugaccccu

SEQ ID NO: 94962 - RNA, 20 nt, Human
cagagacaagagggaaggga

SEQ ID NO: 94963 - RNA, 22 nt, Human
cagagacuuuugcuccgauucu

SEQ ID NO: 94964 - RNA, 19 nt, Human
cagagacuguaacacuuuu

SEQ ID NO: 94965 - RNA, 22 nt, Human
cagcccaggcucagauguuggg

SEQ ID NO: 94966 - RNA, 22 nt, Human
cagaguccuguaguauugcugg

SEQ ID NO: 94967 - RNA, 22 nt, Human
cagaguaaugugauuuccaugu

SEQ ID NO: 94968 - RNA, 22 nt, Human
cagaggcugagcugcgggauga

SEQ ID NO: 94969 - RNA, 22 nt, Human
cagcugcgcagcgccgggccug

SEQ ID NO: 94970 - RNA, 22 nt, Human
cagcugcugguguaucgggucc

SEQ ID NO: 94971 - RNA, 22 nt, Human
cagcuggaggagcagcuuccag

SEQ ID NO: 94972 - RNA, 22 nt, Human
cagcucgaauaauggagaacug

SEQ ID NO: 94973 - RNA, 22 nt, Human
cagaucacauccauccgucacc

SEQ ID NO: 94974 - RNA, 22 nt, Human
cagcucugcugggaggaugcag

SEQ ID NO: 94975 - RNA, 22 nt, Human
cagcucuggcuauugaggacca

SEQ ID NO: 94976 - RNA, 21 nt, Human
cagagcuuuggagacggagga

SEQ ID NO: 94977 - RNA, 22 nt, Human
cagauacaacagcaggaaugaa

SEQ ID NO: 94978 - RNA, 22 nt, Human
cacuuguuaaaugccaauggca

SEQ ID NO: 94979 - RNA, 22 nt, Human
cagauagccugguccuaacaug

SEQ ID NO: 94980 - RNA, 22 nt, Human
cagauggaguuaguuucuaaca

SEQ ID NO: 94981 - RNA, 22 nt, Human
cagauuuaauaaaaaaugcauc

SEQ ID NO: 94982 - RNA, 22 nt, Human
cacuuuuucccccuggugucau

SEQ ID NO: 94983 - RNA, 22 nt, Human
cacaaagugucaggggagagaa

SEQ ID NO: 94984 - RNA, 22 nt, Human
caauugcuuccuucuguaagua

SEQ ID NO: 94985 - RNA, 22 nt, Human
caaugaaaauuuaaguugcagc

SEQ ID NO: 94986 - RNA, 18 nt, Human
cacgcaacuguaaaaccc

SEQ ID NO: 94987 - RNA, 22 nt, Human
cacacagcuagugacaggagaa

SEQ ID NO: 94988 - RNA, 22 nt, Human
cagagaugaggcuggcgugguu

SEQ ID NO: 94989 - RNA, 22 nt, Human
cacacaccagaaagccugggac

SEQ ID NO: 94990 - RNA, 22 nt, Human
cacucaaacugaaauccuuuuu

SEQ ID NO: 94991 - RNA, 22 nt, Human
cagagcugucauuugccaguga

SEQ ID NO: 94992 - RNA, 20 nt, Human
cagagccaggguuuuguuuu

SEQ ID NO: 94993 - RNA, 22 nt, Human
cagagcucacaaacugaaaacc

SEQ ID NO: 94994 - RNA, 22 nt, Human
cuggaaaaauggauccugucuu

SEQ ID NO: 94995 - RNA, 22 nt, Human
cugagaaauacccaagucuggu

SEQ ID NO: 94996 - RNA, 22 nt, Human
cugaccucuaaguaacagagaa

SEQ ID NO: 94997 - RNA, 22 nt, Human
cugacugauuuugcuuuuuaau

SEQ ID NO: 94998 - RNA, 22 nt, Human
cugacugaggaucaguucauca

SEQ ID NO: 94999 - RNA, 22 nt, Human
cuggaaauggcagaguugcauu

SEQ ID NO: 95000 - RNA, 22 nt, Human
cuggaauugcuugagcuaggaa

SEQ ID NO: 95001 - RNA, 22 nt, Human
cuggagaacagagcuguuuaga

SEQ ID NO: 95002 - RNA, 22 nt, Human
cuggagaagagguaguauguag

SEQ ID NO: 95003 - RNA, 22 nt, Human
cuggaugagcuucgugcgcacg

SEQ ID NO: 95004 - RNA, 22 nt, Human
cuggaugucugggaggcuuccc

SEQ ID NO: 95005 - RNA, 22 nt, Human
cuggauagaggaugguaggcac

SEQ ID NO: 95006 - RNA, 22 nt, Human
cuggagcucugggcaucucagg

SEQ ID NO: 95007 - RNA, 22 nt, Human
cuggagcuucaggguucucggg

SEQ ID NO: 95008 - RNA, 22 nt, Human
cuggccagccucccagguaccc

SEQ ID NO: 95009 - RNA, 22 nt, Human
cuggcagcucugagucccuucu

SEQ ID NO: 95010 - RNA, 22 nt, Human
cucauguucuaagcuuucuuca

SEQ ID NO: 95011 - RNA, 22 nt, Human
cuccucguccucuucauccucu

SEQ ID NO: 95012 - RNA, 22 nt, Human
cuccugcuuuuucuucuuccga

SEQ ID NO: 95013 - RNA, 22 nt, Human
cucgccugacucggaugggcug

SEQ ID NO: 95014 - RNA, 22 nt, Human
cuccuuuuugggaccgugcagc

SEQ ID NO: 95015 - RNA, 22 nt, Human
cucggaggaccuguuuuaugca

SEQ ID NO: 95016 - RNA, 22 nt, Human
cucuauucuaauggauucuggg

SEQ ID NO: 95017 - RNA, 22 nt, Human
cucucacucccuccuucccucu

SEQ ID NO: 95018 - RNA, 22 nt, Human
cucuauuuuuucaucuuucagg

SEQ ID NO: 95019 - RNA, 22 nt, Human
cuccggccuucugacuccccug

SEQ ID NO: 95020 - RNA, 22 nt, Human
cuccuauugaucaguacuauuu

SEQ ID NO: 95021 - RNA, 22 nt, Human
cuccaucccccugugugucaau

SEQ ID NO: 95022 - RNA, 21 nt, Human
cucauuccccgucccggcccc

SEQ ID NO: 95023 - RNA, 22 nt, Human
cuccagcucgcgagcucugcuc

SEQ ID NO: 95024 - RNA, 22 nt, Human
cuccaggcccagggccaagagc

SEQ ID NO: 95025 - RNA, 22 nt, Human
cugacagaucuggaucugaacu

SEQ ID NO: 95026 - RNA, 22 nt, Human
cugaccgugccgcgguacugcu

SEQ ID NO: 95027 - RNA, 22 nt, Human
cugaccugugagcuaugccggc

SEQ ID NO: 95028 - RNA, 22 nt, Human
cugaaggcuuugaauggaauga

SEQ ID NO: 95029 - RNA, 22 nt, Human
cugugugcagggcacaauggaa

SEQ ID NO: 95030 - RNA, 22 nt, Human
cuguguguauaauguuugauaa

SEQ ID NO: 95031 - RNA, 22 nt, Human
cuguguuaggaucuugcuggca

SEQ ID NO: 95032 - RNA, 22 nt, Human
cugauagagcauuagugugaga

SEQ ID NO: 95033 - RNA, 22 nt, Human
cuucacugcagucauggcucug

SEQ ID NO: 95034 - RNA, 22 nt, Human
cuucaacuucuguuuuaaggaa

SEQ ID NO: 95035 - RNA, 22 nt, Human
cuucacaaaauauuucauuaua

SEQ ID NO: 95036 - RNA, 22 nt, Human
cugagcggugagggcauacagc

SEQ ID NO: 95037 - RNA, 22 nt, Human
cuuauaucaacuggaaaaauua

SEQ ID NO: 95038 - RNA, 22 nt, Human
cugagaucaugggucagguggu

SEQ ID NO: 95039 - RNA, 22 nt, Human
cucuugacagcuuuaguaucau

SEQ ID NO: 95040 - RNA, 22 nt, Human
cugucucugucucuguuuaucc

SEQ ID NO: 95041 - RNA, 22 nt, Human
cugugaaugguggccacgcguu

SEQ ID NO: 95042 - RNA, 22 nt, Human
cugugcauaugucuugaggucu

SEQ ID NO: 95043 - RNA, 22 nt, Human
cucuuuucaaaccuguuuaugg

SEQ ID NO: 95044 - RNA, 22 nt, Human
cucuuuguauucuagaagcucu

SEQ ID NO: 95045 - RNA, 22 nt, Human
cuguggcugcgcccugggggag

SEQ ID NO: 95046 - RNA, 22 nt, Human
cugugcuucgagggcuccccgc

SEQ ID NO: 95047 - RNA, 19 nt, Human
cucuggcuccugggcugcc

SEQ ID NO: 95048 - RNA, 22 nt, Human
cucugcuuagacaggcuuuaag

SEQ ID NO: 95049 - RNA, 22 nt, Human
cucucuuuuuuucccuuguuaa

SEQ ID NO: 95050 - RNA, 22 nt, Human
cucugcccacaguccccgagga

SEQ ID NO: 95051 - RNA, 20 nt, Human
cuggugccuucugcgauuua

SEQ ID NO: 95052 - RNA, 22 nt, Human
cucucuccuuagcugcagacca

SEQ ID NO: 95053 - RNA, 22 nt, Human
cucuccaguuauagcugauuug

SEQ ID NO: 95054 - RNA, 22 nt, Human
cuuggcaaaguggcaaaauuag

SEQ ID NO: 95055 - RNA, 22 nt, Human
cuuggcauguucaucugcuugg

SEQ ID NO: 95056 - RNA, 22 nt, Human
cugcucuucccaucccuuaaau

SEQ ID NO: 95057 - RNA, 22 nt, Human
cugcgcagaucugcuguucucu

SEQ ID NO: 95058 - RNA, 22 nt, Human
cugcgcgagcacugccggcggg

SEQ ID NO: 95059 - RNA, 22 nt, Human
cugcuauaacacuaacaucuaa

SEQ ID NO: 95060 - RNA, 22 nt, Human
cugcuacgguguccgguggggc

SEQ ID NO: 95061 - RNA, 22 nt, Human
cugcuguugagguuccaggcca

SEQ ID NO: 95062 - RNA, 23 nt, Human
cuuggcuagccacuuccacgcuc

SEQ ID NO: 95063 - RNA, 22 nt, Human
cugcuggugcugcccacacggu

SEQ ID NO: 95064 - RNA, 22 nt, Human
cugcugucuuuauuucacugcu

SEQ ID NO: 95065 - RNA, 22 nt, Human
cuugguuugaaacauacucuac

SEQ ID NO: 95066 - RNA, 22 nt, Human
cuuggugcgaagagucagggga

SEQ ID NO: 95067 - RNA, 22 nt, Human
cugcuugaugaggaaaggauug

SEQ ID NO: 95068 - RNA, 22 nt, Human
cuuugauuucucugguccaauc

SEQ ID NO: 95069 - RNA, 22 nt, Human
cuuucuuucaaguucugcuuua

SEQ ID NO: 95070 - RNA, 18 nt, Human
cuuucugcccccauuagc

SEQ ID NO: 95071 - RNA, 22 nt, Human
cuuuccugaaaucucuucugca

SEQ ID NO: 95072 - RNA, 22 nt, Human
cuuucucucaaacacacauaca

SEQ ID NO: 95073 - RNA, 22 nt, Human
cuuucuccagagugaagauccu

SEQ ID NO: 95074 - RNA, 22 nt, Human
cuuuaaaaauguauuuuugugg

SEQ ID NO: 95075 - RNA, 22 nt, Human
cuggagaucaguuggacaacag

SEQ ID NO: 95076 - RNA, 22 nt, Human
cuuuaguaaaacguauuuagga

SEQ ID NO: 95077 - RNA, 18 nt, Human
cuuuagcugucaucuuug

SEQ ID NO: 95078 - RNA, 22 nt, Human
cuuuauguuggggugucuuagu

SEQ ID NO: 95079 - RNA, 22 nt, Human
cuuucauuuuugggcaucugag

SEQ ID NO: 95080 - RNA, 22 nt, Human
cuggaagcgucggaggaagggc

SEQ ID NO: 95081 - RNA, 23 nt, Human
cuggacauucgcaaaguucaucu

SEQ ID NO: 95082 - RNA, 22 nt, Human
cuggagaacucugugcuucacu

SEQ ID NO: 95083 - RNA, 20 nt, Human
cuuguuaaauaugcagguag

SEQ ID NO: 95084 - RNA, 22 nt, Human
cuuguuuggccauaggugcugg

SEQ ID NO: 95085 - RNA, 22 nt, Human
cuuguuuuaaacuguuguggcu

SEQ ID NO: 95086 - RNA, 22 nt, Human
cugcuuuggaucucucucugcc

SEQ ID NO: 95087 - RNA, 22 nt, Human
cugcuuguguugcucagaguca

SEQ ID NO: 95088 - RNA, 19 nt, Human
cuuguggcuaugcagauac

SEQ ID NO: 95089 - RNA, 22 nt, Human
cuggaaagauuuacacggggaa

SEQ ID NO: 95090 - RNA, 23 nt, Human
cuugugacagcaauuauagcaag

SEQ ID NO: 95091 - RNA, 22 nt, Human
cuugcagccuggagcucagccu

SEQ ID NO: 95092 - RNA, 22 nt, Human
cuugcagagcccauggauguca

SEQ ID NO: 95093 - RNA, 22 nt, Human
cugccuuggcccuaguucaugg

SEQ ID NO: 95094 - RNA, 22 nt, Human
cugcccauggcuccuggcugug

SEQ ID NO: 95095 - RNA, 22 nt, Human
cugccgaugcgcaguggcgccu

SEQ ID NO: 95096 - RNA, 22 nt, Human
cugccuucaaaguaauauuuua

SEQ ID NO: 95097 - RNA, 22 nt, Human
cugccggcugcugcagagaggu

SEQ ID NO: 95098 - RNA, 22 nt, Human
cugccucucaugccugcuugcu

SEQ ID NO: 95099 - RNA, 22 nt, Human
cuucuugucagugauuucuucc

SEQ ID NO: 95100 - RNA, 22 nt, Human
cuucuucuagaagauggggaag

SEQ ID NO: 95101 - RNA, 22 nt, Human
cuucuuucuuuucuucuucucu

SEQ ID NO: 95102 - RNA, 22 nt, Human
cuucuuuucuacuggccuagaa

SEQ ID NO: 95103 - RNA, 22 nt, Human
cuugagcugaguuugcagcucu

SEQ ID NO: 95104 - RNA, 22 nt, Human
cuucuuuuggggaugaaaaugg

SEQ ID NO: 95105 - RNA, 22 nt, Human
cuucuuaaaguugucacagcug

SEQ ID NO: 95106 - RNA, 22 nt, Human
cuucuguggcugagaaggcagc

SEQ ID NO: 95107 - RNA, 22 nt, Human
cuucuggaggcucuagaggaga

SEQ ID NO: 95108 - RNA, 22 nt, Human
cuucuggaggcugcagaaaaga

SEQ ID NO: 95109 - RNA, 22 nt, Human
cuucucugcugccugccucuuu

SEQ ID NO: 95110 - RNA, 22 nt, Human
cugccaguaucuuuggggcugu

SEQ ID NO: 95111 - RNA, 23 nt, Human
cuucggcgcucgcugggcggagg

SEQ ID NO: 95112 - RNA, 21 nt, Human
cuucgcuguuccagcucuugg

SEQ ID NO: 95113 - RNA, 22 nt, Human
cugccaggagaggccagggccc

SEQ ID NO: 95114 - RNA, 22 nt, Human
cuuccugcaacaccuguguugc

SEQ ID NO: 95115 - RNA, 22 nt, Human
cugcagauaaguguuuugaaaa

SEQ ID NO: 95116 - RNA, 22 nt, Human
cugcagauguagcugcuuuccu

SEQ ID NO: 95117 - RNA, 22 nt, Human
cugcaucacagcaggaggcaca

SEQ ID NO: 95118 - RNA, 22 nt, Human
cugccacuaccaugcuggauga

SEQ ID NO: 95119 - RNA, 22 nt, Human
cuucauccguaccacggccaca

SEQ ID NO: 95120 - RNA, 22 nt, Human
cuucaggaccugaagcccaucu

SEQ ID NO: 95121 - RNA, 22 nt, Human
cugauguuuaucucaagaguuc

SEQ ID NO: 95122 - RNA, 22 nt, Human
cugaugucaaauuuaucaaagc

SEQ ID NO: 95123 - RNA, 21 nt, Human
cugauguaccucaagccuagu

SEQ ID NO: 95124 - RNA, 22 nt, Human
cuucauuucaggcugaagaaua

SEQ ID NO: 95125 - RNA, 22 nt, Human
cuucauuacagcaaccauuuga

SEQ ID NO: 95126 - RNA, 22 nt, Human
cuuccauucugauggcuaauua

SEQ ID NO: 95127 - RNA, 22 nt, Human
cugcacagucauuuccucucaa

SEQ ID NO: 95128 - RNA, 22 nt, Human
cugcacuggguacauagaaaca

SEQ ID NO: 95129 - RNA, 22 nt, Human
cugauuucaaauggugcuagau

SEQ ID NO: 95130 - RNA, 22 nt, Human
cugauuguagccacugugauga

SEQ ID NO: 95131 - RNA, 22 nt, Human
gaagaagagauaauggggagca

SEQ ID NO: 95132 - RNA, 22 nt, Human
gaacuuuaauuagcuuuugucu

SEQ ID NO: 95133 - RNA, 22 nt, Human
gagcaggcuggcagggccaggg

SEQ ID NO: 95134 - RNA, 22 nt, Human
gaagaugcugcuuguucacggg

SEQ ID NO: 95135 - RNA, 22 nt, Human
gaagaaggaagaucaugcuuga

SEQ ID NO: 95136 - RNA, 22 nt, Human
gagcagucuuugaaaggcacca

SEQ ID NO: 95137 - RNA, 22 nt, Human
gagcaggucuuugguaaugcuu

SEQ ID NO: 95138 - RNA, 22 nt, Human
gagcacugagcuggaauuggag

SEQ ID NO: 95139 - RNA, 22 nt, Human
gagcaacacauugaaugaggau

SEQ ID NO: 95140 - RNA, 22 nt, Human
gaacauuucugcagaugucuga

SEQ ID NO: 95141 - RNA, 22 nt, Human
gagcagcacagaccaaacagaa

SEQ ID NO: 95142 - RNA, 22 nt, Human
gagcagacugcacaguucuugc

SEQ ID NO: 95143 - RNA, 22 nt, Human
gaacucuugguggucauuagau

SEQ ID NO: 95144 - RNA, 22 nt, Human
gaaccuggcagcccuauaucug

SEQ ID NO: 95145 - RNA, 22 nt, Human
gaacugaauguguaauguuggc

SEQ ID NO: 95146 - RNA, 22 nt, Human
gagcagcaggccagguugcagg

SEQ ID NO: 95147 - RNA, 22 nt, Human
gagauuugaguuccuacugagu

SEQ ID NO: 95148 - RNA, 22 nt, Human
gaacagauucaucuaguggcua

SEQ ID NO: 95149 - RNA, 22 nt, Human
gaacaaggauucccaaagaaga

SEQ ID NO: 95150 - RNA, 22 nt, Human
gagaucuguguuugcugaagcu

SEQ ID NO: 95151 - RNA, 22 nt, Human
gagauuucauuugugaggcuca

SEQ ID NO: 95152 - RNA, 22 nt, Human
gagauuuccauauuuuguaaca

SEQ ID NO: 95153 - RNA, 22 nt, Human
gaacaaaagauagcccaaacau

SEQ ID NO: 95154 - RNA, 22 nt, Human
gaaaugggggcaugcguuacau

SEQ ID NO: 95155 - RNA, 22 nt, Human
gaaauuucuuuguuaucuuggu

SEQ ID NO: 95156 - RNA, 22 nt, Human
gaaauguacuuauagggagguu

SEQ ID NO: 95157 - RNA, 22 nt, Human
gaaaugucaagauauguuugga

SEQ ID NO: 95158 - RNA, 22 nt, Human
gaaaucuggugauuuucuguug

SEQ ID NO: 95159 - RNA, 22 nt, Human
gagaggugaagcuaauuaauuu

SEQ ID NO: 95160 - RNA, 22 nt, Human
gaaagugaauguaacauguuau

SEQ ID NO: 95161 - RNA, 22 nt, Human
gagagauacauucccaaccuga

SEQ ID NO: 95162 - RNA, 22 nt, Human
gagaagugaauaacgaagcagg

SEQ ID NO: 95163 - RNA, 22 nt, Human
gaaaaguauuaugugaggguuc

SEQ ID NO: 95164 - RNA, 22 nt, Human
gagaagucaggaguggagaaca

SEQ ID NO: 95165 - RNA, 22 nt, Human
gaaagggggcuuggacacuggc

SEQ ID NO: 95166 - RNA, 22 nt, Human
gaaagcuuggaaacgacuuuau

SEQ ID NO: 95167 - RNA, 22 nt, Human
gaaaccauggcaaccagguccu

SEQ ID NO: 95168 - RNA, 22 nt, Human
gaaacguuguggaaaauccucu

SEQ ID NO: 95169 - RNA, 22 nt, Human
gaaagagaugucguuugucuuc

SEQ ID NO: 95170 - RNA, 22 nt, Human
gaaaagaaaggaugguaugugu

SEQ ID NO: 95171 - RNA, 22 nt, Human
gaaaagaaggcaggagcccaag

SEQ ID NO: 95172 - RNA, 22 nt, Human
gaaaaagucuuaaaguaaggca

SEQ ID NO: 95173 - RNA, 22 nt, Human
gacuucuuaaagaggugaggaa

SEQ ID NO: 95174 - RNA, 23 nt, Human
gacuucacacucucaaccacugc

SEQ ID NO: 95175 - RNA, 22 nt, Human
gacugucaaauaaaucguuuac

SEQ ID NO: 95176 - RNA, 22 nt, Human
gacuggcucuaucaggauaaau

SEQ ID NO: 95177 - RNA, 22 nt, Human
gacuggggcauuagaguagcuu

SEQ ID NO: 95178 - RNA, 22 nt, Human
cuuuaagugaaaggggauuaaa

SEQ ID NO: 95179 - RNA, 22 nt, Human
cuuguuaaaagugacccuaaug

SEQ ID NO: 95180 - RNA, 18 nt, Human
gacaaaaguacagacaga

SEQ ID NO: 95181 - RNA, 19 nt, Human
gaauugcacgagcagaggc

SEQ ID NO: 95182 - RNA, 22 nt, Human
cuuuacauuaauuucuacugau

SEQ ID NO: 95183 - RNA, 22 nt, Human
gaccacugaaugcacuucuaau

SEQ ID NO: 95184 - RNA, 22 nt, Human
gacccgacaaguaaucagguga

SEQ ID NO: 95185 - RNA, 22 nt, Human
gaccagaacuucuagucuaagu

SEQ ID NO: 95186 - RNA, 21 nt, Human
gacuacaauauguaaucuaau

SEQ ID NO: 95187 - RNA, 19 nt, Human
gacuccugagaugugaaac

SEQ ID NO: 95188 - RNA, 22 nt, Human
cuuuuucuugugguuaauaucu

SEQ ID NO: 95189 - RNA, 22 nt, Human
cuuuucaaacaggacagguccu

SEQ ID NO: 95190 - RNA, 22 nt, Human
gaaugccugggguucuucgauc

SEQ ID NO: 95191 - RNA, 22 nt, Human
gaauggagaacccuggacacug

SEQ ID NO: 95192 - RNA, 22 nt, Human
gaauggaugcuggucaguuugg

SEQ ID NO: 95193 - RNA, 22 nt, Human
cuuggugagcuccuggcgcagc

SEQ ID NO: 95194 - RNA, 22 nt, Human
gaaugacuugcucauucugugu

SEQ ID NO: 95195 - RNA, 22 nt, Human
cuuggcacauuuuguucuucug

SEQ ID NO: 95196 - RNA, 22 nt, Human
cuuggcacccaucuuuccaccu

SEQ ID NO: 95197 - RNA, 22 nt, Human
cuugcuuuaucugguuucucau

SEQ ID NO: 95198 - RNA, 22 nt, Human
cuuggagauacagaggacauuu

SEQ ID NO: 95199 - RNA, 22 nt, Human
cuugcugggagagcuuuagaga

SEQ ID NO: 95200 - RNA, 22 nt, Human
cuugcuguccgaugggucugua

SEQ ID NO: 95201 - RNA, 22 nt, Human
cuucuuugacucacugguacgc

SEQ ID NO: 95202 - RNA, 22 nt, Human
cuucuugggaggggcggagcuc

SEQ ID NO: 95203 - RNA, 22 nt, Human
gaaguaaugugauugcucaggg

SEQ ID NO: 95204 - RNA, 21 nt, Human
gaaguagcucugagaaaagug

SEQ ID NO: 95205 - RNA, 22 nt, Human
gaauaauuuugaucagaaggga

SEQ ID NO: 95206 - RNA, 22 nt, Human
gaauacaagccugccaccugga

SEQ ID NO: 95207 - RNA, 22 nt, Human
gaauauuuaucucagcugcaga

SEQ ID NO: 95208 - RNA, 22 nt, Human
cuugcucugggaauaugaguuu

SEQ ID NO: 95209 - RNA, 20 nt, Human
gaaucuggucaaaugucuau

SEQ ID NO: 95210 - RNA, 22 nt, Human
cuucaguuaguuucaugugagc

SEQ ID NO: 95211 - RNA, 22 nt, Human
gaagcgucaugaaagaaaggcu

SEQ ID NO: 95212 - RNA, 22 nt, Human
gaagcccuggaggggcuggagg

SEQ ID NO: 95213 - RNA, 22 nt, Human
gaagcggguucacuggauggcu

SEQ ID NO: 95214 - RNA, 22 nt, Human
gaagcuucgaaagagugauuuc

SEQ ID NO: 95215 - RNA, 21 nt, Human
gaagcugcuaugaagggggac

SEQ ID NO: 95216 - RNA, 19 nt, Human
cuucaguguucaccuggcc

SEQ ID NO: 95217 - RNA, 22 nt, Human
cuuccagugcauagguagauca

SEQ ID NO: 95218 - RNA, 22 nt, Human
cuucccuaagggacuggcauag

SEQ ID NO: 95219 - RNA, 22 nt, Human
cuuccguuacugacaaaauguu

SEQ ID NO: 95220 - RNA, 22 nt, Human
gaaggagaggauugugaggcug

SEQ ID NO: 95221 - RNA, 22 nt, Human
gaaggaagcugucuggaugugu

SEQ ID NO: 95222 - RNA, 22 nt, Human
gaaggauaauuuugcuggaugu

SEQ ID NO: 95223 - RNA, 22 nt, Human
cuuccacucaguuuuucauugc

SEQ ID NO: 95224 - RNA, 22 nt, Human
gaaggcaguaaauggcuguuuu

SEQ ID NO: 95225 - RNA, 22 nt, Human
cuucucuuugacaguugggugu

SEQ ID NO: 95226 - RNA, 22 nt, Human
cuucccugucuacaacccugcc

SEQ ID NO: 95227 - RNA, 22 nt, Human
cuucuguguggauacagucccu

SEQ ID NO: 95228 - RNA, 22 nt, Human
cuucagcgucgucaguguugcu

SEQ ID NO: 95229 - RNA, 22 nt, Human
cuuaagacaggcucaaagauua

SEQ ID NO: 95230 - RNA, 23 nt, Human
cuuauauaaucauuagaaaccau

SEQ ID NO: 95231 - RNA, 20 nt, Human
cuuaugcaaaauguuaggga

SEQ ID NO: 95232 - RNA, 22 nt, Human
gaacauauuuagcaccuaauau

SEQ ID NO: 95233 - RNA, 22 nt, Human
cuguuuggcuuccacugcuucu

SEQ ID NO: 95234 - RNA, 22 nt, Human
gaacaugaguuuuaugguauuu

SEQ ID NO: 95235 - RNA, 22 nt, Human
cuguuucuuugcugucagagag

SEQ ID NO: 95236 - RNA, 20 nt, Human
cuguuugcuaucaugagcug

SEQ ID NO: 95237 - RNA, 20 nt, Human
cuguucucuugccacaugag

SEQ ID NO: 95238 - RNA, 22 nt, Human
cuguucuccacuccugacuucu

SEQ ID NO: 95239 - RNA, 22 nt, Human
cuguggaguccuggggaaugga

SEQ ID NO: 95240 - RNA, 22 nt, Human
cuguggcuaggaagcuguggga

SEQ ID NO: 95241 - RNA, 22 nt, Human
gaaaggagacugcacuggagcc

SEQ ID NO: 95242 - RNA, 22 nt, Human
cugugcuugcugugcuggggcc

SEQ ID NO: 95243 - RNA, 22 nt, Human
cuguggaaugcaguugcgagca

SEQ ID NO: 95244 - RNA, 22 nt, Human
cugugcuguuaagaaauuuagu

SEQ ID NO: 95245 - RNA, 22 nt, Human
cuguguugggauggugcgcgca

SEQ ID NO: 95246 - RNA, 22 nt, Human
cugugugugcacacguguaugg

SEQ ID NO: 95247 - RNA, 22 nt, Human
cuguguggccuaaguggagaca

SEQ ID NO: 95248 - RNA, 22 nt, Human
gaaauagagacaguaagugucu

SEQ ID NO: 95249 - RNA, 22 nt, Human
cugugucucccaaggaggguca

SEQ ID NO: 95250 - RNA, 19 nt, Human
cuuugugguuuucagaacu

SEQ ID NO: 95251 - RNA, 22 nt, Human
cuuuuaaucuaauuuuuauauu

SEQ ID NO: 95252 - RNA, 22 nt, Human
cuuugugcagcagaaaugugug

SEQ ID NO: 95253 - RNA, 22 nt, Human
cuuuggggcugaggaggagguu

SEQ ID NO: 95254 - RNA, 22 nt, Human
cuggauuaaacaguuugauacu

SEQ ID NO: 95255 - RNA, 22 nt, Human
cuggccaggugggggguagugg

SEQ ID NO: 95256 - RNA, 22 nt, Human
gaaagcauucuggaggggcaga

SEQ ID NO: 95257 - RNA, 22 nt, Human
cuggcccugucagcacagaauc

SEQ ID NO: 95258 - RNA, 22 nt, Human
cuggccugugggcugucuccgg

SEQ ID NO: 95259 - RNA, 22 nt, Human
cugacacagccauuguccuugu

SEQ ID NO: 95260 - RNA, 22 nt, Human
cugaaucaaaugacuuagccau

SEQ ID NO: 95261 - RNA, 20 nt, Human
cugaauaccacagagccauc

SEQ ID NO: 95262 - RNA, 22 nt, Human
cugaaggacacgugaggagcca

SEQ ID NO: 95263 - RNA, 22 nt, Human
cgggucgagugcuguaguucga

SEQ ID NO: 95264 - RNA, 22 nt, Human
cggggugugacggugcgggccu

SEQ ID NO: 95265 - RNA, 22 nt, Human
cggucuauuguguaucauuuca

SEQ ID NO: 95266 - RNA, 19 nt, Human
cggugaagagaguuuagau

SEQ ID NO: 95267 - RNA, 22 nt, Human
cgggcacucagggucgaggugg

SEQ ID NO: 95268 - RNA, 22 nt, Human
cgggagcagcucuggggcuggg

SEQ ID NO: 95269 - RNA, 22 nt, Human
cgggaggcggagcuccgcgggg

SEQ ID NO: 95270 - RNA, 22 nt, Human
cgggaaguaaacauuauuucag

SEQ ID NO: 95271 - RNA, 22 nt, Human
cugaaagcaaaguaauucuuaa

SEQ ID NO: 95272 - RNA, 23 nt, Human
cugaaauucagaugcuaaagaua

SEQ ID NO: 95273 - RNA, 22 nt, Human
cugaaagacgaggggaagucgg

SEQ ID NO: 95274 - RNA, 22 nt, Human
cggggaggagccagcggaggau

SEQ ID NO: 95275 - RNA, 22 nt, Human
cggggcggcgagcgggccgggc

SEQ ID NO: 95276 - RNA, 22 nt, Human
cucuuuuuuugucuuaagaacc

SEQ ID NO: 95277 - RNA, 22 nt, Human
cugaaagacagccaggcaaagc

SEQ ID NO: 95278 - RNA, 22 nt, Human
cugaaacucaagauaggaggaa

SEQ ID NO: 95279 - RNA, 22 nt, Human
cggcggcgaaccgaccugggug

SEQ ID NO: 95280 - RNA, 20 nt, Human
cucuuucugcuuuaugccuc

SEQ ID NO: 95281 - RNA, 22 nt, Human
cucuuuuuccuaugaaaucuau

SEQ ID NO: 95282 - RNA, 20 nt, Human
cucuuuaugagaccacuguc

SEQ ID NO: 95283 - RNA, 22 nt, Human
cucuucugugggugcuauguca

SEQ ID NO: 95284 - RNA, 19 nt, Human
cucuucauuggaggguuga

SEQ ID NO: 95285 - RNA, 22 nt, Human
cucuugugucaccauggauaaa

SEQ ID NO: 95286 - RNA, 17 nt, Human
cucugggucuccugcuu

SEQ ID NO: 95287 - RNA, 22 nt, Human
cucuggggaagugcacucgcug

SEQ ID NO: 95288 - RNA, 22 nt, Human
cucuguauauugagugcuuacu

SEQ ID NO: 95289 - RNA, 22 nt, Human
cucugguuucgcaggaaauaga

SEQ ID NO: 95290 - RNA, 22 nt, Human
cucuuauaaagaugucucuguu

SEQ ID NO: 95291 - RNA, 22 nt, Human
cucuguugucaguggaagcagc

SEQ ID NO: 95292 - RNA, 20 nt, Human
cucugggaggcuugucaccu

SEQ ID NO: 95293 - RNA, 22 nt, Human
cucuggcaacgauggugcuuau

SEQ ID NO: 95294 - RNA, 22 nt, Human
cucuggagggaggcugagcugg

SEQ ID NO: 95295 - RNA, 22 nt, Human
cucugcuuguaucacauuugcu

SEQ ID NO: 95296 - RNA, 18 nt, Human
cucuggacagcaggcauc

SEQ ID NO: 95297 - RNA, 22 nt, Human
cucguccugguuuaaguguccu

SEQ ID NO: 95298 - RNA, 22 nt, Human
cucggagggcaaguacuggcug

SEQ ID NO: 95299 - RNA, 22 nt, Human
cucaugcugcaaauggcuguuu

SEQ ID NO: 95300 - RNA, 22 nt, Human
cggacugaccugcucggggaga

SEQ ID NO: 95301 - RNA, 22 nt, Human
cgcuucauugugggggccccca

SEQ ID NO: 95302 - RNA, 22 nt, Human
cgcuuugguaauagggcagccu

SEQ ID NO: 95303 - RNA, 22 nt, Human
cuccaguugugucuuguaagaa

SEQ ID NO: 95304 - RNA, 22 nt, Human
cuccccauuuucaugggcaggu

SEQ ID NO: 95305 - RNA, 22 nt, Human
cucaggugagcgagcuaaauua

SEQ ID NO: 95306 - RNA, 22 nt, Human
cuccuggagcagcaggcgcagg

SEQ ID NO: 95307 - RNA, 22 nt, Human
cuauugguaucacacugauuuc

SEQ ID NO: 95308 - RNA, 22 nt, Human
cuauuauuauugucguuuuaca

SEQ ID NO: 95309 - RNA, 22 nt, Human
cuauuuucccauaugguugaca

SEQ ID NO: 95310 - RNA, 22 nt, Human
cucaccugccuccccgcccucc

SEQ ID NO: 95311 - RNA, 22 nt, Human
cucagaagaacaaaggcucuac

SEQ ID NO: 95312 - RNA, 22 nt, Human
cucaggaaaauauugaagaagu

SEQ ID NO: 95313 - RNA, 22 nt, Human
cgcucugccugcccuaacuucc

SEQ ID NO: 95314 - RNA, 22 nt, Human
cucagaugaugucuucagggaa

SEQ ID NO: 95315 - RNA, 22 nt, Human
cucagaugcacacaggugaggg

SEQ ID NO: 95316 - RNA, 22 nt, Human
cucagcaacccacacacggucu

SEQ ID NO: 95317 - RNA, 22 nt, Human
cgcugcagcggcugagucccgc

SEQ ID NO: 95318 - RNA, 22 nt, Human
cuaugaaucaauuucugcaguu

SEQ ID NO: 95319 - RNA, 22 nt, Human
cuauguuuugcuagugaugggu

SEQ ID NO: 95320 - RNA, 22 nt, Human
cgccuggccccgcagcgcuugu

SEQ ID NO: 95321 - RNA, 22 nt, Human
cuacaaggucuuuaucugcuuu

SEQ ID NO: 95322 - RNA, 22 nt, Human
cuaauuguaagcuccuugaggg

SEQ ID NO: 95323 - RNA, 21 nt, Human
cuauaaaaaugguucuuugcg

SEQ ID NO: 95324 - RNA, 22 nt, Human
cuaaugaaaugauggcuccuac

SEQ ID NO: 95325 - RNA, 22 nt, Human
cgacuacuaacuacuguagaaa

SEQ ID NO: 95326 - RNA, 22 nt, Human
cguucccuccugccacgggagg

SEQ ID NO: 95327 - RNA, 22 nt, Human
cguuugagggaguuggaacugc

SEQ ID NO: 95328 - RNA, 22 nt, Human
cuaaaaauguucuaguaguuca

SEQ ID NO: 95329 - RNA, 22 nt, Human
ccuuuuguuucccuuuauguuc

SEQ ID NO: 95330 - RNA, 22 nt, Human
cgaaggaaucacuuaacacuuu

SEQ ID NO: 95331 - RNA, 22 nt, Human
cgacagauuauuuugugacugc

SEQ ID NO: 95332 - RNA, 22 nt, Human
cuaagaaggaggaaaagugcca

SEQ ID NO: 95333 - RNA, 22 nt, Human
cuaauaauuuacugagugcuac

SEQ ID NO: 95334 - RNA, 22 nt, Human
cuaagguacuugaugcacauau

SEQ ID NO: 95335 - RNA, 22 nt, Human
cggucggagagaaugaccugga

SEQ ID NO: 95336 - RNA, 22 nt, Human
cgggucgcacaggagaaaggcg

SEQ ID NO: 95337 - RNA, 19 nt, Human
cggugcugauuggugcagu

SEQ ID NO: 95338 - RNA, 22 nt, Human
cgguggcccauuguacgcagcu

SEQ ID NO: 95339 - RNA, 22 nt, Human
cgguugcaggaugugcgggcag

SEQ ID NO: 95340 - RNA, 22 nt, Human
ccuuuuagagaagugcauccag

SEQ ID NO: 95341 - RNA, 22 nt, Human
ccuuuuaucgcgaagaacucca

SEQ ID NO: 95342 - RNA, 21 nt, Human
ccuuuggagacugcagcaaug

SEQ ID NO: 95343 - RNA, 22 nt, Human
cgguuuuuaaaagucucuucua

SEQ ID NO: 95344 - RNA, 22 nt, Human
cgucagccacagcugccccggg

SEQ ID NO: 95345 - RNA, 22 nt, Human
cgugcaggagcuggagguccga

SEQ ID NO: 95346 - RNA, 22 nt, Human
cggggcaaggggggcuggugga

SEQ ID NO: 95347 - RNA, 22 nt, Human
ccugucuuuucugaucauacua

SEQ ID NO: 95348 - RNA, 22 nt, Human
ccugugacucugucugaugguc

SEQ ID NO: 95349 - RNA, 23 nt, Human
ccuggcugaccugaagguguagu

SEQ ID NO: 95350 - RNA, 20 nt, Human
ccugggcuccaggagccccg

SEQ ID NO: 95351 - RNA, 22 nt, Human
ccugggcauaaaucacuccaag

SEQ ID NO: 95352 - RNA, 22 nt, Human
ccugggugaugugcugcccucg

SEQ ID NO: 95353 - RNA, 22 nt, Human
ccuggggcucugcacagagcag

SEQ ID NO: 95354 - RNA, 22 nt, Human
ccuguuuguucauguacuguga

SEQ ID NO: 95355 - RNA, 22 nt, Human
cggggcuggcguuagggaggca

SEQ ID NO: 95356 - RNA, 19 nt, Human
cggggcuugguggguucuc

SEQ ID NO: 95357 - RNA, 22 nt, Human
cggggcgggcgugggaggugga

SEQ ID NO: 95358 - RNA, 18 nt, Human
ccuucaucucugcuucuu

SEQ ID NO: 95359 - RNA, 19 nt, Human
cgguaugaauguacuaugg

SEQ ID NO: 95360 - RNA, 22 nt, Human
cgggguguggggcgguagugug

SEQ ID NO: 95361 - RNA, 22 nt, Human
cgcgcuuugggcaguguggcug

SEQ ID NO: 95362 - RNA, 22 nt, Human
cgcucggcuuucccuccgccgg

SEQ ID NO: 95363 - RNA, 22 nt, Human
cgcucggugagccaguggcgga

SEQ ID NO: 95364 - RNA, 22 nt, Human
cggaagcacuagacacugacac

SEQ ID NO: 95365 - RNA, 22 nt, Human
ccugauauggugucauuuaaac

SEQ ID NO: 95366 - RNA, 22 nt, Human
ccugcacuaccuggggcugcug

SEQ ID NO: 95367 - RNA, 22 nt, Human
ccugcaguagagguugguaggg

SEQ ID NO: 95368 - RNA, 22 nt, Human
ccucuuugcccucuuuccuucc

SEQ ID NO: 95369 - RNA, 22 nt, Human
ccugaagaugguugauccccuu

SEQ ID NO: 95370 - RNA, 22 nt, Human
cgcgcgguguuccgcauucugc

SEQ ID NO: 95371 - RNA, 22 nt, Human
ccugaccauuugccacaugggu

SEQ ID NO: 95372 - RNA, 22 nt, Human
ccugcucccccugcaagccuug

SEQ ID NO: 95373 - RNA, 22 nt, Human
cggcccggccucgcggcgcaug

SEQ ID NO: 95374 - RNA, 22 nt, Human
ccugcaguuuuuccaugauaca

SEQ ID NO: 95375 - RNA, 21 nt, Human
ccugcacuucccuccucaagu

SEQ ID NO: 95376 - RNA, 22 nt, Human
cggccuuuggcuucuccugugu

SEQ ID NO: 95377 - RNA, 22 nt, Human
cggcgcugguacaguggaagag

SEQ ID NO: 95378 - RNA, 22 nt, Human
ccugcugagccuggugggcagc

SEQ ID NO: 95379 - RNA, 22 nt, Human
ccugcuggagucuaguuggucu

SEQ ID NO: 95380 - RNA, 18 nt, Human
ccugcguggauguccucu

SEQ ID NO: 95381 - RNA, 22 nt, Human
cgcauugcaauucaggggauaa

SEQ ID NO: 95382 - RNA, 22 nt, Human
cgccaaccaggcuguccuccca

SEQ ID NO: 95383 - RNA, 22 nt, Human
cgacgacaggcgcccgaggagg

SEQ ID NO: 95384 - RNA, 22 nt, Human
cgaccccugaaaauggcagcca

SEQ ID NO: 95385 - RNA, 19 nt, Human
cgacauggguaaugggaga

SEQ ID NO: 95386 - RNA, 22 nt, Human
ccucaguguguggauguuagag

SEQ ID NO: 95387 - RNA, 22 nt, Human
ccgcaccgucugccauacacgc

SEQ ID NO: 95388 - RNA, 22 nt, Human
ccgcagucugcaaucucccugg

SEQ ID NO: 95389 - RNA, 22 nt, Human
ccugcugcugaugcuguuucac

SEQ ID NO: 95390 - RNA, 22 nt, Human
ccugcucuaauucauucaugcu

SEQ ID NO: 95391 - RNA, 22 nt, Human
ccgccacggggcaugggaggca

SEQ ID NO: 95392 - RNA, 22 nt, Human
ccucaauucgugccucacauug

SEQ ID NO: 95393 - RNA, 22 nt, Human
ccucaggaauuuauucuucugu

SEQ ID NO: 95394 - RNA, 22 nt, Human
ccucagcuguuucucucaucag

SEQ ID NO: 95395 - RNA, 22 nt, Human
ccugcaugacuuugucagaccu

SEQ ID NO: 95396 - RNA, 19 nt, Human
ccugcugaagugaugcagc

SEQ ID NO: 95397 - RNA, 22 nt, Human
ccugccugggcucacuugccag

SEQ ID NO: 95398 - RNA, 22 nt, Human
ccugccagaaaagagggaguuc

SEQ ID NO: 95399 - RNA, 22 nt, Human
ccugccagccugccaucccaca

SEQ ID NO: 95400 - RNA, 22 nt, Human
cccugcacuguguggacucugg

SEQ ID NO: 95401 - RNA, 22 nt, Human
cccugcuuccucuucuguuugu

SEQ ID NO: 95402 - RNA, 22 nt, Human
cccuggacuccauuuucccgua

SEQ ID NO: 95403 - RNA, 22 nt, Human
ccugacuugguuuaggagaugg

SEQ ID NO: 95404 - RNA, 22 nt, Human
ccugacucugauuucgcugcau

SEQ ID NO: 95405 - RNA, 22 nt, Human
ccugacgcugauauauaguuaa

SEQ ID NO: 95406 - RNA, 22 nt, Human
cccugggccccgaacugcugag

SEQ ID NO: 95407 - RNA, 22 nt, Human
cccuggcucaggcagcuuuguu

SEQ ID NO: 95408 - RNA, 22 nt, Human
ccugaguucuuauuuccaguca

SEQ ID NO: 95409 - RNA, 22 nt, Human
cccuggucucugacuugauccu

SEQ ID NO: 95410 - RNA, 22 nt, Human
ccugaggcccuggcugugcuga

SEQ ID NO: 95411 - RNA, 22 nt, Human
cccgccggccacaccggccgcc

SEQ ID NO: 95412 - RNA, 21 nt, Human
ccuccagccagagggucugga

SEQ ID NO: 95413 - RNA, 22 nt, Human
ccuccccugccugugcuguugg

SEQ ID NO: 95414 - RNA, 21 nt, Human
ccuaugucucaaagguucucc

SEQ ID NO: 95415 - RNA, 18 nt, Human
ccuccccuguggaggucc

SEQ ID NO: 95416 - RNA, 22 nt, Human
ccuccgguucucagggcuccac

SEQ ID NO: 95417 - RNA, 22 nt, Human
cccggagcagucgggcuccggg

SEQ ID NO: 95418 - RNA, 22 nt, Human
cccgcucaccccacuccaccag

SEQ ID NO: 95419 - RNA, 22 nt, Human
cccgcuaaaucaguucugaguc

SEQ ID NO: 95420 - RNA, 22 nt, Human
cccguggugggaugacaccaug

SEQ ID NO: 95421 - RNA, 22 nt, Human
cccgggccgagucuuccagcga

SEQ ID NO: 95422 - RNA, 22 nt, Human
cccgggcucuggcagaggcggu

SEQ ID NO: 95423 - RNA, 22 nt, Human
cccgguugggguuccagggcgc

SEQ ID NO: 95424 - RNA, 22 nt, Human
cccgguggagaugugggacagg

SEQ ID NO: 95425 - RNA, 22 nt, Human
cccgggucugugugaaauucca

SEQ ID NO: 95426 - RNA, 22 nt, Human
cccugauaaaucagcaccucag

SEQ ID NO: 95427 - RNA, 22 nt, Human
ccugacagcgugucccuggccc

SEQ ID NO: 95428 - RNA, 22 nt, Human
ccugaauuuaucugaauggugg

SEQ ID NO: 95429 - RNA, 22 nt, Human
ccugaaaugaguucugcucacu

SEQ ID NO: 95430 - RNA, 22 nt, Human
ccggcugcugaggcggccccgg

SEQ ID NO: 95431 - RNA, 22 nt, Human
cccagccgcuguggucuagggu

SEQ ID NO: 95432 - RNA, 22 nt, Human
ccggcggaaacauggcggcgcc

SEQ ID NO: 95433 - RNA, 22 nt, Human
ccggauuugggagccaccaggg

SEQ ID NO: 95434 - RNA, 22 nt, Human
cccagccgaaugcucccuuccc

SEQ ID NO: 95435 - RNA, 22 nt, Human
ccggcugagccucgccgcggcc

SEQ ID NO: 95436 - RNA, 22 nt, Human
ccggcggguggagcaugcgcgg

SEQ ID NO: 95437 - RNA, 19 nt, Human
ccggucaugcauuccuuug

SEQ ID NO: 95438 - RNA, 22 nt, Human
cccaggccguguaaucagcagc

SEQ ID NO: 95439 - RNA, 22 nt, Human
cccagcugaacuugcauuccaa

SEQ ID NO: 95440 - RNA, 22 nt, Human
cccagcuggcaaaggcguccuu

SEQ ID NO: 95441 - RNA, 22 nt, Human
cccagcuuugcggacccgggag

SEQ ID NO: 95442 - RNA, 22 nt, Human
cccagcgccugcccuccgccgc

SEQ ID NO: 95443 - RNA, 22 nt, Human
cccaggaaugagcaggcagggg

SEQ ID NO: 95444 - RNA, 22 nt, Human
ccgcgcccccggcugugccccc

SEQ ID NO: 95445 - RNA, 22 nt, Human
ccgccucucgcucccagcuugc

SEQ ID NO: 95446 - RNA, 22 nt, Human
cccagaagaguauguguuugcu

SEQ ID NO: 95447 - RNA, 22 nt, Human
ccgcgggcagggcuucaccuuu

SEQ ID NO: 95448 - RNA, 22 nt, Human
ccgcggauggggagucaccacc

SEQ ID NO: 95449 - RNA, 22 nt, Human
cccagaaugauucagcgacagu

SEQ ID NO: 95450 - RNA, 22 nt, Human
cccacgccuucuuucuucaaau

SEQ ID NO: 95451 - RNA, 22 nt, Human
cccagaccagagugccuggacg

SEQ ID NO: 95452 - RNA, 22 nt, Human
cccagagacuuuguccgacgac

SEQ ID NO: 95453 - RNA, 22 nt, Human
cccagcccaucauuccugcaaa

SEQ ID NO: 95454 - RNA, 22 nt, Human
ccgcuggaagcgaguggugggc

SEQ ID NO: 95455 - RNA, 22 nt, Human
ccguccgcuccuccagccgcug

SEQ ID NO: 95456 - RNA, 22 nt, Human
cccaucugugaaauggggcugc

SEQ ID NO: 95457 - RNA, 22 nt, Human
ccgugccuuuaguuucuucugu

SEQ ID NO: 95458 - RNA, 22 nt, Human
ccccagugguugcaacagcaga

SEQ ID NO: 95459 - RNA, 22 nt, Human
cccauggacuagcuaugagcag

SEQ ID NO: 95460 - RNA, 22 nt, Human
cccauuuuuuggauguguggau

SEQ ID NO: 95461 - RNA, 22 nt, Human
ccccaguuccugucaaggguaa

SEQ ID NO: 95462 - RNA, 22 nt, Human
ccccauggaaaacccaccuagg

SEQ ID NO: 95463 - RNA, 22 nt, Human
ccccucuguagcccgagcugcu

SEQ ID NO: 95464 - RNA, 21 nt, Human
ccguuauucuucccaccccca

SEQ ID NO: 95465 - RNA, 22 nt, Human
ccuaauuuuagacccacuccua

SEQ ID NO: 95466 - RNA, 23 nt, Human
ccccugcauggcaccacauuccc

SEQ ID NO: 95467 - RNA, 22 nt, Human
ccccugcucagggaggagaccg

SEQ ID NO: 95468 - RNA, 22 nt, Human
ccccuuucucccgcgucuggcc

SEQ ID NO: 95469 - RNA, 22 nt, Human
ccccuuguuuuauucaaauugg

SEQ ID NO: 95470 - RNA, 22 nt, Human
ccuauauuacaggcuugcucua

SEQ ID NO: 95471 - RNA, 22 nt, Human
ccuacguauuuugauauagaga

SEQ ID NO: 95472 - RNA, 22 nt, Human
ccucaucagaaagcagaaagca

SEQ ID NO: 95473 - RNA, 22 nt, Human
ccauuuggccauucaguuguuc

SEQ ID NO: 95474 - RNA, 22 nt, Human
ccauuuuccuguauggacucga

SEQ ID NO: 95475 - RNA, 18 nt, Human
cccaccugcccagguuca

SEQ ID NO: 95476 - RNA, 22 nt, Human
ccgauuuauucugacaguuuau

SEQ ID NO: 95477 - RNA, 22 nt, Human
ccgauuuaugucucugacuuga

SEQ ID NO: 95478 - RNA, 22 nt, Human
ccgcagggcccggcgggcucag

SEQ ID NO: 95479 - RNA, 22 nt, Human
ccauggccaauugcaccuugcu

SEQ ID NO: 95480 - RNA, 22 nt, Human
ccgagcagggcgcccugcccca

SEQ ID NO: 95481 - RNA, 22 nt, Human
ccauggaaaagacgggcaggcc

SEQ ID NO: 95482 - RNA, 22 nt, Human
ccaugauguugccuacacugcu

SEQ ID NO: 95483 - RNA, 22 nt, Human
ccaugaggcaaagacugauaua

SEQ ID NO: 95484 - RNA, 22 nt, Human
ccgaaccacacgacagugcuca

SEQ ID NO: 95485 - RNA, 22 nt, Human
ccauaaaguaggaaacacuaca

SEQ ID NO: 95486 - RNA, 22 nt, Human
ccgaaaaacagaaucuuggaac

SEQ ID NO: 95487 - RNA, 22 nt, Human
cccuuuuuuauggaguuggcca

SEQ ID NO: 95488 - RNA, 22 nt, Human
cccuucuguaucuucugaguuu

SEQ ID NO: 95489 - RNA, 22 nt, Human
ccauaaaagagaaucuaaauga

SEQ ID NO: 95490 - RNA, 22 nt, Human
ccagggaggucauagugcuggu

SEQ ID NO: 95491 - RNA, 22 nt, Human
ccagggcugcugccugggcugg

SEQ ID NO: 95492 - RNA, 17 nt, Human
cccugcacccuacucuc

SEQ ID NO: 95493 - RNA, 22 nt, Human
ccaggggagagucugagucguu

SEQ ID NO: 95494 - RNA, 22 nt, Human
ccagucagccuaguucuucuuu

SEQ ID NO: 95495 - RNA, 22 nt, Human
ccagguuggccaccuucacggg

SEQ ID NO: 95496 - RNA, 22 nt, Human
ccagggucggcaucagcguggg

SEQ ID NO: 95497 - RNA, 22 nt, Human
ccagggcuggguuugucggugu

SEQ ID NO: 95498 - RNA, 22 nt, Human
ccagguggacggcgaguacagg

SEQ ID NO: 95499 - RNA, 22 nt, Human
ccaguggugcauguuugagcaa

SEQ ID NO: 95500 - RNA, 22 nt, Human
cccuguccuucccuccaucuga

SEQ ID NO: 95501 - RNA, 22 nt, Human
ccagugcuuccaggaauacggu

SEQ ID NO: 95502 - RNA, 22 nt, Human
cccuucauguagcugugugucc

SEQ ID NO: 95503 - RNA, 22 nt, Human
ccagugcagacgcggaacuggc

SEQ ID NO: 95504 - RNA, 22 nt, Human
ccagucuuggugucuguagcac

SEQ ID NO: 95505 - RNA, 22 nt, Human
ccagucugccggcccggccccu

SEQ ID NO: 95506 - RNA, 17 nt, Human
cccugcauugauccuca

SEQ ID NO: 95507 - RNA, 22 nt, Human
ccagugagauagugguauaugc

SEQ ID NO: 95508 - RNA, 20 nt, Human
cccuggcuggcaucuggacu

SEQ ID NO: 95509 - RNA, 20 nt, Human
cccuggaaugagaugcauau

SEQ ID NO: 95510 - RNA, 20 nt, Human
ccccagcauccuuuucaucu

SEQ ID NO: 95511 - RNA, 22 nt, Human
cccaugacucucauucacaguc

SEQ ID NO: 95512 - RNA, 22 nt, Human
ccagccacagcuuccagcuccu

SEQ ID NO: 95513 - RNA, 22 nt, Human
ccagcaucagcucuuggcuggc

SEQ ID NO: 95514 - RNA, 22 nt, Human
cccagcucuggaagguggggga

SEQ ID NO: 95515 - RNA, 20 nt, Human
caucaacaccuugucagccu

SEQ ID NO: 95516 - RNA, 22 nt, Human
cauuacaagaaauagcauaaug

SEQ ID NO: 95517 - RNA, 22 nt, Human
cauuaccuggggagaggauacc

SEQ ID NO: 95518 - RNA, 22 nt, Human
cauauuaugcauguuguucuuu

SEQ ID NO: 95519 - RNA, 22 nt, Human
ccagcagaagcucccgcugggu

SEQ ID NO: 95520 - RNA, 22 nt, Human
ccagcaagacucgcagugggau

SEQ ID NO: 95521 - RNA, 22 nt, Human
cccagccugaucucggccagcu

SEQ ID NO: 95522 - RNA, 22 nt, Human
cccagcaccauaacucaggccu

SEQ ID NO: 95523 - RNA, 22 nt, Human
ccccaguuucaccuaccccgcc

SEQ ID NO: 95524 - RNA, 22 nt, Human
ccagccugccaagcccagcccu

SEQ ID NO: 95525 - RNA, 22 nt, Human
ccagccuucugaugggacccuc

SEQ ID NO: 95526 - RNA, 22 nt, Human
ccagccugagcuugcugcccuc

SEQ ID NO: 95527 - RNA, 22 nt, Human
ccagcucgaggcaggggcugca

SEQ ID NO: 95528 - RNA, 19 nt, Human
cccgauggagacuuagcag

SEQ ID NO: 95529 - RNA, 22 nt, Human
cccgacuccuccugguaccuaa

SEQ ID NO: 95530 - RNA, 22 nt, Human
ccaggacuuauuacaguauaac

SEQ ID NO: 95531 - RNA, 22 nt, Human
cccgaaaauuguuguacugcag

SEQ ID NO: 95532 - RNA, 22 nt, Human
ccaggaguccgugggucuugag

SEQ ID NO: 95533 - RNA, 22 nt, Human
ccaggcagaggggucuggagca

SEQ ID NO: 95534 - RNA, 23 nt, Human
cccgggaagugcugcuuaucugg

SEQ ID NO: 95535 - RNA, 22 nt, Human
cccggcgccucguuuccuaguc

SEQ ID NO: 95536 - RNA, 22 nt, Human
ccaggcccugcuccucacacca

SEQ ID NO: 95537 - RNA, 22 nt, Human
ccagggagggccacagggccau

SEQ ID NO: 95538 - RNA, 22 nt, Human
ccagggaagaaagaugaagugc

SEQ ID NO: 95539 - RNA, 22 nt, Human
ccagggacuauuaguuguguau

SEQ ID NO: 95540 - RNA, 22 nt, Human
uuuuuuuccaguuauucauuuu

SEQ ID NO: 95541 - RNA, 22 nt, Human
uuuuugaauaagugcaucauca

SEQ ID NO: 95542 - RNA, 22 nt, Human
uuuuucuuugguaacucuuccu

SEQ ID NO: 95543 - RNA, 22 nt, Human
uuuuucuuugcuuuccacuggc

SEQ ID NO: 95544 - RNA, 22 nt, Human
uuuuucugacugcuaacaaaaa

SEQ ID NO: 95545 - RNA, 22 nt, Human
uuuuucuccucucucuuucauu

SEQ ID NO: 95546 - RNA, 21 nt, Human
uuuuucuccagaguuuccacu

SEQ ID NO: 95547 - RNA, 22 nt, Human
uuuuugcccuaaagaagucauu

SEQ ID NO: 95548 - RNA, 22 nt, Human
uuuuugcuuuuuugucaucuaa

SEQ ID NO: 95549 - RNA, 22 nt, Human
uuuuugggaagaauucugauau

SEQ ID NO: 95550 - RNA, 20 nt, Human
uuuuuuaaauagagcuguug

SEQ ID NO: 95551 - RNA, 22 nt, Human
uuuuuuaaucaaguaggaaaca

SEQ ID NO: 95552 - RNA, 22 nt, Human
uuuuuguuauuuagguguagag

SEQ ID NO: 95553 - RNA, 22 nt, Human
uuuuuuccugguuacagauugu

SEQ ID NO: 95554 - RNA, 22 nt, Human
uuuuuucuggaguuugggguuu

SEQ ID NO: 95555 - RNA, 22 nt, Human
uuuuuucuucucuaucuuaaua

SEQ ID NO: 95556 - RNA, 22 nt, Human
uuuuuuccuguuugucuuuggg

SEQ ID NO: 95557 - RNA, 22 nt, Human
uuuuuugguuuggggauuauuu

SEQ ID NO: 95558 - RNA, 22 nt, Human
uuuuuuguuccuugguuuuugu

SEQ ID NO: 95559 - RNA, 22 nt, Human
uuuuuuuaaguuuugauuuuag

SEQ ID NO: 95560 - RNA, 22 nt, Human
uuuuuuuagaaagaucauaguu

SEQ ID NO: 95561 - RNA, 18 nt, Human
uuuuuuguucuguuuugu

SEQ ID NO: 95562 - RNA, 22 nt, Human
uuuuaaauaaacuacacugauu

SEQ ID NO: 95563 - RNA, 22 nt, Human
uuuuaaaguaauugaagcuugu

SEQ ID NO: 95564 - RNA, 22 nt, Human
uuuuaaaagguugcuguuauaa

SEQ ID NO: 95565 - RNA, 22 nt, Human
uuuuaauaguauaucuagacac

SEQ ID NO: 95566 - RNA, 22 nt, Human
uuuuaaguauuuucuuuuuuua

SEQ ID NO: 95567 - RNA, 22 nt, Human
uuuuaacuuuaccauuucuuca

SEQ ID NO: 95568 - RNA, 22 nt, Human
uuuuaaucagguauuugaguau

SEQ ID NO: 95569 - RNA, 22 nt, Human
uuuuagagacagcauggagaaa

SEQ ID NO: 95570 - RNA, 22 nt, Human
uuuguuguauuaacccagggua

SEQ ID NO: 95571 - RNA, 22 nt, Human
uuuuagccagcaucugggucga

SEQ ID NO: 95572 - RNA, 22 nt, Human
uuuuagccagaguuuaucacag

SEQ ID NO: 95573 - RNA, 22 nt, Human
uuuuaucagagcuugcagugug

SEQ ID NO: 95574 - RNA, 22 nt, Human
uuuucacugacuuggucuggaa

SEQ ID NO: 95575 - RNA, 22 nt, Human
uuuucaguuccaucucugcucu

SEQ ID NO: 95576 - RNA, 22 nt, Human
uuuuaucuuacauggaaucucc

SEQ ID NO: 95577 - RNA, 22 nt, Human
uuuuauuuguauguugaaugua

SEQ ID NO: 95578 - RNA, 21 nt, Human
uuuguucacacacagggcagc

SEQ ID NO: 95579 - RNA, 22 nt, Human
uuuguguuuugaggucuugcaa

SEQ ID NO: 95580 - RNA, 22 nt, Human
uuuagagauaaaugcucuccca

SEQ ID NO: 95581 - RNA, 22 nt, Human
uuuguguuggaagaaaugcuac

SEQ ID NO: 95582 - RNA, 22 nt, Human
uuuaaugucuuuggccuuuaau

SEQ ID NO: 95583 - RNA, 22 nt, Human
uuuacuguuuacagcuaaugca

SEQ ID NO: 95584 - RNA, 19 nt, Human
uuuguuguaucagagcuuu

SEQ ID NO: 95585 - RNA, 22 nt, Human
uuuguucaccuagcaaacuuuu

SEQ ID NO: 95586 - RNA, 22 nt, Human
uuuguuuccagccuuuugucuu

SEQ ID NO: 95587 - RNA, 17 nt, Human
uuuguuucauacuucau

SEQ ID NO: 95588 - RNA, 22 nt, Human
uuuguuugcuaguauuuuguuu

SEQ ID NO: 95589 - RNA, 22 nt, Human
uuuucggagaauguuaaugugu

SEQ ID NO: 95590 - RNA, 22 nt, Human
uuuuccuucuuccugccuugcc

SEQ ID NO: 95591 - RNA, 22 nt, Human
uuuucucacugagagccuugau

SEQ ID NO: 95592 - RNA, 22 nt, Human
uuuucuacaaucacucuggaag

SEQ ID NO: 95593 - RNA, 22 nt, Human
uuuuccaaaaguggagaggaau

SEQ ID NO: 95594 - RNA, 22 nt, Human
uuuucauagccagaaacugaaa

SEQ ID NO: 95595 - RNA, 22 nt, Human
uuuucuguuuaugaaauugugu

SEQ ID NO: 95596 - RNA, 22 nt, Human
uuuucugauccuucuaacuuga

SEQ ID NO: 95597 - RNA, 22 nt, Human
uuuucuucucauucugaccuca

SEQ ID NO: 95598 - RNA, 22 nt, Human
uuuugcaaauuacuaaauuucu

SEQ ID NO: 95599 - RNA, 22 nt, Human
uuuugcuagaaaucaccaauac

SEQ ID NO: 95600 - RNA, 22 nt, Human
uuuugccuauuguaucaucgua

SEQ ID NO: 95601 - RNA, 22 nt, Human
uuuugaauaauucagaaacagc

SEQ ID NO: 95602 - RNA, 22 nt, Human
uuuugagucuggcaguuuuguu

SEQ ID NO: 95603 - RNA, 22 nt, Human
uuuugauacaaguuguaaaaaa

SEQ ID NO: 95604 - RNA, 22 nt, Human
uuuugucagggcaggaggaaga

SEQ ID NO: 95605 - RNA, 22 nt, Human
uuuuguagauagggaaacagag

SEQ ID NO: 95606 - RNA, 20 nt, Human
uuuuguccaccugcaggaag

SEQ ID NO: 95607 - RNA, 22 nt, Human
uuuugucuguggaaagcugcua

SEQ ID NO: 95608 - RNA, 21 nt, Human
uuuuguguugcgcacuuugag

SEQ ID NO: 95609 - RNA, 22 nt, Human
uuuuguggacugauccgaggac

SEQ ID NO: 95610 - RNA, 22 nt, Human
uuuuguggacugugagggugca

SEQ ID NO: 95611 - RNA, 22 nt, Human
uuuuggauugcuaacucagggu

SEQ ID NO: 95612 - RNA, 22 nt, Human
uuuuguuacugauuauuaaaau

SEQ ID NO: 95613 - RNA, 22 nt, Human
uuuuguuuacauuaaauuuuga

SEQ ID NO: 95614 - RNA, 22 nt, Human
uuuuuaaaauuaggacggcacg

SEQ ID NO: 95615 - RNA, 22 nt, Human
uuuuuagcauaugucaaaucag

SEQ ID NO: 95616 - RNA, 22 nt, Human
uuuuuaauuuuaagcuauuugu

SEQ ID NO: 95617 - RNA, 22 nt, Human
uuuuguagauuggaaaaucugg

SEQ ID NO: 95618 - RNA, 22 nt, Human
uuuuuauguaaaauauuaaaag

SEQ ID NO: 95619 - RNA, 22 nt, Human
uuuuucacacuccuuuccaguu

SEQ ID NO: 95620 - RNA, 22 nt, Human
gagauccccagugugucucggc

SEQ ID NO: 95621 - RNA, 22 nt, Human
gagccgcagcugcguagggucc

SEQ ID NO: 95622 - RNA, 22 nt, Human
gagaccaagcgugggugauaau

SEQ ID NO: 95623 - RNA, 22 nt, Human
gaugauuuuguaacuggggaca

SEQ ID NO: 95624 - RNA, 22 nt, Human
gaugauuccuuuguucauugug

SEQ ID NO: 95625 - RNA, 22 nt, Human
gagacugugucugucaagcuag

SEQ ID NO: 95626 - RNA, 23 nt, Human
gaugauggcaacuacauccggug

SEQ ID NO: 95627 - RNA, 22 nt, Human
gaugcauccuuucugucuucuc

SEQ ID NO: 95628 - RNA, 22 nt, Human
gagagaggggaagagaagcucu

SEQ ID NO: 95629 - RNA, 22 nt, Human
gagagcaaaccuguguuuggag

SEQ ID NO: 95630 - RNA, 22 nt, Human
gagagcugucagcguagcaccg

SEQ ID NO: 95631 - RNA, 22 nt, Human
gagaggguugggaggcagcaga

SEQ ID NO: 95632 - RNA, 18 nt, Human
gagaggcauuuagcugau

SEQ ID NO: 95633 - RNA, 22 nt, Human
gagaggcugagcaguccggguu

SEQ ID NO: 95634 - RNA, 22 nt, Human
gaugcucuugauuggaccaggg

SEQ ID NO: 95635 - RNA, 22 nt, Human
gaugccuccaggaaagaggacg

SEQ ID NO: 95636 - RNA, 22 nt, Human
gagaguuggaggguauguuagu

SEQ ID NO: 95637 - RNA, 22 nt, Human
gagauggauuuuuuugccaguc

SEQ ID NO: 95638 - RNA, 22 nt, Human
gagauuaauuaaaaccuuuaug

SEQ ID NO: 95639 - RNA, 22 nt, Human
gagauuguggcagcagcuguuu

SEQ ID NO: 95640 - RNA, 22 nt, Human
gaugguggaggaaucgcugaag

SEQ ID NO: 95641 - RNA, 22 nt, Human
gaugguaucugcuggcuuucag

SEQ ID NO: 95642 - RNA, 22 nt, Human
gauggggaaaaaauggaucuuu

SEQ ID NO: 95643 - RNA, 22 nt, Human
gagcacuucagcauaaaucaca

SEQ ID NO: 95644 - RNA, 22 nt, Human
gagcacauguggagagucuggg

SEQ ID NO: 95645 - RNA, 22 nt, Human
gaugguggggggcagcugggag

SEQ ID NO: 95646 - RNA, 22 nt, Human
gaugucccuggaggggacagga

SEQ ID NO: 95647 - RNA, 22 nt, Human
gaugguuuuacauuuuaauguu

SEQ ID NO: 95648 - RNA, 22 nt, Human
gauguaucugagcugcuuaggu

SEQ ID NO: 95649 - RNA, 22 nt, Human
gaugugugugcccugggccugc

SEQ ID NO: 95650 - RNA, 22 nt, Human
gagcagccugaggauucugcuc

SEQ ID NO: 95651 - RNA, 22 nt, Human
gagcagcucgagaaggaagcag

SEQ ID NO: 95652 - RNA, 22 nt, Human
gagcggcggugagaaguguggg

SEQ ID NO: 95653 - RNA, 22 nt, Human
gagcggcucaguggccauguga

SEQ ID NO: 95654 - RNA, 22 nt, Human
gagcuaauagacagcaacauca

SEQ ID NO: 95655 - RNA, 22 nt, Human
gagcuggacauacaggaaacca

SEQ ID NO: 95656 - RNA, 22 nt, Human
gauuuugcuuuagugaaggaag

SEQ ID NO: 95657 - RNA, 22 nt, Human
gcaaagaauugauucauuuugc

SEQ ID NO: 95658 - RNA, 22 nt, Human
gcaaaugacuuagucacuccag

SEQ ID NO: 95659 - RNA, 22 nt, Human
gcaacguauauggguaaggaua

SEQ ID NO: 95660 - RNA, 22 nt, Human
gauuucauaaaacgagaaacuc

SEQ ID NO: 95661 - RNA, 22 nt, Human
gagccuggagcuggaacgaagc

SEQ ID NO: 95662 - RNA, 22 nt, Human
gagccucaggguuuuguugaca

SEQ ID NO: 95663 - RNA, 22 nt, Human
gagcgcacagaaggaagcagcc

SEQ ID NO: 95664 - RNA, 22 nt, Human
gauuuucauuauagcuaguuuc

SEQ ID NO: 95665 - RNA, 22 nt, Human
gauuucuucauuuaaaaauauu

SEQ ID NO: 95666 - RNA, 21 nt, Human
gauuuuagggcagccaaacac

SEQ ID NO: 95667 - RNA, 22 nt, Human
gauugcaucaauauuuagagua

SEQ ID NO: 95668 - RNA, 22 nt, Human
gauuguagacauauuagacugc

SEQ ID NO: 95669 - RNA, 22 nt, Human
gauuggucacacaauaguauau

SEQ ID NO: 95670 - RNA, 22 nt, Human
gagccauggaggaugugcagca

SEQ ID NO: 95671 - RNA, 22 nt, Human
gauucagagcugcaacaaagaa

SEQ ID NO: 95672 - RNA, 22 nt, Human
gauucuaucauucuguauauua

SEQ ID NO: 95673 - RNA, 22 nt, Human
gauuccugcuauucacagggcu

SEQ ID NO: 95674 - RNA, 22 nt, Human
gagcaggucucaguucugccuc

SEQ ID NO: 95675 - RNA, 19 nt, Human
gagcaugacuggccuugca

SEQ ID NO: 95676 - RNA, 22 nt, Human
gagcaugacgcaacaccaagug

SEQ ID NO: 95677 - RNA, 22 nt, Human
gagcaguuagggaccgcaggcu

SEQ ID NO: 95678 - RNA, 22 nt, Human
gauguuggugcauucacuucug

SEQ ID NO: 95679 - RNA, 22 nt, Human
gagcagguuauuagaaauggaa

SEQ ID NO: 95680 - RNA, 22 nt, Human
gagcagcugagcuggaaugaga

SEQ ID NO: 95681 - RNA, 22 nt, Human
gagcagggagaggcagagaggc

SEQ ID NO: 95682 - RNA, 22 nt, Human
gcaauaaguuuucucuucuguc

SEQ ID NO: 95683 - RNA, 22 nt, Human
gaggagagcuggccagguuucu

SEQ ID NO: 95684 - RNA, 22 nt, Human
gaggagcaggcaggaucugguc

SEQ ID NO: 95685 - RNA, 22 nt, Human
gcaauuguauugucaagacaug

SEQ ID NO: 95686 - RNA, 22 nt, Human
gcaacuccuaggcgaggccuuc

SEQ ID NO: 95687 - RNA, 19 nt, Human
gcaaguuaucugucuccau

SEQ ID NO: 95688 - RNA, 22 nt, Human
gcaaggacagaagcccacacag

SEQ ID NO: 95689 - RNA, 22 nt, Human
gcaaggaagcagaguugcuauc

SEQ ID NO: 95690 - RNA, 22 nt, Human
gaggagaaacagccgugauagu

SEQ ID NO: 95691 - RNA, 22 nt, Human
gcaagagaagaaagaauaguuu

SEQ ID NO: 95692 - RNA, 22 nt, Human
gagcuuuagcugagaccugcuu

SEQ ID NO: 95693 - RNA, 22 nt, Human
gaggaaagcugguuuaaaguau

SEQ ID NO: 95694 - RNA, 22 nt, Human
gaggaagucuuaucuggaugca

SEQ ID NO: 95695 - RNA, 22 nt, Human
gcacaaaagguacuucauguag

SEQ ID NO: 95696 - RNA, 21 nt, Human
gcacaacucucacauucuucu

SEQ ID NO: 95697 - RNA, 22 nt, Human
gcacaaguccuccgacagcacg

SEQ ID NO: 95698 - RNA, 22 nt, Human
gaggagcugggucagggagaca

SEQ ID NO: 95699 - RNA, 22 nt, Human
gaggagcggugcaugugggggc

SEQ ID NO: 95700 - RNA, 22 nt, Human
gcacagaguguaaaaguuucau

SEQ ID NO: 95701 - RNA, 22 nt, Human
gcacagauaaucugccuuacca

SEQ ID NO: 95702 - RNA, 22 nt, Human
gcacacaaaaauauguguugaa

SEQ ID NO: 95703 - RNA, 22 nt, Human
gagggaaaggggccaugauugg

SEQ ID NO: 95704 - RNA, 22 nt, Human
gaggcugguucccuugaucuuu

SEQ ID NO: 95705 - RNA, 22 nt, Human
gagggagagaugcuggaccggg

SEQ ID NO: 95706 - RNA, 23 nt, Human
gcacuguuugaggagcacugugc

SEQ ID NO: 95707 - RNA, 22 nt, Human
gaggcuaugucuacgcucagcg

SEQ ID NO: 95708 - RNA, 22 nt, Human
gaggcgcgcugcgagggcgcgg

SEQ ID NO: 95709 - RNA, 22 nt, Human
gcacucugggucaucugcugcc

SEQ ID NO: 95710 - RNA, 22 nt, Human
gcacucuguggagacaagauag

SEQ ID NO: 95711 - RNA, 22 nt, Human
gcacugagacuuuagauuggag

SEQ ID NO: 95712 - RNA, 22 nt, Human
gaggaugacaaagaaggcagac

SEQ ID NO: 95713 - RNA, 22 nt, Human
gaggauuugagggucacuccac

SEQ ID NO: 95714 - RNA, 22 nt, Human
gaggcagaggaaacagcucauu

SEQ ID NO: 95715 - RNA, 22 nt, Human
gcacauauuuagaucuugaugu

SEQ ID NO: 95716 - RNA, 22 nt, Human
gaggccagcacccagaugcaug

SEQ ID NO: 95717 - RNA, 22 nt, Human
gcacauaugcuguaagcacaug

SEQ ID NO: 95718 - RNA, 22 nt, Human
gcacccagggcaggaagugagg

SEQ ID NO: 95719 - RNA, 22 nt, Human
gcagcguguggcuaauggcucu

SEQ ID NO: 95720 - RNA, 22 nt, Human
gcagccugaguuuagcucgucg

SEQ ID NO: 95721 - RNA, 20 nt, Human
gcagcugacccuagugcuug

SEQ ID NO: 95722 - RNA, 22 nt, Human
gcaggagggggccuggagccca

SEQ ID NO: 95723 - RNA, 22 nt, Human
gcaggcaggauucagagauaca

SEQ ID NO: 95724 - RNA, 22 nt, Human
gaggugauuccucccauguaau

SEQ ID NO: 95725 - RNA, 22 nt, Human
gcaggacuucuguuuaaccagu

SEQ ID NO: 95726 - RNA, 22 nt, Human
gaggugaacccaggugcuucac

SEQ ID NO: 95727 - RNA, 22 nt, Human
gaggucaugcagcucugaguuc

SEQ ID NO: 95728 - RNA, 22 nt, Human
gagguagaggaaaagauuauca

SEQ ID NO: 95729 - RNA, 22 nt, Human
gaggucagcaagccaugcuugu

SEQ ID NO: 95730 - RNA, 22 nt, Human
gcagccaauggcgagccccaca

SEQ ID NO: 95731 - RNA, 22 nt, Human
gcagccagggaccuuugacuau

SEQ ID NO: 95732 - RNA, 22 nt, Human
gcagagcacccugcagugguau

SEQ ID NO: 95733 - RNA, 22 nt, Human
gcagagaaugucagauuuuguu

SEQ ID NO: 95734 - RNA, 22 nt, Human
gcagaggcaaagucuggaugac

SEQ ID NO: 95735 - RNA, 22 nt, Human
gagggcauugucuucuuaguuu

SEQ ID NO: 95736 - RNA, 22 nt, Human
gagggauuuuagugcagcaacu

SEQ ID NO: 95737 - RNA, 22 nt, Human
gagggcugccacguugggcgag

SEQ ID NO: 95738 - RNA, 22 nt, Human
gcagagcugucuaagucacuuc

SEQ ID NO: 95739 - RNA, 22 nt, Human
gcagaggcugccgugggcagga

SEQ ID NO: 95740 - RNA, 22 nt, Human
gcagacuaacuuuugucagccu

SEQ ID NO: 95741 - RNA, 22 nt, Human
gaggggaaggauuucuucagaa

SEQ ID NO: 95742 - RNA, 22 nt, Human
gaggggcacaguggggccuggg

SEQ ID NO: 95743 - RNA, 20 nt, Human
gcagcagacagacaggggac

SEQ ID NO: 95744 - RNA, 22 nt, Human
gcagauaguaggagcuaaucuu

SEQ ID NO: 95745 - RNA, 22 nt, Human
gagggugugguauggauguguu

SEQ ID NO: 95746 - RNA, 22 nt, Human
gaggguggggaauagacugcua

SEQ ID NO: 95747 - RNA, 21 nt, Human
gcagcaugagaaagccccaaa

SEQ ID NO: 95748 - RNA, 22 nt, Human
gagggggcaggcucggcaccgg

SEQ ID NO: 95749 - RNA, 22 nt, Human
gagggggaaaagggcagcagag

SEQ ID NO: 95750 - RNA, 22 nt, Human
gcauuucuguuuuuuuaaauga

SEQ ID NO: 95751 - RNA, 23 nt, Human
gcauuugcaggaaacuggaaaag

SEQ ID NO: 95752 - RNA, 22 nt, Human
gauauuuugugaaaaaacaacu

SEQ ID NO: 95753 - RNA, 19 nt, Human
gauauugagcugagaauuc

SEQ ID NO: 95754 - RNA, 22 nt, Human
gaugaaguaguccacuggaagg

SEQ ID NO: 95755 - RNA, 22 nt, Human
gaugauaacagcauuucaacug

SEQ ID NO: 95756 - RNA, 22 nt, Human
gaucauuuucauuaauguugca

SEQ ID NO: 95757 - RNA, 22 nt, Human
gccagucgucuuuauuacagcu

SEQ ID NO: 95758 - RNA, 22 nt, Human
gaugauugaauaaauaugguca

SEQ ID NO: 95759 - RNA, 22 nt, Human
gauggauuuuuuauuaaaucag

SEQ ID NO: 95760 - RNA, 22 nt, Human
gauggacgguuuuaccagacag

SEQ ID NO: 95761 - RNA, 22 nt, Human
gaugcuaauuaaugaagaggag

SEQ ID NO: 95762 - RNA, 22 nt, Human
gauggcauucacaaacuuaacu

SEQ ID NO: 95763 - RNA, 22 nt, Human
gauggcaaugcuagaaauuuag

SEQ ID NO: 95764 - RNA, 22 nt, Human
gcccagccucagggcaucagcu

SEQ ID NO: 95765 - RNA, 22 nt, Human
gcccgccaacuugccagcggug

SEQ ID NO: 95766 - RNA, 22 nt, Human
gcccguuuagcaaacgccuccu

SEQ ID NO: 95767 - RNA, 22 nt, Human
gcaugguuagacaucaauguga

SEQ ID NO: 95768 - RNA, 22 nt, Human
gcaugguuuccugcaacguucu

SEQ ID NO: 95769 - RNA, 22 nt, Human
gauaauuauaggcuaagccacu

SEQ ID NO: 95770 - RNA, 22 nt, Human
gauacugugggcacucauaaua

SEQ ID NO: 95771 - RNA, 22 nt, Human
gauacuuuguggaauccuggau

SEQ ID NO: 95772 - RNA, 22 nt, Human
gauagaaagagaaucagaacuu

SEQ ID NO: 95773 - RNA, 22 nt, Human
gauagcacacuuguugcuucug

SEQ ID NO: 95774 - RNA, 22 nt, Human
gcauuccagaguugcuggaaaa

SEQ ID NO: 95775 - RNA, 22 nt, Human
gauauauuucaaauucuuuugc

SEQ ID NO: 95776 - RNA, 20 nt, Human
gauagcacaaagagaauggg

SEQ ID NO: 95777 - RNA, 22 nt, Human
gcauucuugucaguggggucag

SEQ ID NO: 95778 - RNA, 22 nt, Human
gcauuggaaacugcuuuaugcu

SEQ ID NO: 95779 - RNA, 22 nt, Human
gagguucgauacagcguauuua

SEQ ID NO: 95780 - RNA, 20 nt, Human
gagguugcucagaguggggu

SEQ ID NO: 95781 - RNA, 22 nt, Human
gcagcuuuggagguggaacucu

SEQ ID NO: 95782 - RNA, 22 nt, Human
gaggugcaggggcccgggcugg

SEQ ID NO: 95783 - RNA, 22 nt, Human
gaggugggaggcgggccugcau

SEQ ID NO: 95784 - RNA, 19 nt, Human
gaguaaaacuagagagaaa

SEQ ID NO: 95785 - RNA, 22 nt, Human
gcaggccgauuuguuagaaguc

SEQ ID NO: 95786 - RNA, 22 nt, Human
gagguuggagggcugcccugca

SEQ ID NO: 95787 - RNA, 22 nt, Human
gauuuuaaaagauguauaaggu

SEQ ID NO: 95788 - RNA, 22 nt, Human
gauuugucuauauucaaauaug

SEQ ID NO: 95789 - RNA, 20 nt, Human
gccuccuccaaguuucauca

SEQ ID NO: 95790 - RNA, 22 nt, Human
gccuccuccaucauugcuucau

SEQ ID NO: 95791 - RNA, 22 nt, Human
gccucaaaaguguuguagaggg

SEQ ID NO: 95792 - RNA, 21 nt, Human
gcaaccagaccacagggcagu

SEQ ID NO: 95793 - RNA, 22 nt, Human
gcacacaagagauuguuauugc

SEQ ID NO: 95794 - RNA, 22 nt, Human
gcacacuguaugcugguauuug

SEQ ID NO: 95795 - RNA, 22 nt, Human
gccugggcuuccgggacccggg

SEQ ID NO: 95796 - RNA, 22 nt, Human
gccuggggaacuugauccuguc

SEQ ID NO: 95797 - RNA, 22 nt, Human
gcacuguauuuaaauauuuaaa

SEQ ID NO: 95798 - RNA, 22 nt, Human
gccuuuauauuacauuuggaag

SEQ ID NO: 95799 - RNA, 22 nt, Human
gccuucccuccucugcucucag

SEQ ID NO: 95800 - RNA, 22 nt, Human
gccugaaaugaaccagaggacu

SEQ ID NO: 95801 - RNA, 22 nt, Human
gcacagcuaugagcugaauugu

SEQ ID NO: 95802 - RNA, 22 nt, Human
gccuggaaugcaaugugacgaa

SEQ ID NO: 95803 - RNA, 22 nt, Human
gccuggccaaucgccgucuagg

SEQ ID NO: 95804 - RNA, 22 nt, Human
gccugcuugaaagcacuuucug

SEQ ID NO: 95805 - RNA, 22 nt, Human
gccugcaaagacuuccuucucu

SEQ ID NO: 95806 - RNA, 22 nt, Human
gauugggagugugacauuguau

SEQ ID NO: 95807 - RNA, 21 nt, Human
gccgugcgccuccaggcgcgc

SEQ ID NO: 95808 - RNA, 22 nt, Human
gccguuccuacucucucugugu

SEQ ID NO: 95809 - RNA, 20 nt, Human
gauuuaacgcugcgucuguc

SEQ ID NO: 95810 - RNA, 22 nt, Human
gauugcauaugcauucugauac

SEQ ID NO: 95811 - RNA, 22 nt, Human
gauugcugccagcguguccgug

SEQ ID NO: 95812 - RNA, 22 nt, Human
gccggcccugcgcggggcggaa

SEQ ID NO: 95813 - RNA, 22 nt, Human
gccgcguggcagucuuggugac

SEQ ID NO: 95814 - RNA, 22 nt, Human
gccggcugggggcggagggcag

SEQ ID NO: 95815 - RNA, 22 nt, Human
gccgcagauucugagacgugua

SEQ ID NO: 95816 - RNA, 21 nt, Human
gccgaugugacucuacguagu

SEQ ID NO: 95817 - RNA, 22 nt, Human
gcccucugccacaggacgccag

SEQ ID NO: 95818 - RNA, 22 nt, Human
gcccugaagagguagagaauuu

SEQ ID NO: 95819 - RNA, 18 nt, Human
gccgccuugcucgugaac

SEQ ID NO: 95820 - RNA, 15 nt, Human
gccgcgcuggggagc

SEQ ID NO: 95821 - RNA, 22 nt, Human
gccgccgccgccuuuguugcgg

SEQ ID NO: 95822 - RNA, 22 nt, Human
gauucugaaauuaacagacugg

SEQ ID NO: 95823 - RNA, 22 nt, Human
gauugauuuaauaugagaggau

SEQ ID NO: 95824 - RNA, 22 nt, Human
gauugauguaggugauaaaucu

SEQ ID NO: 95825 - RNA, 22 nt, Human
gccagggcucgagcaggccagc

SEQ ID NO: 95826 - RNA, 22 nt, Human
gcugcuuagaaccauauuuaaa

SEQ ID NO: 95827 - RNA, 22 nt, Human
gcugcuuacuauaggguuaacu

SEQ ID NO: 95828 - RNA, 22 nt, Human
gcugcuucgcugcacacccgag

SEQ ID NO: 95829 - RNA, 22 nt, Human
gccauauucaugcaggugcuaa

SEQ ID NO: 95830 - RNA, 22 nt, Human
gccaguaaaguaucuccuuuug

SEQ ID NO: 95831 - RNA, 22 nt, Human
gcugcuggcggagcuggcgcug

SEQ ID NO: 95832 - RNA, 22 nt, Human
gcugcuacagagcuggaggggg

SEQ ID NO: 95833 - RNA, 22 nt, Human
gccaggccuggguggagcgcuc

SEQ ID NO: 95834 - RNA, 22 nt, Human
gccaggagaaaaggcgaaugau

SEQ ID NO: 95835 - RNA, 22 nt, Human
gccaugguggggccucccugac

SEQ ID NO: 95836 - RNA, 22 nt, Human
gccauguucuugaaucuggguc

SEQ ID NO: 95837 - RNA, 21 nt, Human
gcuggcugucucuuacacggu

SEQ ID NO: 95838 - RNA, 22 nt, Human
gccauguuuugguaaauaccau

SEQ ID NO: 95839 - RNA, 22 nt, Human
gccauggugagccaccuggugg

SEQ ID NO: 95840 - RNA, 22 nt, Human
gcccaauuugaacaaagauacu

SEQ ID NO: 95841 - RNA, 22 nt, Human
gcccagaagguagcgaguaguc

SEQ ID NO: 95842 - RNA, 22 nt, Human
gccaguggucagugggagggug

SEQ ID NO: 95843 - RNA, 22 nt, Human
gccaucuucggcagccgccugg

SEQ ID NO: 95844 - RNA, 22 nt, Human
gcuggauuuaggguucccuccu

SEQ ID NO: 95845 - RNA, 22 nt, Human
gcuggauaaggaucaguuucuu

SEQ ID NO: 95846 - RNA, 22 nt, Human
gcuggaugucugugccaggcac

SEQ ID NO: 95847 - RNA, 23 nt, Human
gcugccguuucccaucgugguga

SEQ ID NO: 95848 - RNA, 22 nt, Human
gccagcuuagaucccccagccc

SEQ ID NO: 95849 - RNA, 22 nt, Human
gccagccggugaguggaagcgg

SEQ ID NO: 95850 - RNA, 23 nt, Human
gccaaacugcccguucucucugc

SEQ ID NO: 95851 - RNA, 19 nt, Human
gccacccaucauauggagg

SEQ ID NO: 95852 - RNA, 22 nt, Human
gcugcagggagcuggaaggcuc

SEQ ID NO: 95853 - RNA, 22 nt, Human
gcugcccucccagggcaagcuu

SEQ ID NO: 95854 - RNA, 22 nt, Human
gcauuuuaauuggggcaguuag

SEQ ID NO: 95855 - RNA, 22 nt, Human
gcauuucauaaccagccaugcu

SEQ ID NO: 95856 - RNA, 23 nt, Human
gcugagcaccagccauaucuuuu

SEQ ID NO: 95857 - RNA, 22 nt, Human
gcugauucuucugcuuuuucuc

SEQ ID NO: 95858 - RNA, 22 nt, Human
gcugagcagcgaaggcacaugc

SEQ ID NO: 95859 - RNA, 22 nt, Human
gcugagaguguaggauguuuac

SEQ ID NO: 95860 - RNA, 22 nt, Human
gcugagcaaugcacugccgcau

SEQ ID NO: 95861 - RNA, 22 nt, Human
gcucugcuccaucuguuuccuc

SEQ ID NO: 95862 - RNA, 22 nt, Human
gcucucucuucugcaggccuua

SEQ ID NO: 95863 - RNA, 22 nt, Human
gcucgauugucaguguuaggga

SEQ ID NO: 95864 - RNA, 22 nt, Human
gcaucuguuguguuaauuuaca

SEQ ID NO: 95865 - RNA, 22 nt, Human
gcaugaauggaacccccugagu

SEQ ID NO: 95866 - RNA, 22 nt, Human
gcuccggggguuccagaucauc

SEQ ID NO: 95867 - RNA, 22 nt, Human
gcauaaaggacuauaaggauca

SEQ ID NO: 95868 - RNA, 22 nt, Human
gcauaacaacagacucuguguu

SEQ ID NO: 95869 - RNA, 22 nt, Human
gcaguugugguuucguuuccuu

SEQ ID NO: 95870 - RNA, 22 nt, Human
gcucaagaccaagggagcgggg

SEQ ID NO: 95871 - RNA, 22 nt, Human
gcgugcauggccguguguaugc

SEQ ID NO: 95872 - RNA, 22 nt, Human
gcgucucugggcugacccaggu

SEQ ID NO: 95873 - RNA, 22 nt, Human
gcuacaaauaaaaugggugacu

SEQ ID NO: 95874 - RNA, 22 nt, Human
gcuauuggcuaauuguugcaac

SEQ ID NO: 95875 - RNA, 19 nt, Human
gcaguuccucuuaagagaa

SEQ ID NO: 95876 - RNA, 22 nt, Human
gcaguugguccagccucggcug

SEQ ID NO: 95877 - RNA, 22 nt, Human
gcagccaugcacgucauuauga

SEQ ID NO: 95878 - RNA, 22 nt, Human
gcggagaggcagagacuccgcg

SEQ ID NO: 95879 - RNA, 22 nt, Human
gccuuuuaaggcagagggagau

SEQ ID NO: 95880 - RNA, 22 nt, Human
gcggagcuaaagauuggcuccu

SEQ ID NO: 95881 - RNA, 22 nt, Human
gcgauugguuuggggccagagu

SEQ ID NO: 95882 - RNA, 22 nt, Human
gcagcgcugagaugauuuguug

SEQ ID NO: 95883 - RNA, 22 nt, Human
gcggcaguccuuccaguacagg

SEQ ID NO: 95884 - RNA, 22 nt, Human
gcggcccggguccccagcagca

SEQ ID NO: 95885 - RNA, 22 nt, Human
gcagccauuugcaucuaauuaa

SEQ ID NO: 95886 - RNA, 22 nt, Human
gcagcccucuuggucacuaggc

SEQ ID NO: 95887 - RNA, 22 nt, Human
gcagccauggcuggccgggcau

SEQ ID NO: 95888 - RNA, 22 nt, Human
gcagccucugcaguucaggagg

SEQ ID NO: 95889 - RNA, 22 nt, Human
gcaggacugauggagcauaugu

SEQ ID NO: 95890 - RNA, 22 nt, Human
gcgguuauggcagagauuacag

SEQ ID NO: 95891 - RNA, 22 nt, Human
gcguagaagaaagcugcugcua

SEQ ID NO: 95892 - RNA, 22 nt, Human
gcgguguuuuaacacucccucg

SEQ ID NO: 95893 - RNA, 22 nt, Human
gcggguggaggagggacgggca

SEQ ID NO: 95894 - RNA, 22 nt, Human
gcagcguuaacauuuuuccugu

SEQ ID NO: 95895 - RNA, 22 nt, Human
gcggggcucuacuuggccugga

SEQ ID NO: 95896 - RNA, 22 nt, Human
gcggcggcggaggcgggggcag

SEQ ID NO: 95897 - RNA, 22 nt, Human
gcggcgucccagcuccgacggc

SEQ ID NO: 95898 - RNA, 22 nt, Human
gcgggccggcaggggaggaguu

SEQ ID NO: 95899 - RNA, 22 nt, Human
gcggcuggcuguccaaacuggg

SEQ ID NO: 95900 - RNA, 19 nt, Human
ggaguugccaggagaagga

SEQ ID NO: 95901 - RNA, 22 nt, Human
ggaguguuagacuaaauuggga

SEQ ID NO: 95902 - RNA, 22 nt, Human
gggugugcuaaaccuacgcaca

SEQ ID NO: 95903 - RNA, 22 nt, Human
ggguauuugacaaacugacacu

SEQ ID NO: 95904 - RNA, 22 nt, Human
ggguacaccaauggaugccagg

SEQ ID NO: 95905 - RNA, 22 nt, Human
gggguuggaugccuuggaaauu

SEQ ID NO: 95906 - RNA, 22 nt, Human
ggguggugauacugcuucugcc

SEQ ID NO: 95907 - RNA, 20 nt, Human
gggucuggcaucucucucug

SEQ ID NO: 95908 - RNA, 22 nt, Human
gggucuggagauccgggugaag

SEQ ID NO: 95909 - RNA, 22 nt, Human
gggucagggaggccccaccaug

SEQ ID NO: 95910 - RNA, 22 nt, Human
ggagaugaaugugguaaaacug

SEQ ID NO: 95911 - RNA, 17 nt, Human
ggggcguguauuugaug

SEQ ID NO: 95912 - RNA, 22 nt, Human
ggaggaagagaccagggggcuu

SEQ ID NO: 95913 - RNA, 22 nt, Human
ggggucugaucccuucuggcuu

SEQ ID NO: 95914 - RNA, 22 nt, Human
ggggugaggcagggcagggguc

SEQ ID NO: 95915 - RNA, 22 nt, Human
ggagaucuuggacuggccggcc

SEQ ID NO: 95916 - RNA, 22 nt, Human
ggggcguugccacggggacggg

SEQ ID NO: 95917 - RNA, 22 nt, Human
ggggcggcgugggcgcggugau

SEQ ID NO: 95918 - RNA, 22 nt, Human
ggggauuucccaaugcgaagca

SEQ ID NO: 95919 - RNA, 22 nt, Human
ggagacagugacuuagagacug

SEQ ID NO: 95920 - RNA, 22 nt, Human
ggagagcuagugagcuggaggu

SEQ ID NO: 95921 - RNA, 22 nt, Human
ggagacagauggcgucucaguu

SEQ ID NO: 95922 - RNA, 22 nt, Human
ggagaagaggagcuggaagccu

SEQ ID NO: 95923 - RNA, 22 nt, Human
ggggagaugauaagugcauuug

SEQ ID NO: 95924 - RNA, 22 nt, Human
ggggaggaagcuggaacacggg

SEQ ID NO: 95925 - RNA, 22 nt, Human
ggggaggugugcaggacaccuc

SEQ ID NO: 95926 - RNA, 22 nt, Human
ggggacggcuggccggggcccc

SEQ ID NO: 95927 - RNA, 22 nt, Human
ggggaaauauuucugaccugug

SEQ ID NO: 95928 - RNA, 22 nt, Human
ggggaagugguggggcuccgag

SEQ ID NO: 95929 - RNA, 22 nt, Human
ggacuuuggauuuuauucuaaa

SEQ ID NO: 95930 - RNA, 22 nt, Human
ggacauggccguaguccccacg

SEQ ID NO: 95931 - RNA, 22 nt, Human
ggacauuguuguuggauccuug

SEQ ID NO: 95932 - RNA, 22 nt, Human
gggcuguggggccugcagaagg

SEQ ID NO: 95933 - RNA, 22 nt, Human
gggcugcuccgcccgcugcgcc

SEQ ID NO: 95934 - RNA, 22 nt, Human
gggcuggcaguuuucugaguuc

SEQ ID NO: 95935 - RNA, 18 nt, Human
ggacaguuguagaggacu

SEQ ID NO: 95936 - RNA, 22 nt, Human
ggacaauuguacucgauuucaa

SEQ ID NO: 95937 - RNA, 22 nt, Human
gggcuacugagcuggaacuggg

SEQ ID NO: 95938 - RNA, 22 nt, Human
gggcgcgcggagccucgccggg

SEQ ID NO: 95939 - RNA, 22 nt, Human
gggcgcuguguuaggugcugua

SEQ ID NO: 95940 - RNA, 22 nt, Human
gggcgcuuucugggucagggcu

SEQ ID NO: 95941 - RNA, 22 nt, Human
gggcggcguccucagucgggug

SEQ ID NO: 95942 - RNA, 22 nt, Human
gggcggggcucacggugcggca

SEQ ID NO: 95943 - RNA, 20 nt, Human
ggaaguauccacaaauuccu

SEQ ID NO: 95944 - RNA, 22 nt, Human
gggcaugcagcaauucuguggu

SEQ ID NO: 95945 - RNA, 22 nt, Human
ggaaagagaaacaugaacuaga

SEQ ID NO: 95946 - RNA, 17 nt, Human
ggaagaaaaggaucauc

SEQ ID NO: 95947 - RNA, 20 nt, Human
ggaacccuagacuugcgcag

SEQ ID NO: 95948 - RNA, 22 nt, Human
gggauuaaaaaucaccaaagua

SEQ ID NO: 95949 - RNA, 19 nt, Human
gggauuccuggcuuuagaa

SEQ ID NO: 95950 - RNA, 22 nt, Human
ggaaaagccauauuauaggcaa

SEQ ID NO: 95951 - RNA, 22 nt, Human
gggaguggagagugaagcuaau

SEQ ID NO: 95952 - RNA, 22 nt, Human
ggaaaagaauuguuaguuagug

SEQ ID NO: 95953 - RNA, 22 nt, Human
ggaaaaucaaaccauuuacagu

SEQ ID NO: 95954 - RNA, 22 nt, Human
ggaaagaggacaucuuacuucu

SEQ ID NO: 95955 - RNA, 22 nt, Human
gggcaagagaggaagagauggc

SEQ ID NO: 95956 - RNA, 22 nt, Human
gggauuuaaugggaaaaauaug

SEQ ID NO: 95957 - RNA, 22 nt, Human
gggcaagaggguuugacaugag

SEQ ID NO: 95958 - RNA, 22 nt, Human
gggcagaaaggaaggcuggggg

SEQ ID NO: 95959 - RNA, 22 nt, Human
gcuuuucaaguuacaauuagcu

SEQ ID NO: 95960 - RNA, 22 nt, Human
gcuuuguugauggugagucugu

SEQ ID NO: 95961 - RNA, 22 nt, Human
gcuuuuaaauuaucugacaaug

SEQ ID NO: 95962 - RNA, 22 nt, Human
gcuuuggcuucuccuggcagga

SEQ ID NO: 95963 - RNA, 22 nt, Human
ggcuuccuggugcagaguuaua

SEQ ID NO: 95964 - RNA, 22 nt, Human
guaaauuaugucugggucaguu

SEQ ID NO: 95965 - RNA, 22 nt, Human
guaaaucuuggcaucugcuuuc

SEQ ID NO: 95966 - RNA, 22 nt, Human
guaaacugaauuggauacugug

SEQ ID NO: 95967 - RNA, 22 nt, Human
guaaauaucucacgaaugauuc

SEQ ID NO: 95968 - RNA, 22 nt, Human
gguuuuuggcucaauauuuugg

SEQ ID NO: 95969 - RNA, 22 nt, Human
guaauugcucauauggcaccug

SEQ ID NO: 95970 - RNA, 22 nt, Human
guaccuguacauaacuacauau

SEQ ID NO: 95971 - RNA, 22 nt, Human
guaauucugugugaaucuauua

SEQ ID NO: 95972 - RNA, 22 nt, Human
guaaugcuuuuauuucggggaa

SEQ ID NO: 95973 - RNA, 22 nt, Human
guaauaggagggagucugcuuu

SEQ ID NO: 95974 - RNA, 22 nt, Human
guaaggcaggagucuuaaaccu

SEQ ID NO: 95975 - RNA, 22 nt, Human
guaacugguuuucuucccucuc

SEQ ID NO: 95976 - RNA, 22 nt, Human
ggccagcuuugagcugcaggaa

SEQ ID NO: 95977 - RNA, 22 nt, Human
ggccagcgugggggaguagcgg

SEQ ID NO: 95978 - RNA, 22 nt, Human
gguugaagcuacuuucuggaug

SEQ ID NO: 95979 - RNA, 22 nt, Human
gguucuggaaaagaaagcaaag

SEQ ID NO: 95980 - RNA, 22 nt, Human
ggugucagccacuuugucggag

SEQ ID NO: 95981 - RNA, 22 nt, Human
gguguagagaaaauaguuguau

SEQ ID NO: 95982 - RNA, 22 nt, Human
gguguauucuccaguuuuagca

SEQ ID NO: 95983 - RNA, 22 nt, Human
gguuuuccaguagaucagaaga

SEQ ID NO: 95984 - RNA, 22 nt, Human
gguguacuucacucuuaccuag

SEQ ID NO: 95985 - RNA, 22 nt, Human
ggccgccacacagauucccccg

SEQ ID NO: 95986 - RNA, 22 nt, Human
gguugauuuuuaugaagccaug

SEQ ID NO: 95987 - RNA, 22 nt, Human
ggcccugcuuccccaguguaca

SEQ ID NO: 95988 - RNA, 22 nt, Human
guacuuccauccacauauaugu

SEQ ID NO: 95989 - RNA, 22 nt, Human
guagaacucuuuccugcguggg

SEQ ID NO: 95990 - RNA, 22 nt, Human
guagagcagaaacauggagaaa

SEQ ID NO: 95991 - RNA, 22 nt, Human
guacuugauucauuauugcauu

SEQ ID NO: 95992 - RNA, 22 nt, Human
guagaaaauagauugucucuug

SEQ ID NO: 95993 - RNA, 22 nt, Human
guacugguuuucuuacucuggc

SEQ ID NO: 95994 - RNA, 22 nt, Human
guaggaaaugaauaagguaccu

SEQ ID NO: 95995 - RNA, 22 nt, Human
guagcaugauuuuaaaauccug

SEQ ID NO: 95996 - RNA, 22 nt, Human
guaggggccagaaagacuuaga

SEQ ID NO: 95997 - RNA, 22 nt, Human
guaggaguguucgggaacuggg

SEQ ID NO: 95998 - RNA, 22 nt, Human
guagguggaggcaacacagcca

SEQ ID NO: 95999 - RNA, 22 nt, Human
guagucuuaggaaugauuuugu

SEQ ID NO: 96000 - RNA, 22 nt, Human
ggccgggcaugcgagcugagcg

SEQ ID NO: 96001 - RNA, 22 nt, Human
ggccgccacuuuccagugcugc

SEQ ID NO: 96002 - RNA, 22 nt, Human
ggccgccgcuuagcugagcccc

SEQ ID NO: 96003 - RNA, 22 nt, Human
guaguggaauuuagaguauaau

SEQ ID NO: 96004 - RNA, 18 nt, Human
ggccucagccuggccgga

SEQ ID NO: 96005 - RNA, 22 nt, Human
ggccugagaagcaaggacacaa

SEQ ID NO: 96006 - RNA, 20 nt, Human
ggccugagcauggcuggcag

SEQ ID NO: 96007 - RNA, 22 nt, Human
ggccugcucuggcuguggucag

SEQ ID NO: 96008 - RNA, 22 nt, Human
ggccuggccuccugcuuuucca

SEQ ID NO: 96009 - RNA, 22 nt, Human
ggccuucuuuucaugucuuucg

SEQ ID NO: 96010 - RNA, 22 nt, Human
ggugacauuggagagacaggug

SEQ ID NO: 96011 - RNA, 22 nt, Human
ggugccugggcacggaaagcau

SEQ ID NO: 96012 - RNA, 22 nt, Human
ggugcaaagauggcaguugcaa

SEQ ID NO: 96013 - RNA, 22 nt, Human
ggugcguggcccauccuccacc

SEQ ID NO: 96014 - RNA, 22 nt, Human
ggcaggaaguaaggaugcuaca

SEQ ID NO: 96015 - RNA, 22 nt, Human
ggcagcgcuuggcugcucgaca

SEQ ID NO: 96016 - RNA, 22 nt, Human
ggcagcuuucaauaggguuaug

SEQ ID NO: 96017 - RNA, 22 nt, Human
ggcagggaauucagagggaagg

SEQ ID NO: 96018 - RNA, 22 nt, Human
ggcagggagagcaugcugauaa

SEQ ID NO: 96019 - RNA, 22 nt, Human
ggcagggacugggauauggaga

SEQ ID NO: 96020 - RNA, 22 nt, Human
ggcagggagagcgccgccaugc

SEQ ID NO: 96021 - RNA, 22 nt, Human
gguguaaucacaagcuggaauu

SEQ ID NO: 96022 - RNA, 22 nt, Human
gguguaaggaagauggaagaug

SEQ ID NO: 96023 - RNA, 22 nt, Human
gguguacgaagaggcgggaguc

SEQ ID NO: 96024 - RNA, 22 nt, Human
ggugguucagugguuagggcca

SEQ ID NO: 96025 - RNA, 22 nt, Human
ggugacuucugaaccuggagug

SEQ ID NO: 96026 - RNA, 19 nt, Human
ggugggacaggugagauau

SEQ ID NO: 96027 - RNA, 22 nt, Human
gguggcuugcugguaggugugc

SEQ ID NO: 96028 - RNA, 22 nt, Human
gguggggacuuggggucagcgg

SEQ ID NO: 96029 - RNA, 22 nt, Human
gguggucaggagcgcccguugg

SEQ ID NO: 96030 - RNA, 22 nt, Human
ggcaguagucagaggguuuuac

SEQ ID NO: 96031 - RNA, 22 nt, Human
ggugcugcugcugaacccagcu

SEQ ID NO: 96032 - RNA, 22 nt, Human
ggugggaauccaggccuucauc

SEQ ID NO: 96033 - RNA, 22 nt, Human
gguggcuucuguuugcaagagg

SEQ ID NO: 96034 - RNA, 22 nt, Human
ggcagucuuucccuugagcucu

SEQ ID NO: 96035 - RNA, 22 nt, Human
ggcaccuuucaucccaucuaga

SEQ ID NO: 96036 - RNA, 22 nt, Human
ggauuugaugagacuaucuacu

SEQ ID NO: 96037 - RNA, 22 nt, Human
ggcaagcacugggugucuuagc

SEQ ID NO: 96038 - RNA, 22 nt, Human
ggucuuauaauuaauuuaggcu

SEQ ID NO: 96039 - RNA, 22 nt, Human
ggucuucauaugccacagaguc

SEQ ID NO: 96040 - RNA, 22 nt, Human
ggugaaggaucccucuuggccu

SEQ ID NO: 96041 - RNA, 22 nt, Human
ggucucugggacguuggaucgc

SEQ ID NO: 96042 - RNA, 20 nt, Human
ggucuguuucuucuuuucau

SEQ ID NO: 96043 - RNA, 22 nt, Human
ggucugcgauggcaagggucuu

SEQ ID NO: 96044 - RNA, 22 nt, Human
ggucugagcaaguuaccauggg

SEQ ID NO: 96045 - RNA, 22 nt, Human
ggucugcaaugauuugaaaaac

SEQ ID NO: 96046 - RNA, 22 nt, Human
ggauaauguauuuuaaaauggg

SEQ ID NO: 96047 - RNA, 22 nt, Human
ggauaauugaugauuuauaaga

SEQ ID NO: 96048 - RNA, 22 nt, Human
ggguguggaggugacacauuug

SEQ ID NO: 96049 - RNA, 22 nt, Human
gguaccuggcccuggggcugcu

SEQ ID NO: 96050 - RNA, 22 nt, Human
ggguguuuuuggugacagggag

SEQ ID NO: 96051 - RNA, 20 nt, Human
ggauugaacuauuucucagc

SEQ ID NO: 96052 - RNA, 22 nt, Human
gguauagacaaauuauauaucc

SEQ ID NO: 96053 - RNA, 22 nt, Human
ggauuguaugcagcaguaggca

SEQ ID NO: 96054 - RNA, 22 nt, Human
ggauuucuucucauaacugaga

SEQ ID NO: 96055 - RNA, 23 nt, Human
gguagguggggagauuaaagucu

SEQ ID NO: 96056 - RNA, 21 nt, Human
gguagggaagguguuccucau

SEQ ID NO: 96057 - RNA, 22 nt, Human
gguagauacaaaaagauugugg

SEQ ID NO: 96058 - RNA, 22 nt, Human
gguagaggaugaggagguugga

SEQ ID NO: 96059 - RNA, 18 nt, Human
gguacguuuugaucaaug

SEQ ID NO: 96060 - RNA, 22 nt, Human
gcugggucucucccugguccug

SEQ ID NO: 96061 - RNA, 22 nt, Human
gcuggugugagauucucgaggg

SEQ ID NO: 96062 - RNA, 19 nt, Human
gcugggauaggauguauuu

SEQ ID NO: 96063 - RNA, 22 nt, Human
gcuggguaguucuuguuuggga

SEQ ID NO: 96064 - RNA, 22 nt, Human
gcuggggaucgaaggcagagcc

SEQ ID NO: 96065 - RNA, 22 nt, Human
ggcuggggccuguugaagaugc

SEQ ID NO: 96066 - RNA, 18 nt, Human
ggcugggcugugccccuu

SEQ ID NO: 96067 - RNA, 22 nt, Human
ggcugguggcgggcagcacaga

SEQ ID NO: 96068 - RNA, 22 nt, Human
gcugguuucucucauugucagu

SEQ ID NO: 96069 - RNA, 22 nt, Human
gcugguuacuucauuagguccu

SEQ ID NO: 96070 - RNA, 22 nt, Human
ggcugggagguggcgaggaggc

SEQ ID NO: 96071 - RNA, 22 nt, Human
ggcugggaggcggaggcugaga

SEQ ID NO: 96072 - RNA, 22 nt, Human
ggcuuacgcgcuaacagugaau

SEQ ID NO: 96073 - RNA, 22 nt, Human
ggcuuaguagggacagaugcac

SEQ ID NO: 96074 - RNA, 22 nt, Human
ggcugugggguccuguggugug

SEQ ID NO: 96075 - RNA, 22 nt, Human
gcugucccccaaagaugcuccu

SEQ ID NO: 96076 - RNA, 22 nt, Human
ggcugugguggacgcgggaaac

SEQ ID NO: 96077 - RNA, 20 nt, Human
gcugugccaugacccucgag

SEQ ID NO: 96078 - RNA, 22 nt, Human
gcugucauggacaugucuguuu

SEQ ID NO: 96079 - RNA, 18 nt, Human
gcuguccgguagcuggug

SEQ ID NO: 96080 - RNA, 22 nt, Human
gcugucaggaacaugccuuggu

SEQ ID NO: 96081 - RNA, 22 nt, Human
ggcucuccacuauggaugagaa

SEQ ID NO: 96082 - RNA, 22 nt, Human
ggcugaggccucuggggaggga

SEQ ID NO: 96083 - RNA, 22 nt, Human
gcuggaagggccagcuuucagg

SEQ ID NO: 96084 - RNA, 22 nt, Human
gcuggaaauaacuuguguagaa

SEQ ID NO: 96085 - RNA, 22 nt, Human
ggcuccaggguaccccuggaug

SEQ ID NO: 96086 - RNA, 22 nt, Human
ggcuccucaggcugggguaagg

SEQ ID NO: 96087 - RNA, 22 nt, Human
ggcucacuguaccugccgccgc

SEQ ID NO: 96088 - RNA, 22 nt, Human
ggcuggaacuucuucuggcauu

SEQ ID NO: 96089 - RNA, 22 nt, Human
gcuggccugcgagggcaggcug

SEQ ID NO: 96090 - RNA, 22 nt, Human
gcuggcgauggccgagucuccg

SEQ ID NO: 96091 - RNA, 22 nt, Human
gcuggcggguuggggaggcgga

SEQ ID NO: 96092 - RNA, 22 nt, Human
ggcugcuugauagauaugagua

SEQ ID NO: 96093 - RNA, 22 nt, Human
ggcugcuugggcuguuucuuuu

SEQ ID NO: 96094 - RNA, 21 nt, Human
ggcugcucgugaugaacuuca

SEQ ID NO: 96095 - RNA, 17 nt, Human
ggcugccaggcaacaua

SEQ ID NO: 96096 - RNA, 22 nt, Human
ggcugcagggaacaggaugggu

SEQ ID NO: 96097 - RNA, 22 nt, Human
ggcugcagugcaacucuuucua

SEQ ID NO: 96098 - RNA, 22 nt, Human
gcucuggcuacuguggcuaccg

SEQ ID NO: 96099 - RNA, 20 nt, Human
gcucuucuccgggucugccu

SEQ ID NO: 96100 - RNA, 22 nt, Human
gcucuggcugccuuaguuuugu

SEQ ID NO: 96101 - RNA, 22 nt, Human
gcucuugcuuuuucuagaaaga

SEQ ID NO: 96102 - RNA, 18 nt, Human
gcugaaauucuaaacaaa

SEQ ID NO: 96103 - RNA, 23 nt, Human
gcugaagcccacucccugggucu

SEQ ID NO: 96104 - RNA, 22 nt, Human
gcugccgcugcggggcgcgggc

SEQ ID NO: 96105 - RNA, 23 nt, Human
gcugcagugaauguuguuguugu

SEQ ID NO: 96106 - RNA, 22 nt, Human
gcugcaggaggugguagggucu

SEQ ID NO: 96107 - RNA, 22 nt, Human
gcugcacgguccuggcaccacg

SEQ ID NO: 96108 - RNA, 22 nt, Human
ggccgggugggaggcagcggag

SEQ ID NO: 96109 - RNA, 22 nt, Human
ggccuccaucuuaucuuacucu

SEQ ID NO: 96110 - RNA, 22 nt, Human
ggccugcuaccagcugugaccu

SEQ ID NO: 96111 - RNA, 22 nt, Human
ggccuggcacauaguaggcagu

SEQ ID NO: 96112 - RNA, 22 nt, Human
ggccaguauacaaacuuccggu

SEQ ID NO: 96113 - RNA, 22 nt, Human
ggccgcuuucuggggagugagg

SEQ ID NO: 96114 - RNA, 22 nt, Human
ggcccuggggcaggagcagagg

SEQ ID NO: 96115 - RNA, 22 nt, Human
ggcggcugcuccuugcccucgg

SEQ ID NO: 96116 - RNA, 22 nt, Human
ggcgggucuagggcccuggagu

SEQ ID NO: 96117 - RNA, 22 nt, Human
ggcuauuguuuuaaaaaaugag

SEQ ID NO: 96118 - RNA, 23 nt, Human
ggcgugcugggcugacccuuggc

SEQ ID NO: 96119 - RNA, 22 nt, Human
ggcuaaucaagaaggcccagug

SEQ ID NO: 96120 - RNA, 22 nt, Human
ggcgccugguauucuuccucuc

SEQ ID NO: 96121 - RNA, 22 nt, Human
ggcggagggcuguguccccggc

SEQ ID NO: 96122 - RNA, 23 nt, Human
ggccuuuuuaaccgcgagcgaca

SEQ ID NO: 96123 - RNA, 22 nt, Human
gcugccuugaacuuggccuggg

SEQ ID NO: 96124 - RNA, 22 nt, Human
ggcgacuacugaaugcuugaaa

SEQ ID NO: 96125 - RNA, 22 nt, Human
gcugcuggcuuccugcuguuuu

SEQ ID NO: 96126 - RNA, 22 nt, Human
ggcgauuggccgggaggaggca

SEQ ID NO: 96127 - RNA, 22 nt, Human
gcugcgccgggagccggggccg

SEQ ID NO: 96128 - RNA, 22 nt, Human
gcugcgcgcagccggcgccgag

SEQ ID NO: 96129 - RNA, 22 nt, Human
gcugcgcugggacgccaccaac

SEQ ID NO: 96130 - RNA, 22 nt, Human
gcuauuuagaaaggcuuggaga

SEQ ID NO: 96131 - RNA, 22 nt, Human
gcucaacucaacgucauuugaa

SEQ ID NO: 96132 - RNA, 22 nt, Human
ggcaggauggagcagggcuaaa

SEQ ID NO: 96133 - RNA, 22 nt, Human
gcuaaccaaaccuguuguuugg

SEQ ID NO: 96134 - RNA, 22 nt, Human
gcucaugggcccagagcagccc

SEQ ID NO: 96135 - RNA, 22 nt, Human
gcuccagcuccauaaacauaag

SEQ ID NO: 96136 - RNA, 18 nt, Human
ggcagggcucagcugcuc

SEQ ID NO: 96137 - RNA, 22 nt, Human
ggcagagcugugcgcccaccca

SEQ ID NO: 96138 - RNA, 22 nt, Human
ggcagaggaagcuggaaguggg

SEQ ID NO: 96139 - RNA, 22 nt, Human
ggcagaggagcuggaaacaugg

SEQ ID NO: 96140 - RNA, 22 nt, Human
gcggggggcucgggcagcucgg

SEQ ID NO: 96141 - RNA, 22 nt, Human
ggcagagguagcuggaaccagg

SEQ ID NO: 96142 - RNA, 22 nt, Human
gcuacaaaaccagggcaaagga

SEQ ID NO: 96143 - RNA, 22 nt, Human
gcuaagcuuugagucuggacag

SEQ ID NO: 96144 - RNA, 22 nt, Human
gcgugugugauaugccucugca

SEQ ID NO: 96145 - RNA, 22 nt, Human
gcgggugagauucgagagaugg

SEQ ID NO: 96146 - RNA, 22 nt, Human
gcgguggcuacuaaaguucgaa

SEQ ID NO: 96147 - RNA, 19 nt, Human
gcggcggugccggcuggga

SEQ ID NO: 96148 - RNA, 22 nt, Human
gcgggcuuggcuccagggccca

SEQ ID NO: 96149 - RNA, 22 nt, Human
ggcaaagaguacaucguccugg

SEQ ID NO: 96150 - RNA, 22 nt, Human
ggcaagauccagcacaaacaca

SEQ ID NO: 96151 - RNA, 22 nt, Human
ggauugaagggaaccucagaau

SEQ ID NO: 96152 - RNA, 22 nt, Human
ggauggugauguacccagucau

SEQ ID NO: 96153 - RNA, 22 nt, Human
ggagcauggcuucuuggggcug

SEQ ID NO: 96154 - RNA, 22 nt, Human
ggagcaucuaccauuucuagau

SEQ ID NO: 96155 - RNA, 22 nt, Human
ggaucgauuccaaauguagauc

SEQ ID NO: 96156 - RNA, 22 nt, Human
ggaugaguuguauauaggauuc

SEQ ID NO: 96157 - RNA, 22 nt, Human
ggagcagaggaaagaguagcau

SEQ ID NO: 96158 - RNA, 22 nt, Human
ggagaugucugugccacgucuc

SEQ ID NO: 96159 - RNA, 22 nt, Human
ggagcaagagugagcaagcaga

SEQ ID NO: 96160 - RNA, 22 nt, Human
gcgccgacccucccugccggac

SEQ ID NO: 96161 - RNA, 22 nt, Human
gcgcgccugccucccgcggugc

SEQ ID NO: 96162 - RNA, 20 nt, Human
gcgcaguuccgggcgcgucu

SEQ ID NO: 96163 - RNA, 22 nt, Human
ggagaaacuaguuagauccaau

SEQ ID NO: 96164 - RNA, 18 nt, Human
ggagaagaacagaugugg

SEQ ID NO: 96165 - RNA, 22 nt, Human
ggagauaugugaaaaagacagc

SEQ ID NO: 96166 - RNA, 22 nt, Human
ggacggggagcuggaaagggga

SEQ ID NO: 96167 - RNA, 22 nt, Human
gcgcacaaccccguggcgguga

SEQ ID NO: 96168 - RNA, 22 nt, Human
gccuugagcucaugucccagcu

SEQ ID NO: 96169 - RNA, 22 nt, Human
gccuuucuugguuugucaggca

SEQ ID NO: 96170 - RNA, 23 nt, Human
ggaauuucagaugugaaauaaaa

SEQ ID NO: 96171 - RNA, 22 nt, Human
ggacagacuuuacagccccggg

SEQ ID NO: 96172 - RNA, 22 nt, Human
ggacagagcaacccuacgcagc

SEQ ID NO: 96173 - RNA, 22 nt, Human
gccuggcagggagauuguaaga

SEQ ID NO: 96174 - RNA, 22 nt, Human
ggaauaauauuacagauacagu

SEQ ID NO: 96175 - RNA, 22 nt, Human
ggaaguggauucagggcugcua

SEQ ID NO: 96176 - RNA, 22 nt, Human
ggaagugagcucauuacuuuag

SEQ ID NO: 96177 - RNA, 22 nt, Human
ggaagucuacucuuccgaaaac

SEQ ID NO: 96178 - RNA, 22 nt, Human
ggaagguauuucuccuugagug

SEQ ID NO: 96179 - RNA, 18 nt, Human
ggaaggugcuggagugca

SEQ ID NO: 96180 - RNA, 22 nt, Human
ggaaggugagugcugugugauu

SEQ ID NO: 96181 - RNA, 22 nt, Human
ggaagcuguugugagugcagca

SEQ ID NO: 96182 - RNA, 22 nt, Human
ggaagcucaauacuuuccucuu

SEQ ID NO: 96183 - RNA, 22 nt, Human
ggaagauagaaguucaaaaguu

SEQ ID NO: 96184 - RNA, 22 nt, Human
gcuggucuggcaauccucaugg

SEQ ID NO: 96185 - RNA, 22 nt, Human
gcugggagucgcgucuguggcc

SEQ ID NO: 96186 - RNA, 22 nt, Human
gcugggagaggcagcuuucgga

SEQ ID NO: 96187 - RNA, 22 nt, Human
gcugggacacacagucuucuuu

SEQ ID NO: 96188 - RNA, 22 nt, Human
gcuggguuguucuccuggucca

SEQ ID NO: 96189 - RNA, 22 nt, Human
gcugggccucuuacuucuuacg

SEQ ID NO: 96190 - RNA, 22 nt, Human
ggccuugauuccggucauugaa

SEQ ID NO: 96191 - RNA, 22 nt, Human
ggccuugggauguggcugcagc

SEQ ID NO: 96192 - RNA, 22 nt, Human
gugcuugcgcauaacuggggcc

SEQ ID NO: 96193 - RNA, 22 nt, Human
guggaaauaugggcaacaaaga

SEQ ID NO: 96194 - RNA, 22 nt, Human
gggcagagggcgagcugggaga

SEQ ID NO: 96195 - RNA, 22 nt, Human
gggcaggggcagugguggcauu

SEQ ID NO: 96196 - RNA, 22 nt, Human
gggcaguuucaugugguucaac

SEQ ID NO: 96197 - RNA, 22 nt, Human
guggagauauuugugauagggg

SEQ ID NO: 96198 - RNA, 22 nt, Human
gggcaugugauggacgugugcc

SEQ ID NO: 96199 - RNA, 22 nt, Human
guggagaugagauauaccccuu

SEQ ID NO: 96200 - RNA, 22 nt, Human
guggacagacauaauccuaauu

SEQ ID NO: 96201 - RNA, 22 nt, Human
guggacuuuggucugugccauc

SEQ ID NO: 96202 - RNA, 22 nt, Human
guggacuagaguaggaguugca

SEQ ID NO: 96203 - RNA, 22 nt, Human
guggagaaauauguucagcuuc

SEQ ID NO: 96204 - RNA, 22 nt, Human
guggagaaagcuggaaucugag

SEQ ID NO: 96205 - RNA, 22 nt, Human
gggccaggaugugguucauuuu

SEQ ID NO: 96206 - RNA, 20 nt, Human
gggccagguggaccaggggc

SEQ ID NO: 96207 - RNA, 22 nt, Human
gggccgcagccucuccggccug

SEQ ID NO: 96208 - RNA, 22 nt, Human
gggccggagaagguagcugaag

SEQ ID NO: 96209 - RNA, 22 nt, Human
gggccggcuggggcggggcggg

SEQ ID NO: 96210 - RNA, 22 nt, Human
gugggagaaugggaggaguaau

SEQ ID NO: 96211 - RNA, 22 nt, Human
guggcuuuguuuccaaaugaaa

SEQ ID NO: 96212 - RNA, 22 nt, Human
guggaggguuugcaaugugcag

SEQ ID NO: 96213 - RNA, 22 nt, Human
gugggauaaccugagauaacau

SEQ ID NO: 96214 - RNA, 22 nt, Human
gugggaguggagcucagcaugu

SEQ ID NO: 96215 - RNA, 22 nt, Human
gugggcuuuuuugaaaccugaa

SEQ ID NO: 96216 - RNA, 22 nt, Human
gugggugaguggggccgccuga

SEQ ID NO: 96217 - RNA, 22 nt, Human
gggccugcgcuggggggagccg

SEQ ID NO: 96218 - RNA, 21 nt, Human
gggccugggccagggccgggu

SEQ ID NO: 96219 - RNA, 22 nt, Human
gggccuguccccccaggagaac

SEQ ID NO: 96220 - RNA, 22 nt, Human
guggggguaggggguuuucugg

SEQ ID NO: 96221 - RNA, 22 nt, Human
guggggguaggggguuuccugg

SEQ ID NO: 96222 - RNA, 18 nt, Human
guggccauugaccagcuu

SEQ ID NO: 96223 - RNA, 22 nt, Human
guggcgucgaugauggugucau

SEQ ID NO: 96224 - RNA, 22 nt, Human
guggccuuccuguuccuuugaa

SEQ ID NO: 96225 - RNA, 22 nt, Human
guggcuugguauuaaggugcca

SEQ ID NO: 96226 - RNA, 22 nt, Human
guggcuuucuaccauuaaauug

SEQ ID NO: 96227 - RNA, 22 nt, Human
guggauaaguuguuugaccuac

SEQ ID NO: 96228 - RNA, 22 nt, Human
guggcaaguuuucugacaagga

SEQ ID NO: 96229 - RNA, 22 nt, Human
guggauggagcuggaagccauu

SEQ ID NO: 96230 - RNA, 22 nt, Human
guggcagagagcaagugucuga

SEQ ID NO: 96231 - RNA, 22 nt, Human
gugguuugacccuucagguaaa

SEQ ID NO: 96232 - RNA, 22 nt, Human
gugguuuagccuucauuaaccu

SEQ ID NO: 96233 - RNA, 22 nt, Human
guguauuucuagaagaaaugaa

SEQ ID NO: 96234 - RNA, 22 nt, Human
guguaucagaggcuguguuaua

SEQ ID NO: 96235 - RNA, 22 nt, Human
gggcuacagaugggagggauga

SEQ ID NO: 96236 - RNA, 20 nt, Human
gggcucugcauccaucagcc

SEQ ID NO: 96237 - RNA, 22 nt, Human
gggcggugccugucuccgaagc

SEQ ID NO: 96238 - RNA, 22 nt, Human
gugguggggaguuggauggaag

SEQ ID NO: 96239 - RNA, 22 nt, Human
guggugggcgugguguaugccu

SEQ ID NO: 96240 - RNA, 22 nt, Human
gugguggugaggcaaggggugu

SEQ ID NO: 96241 - RNA, 22 nt, Human
gugggugauacugccgugggag

SEQ ID NO: 96242 - RNA, 22 nt, Human
guggguuggguuuuugaaggga

SEQ ID NO: 96243 - RNA, 22 nt, Human
gggcgcgccaggagcugcgcgg

SEQ ID NO: 96244 - RNA, 22 nt, Human
gggcgagcgucucagccgggcg

SEQ ID NO: 96245 - RNA, 22 nt, Human
gggcgcaagcaugugucugggu

SEQ ID NO: 96246 - RNA, 22 nt, Human
gggcggggggagcuggaaugaa

SEQ ID NO: 96247 - RNA, 22 nt, Human
gggcggggcuuccguccuccac

SEQ ID NO: 96248 - RNA, 22 nt, Human
guggugauuugggucuagcuuu

SEQ ID NO: 96249 - RNA, 18 nt, Human
gggcuuuacagaguggag

SEQ ID NO: 96250 - RNA, 22 nt, Human
gggcuuuuccaacacucuggag

SEQ ID NO: 96251 - RNA, 19 nt, Human
gggcuuguuggcaaaugac

SEQ ID NO: 96252 - RNA, 22 nt, Human
gugugucucaguugcuccgaag

SEQ ID NO: 96253 - RNA, 22 nt, Human
guguguggacgucugagcccag

SEQ ID NO: 96254 - RNA, 22 nt, Human
guguuagcauggaacagaacgc

SEQ ID NO: 96255 - RNA, 22 nt, Human
gggcuuguuaacuuggcuucca

SEQ ID NO: 96256 - RNA, 22 nt, Human
ggggaagaaauagaacauuuug

SEQ ID NO: 96257 - RNA, 22 nt, Human
ggggaagagagaagaaugaucu

SEQ ID NO: 96258 - RNA, 22 nt, Human
guguugaaaaguagcacugcuu

SEQ ID NO: 96259 - RNA, 22 nt, Human
guguugacacagccaucuuguc

SEQ ID NO: 96260 - RNA, 22 nt, Human
guguucccauccacaccaagcc

SEQ ID NO: 96261 - RNA, 22 nt, Human
gugugaguggcuaagugugccu

SEQ ID NO: 96262 - RNA, 22 nt, Human
guguccuguagaaacuguucca

SEQ ID NO: 96263 - RNA, 22 nt, Human
gugucuuauugauguuggcacu

SEQ ID NO: 96264 - RNA, 22 nt, Human
gugucauuggcuucccaagucc

SEQ ID NO: 96265 - RNA, 22 nt, Human
gggcugaugcuuauacauacug

SEQ ID NO: 96266 - RNA, 22 nt, Human
gggcuguaggagcuggaauggg

SEQ ID NO: 96267 - RNA, 23 nt, Human
gugugccuuuaucuucuguacuc

SEQ ID NO: 96268 - RNA, 22 nt, Human
guguguauguagguauauaugu

SEQ ID NO: 96269 - RNA, 22 nt, Human
ggguuaaauggauggcauuugc

SEQ ID NO: 96270 - RNA, 22 nt, Human
ggguucauuugccggguaguuu

SEQ ID NO: 96271 - RNA, 22 nt, Human
ggguuacgaugauuucaugugu

SEQ ID NO: 96272 - RNA, 22 nt, Human
ggguuccuuggaacacuguuug

SEQ ID NO: 96273 - RNA, 22 nt, Human
ggguucugggaggacuagggga

SEQ ID NO: 96274 - RNA, 22 nt, Human
ggguuguuuguauuucucugaa

SEQ ID NO: 96275 - RNA, 22 nt, Human
ggguuguagagcuggaagggga

SEQ ID NO: 96276 - RNA, 22 nt, Human
ggguuuuaccagauguguggug

SEQ ID NO: 96277 - RNA, 22 nt, Human
guucuuuacuucgcaucugcua

SEQ ID NO: 96278 - RNA, 22 nt, Human
guugagaagaccauuuuguuca

SEQ ID NO: 96279 - RNA, 22 nt, Human
guugagaaucucuagcuuagga

SEQ ID NO: 96280 - RNA, 22 nt, Human
guugauuuaggguuuugguuuu

SEQ ID NO: 96281 - RNA, 22 nt, Human
guugauuuaaccucaccuuuga

SEQ ID NO: 96282 - RNA, 22 nt, Human
guugauauggaaacucuagguu

SEQ ID NO: 96283 - RNA, 22 nt, Human
guugcuaugaaauuaaaauuua

SEQ ID NO: 96284 - RNA, 22 nt, Human
guugccugguuucaaaaggaau

SEQ ID NO: 96285 - RNA, 22 nt, Human
guugcggaguguagcgaugcuu

SEQ ID NO: 96286 - RNA, 22 nt, Human
guugcaaaugggaagaugguua

SEQ ID NO: 96287 - RNA, 22 nt, Human
gguaauugaaaguuuguugaug

SEQ ID NO: 96288 - RNA, 22 nt, Human
gguaauguucugaugaauuugu

SEQ ID NO: 96289 - RNA, 22 nt, Human
gguaagguugggugucagaggg

SEQ ID NO: 96290 - RNA, 22 nt, Human
guugagaggccuggcucuuuuc

SEQ ID NO: 96291 - RNA, 22 nt, Human
guucgucuguggugugaggugc

SEQ ID NO: 96292 - RNA, 22 nt, Human
gggucggcacucuggcagcacc

SEQ ID NO: 96293 - RNA, 22 nt, Human
gggugcuuaagcuuguuuguaa

SEQ ID NO: 96294 - RNA, 22 nt, Human
gggugcauggcagcccuucugg

SEQ ID NO: 96295 - RNA, 21 nt, Human
guucucacagcugaggugguu

SEQ ID NO: 96296 - RNA, 16 nt, Human
guuccuguguguacaa

SEQ ID NO: 96297 - RNA, 22 nt, Human
gggucucucuucuuucugugaa

SEQ ID NO: 96298 - RNA, 22 nt, Human
guucacaguauaucuuuuaacu

SEQ ID NO: 96299 - RNA, 22 nt, Human
guucauuucaagucuaauccau

SEQ ID NO: 96300 - RNA, 22 nt, Human
guucaccaguagcugggcuguu

SEQ ID NO: 96301 - RNA, 22 nt, Human
guuccgcugcaaggccaggaaa

SEQ ID NO: 96302 - RNA, 22 nt, Human
ggguggugagagaacuuugcag

SEQ ID NO: 96303 - RNA, 22 nt, Human
guucuguucuucacagguuugu

SEQ ID NO: 96304 - RNA, 22 nt, Human
guucuucagauuccauuucagu

SEQ ID NO: 96305 - RNA, 22 nt, Human
ggguguuaugccucugagucag

SEQ ID NO: 96306 - RNA, 22 nt, Human
gggugguggagguuugacagac

SEQ ID NO: 96307 - RNA, 22 nt, Human
gggugguuccuggaucugacug

SEQ ID NO: 96308 - RNA, 22 nt, Human
ggguggcaagucuuucugcaac

SEQ ID NO: 96309 - RNA, 22 nt, Human
guucuccaggggcuguucaucu

SEQ ID NO: 96310 - RNA, 22 nt, Human
guucuggaggagagccuggugu

SEQ ID NO: 96311 - RNA, 22 nt, Human
guucucuccugcuggugaugga

SEQ ID NO: 96312 - RNA, 22 nt, Human
guucuguauauauccuagcaaa

SEQ ID NO: 96313 - RNA, 22 nt, Human
guucuguuguugaucuuuggag

SEQ ID NO: 96314 - RNA, 22 nt, Human
gggguauuugguagacauuuug

SEQ ID NO: 96315 - RNA, 22 nt, Human
gggguaggaagagaaaauagug

SEQ ID NO: 96316 - RNA, 22 nt, Human
guuauacuuaugugcaaaaaua

SEQ ID NO: 96317 - RNA, 22 nt, Human
guuaggcagugugguauagcag

SEQ ID NO: 96318 - RNA, 22 nt, Human
gggggcgccgccgcucaucuca

SEQ ID NO: 96319 - RNA, 22 nt, Human
ggggcugggaggccggcgcgca

SEQ ID NO: 96320 - RNA, 22 nt, Human
ggggcuuggguagagcagaaac

SEQ ID NO: 96321 - RNA, 22 nt, Human
ggggcuuggguaagaaugcaaa

SEQ ID NO: 96322 - RNA, 22 nt, Human
gggggaaaguggagguucguga

SEQ ID NO: 96323 - RNA, 22 nt, Human
gggggagaauaugugaaggggg

SEQ ID NO: 96324 - RNA, 22 nt, Human
gggguugauaauuagagaaaug

SEQ ID NO: 96325 - RNA, 21 nt, Human
gggguuuuguucuuauaaugu

SEQ ID NO: 96326 - RNA, 22 nt, Human
gggucauugcgugacgcgagca

SEQ ID NO: 96327 - RNA, 22 nt, Human
guucaaggagcagcuugcuaca

SEQ ID NO: 96328 - RNA, 22 nt, Human
guucacauccuugugaggauuu

SEQ ID NO: 96329 - RNA, 22 nt, Human
guucaaccaugauuaggaacug

SEQ ID NO: 96330 - RNA, 22 nt, Human
guuauuaaauauuuuggugauu

SEQ ID NO: 96331 - RNA, 22 nt, Human
guuauugggagagggaauggga

SEQ ID NO: 96332 - RNA, 22 nt, Human
guuauuguuauugcguugucga

SEQ ID NO: 96333 - RNA, 22 nt, Human
guuaguucccaccccuguaaga

SEQ ID NO: 96334 - RNA, 22 nt, Human
ggggugagaguguuuuaaagca

SEQ ID NO: 96335 - RNA, 22 nt, Human
gggguguuuugaagagguucag

SEQ ID NO: 96336 - RNA, 22 nt, Human
guguuuauguuuuugcuaggga

SEQ ID NO: 96337 - RNA, 23 nt, Human
guguuguugauuuucgaaucuuu

SEQ ID NO: 96338 - RNA, 22 nt, Human
guguuggugagcucauuuccac

SEQ ID NO: 96339 - RNA, 22 nt, Human
guguugugauuggucagucacu

SEQ ID NO: 96340 - RNA, 22 nt, Human
guguugaugugucuguauucua

SEQ ID NO: 96341 - RNA, 22 nt, Human
guguugcaggaagauauagcug

SEQ ID NO: 96342 - RNA, 22 nt, Human
ggggaaggaaggggagggcacg

SEQ ID NO: 96343 - RNA, 22 nt, Human
ggggaauaaacacuuugucacu

SEQ ID NO: 96344 - RNA, 22 nt, Human
ggggacaagggugucaguaggc

SEQ ID NO: 96345 - RNA, 22 nt, Human
ggggaauuaaaugagaagccuu

SEQ ID NO: 96346 - RNA, 22 nt, Human
ggggacuugguuuuaaugagcu

SEQ ID NO: 96347 - RNA, 22 nt, Human
guuaaaggaagccauauguucg

SEQ ID NO: 96348 - RNA, 21 nt, Human
guuaccacugaugcaacagga

SEQ ID NO: 96349 - RNA, 22 nt, Human
ggggcggggagcaugagcuggg

SEQ ID NO: 96350 - RNA, 22 nt, Human
ggggcgaguguggaccgcagcc

SEQ ID NO: 96351 - RNA, 22 nt, Human
ggggccgggccggcagacuggg

SEQ ID NO: 96352 - RNA, 22 nt, Human
ggggauuuuucuuacucuuagg

SEQ ID NO: 96353 - RNA, 22 nt, Human
ggggccaaggcaaacuugaggg

SEQ ID NO: 96354 - RNA, 22 nt, Human
uaaccuuuuuuaaaguuuccug

SEQ ID NO: 96355 - RNA, 22 nt, Human
uaaccuugaagacugagcugac

SEQ ID NO: 96356 - RNA, 22 nt, Human
uaacauuuaguuuuaagauggu

SEQ ID NO: 96357 - RNA, 23 nt, Human
uaaauuuuauucugauaacacag

SEQ ID NO: 96358 - RNA, 22 nt, Human
uaacaacuuucugguguaacuu

SEQ ID NO: 96359 - RNA, 22 nt, Human
uaaauuugugaauuagcuauca

SEQ ID NO: 96360 - RNA, 23 nt, Human
uaacacaguccuggucuuuggcc

SEQ ID NO: 96361 - RNA, 22 nt, Human
uaacagugcuacaguuacuuuc

SEQ ID NO: 96362 - RNA, 22 nt, Human
guaggugggcuuccaagguccu

SEQ ID NO: 96363 - RNA, 22 nt, Human
guaguuuuucuugcaagaguag

SEQ ID NO: 96364 - RNA, 22 nt, Human
guaguuuuugagcuguaaucuu

SEQ ID NO: 96365 - RNA, 22 nt, Human
guaguuagaguugugcuggaga

SEQ ID NO: 96366 - RNA, 22 nt, Human
guagugauuguuccucaggggu

SEQ ID NO: 96367 - RNA, 22 nt, Human
guaguucuccaggggcuguuca

SEQ ID NO: 96368 - RNA, 22 nt, Human
uaacuugaauacauucuuuuca

SEQ ID NO: 96369 - RNA, 22 nt, Human
uaacuuuucuguucaauuuucc

SEQ ID NO: 96370 - RNA, 22 nt, Human
uaacgcaucuggaaacaggaca

SEQ ID NO: 96371 - RNA, 22 nt, Human
uaacucugcuguggaaauggga

SEQ ID NO: 96372 - RNA, 22 nt, Human
guauaaagaugccauacuuacu

SEQ ID NO: 96373 - RNA, 22 nt, Human
guaguuuucaugguuagaaaua

SEQ ID NO: 96374 - RNA, 22 nt, Human
guauauuuaugagcauuagccu

SEQ ID NO: 96375 - RNA, 22 nt, Human
guauauccaauaggugaugaaa

SEQ ID NO: 96376 - RNA, 22 nt, Human
guaucaggugugagcauuuuaa

SEQ ID NO: 96377 - RNA, 22 nt, Human
uaagaaacauuuuuaugacagu

SEQ ID NO: 96378 - RNA, 22 nt, Human
guaucugaaaaagaauucugac

SEQ ID NO: 96379 - RNA, 22 nt, Human
guauuaugaaugccgaggcggc

SEQ ID NO: 96380 - RNA, 23 nt, Human
uaagccugugccugcuaccugcu

SEQ ID NO: 96381 - RNA, 22 nt, Human
guauuaagaaaugccugugaaa

SEQ ID NO: 96382 - RNA, 22 nt, Human
guaugugugcauacauguacga

SEQ ID NO: 96383 - RNA, 22 nt, Human
uaagagcagacacaaccugaga

SEQ ID NO: 96384 - RNA, 22 nt, Human
guagucauugggucugugguca

SEQ ID NO: 96385 - RNA, 22 nt, Human
uaagaggucugaaacgguggga

SEQ ID NO: 96386 - RNA, 22 nt, Human
guaugugguaccaugcaacggg

SEQ ID NO: 96387 - RNA, 22 nt, Human
uaagcguuugggaguuaugaac

SEQ ID NO: 96388 - RNA, 22 nt, Human
guauuugcaaucacaaacaaaa

SEQ ID NO: 96389 - RNA, 22 nt, Human
guauuuggacugccuguucauu

SEQ ID NO: 96390 - RNA, 22 nt, Human
uaagcgagccaguggaaaaagc

SEQ ID NO: 96391 - RNA, 22 nt, Human
gucaaaguuaacuagcaggugc

SEQ ID NO: 96392 - RNA, 22 nt, Human
gucacaaaugauuuagcaauca

SEQ ID NO: 96393 - RNA, 22 nt, Human
gucagacucuggggccccaggc

SEQ ID NO: 96394 - RNA, 23 nt, Human
gucaccuccccuugccuucuccc

SEQ ID NO: 96395 - RNA, 22 nt, Human
gucacuuugcuugcgaugcucc

SEQ ID NO: 96396 - RNA, 22 nt, Human
guuuuuacuuccaaugcuauga

SEQ ID NO: 96397 - RNA, 22 nt, Human
guuuuuaguuuaaguuuuugca

SEQ ID NO: 96398 - RNA, 22 nt, Human
guuuuucuagaaaucuccuccu

SEQ ID NO: 96399 - RNA, 22 nt, Human
guuuuucuuugauuuagaacca

SEQ ID NO: 96400 - RNA, 22 nt, Human
gguguuccgguucugcucuggg

SEQ ID NO: 96401 - RNA, 22 nt, Human
uaaaaguuagcuaggacaaagu

SEQ ID NO: 96402 - RNA, 22 nt, Human
gguuaacaccacagcugggaca

SEQ ID NO: 96403 - RNA, 22 nt, Human
gguucaaagccugaugggguug

SEQ ID NO: 96404 - RNA, 22 nt, Human
uaaacugacagugagggagagu

SEQ ID NO: 96405 - RNA, 22 nt, Human
gguugccuuugcaguuggauca

SEQ ID NO: 96406 - RNA, 22 nt, Human
gguugcggaccagcugggcugc

SEQ ID NO: 96407 - RNA, 22 nt, Human
uaaagaagaaaaggcuucaggc

SEQ ID NO: 96408 - RNA, 22 nt, Human
guaaauacuaugagauaaugaa

SEQ ID NO: 96409 - RNA, 22 nt, Human
uaaauguacugaggcaacagga

SEQ ID NO: 96410 - RNA, 22 nt, Human
uaaaugauaguauugaagguag

SEQ ID NO: 96411 - RNA, 21 nt, Human
gguuucugcaaaccuuguaca

SEQ ID NO: 96412 - RNA, 22 nt, Human
gguuuaucuuuacaaaugaaau

SEQ ID NO: 96413 - RNA, 22 nt, Human
gguugggauuauccaaggcaga

SEQ ID NO: 96414 - RNA, 22 nt, Human
guuuuguucaugaacauugggu

SEQ ID NO: 96415 - RNA, 22 nt, Human
guuuucuccugcuauacagugc

SEQ ID NO: 96416 - RNA, 22 nt, Human
guuuucuaaaacacauauaagu

SEQ ID NO: 96417 - RNA, 22 nt, Human
gguggcauguaccucacagacu

SEQ ID NO: 96418 - RNA, 22 nt, Human
gguggccuaacaaugguggcaa

SEQ ID NO: 96419 - RNA, 22 nt, Human
ggucaaucaugggucauugucu

SEQ ID NO: 96420 - RNA, 20 nt, Human
ggucagccaagaaguuaccu

SEQ ID NO: 96421 - RNA, 22 nt, Human
ggucaauuuggucaaucguuua

SEQ ID NO: 96422 - RNA, 22 nt, Human
ggucauacaaggcacuggugau

SEQ ID NO: 96423 - RNA, 22 nt, Human
gguggagacucagauuuguugc

SEQ ID NO: 96424 - RNA, 22 nt, Human
ggugcuucgauagguguccaua

SEQ ID NO: 96425 - RNA, 22 nt, Human
guuuuauaacuauagugagaau

SEQ ID NO: 96426 - RNA, 22 nt, Human
guuuuaaucuccuuauuccuaa

SEQ ID NO: 96427 - RNA, 22 nt, Human
guugcuggggcugaguccccag

SEQ ID NO: 96428 - RNA, 22 nt, Human
uaauaguugaaggucaucacua

SEQ ID NO: 96429 - RNA, 22 nt, Human
uaauagauagggagaguugcug

SEQ ID NO: 96430 - RNA, 22 nt, Human
uacaaauguuucuucuccuuuu

SEQ ID NO: 96431 - RNA, 22 nt, Human
uacaaauuguuuugccacaaag

SEQ ID NO: 96432 - RNA, 22 nt, Human
uaauaacuacacucagaggacc

SEQ ID NO: 96433 - RNA, 22 nt, Human
uaauaagugcuggcuguacauc

SEQ ID NO: 96434 - RNA, 21 nt, Human
uaauaauugggggcagggugg

SEQ ID NO: 96435 - RNA, 22 nt, Human
uaauaauuaacagugauggguc

SEQ ID NO: 96436 - RNA, 22 nt, Human
gucaggaugagggaugaggagu

SEQ ID NO: 96437 - RNA, 22 nt, Human
uaauaaaaauuuaauucacauu

SEQ ID NO: 96438 - RNA, 22 nt, Human
uaagugugcauguguauuauau

SEQ ID NO: 96439 - RNA, 22 nt, Human
gucugccagauucugcuggauc

SEQ ID NO: 96440 - RNA, 22 nt, Human
gucugcccuuggccugggacuu

SEQ ID NO: 96441 - RNA, 22 nt, Human
uacaaucacccaaagagccaga

SEQ ID NO: 96442 - RNA, 22 nt, Human
uacacacacaugcauguacgug

SEQ ID NO: 96443 - RNA, 22 nt, Human
gucuccugcccacccugguccc

SEQ ID NO: 96444 - RNA, 23 nt, Human
gucucacaaccaccugagaaaau

SEQ ID NO: 96445 - RNA, 22 nt, Human
gucugcagcacugugcacgguc

SEQ ID NO: 96446 - RNA, 20 nt, Human
uacaaggauguucaucagag

SEQ ID NO: 96447 - RNA, 20 nt, Human
uacaauauucccacuuugcu

SEQ ID NO: 96448 - RNA, 22 nt, Human
uacuuaauuuuaaaagcuagau

SEQ ID NO: 96449 - RNA, 22 nt, Human
gugaagcacaugggcguugggu

SEQ ID NO: 96450 - RNA, 22 nt, Human
uacugacguaguagaguugcuu

SEQ ID NO: 96451 - RNA, 22 nt, Human
uacugaagaugccaucacaagc

SEQ ID NO: 96452 - RNA, 22 nt, Human
uacugaauuacugcugguaaau

SEQ ID NO: 96453 - RNA, 22 nt, Human
uacucuggaguugagaugcgag

SEQ ID NO: 96454 - RNA, 22 nt, Human
uacucgaaaucagagagaauaa

SEQ ID NO: 96455 - RNA, 22 nt, Human
uacagcuuccucuaugguggcc

SEQ ID NO: 96456 - RNA, 21 nt, Human
uacagcucaucaauuacugcu

SEQ ID NO: 96457 - RNA, 22 nt, Human
uacaggaggaugugcagccagg

SEQ ID NO: 96458 - RNA, 23 nt, Human
uaccagacccugaaagaaagugu

SEQ ID NO: 96459 - RNA, 20 nt, Human
uaccagggguuugggacagc

SEQ ID NO: 96460 - RNA, 23 nt, Human
uaccauugauuuuaugguuuucu

SEQ ID NO: 96461 - RNA, 20 nt, Human
uaccaucauuggcaaaccuc

SEQ ID NO: 96462 - RNA, 22 nt, Human
uacccauuuugguucuugaugc

SEQ ID NO: 96463 - RNA, 22 nt, Human
uacuaaagaaugaguuaaguuu

SEQ ID NO: 96464 - RNA, 19 nt, Human
uacccggauagccagguag

SEQ ID NO: 96465 - RNA, 22 nt, Human
uacuauuuugacaugaaauuga

SEQ ID NO: 96466 - RNA, 22 nt, Human
uacuaccugcaggaacaauuag

SEQ ID NO: 96467 - RNA, 19 nt, Human
uagauuagagcauaggguu

SEQ ID NO: 96468 - RNA, 22 nt, Human
gugcauauguguguauacaaac

SEQ ID NO: 96469 - RNA, 22 nt, Human
uagaguaagugugugcugagcu

SEQ ID NO: 96470 - RNA, 22 nt, Human
uagaggcuagugguuaugaccu

SEQ ID NO: 96471 - RNA, 22 nt, Human
gugcagcugguggagucugggg

SEQ ID NO: 96472 - RNA, 19 nt, Human
gugcacugucacuuugcuc

SEQ ID NO: 96473 - RNA, 22 nt, Human
gugccuggugcaggauaaucac

SEQ ID NO: 96474 - RNA, 22 nt, Human
gugccuuuuucccaguucauug

SEQ ID NO: 96475 - RNA, 22 nt, Human
uagcaggagagaaguuuuaagu

SEQ ID NO: 96476 - RNA, 22 nt, Human
uagcagcacuauuuguuguagu

SEQ ID NO: 96477 - RNA, 22 nt, Human
gugccgcuggagcuggaauuga

SEQ ID NO: 96478 - RNA, 22 nt, Human
gugccgggcugcggcaaggugu

SEQ ID NO: 96479 - RNA, 22 nt, Human
gugccucuaguuuucuccuaaa

SEQ ID NO: 96480 - RNA, 22 nt, Human
gugccugcucauucucaauauu

SEQ ID NO: 96481 - RNA, 22 nt, Human
gugccuggaaucuuuucuucac

SEQ ID NO: 96482 - RNA, 21 nt, Human
uagaccagcugugcuccucgg

SEQ ID NO: 96483 - RNA, 19 nt, Human
gugauauuuauuauuuauu

SEQ ID NO: 96484 - RNA, 22 nt, Human
uagaaauaaacacugcuaccuu

SEQ ID NO: 96485 - RNA, 22 nt, Human
uagaaguuaaaggaauacagaa

SEQ ID NO: 96486 - RNA, 22 nt, Human
gugauauaacaauuuagggaau

SEQ ID NO: 96487 - RNA, 22 nt, Human
uacuuaucuuagggaugcuugc

SEQ ID NO: 96488 - RNA, 22 nt, Human
gugaguugugugaguaagcaga

SEQ ID NO: 96489 - RNA, 22 nt, Human
gugaggugauugcugguguuug

SEQ ID NO: 96490 - RNA, 22 nt, Human
gugauggucgagcgcuuguugu

SEQ ID NO: 96491 - RNA, 22 nt, Human
gugaugaagguggagaaucaga

SEQ ID NO: 96492 - RNA, 22 nt, Human
uagagaaauuacagcuuucuuu

SEQ ID NO: 96493 - RNA, 22 nt, Human
uagagaaauauuuguagugcug

SEQ ID NO: 96494 - RNA, 22 nt, Human
gugaugugugaaggucugcagg

SEQ ID NO: 96495 - RNA, 22 nt, Human
gugauuucaaauauagagugag

SEQ ID NO: 96496 - RNA, 22 nt, Human
gugauuucagguuuuucauacu

SEQ ID NO: 96497 - RNA, 22 nt, Human
uagaggauucuaaaggaagcug

SEQ ID NO: 96498 - RNA, 19 nt, Human
uagagcagcuucagauucc

SEQ ID NO: 96499 - RNA, 19 nt, Human
uccuacaugagacagagag

SEQ ID NO: 96500 - RNA, 22 nt, Human
uccucuucaaaauagcucugaa

SEQ ID NO: 96501 - RNA, 22 nt, Human
uccucugagguccucucggcca

SEQ ID NO: 96502 - RNA, 22 nt, Human
uagaagaugccuuaaaguugaa

SEQ ID NO: 96503 - RNA, 22 nt, Human
uacuuacacugaagcaaagaua

SEQ ID NO: 96504 - RNA, 22 nt, Human
uacuucaguuacaugaagguau

SEQ ID NO: 96505 - RNA, 22 nt, Human
ucccagcaggcaccgcuucugc

SEQ ID NO: 96506 - RNA, 22 nt, Human
ucccagccugacagugcaucaa

SEQ ID NO: 96507 - RNA, 22 nt, Human
ucccagucuagagccggauugg

SEQ ID NO: 96508 - RNA, 22 nt, Human
ucccauauuauggggaaaaacu

SEQ ID NO: 96509 - RNA, 22 nt, Human
uagcauuuauugggcuagcaaa

SEQ ID NO: 96510 - RNA, 22 nt, Human
uagccaaguguuuuucaugacc

SEQ ID NO: 96511 - RNA, 22 nt, Human
uagcauuucacugaucuucacu

SEQ ID NO: 96512 - RNA, 22 nt, Human
uagcaggaggcaguuccucgcu

SEQ ID NO: 96513 - RNA, 22 nt, Human
uagcauaaaguuucuguguggu

SEQ ID NO: 96514 - RNA, 22 nt, Human
uagcauccugugugaauguauu

SEQ ID NO: 96515 - RNA, 22 nt, Human
uagcaaucugugaugugugugu

SEQ ID NO: 96516 - RNA, 22 nt, Human
uagcaaugugggugggcuccaa

SEQ ID NO: 96517 - RNA, 22 nt, Human
uccugagaagcacuuaauacac

SEQ ID NO: 96518 - RNA, 22 nt, Human
uagcuucccagcuaaccauguc

SEQ ID NO: 96519 - RNA, 22 nt, Human
uccuuucaaauuuauuugacau

SEQ ID NO: 96520 - RNA, 18 nt, Human
uccuuucaccccuucucu

SEQ ID NO: 96521 - RNA, 22 nt, Human
uccuuuucuuugaggaaggugu

SEQ ID NO: 96522 - RNA, 22 nt, Human
uagcccgugaggaggggcugug

SEQ ID NO: 96523 - RNA, 22 nt, Human
uagccuguuuuuaugagaauuu

SEQ ID NO: 96524 - RNA, 22 nt, Human
uagcgggucacccugcugugaa

SEQ ID NO: 96525 - RNA, 22 nt, Human
uagccaucaugaguaagggcuu

SEQ ID NO: 96526 - RNA, 22 nt, Human
uaguccacagagggcaggguca

SEQ ID NO: 96527 - RNA, 22 nt, Human
ucgugaagaaauguggacuuca

SEQ ID NO: 96528 - RNA, 22 nt, Human
ucgugagugcugucaccugcug

SEQ ID NO: 96529 - RNA, 22 nt, Human
uaguauuguguuguuugacagu

SEQ ID NO: 96530 - RNA, 22 nt, Human
ucgugacuggacaaacuugggu

SEQ ID NO: 96531 - RNA, 20 nt, Human
uagugaccaagagggcugcu

SEQ ID NO: 96532 - RNA, 22 nt, Human
ucguuucuuuuucuucccugga

SEQ ID NO: 96533 - RNA, 22 nt, Human
ucuaaaaauuagaaauuagguc

SEQ ID NO: 96534 - RNA, 22 nt, Human
ucuaagcuugaucacuugcuuu

SEQ ID NO: 96535 - RNA, 21 nt, Human
ucgggcggcggcugaggcggc

SEQ ID NO: 96536 - RNA, 22 nt, Human
ucgggaggaggcggagcucguu

SEQ ID NO: 96537 - RNA, 22 nt, Human
uaggucugaggcugcaucuugg

SEQ ID NO: 96538 - RNA, 22 nt, Human
uaggucaaggccacuucuugga

SEQ ID NO: 96539 - RNA, 22 nt, Human
uagguaauacuuagaccugauu

SEQ ID NO: 96540 - RNA, 22 nt, Human
uagguauguuaacugugcaauu

SEQ ID NO: 96541 - RNA, 22 nt, Human
uaguaauagcuguaaagugugu

SEQ ID NO: 96542 - RNA, 22 nt, Human
uagguuuugugucagaguagaa

SEQ ID NO: 96543 - RNA, 22 nt, Human
uagguuguaagaggucuuuugu

SEQ ID NO: 96544 - RNA, 22 nt, Human
ucgcuguguccuuuucacuuau

SEQ ID NO: 96545 - RNA, 22 nt, Human
ucgcuucugaguuggugacccc

SEQ ID NO: 96546 - RNA, 22 nt, Human
ucgcuugaacccaggaagugga

SEQ ID NO: 96547 - RNA, 22 nt, Human
ucggcgaccugucauggaccaa

SEQ ID NO: 96548 - RNA, 22 nt, Human
ucggccggagggggcgggcgca

SEQ ID NO: 96549 - RNA, 19 nt, Human
ucggaaugugggaagcaug

SEQ ID NO: 96550 - RNA, 22 nt, Human
ucggauuggggaugggugggag

SEQ ID NO: 96551 - RNA, 20 nt, Human
ucgcugcaagggaaauggag

SEQ ID NO: 96552 - RNA, 22 nt, Human
uaggccugcugaagagcaagcu

SEQ ID NO: 96553 - RNA, 22 nt, Human
uaggcaguagcuuuggauguca

SEQ ID NO: 96554 - RNA, 22 nt, Human
uaggcauguaaaagugaguucg

SEQ ID NO: 96555 - RNA, 22 nt, Human
uaggcaauauuagacuuugucu

SEQ ID NO: 96556 - RNA, 22 nt, Human
ucgagcgcucccugugcucucg

SEQ ID NO: 96557 - RNA, 22 nt, Human
uaggaucaugaugguaaggcaa

SEQ ID NO: 96558 - RNA, 22 nt, Human
ucgagauguuuguuguggugau

SEQ ID NO: 96559 - RNA, 22 nt, Human
ucgaaugccaacaccgaaguuu

SEQ ID NO: 96560 - RNA, 22 nt, Human
uccuuuuuagguuauuguacau

SEQ ID NO: 96561 - RNA, 22 nt, Human
ucgacuccauuuuucuugguuc

SEQ ID NO: 96562 - RNA, 22 nt, Human
ucgcucgcuggcuccugcccgc

SEQ ID NO: 96563 - RNA, 22 nt, Human
ucgcggccgcuccacaugcaca

SEQ ID NO: 96564 - RNA, 22 nt, Human
uaggcaaguggaccagagguuu

SEQ ID NO: 96565 - RNA, 22 nt, Human
ucgccuccucccagaucaacaa

SEQ ID NO: 96566 - RNA, 22 nt, Human
ucgcccagguuggagugcagug

SEQ ID NO: 96567 - RNA, 22 nt, Human
uccagccauaucuuguagcccu

SEQ ID NO: 96568 - RNA, 20 nt, Human
uacccgcagcugggucuggc

SEQ ID NO: 96569 - RNA, 22 nt, Human
uaccgcagagucauugugagga

SEQ ID NO: 96570 - RNA, 22 nt, Human
uaccgaagcugcuuuugcaugu

SEQ ID NO: 96571 - RNA, 22 nt, Human
uccagccugaacuuuguccaga

SEQ ID NO: 96572 - RNA, 22 nt, Human
uccagguucaguucaucaucua

SEQ ID NO: 96573 - RNA, 17 nt, Human
uccauugagacaagaag

SEQ ID NO: 96574 - RNA, 22 nt, Human
uccauaugaucuguuguauggu

SEQ ID NO: 96575 - RNA, 22 nt, Human
uacucauuggagaauuacgagg

SEQ ID NO: 96576 - RNA, 22 nt, Human
uccagguuuggcuuuauaacuu

SEQ ID NO: 96577 - RNA, 22 nt, Human
uccagugaacaucauggcucca

SEQ ID NO: 96578 - RNA, 22 nt, Human
uccagugccagcuguuaaaguu

SEQ ID NO: 96579 - RNA, 22 nt, Human
uacuaucauuuuuuguugccaa

SEQ ID NO: 96580 - RNA, 21 nt, Human
uacugugccagggcagcucug

SEQ ID NO: 96581 - RNA, 23 nt, Human
ucccaacuuugaaauauuccaca

SEQ ID NO: 96582 - RNA, 22 nt, Human
ucccaccugcuaagauguaucc

SEQ ID NO: 96583 - RNA, 22 nt, Human
uacugaaagagugguggacucu

SEQ ID NO: 96584 - RNA, 22 nt, Human
uacuggaugcaacaaagcccag

SEQ ID NO: 96585 - RNA, 22 nt, Human
uccacuuaaaacucuuuuuguc

SEQ ID NO: 96586 - RNA, 22 nt, Human
uccagagcuguccuacugugag

SEQ ID NO: 96587 - RNA, 22 nt, Human
uaccauaaagcaggcaaaugag

SEQ ID NO: 96588 - RNA, 21 nt, Human
uaccacugaaauugaucguuc

SEQ ID NO: 96589 - RNA, 22 nt, Human
uacauguggagauaacugaagc

SEQ ID NO: 96590 - RNA, 22 nt, Human
uacagugaggcgagauucacca

SEQ ID NO: 96591 - RNA, 22 nt, Human
uacaccaugcuccagcaggaca

SEQ ID NO: 96592 - RNA, 22 nt, Human
uacaccuuaagccgcggcuccc

SEQ ID NO: 96593 - RNA, 22 nt, Human
uacagauggacacuguuucaag

SEQ ID NO: 96594 - RNA, 22 nt, Human
uacagaccaguaguucucagcg

SEQ ID NO: 96595 - RNA, 22 nt, Human
uccaccaccaucacagucagac

SEQ ID NO: 96596 - RNA, 22 nt, Human
uccacagggaugccugcggcuu

SEQ ID NO: 96597 - RNA, 19 nt, Human
uccaccgcgugcaccucua

SEQ ID NO: 96598 - RNA, 22 nt, Human
uccacuaucagaccuguagucu

SEQ ID NO: 96599 - RNA, 21 nt, Human
uacaucaguuuucuuggcuca

SEQ ID NO: 96600 - RNA, 22 nt, Human
uccaccugucccugcuuccugc

SEQ ID NO: 96601 - RNA, 22 nt, Human
ucauccucguccucuggugccc

SEQ ID NO: 96602 - RNA, 22 nt, Human
ucaucuuuauaaugcaaguuuu

SEQ ID NO: 96603 - RNA, 22 nt, Human
uaagggagcagaagcugugaaa

SEQ ID NO: 96604 - RNA, 22 nt, Human
ucaugacaacuugcacaguuuu

SEQ ID NO: 96605 - RNA, 22 nt, Human
uaagaaaggggaaguuccucuu

SEQ ID NO: 96606 - RNA, 22 nt, Human
uaacuuuuuauccuguuaaaug

SEQ ID NO: 96607 - RNA, 22 nt, Human
uaaagaggagaauuaagucagc

SEQ ID NO: 96608 - RNA, 22 nt, Human
uaaagacaauuucgagcuguag

SEQ ID NO: 96609 - RNA, 23 nt, Human
uaaagauaguuuaaaggugaguu

SEQ ID NO: 96610 - RNA, 22 nt, Human
uaaagcacucaaaauuguagcu

SEQ ID NO: 96611 - RNA, 22 nt, Human
uaagauauugagugguaauuug

SEQ ID NO: 96612 - RNA, 22 nt, Human
uaagauuuuuacaaauagagug

SEQ ID NO: 96613 - RNA, 20 nt, Human
ucaguuucccuauuagguug

SEQ ID NO: 96614 - RNA, 22 nt, Human
ucaucauccuuuuuugaagagu

SEQ ID NO: 96615 - RNA, 22 nt, Human
uaaguuguagaacguuuucuua

SEQ ID NO: 96616 - RNA, 22 nt, Human
ucauugguugcguaauuugauu

SEQ ID NO: 96617 - RNA, 22 nt, Human
ucauugguugcauaauuugauc

SEQ ID NO: 96618 - RNA, 23 nt, Human
ucauugcucaagauaaugguuga

SEQ ID NO: 96619 - RNA, 22 nt, Human
ucauucucucguauucgcgaau

SEQ ID NO: 96620 - RNA, 22 nt, Human
uccaaauucccaugacagaagu

SEQ ID NO: 96621 - RNA, 22 nt, Human
ucauugugugugcuucuugggc

SEQ ID NO: 96622 - RNA, 22 nt, Human
uacaaucaggcucuagcuucuc

SEQ ID NO: 96623 - RNA, 22 nt, Human
ucauuugggauuuuuuauaauu

SEQ ID NO: 96624 - RNA, 22 nt, Human
uacaaauugccugacggcaggu

SEQ ID NO: 96625 - RNA, 22 nt, Human
uaauuauuaauuuuagguugcu

SEQ ID NO: 96626 - RNA, 22 nt, Human
uaauuccacacucccgcaagcg

SEQ ID NO: 96627 - RNA, 22 nt, Human
ucagcguuggccuccuccaggg

SEQ ID NO: 96628 - RNA, 21 nt, Human
ucagccuguccaguguuaacc

SEQ ID NO: 96629 - RNA, 23 nt, Human
guuuuugcugcagcugaagaagg

SEQ ID NO: 96630 - RNA, 22 nt, Human
uaaaaccauucauugaccuaug

SEQ ID NO: 96631 - RNA, 21 nt, Human
uaaaagaugacaagacagcuc

SEQ ID NO: 96632 - RNA, 22 nt, Human
ucagccuugguuuugguguugg

SEQ ID NO: 96633 - RNA, 23 nt, Human
ucagccgcuggcgaguccacugg

SEQ ID NO: 96634 - RNA, 22 nt, Human
ucagcaguuaagcuucccugcc

SEQ ID NO: 96635 - RNA, 19 nt, Human
ucagcagauuuugcaaaca

SEQ ID NO: 96636 - RNA, 22 nt, Human
ucagcaaugggauucaggcuuu

SEQ ID NO: 96637 - RNA, 22 nt, Human
ucagauagcaagggauaccugu

SEQ ID NO: 96638 - RNA, 22 nt, Human
guuuuaucuauguaauuauaaa

SEQ ID NO: 96639 - RNA, 22 nt, Human
ucagaacuaacuuugcugaacc

SEQ ID NO: 96640 - RNA, 22 nt, Human
guuuuagugauaagaacaccaa

SEQ ID NO: 96641 - RNA, 22 nt, Human
guuugguucucauuguuuuucu

SEQ ID NO: 96642 - RNA, 22 nt, Human
guuugggauucuagacaaaaau

SEQ ID NO: 96643 - RNA, 22 nt, Human
guuuuauguuuuauagacacaa

SEQ ID NO: 96644 - RNA, 22 nt, Human
ucagaagguacugaagacaugg

SEQ ID NO: 96645 - RNA, 22 nt, Human
ucagaaggagagacagcgugga

SEQ ID NO: 96646 - RNA, 20 nt, Human
ucagaaugugacccccaugg

SEQ ID NO: 96647 - RNA, 22 nt, Human
ucagacacacaacuucugcuua

SEQ ID NO: 96648 - RNA, 22 nt, Human
guuuugauggaguguguuaaau

SEQ ID NO: 96649 - RNA, 22 nt, Human
guuuugaugugauuucucaugu

SEQ ID NO: 96650 - RNA, 22 nt, Human
guuuugaagagaagcaagucug

SEQ ID NO: 96651 - RNA, 22 nt, Human
guuuucuuguuaauuuugaacg

SEQ ID NO: 96652 - RNA, 22 nt, Human
guuuuguagucuggagacuguc

SEQ ID NO: 96653 - RNA, 22 nt, Human
ucagauaauccaauagagagga

SEQ ID NO: 96654 - RNA, 22 nt, Human
ucagagccagacacacagcaga

SEQ ID NO: 96655 - RNA, 22 nt, Human
ucacugaauuucaagcuagugg

SEQ ID NO: 96656 - RNA, 23 nt, Human
ucacugccaagaaaaguuacaga

SEQ ID NO: 96657 - RNA, 22 nt, Human
ucacugccuagggcuacugugc

SEQ ID NO: 96658 - RNA, 22 nt, Human
ucaccuguuggauguauacugu

SEQ ID NO: 96659 - RNA, 22 nt, Human
ucaccuguucaacagcaauaau

SEQ ID NO: 96660 - RNA, 22 nt, Human
ucacuggaaaacaaauguuuua

SEQ ID NO: 96661 - RNA, 22 nt, Human
ucacugaacucucauagagaaa

SEQ ID NO: 96662 - RNA, 22 nt, Human
guuuggguggcuagagaaagaa

SEQ ID NO: 96663 - RNA, 22 nt, Human
ucacuucuaugaucugucucuu

SEQ ID NO: 96664 - RNA, 22 nt, Human
guuuauuucuuaucaucacuau

SEQ ID NO: 96665 - RNA, 22 nt, Human
ucaccuggagagcuugcuaaua

SEQ ID NO: 96666 - RNA, 22 nt, Human
guuugcagacuauguaaacuuc

SEQ ID NO: 96667 - RNA, 22 nt, Human
guuugaacagaaggguugauca

SEQ ID NO: 96668 - RNA, 22 nt, Human
guuugagcaaucccucuauccc

SEQ ID NO: 96669 - RNA, 22 nt, Human
guuucucuuugguggguugaga

SEQ ID NO: 96670 - RNA, 22 nt, Human
ucaccccagccuuaugacucag

SEQ ID NO: 96671 - RNA, 22 nt, Human
ucaccauguuuucauaggaaca

SEQ ID NO: 96672 - RNA, 22 nt, Human
ucacccuguggcuauaaggcaa

SEQ ID NO: 96673 - RNA, 22 nt, Human
guuuauucuuuuauuugugaga

SEQ ID NO: 96674 - RNA, 22 nt, Human
ucaccauguacaugaagggcgg

SEQ ID NO: 96675 - RNA, 22 nt, Human
ucaccaugcccuucucugcucu

SEQ ID NO: 96676 - RNA, 21 nt, Human
ucacagggucacucuuaccac

SEQ ID NO: 96677 - RNA, 23 nt, Human
ucacaaggcuauguuauauguac

SEQ ID NO: 96678 - RNA, 22 nt, Human
ucaauuggcuacaaauaaugua

SEQ ID NO: 96679 - RNA, 22 nt, Human
ucacaagaagaaauuaaacugu

SEQ ID NO: 96680 - RNA, 22 nt, Human
ucacauggauuaacucauuuau

SEQ ID NO: 96681 - RNA, 22 nt, Human
ucaccaggauugggcuguaggc

SEQ ID NO: 96682 - RNA, 22 nt, Human
ucacaugcucaccuaagccaca

SEQ ID NO: 96683 - RNA, 22 nt, Human
guuuagauguagauucucuggu

SEQ ID NO: 96684 - RNA, 22 nt, Human
guuuaaaagcaaccaacaggcu

SEQ ID NO: 96685 - RNA, 22 nt, Human
uauuuuuacuguuugaugauuc

SEQ ID NO: 96686 - RNA, 22 nt, Human
uauuuuucacagauuggugcuu

SEQ ID NO: 96687 - RNA, 22 nt, Human
guugucuggcucugaccauucu

SEQ ID NO: 96688 - RNA, 22 nt, Human
uauuuuuaccuaauuuaugaga

SEQ ID NO: 96689 - RNA, 22 nt, Human
guuguugucauuagcuguuuaa

SEQ ID NO: 96690 - RNA, 22 nt, Human
guuguuaagugcugguuguuag

SEQ ID NO: 96691 - RNA, 22 nt, Human
guuguugcuauguuauuguuau

SEQ ID NO: 96692 - RNA, 21 nt, Human
guugugaccaugggaguugcu

SEQ ID NO: 96693 - RNA, 22 nt, Human
guuguuuucagcccagcauuag

SEQ ID NO: 96694 - RNA, 18 nt, Human
uauuccucuuccucuauc

SEQ ID NO: 96695 - RNA, 22 nt, Human
guuccgcggccucgcgcugagc

SEQ ID NO: 96696 - RNA, 22 nt, Human
guucagauucuuucucuuucac

SEQ ID NO: 96697 - RNA, 22 nt, Human
uauuaaaagagaaaaagccacc

SEQ ID NO: 96698 - RNA, 22 nt, Human
uauuaauugugguuauuguauu

SEQ ID NO: 96699 - RNA, 22 nt, Human
uauguuaauuaccagcacugau

SEQ ID NO: 96700 - RNA, 22 nt, Human
uaugugugugcguguguuuugc

SEQ ID NO: 96701 - RNA, 22 nt, Human
guuauuuugucuuguucaugaa

SEQ ID NO: 96702 - RNA, 23 nt, Human
guuaccgaccugauucggcagcc

SEQ ID NO: 96703 - RNA, 22 nt, Human
guguuaaucauuuuugauuuug

SEQ ID NO: 96704 - RNA, 22 nt, Human
gugugugucuacuuucaucucu

SEQ ID NO: 96705 - RNA, 22 nt, Human
uaugggaaggauuugucuuuca

SEQ ID NO: 96706 - RNA, 22 nt, Human
uauggcucacaaauaauaaauu

SEQ ID NO: 96707 - RNA, 22 nt, Human
uauuacugccacaucauuaggu

SEQ ID NO: 96708 - RNA, 22 nt, Human
uauuggcucagucagaaguuuu

SEQ ID NO: 96709 - RNA, 22 nt, Human
uauuuacuuugaggaaguuguu

SEQ ID NO: 96710 - RNA, 22 nt, Human
uauuuacuguguucaucccucu

SEQ ID NO: 96711 - RNA, 22 nt, Human
uauuuacgcaaacaauugugca

SEQ ID NO: 96712 - RNA, 22 nt, Human
uauuuaugcaucacuuuuuucc

SEQ ID NO: 96713 - RNA, 20 nt, Human
uauuucaaugugccaaguuu

SEQ ID NO: 96714 - RNA, 22 nt, Human
uauuuguuucuaguggcagcaa

SEQ ID NO: 96715 - RNA, 22 nt, Human
uauuucaugagugaauaucuag

SEQ ID NO: 96716 - RNA, 22 nt, Human
guugauaauuaauagcuuuuga

SEQ ID NO: 96717 - RNA, 22 nt, Human
guugaacagucacccugggagu

SEQ ID NO: 96718 - RNA, 22 nt, Human
uauuuugaggugaaagaguuug

SEQ ID NO: 96719 - RNA, 22 nt, Human
uaugacugcucagugaauggaa

SEQ ID NO: 96720 - RNA, 19 nt, Human
uaugacaaguacuaguucu

SEQ ID NO: 96721 - RNA, 22 nt, Human
uaugcacacguguccaugugca

SEQ ID NO: 96722 - RNA, 22 nt, Human
uaugauuuucaugguagaguua

SEQ ID NO: 96723 - RNA, 22 nt, Human
uaugagugccaaguuaccuggg

SEQ ID NO: 96724 - RNA, 22 nt, Human
gugugguguuaagcaaauuaau

SEQ ID NO: 96725 - RNA, 22 nt, Human
gugucacuuucaggagcucuaa

SEQ ID NO: 96726 - RNA, 22 nt, Human
uaucuguauuguagaacuguug

SEQ ID NO: 96727 - RNA, 22 nt, Human
uaucugcuggagguaauuacuc

SEQ ID NO: 96728 - RNA, 22 nt, Human
uaucugaugcaggcucccagga

SEQ ID NO: 96729 - RNA, 22 nt, Human
uaucuagguacacaucuccucu

SEQ ID NO: 96730 - RNA, 22 nt, Human
uauccuaaaggguaguguggga

SEQ ID NO: 96731 - RNA, 22 nt, Human
uaucacauaaaugaggaauauu

SEQ ID NO: 96732 - RNA, 22 nt, Human
uaucaguagaacaauggacauu

SEQ ID NO: 96733 - RNA, 22 nt, Human
uaucaguccaggguuuugugac

SEQ ID NO: 96734 - RNA, 22 nt, Human
uauauauaugcaccacaugugu

SEQ ID NO: 96735 - RNA, 22 nt, Human
uauaugaggauauuuuaaagcu

SEQ ID NO: 96736 - RNA, 22 nt, Human
uauaugcagauuuucaucaucg

SEQ ID NO: 96737 - RNA, 22 nt, Human
uauauaauacacaaauauguac

SEQ ID NO: 96738 - RNA, 22 nt, Human
uauauauaauguguacagguga

SEQ ID NO: 96739 - RNA, 22 nt, Human
uauauacacugauuaggauuuu

SEQ ID NO: 96740 - RNA, 22 nt, Human
uauaagaaaagucauuaucaaa

SEQ ID NO: 96741 - RNA, 22 nt, Human
uauaaagaccuuauccuucaua

SEQ ID NO: 96742 - RNA, 18 nt, Human
uauaaacacacuuagguu

SEQ ID NO: 96743 - RNA, 22 nt, Human
uauacauauacaaaugcacaua

SEQ ID NO: 96744 - RNA, 22 nt, Human
uauaaucuugcccauaguauuu

SEQ ID NO: 96745 - RNA, 22 nt, Human
uaguuauuucugcacuuaauga

SEQ ID NO: 96746 - RNA, 22 nt, Human
uaguuacuuuugcucuucauua

SEQ ID NO: 96747 - RNA, 22 nt, Human
uaguuaaugauagggagagggg

SEQ ID NO: 96748 - RNA, 22 nt, Human
gugcuaugugcugaacucaggu

SEQ ID NO: 96749 - RNA, 22 nt, Human
uagcauuuagaacaccuugaga

SEQ ID NO: 96750 - RNA, 22 nt, Human
uaguuucuucaacugucccagc

SEQ ID NO: 96751 - RNA, 22 nt, Human
uaguuggguagacaguucuaca

SEQ ID NO: 96752 - RNA, 22 nt, Human
uaguugaauuuaucaguagcau

SEQ ID NO: 96753 - RNA, 22 nt, Human
uaguucugaauagcauugaaga

SEQ ID NO: 96754 - RNA, 22 nt, Human
ucagcgucuccaaaagagcccg

SEQ ID NO: 96755 - RNA, 22 nt, Human
ucagcguuaguuuuucaucuaa

SEQ ID NO: 96756 - RNA, 22 nt, Human
ucagcucacaauguugagaaag

SEQ ID NO: 96757 - RNA, 21 nt, Human
ucaggaagagccaguucaugc

SEQ ID NO: 96758 - RNA, 22 nt, Human
ucagcugggagaaaguuuuagg

SEQ ID NO: 96759 - RNA, 22 nt, Human
ucagcucucucuuggugaucuc

SEQ ID NO: 96760 - RNA, 22 nt, Human
ucaggagaguguucaguggagg

SEQ ID NO: 96761 - RNA, 22 nt, Human
ucagcuucaucuugagcccaca

SEQ ID NO: 96762 - RNA, 22 nt, Human
ucaggacacuuaauaggaacag

SEQ ID NO: 96763 - RNA, 22 nt, Human
ugacuaauacagaaacuacaag

SEQ ID NO: 96764 - RNA, 22 nt, Human
ugacucugaugcaguguguuua

SEQ ID NO: 96765 - RNA, 22 nt, Human
ugacugaggaaggugggguggg

SEQ ID NO: 96766 - RNA, 22 nt, Human
ugacugguauuuguaaaccaua

SEQ ID NO: 96767 - RNA, 22 nt, Human
ugacauuugagagagauauaca

SEQ ID NO: 96768 - RNA, 22 nt, Human
ugaccgucagcugucuuccauu

SEQ ID NO: 96769 - RNA, 22 nt, Human
ucagauggucauucacuagggu

SEQ ID NO: 96770 - RNA, 22 nt, Human
ugacgcauggccagcucugucu

SEQ ID NO: 96771 - RNA, 22 nt, Human
ucagagagagagaggcggaaga

SEQ ID NO: 96772 - RNA, 22 nt, Human
ugaccucugagcaaggcagagg

SEQ ID NO: 96773 - RNA, 22 nt, Human
ucagcaggugcuuuguuuacuc

SEQ ID NO: 96774 - RNA, 22 nt, Human
ucagaaugaaauuucuuucaga

SEQ ID NO: 96775 - RNA, 18 nt, Human
ucagaaugauuuggugga

SEQ ID NO: 96776 - RNA, 22 nt, Human
ucagagaaguaggcuaauggug

SEQ ID NO: 96777 - RNA, 22 nt, Human
ucagaacugcggggaagguggg

SEQ ID NO: 96778 - RNA, 23 nt, Human
ucagaccaaccucuugcuggaac

SEQ ID NO: 96779 - RNA, 22 nt, Human
ucagagugagcuggggcugcuu

SEQ ID NO: 96780 - RNA, 21 nt, Human
ucagaccaacucuuguauccu

SEQ ID NO: 96781 - RNA, 21 nt, Human
ucagaaucguuccagguagau

SEQ ID NO: 96782 - RNA, 17 nt, Human
ugacagcuaaggggcuu

SEQ ID NO: 96783 - RNA, 22 nt, Human
ugacagucacagcagaaacucg

SEQ ID NO: 96784 - RNA, 22 nt, Human
ugaauuuuggcaauuuucugug

SEQ ID NO: 96785 - RNA, 22 nt, Human
ucacuguuucaccgucugaagg

SEQ ID NO: 96786 - RNA, 22 nt, Human
ugacacacagggggauggaguu

SEQ ID NO: 96787 - RNA, 22 nt, Human
ugacaagagaccccuccgcagg

SEQ ID NO: 96788 - RNA, 22 nt, Human
ugaauuuuaacauucugcugga

SEQ ID NO: 96789 - RNA, 22 nt, Human
ucacuuuacaucuguaaaagga

SEQ ID NO: 96790 - RNA, 22 nt, Human
ucacuucugcuccuuggaugcc

SEQ ID NO: 96791 - RNA, 22 nt, Human
ucacuguugccacggugauaau

SEQ ID NO: 96792 - RNA, 22 nt, Human
ucacuuccuugcagcuguagaa

SEQ ID NO: 96793 - RNA, 22 nt, Human
ugacagaggagcuggaaugauu

SEQ ID NO: 96794 - RNA, 22 nt, Human
ugacagaaaccaccccccaggu

SEQ ID NO: 96795 - RNA, 22 nt, Human
ucagaacucuagucucagccug

SEQ ID NO: 96796 - RNA, 22 nt, Human
ucagaaacuaaauguggauuug

SEQ ID NO: 96797 - RNA, 22 nt, Human
ugaauggugcccuagagggaug

SEQ ID NO: 96798 - RNA, 22 nt, Human
ugaauguggucaggaaauuguu

SEQ ID NO: 96799 - RNA, 22 nt, Human
ugaaugcuacccugcuggcucu

SEQ ID NO: 96800 - RNA, 22 nt, Human
ugaaugaguucaccgcucaguu

SEQ ID NO: 96801 - RNA, 22 nt, Human
ugaauuauaugguauugaacau

SEQ ID NO: 96802 - RNA, 22 nt, Human
ucacccagacugucugacucuu

SEQ ID NO: 96803 - RNA, 22 nt, Human
ucacaggagucaaggaauagua

SEQ ID NO: 96804 - RNA, 22 nt, Human
ucacacaucucagguguuuaau

SEQ ID NO: 96805 - RNA, 22 nt, Human
ucacaguucaacuaguucagau

SEQ ID NO: 96806 - RNA, 22 nt, Human
ucacagguuuaguccagcaguc

SEQ ID NO: 96807 - RNA, 22 nt, Human
ugaauucaaacuuuuuaacaag

SEQ ID NO: 96808 - RNA, 22 nt, Human
ucacuggauucauguuucuuua

SEQ ID NO: 96809 - RNA, 22 nt, Human
ucacucgccuuuucguucgccg

SEQ ID NO: 96810 - RNA, 22 nt, Human
ucacucagucugagcaauugcu

SEQ ID NO: 96811 - RNA, 19 nt, Human
ucacggucaaccagagccu

SEQ ID NO: 96812 - RNA, 22 nt, Human
ucaccugccuggguggucaccu

SEQ ID NO: 96813 - RNA, 22 nt, Human
ucaccgucucaguacggaggga

SEQ ID NO: 96814 - RNA, 22 nt, Human
ucaccuuuugaauugcuguugu

SEQ ID NO: 96815 - RNA, 22 nt, Human
ucaauuuauguggcuauucauu

SEQ ID NO: 96816 - RNA, 21 nt, Human
ucaagugcccaagguuuguuu

SEQ ID NO: 96817 - RNA, 22 nt, Human
ucaagguauuauuuuuguggug

SEQ ID NO: 96818 - RNA, 22 nt, Human
ucaagggaccaagcauucauua

SEQ ID NO: 96819 - RNA, 22 nt, Human
ugaaucaaugaauugcacuuca

SEQ ID NO: 96820 - RNA, 22 nt, Human
ugaaucugagccugcgcaaagu

SEQ ID NO: 96821 - RNA, 22 nt, Human
ugaauagucaaagcacaagagg

SEQ ID NO: 96822 - RNA, 22 nt, Human
ugaaucuuguuuacugauuccu

SEQ ID NO: 96823 - RNA, 21 nt, Human
ucaagcggcagagcaguuauu

SEQ ID NO: 96824 - RNA, 21 nt, Human
ugaagggugagauauaaguga

SEQ ID NO: 96825 - RNA, 22 nt, Human
ucaaggaagggguaggaauaau

SEQ ID NO: 96826 - RNA, 23 nt, Human
ugaagugaaauuucacaagggac

SEQ ID NO: 96827 - RNA, 22 nt, Human
ugaagguggcuugcagcuaguc

SEQ ID NO: 96828 - RNA, 22 nt, Human
ugaaguuuagaaaaagugccuu

SEQ ID NO: 96829 - RNA, 22 nt, Human
ugaauaaauaaacuuuuacuac

SEQ ID NO: 96830 - RNA, 22 nt, Human
ucaagagauauaugcugguuua

SEQ ID NO: 96831 - RNA, 22 nt, Human
ucaagcaaggaauccuuuugua

SEQ ID NO: 96832 - RNA, 22 nt, Human
ugaagcuagguucaugaggucg

SEQ ID NO: 96833 - RNA, 22 nt, Human
ugaagcuaguauuaacucagau

SEQ ID NO: 96834 - RNA, 22 nt, Human
ugaaggagucgaggugggugag

SEQ ID NO: 96835 - RNA, 22 nt, Human
ucaaccagcuuaucugcaggau

SEQ ID NO: 96836 - RNA, 22 nt, Human
ucaacagaagugauagcuauua

SEQ ID NO: 96837 - RNA, 22 nt, Human
ucaagaagauaaugucuagggu

SEQ ID NO: 96838 - RNA, 21 nt, Human
ugaagcccugugaggugcuua

SEQ ID NO: 96839 - RNA, 21 nt, Human
ugaagccuagagaauugggga

SEQ ID NO: 96840 - RNA, 22 nt, Human
ugaagacuucuuuuggucacca

SEQ ID NO: 96841 - RNA, 22 nt, Human
ucaaagaucuuugcuuuugggg

SEQ ID NO: 96842 - RNA, 22 nt, Human
ucaaaggcuugugguucuggga

SEQ ID NO: 96843 - RNA, 22 nt, Human
ucaaauaugggccagaggaaau

SEQ ID NO: 96844 - RNA, 22 nt, Human
ucaaaucuuuuuuccuucccug

SEQ ID NO: 96845 - RNA, 22 nt, Human
uauuuuuguuuaccaguuaaca

SEQ ID NO: 96846 - RNA, 22 nt, Human
ucaaaaauaagauauucuggac

SEQ ID NO: 96847 - RNA, 22 nt, Human
uauuuuuuuaacauuuauugua

SEQ ID NO: 96848 - RNA, 22 nt, Human
ugaaccgcuucauggugccugu

SEQ ID NO: 96849 - RNA, 22 nt, Human
ugaaccugagggcaaagggaca

SEQ ID NO: 96850 - RNA, 22 nt, Human
ugaacuaauguuguguccuaau

SEQ ID NO: 96851 - RNA, 22 nt, Human
ugaacauuuuugcuugcagcuu

SEQ ID NO: 96852 - RNA, 22 nt, Human
ugaagaauuccauggcuuccau

SEQ ID NO: 96853 - RNA, 22 nt, Human
ugaaccuaacauuucuggcagu

SEQ ID NO: 96854 - RNA, 22 nt, Human
ugaacuucccauguacagacug

SEQ ID NO: 96855 - RNA, 22 nt, Human
ugaaaugccucuuugguucuaa

SEQ ID NO: 96856 - RNA, 22 nt, Human
ugaaaaaugcuuuaaugcaugu

SEQ ID NO: 96857 - RNA, 22 nt, Human
ugaaagcuggcucugcagagug

SEQ ID NO: 96858 - RNA, 22 nt, Human
uauuuuauuuagguuuaguugu

SEQ ID NO: 96859 - RNA, 22 nt, Human
uauuuuagccaacagaaugaug

SEQ ID NO: 96860 - RNA, 22 nt, Human
uauuuuggaugcauugagaugc

SEQ ID NO: 96861 - RNA, 22 nt, Human
uauuuuggcuccugagcucuga

SEQ ID NO: 96862 - RNA, 22 nt, Human
uauuuguauugucuuaucacuu

SEQ ID NO: 96863 - RNA, 22 nt, Human
uauuugauggaacucuugcuuu

SEQ ID NO: 96864 - RNA, 22 nt, Human
ucuuuuuaugucaaaaucgaug

SEQ ID NO: 96865 - RNA, 18 nt, Human
uauuugugugugugugug

SEQ ID NO: 96866 - RNA, 22 nt, Human
ucuuuucagccagcugguagga

SEQ ID NO: 96867 - RNA, 22 nt, Human
ucuuuugugauuuucugaagca

SEQ ID NO: 96868 - RNA, 22 nt, Human
ucuuuugaacauccaggauguc

SEQ ID NO: 96869 - RNA, 22 nt, Human
uauuucaucugaacuucccaac

SEQ ID NO: 96870 - RNA, 22 nt, Human
uauuucaguuaagaugagguca

SEQ ID NO: 96871 - RNA, 22 nt, Human
uauuuccugcguuucugugagc

SEQ ID NO: 96872 - RNA, 22 nt, Human
uauuucuagggcaugaaaauaa

SEQ ID NO: 96873 - RNA, 22 nt, Human
uauuuaaagucagcaacuuuuc

SEQ ID NO: 96874 - RNA, 22 nt, Human
uauuguuuuaagguguauuaau

SEQ ID NO: 96875 - RNA, 22 nt, Human
uauugugaaggccaugugcuaa

SEQ ID NO: 96876 - RNA, 18 nt, Human
uauuuacuguguguuacc

SEQ ID NO: 96877 - RNA, 22 nt, Human
ucuuucugaugggaagggucaa

SEQ ID NO: 96878 - RNA, 22 nt, Human
uauuuaggcagaaagugauauu

SEQ ID NO: 96879 - RNA, 22 nt, Human
ucuuuguuagucagaauugauc

SEQ ID NO: 96880 - RNA, 19 nt, Human
ucuuugcuuuucuaagagg

SEQ ID NO: 96881 - RNA, 22 nt, Human
ucuuugcauggacauguguuuu

SEQ ID NO: 96882 - RNA, 22 nt, Human
ucuuguuaaagguuaaagguga

SEQ ID NO: 96883 - RNA, 22 nt, Human
ucuugggcaguccucuacuggu

SEQ ID NO: 96884 - RNA, 22 nt, Human
ucuuggucccugagcucuuuca

SEQ ID NO: 96885 - RNA, 22 nt, Human
ucuuggcaguucuugugcuuuu

SEQ ID NO: 96886 - RNA, 22 nt, Human
ucuugcuguggcagaucuggag

SEQ ID NO: 96887 - RNA, 22 nt, Human
uauugucuuuuucuuccaccug

SEQ ID NO: 96888 - RNA, 22 nt, Human
ucuuuccagaccagccccagcu

SEQ ID NO: 96889 - RNA, 22 nt, Human
ucuuucucuccagccuggaccu

SEQ ID NO: 96890 - RNA, 23 nt, Human
ucuuuccuuucauacagucagcu

SEQ ID NO: 96891 - RNA, 22 nt, Human
ucuuuauuucccuaacuugcua

SEQ ID NO: 96892 - RNA, 19 nt, Human
ucuuucauuucuagcucug

SEQ ID NO: 96893 - RNA, 22 nt, Human
ucuuuaucugugagcagucucc

SEQ ID NO: 96894 - RNA, 22 nt, Human
uauugauuuuguugcuaccugg

SEQ ID NO: 96895 - RNA, 22 nt, Human
uauugguagauggagagagaca

SEQ ID NO: 96896 - RNA, 22 nt, Human
uauuguauuagcucuuggagau

SEQ ID NO: 96897 - RNA, 22 nt, Human
ucuucuguguguagugguugug

SEQ ID NO: 96898 - RNA, 22 nt, Human
uauucuucagcauaaaaauucu

SEQ ID NO: 96899 - RNA, 22 nt, Human
uauucuucaacuuuucuccucu

SEQ ID NO: 96900 - RNA, 22 nt, Human
uauugaucuuugaaaccuuggu

SEQ ID NO: 96901 - RNA, 22 nt, Human
ucuucuuauuuuaugaucgcuu

SEQ ID NO: 96902 - RNA, 22 nt, Human
ucuucuuuccuuuugugcauuu

SEQ ID NO: 96903 - RNA, 22 nt, Human
ucuugcuguagcuguuucuucu

SEQ ID NO: 96904 - RNA, 22 nt, Human
ucuugcuggagucaaggcuaca

SEQ ID NO: 96905 - RNA, 22 nt, Human
uagugcuuaaaacagaauuuuc

SEQ ID NO: 96906 - RNA, 22 nt, Human
uaguggccacugaagugcuaga

SEQ ID NO: 96907 - RNA, 22 nt, Human
uaguggaaccuucuaaaugacg

SEQ ID NO: 96908 - RNA, 22 nt, Human
ucuaccuucagaaugugggguu

SEQ ID NO: 96909 - RNA, 22 nt, Human
ucuuccuuguaagggcuuuaga

SEQ ID NO: 96910 - RNA, 22 nt, Human
ucuuccucuccuggggcauuug

SEQ ID NO: 96911 - RNA, 21 nt, Human
ucuucccaggccuuaaagggc

SEQ ID NO: 96912 - RNA, 19 nt, Human
ugcagcuguaugagcuuaa

SEQ ID NO: 96913 - RNA, 20 nt, Human
ugcagcucccccgcaguuuc

SEQ ID NO: 96914 - RNA, 22 nt, Human
ugcagccucacgcauccgcauu

SEQ ID NO: 96915 - RNA, 18 nt, Human
ugcacccuaagggcccca

SEQ ID NO: 96916 - RNA, 20 nt, Human
ugcacggcugugugugugca

SEQ ID NO: 96917 - RNA, 22 nt, Human
ugcagagagccagcucucucgg

SEQ ID NO: 96918 - RNA, 22 nt, Human
uccauggucgauggcugcuggg

SEQ ID NO: 96919 - RNA, 22 nt, Human
ugcaagagcccaaacuauauac

SEQ ID NO: 96920 - RNA, 21 nt, Human
ugcaacugaaaggaauauggu

SEQ ID NO: 96921 - RNA, 19 nt, Human
ugcaagcuuuuucuuguua

SEQ ID NO: 96922 - RNA, 22 nt, Human
ugcaaggcacccacucugcuuu

SEQ ID NO: 96923 - RNA, 22 nt, Human
uccauuuacuauucucauaucg

SEQ ID NO: 96924 - RNA, 22 nt, Human
uccauugucaauaguauugauu

SEQ ID NO: 96925 - RNA, 22 nt, Human
ugcacauuucucacaauguaca

SEQ ID NO: 96926 - RNA, 16 nt, Human
ugcaccgggaacacug

SEQ ID NO: 96927 - RNA, 22 nt, Human
ugauguggaucuauaacuguaa

SEQ ID NO: 96928 - RNA, 22 nt, Human
uccaccacgaaacugcagcugc

SEQ ID NO: 96929 - RNA, 22 nt, Human
uccacagcagagcacgguaccu

SEQ ID NO: 96930 - RNA, 22 nt, Human
uccagaaagccguugacuuauu

SEQ ID NO: 96931 - RNA, 22 nt, Human
uccagacucaaaaaccagaugg

SEQ ID NO: 96932 - RNA, 22 nt, Human
uccagaaaucucuguugauugu

SEQ ID NO: 96933 - RNA, 22 nt, Human
ugauuuggcaucaguguauccu

SEQ ID NO: 96934 - RNA, 22 nt, Human
ugcaaauuuuuuuauuuuuccu

SEQ ID NO: 96935 - RNA, 20 nt, Human
uccaguuuuggagacauucu

SEQ ID NO: 96936 - RNA, 22 nt, Human
ugcaaaaagagcgaggagcccu

SEQ ID NO: 96937 - RNA, 22 nt, Human
ugauuugguauccaggauuuaa

SEQ ID NO: 96938 - RNA, 22 nt, Human
uccagguggcuuuccuggggga

SEQ ID NO: 96939 - RNA, 22 nt, Human
ugaugaucaugcagguugguuu

SEQ ID NO: 96940 - RNA, 22 nt, Human
ugaugaaguuggaaggaaaguu

SEQ ID NO: 96941 - RNA, 17 nt, Human
ucauuuauccucuuugg

SEQ ID NO: 96942 - RNA, 22 nt, Human
ugaucuuugcuuuuggcuuagu

SEQ ID NO: 96943 - RNA, 17 nt, Human
ucauuucaguaaaucca

SEQ ID NO: 96944 - RNA, 22 nt, Human
ugauggaguauaauaaaaugac

SEQ ID NO: 96945 - RNA, 22 nt, Human
uccacaaagucuaugagaguug

SEQ ID NO: 96946 - RNA, 20 nt, Human
ucauucagaaucaguaugca

SEQ ID NO: 96947 - RNA, 22 nt, Human
ucauuguguaguagagguggca

SEQ ID NO: 96948 - RNA, 22 nt, Human
ugauauaaaagauucuuauuga

SEQ ID NO: 96949 - RNA, 20 nt, Human
ugauaggcauugacauaagg

SEQ ID NO: 96950 - RNA, 22 nt, Human
ugauaccugagucuuccccguu

SEQ ID NO: 96951 - RNA, 22 nt, Human
ucauuagucuuuaauacauaau

SEQ ID NO: 96952 - RNA, 22 nt, Human
ucauuagcuaucagaguggaac

SEQ ID NO: 96953 - RNA, 22 nt, Human
ugauagcaugcucucaguaaaa

SEQ ID NO: 96954 - RNA, 22 nt, Human
ucauccugaagaaccugcuucc

SEQ ID NO: 96955 - RNA, 22 nt, Human
ugaguuuaggccaggauauggu

SEQ ID NO: 96956 - RNA, 22 nt, Human
ugaguucugacugagcaugggg

SEQ ID NO: 96957 - RNA, 22 nt, Human
ugaguugcagucaauauugcaa

SEQ ID NO: 96958 - RNA, 22 nt, Human
ugaguguuguaaccauaugauu

SEQ ID NO: 96959 - RNA, 22 nt, Human
ugagucugaagagagaauaagg

SEQ ID NO: 96960 - RNA, 22 nt, Human
ucauaucauuuugaaagcugag

SEQ ID NO: 96961 - RNA, 20 nt, Human
ugagucagcugcaugggugg

SEQ ID NO: 96962 - RNA, 19 nt, Human
ugaguacuaaugagauuga

SEQ ID NO: 96963 - RNA, 22 nt, Human
ugagguugggaggacugccuaa

SEQ ID NO: 96964 - RNA, 22 nt, Human
ugaggggaggggagaaaauggu

SEQ ID NO: 96965 - RNA, 22 nt, Human
ugaggucaggcagggguuuggc

SEQ ID NO: 96966 - RNA, 22 nt, Human
ugagggaagguugauaauguuc

SEQ ID NO: 96967 - RNA, 22 nt, Human
ugacuuuucuccucugaaguuu

SEQ ID NO: 96968 - RNA, 22 nt, Human
ugagaaaacaguuuguaauaau

SEQ ID NO: 96969 - RNA, 22 nt, Human
ucaggcgcucuucguggcugcc

SEQ ID NO: 96970 - RNA, 22 nt, Human
ucgacguuguuuuuucucuguc

SEQ ID NO: 96971 - RNA, 22 nt, Human
ugccuguguauuuccggccugc

SEQ ID NO: 96972 - RNA, 22 nt, Human
uccuucuguuguuuauuuuaaa

SEQ ID NO: 96973 - RNA, 22 nt, Human
ugccgggcugagcaagugcugc

SEQ ID NO: 96974 - RNA, 22 nt, Human
ugccgcuuucuggcccucaguc

SEQ ID NO: 96975 - RNA, 22 nt, Human
ugcccugucccuagguuugugg

SEQ ID NO: 96976 - RNA, 23 nt, Human
ugccggaucuacuuuggguucuc

SEQ ID NO: 96977 - RNA, 22 nt, Human
ugccgccgugggucccgacgcg

SEQ ID NO: 96978 - RNA, 22 nt, Human
ugccaucuuugccccuauuuua

SEQ ID NO: 96979 - RNA, 22 nt, Human
ugccaucaugucagauuuggga

SEQ ID NO: 96980 - RNA, 22 nt, Human
ugccauuggucuuaaggcuagc

SEQ ID NO: 96981 - RNA, 22 nt, Human
ugccaugguuguacaguagcag

SEQ ID NO: 96982 - RNA, 20 nt, Human
uccugaaauuacgugauuca

SEQ ID NO: 96983 - RNA, 22 nt, Human
uccucuucucuagagccggaau

SEQ ID NO: 96984 - RNA, 22 nt, Human
ugcccaaucaauuguagcuauu

SEQ ID NO: 96985 - RNA, 22 nt, Human
uccugaaugguguaauagguuu

SEQ ID NO: 96986 - RNA, 21 nt, Human
uccugcagggcagcagagugg

SEQ ID NO: 96987 - RNA, 23 nt, Human
uccugcagauaagcugguugaca

SEQ ID NO: 96988 - RNA, 22 nt, Human
uccugggcuugcucuuuccauu

SEQ ID NO: 96989 - RNA, 22 nt, Human
ugcccuuucuccagugaccauu

SEQ ID NO: 96990 - RNA, 22 nt, Human
ugcccugcagacccugcagugu

SEQ ID NO: 96991 - RNA, 22 nt, Human
ugcauuauaacaauaaggcuua

SEQ ID NO: 96992 - RNA, 22 nt, Human
ugcauuccagcucccuucuggc

SEQ ID NO: 96993 - RNA, 22 nt, Human
ugcauuacuuugauaagcgucu

SEQ ID NO: 96994 - RNA, 22 nt, Human
ugcauucugaacguaaauguga

SEQ ID NO: 96995 - RNA, 22 nt, Human
ugccaauuaccuauuucugaga

SEQ ID NO: 96996 - RNA, 22 nt, Human
ugccaaugauuccacaauggaa

SEQ ID NO: 96997 - RNA, 22 nt, Human
ugccagcuccgaggagcugcag

SEQ ID NO: 96998 - RNA, 22 nt, Human
ugccagauuaugucuccagggc

SEQ ID NO: 96999 - RNA, 22 nt, Human
uccucagcaagacgcuggcagc

SEQ ID NO: 97000 - RNA, 22 nt, Human
ugccagugugccuuccgcucac

SEQ ID NO: 97001 - RNA, 22 nt, Human
ucccuuucuucuugguccaccu

SEQ ID NO: 97002 - RNA, 23 nt, Human
ucccuuuguucuugcuaggaugu

SEQ ID NO: 97003 - RNA, 22 nt, Human
ucccuuuggagguguccagcac

SEQ ID NO: 97004 - RNA, 22 nt, Human
ucccuuuucauccuaucccagc

SEQ ID NO: 97005 - RNA, 22 nt, Human
ugcauguuucuguauguuaaug

SEQ ID NO: 97006 - RNA, 17 nt, Human
uccuacaggugugcuga

SEQ ID NO: 97007 - RNA, 23 nt, Human
ugcaugagcaucuccaccucagu

SEQ ID NO: 97008 - RNA, 22 nt, Human
ugcaugaucucacuuacaggug

SEQ ID NO: 97009 - RNA, 22 nt, Human
ucuaaagcuccuuccacuaaaa

SEQ ID NO: 97010 - RNA, 22 nt, Human
ucuaaaugaccuccuugcccag

SEQ ID NO: 97011 - RNA, 22 nt, Human
ucguccaauaaccugccagcgc

SEQ ID NO: 97012 - RNA, 22 nt, Human
ucguggaugaagaauagaggcc

SEQ ID NO: 97013 - RNA, 22 nt, Human
ucuaaugcuuccucucauccca

SEQ ID NO: 97014 - RNA, 22 nt, Human
ugcugcacucacaggaagaguu

SEQ ID NO: 97015 - RNA, 22 nt, Human
ugcugcacccuucauuuuccca

SEQ ID NO: 97016 - RNA, 22 nt, Human
ucggguguguguguuggguaug

SEQ ID NO: 97017 - RNA, 22 nt, Human
ugcucgggcuccuuugagugag

SEQ ID NO: 97018 - RNA, 22 nt, Human
ugcucugcuaggagaagaauga

SEQ ID NO: 97019 - RNA, 22 nt, Human
ucgggacccccgcccgggcccg

SEQ ID NO: 97020 - RNA, 22 nt, Human
ucgggccacauccacacaucca

SEQ ID NO: 97021 - RNA, 22 nt, Human
ucgggcgaauguuguuuuucuc

SEQ ID NO: 97022 - RNA, 22 nt, Human
ugcucuguuuuaacucuuucaa

SEQ ID NO: 97023 - RNA, 22 nt, Human
ugcucuuucaggcauagaccuu

SEQ ID NO: 97024 - RNA, 22 nt, Human
ucguauaguugcugcagauggu

SEQ ID NO: 97025 - RNA, 22 nt, Human
ugcugacuauacauuuagcauu

SEQ ID NO: 97026 - RNA, 23 nt, Human
ucgucgucagccacuaccucccc

SEQ ID NO: 97027 - RNA, 22 nt, Human
ugcuccguucuucugcuucuug

SEQ ID NO: 97028 - RNA, 22 nt, Human
ugcucacugcuuguguucaguu

SEQ ID NO: 97029 - RNA, 22 nt, Human
ugcuauuuuguuuucaguccau

SEQ ID NO: 97030 - RNA, 22 nt, Human
ugcucagaagacuuacugguua

SEQ ID NO: 97031 - RNA, 22 nt, Human
ugcuccugaacacagcccuaug

SEQ ID NO: 97032 - RNA, 22 nt, Human
ugcuauccagacacauaugauc

SEQ ID NO: 97033 - RNA, 22 nt, Human
ugcuaaugaauggaggaucuga

SEQ ID NO: 97034 - RNA, 20 nt, Human
ugcuaucugcucucccuucu

SEQ ID NO: 97035 - RNA, 22 nt, Human
ugcuaucuagaaauacuggguu

SEQ ID NO: 97036 - RNA, 21 nt, Human
ugcguaugucuuguauuacuc

SEQ ID NO: 97037 - RNA, 22 nt, Human
ugcguuuaguuucaagacacgu

SEQ ID NO: 97038 - RNA, 22 nt, Human
ucgccccccgccucacccucgg

SEQ ID NO: 97039 - RNA, 22 nt, Human
ucgccauguacaugaagggcgg

SEQ ID NO: 97040 - RNA, 22 nt, Human
ugcgccaggacacccguggcgg

SEQ ID NO: 97041 - RNA, 22 nt, Human
ucgaugcuggcgcagguuucac

SEQ ID NO: 97042 - RNA, 22 nt, Human
ucgauccaggaaggcugguuua

SEQ ID NO: 97043 - RNA, 22 nt, Human
uggaagcccagaaggaagcaga

SEQ ID NO: 97044 - RNA, 22 nt, Human
ucugggccaacccuuccauggg

SEQ ID NO: 97045 - RNA, 21 nt, Human
ucuggggacaagguccaggaa

SEQ ID NO: 97046 - RNA, 22 nt, Human
ucugggguucuuaauuuggaag

SEQ ID NO: 97047 - RNA, 22 nt, Human
uggaagggagcuggaauuugga

SEQ ID NO: 97048 - RNA, 23 nt, Human
uggaaguugagagucugcuuugu

SEQ ID NO: 97049 - RNA, 21 nt, Human
uggaauuggaaaccauucuau

SEQ ID NO: 97050 - RNA, 22 nt, Human
uggagagauagucauucuagag

SEQ ID NO: 97051 - RNA, 22 nt, Human
uggagagaaguucuauaaauca

SEQ ID NO: 97052 - RNA, 22 nt, Human
uggacagugguggggaggagga

SEQ ID NO: 97053 - RNA, 22 nt, Human
ucugguuuggguugcuauggcu

SEQ ID NO: 97054 - RNA, 22 nt, Human
uggacuguaauguguguggacc

SEQ ID NO: 97055 - RNA, 22 nt, Human
uggaggaggagaacuuggcacu

SEQ ID NO: 97056 - RNA, 22 nt, Human
uggaggagaacugauuuggcuu

SEQ ID NO: 97057 - RNA, 22 nt, Human
uggaggauaacacaagaaguga

SEQ ID NO: 97058 - RNA, 22 nt, Human
uggaggaugacagagaugggcu

SEQ ID NO: 97059 - RNA, 19 nt, Human
uggaggcacuaacaaacuc

SEQ ID NO: 97060 - RNA, 22 nt, Human
uggagaugcacgagcaggugga

SEQ ID NO: 97061 - RNA, 22 nt, Human
uggagagcaaugaggggcaggc

SEQ ID NO: 97062 - RNA, 22 nt, Human
uggagcugaaguacucucacua

SEQ ID NO: 97063 - RNA, 22 nt, Human
uggagccugauggauaggaacg

SEQ ID NO: 97064 - RNA, 22 nt, Human
uggaacugauuaaaagggcaga

SEQ ID NO: 97065 - RNA, 22 nt, Human
uggaaaugcuuagaggugaucu

SEQ ID NO: 97066 - RNA, 22 nt, Human
ucugcaugccucaggaggccug

SEQ ID NO: 97067 - RNA, 22 nt, Human
ucugccuucaggagcagacucu

SEQ ID NO: 97068 - RNA, 22 nt, Human
uggaacugguuugcuucagacu

SEQ ID NO: 97069 - RNA, 22 nt, Human
uggaaagcagcccugcucccca

SEQ ID NO: 97070 - RNA, 22 nt, Human
uggaaauacaagaaguauguca

SEQ ID NO: 97071 - RNA, 21 nt, Human
ucugccaguuucucuuacuuu

SEQ ID NO: 97072 - RNA, 22 nt, Human
ucuacugagugcugagauuuug

SEQ ID NO: 97073 - RNA, 19 nt, Human
ugcugcaggaauucucaag

SEQ ID NO: 97074 - RNA, 22 nt, Human
ugcugccgccgccaccgccgcc

SEQ ID NO: 97075 - RNA, 22 nt, Human
ugcugccucugaauggagcagu

SEQ ID NO: 97076 - RNA, 22 nt, Human
ugcugccucccaucccucccga

SEQ ID NO: 97077 - RNA, 22 nt, Human
uggcccauccggcuccuccuug

SEQ ID NO: 97078 - RNA, 22 nt, Human
uggcccaucagggcaccugaga

SEQ ID NO: 97079 - RNA, 22 nt, Human
ucuuucucauccaaacuaguug

SEQ ID NO: 97080 - RNA, 20 nt, Human
ucuugucuggcagccuggag

SEQ ID NO: 97081 - RNA, 22 nt, Human
ucuuuaaauucuuaugagugaa

SEQ ID NO: 97082 - RNA, 22 nt, Human
uggcccagaucucugaccuuga

SEQ ID NO: 97083 - RNA, 22 nt, Human
ucuucuuugugguugcccaagg

SEQ ID NO: 97084 - RNA, 22 nt, Human
ucuugccccugcuuuggaacaa

SEQ ID NO: 97085 - RNA, 19 nt, Human
ucuugcaucuuccuacugu

SEQ ID NO: 97086 - RNA, 22 nt, Human
ucuugauggugauguuguguca

SEQ ID NO: 97087 - RNA, 20 nt, Human
uggcaugcucucuuuuuagg

SEQ ID NO: 97088 - RNA, 22 nt, Human
uggcaguaaagcuggaaaagug

SEQ ID NO: 97089 - RNA, 22 nt, Human
uggcagcucauuuggaaaugga

SEQ ID NO: 97090 - RNA, 22 nt, Human
uggcagccugcgugaaggagcu

SEQ ID NO: 97091 - RNA, 21 nt, Human
uggcaggcagcuggaagcuug

SEQ ID NO: 97092 - RNA, 22 nt, Human
uggcaggggaaaagggguggga

SEQ ID NO: 97093 - RNA, 22 nt, Human
uggcacagcuugucauaaacuc

SEQ ID NO: 97094 - RNA, 22 nt, Human
uggcacaguuaaaguuguagaa

SEQ ID NO: 97095 - RNA, 22 nt, Human
uggcacguuggauugggaguuc

SEQ ID NO: 97096 - RNA, 22 nt, Human
uggcacugaagcuggaaagccu

SEQ ID NO: 97097 - RNA, 22 nt, Human
ucuuccauuccccuccuacgcc

SEQ ID NO: 97098 - RNA, 22 nt, Human
ucuucaguaaucgacauuccac

SEQ ID NO: 97099 - RNA, 22 nt, Human
uggcagcauuuuuuccagaaca

SEQ ID NO: 97100 - RNA, 22 nt, Human
uggcagaaugaagacuggggcc

SEQ ID NO: 97101 - RNA, 22 nt, Human
ucuuagacagagaagacuauug

SEQ ID NO: 97102 - RNA, 22 nt, Human
ucuuaaucauucuucacuuccu

SEQ ID NO: 97103 - RNA, 21 nt, Human
ucuuauacagcaauagaucug

SEQ ID NO: 97104 - RNA, 18 nt, Human
uggcaaugccaaaggcuu

SEQ ID NO: 97105 - RNA, 22 nt, Human
uggauucucuguagccugguuc

SEQ ID NO: 97106 - RNA, 22 nt, Human
uggaugagugaauggauaaauc

SEQ ID NO: 97107 - RNA, 22 nt, Human
uggaguuuuaaucuguacagaa

SEQ ID NO: 97108 - RNA, 22 nt, Human
uggagguagcugacuccagccc

SEQ ID NO: 97109 - RNA, 21 nt, Human
uggaggcguaaucacuguuga

SEQ ID NO: 97110 - RNA, 22 nt, Human
uggaguaauggguguuuuugaa

SEQ ID NO: 97111 - RNA, 22 nt, Human
ucuguucucuuguucugacggu

SEQ ID NO: 97112 - RNA, 22 nt, Human
uggaguuuauuugaauucuugg

SEQ ID NO: 97113 - RNA, 22 nt, Human
ugaauuuguaggaauucuccau

SEQ ID NO: 97114 - RNA, 22 nt, Human
ugaauuucuuuuuaaaauauua

SEQ ID NO: 97115 - RNA, 22 nt, Human
ugaauguguacacgauuguuug

SEQ ID NO: 97116 - RNA, 22 nt, Human
ugaauuacacugggaucagggc

SEQ ID NO: 97117 - RNA, 22 nt, Human
ugacagugugcccggagguuag

SEQ ID NO: 97118 - RNA, 23 nt, Human
ugacagguucuaugguuuccaac

SEQ ID NO: 97119 - RNA, 22 nt, Human
ugacaguuugacugcaaccuuu

SEQ ID NO: 97120 - RNA, 22 nt, Human
ugacacagaccaaguggugcug

SEQ ID NO: 97121 - RNA, 22 nt, Human
ugggggagggagaguugauggg

SEQ ID NO: 97122 - RNA, 22 nt, Human
ugaaugaacugaugaacuuaac

SEQ ID NO: 97123 - RNA, 22 nt, Human
ugaaugaagcacuguaauucuc

SEQ ID NO: 97124 - RNA, 22 nt, Human
uggggcuuucgcggagcgucgg

SEQ ID NO: 97125 - RNA, 22 nt, Human
uggggcgcaggcccagcgggcu

SEQ ID NO: 97126 - RNA, 22 nt, Human
uggggcuccuccuggcaggagg

SEQ ID NO: 97127 - RNA, 23 nt, Human
ugggccucuccacccuuuucugu

SEQ ID NO: 97128 - RNA, 22 nt, Human
ugggccgugagacgucucuggg

SEQ ID NO: 97129 - RNA, 22 nt, Human
ugaauaaucuuggguauuaaua

SEQ ID NO: 97130 - RNA, 22 nt, Human
ugaauagcaccuugaguaauga

SEQ ID NO: 97131 - RNA, 22 nt, Human
ugaaucagaccuucauugggua

SEQ ID NO: 97132 - RNA, 22 nt, Human
uggggaauguaauucuuuggcu

SEQ ID NO: 97133 - RNA, 22 nt, Human
uggggagcucagcaccaucagu

SEQ ID NO: 97134 - RNA, 22 nt, Human
ugaaggccagggauuugcagcc

SEQ ID NO: 97135 - RNA, 22 nt, Human
ugaaggaggugaauccaugcau

SEQ ID NO: 97136 - RNA, 20 nt, Human
ugggauggaaucaccugcac

SEQ ID NO: 97137 - RNA, 22 nt, Human
ugggauucucagaaacacagag

SEQ ID NO: 97138 - RNA, 22 nt, Human
ugaaggggaaagucuugcuaua

SEQ ID NO: 97139 - RNA, 22 nt, Human
ugggcacacugaaucugcuauu

SEQ ID NO: 97140 - RNA, 22 nt, Human
ugggcagagggugaggaaggcg

SEQ ID NO: 97141 - RNA, 22 nt, Human
ugggcagggagcuggaaccaca

SEQ ID NO: 97142 - RNA, 22 nt, Human
ugggccacguggagucuguagg

SEQ ID NO: 97143 - RNA, 22 nt, Human
ugggaaggggagcuggaaagga

SEQ ID NO: 97144 - RNA, 22 nt, Human
ugggagagauaggcuucuggac

SEQ ID NO: 97145 - RNA, 22 nt, Human
ugggagagaagcugaggcaggg

SEQ ID NO: 97146 - RNA, 22 nt, Human
ugggauauagaauuggcagagu

SEQ ID NO: 97147 - RNA, 22 nt, Human
ugggaugagcuauauagaaagu

SEQ ID NO: 97148 - RNA, 22 nt, Human
ugaagccaugcuaaauguuaca

SEQ ID NO: 97149 - RNA, 23 nt, Human
ugggagcuauguuuggaaugggg

SEQ ID NO: 97150 - RNA, 22 nt, Human
ugaagacaguuuuacucaugag

SEQ ID NO: 97151 - RNA, 22 nt, Human
ugaagccacacuagcuuguccu

SEQ ID NO: 97152 - RNA, 22 nt, Human
uggcuuuuuauuccuaugugau

SEQ ID NO: 97153 - RNA, 22 nt, Human
uggcuuuuuucuccccuuggau

SEQ ID NO: 97154 - RNA, 22 nt, Human
ugggaaacucuaaacuugagua

SEQ ID NO: 97155 - RNA, 22 nt, Human
ugggaacuggaaaaaaugaagu

SEQ ID NO: 97156 - RNA, 22 nt, Human
ugggaagaguuagagacagcug

SEQ ID NO: 97157 - RNA, 22 nt, Human
ugaacagugugagggugugacc

SEQ ID NO: 97158 - RNA, 22 nt, Human
ugaacuguccuuguugucuaga

SEQ ID NO: 97159 - RNA, 22 nt, Human
ugaacuggauuugugagcuccu

SEQ ID NO: 97160 - RNA, 22 nt, Human
ugaacuuacauugaggaauucu

SEQ ID NO: 97161 - RNA, 22 nt, Human
ugggaagcugagccucgaugug

SEQ ID NO: 97162 - RNA, 22 nt, Human
ugaaccgacaggggaagauugu

SEQ ID NO: 97163 - RNA, 22 nt, Human
ucuuugcugacacuuacacugu

SEQ ID NO: 97164 - RNA, 22 nt, Human
uggccugauuuugcuaagagaa

SEQ ID NO: 97165 - RNA, 22 nt, Human
ucuuuuaucuguuguguaacaa

SEQ ID NO: 97166 - RNA, 22 nt, Human
uggcggcuggacuggggggcca

SEQ ID NO: 97167 - RNA, 23 nt, Human
uggcucugagcuuccugguggcc

SEQ ID NO: 97168 - RNA, 22 nt, Human
uggcuguuggagcuggaagaug

SEQ ID NO: 97169 - RNA, 22 nt, Human
uggcugaugucuguucuguuau

SEQ ID NO: 97170 - RNA, 22 nt, Human
uggcuuuucaccugcuccucug

SEQ ID NO: 97171 - RNA, 22 nt, Human
uggcuuuugaaaaggugaugua

SEQ ID NO: 97172 - RNA, 22 nt, Human
ugaaauugaguaccucuuuaua

SEQ ID NO: 97173 - RNA, 21 nt, Human
ugaacaccaggagaaaucggu

SEQ ID NO: 97174 - RNA, 22 nt, Human
ugaacagacuauucucccaugu

SEQ ID NO: 97175 - RNA, 22 nt, Human
ugaaaggaauuuaaauguuguu

SEQ ID NO: 97176 - RNA, 16 nt, Human
uggcuuccaguucucu

SEQ ID NO: 97177 - RNA, 22 nt, Human
ugaaauuuuuuggagauaauuu

SEQ ID NO: 97178 - RNA, 22 nt, Human
ugaaauguggagaugguaagua

SEQ ID NO: 97179 - RNA, 22 nt, Human
uguauuuauuuuucaacuacca

SEQ ID NO: 97180 - RNA, 19 nt, Human
uguauuuauauuucugugc

SEQ ID NO: 97181 - RNA, 18 nt, Human
uguauuguucacuucugu

SEQ ID NO: 97182 - RNA, 22 nt, Human
uguauuugaagaaagagcuucu

SEQ ID NO: 97183 - RNA, 22 nt, Human
ugcaaaaguuuuauacacagau

SEQ ID NO: 97184 - RNA, 22 nt, Human
ugcacgcacuugcucuccagcg

SEQ ID NO: 97185 - RNA, 23 nt, Human
ugucugccuaucaugugaaggac

SEQ ID NO: 97186 - RNA, 22 nt, Human
ugucugcauucgaguucaugga

SEQ ID NO: 97187 - RNA, 22 nt, Human
ugcacgcgcccuucgauggccc

SEQ ID NO: 97188 - RNA, 22 nt, Human
ugucccuaucagucccaaguca

SEQ ID NO: 97189 - RNA, 22 nt, Human
ugcaagauccagucuugagaag

SEQ ID NO: 97190 - RNA, 22 nt, Human
ugcaaauucuuuacucugugau

SEQ ID NO: 97191 - RNA, 23 nt, Human
ugcaaaauuugcagaguucgaug

SEQ ID NO: 97192 - RNA, 22 nt, Human
ugauguauaaaaagagugaaau

SEQ ID NO: 97193 - RNA, 22 nt, Human
uguauaugucugugagcuauua

SEQ ID NO: 97194 - RNA, 20 nt, Human
ugauuauuccaacaagaaug

SEQ ID NO: 97195 - RNA, 22 nt, Human
ugauuagccguccuuuuauuaa

SEQ ID NO: 97196 - RNA, 22 nt, Human
ugauguuucugaagggguuacu

SEQ ID NO: 97197 - RNA, 22 nt, Human
ugaugugugaauucuuaaaugu

SEQ ID NO: 97198 - RNA, 22 nt, Human
uguauugaggauucauuuuugu

SEQ ID NO: 97199 - RNA, 22 nt, Human
ugauucaguacuuucucuaacu

SEQ ID NO: 97200 - RNA, 22 nt, Human
uguagcaauauaucagugcaca

SEQ ID NO: 97201 - RNA, 22 nt, Human
uguaccucagauuauugaucuc

SEQ ID NO: 97202 - RNA, 22 nt, Human
ugauguaaaauaggaaguucua

SEQ ID NO: 97203 - RNA, 22 nt, Human
ugauggugagaugucccguguu

SEQ ID NO: 97204 - RNA, 22 nt, Human
uguagaccaaaccuucuaaacu

SEQ ID NO: 97205 - RNA, 22 nt, Human
uguaggcacauguauauauccc

SEQ ID NO: 97206 - RNA, 22 nt, Human
uguagggaggaaggguuggaaa

SEQ ID NO: 97207 - RNA, 22 nt, Human
uguauagcaggguucuuccucc

SEQ ID NO: 97208 - RNA, 22 nt, Human
uguaaagugguauuuaauuuua

SEQ ID NO: 97209 - RNA, 22 nt, Human
uguaaagguuuuagagcagaga

SEQ ID NO: 97210 - RNA, 22 nt, Human
uguaaaguuuccuauugcccua

SEQ ID NO: 97211 - RNA, 22 nt, Human
ugaucauugaacaucgaguuaa

SEQ ID NO: 97212 - RNA, 22 nt, Human
ugaucauguucuccaaaagcgu

SEQ ID NO: 97213 - RNA, 22 nt, Human
ugaguugucacaacgucacaag

SEQ ID NO: 97214 - RNA, 22 nt, Human
ugaguuucuuacucaggagcug

SEQ ID NO: 97215 - RNA, 22 nt, Human
ugaguuuuggaagauguuacag

SEQ ID NO: 97216 - RNA, 22 nt, Human
ugguugagguugacucuauaua

SEQ ID NO: 97217 - RNA, 22 nt, Human
ugguugcaguggugcuuauaca

SEQ ID NO: 97218 - RNA, 22 nt, Human
ugguugugcucuguuugaaagu

SEQ ID NO: 97219 - RNA, 22 nt, Human
ugguugguuaaugugcccauuu

SEQ ID NO: 97220 - RNA, 22 nt, Human
ugguuucagacagacucgaacu

SEQ ID NO: 97221 - RNA, 22 nt, Human
ugagugugugucuuggguaccg

SEQ ID NO: 97222 - RNA, 22 nt, Human
ugaguuagcucuauucuuuugg

SEQ ID NO: 97223 - RNA, 17 nt, Human
ugguucuuuuccugacc

SEQ ID NO: 97224 - RNA, 22 nt, Human
ugagguuacauuaggaauaacc

SEQ ID NO: 97225 - RNA, 22 nt, Human
ugagggucgcaagcaccaggcc

SEQ ID NO: 97226 - RNA, 22 nt, Human
ugagggauuucuggccuuaacu

SEQ ID NO: 97227 - RNA, 22 nt, Human
ugagguguuugugcaccaucug

SEQ ID NO: 97228 - RNA, 22 nt, Human
ugaggggucuccuaccaugaug

SEQ ID NO: 97229 - RNA, 22 nt, Human
ugaggaagugguuguaugguuu

SEQ ID NO: 97230 - RNA, 22 nt, Human
ugaggaacaugggagaaauguc

SEQ ID NO: 97231 - RNA, 22 nt, Human
uggugcacgugggcagucggcc

SEQ ID NO: 97232 - RNA, 22 nt, Human
uggugcaggauuuauuuaacua

SEQ ID NO: 97233 - RNA, 23 nt, Human
uggugcagcgcaggccggguggc

SEQ ID NO: 97234 - RNA, 22 nt, Human
ugguggaggugggggguauuuu

SEQ ID NO: 97235 - RNA, 22 nt, Human
ugaggcuuucacuuggcaaaga

SEQ ID NO: 97236 - RNA, 22 nt, Human
ugguggagucugggggaggcuu

SEQ ID NO: 97237 - RNA, 22 nt, Human
uggugcagacaggagccccgcu

SEQ ID NO: 97238 - RNA, 22 nt, Human
ugaggccaagccuccucugcca

SEQ ID NO: 97239 - RNA, 17 nt, Human
ugaggcugucucccugg

SEQ ID NO: 97240 - RNA, 23 nt, Human
ugaccauauauccaucagauaua

SEQ ID NO: 97241 - RNA, 20 nt, Human
ugggguucccuuuagggcuu

SEQ ID NO: 97242 - RNA, 22 nt, Human
ugacaucuagauaaaugggaca

SEQ ID NO: 97243 - RNA, 22 nt, Human
uggugaggacccagauuuuccu

SEQ ID NO: 97244 - RNA, 22 nt, Human
uggucuuuccuucauuguccag

SEQ ID NO: 97245 - RNA, 22 nt, Human
uggggugccccccucgguuugc

SEQ ID NO: 97246 - RNA, 22 nt, Human
ugggguuuuagagcaggcagag

SEQ ID NO: 97247 - RNA, 22 nt, Human
uggggccaggcuguuggcuucc

SEQ ID NO: 97248 - RNA, 22 nt, Human
ugggggcacccagccgaugagg

SEQ ID NO: 97249 - RNA, 22 nt, Human
ugggggauucaucucagagcgu

SEQ ID NO: 97250 - RNA, 22 nt, Human
ugacaucagacugugagaagag

SEQ ID NO: 97251 - RNA, 22 nt, Human
ugggggauauggcuccauacuu

SEQ ID NO: 97252 - RNA, 22 nt, Human
ugcgcgccgacggcuccgugac

SEQ ID NO: 97253 - RNA, 19 nt, Human
ugcgggcugcggucagggc

SEQ ID NO: 97254 - RNA, 22 nt, Human
ugcggcucaaagggaaggccuu

SEQ ID NO: 97255 - RNA, 22 nt, Human
uguuccuuuuguuguuuuguuu

SEQ ID NO: 97256 - RNA, 22 nt, Human
ugcgccucugucacucagcauc

SEQ ID NO: 97257 - RNA, 22 nt, Human
uguuccuggggaccugccuucc

SEQ ID NO: 97258 - RNA, 23 nt, Human
uguuccugaugccucguccuguc

SEQ ID NO: 97259 - RNA, 19 nt, Human
uguucuacuugcuaguauu

SEQ ID NO: 97260 - RNA, 22 nt, Human
uguucggaaaagggcaagcuau

SEQ ID NO: 97261 - RNA, 22 nt, Human
ugcggugcagcccugcccucuc

SEQ ID NO: 97262 - RNA, 22 nt, Human
ugcggugcgcccgggcgagugc

SEQ ID NO: 97263 - RNA, 22 nt, Human
uguucugaggaggguuucaagg

SEQ ID NO: 97264 - RNA, 22 nt, Human
uguugaaacagcuauugacuuu

SEQ ID NO: 97265 - RNA, 22 nt, Human
uguugauuaauuuucccaaaca

SEQ ID NO: 97266 - RNA, 22 nt, Human
ugcuagggcaggaggugaggag

SEQ ID NO: 97267 - RNA, 22 nt, Human
uguugagaacaucucggggaca

SEQ ID NO: 97268 - RNA, 22 nt, Human
ugcuacaucuacugguaagggu

SEQ ID NO: 97269 - RNA, 22 nt, Human
ugcuaaugagugcugugugaag

SEQ ID NO: 97270 - RNA, 22 nt, Human
ugcguugaggaccgcgagggcg

SEQ ID NO: 97271 - RNA, 22 nt, Human
ugcguggauuuaggagugaggg

SEQ ID NO: 97272 - RNA, 22 nt, Human
ugccuucugccaaggacggugc

SEQ ID NO: 97273 - RNA, 22 nt, Human
uguguuucggauagcagauucu

SEQ ID NO: 97274 - RNA, 20 nt, Human
ugccuuccgccccgggcacc

SEQ ID NO: 97275 - RNA, 22 nt, Human
uguguuguuggggauguuuuca

SEQ ID NO: 97276 - RNA, 22 nt, Human
uguguguuguuuugccagaaua

SEQ ID NO: 97277 - RNA, 22 nt, Human
uguguuacaauaauggcaagua

SEQ ID NO: 97278 - RNA, 22 nt, Human
uguguguucauccccucaacau

SEQ ID NO: 97279 - RNA, 22 nt, Human
ugccugaagccugccccugggu

SEQ ID NO: 97280 - RNA, 22 nt, Human
uguuaacuuagcugaccuuaaa

SEQ ID NO: 97281 - RNA, 22 nt, Human
uguuaacugccaggacagaucg

SEQ ID NO: 97282 - RNA, 22 nt, Human
uguuaaaaagucccuguuuugu

SEQ ID NO: 97283 - RNA, 22 nt, Human
ugccuuguagccaccgggucac

SEQ ID NO: 97284 - RNA, 22 nt, Human
uguucaguuugcuaucauaauc

SEQ ID NO: 97285 - RNA, 22 nt, Human
uguuccggucuaucgugucaau

SEQ ID NO: 97286 - RNA, 22 nt, Human
uguucccgaugacaggaccagg

SEQ ID NO: 97287 - RNA, 22 nt, Human
ugccauauuuugaggauguaca

SEQ ID NO: 97288 - RNA, 22 nt, Human
ugugggaucauggaucagggcc

SEQ ID NO: 97289 - RNA, 22 nt, Human
ugugggcguggguuggggaggg

SEQ ID NO: 97290 - RNA, 22 nt, Human
ugcccacuucaaaaucuucauu

SEQ ID NO: 97291 - RNA, 22 nt, Human
ugccaacaggcuugccugaugu

SEQ ID NO: 97292 - RNA, 22 nt, Human
ugugggaggaugggccccuaga

SEQ ID NO: 97293 - RNA, 22 nt, Human
ugccaaagauagagguuugagu

SEQ ID NO: 97294 - RNA, 22 nt, Human
ugcauuuugaaggaaaaaaaug

SEQ ID NO: 97295 - RNA, 22 nt, Human
ugcauuguuuauggaauaaaau

SEQ ID NO: 97296 - RNA, 22 nt, Human
ugugguuuguaagcaaagcaaa

SEQ ID NO: 97297 - RNA, 22 nt, Human
ugugguuggggucagauaggga

SEQ ID NO: 97298 - RNA, 22 nt, Human
uguggugcucagggaggauggg

SEQ ID NO: 97299 - RNA, 22 nt, Human
uguggugacuugagcuuccuaa

SEQ ID NO: 97300 - RNA, 22 nt, Human
ugugggcugcuguuuccuugua

SEQ ID NO: 97301 - RNA, 22 nt, Human
ugugggaucguaaauuugggac

SEQ ID NO: 97302 - RNA, 22 nt, Human
uguggguggucagcgugugaug

SEQ ID NO: 97303 - RNA, 22 nt, Human
ugccuacuuuaguacuuuaaag

SEQ ID NO: 97304 - RNA, 22 nt, Human
uguguguauauauauguaucau

SEQ ID NO: 97305 - RNA, 17 nt, Human
uguguaaguugcauaga

SEQ ID NO: 97306 - RNA, 22 nt, Human
uguguauaugugugugugugug

SEQ ID NO: 97307 - RNA, 21 nt, Human
uguguaccuucuuccgagcuc

SEQ ID NO: 97308 - RNA, 22 nt, Human
ugucuucagguuccucaccacu

SEQ ID NO: 97309 - RNA, 22 nt, Human
ugucuuaugcugcauagacuau

SEQ ID NO: 97310 - RNA, 22 nt, Human
ugugcaguauugaaauauaugu

SEQ ID NO: 97311 - RNA, 22 nt, Human
ugugcgucuguguacagaugug

SEQ ID NO: 97312 - RNA, 22 nt, Human
ugugccuucuucauuuaauuua

SEQ ID NO: 97313 - RNA, 22 nt, Human
ugugcagugcguggguguugaa

SEQ ID NO: 97314 - RNA, 22 nt, Human
ugcauaaauauuguugggagua

SEQ ID NO: 97315 - RNA, 22 nt, Human
ugcauuaguaaagagaggaggg

SEQ ID NO: 97316 - RNA, 22 nt, Human
ugcaucauuaagguacaguugg

SEQ ID NO: 97317 - RNA, 22 nt, Human
ugcauugccucuauucauuaua

SEQ ID NO: 97318 - RNA, 22 nt, Human
ugcauugccauagcagggggau

SEQ ID NO: 97319 - RNA, 22 nt, Human
ugcauucugggucgcagagugg

SEQ ID NO: 97320 - RNA, 22 nt, Human
ugugggaggauuuaggugaauc

SEQ ID NO: 97321 - RNA, 22 nt, Human
ugcagugaugcuucuggcucag

SEQ ID NO: 97322 - RNA, 18 nt, Human
ugcaggggaggggugaua

SEQ ID NO: 97323 - RNA, 22 nt, Human
ugcagguggcagcggggcacca

SEQ ID NO: 97324 - RNA, 22 nt, Human
ugggguguuacacaacauugag

SEQ ID NO: 97325 - RNA, 22 nt, Human
uucuagauagucugauauuccu

SEQ ID NO: 97326 - RNA, 22 nt, Human
ugggucagauacaguguuuggu

SEQ ID NO: 97327 - RNA, 20 nt, Human
uucucugcagcaggcggccc

SEQ ID NO: 97328 - RNA, 22 nt, Human
uucucucaguuaaacuuuguga

SEQ ID NO: 97329 - RNA, 22 nt, Human
uucuccaccugcuccucccacc

SEQ ID NO: 97330 - RNA, 22 nt, Human
uucucaauggcaacuuguugcu

SEQ ID NO: 97331 - RNA, 22 nt, Human
ugggugaagaggcuaugcuacu

SEQ ID NO: 97332 - RNA, 20 nt, Human
ugggggugcccaucuccccu

SEQ ID NO: 97333 - RNA, 22 nt, Human
ugggggaugacuugcucuuuca

SEQ ID NO: 97334 - RNA, 22 nt, Human
ugggggaggaggagacagacug

SEQ ID NO: 97335 - RNA, 22 nt, Human
uucguugaagcaacgacuuugg

SEQ ID NO: 97336 - RNA, 18 nt, Human
uucuaaauucuguuuuua

SEQ ID NO: 97337 - RNA, 22 nt, Human
uucuacauugugaaguucuuua

SEQ ID NO: 97338 - RNA, 22 nt, Human
uucguucagcgcuugcgcaugc

SEQ ID NO: 97339 - RNA, 22 nt, Human
uggggacucacugacuaucuug

SEQ ID NO: 97340 - RNA, 22 nt, Human
uggggaagaacuugccauuuca

SEQ ID NO: 97341 - RNA, 22 nt, Human
ugggcuguuucuuaaggauaug

SEQ ID NO: 97342 - RNA, 22 nt, Human
uggggagucccaacgguggaag

SEQ ID NO: 97343 - RNA, 22 nt, Human
uggggagacauggaguaaaaga

SEQ ID NO: 97344 - RNA, 21 nt, Human
uggggaugcauugcagaggca

SEQ ID NO: 97345 - RNA, 22 nt, Human
uggggcugguaccguaauauau

SEQ ID NO: 97346 - RNA, 22 nt, Human
ugggccaaaugucugcauaagu

SEQ ID NO: 97347 - RNA, 22 nt, Human
ugggcccaucauugcugugggc

SEQ ID NO: 97348 - RNA, 22 nt, Human
ugggcaguccagcuggaaacgg

SEQ ID NO: 97349 - RNA, 22 nt, Human
ugggcagggauuuggggaaacu

SEQ ID NO: 97350 - RNA, 22 nt, Human
ugggauggacuuuagagaaucg

SEQ ID NO: 97351 - RNA, 19 nt, Human
uuccucaggugugaguuag

SEQ ID NO: 97352 - RNA, 22 nt, Human
ugggcaaaugcuuuuuagucaa

SEQ ID NO: 97353 - RNA, 22 nt, Human
uggcuucuggccaggcacagga

SEQ ID NO: 97354 - RNA, 18 nt, Human
uuccauuuuucagucuuc

SEQ ID NO: 97355 - RNA, 22 nt, Human
uuccauuccauaucagguacag

SEQ ID NO: 97356 - RNA, 22 nt, Human
uuccccaugugaugcuauugcu

SEQ ID NO: 97357 - RNA, 22 nt, Human
ugggagccuuccacugggggaa

SEQ ID NO: 97358 - RNA, 22 nt, Human
uggccauuuacucuguaagagu

SEQ ID NO: 97359 - RNA, 22 nt, Human
uucauacucuucccugggcaaa

SEQ ID NO: 97360 - RNA, 22 nt, Human
uucauagaagggaguuuuuccu

SEQ ID NO: 97361 - RNA, 22 nt, Human
uucaguguuagaauuccaagaa

SEQ ID NO: 97362 - RNA, 22 nt, Human
uggcauuuuguagcuguguauc

SEQ ID NO: 97363 - RNA, 22 nt, Human
uggccaaauuggccugauguau

SEQ ID NO: 97364 - RNA, 22 nt, Human
uggccagucuuagcugugccug

SEQ ID NO: 97365 - RNA, 22 nt, Human
uucauauuguggucuugcauuc

SEQ ID NO: 97366 - RNA, 22 nt, Human
uggccuucagcucuggggugca

SEQ ID NO: 97367 - RNA, 22 nt, Human
uucaucauuuuccauuccucuu

SEQ ID NO: 97368 - RNA, 20 nt, Human
uucaugcagugguugcugug

SEQ ID NO: 97369 - RNA, 22 nt, Human
uucaugcgcuuuucaggagugu

SEQ ID NO: 97370 - RNA, 22 nt, Human
uucaugcaagagugugaggucc

SEQ ID NO: 97371 - RNA, 22 nt, Human
uggcucuucucaagcauuggcu

SEQ ID NO: 97372 - RNA, 18 nt, Human
uggcuagaagagcucuca

SEQ ID NO: 97373 - RNA, 22 nt, Human
uggcuacguacaauggaacuuu

SEQ ID NO: 97374 - RNA, 22 nt, Human
uggcucagcgcggccuggucuu

SEQ ID NO: 97375 - RNA, 22 nt, Human
uuccagcaaagguaguguguua

SEQ ID NO: 97376 - RNA, 22 nt, Human
uuccagguggcuuuccuggggg

SEQ ID NO: 97377 - RNA, 22 nt, Human
uuccagauguuuaaguucugcu

SEQ ID NO: 97378 - RNA, 22 nt, Human
uuccagaacaauguggacguau

SEQ ID NO: 97379 - RNA, 22 nt, Human
uggcuucagacuucugcuacgu

SEQ ID NO: 97380 - RNA, 22 nt, Human
uggcuucugguuuauccuuaua

SEQ ID NO: 97381 - RNA, 22 nt, Human
uuccaggacuggguguuugaag

SEQ ID NO: 97382 - RNA, 22 nt, Human
uucaugucuuugauucugauaa

SEQ ID NO: 97383 - RNA, 22 nt, Human
uucauggauuugugaaauuuag

SEQ ID NO: 97384 - RNA, 22 nt, Human
uucauccucuuuaucuaccugu

SEQ ID NO: 97385 - RNA, 22 nt, Human
uucauugcagaauuuggccuca

SEQ ID NO: 97386 - RNA, 22 nt, Human
uggcgcgcagccugcuggugcu

SEQ ID NO: 97387 - RNA, 22 nt, Human
uggcgacuggaauuaaucuuuu

SEQ ID NO: 97388 - RNA, 22 nt, Human
uucauuuccauuuuauagauaa

SEQ ID NO: 97389 - RNA, 22 nt, Human
uggcgcucacccugcggcccug

SEQ ID NO: 97390 - RNA, 21 nt, Human
uggcauacugcuaaaaagugu

SEQ ID NO: 97391 - RNA, 20 nt, Human
uggcaugaaauuuuccaagc

SEQ ID NO: 97392 - RNA, 22 nt, Human
uggcaugugaauuguuacauug

SEQ ID NO: 97393 - RNA, 18 nt, Human
uggcaugcuuugauacau

SEQ ID NO: 97394 - RNA, 18 nt, Human
uucaggcucuugcaugaa

SEQ ID NO: 97395 - RNA, 22 nt, Human
uucagcugcuugccugaaguca

SEQ ID NO: 97396 - RNA, 22 nt, Human
uucagaugcuugauuauggcaa

SEQ ID NO: 97397 - RNA, 22 nt, Human
uucagauuuguuuuuguuucug

SEQ ID NO: 97398 - RNA, 22 nt, Human
uggcaguagagcuggaacuuga

SEQ ID NO: 97399 - RNA, 22 nt, Human
uggcagugagauuucucuucug

SEQ ID NO: 97400 - RNA, 22 nt, Human
uggcagccucugguccuuaguu

SEQ ID NO: 97401 - RNA, 22 nt, Human
uggcacugcccugucucggugg

SEQ ID NO: 97402 - RNA, 22 nt, Human
uucacguuguugaagaaaauac

SEQ ID NO: 97403 - RNA, 20 nt, Human
uucacggaggccgcgccccc

SEQ ID NO: 97404 - RNA, 22 nt, Human
uucacucagagcaggacagccc

SEQ ID NO: 97405 - RNA, 22 nt, Human
uucacuuuuuccugguccauuu

SEQ ID NO: 97406 - RNA, 23 nt, Human
uggcaaacgggaauaaaggaauu

SEQ ID NO: 97407 - RNA, 22 nt, Human
uggcaacucaauuucuacaaga

SEQ ID NO: 97408 - RNA, 15 nt, Human
uggauuugccacaua

SEQ ID NO: 97409 - RNA, 22 nt, Human
uucacccuucucuggcuuucag

SEQ ID NO: 97410 - RNA, 22 nt, Human
uggauuguauugauugguuggc

SEQ ID NO: 97411 - RNA, 22 nt, Human
uggauuguuuacaucaugucug

SEQ ID NO: 97412 - RNA, 22 nt, Human
uggaugcuccaaguagaccuua

SEQ ID NO: 97413 - RNA, 22 nt, Human
uggauuagugcugaaaugaugg

SEQ ID NO: 97414 - RNA, 22 nt, Human
uggaugccauuugauuaaggcu

SEQ ID NO: 97415 - RNA, 22 nt, Human
uggaugccuugggggaggagga

SEQ ID NO: 97416 - RNA, 21 nt, Human
uucaaccagcaauuggcagaa

SEQ ID NO: 97417 - RNA, 22 nt, Human
uucaaaaugcagaauaguuugg

SEQ ID NO: 97418 - RNA, 22 nt, Human
uggaguucauauuggacauaag

SEQ ID NO: 97419 - RNA, 22 nt, Human
uucaaacacugugcaauugggu

SEQ ID NO: 97420 - RNA, 22 nt, Human
uggagucagaaugcgacaggcc

SEQ ID NO: 97421 - RNA, 22 nt, Human
uggagucuugcuuugggagugc

SEQ ID NO: 97422 - RNA, 22 nt, Human
uggaguguuggucccacugagg

SEQ ID NO: 97423 - RNA, 22 nt, Human
uuauuuuuguaacacuguauag

SEQ ID NO: 97424 - RNA, 22 nt, Human
uggaucaugcgaggccuccccu

SEQ ID NO: 97425 - RNA, 22 nt, Human
uggauauagcugaggugucuug

SEQ ID NO: 97426 - RNA, 21 nt, Human
uggauauugaguaguuucuga

SEQ ID NO: 97427 - RNA, 22 nt, Human
uggauauuuuguaugugcguuu

SEQ ID NO: 97428 - RNA, 21 nt, Human
uucaaguucacacucaaaggu

SEQ ID NO: 97429 - RNA, 22 nt, Human
uggauaugaaacaaaacaagag

SEQ ID NO: 97430 - RNA, 22 nt, Human
uucacagugguaaggguuguga

SEQ ID NO: 97431 - RNA, 20 nt, Human
uucacagaucucuaacugag

SEQ ID NO: 97432 - RNA, 22 nt, Human
uucacaauuuuaaaaaguggaa

SEQ ID NO: 97433 - RNA, 22 nt, Human
uucaauuacaucagaaucuaaa

SEQ ID NO: 97434 - RNA, 22 nt, Human
uuauuuuguagcucugaucuuu

SEQ ID NO: 97435 - RNA, 22 nt, Human
uuauuugguuuuggcuuuagcu

SEQ ID NO: 97436 - RNA, 22 nt, Human
uuauuucaggcauuuguaaaug

SEQ ID NO: 97437 - RNA, 22 nt, Human
uuauuugcccauguuuagcaga

SEQ ID NO: 97438 - RNA, 22 nt, Human
uuauuucuucucgaagcuuggg

SEQ ID NO: 97439 - RNA, 22 nt, Human
uuauuuaaguauuuauugaagu

SEQ ID NO: 97440 - RNA, 22 nt, Human
uuauuuaagaucuuaauauaua

SEQ ID NO: 97441 - RNA, 22 nt, Human
uggaggauggaaggaaagcugg

SEQ ID NO: 97442 - RNA, 22 nt, Human
ugcuauuaagagaaagugaaca

SEQ ID NO: 97443 - RNA, 22 nt, Human
ugcuauucuuggagcugaugga

SEQ ID NO: 97444 - RNA, 22 nt, Human
uuauguugauaggaaucugauu

SEQ ID NO: 97445 - RNA, 20 nt, Human
ugcuccaggaacacuggccg

SEQ ID NO: 97446 - RNA, 22 nt, Human
uuauuguagcacuuuggcagug

SEQ ID NO: 97447 - RNA, 22 nt, Human
uggagcugguucuggggaagcu

SEQ ID NO: 97448 - RNA, 22 nt, Human
uuauuccauagaagucaaggaa

SEQ ID NO: 97449 - RNA, 22 nt, Human
uuauucuuagccucgguauuuc

SEQ ID NO: 97450 - RNA, 22 nt, Human
uuauuggcagcuccugcacaug

SEQ ID NO: 97451 - RNA, 22 nt, Human
uucugagccacaguaaggaucu

SEQ ID NO: 97452 - RNA, 22 nt, Human
uucugaaccauugagcacugcc

SEQ ID NO: 97453 - RNA, 22 nt, Human
uucucucacucuuagaucccgc

SEQ ID NO: 97454 - RNA, 22 nt, Human
uucugaguguugucaccaugug

SEQ ID NO: 97455 - RNA, 22 nt, Human
uucugauacagucccaacacaa

SEQ ID NO: 97456 - RNA, 22 nt, Human
uucugcccuugccagacaagua

SEQ ID NO: 97457 - RNA, 22 nt, Human
uucuuauuuuucguaaauccug

SEQ ID NO: 97458 - RNA, 22 nt, Human
uucuucuguuggcagagcauac

SEQ ID NO: 97459 - RNA, 22 nt, Human
uucuuccagugaaacgugcauc

SEQ ID NO: 97460 - RNA, 22 nt, Human
uucuucgacuguauaaaaguau

SEQ ID NO: 97461 - RNA, 22 nt, Human
ugguggcaauuuuuggggucaa

SEQ ID NO: 97462 - RNA, 22 nt, Human
uucuuggcacagaugagauucu

SEQ ID NO: 97463 - RNA, 22 nt, Human
ugguucacaagaauccagguag

SEQ ID NO: 97464 - RNA, 21 nt, Human
ugguguacauuuccauaguuu

SEQ ID NO: 97465 - RNA, 22 nt, Human
ugguggcuuuucguagguucac

SEQ ID NO: 97466 - RNA, 22 nt, Human
ugguggccucaguggcuucugu

SEQ ID NO: 97467 - RNA, 22 nt, Human
uugaacauuagaauaaguaauu

SEQ ID NO: 97468 - RNA, 22 nt, Human
uugaacaguuuugucagguuca

SEQ ID NO: 97469 - RNA, 22 nt, Human
uugaagaagucaaaagcugcag

SEQ ID NO: 97470 - RNA, 22 nt, Human
uguacagauaucaggagugagg

SEQ ID NO: 97471 - RNA, 22 nt, Human
uguaauguuagaaacaauugcu

SEQ ID NO: 97472 - RNA, 22 nt, Human
uguaauuugguuagauuucuuu

SEQ ID NO: 97473 - RNA, 22 nt, Human
uugaaaacugucaccuuuauuc

SEQ ID NO: 97474 - RNA, 22 nt, Human
uguaaacuuuugcauacugcuu

SEQ ID NO: 97475 - RNA, 22 nt, Human
uugaaaauuaauagguguacaa

SEQ ID NO: 97476 - RNA, 21 nt, Human
uucuuugaagacccauuugag

SEQ ID NO: 97477 - RNA, 18 nt, Human
ugguuggugggggugaag

SEQ ID NO: 97478 - RNA, 22 nt, Human
ugguuuacucuguaaaccagga

SEQ ID NO: 97479 - RNA, 22 nt, Human
ugguugugcuucuuugccucag

SEQ ID NO: 97480 - RNA, 22 nt, Human
uguaaagaaagacgcagaguua

SEQ ID NO: 97481 - RNA, 22 nt, Human
uugaaaaaaucugaggaggacc

SEQ ID NO: 97482 - RNA, 22 nt, Human
uucuuuuuagcugguuguaaga

SEQ ID NO: 97483 - RNA, 22 nt, Human
uugcagauuucuuguccccauu

SEQ ID NO: 97484 - RNA, 22 nt, Human
uugcacgucacccuucccaccu

SEQ ID NO: 97485 - RNA, 22 nt, Human
uugcaagcccugaagggcugga

SEQ ID NO: 97486 - RNA, 22 nt, Human
uugcacagaugcacaugguugc

SEQ ID NO: 97487 - RNA, 22 nt, Human
ugucuuugaccuuaagaaguuu

SEQ ID NO: 97488 - RNA, 22 nt, Human
ugucuuuagagugaacagaaga

SEQ ID NO: 97489 - RNA, 22 nt, Human
ugucugggauguuggcagccac

SEQ ID NO: 97490 - RNA, 22 nt, Human
ugugaagaauuaaugugaauca

SEQ ID NO: 97491 - RNA, 19 nt, Human
ugugaagaccucagugcgg

SEQ ID NO: 97492 - RNA, 22 nt, Human
ugugaagcgugugcaggggaca

SEQ ID NO: 97493 - RNA, 23 nt, Human
ugugaauggccuucuuuagaggu

SEQ ID NO: 97494 - RNA, 22 nt, Human
ugugagauuuuauuugauaugc

SEQ ID NO: 97495 - RNA, 22 nt, Human
ugugacugaaaaugauugagug

SEQ ID NO: 97496 - RNA, 22 nt, Human
ugugacaugauggcgucaugua

SEQ ID NO: 97497 - RNA, 22 nt, Human
ugugauaauauuauuagagcuc

SEQ ID NO: 97498 - RNA, 22 nt, Human
ugugcagaaggagguucuccgg

SEQ ID NO: 97499 - RNA, 22 nt, Human
ugugauuucaaagggugucuuu

SEQ ID NO: 97500 - RNA, 22 nt, Human
ugugauaaaggcccgcagaucc

SEQ ID NO: 97501 - RNA, 22 nt, Human
ugugagcugccacuucuaaucu

SEQ ID NO: 97502 - RNA, 22 nt, Human
ugugauugcauugcagauuacu

SEQ ID NO: 97503 - RNA, 22 nt, Human
uguauuuuuucccugaaauaaa

SEQ ID NO: 97504 - RNA, 22 nt, Human
ugucacaccuggcgauaauggg

SEQ ID NO: 97505 - RNA, 22 nt, Human
uugauaacuuagcugggcugcu

SEQ ID NO: 97506 - RNA, 22 nt, Human
ugucacagugcacagcuaagaa

SEQ ID NO: 97507 - RNA, 22 nt, Human
ugucaccucauacaguaccuca

SEQ ID NO: 97508 - RNA, 22 nt, Human
uguaucuguguguauguguuua

SEQ ID NO: 97509 - RNA, 22 nt, Human
uguaucucugacacagucucac

SEQ ID NO: 97510 - RNA, 22 nt, Human
uguauauuccagggguagggcc

SEQ ID NO: 97511 - RNA, 22 nt, Human
uguauauguguguagcauguua

SEQ ID NO: 97512 - RNA, 22 nt, Human
uguauugugggugucagagugc

SEQ ID NO: 97513 - RNA, 22 nt, Human
uguauggguaggaaacagcugg

SEQ ID NO: 97514 - RNA, 19 nt, Human
uugaauguuugauagucuc

SEQ ID NO: 97515 - RNA, 22 nt, Human
uguauguguuuuauguguguuu

SEQ ID NO: 97516 - RNA, 22 nt, Human
uugauuugcagaagguguagag

SEQ ID NO: 97517 - RNA, 22 nt, Human
uugauuuccauuguccagcauu

SEQ ID NO: 97518 - RNA, 20 nt, Human
ugucccuggagagcugcaga

SEQ ID NO: 97519 - RNA, 22 nt, Human
ugucaucuuucuaaagcugguc

SEQ ID NO: 97520 - RNA, 22 nt, Human
ugucauggacuggauuucugcu

SEQ ID NO: 97521 - RNA, 22 nt, Human
uugauggaggaaaaguuggaau

SEQ ID NO: 97522 - RNA, 22 nt, Human
ugucauauagaauguucuauga

SEQ ID NO: 97523 - RNA, 22 nt, Human
ugucacagggauaccauggggc

SEQ ID NO: 97524 - RNA, 23 nt, Human
ugucacugcggaguggccugcag

SEQ ID NO: 97525 - RNA, 21 nt, Human
uguugguugugggaaggagga

SEQ ID NO: 97526 - RNA, 18 nt, Human
uguugguguucacucacu

SEQ ID NO: 97527 - RNA, 22 nt, Human
uugguugaaauguguucaugcu

SEQ ID NO: 97528 - RNA, 22 nt, Human
uuguacuuaaauaugcaaauag

SEQ ID NO: 97529 - RNA, 22 nt, Human
uuguagaucagauggccaguag

SEQ ID NO: 97530 - RNA, 20 nt, Human
uuguacuuaugugagaagga

SEQ ID NO: 97531 - RNA, 21 nt, Human
uguuggccuucauucucuguc

SEQ ID NO: 97532 - RNA, 22 nt, Human
uuggugaugcuaggaauguagu

SEQ ID NO: 97533 - RNA, 21 nt, Human
uguugcuugucugagacuaug

SEQ ID NO: 97534 - RNA, 22 nt, Human
uguugccaucuaaaauguuacu

SEQ ID NO: 97535 - RNA, 22 nt, Human
uguugcauguggcuguuugcca

SEQ ID NO: 97536 - RNA, 19 nt, Human
uguugcagcuugaucggua

SEQ ID NO: 97537 - RNA, 19 nt, Human
uuggugaagguucacugac

SEQ ID NO: 97538 - RNA, 22 nt, Human
uguuggaauaagugcuugaagg

SEQ ID NO: 97539 - RNA, 22 nt, Human
uguugaucucuuuccaaauucu

SEQ ID NO: 97540 - RNA, 22 nt, Human
uuggucagaugugucuccuccu

SEQ ID NO: 97541 - RNA, 22 nt, Human
uguugaugaccacaauuuaugc

SEQ ID NO: 97542 - RNA, 22 nt, Human
uguucuuacuaaguaccugaaa

SEQ ID NO: 97543 - RNA, 22 nt, Human
uguucuucaaacucaguuccac

SEQ ID NO: 97544 - RNA, 22 nt, Human
uguugaagcaccucugucuuuc

SEQ ID NO: 97545 - RNA, 22 nt, Human
uugggagaggcagcagagucau

SEQ ID NO: 97546 - RNA, 22 nt, Human
uguuccucuuagucuuaugugu

SEQ ID NO: 97547 - RNA, 22 nt, Human
uugggaguaauacugaagagag

SEQ ID NO: 97548 - RNA, 22 nt, Human
uugggcuagaaacaacgugggu

SEQ ID NO: 97549 - RNA, 22 nt, Human
uuggggaauuuggggccguccg

SEQ ID NO: 97550 - RNA, 22 nt, Human
uugggauuggugggguggguuu

SEQ ID NO: 97551 - RNA, 22 nt, Human
uugggcauuucuuauguauuuu

SEQ ID NO: 97552 - RNA, 22 nt, Human
uuggccauuacugagccuggag

SEQ ID NO: 97553 - RNA, 22 nt, Human
uguguguauauauggaauauug

SEQ ID NO: 97554 - RNA, 22 nt, Human
uuggcgcuauuauuaccacauu

SEQ ID NO: 97555 - RNA, 22 nt, Human
uuggcuuuucaguuuuaaguua

SEQ ID NO: 97556 - RNA, 22 nt, Human
uguuacugaaugucucugcuuu

SEQ ID NO: 97557 - RNA, 22 nt, Human
uugcuuuuugggguuuacuggg

SEQ ID NO: 97558 - RNA, 22 nt, Human
uugcuuugcuucuuuaugguca

SEQ ID NO: 97559 - RNA, 23 nt, Human
uugcuugagcccaggaaguggag

SEQ ID NO: 97560 - RNA, 22 nt, Human
uugcuuucuuuguagguuuucc

SEQ ID NO: 97561 - RNA, 22 nt, Human
uuggaaaagaaauacucauaua

SEQ ID NO: 97562 - RNA, 22 nt, Human
uugcuuuuuuggguuuacuggg

SEQ ID NO: 97563 - RNA, 22 nt, Human
uuggaaaugcauuuguuauuau

SEQ ID NO: 97564 - RNA, 22 nt, Human
uguggucuccucucugucuucc

SEQ ID NO: 97565 - RNA, 22 nt, Human
uuggaggucucugugguggugg

SEQ ID NO: 97566 - RNA, 22 nt, Human
uuggaguucuucaugcucugua

SEQ ID NO: 97567 - RNA, 22 nt, Human
uuggaggaagcucaugggggau

SEQ ID NO: 97568 - RNA, 22 nt, Human
uuggauguccucuguggaguau

SEQ ID NO: 97569 - RNA, 22 nt, Human
uguguggaggugggugaugucu

SEQ ID NO: 97570 - RNA, 22 nt, Human
ugugugguaaugagagauccaa

SEQ ID NO: 97571 - RNA, 19 nt, Human
uguguaccuaauguuugug

SEQ ID NO: 97572 - RNA, 20 nt, Human
uuggagaucacguguccagg

SEQ ID NO: 97573 - RNA, 22 nt, Human
uguguaacaacauaaugguuau

SEQ ID NO: 97574 - RNA, 22 nt, Human
ugugcaucuggaggcaauguuu

SEQ ID NO: 97575 - RNA, 22 nt, Human
ugugccuagauuccaugcacuc

SEQ ID NO: 97576 - RNA, 22 nt, Human
ugugccuuucacuaugucauuc

SEQ ID NO: 97577 - RNA, 22 nt, Human
ugugcgcgugugcuuugugugu

SEQ ID NO: 97578 - RNA, 22 nt, Human
uugcucaugucaccaaagcaca

SEQ ID NO: 97579 - RNA, 22 nt, Human
uugcucaccugagaagaauaga

SEQ ID NO: 97580 - RNA, 22 nt, Human
uugcugagcugaaccagccacc

SEQ ID NO: 97581 - RNA, 22 nt, Human
ugugcuugucguggagccaggc

SEQ ID NO: 97582 - RNA, 22 nt, Human
ugugcuggcuucugugagcuga

SEQ ID NO: 97583 - RNA, 22 nt, Human
ugugcugcagcgagagcuacga

SEQ ID NO: 97584 - RNA, 22 nt, Human
ugugcuauuuuugcauaugugu

SEQ ID NO: 97585 - RNA, 22 nt, Human
ugugcuaauguuaggauugaau

SEQ ID NO: 97586 - RNA, 22 nt, Human
uguggccaccagagcugcuauu

SEQ ID NO: 97587 - RNA, 22 nt, Human
uguggcuuaggugagcauguga

SEQ ID NO: 97588 - RNA, 22 nt, Human
uugcugugucauuuguuuaauc

SEQ ID NO: 97589 - RNA, 22 nt, Human
uugcuggaguagaaaacuuaac

SEQ ID NO: 97590 - RNA, 21 nt, Human
uugcuggagcaauguaaauca

SEQ ID NO: 97591 - RNA, 22 nt, Human
uugcugcgcugaccuccaguga

SEQ ID NO: 97592 - RNA, 22 nt, Human
uguggacauuccaaaaggacca

SEQ ID NO: 97593 - RNA, 22 nt, Human
uugcugggauucauugaagggu

SEQ ID NO: 97594 - RNA, 22 nt, Human
uuucuaaaauuacugcagucgg

SEQ ID NO: 97595 - RNA, 22 nt, Human
uuucguugcacucauaugguug

SEQ ID NO: 97596 - RNA, 22 nt, Human
uuauuguuuggguauaauuuga

SEQ ID NO: 97597 - RNA, 22 nt, Human
uuucuauuuacagugcuaggua

SEQ ID NO: 97598 - RNA, 22 nt, Human
uuucuaguauauaacuagaucu

SEQ ID NO: 97599 - RNA, 22 nt, Human
uuuccccugggaacauugauuc

SEQ ID NO: 97600 - RNA, 18 nt, Human
uuuccucauuugcagacu

SEQ ID NO: 97601 - RNA, 22 nt, Human
uuaugggguuaaauuucuccua

SEQ ID NO: 97602 - RNA, 22 nt, Human
uuuccaguaaguggcaaggagc

SEQ ID NO: 97603 - RNA, 22 nt, Human
uuaugguuuaauauccagcaca

SEQ ID NO: 97604 - RNA, 22 nt, Human
uuucagagaaagcccaaagacu

SEQ ID NO: 97605 - RNA, 22 nt, Human
uuuccuguuuugguuuggagag

SEQ ID NO: 97606 - RNA, 22 nt, Human
uuuccuuaauuguaaaauggag

SEQ ID NO: 97607 - RNA, 22 nt, Human
uuaugugcuuuuugagcucuaa

SEQ ID NO: 97608 - RNA, 22 nt, Human
uuauuaauacaugcaccugcau

SEQ ID NO: 97609 - RNA, 22 nt, Human
uuauauuaaaaaucgcuaacag

SEQ ID NO: 97610 - RNA, 22 nt, Human
uuucagugaaugaauggcuaac

SEQ ID NO: 97611 - RNA, 22 nt, Human
uuucagaaauggcacugaaauc

SEQ ID NO: 97612 - RNA, 22 nt, Human
uuucagauuauguucauggguu

SEQ ID NO: 97613 - RNA, 22 nt, Human
uuauauuuuauuuaauuaaaua

SEQ ID NO: 97614 - RNA, 22 nt, Human
uuauacuucugccagaggacaa

SEQ ID NO: 97615 - RNA, 22 nt, Human
uuaucaaaaaauaguacuuuga

SEQ ID NO: 97616 - RNA, 21 nt, Human
uuuccagaggcagccggacuc

SEQ ID NO: 97617 - RNA, 22 nt, Human
uuaucagggaguuguguguucu

SEQ ID NO: 97618 - RNA, 22 nt, Human
uuucauguuggauacuguuuca

SEQ ID NO: 97619 - RNA, 22 nt, Human
uuaucuguuuuaaugaauaauu

SEQ ID NO: 97620 - RNA, 22 nt, Human
uuaugcaaaggggccucuuccu

SEQ ID NO: 97621 - RNA, 22 nt, Human
uuaugccuguuaggcagcaucu

SEQ ID NO: 97622 - RNA, 22 nt, Human
uuauggauuagaguuugauucu

SEQ ID NO: 97623 - RNA, 22 nt, Human
uuaugggcgaugcaaaccugau

SEQ ID NO: 97624 - RNA, 22 nt, Human
uuaucugcccauuguagaauug

SEQ ID NO: 97625 - RNA, 22 nt, Human
uuaucuuuuaaaaacacuugug

SEQ ID NO: 97626 - RNA, 22 nt, Human
uuuagguccguguugcaguugg

SEQ ID NO: 97627 - RNA, 22 nt, Human
uuuaggaagaucugaaggaaga

SEQ ID NO: 97628 - RNA, 19 nt, Human
uuuagcuacugugguauua

SEQ ID NO: 97629 - RNA, 22 nt, Human
uuuagcaaggagaaauaauccu

SEQ ID NO: 97630 - RNA, 22 nt, Human
uuagagaauagacuuuacccug

SEQ ID NO: 97631 - RNA, 22 nt, Human
uuacuggaauauaaagauaaga

SEQ ID NO: 97632 - RNA, 22 nt, Human
uguuugaggugacucuggaaug

SEQ ID NO: 97633 - RNA, 22 nt, Human
uuuacaaggcaguuauuuuccu

SEQ ID NO: 97634 - RNA, 22 nt, Human
uguuuguaugauggcacaucca

SEQ ID NO: 97635 - RNA, 22 nt, Human
uguuugagaauuugcugauguu

SEQ ID NO: 97636 - RNA, 22 nt, Human
uuuacucagucugagcaggugu

SEQ ID NO: 97637 - RNA, 22 nt, Human
uuaccugcagagacguggaggc

SEQ ID NO: 97638 - RNA, 22 nt, Human
uuacccuugaauuugugacaaa

SEQ ID NO: 97639 - RNA, 22 nt, Human
uuaccgagaacaugacuggaau

SEQ ID NO: 97640 - RNA, 22 nt, Human
uuuacaagucuguugaucccaa

SEQ ID NO: 97641 - RNA, 22 nt, Human
uuacaugcuugugcagguuuug

SEQ ID NO: 97642 - RNA, 22 nt, Human
uuagagagaggagagagagaga

SEQ ID NO: 97643 - RNA, 22 nt, Human
uuagagauuuuauguuaaugua

SEQ ID NO: 97644 - RNA, 23 nt, Human
uuagcccaggcuggagguagccc

SEQ ID NO: 97645 - RNA, 22 nt, Human
uuuauauauauguaggagcaca

SEQ ID NO: 97646 - RNA, 22 nt, Human
uuaggacucuauuuggguaucu

SEQ ID NO: 97647 - RNA, 22 nt, Human
uuucaaguagagggaucgcuag

SEQ ID NO: 97648 - RNA, 19 nt, Human
uuucacaaagagagcguga

SEQ ID NO: 97649 - RNA, 22 nt, Human
uuucacauacaguguauaguag

SEQ ID NO: 97650 - RNA, 22 nt, Human
uuuauuugugguaguguaaucu

SEQ ID NO: 97651 - RNA, 22 nt, Human
uuauaaaccgcuaacagcacuu

SEQ ID NO: 97652 - RNA, 22 nt, Human
uuucaagccucacugcguuuug

SEQ ID NO: 97653 - RNA, 22 nt, Human
uuuauuuuccaugucucuaggu

SEQ ID NO: 97654 - RNA, 22 nt, Human
uuaguuauaggugaaucagaga

SEQ ID NO: 97655 - RNA, 22 nt, Human
uuuaugauguagccuagagcug

SEQ ID NO: 97656 - RNA, 22 nt, Human
uuucuguugugaccugacucuu

SEQ ID NO: 97657 - RNA, 22 nt, Human
uuucuguucuguuggauucuuu

SEQ ID NO: 97658 - RNA, 22 nt, Human
uuucuggaaacuguaaagagga

SEQ ID NO: 97659 - RNA, 22 nt, Human
uuucuggacuaaagggagagau

SEQ ID NO: 97660 - RNA, 22 nt, Human
uuucugggggucgugcuggcug

SEQ ID NO: 97661 - RNA, 22 nt, Human
uuucugugguggguaguucaga

SEQ ID NO: 97662 - RNA, 19 nt, Human
uuucuggguucaccucuug

SEQ ID NO: 97663 - RNA, 22 nt, Human
uuucuuccuucuugaucauuug

SEQ ID NO: 97664 - RNA, 22 nt, Human
uuucuugggaaaugucagaagu

SEQ ID NO: 97665 - RNA, 22 nt, Human
uuauuuuauaaagagaagacuu

SEQ ID NO: 97666 - RNA, 22 nt, Human
uuucuuugcugguuggcucucc

SEQ ID NO: 97667 - RNA, 20 nt, Human
uuucucccacaaugacccuc

SEQ ID NO: 97668 - RNA, 22 nt, Human
uuucucugggugaugagguggc

SEQ ID NO: 97669 - RNA, 22 nt, Human
uuucugaugaaguagaaagacc

SEQ ID NO: 97670 - RNA, 22 nt, Human
uuucugcauuuguauuggaaaa

SEQ ID NO: 97671 - RNA, 22 nt, Human
uuauuucauguaaaauuuaugu

SEQ ID NO: 97672 - RNA, 22 nt, Human
uucaaacaguguagaauauaug

SEQ ID NO: 97673 - RNA, 22 nt, Human
uuauuuuuguuuguuaagccua

SEQ ID NO: 97674 - RNA, 22 nt, Human
uuugaagaaacagucuuaagag

SEQ ID NO: 97675 - RNA, 22 nt, Human
uuugaagauaaauauggagaaa

SEQ ID NO: 97676 - RNA, 22 nt, Human
uuugaagaccuuaucucuaaau

SEQ ID NO: 97677 - RNA, 22 nt, Human
uuauuuucgugugugugugugu

SEQ ID NO: 97678 - RNA, 22 nt, Human
uuauuuuuaggaauguagaggu

SEQ ID NO: 97679 - RNA, 18 nt, Human
uuucuuuuauuccagguc

SEQ ID NO: 97680 - RNA, 23 nt, Human
uuugaaucauuguggggcuuuug

SEQ ID NO: 97681 - RNA, 22 nt, Human
uuugacaccaggagagaaaaca

SEQ ID NO: 97682 - RNA, 22 nt, Human
uuugagaagauaggggaauacu

SEQ ID NO: 97683 - RNA, 21 nt, Human
uuugacagaccagguauaguu

SEQ ID NO: 97684 - RNA, 22 nt, Human
uucaacacaaguugugcaguaa

SEQ ID NO: 97685 - RNA, 22 nt, Human
uucaaaccuaucuaagaaauag

SEQ ID NO: 97686 - RNA, 22 nt, Human
uucaacaacuugguucaaaugg

SEQ ID NO: 97687 - RNA, 22 nt, Human
uuugaugagaaaugacuuaagu

SEQ ID NO: 97688 - RNA, 22 nt, Human
uuugaugauuuucuagagugua

SEQ ID NO: 97689 - RNA, 20 nt, Human
uuugauugccccucugacuu

SEQ ID NO: 97690 - RNA, 22 nt, Human
uuugaguaagauguugauacug

SEQ ID NO: 97691 - RNA, 22 nt, Human
uuugaguacagcugccuuuuug

SEQ ID NO: 97692 - RNA, 22 nt, Human
uucagguacuaagugcugauuc

SEQ ID NO: 97693 - RNA, 22 nt, Human
uucaggaucuaggaguauuuuu

SEQ ID NO: 97694 - RNA, 22 nt, Human
uuugcacuuaaauuuacaacac

SEQ ID NO: 97695 - RNA, 22 nt, Human
uuugcauuugagagaggaaaca

SEQ ID NO: 97696 - RNA, 22 nt, Human
uuuggccauuuguaugcaugau

SEQ ID NO: 97697 - RNA, 22 nt, Human
uuuggcaagcagaugaagguag

SEQ ID NO: 97698 - RNA, 22 nt, Human
uucagacugcccauguuugcca

SEQ ID NO: 97699 - RNA, 23 nt, Human
uuugcaaauuggacacaaccaca

SEQ ID NO: 97700 - RNA, 22 nt, Human
uuugcauuaguuuagauuucaa

SEQ ID NO: 97701 - RNA, 22 nt, Human
uuugcaggaaauguacugaaug

SEQ ID NO: 97702 - RNA, 22 nt, Human
uuuggggcucauuugcuuuugu

SEQ ID NO: 97703 - RNA, 22 nt, Human
uuuggugacuguaggaaaggau

SEQ ID NO: 97704 - RNA, 22 nt, Human
uuugguaccucucgucacaaug

SEQ ID NO: 97705 - RNA, 22 nt, Human
uucaucuucaaaccccagugcc

SEQ ID NO: 97706 - RNA, 22 nt, Human
uucauacuguuuaaguucuguu

SEQ ID NO: 97707 - RNA, 22 nt, Human
uucaguuuugcuuuuaaucaug

SEQ ID NO: 97708 - RNA, 22 nt, Human
uucaguagagguggaaauaaca

SEQ ID NO: 97709 - RNA, 22 nt, Human
uucaguaugcugaaugauuuuu

SEQ ID NO: 97710 - RNA, 19 nt, Human
uucaggcuuuucauuuuuc

SEQ ID NO: 97711 - RNA, 22 nt, Human
uucaguuugaauucuguagaac

SEQ ID NO: 97712 - RNA, 22 nt, Human
uuccccagaaaaguaaacaagg

SEQ ID NO: 97713 - RNA, 22 nt, Human
uuuguuaugguuggaagcagga

SEQ ID NO: 97714 - RNA, 22 nt, Human
uuuguuaggguuucagcuagcc

SEQ ID NO: 97715 - RNA, 22 nt, Human
uuuguccuguuggcaugaaaau

SEQ ID NO: 97716 - RNA, 22 nt, Human
uuccaugccuaagagccugaag

SEQ ID NO: 97717 - RNA, 22 nt, Human
uuuguaguuguggaugcugaag

SEQ ID NO: 97718 - RNA, 22 nt, Human
uuugguguuuucaggaauauac

SEQ ID NO: 97719 - RNA, 22 nt, Human
uuuggugauuuuuaaucccccu

SEQ ID NO: 97720 - RNA, 22 nt, Human
uuuguacuuucuaauguauuua

SEQ ID NO: 97721 - RNA, 22 nt, Human
uucauugcuacuuaaaauacca

SEQ ID NO: 97722 - RNA, 22 nt, Human
uucauugauuuccuuggaauaa

SEQ ID NO: 97723 - RNA, 22 nt, Human
uugccuagugguagugacuguu

SEQ ID NO: 97724 - RNA, 22 nt, Human
uugcggaucuucauggccucag

SEQ ID NO: 97725 - RNA, 23 nt, Human
uugcauuaauguggaggcacagg

SEQ ID NO: 97726 - RNA, 22 nt, Human
uugccaggggacaucuggagcc

SEQ ID NO: 97727 - RNA, 22 nt, Human
uugccgacuggccaaggaguaa

SEQ ID NO: 97728 - RNA, 22 nt, Human
uugccaggagacaucuggagcc

SEQ ID NO: 97729 - RNA, 22 nt, Human
uugccauacuugaaaggagaaa

SEQ ID NO: 97730 - RNA, 22 nt, Human
uugcguaauuugagauuguaaa

SEQ ID NO: 97731 - RNA, 22 nt, Human
uugcggauguccacgucacacu

SEQ ID NO: 97732 - RNA, 20 nt, Human
uugcucucuuguguugaugu

SEQ ID NO: 97733 - RNA, 18 nt, Human
uugcucucucugggggca

SEQ ID NO: 97734 - RNA, 22 nt, Human
uugcagagaacuaaagggagua

SEQ ID NO: 97735 - RNA, 22 nt, Human
uugcagugucaucuagacgugg

SEQ ID NO: 97736 - RNA, 22 nt, Human
uugaguuuacauuguauuagcc

SEQ ID NO: 97737 - RNA, 22 nt, Human
uugauuuggaauuuuuagagcu

SEQ ID NO: 97738 - RNA, 22 nt, Human
uugcaagauaguguauuuuuca

SEQ ID NO: 97739 - RNA, 22 nt, Human
uugcagaauucuucccacucag

SEQ ID NO: 97740 - RNA, 22 nt, Human
uugcacuccagcccgagcaaca

SEQ ID NO: 97741 - RNA, 22 nt, Human
uugauuuggcguuuuccuccug

SEQ ID NO: 97742 - RNA, 22 nt, Human
uuggaaauguagaaaagcagau

SEQ ID NO: 97743 - RNA, 23 nt, Human
uugcuuuugccccaaaagaguua

SEQ ID NO: 97744 - RNA, 22 nt, Human
uuggaagagagauggggagaga

SEQ ID NO: 97745 - RNA, 22 nt, Human
uuggacugguuuacauuucaag

SEQ ID NO: 97746 - RNA, 22 nt, Human
uuggacugggauggccgaggcu

SEQ ID NO: 97747 - RNA, 22 nt, Human
uugcugguggcucugauuucau

SEQ ID NO: 97748 - RNA, 22 nt, Human
uugcuuaaaucgcuuaaacugg

SEQ ID NO: 97749 - RNA, 22 nt, Human
uugcuugaacccaggaagugga

SEQ ID NO: 97750 - RNA, 22 nt, Human
uugcuuaggccaaauggcgcau

SEQ ID NO: 97751 - RNA, 22 nt, Human
uugcuugcggccuuugugccuu

SEQ ID NO: 97752 - RNA, 22 nt, Human
uugcugccagcgcccugcaggg

SEQ ID NO: 97753 - RNA, 22 nt, Human
uugcugaggcuggggagaggug

SEQ ID NO: 97754 - RNA, 22 nt, Human
uugcucuuaccauuauguguga

SEQ ID NO: 97755 - RNA, 22 nt, Human
uuggggcugcguguuuccaugu

SEQ ID NO: 97756 - RNA, 22 nt, Human
uugggggccuccuguuccccca

SEQ ID NO: 97757 - RNA, 22 nt, Human
uugggucagcuuucagguagua

SEQ ID NO: 97758 - RNA, 22 nt, Human
uugggucaugggaucccagcau

SEQ ID NO: 97759 - RNA, 22 nt, Human
uuggucaagacugauaucaaga

SEQ ID NO: 97760 - RNA, 22 nt, Human
uugguauucaguuggauuugga

SEQ ID NO: 97761 - RNA, 22 nt, Human
uugguaccaagcaaacuuucug

SEQ ID NO: 97762 - RNA, 22 nt, Human
uuggcacagagcugcagccugg

SEQ ID NO: 97763 - RNA, 22 nt, Human
uuggcaaaaauacuguaggccu

SEQ ID NO: 97764 - RNA, 22 nt, Human
uuggugaugaaagugcugcgcu

SEQ ID NO: 97765 - RNA, 22 nt, Human
uuggugaugcccaccuuuucau

SEQ ID NO: 97766 - RNA, 22 nt, Human
uuggugauguagcagcaauugu

SEQ ID NO: 97767 - RNA, 19 nt, Human
uugucuuagcugcauaaga

SEQ ID NO: 97768 - RNA, 22 nt, Human
uugucuuggcauaccguuauau

SEQ ID NO: 97769 - RNA, 22 nt, Human
uugucucuacagagaguaguag

SEQ ID NO: 97770 - RNA, 22 nt, Human
uuguauaaagauggcuagaucc

SEQ ID NO: 97771 - RNA, 22 nt, Human
uuguagccaugucacaagcaca

SEQ ID NO: 97772 - RNA, 22 nt, Human
uuguauguuucugugcacauga

SEQ ID NO: 97773 - RNA, 22 nt, Human
uuguaugcugggaagcgggagg

SEQ ID NO: 97774 - RNA, 21 nt, Human
uuguccacacacaccaacugc

SEQ ID NO: 97775 - RNA, 18 nt, Human
uuuaauaagccuguuaug

SEQ ID NO: 97776 - RNA, 22 nt, Human
uuuaauauucucuuugaaggaa

SEQ ID NO: 97777 - RNA, 22 nt, Human
uuuaaucaauaaccuccugggu

SEQ ID NO: 97778 - RNA, 22 nt, Human
uuuaacccaaauaaccacagga

SEQ ID NO: 97779 - RNA, 22 nt, Human
uuuaaagucaggcuguaguggu

SEQ ID NO: 97780 - RNA, 22 nt, Human
uuuaaauaguugguuuuuuugc

SEQ ID NO: 97781 - RNA, 20 nt, Human
uuuaacuggccuucuggcuc

SEQ ID NO: 97782 - RNA, 22 nt, Human
uuuaaauuucugaaucuugagg

SEQ ID NO: 97783 - RNA, 22 nt, Human
uuguuuacuugagcugcacucu

SEQ ID NO: 97784 - RNA, 21 nt, Human
uugugaaaguccaggaacaac

SEQ ID NO: 97785 - RNA, 22 nt, Human
uugugacaauacagcauggaga

SEQ ID NO: 97786 - RNA, 22 nt, Human
uuguuuguaaggcucuuagaau

SEQ ID NO: 97787 - RNA, 22 nt, Human
uuuaaaacagcauuuaaaaggu

SEQ ID NO: 97788 - RNA, 22 nt, Human
uuguuuucuugaugaaauuauu

SEQ ID NO: 97789 - RNA, 22 nt, Human
uuguuuucuaguguuuugaaua

SEQ ID NO: 97790 - RNA, 22 nt, Human
uuguuuuaaaaagaauaacuac

SEQ ID NO: 97791 - RNA, 22 nt, Human
uuuuuaaaagaugauuuaauga

SEQ ID NO: 97792 - RNA, 18 nt, Human
uuuuguguuuauucugca

SEQ ID NO: 97793 - RNA, 22 nt, Human
uucuguucugcuuucuccaucc

SEQ ID NO: 97794 - RNA, 22 nt, Human
uucuguucuuuguccccuuggu

SEQ ID NO: 97795 - RNA, 22 nt, Human
uucuguguauggaagaaugucc

SEQ ID NO: 97796 - RNA, 22 nt, Human
uuuuuaccugguguccagcuuc

SEQ ID NO: 97797 - RNA, 22 nt, Human
uuuuuagcuguuauuguggaag

SEQ ID NO: 97798 - RNA, 22 nt, Human
uuuuuauaagagcagcagaguu

SEQ ID NO: 97799 - RNA, 19 nt, Human
uuuuucccccucuccucag

SEQ ID NO: 97800 - RNA, 22 nt, Human
uuuuucuccauuccaggugccu

SEQ ID NO: 97801 - RNA, 22 nt, Human
uugaaaaaugcccagcagacaa

SEQ ID NO: 97802 - RNA, 22 nt, Human
uuuuuauaagauuuaaaaugua

SEQ ID NO: 97803 - RNA, 22 nt, Human
uuuuucagacuaauagggcaua

SEQ ID NO: 97804 - RNA, 22 nt, Human
uuuuuguggggggcggugugaa

SEQ ID NO: 97805 - RNA, 20 nt, Human
uugaaagucagggcuccagu

SEQ ID NO: 97806 - RNA, 22 nt, Human
uugaaaaguuuguuacucacau

SEQ ID NO: 97807 - RNA, 22 nt, Human
uugaaagaacaauucugugaug

SEQ ID NO: 97808 - RNA, 22 nt, Human
uugaaccaggauaaacauagaa

SEQ ID NO: 97809 - RNA, 22 nt, Human
uugaacguguaggaagcugguu

SEQ ID NO: 97810 - RNA, 22 nt, Human
uugaagccaccacuguaaguca

SEQ ID NO: 97811 - RNA, 22 nt, Human
uugaauggaauuggaaucuuau

SEQ ID NO: 97812 - RNA, 22 nt, Human
uugaauuuagguuuaugugaaa

SEQ ID NO: 97813 - RNA, 22 nt, Human
uuuuuuuguagguguaugaaaa

SEQ ID NO: 97814 - RNA, 22 nt, Human
uuuuuuuuacuccggacagcuc

SEQ ID NO: 97815 - RNA, 23 nt, Human
uucugcuucccauagcacuuugu

SEQ ID NO: 97816 - RNA, 22 nt, Human
uucugcuuuaaagcucauguuu

SEQ ID NO: 97817 - RNA, 22 nt, Human
uuuugaugaccauucuucuuuu

SEQ ID NO: 97818 - RNA, 22 nt, Human
uucuggucucucugaccuagga

SEQ ID NO: 97819 - RNA, 22 nt, Human
uucuguacuagaucuuaucagu

SEQ ID NO: 97820 - RNA, 20 nt, Human
uucuguggcccguuuaagug

SEQ ID NO: 97821 - RNA, 22 nt, Human
uucugucaguguugguggaaau

SEQ ID NO: 97822 - RNA, 22 nt, Human
uucugcauaggcuauauuuguu

SEQ ID NO: 97823 - RNA, 20 nt, Human
uucugcagcagguguugaag

SEQ ID NO: 97824 - RNA, 22 nt, Human
uucugaugccuggguugcuucu

SEQ ID NO: 97825 - RNA, 20 nt, Human
uucugcucuagagucuagaa

SEQ ID NO: 97826 - RNA, 22 nt, Human
uucugaaggcaggggcuaucuu

SEQ ID NO: 97827 - RNA, 22 nt, Human
uuuuccuuaacagagggagaaa

SEQ ID NO: 97828 - RNA, 22 nt, Human
uucugaaacauugcuauuuucc

SEQ ID NO: 97829 - RNA, 22 nt, Human
uucucuggggacugucucuauu

SEQ ID NO: 97830 - RNA, 22 nt, Human
uucucugcgcuccggcccaguu

SEQ ID NO: 97831 - RNA, 22 nt, Human
uuuucaauuuucauuugcaaga

SEQ ID NO: 97832 - RNA, 22 nt, Human
uuuucaaucaaguuuauuuaua

SEQ ID NO: 97833 - RNA, 22 nt, Human
uuuuauaaaaccuguuugaccu

SEQ ID NO: 97834 - RNA, 22 nt, Human
uuuuaguaauacuuuggccuuu

SEQ ID NO: 97835 - RNA, 22 nt, Human
uucuaauauuaugauuucuaag

SEQ ID NO: 97836 - RNA, 20 nt, Human
uucguuucaguguuggauca

SEQ ID NO: 97837 - RNA, 22 nt, Human
uuuguugaauggcaggauuuua

SEQ ID NO: 97838 - RNA, 22 nt, Human
uuuguucuucucaugcacacaa

SEQ ID NO: 97839 - RNA, 22 nt, Human
uuuguucuagauaacugguaau

SEQ ID NO: 97840 - RNA, 22 nt, Human
uuuucaacuuuauuuuccccca

SEQ ID NO: 97841 - RNA, 19 nt, Human
uuuucaacguccgguucau

SEQ ID NO: 97842 - RNA, 22 nt, Human
uucuagcucauggugacagauc

SEQ ID NO: 97843 - RNA, 22 nt, Human
uucuaggagucugguuccugcc

SEQ ID NO: 97844 - RNA, 20 nt, Human
uucuccacaggguggaggag

SEQ ID NO: 97845 - RNA, 22 nt, Human
uucuccucaaaccaucagacau

SEQ ID NO: 97846 - RNA, 22 nt, Human
uucuccacguucuucucggccu

SEQ ID NO: 97847 - RNA, 22 nt, Human
uucuccccacuccucccucuga

SEQ ID NO: 97848 - RNA, 22 nt, Human
uucucuauuugcugcaccucuc

SEQ ID NO: 97849 - RNA, 22 nt, Human
aaaaauuucuggugaaaugccu

SEQ ID NO: 97850 - RNA, 22 nt, Human
aaaagaaugaugggagcugggu

SEQ ID NO: 97851 - RNA, 22 nt, Human
aaaacuuucagggauacagaaa

SEQ ID NO: 97852 - RNA, 22 nt, Human
aaaaggauauuuggugcaaagc

SEQ ID NO: 97853 - RNA, 22 nt, Human
aaaaggaagaguuuucagagac

SEQ ID NO: 97854 - RNA, 22 nt, Human
aaaagcauuauuagucugggug

SEQ ID NO: 97855 - RNA, 22 nt, Human
aaaagguuauagcuuugccuug

SEQ ID NO: 97856 - RNA, 22 nt, Human
aaaaggucacuguaaaaugacg

SEQ ID NO: 97857 - RNA, 22 nt, Human
aaaauaauauuauaccacugcu

SEQ ID NO: 97858 - RNA, 22 nt, Human
aaaaguuguaauauuuccuuua

SEQ ID NO: 97859 - RNA, 22 nt, Human
aaaauauuuaucuagcucuuaa

SEQ ID NO: 97860 - RNA, 17 nt, Human
aaaaucaaaggaggugc

SEQ ID NO: 97861 - RNA, 22 nt, Human
aaaauauucuauaucaaagaua

SEQ ID NO: 97862 - RNA, 22 nt, Human
aaaagguauuuagcgauugcau

SEQ ID NO: 97863 - RNA, 22 nt, Human
aaaaguauaagugucuccugau

SEQ ID NO: 97864 - RNA, 22 nt, Human
aaaaucucagaaaaguuuaggu

SEQ ID NO: 97865 - RNA, 18 nt, Human
aaacgguuucaugcugua

SEQ ID NO: 97866 - RNA, 22 nt, Human
aaaaugggaaaauuuuagauua

SEQ ID NO: 97867 - RNA, 22 nt, Human
aaacuagaacagagagagaagc

SEQ ID NO: 97868 - RNA, 22 nt, Human
aaacgcauucuuacaugcuucc

SEQ ID NO: 97869 - RNA, 22 nt, Human
aaacaagagcuuacauggcugc

SEQ ID NO: 97870 - RNA, 22 nt, Human
aaacaaauccaauaauaaaauu

SEQ ID NO: 97871 - RNA, 22 nt, Human
aaaauuuccuuggaccauuuuu

SEQ ID NO: 97872 - RNA, 22 nt, Human
aaacaccaagagcuagcuauua

SEQ ID NO: 97873 - RNA, 22 nt, Human
aaagcugaaacgaaaugacaac

SEQ ID NO: 97874 - RNA, 17 nt, Human
aaagccgaucagauguu

SEQ ID NO: 97875 - RNA, 22 nt, Human
aaagccaagguccauguacuuu

SEQ ID NO: 97876 - RNA, 22 nt, Human
aaagcagguugcaauuacagug

SEQ ID NO: 97877 - RNA, 22 nt, Human
aaagccaagucugauuuuguug

SEQ ID NO: 97878 - RNA, 22 nt, Human
aaagccagggacagugugcaug

SEQ ID NO: 97879 - RNA, 22 nt, Human
aaagccauaucuauucuauucu

SEQ ID NO: 97880 - RNA, 20 nt, Human
aaagauacuuuuuguaaugg

SEQ ID NO: 97881 - RNA, 22 nt, Human
aaagaugaaguucagcgaagaa

SEQ ID NO: 97882 - RNA, 22 nt, Human
aaagaugucauacacauuaaga

SEQ ID NO: 97883 - RNA, 22 nt, Human
aaagguguagacucaguuaugc

SEQ ID NO: 97884 - RNA, 22 nt, Human
aaagguggugguuagggaauau

SEQ ID NO: 97885 - RNA, 22 nt, Human
aaaggugccucuuacaaggcuu

SEQ ID NO: 97886 - RNA, 22 nt, Human
aaaggggugguauuucuuuugg

SEQ ID NO: 97887 - RNA, 22 nt, Human
aaagggcugaaguagucucugu

SEQ ID NO: 97888 - RNA, 22 nt, Human
aaagcccuccaggguauacauu

SEQ ID NO: 97889 - RNA, 22 nt, Human
aaagcauuuguuucuccuggaa

SEQ ID NO: 97890 - RNA, 22 nt, Human
aaagcagucuguuuuaaccuga

SEQ ID NO: 97891 - RNA, 21 nt, Human
aaagaagagcucagagguaga

SEQ ID NO: 97892 - RNA, 22 nt, Human
aaagaacguuucugggaaucag

SEQ ID NO: 97893 - RNA, 22 nt, Human
aaagaguuguauucuuuuugag

SEQ ID NO: 97894 - RNA, 22 nt, Human
aaagacaauaauucucucuagc

SEQ ID NO: 97895 - RNA, 22 nt, Human
aaacagcugcaguacacggccu

SEQ ID NO: 97896 - RNA, 22 nt, Human
aaaccgguacccuccugccugc

SEQ ID NO: 97897 - RNA, 22 nt, Human
aaacgcaauuucuugcauguca

SEQ ID NO: 97898 - RNA, 22 nt, Human
aaacuuuugaaggaggaaaaag

SEQ ID NO: 97899 - RNA, 22 nt, Human
aaagaguuaagagucuuaagcu

SEQ ID NO: 97900 - RNA, 22 nt, Human
aaagcauucuaaccgaucgacg

SEQ ID NO: 97901 - RNA, 22 nt, Human
aaagagugugcauguaccugug

SEQ ID NO: 97902 - RNA, 22 nt, Human
aaagagcugccaagguuacagu

SEQ ID NO: 97903 - RNA, 22 nt, Human
aaagacagccuguuggcuuucu

SEQ ID NO: 97904 - RNA, 22 nt, Human
aaagaauuucaagauucccaca

SEQ ID NO: 97905 - RNA, 22 nt, Human
aaagagacaacaacaacuucua

SEQ ID NO: 97906 - RNA, 22 nt, Human
aaagagccaacuaccgcaaauu

SEQ ID NO: 97907 - RNA, 22 nt, Human
aaagcaaauaguugcuuaauau

SEQ ID NO: 97908 - RNA, 22 nt, Human
aaagcaaagaucuguagcccaa

SEQ ID NO: 97909 - RNA, 22 nt, Human
aaauauauccuucuguccugcc

SEQ ID NO: 97910 - RNA, 22 nt, Human
aaauauauauaauauauauauu

SEQ ID NO: 97911 - RNA, 22 nt, Human
aaaugcucgccagguuuuauua

SEQ ID NO: 97912 - RNA, 22 nt, Human
aaaucuuucacauauuuuuuau

SEQ ID NO: 97913 - RNA, 22 nt, Human
aaaugcacaauaaaguaaaggc

SEQ ID NO: 97914 - RNA, 22 nt, Human
aaaucugaauuaaaaucugguu

SEQ ID NO: 97915 - RNA, 22 nt, Human
aaauauuagacauaccuggaga

SEQ ID NO: 97916 - RNA, 22 nt, Human
aaauaugguaucugccaaacua

SEQ ID NO: 97917 - RNA, 22 nt, Human
aaauauuaaugaugaagguagu

SEQ ID NO: 97918 - RNA, 22 nt, Human
aaaucauguuaaagagggaguu

SEQ ID NO: 97919 - RNA, 22 nt, Human
aaaucaagucagcugaauucca

SEQ ID NO: 97920 - RNA, 22 nt, Human
aaauguaaacuguauuuauaaa

SEQ ID NO: 97921 - RNA, 22 nt, Human
aaaugguguucuuuagaugaaa

SEQ ID NO: 97922 - RNA, 22 nt, Human
aaauuaggcccugauuuuaugu

SEQ ID NO: 97923 - RNA, 22 nt, Human
aaauauuugaaugguguaagau

SEQ ID NO: 97924 - RNA, 22 nt, Human
aaaucuuccugaaauuuguuca

SEQ ID NO: 97925 - RNA, 22 nt, Human
aaaucugaaggaaacagcuuca

SEQ ID NO: 97926 - RNA, 22 nt, Human
aaauuagucacaccagugucuu

SEQ ID NO: 97927 - RNA, 22 nt, Human
aaauguauuagccuaugugaga

SEQ ID NO: 97928 - RNA, 22 nt, Human
aaauugcauuuuaaagguagau

SEQ ID NO: 97929 - RNA, 22 nt, Human
aaauuuauaacuuaaagugaau

SEQ ID NO: 97930 - RNA, 20 nt, Human
aacagcucucgacuuaucuu

SEQ ID NO: 97931 - RNA, 22 nt, Human
aacagaauaucaaaagauuaug

SEQ ID NO: 97932 - RNA, 21 nt, Human
aacaaaagggaagaacagcug

SEQ ID NO: 97933 - RNA, 22 nt, Human
aacaaaacauuuuacgaauaua

SEQ ID NO: 97934 - RNA, 22 nt, Human
aacacaucagcacacuaacgga

SEQ ID NO: 97935 - RNA, 22 nt, Human
aacaaagaacuuucuuccuuug

SEQ ID NO: 97936 - RNA, 22 nt, Human
aacaaagaaaagcuugagguuu

SEQ ID NO: 97937 - RNA, 19 nt, Human
aacaaaauaguucuaguua

SEQ ID NO: 97938 - RNA, 22 nt, Human
aacaggaagaauccagauggug

SEQ ID NO: 97939 - RNA, 22 nt, Human
aacagggcgugaauaaugaaga

SEQ ID NO: 97940 - RNA, 22 nt, Human
aaauauugaauuugaggaugua

SEQ ID NO: 97941 - RNA, 22 nt, Human
aaaguguuaacacuggcuacuu

SEQ ID NO: 97942 - RNA, 22 nt, Human
aaauauagugacacuuauaguc

SEQ ID NO: 97943 - RNA, 22 nt, Human
aaaguguuuaacaaauugcuuu

SEQ ID NO: 97944 - RNA, 22 nt, Human
aaaucccacucacgaguuuugc

SEQ ID NO: 97945 - RNA, 22 nt, Human
aaaucgcuugaacccaggaagu

SEQ ID NO: 97946 - RNA, 21 nt, Human
aaauccagugaucuccucuaa

SEQ ID NO: 97947 - RNA, 22 nt, Human
aaauccaucaaaucuucuagaa

SEQ ID NO: 97948 - RNA, 22 nt, Human
aaaucaaaagugguuauuuuau

SEQ ID NO: 97949 - RNA, 22 nt, Human
aaauagauuugacuacuuggug

SEQ ID NO: 97950 - RNA, 22 nt, Human
aaauagucagaaaucaacgugc

SEQ ID NO: 97951 - RNA, 22 nt, Human
aaaguagaauaauaaacccuug

SEQ ID NO: 97952 - RNA, 22 nt, Human
aaaguuacccaaucucuaugaa

SEQ ID NO: 97953 - RNA, 22 nt, Human
aaaguugcauccuaugaccuca

SEQ ID NO: 97954 - RNA, 22 nt, Human
aaaguuguccuuugugccuuua

SEQ ID NO: 97955 - RNA, 22 nt, Human
aaaguuuguacugggaguuacu

SEQ ID NO: 97956 - RNA, 23 nt, Human
aaauaauaauuucucuguuggga

SEQ ID NO: 97957 - RNA, 22 nt, Human
aaaggucagaugugucgaggag

SEQ ID NO: 97958 - RNA, 22 nt, Human
aaagggaugauuucugaagaua

SEQ ID NO: 97959 - RNA, 23 nt, Human
aaaguacuuaaucugcaaaccac

SEQ ID NO: 97960 - RNA, 22 nt, Human
aaaguuacacgacuauuuaugu

SEQ ID NO: 97961 - RNA, 22 nt, Human
aaaguaaagccuauuuaauaau

SEQ ID NO: 97962 - RNA, 22 nt, Human
aaagucugaaaaaguuuguggg

SEQ ID NO: 97963 - RNA, 22 nt, Human
aaaguguaagucccugguuguc

SEQ ID NO: 97964 - RNA, 21 nt, Human
aaagugguaaggauuauuuug

SEQ ID NO: 97965 - RNA, 22 nt, Human
aaagccuacagucaugguuaga

SEQ ID NO: 97966 - RNA, 22 nt, Human
aaagcuccaaauggguggaagu

SEQ ID NO: 97967 - RNA, 22 nt, Human
aaagggagauaaaguaauuuua

SEQ ID NO: 97968 - RNA, 22 nt, Human
aaaggcaugugcaacuacaaau

SEQ ID NO: 97969 - RNA, 22 nt, Human
aaaggagugaaaugagaggaaa

SEQ ID NO: 97970 - RNA, 22 nt, Human
aaaggaaacuaugaaucucugg

SEQ ID NO: 97971 - RNA, 22 nt, Human
aagcaaagucaucuagaguagu

SEQ ID NO: 97972 - RNA, 22 nt, Human
aagcaaaaucgcaucuggggcc

SEQ ID NO: 97973 - RNA, 22 nt, Human
aagagugugagguugugcuuuu

SEQ ID NO: 97974 - RNA, 22 nt, Human
aagaguggagcuggaaaguggg

SEQ ID NO: 97975 - RNA, 22 nt, Human
aagagggguggucugugaggau

SEQ ID NO: 97976 - RNA, 22 nt, Human
aagaugaguuacaaaggaguaa

SEQ ID NO: 97977 - RNA, 22 nt, Human
aagaugcuucaugagaguuggg

SEQ ID NO: 97978 - RNA, 22 nt, Human
aagaggcagcuugguaggcauc

SEQ ID NO: 97979 - RNA, 22 nt, Human
aagauauauaaggaaguucagu

SEQ ID NO: 97980 - RNA, 22 nt, Human
aagaucugaccgugauggcggc

SEQ ID NO: 97981 - RNA, 22 nt, Human
aagaguuaggagugggcuuuga

SEQ ID NO: 97982 - RNA, 22 nt, Human
aagacagugacagucacaauug

SEQ ID NO: 97983 - RNA, 22 nt, Human
aagauauauaacccuuucacuu

SEQ ID NO: 97984 - RNA, 22 nt, Human
aagcagcauaugacagcaucca

SEQ ID NO: 97985 - RNA, 22 nt, Human
aagcagacugggccauaaggaa

SEQ ID NO: 97986 - RNA, 21 nt, Human
aagcagcugcagaauuucagu

SEQ ID NO: 97987 - RNA, 22 nt, Human
aagcaacccagugcuuguauag

SEQ ID NO: 97988 - RNA, 22 nt, Human
aagaugcaagcauuuugaacug

SEQ ID NO: 97989 - RNA, 22 nt, Human
aagcagaacuguuuuguuuucu

SEQ ID NO: 97990 - RNA, 23 nt, Human
aagcaacagacuucaucagauau

SEQ ID NO: 97991 - RNA, 22 nt, Human
aagauagaaugauguuggcuca

SEQ ID NO: 97992 - RNA, 22 nt, Human
aagaugaucagagggcaagagg

SEQ ID NO: 97993 - RNA, 22 nt, Human
aagacagaaaagcagagagagg

SEQ ID NO: 97994 - RNA, 22 nt, Human
aagaaugaaaugaaagaacuaa

SEQ ID NO: 97995 - RNA, 22 nt, Human
aagaaguccuugaggcgcaccc

SEQ ID NO: 97996 - RNA, 22 nt, Human
aagaaggcggaccagaagggag

SEQ ID NO: 97997 - RNA, 22 nt, Human
aagacccuaccccuggagagga

SEQ ID NO: 97998 - RNA, 22 nt, Human
aagagaaaaaucuuaaucuagu

SEQ ID NO: 97999 - RNA, 22 nt, Human
aagagaaagggaaaaugguaaa

SEQ ID NO: 98000 - RNA, 22 nt, Human
aagagaaacauauggccagauu

SEQ ID NO: 98001 - RNA, 22 nt, Human
aagaagcuacugucacuaucag

SEQ ID NO: 98002 - RNA, 22 nt, Human
aagaaggaaggcaagagauggg

SEQ ID NO: 98003 - RNA, 22 nt, Human
aagaagagaauauauuuacguc

SEQ ID NO: 98004 - RNA, 22 nt, Human
aagaaauagauagaggaauacu

SEQ ID NO: 98005 - RNA, 22 nt, Human
aagaaaggcacaagaaagaaaa

SEQ ID NO: 98006 - RNA, 22 nt, Human
aagaaaagcaucuuuguaguag

SEQ ID NO: 98007 - RNA, 22 nt, Human
aaggcgaggggcacagcugaga

SEQ ID NO: 98008 - RNA, 22 nt, Human
aaggcagagggaaaacgggaau

SEQ ID NO: 98009 - RNA, 22 nt, Human
aaggauguuuaaacuacuuucc

SEQ ID NO: 98010 - RNA, 22 nt, Human
aaggaucuuucuuuuuaccauu

SEQ ID NO: 98011 - RNA, 20 nt, Human
aaggaggcuuaaaguuagaa

SEQ ID NO: 98012 - RNA, 22 nt, Human
aaggaggaugaauugucugcaa

SEQ ID NO: 98013 - RNA, 22 nt, Human
aagcuguuagggagugguaggu

SEQ ID NO: 98014 - RNA, 22 nt, Human
aagcugccugggaggaagggcu

SEQ ID NO: 98015 - RNA, 22 nt, Human
aagcugaguaggaaugguaggu

SEQ ID NO: 98016 - RNA, 22 nt, Human
aagccuuagauuggcgaugucg

SEQ ID NO: 98017 - RNA, 22 nt, Human
aagcgcggccgccgcggucgcu

SEQ ID NO: 98018 - RNA, 22 nt, Human
aagcucagcugguggugauugc

SEQ ID NO: 98019 - RNA, 22 nt, Human
aagcugcagacccccugucuca

SEQ ID NO: 98020 - RNA, 22 nt, Human
aagccuguugacagcugucagu

SEQ ID NO: 98021 - RNA, 22 nt, Human
aagcccuuugaaaauguguguc

SEQ ID NO: 98022 - RNA, 22 nt, Human
aagccugguuauuugaggaugu

SEQ ID NO: 98023 - RNA, 22 nt, Human
aagcuuugaauauuagaccuug

SEQ ID NO: 98024 - RNA, 18 nt, Human
aagcugcauuauuuuggc

SEQ ID NO: 98025 - RNA, 20 nt, Human
aagcuguguucaagauggga

SEQ ID NO: 98026 - RNA, 22 nt, Human
aaggaaaaccugacugaagaac

SEQ ID NO: 98027 - RNA, 22 nt, Human
aagcucuauaggagauacagua

SEQ ID NO: 98028 - RNA, 22 nt, Human
aagcacuaauauuuuggcaccu

SEQ ID NO: 98029 - RNA, 22 nt, Human
aagcgggcagcggccugcgcca

SEQ ID NO: 98030 - RNA, 22 nt, Human
aagcuagguccuccugaacugc

SEQ ID NO: 98031 - RNA, 22 nt, Human
aagccagccaguuccagcagcu

SEQ ID NO: 98032 - RNA, 22 nt, Human
aagccucaugccagauccaggu

SEQ ID NO: 98033 - RNA, 22 nt, Human
aagcagugacucucagaggcag

SEQ ID NO: 98034 - RNA, 22 nt, Human
aagcaauucacaguucacuuaa

SEQ ID NO: 98035 - RNA, 22 nt, Human
aagcacagggacucaggaccgg

SEQ ID NO: 98036 - RNA, 22 nt, Human
aaucacuuagaacccaggaagu

SEQ ID NO: 98037 - RNA, 22 nt, Human
aaucacuggcuccucacggcaa

SEQ ID NO: 98038 - RNA, 22 nt, Human
aaucaauuauccauuuguuagu

SEQ ID NO: 98039 - RNA, 22 nt, Human
aauauuuugggacugaggaauu

SEQ ID NO: 98040 - RNA, 22 nt, Human
aauagaguccuguacugaauga

SEQ ID NO: 98041 - RNA, 22 nt, Human
aauagcaauuacccuucaacuc

SEQ ID NO: 98042 - RNA, 22 nt, Human
aauauuuaaauagaauuacauc

SEQ ID NO: 98043 - RNA, 22 nt, Human
aauaugucacacuccuuaauag

SEQ ID NO: 98044 - RNA, 22 nt, Human
aauaugccaaauccugucacau

SEQ ID NO: 98045 - RNA, 22 nt, Human
aaguuuaagguagugaugauga

SEQ ID NO: 98046 - RNA, 23 nt, Human
aaguugucauguaaaaugggcua

SEQ ID NO: 98047 - RNA, 22 nt, Human
aaguuccacuagugacccagaa

SEQ ID NO: 98048 - RNA, 22 nt, Human
aaguuaugauuggcguggacaa

SEQ ID NO: 98049 - RNA, 22 nt, Human
aagugauuuuccuacuugcuaa

SEQ ID NO: 98050 - RNA, 23 nt, Human
aagugcucaguggacagcauugc

SEQ ID NO: 98051 - RNA, 22 nt, Human
aagugcuggccuacucaaucga

SEQ ID NO: 98052 - RNA, 20 nt, Human
aagugcuguuagcugccuga

SEQ ID NO: 98053 - RNA, 22 nt, Human
aauaauacaugugaugagaauu

SEQ ID NO: 98054 - RNA, 22 nt, Human
aauaauacaauuggugucaugu

SEQ ID NO: 98055 - RNA, 22 nt, Human
aauaacuuaaugacuguguaca

SEQ ID NO: 98056 - RNA, 22 nt, Human
aauaacuuacucuaugcuuagu

SEQ ID NO: 98057 - RNA, 22 nt, Human
aauaagagaauaaaaucuguua

SEQ ID NO: 98058 - RNA, 21 nt, Human
aaguuuuggcuguacaguugu

SEQ ID NO: 98059 - RNA, 21 nt, Human
aaguuucucccuaauuguugc

SEQ ID NO: 98060 - RNA, 22 nt, Human
aauaaagcuugaaagcagggaa

SEQ ID NO: 98061 - RNA, 20 nt, Human
aauaaauauaacccauaauu

SEQ ID NO: 98062 - RNA, 22 nt, Human
aagucuguucuacagcaccaga

SEQ ID NO: 98063 - RNA, 22 nt, Human
aagugaaaaaagucaguacuga

SEQ ID NO: 98064 - RNA, 22 nt, Human
aagugaagccaauuuuuuuagg

SEQ ID NO: 98065 - RNA, 22 nt, Human
aagucuuugagaucggacauag

SEQ ID NO: 98066 - RNA, 22 nt, Human
aagugauuuagagagcucuuag

SEQ ID NO: 98067 - RNA, 22 nt, Human
aagugauuuucccaccaucuac

SEQ ID NO: 98068 - RNA, 22 nt, Human
aagugauauaaaucgagaggga

SEQ ID NO: 98069 - RNA, 22 nt, Human
aaguccgggcagcaggaauucu

SEQ ID NO: 98070 - RNA, 20 nt, Human
aagucuauuuagaguugcuu

SEQ ID NO: 98071 - RNA, 22 nt, Human
aagucauuaucucuucuaaucu

SEQ ID NO: 98072 - RNA, 22 nt, Human
aaguagaaaaccgcacuggacu

SEQ ID NO: 98073 - RNA, 22 nt, Human
aaguacugauucuguuccucaa

SEQ ID NO: 98074 - RNA, 22 nt, Human
aaggugcugaggguccuggcuu

SEQ ID NO: 98075 - RNA, 22 nt, Human
aagguggugaucaucuugaagg

SEQ ID NO: 98076 - RNA, 22 nt, Human
aagggagaguauccagaaacag

SEQ ID NO: 98077 - RNA, 22 nt, Human
aagguauaucuuuaaaagugaa

SEQ ID NO: 98078 - RNA, 22 nt, Human
aagggccacaugccauuuaaaa

SEQ ID NO: 98079 - RNA, 22 nt, Human
aaggggaggccugcgcuuucgg

SEQ ID NO: 98080 - RNA, 22 nt, Human
aagggggacaagcauuggcuua

SEQ ID NO: 98081 - RNA, 22 nt, Human
aagguccuguagccacagagcc

SEQ ID NO: 98082 - RNA, 22 nt, Human
aaggucuuggcucuggccgcac

SEQ ID NO: 98083 - RNA, 23 nt, Human
aaggugaagccaccaggugagga

SEQ ID NO: 98084 - RNA, 22 nt, Human
aaggggauuuaagguaagaaga

SEQ ID NO: 98085 - RNA, 22 nt, Human
aagguaaugcaucaggcaggga

SEQ ID NO: 98086 - RNA, 22 nt, Human
aaggcuguuugagcacuggagc

SEQ ID NO: 98087 - RNA, 22 nt, Human
aaggcugaccaguuuacacuuu

SEQ ID NO: 98088 - RNA, 19 nt, Human
aaggcuuucugagugaaaa

SEQ ID NO: 98089 - RNA, 22 nt, Human
aaggacaccaaacuaauuggga

SEQ ID NO: 98090 - RNA, 22 nt, Human
aaggcgguuccgguucgcggcg

SEQ ID NO: 98091 - RNA, 22 nt, Human
aaggacaaaacagcuguucuaa

SEQ ID NO: 98092 - RNA, 22 nt, Human
aaggagaggagucauugggaua

SEQ ID NO: 98093 - RNA, 22 nt, Human
aaggaacuucagggcgaaugga

SEQ ID NO: 98094 - RNA, 22 nt, Human
aaggaaaguuaagguaaacucu

SEQ ID NO: 98095 - RNA, 22 nt, Human
aaggaaaaaauggcuugugaua

SEQ ID NO: 98096 - RNA, 22 nt, Human
acaguguuacuugauaguguau

SEQ ID NO: 98097 - RNA, 22 nt, Human
acagucucucaagcauauccug

SEQ ID NO: 98098 - RNA, 22 nt, Human
acagugguggagggcuguccug

SEQ ID NO: 98099 - RNA, 22 nt, Human
acauaaauagcacugugaauuu

SEQ ID NO: 98100 - RNA, 22 nt, Human
acauaaacaugcagccugccaa

SEQ ID NO: 98101 - RNA, 22 nt, Human
acaggggauaggcaggaaggca

SEQ ID NO: 98102 - RNA, 21 nt, Human
acauccaggguccucacugcc

SEQ ID NO: 98103 - RNA, 22 nt, Human
acagguuucuccccugguuauu

SEQ ID NO: 98104 - RNA, 22 nt, Human
acagguauuaugaagccuauuu

SEQ ID NO: 98105 - RNA, 19 nt, Human
acaggaaggaaaauuucaa

SEQ ID NO: 98106 - RNA, 22 nt, Human
acaggccuggguucaaauuugg

SEQ ID NO: 98107 - RNA, 22 nt, Human
acaggauuuucagggaagguga

SEQ ID NO: 98108 - RNA, 22 nt, Human
acaggguauauaggcaaagcua

SEQ ID NO: 98109 - RNA, 22 nt, Human
acaggaaugaagaugagagagu

SEQ ID NO: 98110 - RNA, 22 nt, Human
acaggacgugugugcgcaugug

SEQ ID NO: 98111 - RNA, 22 nt, Human
acagucuuggauuccaggaguc

SEQ ID NO: 98112 - RNA, 21 nt, Human
acaguacuugagaucuuuuga

SEQ ID NO: 98113 - RNA, 22 nt, Human
acaggcgucgccugcucuugcc

SEQ ID NO: 98114 - RNA, 22 nt, Human
acagcucaggcccaucaacccc

SEQ ID NO: 98115 - RNA, 22 nt, Human
acagccacccuggaacgguugu

SEQ ID NO: 98116 - RNA, 22 nt, Human
acagagguuaggauggguugua

SEQ ID NO: 98117 - RNA, 22 nt, Human
acagcugagaugcuacuugugg

SEQ ID NO: 98118 - RNA, 22 nt, Human
acagcuggaggucugugagcac

SEQ ID NO: 98119 - RNA, 22 nt, Human
acaggacaaaaaucuggauggc

SEQ ID NO: 98120 - RNA, 22 nt, Human
acaggaaaugaaaugguaucua

SEQ ID NO: 98121 - RNA, 22 nt, Human
acagcugguugaaggggaccaa

SEQ ID NO: 98122 - RNA, 22 nt, Human
acagcauagaggaaauguggaa

SEQ ID NO: 98123 - RNA, 22 nt, Human
acagcuauuuaaaggcuuuagg

SEQ ID NO: 98124 - RNA, 19 nt, Human
acagccuguugguggggcu

SEQ ID NO: 98125 - RNA, 20 nt, Human
acagccguaaugguccuugg

SEQ ID NO: 98126 - RNA, 22 nt, Human
acagccaacgucuuucuuacuu

SEQ ID NO: 98127 - RNA, 22 nt, Human
acagcagguuauuguuauggca

SEQ ID NO: 98128 - RNA, 22 nt, Human
acagcaauccuggcagaggguu

SEQ ID NO: 98129 - RNA, 22 nt, Human
acagaugccagcuacaccaccg

SEQ ID NO: 98130 - RNA, 22 nt, Human
acagagcucccagccaucuccu

SEQ ID NO: 98131 - RNA, 23 nt, Human
acagaggcaucagagcagcaggc

SEQ ID NO: 98132 - RNA, 23 nt, Human
acagcaagaggaccagaugugag

SEQ ID NO: 98133 - RNA, 22 nt, Human
acagaucuauauuauauauaca

SEQ ID NO: 98134 - RNA, 22 nt, Human
acagagggagugacggccaacc

SEQ ID NO: 98135 - RNA, 20 nt, Human
acagagauccucucuuuauc

SEQ ID NO: 98136 - RNA, 22 nt, Human
acagacuuaguauccugcugcu

SEQ ID NO: 98137 - RNA, 22 nt, Human
acagacaucaucaacaucuucc

SEQ ID NO: 98138 - RNA, 22 nt, Human
acagaucugcacagugaacaau

SEQ ID NO: 98139 - RNA, 22 nt, Human
acacucaugcucagcuggugcu

SEQ ID NO: 98140 - RNA, 22 nt, Human
acacugguucucuuaacccuau

SEQ ID NO: 98141 - RNA, 22 nt, Human
acacuuacugcauuuuucuaua

SEQ ID NO: 98142 - RNA, 21 nt, Human
acagaaguggcuuggucucag

SEQ ID NO: 98143 - RNA, 14 nt, Human
acagaagucugcua

SEQ ID NO: 98144 - RNA, 22 nt, Human
acacucagaaaggcagagguuc

SEQ ID NO: 98145 - RNA, 22 nt, Human
acacgguggccagcaguaggug

SEQ ID NO: 98146 - RNA, 22 nt, Human
acacgugcaggagaauguagug

SEQ ID NO: 98147 - RNA, 22 nt, Human
acacagugaccuacauuccaaa

SEQ ID NO: 98148 - RNA, 22 nt, Human
acacccuugcagacgguuccuu

SEQ ID NO: 98149 - RNA, 22 nt, Human
acacgauguuuuaagccccuaa

SEQ ID NO: 98150 - RNA, 22 nt, Human
acacaggacacaaaagucacca

SEQ ID NO: 98151 - RNA, 22 nt, Human
acacgcacaccugugcacucgu

SEQ ID NO: 98152 - RNA, 22 nt, Human
acacccuuuagcaauucuucaa

SEQ ID NO: 98153 - RNA, 22 nt, Human
acaaugugcuuaugaaggcagu

SEQ ID NO: 98154 - RNA, 22 nt, Human
acacaacuuuauuaauuuauac

SEQ ID NO: 98155 - RNA, 22 nt, Human
acaaucuuauuaguaguauaga

SEQ ID NO: 98156 - RNA, 22 nt, Human
acaaucauuuuuccccuucagu

SEQ ID NO: 98157 - RNA, 22 nt, Human
acaaucagcacugaguuuaucu

SEQ ID NO: 98158 - RNA, 21 nt, Human
acacagcuggagcaucccggu

SEQ ID NO: 98159 - RNA, 20 nt, Human
acacagccuagaguuuggcu

SEQ ID NO: 98160 - RNA, 19 nt, Human
acacaccagugccugugac

SEQ ID NO: 98161 - RNA, 22 nt, Human
acaauaauguuuuuagguuauu

SEQ ID NO: 98162 - RNA, 22 nt, Human
acaagaaaggucugggaacaau

SEQ ID NO: 98163 - RNA, 22 nt, Human
acaaggaagaaaacauuacuuu

SEQ ID NO: 98164 - RNA, 22 nt, Human
acaacuuuaauggguuucagcu

SEQ ID NO: 98165 - RNA, 22 nt, Human
aauuguuagaaaugacuguuuu

SEQ ID NO: 98166 - RNA, 22 nt, Human
aauuuaaguuauugcuaaugug

SEQ ID NO: 98167 - RNA, 22 nt, Human
aauugguuugaauaaauaaaga

SEQ ID NO: 98168 - RNA, 22 nt, Human
aauuucaucugagacugggagc

SEQ ID NO: 98169 - RNA, 22 nt, Human
aauuuaauugguuuuuacuugu

SEQ ID NO: 98170 - RNA, 22 nt, Human
aauuucagaccaacgagucagg

SEQ ID NO: 98171 - RNA, 22 nt, Human
aauuuauccuuuugcuaaagca

SEQ ID NO: 98172 - RNA, 22 nt, Human
aauugcuuucacaaguguuaua

SEQ ID NO: 98173 - RNA, 21 nt, Human
aauugccuaauauaugggaag

SEQ ID NO: 98174 - RNA, 22 nt, Human
aauugcauucauuuguauauuu

SEQ ID NO: 98175 - RNA, 22 nt, Human
aauugaggaaccuuagggcaaa

SEQ ID NO: 98176 - RNA, 22 nt, Human
aauucugcagucguacuauaau

SEQ ID NO: 98177 - RNA, 22 nt, Human
aauuauucucucaacugagaug

SEQ ID NO: 98178 - RNA, 22 nt, Human
aauuauucaugucugggcagcc

SEQ ID NO: 98179 - RNA, 22 nt, Human
aauuauugucuuuuuuaaaagc

SEQ ID NO: 98180 - RNA, 22 nt, Human
acaacagaacuccugggauuuu

SEQ ID NO: 98181 - RNA, 20 nt, Human
acaaccacugcucacaguuu

SEQ ID NO: 98182 - RNA, 22 nt, Human
aauuggagaguugugaaaggau

SEQ ID NO: 98183 - RNA, 22 nt, Human
acaaccaugucaguucaaacca

SEQ ID NO: 98184 - RNA, 22 nt, Human
acaacccacacguuccgggugg

SEQ ID NO: 98185 - RNA, 22 nt, Human
acaaacugggauaggauccugu

SEQ ID NO: 98186 - RNA, 22 nt, Human
acaaaucccuguaaacacagcu

SEQ ID NO: 98187 - RNA, 22 nt, Human
acaaauuuaaauguugucuguu

SEQ ID NO: 98188 - RNA, 22 nt, Human
acaaagugaaaagcaucgaauu

SEQ ID NO: 98189 - RNA, 21 nt, Human
acaaaaccuaacuuggcugcu

SEQ ID NO: 98190 - RNA, 22 nt, Human
aauuugcuccaaugucaguucu

SEQ ID NO: 98191 - RNA, 22 nt, Human
aauuucuuucagcugcuuuaag

SEQ ID NO: 98192 - RNA, 22 nt, Human
aauuucuuuagagguacugauc

SEQ ID NO: 98193 - RNA, 22 nt, Human
aauuucuccuuuucaguuagau

SEQ ID NO: 98194 - RNA, 18 nt, Human
acaaaaauagugcuuugg

SEQ ID NO: 98195 - RNA, 22 nt, Human
acaaaaauauuguagaagugcu

SEQ ID NO: 98196 - RNA, 22 nt, Human
aauuuuauuagacaggcauaau

SEQ ID NO: 98197 - RNA, 22 nt, Human
aauuuuagcuaaagauccaugg

SEQ ID NO: 98198 - RNA, 22 nt, Human
aauggcuagcauguaaaauauc

SEQ ID NO: 98199 - RNA, 22 nt, Human
aauggcagauaauuuuccagau

SEQ ID NO: 98200 - RNA, 22 nt, Human
aaugugcauaacuuuauaaauu

SEQ ID NO: 98201 - RNA, 22 nt, Human
aaugugguauuuuggcauucuu

SEQ ID NO: 98202 - RNA, 22 nt, Human
aauguggaguugguuuccuucc

SEQ ID NO: 98203 - RNA, 22 nt, Human
aauguuaguauuuaagagcuug

SEQ ID NO: 98204 - RNA, 22 nt, Human
aauguucauauggguagcagau

SEQ ID NO: 98205 - RNA, 23 nt, Human
aaugugaaauugaguuuuuguua

SEQ ID NO: 98206 - RNA, 22 nt, Human
aaugugcugguaacugcuuugc

SEQ ID NO: 98207 - RNA, 22 nt, Human
aauuauuaucauuaucuuccug

SEQ ID NO: 98208 - RNA, 22 nt, Human
aauuauuauguggaagacgacg

SEQ ID NO: 98209 - RNA, 22 nt, Human
aauuaaggccuuuaaaugucuu

SEQ ID NO: 98210 - RNA, 22 nt, Human
aauuaacuggguucucagaugc

SEQ ID NO: 98211 - RNA, 22 nt, Human
aauuaaauguuugguuugagcu

SEQ ID NO: 98212 - RNA, 22 nt, Human
aauguuugaacuuugcauauuu

SEQ ID NO: 98213 - RNA, 22 nt, Human
aaugugugggagaacagucuuu

SEQ ID NO: 98214 - RNA, 22 nt, Human
aauggaugauuaaauggaugaa

SEQ ID NO: 98215 - RNA, 23 nt, Human
aaugggcggaaguguuaaguugc

SEQ ID NO: 98216 - RNA, 22 nt, Human
aauggcaauagugcauuaugua

SEQ ID NO: 98217 - RNA, 22 nt, Human
aauggaaaaagaacuguuuaaa

SEQ ID NO: 98218 - RNA, 22 nt, Human
aauggagugguucuugcccucu

SEQ ID NO: 98219 - RNA, 22 nt, Human
aaugcugugggauagggcuccu

SEQ ID NO: 98220 - RNA, 22 nt, Human
aauggaaaggagccugacuaua

SEQ ID NO: 98221 - RNA, 22 nt, Human
aaucauaacaaaagcaauuaua

SEQ ID NO: 98222 - RNA, 22 nt, Human
aaucaagcugcuguuuguucua

SEQ ID NO: 98223 - RNA, 22 nt, Human
aaucccaguugacagaacuguu

SEQ ID NO: 98224 - RNA, 22 nt, Human
aaucgacuguagagacuuggcg

SEQ ID NO: 98225 - RNA, 22 nt, Human
aaucgguugaacccaggaagug

SEQ ID NO: 98226 - RNA, 22 nt, Human
aaucuacaaugaaaaaauguuu

SEQ ID NO: 98227 - RNA, 22 nt, Human
aaugcugaaugcauguuuccau

SEQ ID NO: 98228 - RNA, 22 nt, Human
aaugcugugauuuauuaaguau

SEQ ID NO: 98229 - RNA, 22 nt, Human
aaugcuuuuugcgaaaugugca

SEQ ID NO: 98230 - RNA, 23 nt, Human
acuggauuguucuugggcgcuga

SEQ ID NO: 98231 - RNA, 22 nt, Human
acuggcauuccuaggggagggg

SEQ ID NO: 98232 - RNA, 22 nt, Human
acuucaggagcagucucuggaa

SEQ ID NO: 98233 - RNA, 22 nt, Human
acuggcgucugucuccccugcc

SEQ ID NO: 98234 - RNA, 22 nt, Human
acuucauuugaaaugguugaau

SEQ ID NO: 98235 - RNA, 22 nt, Human
acuucugcccuggcgagggcgu

SEQ ID NO: 98236 - RNA, 22 nt, Human
acuugagcuugaaagguaugcu

SEQ ID NO: 98237 - RNA, 22 nt, Human
acuguucacccagcacuagcag

SEQ ID NO: 98238 - RNA, 22 nt, Human
acuguugcuuguuuggaauguu

SEQ ID NO: 98239 - RNA, 22 nt, Human
acuuaagcagaucuguggucca

SEQ ID NO: 98240 - RNA, 17 nt, Human
acuuaagacaguggaaa

SEQ ID NO: 98241 - RNA, 22 nt, Human
acuuagacaucuuuagugguua

SEQ ID NO: 98242 - RNA, 22 nt, Human
acuuggcuaggguuuuuaucuu

SEQ ID NO: 98243 - RNA, 19 nt, Human
acuugcuuucauuuaagau

SEQ ID NO: 98244 - RNA, 22 nt, Human
acuuugccagcucccugcuggc

SEQ ID NO: 98245 - RNA, 23 nt, Human
acuuugaggagaagaaugucagu

SEQ ID NO: 98246 - RNA, 22 nt, Human
acuucagugugguauaaaacgu

SEQ ID NO: 98247 - RNA, 22 nt, Human
acuuuaaauaucauuugguagg

SEQ ID NO: 98248 - RNA, 22 nt, Human
acuuguuuacaagcaguucuga

SEQ ID NO: 98249 - RNA, 22 nt, Human
acuuugccuucuuacuguguug

SEQ ID NO: 98250 - RNA, 22 nt, Human
acuugaugcauauggaagagca

SEQ ID NO: 98251 - RNA, 22 nt, Human
agaaaaggaagcuuagacugua

SEQ ID NO: 98252 - RNA, 22 nt, Human
agaaaagaggcuuucuaagcau

SEQ ID NO: 98253 - RNA, 22 nt, Human
agaaauggccagacuugccccu

SEQ ID NO: 98254 - RNA, 22 nt, Human
agaaacaagcccuagaaguccu

SEQ ID NO: 98255 - RNA, 22 nt, Human
agaccauuuuguagccagcaua

SEQ ID NO: 98256 - RNA, 22 nt, Human
agacaaucaacuguugaugccu

SEQ ID NO: 98257 - RNA, 22 nt, Human
agaauuuguaucuacggugugc

SEQ ID NO: 98258 - RNA, 22 nt, Human
agacccugauucugcuggcggu

SEQ ID NO: 98259 - RNA, 22 nt, Human
agacaauuccauccuacguggg

SEQ ID NO: 98260 - RNA, 22 nt, Human
agaccccuggggaggauuauag

SEQ ID NO: 98261 - RNA, 22 nt, Human
agacaagagcugaggacauauu

SEQ ID NO: 98262 - RNA, 22 nt, Human
agacaaggggauuuuugauggu

SEQ ID NO: 98263 - RNA, 22 nt, Human
agaauauaguaaauauuuucua

SEQ ID NO: 98264 - RNA, 22 nt, Human
agaaguuuguuauguaaacaaa

SEQ ID NO: 98265 - RNA, 22 nt, Human
agaauacuaauaagggauuugc

SEQ ID NO: 98266 - RNA, 21 nt, Human
agaaguuauuccauggguguu

SEQ ID NO: 98267 - RNA, 19 nt, Human
agaauuggaaccaugaacc

SEQ ID NO: 98268 - RNA, 22 nt, Human
agaagguagaugcaucaggagg

SEQ ID NO: 98269 - RNA, 22 nt, Human
agaagguggaguagaacaagcu

SEQ ID NO: 98270 - RNA, 22 nt, Human
agaaucaggaagacagccuggc

SEQ ID NO: 98271 - RNA, 22 nt, Human
agaaucugcauuuuaacaagau

SEQ ID NO: 98272 - RNA, 20 nt, Human
agaaggagagaugaggcaaa

SEQ ID NO: 98273 - RNA, 22 nt, Human
agaagggaagcaggagaggcau

SEQ ID NO: 98274 - RNA, 16 nt, Human
agaaggcuaguaacag

SEQ ID NO: 98275 - RNA, 22 nt, Human
agaaggcaucugcucgcuucca

SEQ ID NO: 98276 - RNA, 22 nt, Human
agaagcaauuggaaaguacagg

SEQ ID NO: 98277 - RNA, 22 nt, Human
agaauaagucuaauauauuggu

SEQ ID NO: 98278 - RNA, 22 nt, Human
agaaguguacuuagagaacaua

SEQ ID NO: 98279 - RNA, 22 nt, Human
agaauacaauuguucaguaaua

SEQ ID NO: 98280 - RNA, 22 nt, Human
agaagaagacccuaaggaaagg

SEQ ID NO: 98281 - RNA, 22 nt, Human
agaaccauccugguuccagcuu

SEQ ID NO: 98282 - RNA, 22 nt, Human
agaaaauagguaguagacgggc

SEQ ID NO: 98283 - RNA, 22 nt, Human
agaacauaucuguuuucuaacu

SEQ ID NO: 98284 - RNA, 22 nt, Human
agaagggcugcuuagaauauac

SEQ ID NO: 98285 - RNA, 22 nt, Human
acugcauuucauaaauuacaau

SEQ ID NO: 98286 - RNA, 22 nt, Human
acugccauauuaggagcuucag

SEQ ID NO: 98287 - RNA, 22 nt, Human
acugcauuaucaccaagaugua

SEQ ID NO: 98288 - RNA, 22 nt, Human
acugcugauuauugaaguagag

SEQ ID NO: 98289 - RNA, 22 nt, Human
acugauuuuauauauuaccccg

SEQ ID NO: 98290 - RNA, 22 nt, Human
acugcaggucccaucaccugcg

SEQ ID NO: 98291 - RNA, 22 nt, Human
acugcagauccucugagaaacc

SEQ ID NO: 98292 - RNA, 22 nt, Human
acugaugacaaugugaguguuc

SEQ ID NO: 98293 - RNA, 22 nt, Human
acugauuccaagcuuguggagg

SEQ ID NO: 98294 - RNA, 22 nt, Human
acugaaggcuggaccaugcauc

SEQ ID NO: 98295 - RNA, 22 nt, Human
acucuugacuaaugcuaauguc

SEQ ID NO: 98296 - RNA, 22 nt, Human
acugaauguucucaaaggggag

SEQ ID NO: 98297 - RNA, 22 nt, Human
acugaaauuuauauuuugggca

SEQ ID NO: 98298 - RNA, 22 nt, Human
acucuguaauucugaagcaccu

SEQ ID NO: 98299 - RNA, 22 nt, Human
acucuuauuuugaaguaauaau

SEQ ID NO: 98300 - RNA, 22 nt, Human
acugacuacauguccugucauu

SEQ ID NO: 98301 - RNA, 22 nt, Human
acugaacuaaagaaaugggcaa

SEQ ID NO: 98302 - RNA, 22 nt, Human
acugaaaguugaugagucacug

SEQ ID NO: 98303 - RNA, 22 nt, Human
acugaaauggggacaguccuua

SEQ ID NO: 98304 - RNA, 22 nt, Human
acucugaggauuucaguuuuac

SEQ ID NO: 98305 - RNA, 22 nt, Human
acucugcaguaaggaauuguuu

SEQ ID NO: 98306 - RNA, 22 nt, Human
acucugaaaggcuacaaaugcu

SEQ ID NO: 98307 - RNA, 18 nt, Human
acucugaagcuaagucac

SEQ ID NO: 98308 - RNA, 22 nt, Human
acucucugcugcugagcuuggg

SEQ ID NO: 98309 - RNA, 22 nt, Human
acucgggggccgcugcagggag

SEQ ID NO: 98310 - RNA, 23 nt, Human
acucucuguuuggaggcacuggu

SEQ ID NO: 98311 - RNA, 22 nt, Human
acucugagaugugucuugauuc

SEQ ID NO: 98312 - RNA, 21 nt, Human
acuccagccacugacugucuc

SEQ ID NO: 98313 - RNA, 22 nt, Human
acucaucauuuuacggagcagc

SEQ ID NO: 98314 - RNA, 22 nt, Human
acuccuuuuaugugugcuaaaa

SEQ ID NO: 98315 - RNA, 22 nt, Human
acucauuuggauuuuggaguuu

SEQ ID NO: 98316 - RNA, 22 nt, Human
acucggaggccaaggccaacgg

SEQ ID NO: 98317 - RNA, 22 nt, Human
acucggcggccucgagugcugg

SEQ ID NO: 98318 - RNA, 22 nt, Human
acucaguuuugaucguucuuau

SEQ ID NO: 98319 - RNA, 22 nt, Human
acucagucauuuggggaacagu

SEQ ID NO: 98320 - RNA, 22 nt, Human
acuauugcuuuagggggaaacc

SEQ ID NO: 98321 - RNA, 22 nt, Human
acucacuguuuugaaauugaac

SEQ ID NO: 98322 - RNA, 22 nt, Human
acguugaaaugggcauuuuccg

SEQ ID NO: 98323 - RNA, 22 nt, Human
acguuauagaugcuucaugaaa

SEQ ID NO: 98324 - RNA, 22 nt, Human
acgugcauuacucaaaucucaa

SEQ ID NO: 98325 - RNA, 22 nt, Human
acgugaccuuauuugaaaaaug

SEQ ID NO: 98326 - RNA, 22 nt, Human
acgguuuggggaggaggauccc

SEQ ID NO: 98327 - RNA, 22 nt, Human
acguccgcugauucuuuggaag

SEQ ID NO: 98328 - RNA, 22 nt, Human
acguccaccccguaccagauca

SEQ ID NO: 98329 - RNA, 22 nt, Human
acguaaacagcaaagacaugau

SEQ ID NO: 98330 - RNA, 22 nt, Human
acgucaucguugucaucgucau

SEQ ID NO: 98331 - RNA, 22 nt, Human
acuaauuuacagaaauuucuua

SEQ ID NO: 98332 - RNA, 22 nt, Human
acuacccugaccaaguauuuua

SEQ ID NO: 98333 - RNA, 22 nt, Human
acuauacaguauguacgugcac

SEQ ID NO: 98334 - RNA, 22 nt, Human
acucagcaccuagaaagugugc

SEQ ID NO: 98335 - RNA, 22 nt, Human
acucaguaacuguuugcugaau

SEQ ID NO: 98336 - RNA, 22 nt, Human
acuauggaguucagaucuugag

SEQ ID NO: 98337 - RNA, 22 nt, Human
acuaucaacagcaucagggugu

SEQ ID NO: 98338 - RNA, 22 nt, Human
acuauuguccgauuucuuuacu

SEQ ID NO: 98339 - RNA, 22 nt, Human
acucaaccaucugcauuuuuga

SEQ ID NO: 98340 - RNA, 22 nt, Human
acgcacuuuaugcuuuuaacaa

SEQ ID NO: 98341 - RNA, 20 nt, Human
acgccgcgaggugagcuggu

SEQ ID NO: 98342 - RNA, 22 nt, Human
acgccugccuguacuugugggg

SEQ ID NO: 98343 - RNA, 22 nt, Human
acgccggguaaggucauucugc

SEQ ID NO: 98344 - RNA, 22 nt, Human
acgcugagcucauggagaugca

SEQ ID NO: 98345 - RNA, 22 nt, Human
acgggugcuuguucccgcugcu

SEQ ID NO: 98346 - RNA, 22 nt, Human
acggcuugaacgcgccuguggg

SEQ ID NO: 98347 - RNA, 22 nt, Human
acggcggguuccgggccagccc

SEQ ID NO: 98348 - RNA, 22 nt, Human
acgggaggcguggucuuguagu

SEQ ID NO: 98349 - RNA, 22 nt, Human
acggggagcgucggccucuccc

SEQ ID NO: 98350 - RNA, 22 nt, Human
acgccuugagccuugccugaau

SEQ ID NO: 98351 - RNA, 22 nt, Human
acgcgcuccagcaggugcuuca

SEQ ID NO: 98352 - RNA, 22 nt, Human
acgcauguacuuguaugcaaug

SEQ ID NO: 98353 - RNA, 22 nt, Human
acaugacagugacuuuauaaga

SEQ ID NO: 98354 - RNA, 22 nt, Human
acgccaggagcuucuccguuca

SEQ ID NO: 98355 - RNA, 21 nt, Human
acaguaugaucaaaugugcca

SEQ ID NO: 98356 - RNA, 22 nt, Human
acaucucacuucuuugaaggcu

SEQ ID NO: 98357 - RNA, 22 nt, Human
acauccaguaucagaagcauca

SEQ ID NO: 98358 - RNA, 23 nt, Human
agauaaggaagcauuugagccag

SEQ ID NO: 98359 - RNA, 22 nt, Human
agauaagaacauuaguaagccg

SEQ ID NO: 98360 - RNA, 22 nt, Human
agauauuauuuucuauuuauca

SEQ ID NO: 98361 - RNA, 21 nt, Human
agaguuuucuccauuucaggc

SEQ ID NO: 98362 - RNA, 22 nt, Human
agauaaacaacucuuagcuguu

SEQ ID NO: 98363 - RNA, 22 nt, Human
agauacaaaagauaagauuuag

SEQ ID NO: 98364 - RNA, 22 nt, Human
agaugaacuuuuuuaaacugga

SEQ ID NO: 98365 - RNA, 17 nt, Human
agaucugaaggagaaca

SEQ ID NO: 98366 - RNA, 19 nt, Human
agaucaggauguauuuuug

SEQ ID NO: 98367 - RNA, 22 nt, Human
agauauucugccuaacagguuu

SEQ ID NO: 98368 - RNA, 22 nt, Human
agaguguagugaaaagagauua

SEQ ID NO: 98369 - RNA, 22 nt, Human
agaguaauguggaguuugugcu

SEQ ID NO: 98370 - RNA, 22 nt, Human
agaguggcaccuuaccugagac

SEQ ID NO: 98371 - RNA, 22 nt, Human
agauaaaucauuuauuaagcgg

SEQ ID NO: 98372 - RNA, 22 nt, Human
agauauguuaggcuuguucccu

SEQ ID NO: 98373 - RNA, 21 nt, Human
agaguugaaggcaguaaagag

SEQ ID NO: 98374 - RNA, 22 nt, Human
agagggagcuccaagaucaagg

SEQ ID NO: 98375 - RNA, 22 nt, Human
agagggagccugcacagcuuuc

SEQ ID NO: 98376 - RNA, 22 nt, Human
agaggggaaggaugugauguga

SEQ ID NO: 98377 - RNA, 22 nt, Human
agaggcaggcagcagagaagau

SEQ ID NO: 98378 - RNA, 22 nt, Human
agagcacaggguuuugugccgg

SEQ ID NO: 98379 - RNA, 22 nt, Human
agagccaugcuugugcauauau

SEQ ID NO: 98380 - RNA, 22 nt, Human
agagccggagucuucuuguuug

SEQ ID NO: 98381 - RNA, 22 nt, Human
agagccauuuaaauaguuguca

SEQ ID NO: 98382 - RNA, 22 nt, Human
agagcccagaucccacccugga

SEQ ID NO: 98383 - RNA, 22 nt, Human
agacgggacagacuuuugagug

SEQ ID NO: 98384 - RNA, 22 nt, Human
agacgacucuuaaggcagaauu

SEQ ID NO: 98385 - RNA, 22 nt, Human
agacgcgcagaaggaagcggcc

SEQ ID NO: 98386 - RNA, 22 nt, Human
agaccguguguggguugcggug

SEQ ID NO: 98387 - RNA, 22 nt, Human
agagauuuacaacuugggcuuu

SEQ ID NO: 98388 - RNA, 22 nt, Human
agacagaaaaguugucaaucau

SEQ ID NO: 98389 - RNA, 22 nt, Human
agacucacuucuuucucguauu

SEQ ID NO: 98390 - RNA, 19 nt, Human
agagauuuucuguuuuagu

SEQ ID NO: 98391 - RNA, 22 nt, Human
agacacugacaggguccaugga

SEQ ID NO: 98392 - RNA, 22 nt, Human
agagcagauggagcuggaagag

SEQ ID NO: 98393 - RNA, 22 nt, Human
agagcagaggcauggccguggg

SEQ ID NO: 98394 - RNA, 22 nt, Human
agcaaagguagcagcucccagg

SEQ ID NO: 98395 - RNA, 22 nt, Human
agcaaaacuaaagacacagaca

SEQ ID NO: 98396 - RNA, 21 nt, Human
agauguucaguguccuaaccc

SEQ ID NO: 98397 - RNA, 22 nt, Human
agauguugucucuuacguuuga

SEQ ID NO: 98398 - RNA, 22 nt, Human
agauuaagcauuauaauuauaa

SEQ ID NO: 98399 - RNA, 22 nt, Human
agauuauuuaagacaggaacca

SEQ ID NO: 98400 - RNA, 22 nt, Human
agauucgucuuuaauucaccau

SEQ ID NO: 98401 - RNA, 22 nt, Human
agauugaacgagcuggcaugga

SEQ ID NO: 98402 - RNA, 22 nt, Human
agauugaugugaccauuggaag

SEQ ID NO: 98403 - RNA, 22 nt, Human
agauggcugggagcucuguuug

SEQ ID NO: 98404 - RNA, 22 nt, Human
agauggcuccaguguccagagg

SEQ ID NO: 98405 - RNA, 22 nt, Human
agauuuucuuuuccaucuuugu

SEQ ID NO: 98406 - RNA, 22 nt, Human
agauuuguauagaugugguuga

SEQ ID NO: 98407 - RNA, 19 nt, Human
agauggcaaaaugcaaaga

SEQ ID NO: 98408 - RNA, 21 nt, Human
agaugcaguuugcaggugggu

SEQ ID NO: 98409 - RNA, 20 nt, Human
agaugcccaacucuguuuug

SEQ ID NO: 98410 - RNA, 22 nt, Human
agauggaggaaagcaguuagaa

SEQ ID NO: 98411 - RNA, 22 nt, Human
agauuuuacggaguauuagggu

SEQ ID NO: 98412 - RNA, 22 nt, Human
agauuuggaauggggguucaua

SEQ ID NO: 98413 - RNA, 22 nt, Human
agaugaugugugucuucagcua

SEQ ID NO: 98414 - RNA, 22 nt, Human
agauguuaauaaccuuagggca

SEQ ID NO: 98415 - RNA, 22 nt, Human
agaugucauguguugcuccaag

SEQ ID NO: 98416 - RNA, 22 nt, Human
agauggggccugaggacacugu

SEQ ID NO: 98417 - RNA, 22 nt, Human
agaugguucagaauuauaaaga

SEQ ID NO: 98418 - RNA, 22 nt, Human
agaucugucaccauccuggagc

SEQ ID NO: 98419 - RNA, 22 nt, Human
agaugacuaacauaguauugcu

SEQ ID NO: 98420 - RNA, 22 nt, Human
agaugaccaguaagugguugaa

SEQ ID NO: 98421 - RNA, 22 nt, Human
agauggaguccugaagccagaa

SEQ ID NO: 98422 - RNA, 22 nt, Human
agaugacuuuguccugagcuga

SEQ ID NO: 98423 - RNA, 22 nt, Human
agaugaguaaauggagucuucc

SEQ ID NO: 98424 - RNA, 23 nt, Human
agaugaugaauaaagagugagga

SEQ ID NO: 98425 - RNA, 22 nt, Human
agauaucuuguuggcauaaaug

SEQ ID NO: 98426 - RNA, 22 nt, Human
agauacuaagccucaagagacg

SEQ ID NO: 98427 - RNA, 22 nt, Human
agccccggugagggaguccugu

SEQ ID NO: 98428 - RNA, 22 nt, Human
agcccgggagggcugucuggga

SEQ ID NO: 98429 - RNA, 22 nt, Human
agcccugaccuguccuguucug

SEQ ID NO: 98430 - RNA, 22 nt, Human
agcauucagacaucugauggau

SEQ ID NO: 98431 - RNA, 22 nt, Human
agcaggggcaggguuuugugcu

SEQ ID NO: 98432 - RNA, 22 nt, Human
agcaggguggcaagucuuucug

SEQ ID NO: 98433 - RNA, 22 nt, Human
agccagugcagcuggaaauuca

SEQ ID NO: 98434 - RNA, 22 nt, Human
agccagugucgugugacaugag

SEQ ID NO: 98435 - RNA, 22 nt, Human
agccgauaaauuguuuucuugg

SEQ ID NO: 98436 - RNA, 22 nt, Human
agcccagguggagugugugggg

SEQ ID NO: 98437 - RNA, 22 nt, Human
agccauggagaacagacuugaa

SEQ ID NO: 98438 - RNA, 22 nt, Human
agccauggagauguggguuggg

SEQ ID NO: 98439 - RNA, 23 nt, Human
agcccagcagagaaccuaggucc

SEQ ID NO: 98440 - RNA, 21 nt, Human
agccagguuuccuuugaagag

SEQ ID NO: 98441 - RNA, 22 nt, Human
agccaugcuguuuugccuggga

SEQ ID NO: 98442 - RNA, 22 nt, Human
agccaucuggugucaaugauuc

SEQ ID NO: 98443 - RNA, 22 nt, Human
agccacggcaaugauaggcugc

SEQ ID NO: 98444 - RNA, 22 nt, Human
agccugaaccaauauagcagcc

SEQ ID NO: 98445 - RNA, 22 nt, Human
agccuggacagcuacggagaac

SEQ ID NO: 98446 - RNA, 22 nt, Human
agccuacauuugacuauagucu

SEQ ID NO: 98447 - RNA, 22 nt, Human
agccuaauuuguaggucugugu

SEQ ID NO: 98448 - RNA, 22 nt, Human
agccgcugaauuugaaacaagc

SEQ ID NO: 98449 - RNA, 22 nt, Human
agccgcgcuguuccugcugcug

SEQ ID NO: 98450 - RNA, 21 nt, Human
agccgggacaacguggacccc

SEQ ID NO: 98451 - RNA, 22 nt, Human
agccuauucaucugaucuugaa

SEQ ID NO: 98452 - RNA, 22 nt, Human
agccuggagcaggcucugcucu

SEQ ID NO: 98453 - RNA, 22 nt, Human
agccugagucugcacauagaac

SEQ ID NO: 98454 - RNA, 22 nt, Human
agccugugcuguguuugcucca

SEQ ID NO: 98455 - RNA, 22 nt, Human
agcgcgcggggcugcggcaggg

SEQ ID NO: 98456 - RNA, 19 nt, Human
agcgccucuacugcaugga

SEQ ID NO: 98457 - RNA, 22 nt, Human
agcgccgcugugauuggugagg

SEQ ID NO: 98458 - RNA, 22 nt, Human
agcgcucauuuuccuccugcuc

SEQ ID NO: 98459 - RNA, 21 nt, Human
agcgcugcauccaccauggcu

SEQ ID NO: 98460 - RNA, 22 nt, Human
agcaauguuggccuauauaccu

SEQ ID NO: 98461 - RNA, 22 nt, Human
agcaaauaauugucuuugaggg

SEQ ID NO: 98462 - RNA, 22 nt, Human
agcaacauggaguuugugcgca

SEQ ID NO: 98463 - RNA, 22 nt, Human
agcaaaguacugagcucaaagg

SEQ ID NO: 98464 - RNA, 22 nt, Human
agcacguucuucauuacuucac

SEQ ID NO: 98465 - RNA, 22 nt, Human
agcacuuuagaauuuagaguug

SEQ ID NO: 98466 - RNA, 22 nt, Human
agauucucccuccuggcgcugu

SEQ ID NO: 98467 - RNA, 22 nt, Human
agauuguaugaggacuccauga

SEQ ID NO: 98468 - RNA, 22 nt, Human
agcacauguuucuuuugcaauu

SEQ ID NO: 98469 - RNA, 20 nt, Human
agcacaggcagucauucagu

SEQ ID NO: 98470 - RNA, 22 nt, Human
agauuucaauggauauugcaag

SEQ ID NO: 98471 - RNA, 22 nt, Human
agcaaaauuccaaaaugcuaau

SEQ ID NO: 98472 - RNA, 22 nt, Human
agcaaagccucuuugaaaaaaa

SEQ ID NO: 98473 - RNA, 22 nt, Human
agcagcaaugacaauucaacca

SEQ ID NO: 98474 - RNA, 22 nt, Human
agcagagggucaguuuuuuagu

SEQ ID NO: 98475 - RNA, 22 nt, Human
agcagauaaagguugcauuucu

SEQ ID NO: 98476 - RNA, 22 nt, Human
agcagagaacauucauucaugu

SEQ ID NO: 98477 - RNA, 22 nt, Human
agcacuagcugcuugucucaag

SEQ ID NO: 98478 - RNA, 22 nt, Human
agcacucacuagaguuagaacc

SEQ ID NO: 98479 - RNA, 22 nt, Human
agcacuaccggucacggccaug

SEQ ID NO: 98480 - RNA, 22 nt, Human
agcaccuuguucagaucuuaca

SEQ ID NO: 98481 - RNA, 22 nt, Human
agcacgcccaccuccugcggcg

SEQ ID NO: 98482 - RNA, 22 nt, Human
agcagcaccuguccucgcugcu

SEQ ID NO: 98483 - RNA, 22 nt, Human
agcagauuguacagugcauuag

SEQ ID NO: 98484 - RNA, 22 nt, Human
agcaauucagagcauggacuuu

SEQ ID NO: 98485 - RNA, 22 nt, Human
agcaauucugaaauuacuugac

SEQ ID NO: 98486 - RNA, 22 nt, Human
agcacagugccugacauauaug

SEQ ID NO: 98487 - RNA, 22 nt, Human
agcauaacaaagggcauaauug

SEQ ID NO: 98488 - RNA, 22 nt, Human
agcaggaaggcuagaagcagga

SEQ ID NO: 98489 - RNA, 22 nt, Human
agcaggagagacuggcccaaaa

SEQ ID NO: 98490 - RNA, 20 nt, Human
agcauucaacuuucuauguu

SEQ ID NO: 98491 - RNA, 22 nt, Human
agcagggagacagugcagcauu

SEQ ID NO: 98492 - RNA, 22 nt, Human
agcagcugagccccagcuguga

SEQ ID NO: 98493 - RNA, 16 nt, Human
agcagcgugggggugg

SEQ ID NO: 98494 - RNA, 19 nt, Human
agcagccaucgaccaugga

SEQ ID NO: 98495 - RNA, 22 nt, Human
aggcagugccuggaccccagcu

SEQ ID NO: 98496 - RNA, 20 nt, Human
aggccgcccgcugccgcuuc

SEQ ID NO: 98497 - RNA, 22 nt, Human
aggcugggaaguguguccugag

SEQ ID NO: 98498 - RNA, 22 nt, Human
aggcauuuucuuguuauuuuua

SEQ ID NO: 98499 - RNA, 22 nt, Human
aggccacucagggggccaagau

SEQ ID NO: 98500 - RNA, 22 nt, Human
aggccaggcgccggcgcgagac

SEQ ID NO: 98501 - RNA, 22 nt, Human
aggcugcucucgccggcggugu

SEQ ID NO: 98502 - RNA, 22 nt, Human
aggccauuucacagguuuugga

SEQ ID NO: 98503 - RNA, 22 nt, Human
aggccagugcagcuggaacaga

SEQ ID NO: 98504 - RNA, 19 nt, Human
aggcugccucacccucccu

SEQ ID NO: 98505 - RNA, 22 nt, Human
aggcauuuaucaggaaauguuc

SEQ ID NO: 98506 - RNA, 22 nt, Human
aggcauuuaaagauguaagacu

SEQ ID NO: 98507 - RNA, 21 nt, Human
aggcauuuucuuggagauucu

SEQ ID NO: 98508 - RNA, 22 nt, Human
aggcaucguguuuuucugcuuu

SEQ ID NO: 98509 - RNA, 22 nt, Human
aggcauguugcuucgggcuuug

SEQ ID NO: 98510 - RNA, 22 nt, Human
aggcaguguggagggcuguugc

SEQ ID NO: 98511 - RNA, 22 nt, Human
aggcaguguguagcuggaagag

SEQ ID NO: 98512 - RNA, 22 nt, Human
aggcagaugggagcuggaaguu

SEQ ID NO: 98513 - RNA, 19 nt, Human
aggcagccccaacuugcau

SEQ ID NO: 98514 - RNA, 22 nt, Human
aggcaguggcuuuuguuguguu

SEQ ID NO: 98515 - RNA, 22 nt, Human
aggcaguggagcuggaauaggc

SEQ ID NO: 98516 - RNA, 22 nt, Human
aggcaggcucaaugcccagucu

SEQ ID NO: 98517 - RNA, 23 nt, Human
aggcagaguccuggggcacagcc

SEQ ID NO: 98518 - RNA, 22 nt, Human
aggcaggggagcuggaagggua

SEQ ID NO: 98519 - RNA, 22 nt, Human
aggcagugguguuugcuggugg

SEQ ID NO: 98520 - RNA, 22 nt, Human
aggcauauaguguuuaaaaaaa

SEQ ID NO: 98521 - RNA, 21 nt, Human
aggcagcgauuuucauauugc

SEQ ID NO: 98522 - RNA, 23 nt, Human
aggcagcaugcaacaggccauuu

SEQ ID NO: 98523 - RNA, 22 nt, Human
aggcagcagggagggagaaaug

SEQ ID NO: 98524 - RNA, 22 nt, Human
aggauugauggcauguuuacug

SEQ ID NO: 98525 - RNA, 22 nt, Human
aggcagagauggcugcagggcc

SEQ ID NO: 98526 - RNA, 22 nt, Human
aggcaauuuuuaggguuguugu

SEQ ID NO: 98527 - RNA, 22 nt, Human
aggcaauagagggugaggagga

SEQ ID NO: 98528 - RNA, 22 nt, Human
aggcaggagcugugguggugag

SEQ ID NO: 98529 - RNA, 20 nt, Human
aggcagacaaggagucuguu

SEQ ID NO: 98530 - RNA, 22 nt, Human
aggcacagaauccagucugcug

SEQ ID NO: 98531 - RNA, 22 nt, Human
aggauugucuccugugaugugc

SEQ ID NO: 98532 - RNA, 22 nt, Human
aggauugaaaaaacacauauau

SEQ ID NO: 98533 - RNA, 22 nt, Human
aggcagagaggucuuccuggaa

SEQ ID NO: 98534 - RNA, 22 nt, Human
aggauuuagcaugaaaugugaa

SEQ ID NO: 98535 - RNA, 22 nt, Human
aggauuuauuccagaaaugcaa

SEQ ID NO: 98536 - RNA, 22 nt, Human
aggauggauagcaaggaagccg

SEQ ID NO: 98537 - RNA, 22 nt, Human
aggcaacagacaggcuugguuc

SEQ ID NO: 98538 - RNA, 23 nt, Human
aggcaagaacggguuguucaccc

SEQ ID NO: 98539 - RNA, 22 nt, Human
aggcaauuauacuagguuuugg

SEQ ID NO: 98540 - RNA, 20 nt, Human
aggauuauguacauggaugc

SEQ ID NO: 98541 - RNA, 22 nt, Human
aggacacagaguauggaagugu

SEQ ID NO: 98542 - RNA, 22 nt, Human
aggauucuccuguuucccaccc

SEQ ID NO: 98543 - RNA, 22 nt, Human
aggauaaaggucauuauuccca

SEQ ID NO: 98544 - RNA, 22 nt, Human
aggaguuugaaaacuuaacuaa

SEQ ID NO: 98545 - RNA, 22 nt, Human
aggauaaaugggucauuaggca

SEQ ID NO: 98546 - RNA, 22 nt, Human
aggaacaacagccuuuauaucc

SEQ ID NO: 98547 - RNA, 22 nt, Human
aggaauuuuaauaugcuugucu

SEQ ID NO: 98548 - RNA, 22 nt, Human
aggaggaggacucgccaggcca

SEQ ID NO: 98549 - RNA, 22 nt, Human
aggagcugccggauggggcaug

SEQ ID NO: 98550 - RNA, 22 nt, Human
agcggcaagguguauguggcag

SEQ ID NO: 98551 - RNA, 22 nt, Human
agcgcuguguucccgugggcau

SEQ ID NO: 98552 - RNA, 22 nt, Human
agcgcugugaaggcugggccac

SEQ ID NO: 98553 - RNA, 22 nt, Human
aggacaaaggaccagaucugga

SEQ ID NO: 98554 - RNA, 22 nt, Human
aggaauuugggguuacaugaug

SEQ ID NO: 98555 - RNA, 22 nt, Human
aggaaauaggaccagacaaagc

SEQ ID NO: 98556 - RNA, 22 nt, Human
aggaauugucgucauguauaau

SEQ ID NO: 98557 - RNA, 20 nt, Human
agguuugcuguauaucaugg

SEQ ID NO: 98558 - RNA, 22 nt, Human
agguuuauggagcaccacaucu

SEQ ID NO: 98559 - RNA, 22 nt, Human
agguuuuagaagcugaagccaa

SEQ ID NO: 98560 - RNA, 22 nt, Human
aguaaaggaaggaagggacagc

SEQ ID NO: 98561 - RNA, 22 nt, Human
agguuuuugucauuuucuggua

SEQ ID NO: 98562 - RNA, 18 nt, Human
aguaaauguuaaauauug

SEQ ID NO: 98563 - RNA, 19 nt, Human
aguaaagugguggcauuuu

SEQ ID NO: 98564 - RNA, 22 nt, Human
aguaaucgugaucgagagauca

SEQ ID NO: 98565 - RNA, 22 nt, Human
aguaagaacugugggugggguu

SEQ ID NO: 98566 - RNA, 22 nt, Human
aguaauggucucaauaaauucu

SEQ ID NO: 98567 - RNA, 21 nt, Human
aguaccugugugccugugugu

SEQ ID NO: 98568 - RNA, 22 nt, Human
aguaacagguguacagacuauc

SEQ ID NO: 98569 - RNA, 20 nt, Human
aguacugacaauauucugug

SEQ ID NO: 98570 - RNA, 22 nt, Human
aguaauaaacaacucauuuugg

SEQ ID NO: 98571 - RNA, 22 nt, Human
aguaacuuaagcaauuguguau

SEQ ID NO: 98572 - RNA, 22 nt, Human
agguuuggaaguggcgauccau

SEQ ID NO: 98573 - RNA, 22 nt, Human
agguuuggguucauugcuggcu

SEQ ID NO: 98574 - RNA, 22 nt, Human
agguucaucaauaacucagaga

SEQ ID NO: 98575 - RNA, 18 nt, Human
agguugcaucugugcaga

SEQ ID NO: 98576 - RNA, 22 nt, Human
agguggcuaugaggaugcaguc

SEQ ID NO: 98577 - RNA, 22 nt, Human
agguggcguauguguucguguu

SEQ ID NO: 98578 - RNA, 22 nt, Human
aggugcuugcauacugcuugac

SEQ ID NO: 98579 - RNA, 22 nt, Human
aggugugcacccggucgcuucc

SEQ ID NO: 98580 - RNA, 18 nt, Human
agguguguuucuaggagc

SEQ ID NO: 98581 - RNA, 22 nt, Human
agguuaaacuuccugcagggcu

SEQ ID NO: 98582 - RNA, 22 nt, Human
agguuaauaugaacagcagaag

SEQ ID NO: 98583 - RNA, 22 nt, Human
agguuaggaggggagugccaca

SEQ ID NO: 98584 - RNA, 21 nt, Human
aggugguuccaauaaguaggu

SEQ ID NO: 98585 - RNA, 22 nt, Human
agguggugacgaugcuccguac

SEQ ID NO: 98586 - RNA, 22 nt, Human
agguguaauuacucuugcaguu

SEQ ID NO: 98587 - RNA, 22 nt, Human
aggugucauuauagaccagaua

SEQ ID NO: 98588 - RNA, 22 nt, Human
agguggggacuccaccgaugcu

SEQ ID NO: 98589 - RNA, 22 nt, Human
aggugggucgcaggcaucagug

SEQ ID NO: 98590 - RNA, 22 nt, Human
aggugguauuuaaaauuauuug

SEQ ID NO: 98591 - RNA, 22 nt, Human
agguggucuuguggaugccgca

SEQ ID NO: 98592 - RNA, 22 nt, Human
aggugauauuauguauuucuau

SEQ ID NO: 98593 - RNA, 22 nt, Human
aggugagaaggacuguugcauu

SEQ ID NO: 98594 - RNA, 22 nt, Human
aggugauaugggcuucucugag

SEQ ID NO: 98595 - RNA, 19 nt, Human
aggugaugugacucuagaa

SEQ ID NO: 98596 - RNA, 22 nt, Human
aggugggcuuagaaaucuguau

SEQ ID NO: 98597 - RNA, 22 nt, Human
aggugcucaguaauugauuguu

SEQ ID NO: 98598 - RNA, 22 nt, Human
aggugcagcugguggagucugg

SEQ ID NO: 98599 - RNA, 22 nt, Human
aggguaauaacaguauggugau

SEQ ID NO: 98600 - RNA, 22 nt, Human
agggggccucucccgcggcgcc

SEQ ID NO: 98601 - RNA, 22 nt, Human
agggggcuccugcaggccccca

SEQ ID NO: 98602 - RNA, 22 nt, Human
agggggaaaauguggauuaugg

SEQ ID NO: 98603 - RNA, 18 nt, Human
agggggaagccaggagga

SEQ ID NO: 98604 - RNA, 22 nt, Human
aggguauguuuuuaucuacugu

SEQ ID NO: 98605 - RNA, 20 nt, Human
agggucucuccuggcucugc

SEQ ID NO: 98606 - RNA, 22 nt, Human
aggguugaagucugguccucau

SEQ ID NO: 98607 - RNA, 22 nt, Human
aggguuugaauccucuuucuua

SEQ ID NO: 98608 - RNA, 22 nt, Human
aggucagacagggugucuuucu

SEQ ID NO: 98609 - RNA, 22 nt, Human
aggucgugggugagagagagac

SEQ ID NO: 98610 - RNA, 22 nt, Human
aggucguauaguuaccuccuug

SEQ ID NO: 98611 - RNA, 22 nt, Human
aggggcugagaguuugaugugg

SEQ ID NO: 98612 - RNA, 22 nt, Human
agggcuucugcugcagagaccu

SEQ ID NO: 98613 - RNA, 22 nt, Human
agggcuugggggccuugaaggc

SEQ ID NO: 98614 - RNA, 19 nt, Human
aggggccugcuuggccuug

SEQ ID NO: 98615 - RNA, 22 nt, Human
agggcuuaggcacacugugacu

SEQ ID NO: 98616 - RNA, 22 nt, Human
agggcuguuggugcccucgagg

SEQ ID NO: 98617 - RNA, 22 nt, Human
agggcugggcuuggcaggcugg

SEQ ID NO: 98618 - RNA, 22 nt, Human
aggggcaagucuggccauuucu

SEQ ID NO: 98619 - RNA, 22 nt, Human
aggguguuugggagcagaggau

SEQ ID NO: 98620 - RNA, 22 nt, Human
agggucgucuggguccgugggg

SEQ ID NO: 98621 - RNA, 22 nt, Human
aggguaccugauuuauggagca

SEQ ID NO: 98622 - RNA, 22 nt, Human
aggcuuaacuacaauuuuugcc

SEQ ID NO: 98623 - RNA, 22 nt, Human
aggcuuaaaugcucauaucagu

SEQ ID NO: 98624 - RNA, 22 nt, Human
aggcuuuugcucuggcuccucu

SEQ ID NO: 98625 - RNA, 22 nt, Human
aggcuguagaucuagacaugua

SEQ ID NO: 98626 - RNA, 22 nt, Human
aggcugucucagccugcuugca

SEQ ID NO: 98627 - RNA, 22 nt, Human
agggcaguguggugggacugac

SEQ ID NO: 98628 - RNA, 22 nt, Human
agggcauacauuuuccugagau

SEQ ID NO: 98629 - RNA, 22 nt, Human
agggcaguuuuacugaaaggug

SEQ ID NO: 98630 - RNA, 22 nt, Human
agggccagcagcuuggccaacc

SEQ ID NO: 98631 - RNA, 22 nt, Human
agggaguuccgaucugugcacc

SEQ ID NO: 98632 - RNA, 20 nt, Human
agggauuugguugguauugu

SEQ ID NO: 98633 - RNA, 22 nt, Human
agggcaggguuggugcuggugc

SEQ ID NO: 98634 - RNA, 20 nt, Human
agggccuauauaaacugcug

SEQ ID NO: 98635 - RNA, 22 nt, Human
aggggcagaggaugauggaaga

SEQ ID NO: 98636 - RNA, 21 nt, Human
agggccagaucaccaaggagc

SEQ ID NO: 98637 - RNA, 22 nt, Human
agggcaugugaaguaaccuagg

SEQ ID NO: 98638 - RNA, 20 nt, Human
agugaguuaucagcuacagu

SEQ ID NO: 98639 - RNA, 21 nt, Human
agugaguagagcacugaguca

SEQ ID NO: 98640 - RNA, 21 nt, Human
agugagugacagaagaagguu

SEQ ID NO: 98641 - RNA, 23 nt, Human
agugaagcugguuagugaugacc

SEQ ID NO: 98642 - RNA, 22 nt, Human
agucuuuguuccugggaccuga

SEQ ID NO: 98643 - RNA, 22 nt, Human
agugacuguccuacuuuguaga

SEQ ID NO: 98644 - RNA, 22 nt, Human
agugagaguauuaaugugaacu

SEQ ID NO: 98645 - RNA, 22 nt, Human
aguaggagugacaagcagguca

SEQ ID NO: 98646 - RNA, 22 nt, Human
aguacuuuuuguucaauugugc

SEQ ID NO: 98647 - RNA, 19 nt, Human
agugaacuccauaucaggu

SEQ ID NO: 98648 - RNA, 22 nt, Human
agugaaauaugcccauugcugu

SEQ ID NO: 98649 - RNA, 22 nt, Human
agugaaaacugaaucaccuucc

SEQ ID NO: 98650 - RNA, 23 nt, Human
aguggccgaucaucucgggcuug

SEQ ID NO: 98651 - RNA, 21 nt, Human
aguggcacuguuucuucccua

SEQ ID NO: 98652 - RNA, 22 nt, Human
agugcuccucagaagaguugga

SEQ ID NO: 98653 - RNA, 22 nt, Human
agugccauggcugcuagauggc

SEQ ID NO: 98654 - RNA, 22 nt, Human
agugcucagggaaugccacuga

SEQ ID NO: 98655 - RNA, 22 nt, Human
agugaugauccaaaugaauuga

SEQ ID NO: 98656 - RNA, 23 nt, Human
agugaucuguguuugaagaaugc

SEQ ID NO: 98657 - RNA, 22 nt, Human
agugaucugcugcagugcucug

SEQ ID NO: 98658 - RNA, 22 nt, Human
agugccaucuuuaacuguccca

SEQ ID NO: 98659 - RNA, 20 nt, Human
agugauuuguuaguacauug

SEQ ID NO: 98660 - RNA, 22 nt, Human
agugauguaauggugaauguga

SEQ ID NO: 98661 - RNA, 22 nt, Human
agugaugcuuuggagaagaucc

SEQ ID NO: 98662 - RNA, 23 nt, Human
agugaugcaguaucugggucugu

SEQ ID NO: 98663 - RNA, 22 nt, Human
aguggcuagaucaugagugagc

SEQ ID NO: 98664 - RNA, 22 nt, Human
aguggugaucuguuacagucac

SEQ ID NO: 98665 - RNA, 19 nt, Human
agugggauggcuuuuuccc

SEQ ID NO: 98666 - RNA, 22 nt, Human
agugggaaagcugccuuguaga

SEQ ID NO: 98667 - RNA, 22 nt, Human
aguggcugugaaauacauggga

SEQ ID NO: 98668 - RNA, 22 nt, Human
agugccuggcugauggguccug

SEQ ID NO: 98669 - RNA, 22 nt, Human
aguucauucuagcugggagcag

SEQ ID NO: 98670 - RNA, 22 nt, Human
aguuauuuuucacuauuaggcu

SEQ ID NO: 98671 - RNA, 22 nt, Human
aguucaauuguuuuguaaaagu

SEQ ID NO: 98672 - RNA, 22 nt, Human
aguucaugcuuagaucucauuu

SEQ ID NO: 98673 - RNA, 22 nt, Human
aguuauuaagaaaauuuugcca

SEQ ID NO: 98674 - RNA, 20 nt, Human
aguucagguuauuuuccucc

SEQ ID NO: 98675 - RNA, 22 nt, Human
aguucauccucauuuacaagga

SEQ ID NO: 98676 - RNA, 22 nt, Human
aguucauaucuacuuuuccauc

SEQ ID NO: 98677 - RNA, 22 nt, Human
aguucaugugguuuaacuuaau

SEQ ID NO: 98678 - RNA, 22 nt, Human
aguuaugcaagcaaguaccacu

SEQ ID NO: 98679 - RNA, 22 nt, Human
aguuaucuauaaaucccugagg

SEQ ID NO: 98680 - RNA, 22 nt, Human
aguguuugggagagggugugag

SEQ ID NO: 98681 - RNA, 22 nt, Human
aguuaauuauagugcuuaauau

SEQ ID NO: 98682 - RNA, 17 nt, Human
aguuacugcacuugcca

SEQ ID NO: 98683 - RNA, 23 nt, Human
aguuaucuaaugaaguucuucca

SEQ ID NO: 98684 - RNA, 22 nt, Human
aguuauggguauguauuauaau

SEQ ID NO: 98685 - RNA, 22 nt, Human
aguguccaacucagcuugucaa

SEQ ID NO: 98686 - RNA, 22 nt, Human
aguguuuuaugugccaguuuaa

SEQ ID NO: 98687 - RNA, 22 nt, Human
aguguuuuaagaaaguaauuuu

SEQ ID NO: 98688 - RNA, 22 nt, Human
aguuaaagggggcuacagugug

SEQ ID NO: 98689 - RNA, 22 nt, Human
aguuaacuugugguuuggcugu

SEQ ID NO: 98690 - RNA, 22 nt, Human
aguuaaucuuguauuaaugguu

SEQ ID NO: 98691 - RNA, 20 nt, Human
aguguuggugcuuuucccag

SEQ ID NO: 98692 - RNA, 20 nt, Human
aguguugaacuacacuuccc

SEQ ID NO: 98693 - RNA, 22 nt, Human
aguguggccaaugaggaugggc

SEQ ID NO: 98694 - RNA, 22 nt, Human
aguguauuugccuauaaaaaug

SEQ ID NO: 98695 - RNA, 22 nt, Human
agugugacccauggcaagggca

SEQ ID NO: 98696 - RNA, 22 nt, Human
aguguucaauuugagcucaaag

SEQ ID NO: 98697 - RNA, 22 nt, Human
aguggggcccaagaaucugcau

SEQ ID NO: 98698 - RNA, 23 nt, Human
aguguucagcauguaguaaauac

SEQ ID NO: 98699 - RNA, 22 nt, Human
aguggugccuaagcgcggaggc

SEQ ID NO: 98700 - RNA, 22 nt, Human
agugucagcagcuucauugucu

SEQ ID NO: 98701 - RNA, 22 nt, Human
aguggggaaauaucaauauuug

SEQ ID NO: 98702 - RNA, 22 nt, Human
aguggcuggcaggggagggucc

SEQ ID NO: 98703 - RNA, 22 nt, Human
aguggcuucucuggggucaaga

SEQ ID NO: 98704 - RNA, 22 nt, Human
aguggcuguuccaggugaggac

SEQ ID NO: 98705 - RNA, 22 nt, Human
auaaaguaaugcauauaaugug

SEQ ID NO: 98706 - RNA, 22 nt, Human
auaaucuuuccagucaguuucc

SEQ ID NO: 98707 - RNA, 22 nt, Human
auaaugccucauaggguguucc

SEQ ID NO: 98708 - RNA, 22 nt, Human
auaaaaucugaagcaagaauaa

SEQ ID NO: 98709 - RNA, 22 nt, Human
auaaagggccuuauuuuagcaa

SEQ ID NO: 98710 - RNA, 22 nt, Human
auaaggcauagugagucaucau

SEQ ID NO: 98711 - RNA, 22 nt, Human
auaagguuuucuuuuguucccu

SEQ ID NO: 98712 - RNA, 22 nt, Human
aguuuuguuuguuuguuuguua

SEQ ID NO: 98713 - RNA, 22 nt, Human
aguuuuuaacgccauguuugaa

SEQ ID NO: 98714 - RNA, 22 nt, Human
auaaaaauguuuuuguguggua

SEQ ID NO: 98715 - RNA, 22 nt, Human
auaaaacagaucaggagaauga

SEQ ID NO: 98716 - RNA, 22 nt, Human
auaaaagcacaauagaguuaug

SEQ ID NO: 98717 - RNA, 22 nt, Human
aguuuuugccucgaauucugcg

SEQ ID NO: 98718 - RNA, 20 nt, Human
auaaauaggauuuucugaca

SEQ ID NO: 98719 - RNA, 22 nt, Human
auaaauuugccagcauauguuc

SEQ ID NO: 98720 - RNA, 22 nt, Human
auaacgaaagcaauuauuuuca

SEQ ID NO: 98721 - RNA, 22 nt, Human
auaagcuucucugcaguucagu

SEQ ID NO: 98722 - RNA, 22 nt, Human
auaaccaaaaauaguuuaguac

SEQ ID NO: 98723 - RNA, 22 nt, Human
auaaauuugacagcucuucaug

SEQ ID NO: 98724 - RNA, 22 nt, Human
auaaauucuaugauggauuggg

SEQ ID NO: 98725 - RNA, 22 nt, Human
auaaaucaagggcaguauuucc

SEQ ID NO: 98726 - RNA, 22 nt, Human
auacagccuaguuugaguccca

SEQ ID NO: 98727 - RNA, 22 nt, Human
auacaggcaguaagauucucag

SEQ ID NO: 98728 - RNA, 22 nt, Human
auacagacacuguagguuauuu

SEQ ID NO: 98729 - RNA, 22 nt, Human
auacaaaaaguggugaguguau

SEQ ID NO: 98730 - RNA, 22 nt, Human
auaccaaugacaggaguuaggg

SEQ ID NO: 98731 - RNA, 22 nt, Human
auaacccuauuaaauggugcgc

SEQ ID NO: 98732 - RNA, 22 nt, Human
auaauugaauaagagcugcagg

SEQ ID NO: 98733 - RNA, 18 nt, Human
auaccaggauagggacaa

SEQ ID NO: 98734 - RNA, 22 nt, Human
auaccaguagaggacugcccaa

SEQ ID NO: 98735 - RNA, 22 nt, Human
auaaguuauuuuaguaaaucag

SEQ ID NO: 98736 - RNA, 22 nt, Human
auacaucuuaacgcgcucuugg

SEQ ID NO: 98737 - RNA, 21 nt, Human
auacaguucagcuuuuacuau

SEQ ID NO: 98738 - RNA, 22 nt, Human
auaaucuuugaguagaguugag

SEQ ID NO: 98739 - RNA, 23 nt, Human
auaaugauaaugcuauuuuuugu

SEQ ID NO: 98740 - RNA, 22 nt, Human
aguugugagaaugaacacugaa

SEQ ID NO: 98741 - RNA, 22 nt, Human
aguuuaaauuguucuaucagaa

SEQ ID NO: 98742 - RNA, 22 nt, Human
aguuuacccacuguugaaauua

SEQ ID NO: 98743 - RNA, 22 nt, Human
aguugguucgucucgccuugag

SEQ ID NO: 98744 - RNA, 22 nt, Human
aguuucccucacaggucugcau

SEQ ID NO: 98745 - RNA, 21 nt, Human
aguuguacuguauagcagaug

SEQ ID NO: 98746 - RNA, 22 nt, Human
aguuucuugaagacugauguuu

SEQ ID NO: 98747 - RNA, 22 nt, Human
aguuuuugagaauucuucugaa

SEQ ID NO: 98748 - RNA, 23 nt, Human
aguuuacguauucauucuuacuc

SEQ ID NO: 98749 - RNA, 22 nt, Human
aguuucaguuaguugggugaca

SEQ ID NO: 98750 - RNA, 22 nt, Human
aguuuccacuggagacacugug

SEQ ID NO: 98751 - RNA, 22 nt, Human
aguuuguagguuaggaucagca

SEQ ID NO: 98752 - RNA, 22 nt, Human
aguuugauuugucuaucuucau

SEQ ID NO: 98753 - RNA, 22 nt, Human
aguuuucugccucuggaugcgu

SEQ ID NO: 98754 - RNA, 22 nt, Human
auaaaaaguggcugcuauugga

SEQ ID NO: 98755 - RNA, 18 nt, Human
aguuuuuuuggcaaaagg

SEQ ID NO: 98756 - RNA, 22 nt, Human
aguugguauuuacugcaguugg

SEQ ID NO: 98757 - RNA, 22 nt, Human
aguuguuuuucuuagauuuuag

SEQ ID NO: 98758 - RNA, 22 nt, Human
aguugguggaagcuaagcuucu

SEQ ID NO: 98759 - RNA, 22 nt, Human
aguugcuaauacaaaaaguccc

SEQ ID NO: 98760 - RNA, 22 nt, Human
aguugcugccagguccugggag

SEQ ID NO: 98761 - RNA, 22 nt, Human
aguugcagguucacguaucuug

SEQ ID NO: 98762 - RNA, 22 nt, Human
aguuggcauuuuauuuaaguau

SEQ ID NO: 98763 - RNA, 22 nt, Human
aguugaggguuaguaaauagcu

SEQ ID NO: 98764 - RNA, 22 nt, Human
aguugggaaaugcugcaguagu

SEQ ID NO: 98765 - RNA, 22 nt, Human
aguuggaagacacccugaaauc

SEQ ID NO: 98766 - RNA, 22 nt, Human
aguugguguuagaguuuuucag

SEQ ID NO: 98767 - RNA, 22 nt, Human
aguuguucucagcagaagaacu

SEQ ID NO: 98768 - RNA, 22 nt, Human
aguucucaagguuaggaaaagu

SEQ ID NO: 98769 - RNA, 22 nt, Human
aguugcuucccuauucuuagca

SEQ ID NO: 98770 - RNA, 22 nt, Human
aguucccgcgggagggcgcagg

SEQ ID NO: 98771 - RNA, 22 nt, Human
aguucugacucugaaucuggga

SEQ ID NO: 98772 - RNA, 22 nt, Human
aguucuggcccugaaacaggga

SEQ ID NO: 98773 - RNA, 22 nt, Human
aguucugggaggugcacgucca

SEQ ID NO: 98774 - RNA, 22 nt, Human
aguucggauuguaauagauaau

SEQ ID NO: 98775 - RNA, 22 nt, Human
aguucuuugcucccugcuuuuu

SEQ ID NO: 98776 - RNA, 22 nt, Human
aguucuguucccccaguuacau

SEQ ID NO: 98777 - RNA, 22 nt, Human
auucugaagcagaaaaggcaga

SEQ ID NO: 98778 - RNA, 21 nt, Human
auucugaguugucagucuuca

SEQ ID NO: 98779 - RNA, 22 nt, Human
auucuguaggcuuuuguuaaaa

SEQ ID NO: 98780 - RNA, 22 nt, Human
auucugcaauaaucaguccuua

SEQ ID NO: 98781 - RNA, 23 nt, Human
auuauuucaggguuuugacuugc

SEQ ID NO: 98782 - RNA, 20 nt, Human
auuauuucuucugcccaaag

SEQ ID NO: 98783 - RNA, 22 nt, Human
auuauucuuugggaaaguugaa

SEQ ID NO: 98784 - RNA, 22 nt, Human
auuauuugcuuaagcuggucuc

SEQ ID NO: 98785 - RNA, 22 nt, Human
auucaagauaagggucugggag

SEQ ID NO: 98786 - RNA, 22 nt, Human
auucauucugaccucaagagaa

SEQ ID NO: 98787 - RNA, 22 nt, Human
auucaggacucuuccuugaaga

SEQ ID NO: 98788 - RNA, 22 nt, Human
auucaccaucuugauccccucu

SEQ ID NO: 98789 - RNA, 20 nt, Human
auucuguguaaauguccugu

SEQ ID NO: 98790 - RNA, 17 nt, Human
auucuuauacucuguga

SEQ ID NO: 98791 - RNA, 22 nt, Human
auucuguuuaauacacgaaagg

SEQ ID NO: 98792 - RNA, 22 nt, Human
auucuguugguuuaauagucaa

SEQ ID NO: 98793 - RNA, 22 nt, Human
auuaacaggcucuguucuaguu

SEQ ID NO: 98794 - RNA, 22 nt, Human
auguuguugaacucuuugcaug

SEQ ID NO: 98795 - RNA, 22 nt, Human
auucgaucacugccgaggaccu

SEQ ID NO: 98796 - RNA, 22 nt, Human
auucgcggcuugaucugcuugc

SEQ ID NO: 98797 - RNA, 22 nt, Human
auucuacucuccuacaggucua

SEQ ID NO: 98798 - RNA, 22 nt, Human
auuccuguggcuggguaaagua

SEQ ID NO: 98799 - RNA, 22 nt, Human
auuccguuuuaaaaccuuaagc

SEQ ID NO: 98800 - RNA, 22 nt, Human
auuaugugagggacuuaaucau

SEQ ID NO: 98801 - RNA, 22 nt, Human
auuaucuauccgccaacaguaa

SEQ ID NO: 98802 - RNA, 22 nt, Human
auucuacucuuuaaauaugaaa

SEQ ID NO: 98803 - RNA, 23 nt, Human
auuaugaagaagacucgccuguu

SEQ ID NO: 98804 - RNA, 17 nt, Human
auucuaguuggcuuuuu

SEQ ID NO: 98805 - RNA, 22 nt, Human
auucucuauugguaaauuugac

SEQ ID NO: 98806 - RNA, 22 nt, Human
auucucugaugcagguggaaga

SEQ ID NO: 98807 - RNA, 22 nt, Human
auucucauguuaccaaauucua

SEQ ID NO: 98808 - RNA, 22 nt, Human
auucguguauauacacauccac

SEQ ID NO: 98809 - RNA, 22 nt, Human
auucuaauaagcguuuugucgc

SEQ ID NO: 98810 - RNA, 22 nt, Human
auucuacgcuccgucucuauca

SEQ ID NO: 98811 - RNA, 22 nt, Human
auuccagggaaauggggaugga

SEQ ID NO: 98812 - RNA, 22 nt, Human
auucccuuugacgaucccuagg

SEQ ID NO: 98813 - RNA, 22 nt, Human
auugaaauuaauuucugcuuuc

SEQ ID NO: 98814 - RNA, 22 nt, Human
auucuugauauagauaguuaau

SEQ ID NO: 98815 - RNA, 19 nt, Human
auucuucucuuccugcugu

SEQ ID NO: 98816 - RNA, 22 nt, Human
auugaagcauggagaugaggca

SEQ ID NO: 98817 - RNA, 22 nt, Human
auugaaguguacguuugaucua

SEQ ID NO: 98818 - RNA, 22 nt, Human
auugaauuagauguuguagucc

SEQ ID NO: 98819 - RNA, 22 nt, Human
auucuccucaaaacaucugcug

SEQ ID NO: 98820 - RNA, 22 nt, Human
auugacuuucccuucuccucau

SEQ ID NO: 98821 - RNA, 22 nt, Human
auucucauguuuuaaaaaaguu

SEQ ID NO: 98822 - RNA, 20 nt, Human
auucucaccaugugacaugg

SEQ ID NO: 98823 - RNA, 22 nt, Human
auucuaugaaugacuguuagau

SEQ ID NO: 98824 - RNA, 22 nt, Human
auucuguuuuaccauuuucuuu

SEQ ID NO: 98825 - RNA, 22 nt, Human
auucuuauaaaaaguguugacu

SEQ ID NO: 98826 - RNA, 21 nt, Human
auucugauguuucuauuguuu

SEQ ID NO: 98827 - RNA, 22 nt, Human
auucugcugccuaguuuaugaa

SEQ ID NO: 98828 - RNA, 22 nt, Human
auucugcauuucuaaccagguc

SEQ ID NO: 98829 - RNA, 22 nt, Human
auucugagaucucuucuaggcc

SEQ ID NO: 98830 - RNA, 22 nt, Human
auucucuguacagaagguaccg

SEQ ID NO: 98831 - RNA, 22 nt, Human
auugcauucaugcuccccuuag

SEQ ID NO: 98832 - RNA, 23 nt, Human
auugccuguagaucuucacuuuc

SEQ ID NO: 98833 - RNA, 22 nt, Human
auucuucauguugaagcuguca

SEQ ID NO: 98834 - RNA, 22 nt, Human
auugaugccugaaaaauaugua

SEQ ID NO: 98835 - RNA, 22 nt, Human
auugauuuugugcuuuccuacg

SEQ ID NO: 98836 - RNA, 19 nt, Human
auugcaguguaaaacuauu

SEQ ID NO: 98837 - RNA, 22 nt, Human
auugaugaaaauaguuauuuua

SEQ ID NO: 98838 - RNA, 22 nt, Human
auugaguucaccucuuucagaa

SEQ ID NO: 98839 - RNA, 18 nt, Human
auugagcaugacagaccu

SEQ ID NO: 98840 - RNA, 22 nt, Human
auugaguacuugcugggcucuc

SEQ ID NO: 98841 - RNA, 22 nt, Human
caaaugaugcauggcuagugag

SEQ ID NO: 98842 - RNA, 22 nt, Human
caaauacguuuggcuggagcac

SEQ ID NO: 98843 - RNA, 22 nt, Human
auuuuuaucuaaaauccacuuu

SEQ ID NO: 98844 - RNA, 22 nt, Human
caaaggaaagagaaaaagucuu

SEQ ID NO: 98845 - RNA, 22 nt, Human
auuuuuagucuugcugcaauca

SEQ ID NO: 98846 - RNA, 22 nt, Human
auuuuuagagugaaagaauuaa

SEQ ID NO: 98847 - RNA, 22 nt, Human
caaauuuuuauuuaccaucugc

SEQ ID NO: 98848 - RNA, 22 nt, Human
auuuuugguuauaaaauaguuu

SEQ ID NO: 98849 - RNA, 22 nt, Human
auuuuugguuucaccugcacgc

SEQ ID NO: 98850 - RNA, 22 nt, Human
auuuuuuuuccugucucuuuca

SEQ ID NO: 98851 - RNA, 22 nt, Human
caaaaauacuugccuguaucug

SEQ ID NO: 98852 - RNA, 22 nt, Human
caagagcgugugcagggcaagu

SEQ ID NO: 98853 - RNA, 22 nt, Human
auuuuuucaugugugguugaga

SEQ ID NO: 98854 - RNA, 23 nt, Human
auuuuuccacacacagacucagu

SEQ ID NO: 98855 - RNA, 22 nt, Human
auuuuacuaugauaguugagaa

SEQ ID NO: 98856 - RNA, 22 nt, Human
auuuuagagaaacaaacguagg

SEQ ID NO: 98857 - RNA, 22 nt, Human
auuuuucacauuuugggggaca

SEQ ID NO: 98858 - RNA, 21 nt, Human
auuuuucagaaggaugugaua

SEQ ID NO: 98859 - RNA, 22 nt, Human
auuuuuauuugccuaugauaua

SEQ ID NO: 98860 - RNA, 22 nt, Human
auuuuauuuugggaucuuuuua

SEQ ID NO: 98861 - RNA, 22 nt, Human
auuuucgcaccucgcgaguugc

SEQ ID NO: 98862 - RNA, 22 nt, Human
auuuucauauggguuauuugua

SEQ ID NO: 98863 - RNA, 22 nt, Human
auuucuguaauucugaggagug

SEQ ID NO: 98864 - RNA, 17 nt, Human
auuuccgaguuucuuuc

SEQ ID NO: 98865 - RNA, 22 nt, Human
auuuugcuuuucuaguggguuu

SEQ ID NO: 98866 - RNA, 19 nt, Human
auuuugguucuuuccauuc

SEQ ID NO: 98867 - RNA, 22 nt, Human
auuuuguugaaacccuuguugu

SEQ ID NO: 98868 - RNA, 22 nt, Human
auuugcaucagugagcgaugug

SEQ ID NO: 98869 - RNA, 22 nt, Human
auuugacuugguaagacuuaag

SEQ ID NO: 98870 - RNA, 23 nt, Human
auuugcugaucguagaugacuag

SEQ ID NO: 98871 - RNA, 22 nt, Human
auuuccagcagcauauuugucu

SEQ ID NO: 98872 - RNA, 22 nt, Human
auuguauugcguuugcgaaugu

SEQ ID NO: 98873 - RNA, 22 nt, Human
auuggaagacgcuggaggcacu

SEQ ID NO: 98874 - RNA, 22 nt, Human
auuggccaguggacagcgccgu

SEQ ID NO: 98875 - RNA, 21 nt, Human
auuggcagaucucuggauugu

SEQ ID NO: 98876 - RNA, 22 nt, Human
auuuaucugcucuucgcguuga

SEQ ID NO: 98877 - RNA, 22 nt, Human
auuuauccuugggguagagcca

SEQ ID NO: 98878 - RNA, 22 nt, Human
auuuauauauuuuguucuggua

SEQ ID NO: 98879 - RNA, 22 nt, Human
auuuagagaaguagcaaggucc

SEQ ID NO: 98880 - RNA, 22 nt, Human
auuugcuuguucaccaguacuu

SEQ ID NO: 98881 - RNA, 22 nt, Human
auuuaagugagucuuuaaaaua

SEQ ID NO: 98882 - RNA, 22 nt, Human
auuuagacaacaagccuucucc

SEQ ID NO: 98883 - RNA, 22 nt, Human
auuuacugagguaaauaaacug

SEQ ID NO: 98884 - RNA, 22 nt, Human
auuuaaguuacuucucuuuccu

SEQ ID NO: 98885 - RNA, 22 nt, Human
auuucauccauuaagaguacuc

SEQ ID NO: 98886 - RNA, 22 nt, Human
auuucaguuugcaguuucucuc

SEQ ID NO: 98887 - RNA, 22 nt, Human
auugccauaauagagccaugua

SEQ ID NO: 98888 - RNA, 22 nt, Human
auugcaggucguguggaaguga

SEQ ID NO: 98889 - RNA, 22 nt, Human
auugagcuguugaagucccaca

SEQ ID NO: 98890 - RNA, 22 nt, Human
auugagaugcuuaaaucuucac

SEQ ID NO: 98891 - RNA, 22 nt, Human
auugagacugaaauuacugaag

SEQ ID NO: 98892 - RNA, 22 nt, Human
auugagaaaauucgagcaaguu

SEQ ID NO: 98893 - RNA, 22 nt, Human
auugguuucuuguggguuaucc

SEQ ID NO: 98894 - RNA, 22 nt, Human
auuggcugucagcccggauggg

SEQ ID NO: 98895 - RNA, 22 nt, Human
auucuuuauuuucuguacuugc

SEQ ID NO: 98896 - RNA, 22 nt, Human
auucuuuagaguccuucaaaua

SEQ ID NO: 98897 - RNA, 22 nt, Human
auuguucuagaauuuuuuuucc

SEQ ID NO: 98898 - RNA, 22 nt, Human
auugacagaaaauuggauggca

SEQ ID NO: 98899 - RNA, 22 nt, Human
auuguuuccccggaauuauuca

SEQ ID NO: 98900 - RNA, 22 nt, Human
auuguuuugugaaacauaguga

SEQ ID NO: 98901 - RNA, 19 nt, Human
auugguuugcucgggaaug

SEQ ID NO: 98902 - RNA, 22 nt, Human
auguuuuuugaaaauguauuuu

SEQ ID NO: 98903 - RNA, 22 nt, Human
auguugagaaucucucuucuaa

SEQ ID NO: 98904 - RNA, 22 nt, Human
auuaaaaaugagaguagggauu

SEQ ID NO: 98905 - RNA, 22 nt, Human
auuaaacuaaauuaugaauugg

SEQ ID NO: 98906 - RNA, 22 nt, Human
auguuuucauuuagaagcuaau

SEQ ID NO: 98907 - RNA, 20 nt, Human
augugcuaauauuaauaugu

SEQ ID NO: 98908 - RNA, 22 nt, Human
augugccuuaauauaggcgcug

SEQ ID NO: 98909 - RNA, 22 nt, Human
auguuuuaaaaaacaggcuacc

SEQ ID NO: 98910 - RNA, 22 nt, Human
auguuuaaguguuuugccccaa

SEQ ID NO: 98911 - RNA, 19 nt, Human
auguuuccauuucuggaua

SEQ ID NO: 98912 - RNA, 22 nt, Human
auguauauauacauguauugua

SEQ ID NO: 98913 - RNA, 22 nt, Human
auguguguaugugugcauguau

SEQ ID NO: 98914 - RNA, 22 nt, Human
augugggugaggaggccauugu

SEQ ID NO: 98915 - RNA, 22 nt, Human
augugucauuauccagaauaac

SEQ ID NO: 98916 - RNA, 22 nt, Human
auguguguaugacugaaucuau

SEQ ID NO: 98917 - RNA, 22 nt, Human
auguugcugauccuguggcugu

SEQ ID NO: 98918 - RNA, 22 nt, Human
auguuguuuauggguuaucaag

SEQ ID NO: 98919 - RNA, 22 nt, Human
augugauacuccuucuagugga

SEQ ID NO: 98920 - RNA, 22 nt, Human
augugagcuggaugaauuuaua

SEQ ID NO: 98921 - RNA, 22 nt, Human
auggcagcggagcuggaaauga

SEQ ID NO: 98922 - RNA, 22 nt, Human
augggaauggauugagugggug

SEQ ID NO: 98923 - RNA, 22 nt, Human
augggagggagcagugaguguu

SEQ ID NO: 98924 - RNA, 22 nt, Human
auggugaaaugauuugauguca

SEQ ID NO: 98925 - RNA, 22 nt, Human
auggucugcucagucucuugac

SEQ ID NO: 98926 - RNA, 22 nt, Human
augguguaggugaagagaacau

SEQ ID NO: 98927 - RNA, 22 nt, Human
auggggaucugcaguguugauc

SEQ ID NO: 98928 - RNA, 22 nt, Human
auggggaauugaccguggaucu

SEQ ID NO: 98929 - RNA, 18 nt, Human
augggggaggaggaaagg

SEQ ID NO: 98930 - RNA, 22 nt, Human
auguaacauaugugaucgcauu

SEQ ID NO: 98931 - RNA, 22 nt, Human
auggggaggcggauggagugcu

SEQ ID NO: 98932 - RNA, 22 nt, Human
augggaggguagagugaacaga

SEQ ID NO: 98933 - RNA, 22 nt, Human
auggcaucuucgguuggacugc

SEQ ID NO: 98934 - RNA, 22 nt, Human
augggcauacaaaugcuacccu

SEQ ID NO: 98935 - RNA, 22 nt, Human
augggauuugaaaaguggaaau

SEQ ID NO: 98936 - RNA, 22 nt, Human
augggcauggauggccgagucu

SEQ ID NO: 98937 - RNA, 22 nt, Human
augguuacgcccucacccuacc

SEQ ID NO: 98938 - RNA, 22 nt, Human
auguacugacuguacuuuuaaa

SEQ ID NO: 98939 - RNA, 22 nt, Human
auggugugugugugugugugug

SEQ ID NO: 98940 - RNA, 22 nt, Human
auguaccgccuuggagaaaugc

SEQ ID NO: 98941 - RNA, 22 nt, Human
auguggaaagcuugucuuagag

SEQ ID NO: 98942 - RNA, 22 nt, Human
auguccccagacugcugugcag

SEQ ID NO: 98943 - RNA, 22 nt, Human
augguaaguuuuuaaaaagcgu

SEQ ID NO: 98944 - RNA, 22 nt, Human
auggugaugaugaugaugauaa

SEQ ID NO: 98945 - RNA, 22 nt, Human
augguguaagacuguauuucuu

SEQ ID NO: 98946 - RNA, 22 nt, Human
auggagcagagcugaugggccu

SEQ ID NO: 98947 - RNA, 22 nt, Human
auggagcgggaggauggaggag

SEQ ID NO: 98948 - RNA, 22 nt, Human
augggcggugcauuugcacagu

SEQ ID NO: 98949 - RNA, 22 nt, Human
auggagggguuguugcuugagu

SEQ ID NO: 98950 - RNA, 22 nt, Human
auggaggagcagaggguuucca

SEQ ID NO: 98951 - RNA, 22 nt, Human
auggauuggguugauggcauac

SEQ ID NO: 98952 - RNA, 19 nt, Human
augguauugcuggguuuuu

SEQ ID NO: 98953 - RNA, 22 nt, Human
augggugggagugaaggggcuc

SEQ ID NO: 98954 - RNA, 22 nt, Human
augggagugacagggccacugg

SEQ ID NO: 98955 - RNA, 20 nt, Human
auggaaacacgcagccccaa

SEQ ID NO: 98956 - RNA, 22 nt, Human
auggccguggccagggucaggg

SEQ ID NO: 98957 - RNA, 22 nt, Human
auggccugaagcuaaccccccu

SEQ ID NO: 98958 - RNA, 22 nt, Human
auggaauuuaaauuuugguguc

SEQ ID NO: 98959 - RNA, 22 nt, Human
auggaaggggagguagggagga

SEQ ID NO: 98960 - RNA, 22 nt, Human
auggaagagacaaugcuaucug

SEQ ID NO: 98961 - RNA, 22 nt, Human
auggaacccgggcgucugcucu

SEQ ID NO: 98962 - RNA, 22 nt, Human
auggaacauuaaucuucaaaug

SEQ ID NO: 98963 - RNA, 22 nt, Human
auggaggaugugcagcaugggc

SEQ ID NO: 98964 - RNA, 22 nt, Human
auggauggaagcagccugaacu

SEQ ID NO: 98965 - RNA, 22 nt, Human
auggacagcucuuaugugggca

SEQ ID NO: 98966 - RNA, 22 nt, Human
augcuuucucuucuauuucuca

SEQ ID NO: 98967 - RNA, 22 nt, Human
augccacuguuuaugucacuua

SEQ ID NO: 98968 - RNA, 22 nt, Human
augccaccucuucugauuccag

SEQ ID NO: 98969 - RNA, 22 nt, Human
augauuauuugaaugaagagga

SEQ ID NO: 98970 - RNA, 22 nt, Human
augauucuaccaaugccaucuu

SEQ ID NO: 98971 - RNA, 22 nt, Human
augauuuguuaacagacuuaau

SEQ ID NO: 98972 - RNA, 22 nt, Human
augcaugaucccgguaugugaa

SEQ ID NO: 98973 - RNA, 14 nt, Human
augauuucugggaa

SEQ ID NO: 98974 - RNA, 22 nt, Human
augcccagaacccccuggaugg

SEQ ID NO: 98975 - RNA, 22 nt, Human
augcugcuccuuuucaggcauu

SEQ ID NO: 98976 - RNA, 22 nt, Human
augcugccuccucuucagccgc

SEQ ID NO: 98977 - RNA, 22 nt, Human
augcaguuagguaauagucuca

SEQ ID NO: 98978 - RNA, 22 nt, Human
augcauaugugugcaagugugu

SEQ ID NO: 98979 - RNA, 22 nt, Human
augaguaaguucugauuagauu

SEQ ID NO: 98980 - RNA, 22 nt, Human
augaguuaaguagcccuucaug

SEQ ID NO: 98981 - RNA, 18 nt, Human
augauaauguuugcauca

SEQ ID NO: 98982 - RNA, 19 nt, Human
augcacgugaaaugcauuu

SEQ ID NO: 98983 - RNA, 19 nt, Human
augcaauguuaucaauaac

SEQ ID NO: 98984 - RNA, 22 nt, Human
augcacaagguagauuauuauu

SEQ ID NO: 98985 - RNA, 22 nt, Human
augaggauuagcaucugcaaau

SEQ ID NO: 98986 - RNA, 22 nt, Human
augaggagucaaggagucggag

SEQ ID NO: 98987 - RNA, 21 nt, Human
augagguggcuacuaaagagu

SEQ ID NO: 98988 - RNA, 22 nt, Human
augaaggauagggcaaaauuuu

SEQ ID NO: 98989 - RNA, 23 nt, Human
augcaacauugccaguaugggca

SEQ ID NO: 98990 - RNA, 22 nt, Human
augcaaaaucuuauuuuuucua

SEQ ID NO: 98991 - RNA, 22 nt, Human
augaaacucuagcuuucagcac

SEQ ID NO: 98992 - RNA, 23 nt, Human
augaaaugauacuuuauucacug

SEQ ID NO: 98993 - RNA, 23 nt, Human
augaacgcacugagaucauaauu

SEQ ID NO: 98994 - RNA, 22 nt, Human
aucuuuuuucacaauuuauuuu

SEQ ID NO: 98995 - RNA, 22 nt, Human
aucuuugauuuuggcuuuuagg

SEQ ID NO: 98996 - RNA, 22 nt, Human
augagugugugguucuaaauga

SEQ ID NO: 98997 - RNA, 22 nt, Human
aucuuguuagaaggcaguaggu

SEQ ID NO: 98998 - RNA, 19 nt, Human
aucuuucagcagcuccccu

SEQ ID NO: 98999 - RNA, 22 nt, Human
aucuuggccuucuccuggagug

SEQ ID NO: 99000 - RNA, 22 nt, Human
augaccauccagaaguccagcu

SEQ ID NO: 99001 - RNA, 22 nt, Human
aucuuggauccuuugccagcuu

SEQ ID NO: 99002 - RNA, 22 nt, Human
aucuugaaacauauaugcauuu

SEQ ID NO: 99003 - RNA, 21 nt, Human
aucugugucauuagguggcag

SEQ ID NO: 99004 - RNA, 22 nt, Human
augaacuaagagucauuagugu

SEQ ID NO: 99005 - RNA, 22 nt, Human
augaacugcaguauaaacuugg

SEQ ID NO: 99006 - RNA, 22 nt, Human
augaagguggacagauuuuuuu

SEQ ID NO: 99007 - RNA, 22 nt, Human
augaaaacggaccagagcuauu

SEQ ID NO: 99008 - RNA, 22 nt, Human
augaauuugaacaccagguugg

SEQ ID NO: 99009 - RNA, 22 nt, Human
aucugugauuuuggcaagauuu

SEQ ID NO: 99010 - RNA, 22 nt, Human
aucuguuccccuaugcucucua

SEQ ID NO: 99011 - RNA, 22 nt, Human
aucugugguacaugacggcugc

SEQ ID NO: 99012 - RNA, 22 nt, Human
aucuucucucucaucaggauca

SEQ ID NO: 99013 - RNA, 22 nt, Human
aucucaaagauaugcugguaaa

SEQ ID NO: 99014 - RNA, 22 nt, Human
aucgaguggugagaacacaaca

SEQ ID NO: 99015 - RNA, 21 nt, Human
aucucaguccugggaaugauu

SEQ ID NO: 99016 - RNA, 22 nt, Human
aucucacuucugucauguggca

SEQ ID NO: 99017 - RNA, 22 nt, Human
aucuuugccuuuaugccucuag

SEQ ID NO: 99018 - RNA, 22 nt, Human
aucuuuguaaguaaucaaagcu

SEQ ID NO: 99019 - RNA, 22 nt, Human
aucguuaugauagagaaagaga

SEQ ID NO: 99020 - RNA, 22 nt, Human
aucggggaaugaccuuuucauu

SEQ ID NO: 99021 - RNA, 22 nt, Human
aucuuagagagucguguuuugu

SEQ ID NO: 99022 - RNA, 22 nt, Human
aucuguucuucaaaauauuaca

SEQ ID NO: 99023 - RNA, 22 nt, Human
aucuucuauguguaggcauuuu

SEQ ID NO: 99024 - RNA, 22 nt, Human
aucuucaaagcacaucguuugu

SEQ ID NO: 99025 - RNA, 22 nt, Human
aucuaauguggcaaguugcuga

SEQ ID NO: 99026 - RNA, 22 nt, Human
aucuuagcucaacucucaccaa

SEQ ID NO: 99027 - RNA, 22 nt, Human
aucuguggguaaggauaagcau

SEQ ID NO: 99028 - RNA, 20 nt, Human
aucuuaucuaucuuuuguuc

SEQ ID NO: 99029 - RNA, 19 nt, Human
auacacguguauacauaca

SEQ ID NO: 99030 - RNA, 22 nt, Human
auacaauugcaauggaagauga

SEQ ID NO: 99031 - RNA, 22 nt, Human
auacacauguuauuguggaagc

SEQ ID NO: 99032 - RNA, 22 nt, Human
auacuaagcucauuacauuuug

SEQ ID NO: 99033 - RNA, 22 nt, Human
auccuucaaaaggaauagcagg

SEQ ID NO: 99034 - RNA, 22 nt, Human
aucuccagcagugcuuuugagc

SEQ ID NO: 99035 - RNA, 22 nt, Human
auccuggcuuuccugauuuacu

SEQ ID NO: 99036 - RNA, 22 nt, Human
aucuccaguuagcaguacugau

SEQ ID NO: 99037 - RNA, 22 nt, Human
auacuuccugcuucccugaucu

SEQ ID NO: 99038 - RNA, 22 nt, Human
auacuagccugggcaucuccua

SEQ ID NO: 99039 - RNA, 22 nt, Human
aucucuguaaaccauaaauuga

SEQ ID NO: 99040 - RNA, 22 nt, Human
aucugacaaccuauugacuuga

SEQ ID NO: 99041 - RNA, 22 nt, Human
aucugcauguggcagguggauu

SEQ ID NO: 99042 - RNA, 22 nt, Human
auccuugacuguagugauauua

SEQ ID NO: 99043 - RNA, 18 nt, Human
auccuuugaucaucuguc

SEQ ID NO: 99044 - RNA, 22 nt, Human
aucgcagaguggaaauugauga

SEQ ID NO: 99045 - RNA, 22 nt, Human
aucuggaacuucucugcauuga

SEQ ID NO: 99046 - RNA, 22 nt, Human
aucugggaaggggaaaaugcug

SEQ ID NO: 99047 - RNA, 23 nt, Human
aucugagccuggucccacccgcu

SEQ ID NO: 99048 - RNA, 22 nt, Human
aucugcugcuccuucuucuugc

SEQ ID NO: 99049 - RNA, 22 nt, Human
aucugcuguaguuggugccagu

SEQ ID NO: 99050 - RNA, 20 nt, Human
aucugguggggaauaacuuc

SEQ ID NO: 99051 - RNA, 22 nt, Human
cagcuucuccauucuucuggcu

SEQ ID NO: 99052 - RNA, 22 nt, Human
cagcuucaugacaaacaguuuu

SEQ ID NO: 99053 - RNA, 22 nt, Human
cagcuguacgugaucuacaugg

SEQ ID NO: 99054 - RNA, 22 nt, Human
caggguuuuaguugcagguuau

SEQ ID NO: 99055 - RNA, 22 nt, Human
caggguuuuauuuggcuuuaaa

SEQ ID NO: 99056 - RNA, 19 nt, Human
caggauuguuuaaagcuuu

SEQ ID NO: 99057 - RNA, 22 nt, Human
caggauauguucaagguuuucu

SEQ ID NO: 99058 - RNA, 22 nt, Human
cagcuacuaccuguagacaaag

SEQ ID NO: 99059 - RNA, 22 nt, Human
cagcuauggaauuggcccagau

SEQ ID NO: 99060 - RNA, 22 nt, Human
caggaggugugucccaccgggu

SEQ ID NO: 99061 - RNA, 22 nt, Human
caggaguggugagguuagcaga

SEQ ID NO: 99062 - RNA, 22 nt, Human
caggcacaaugagcgccaucuu

SEQ ID NO: 99063 - RNA, 22 nt, Human
cagggagcggggagaucucggg

SEQ ID NO: 99064 - RNA, 22 nt, Human
cagggacgugagccaugucagu

SEQ ID NO: 99065 - RNA, 22 nt, Human
cagggaaguauuacauguuucc

SEQ ID NO: 99066 - RNA, 22 nt, Human
caggcgcugacgggaccgggcu

SEQ ID NO: 99067 - RNA, 22 nt, Human
cagcauucuacuuugugaacug

SEQ ID NO: 99068 - RNA, 22 nt, Human
caggaacucggagcccaucucu

SEQ ID NO: 99069 - RNA, 22 nt, Human
cagcauugagcacagaaggaaa

SEQ ID NO: 99070 - RNA, 22 nt, Human
cagcaugcaaguccagaugugg

SEQ ID NO: 99071 - RNA, 22 nt, Human
cagcuccagcccaggcagcucc

SEQ ID NO: 99072 - RNA, 22 nt, Human
cagaggauggaaaugagaacaa

SEQ ID NO: 99073 - RNA, 22 nt, Human
cagcuucaaaggcccugauggu

SEQ ID NO: 99074 - RNA, 22 nt, Human
cagcuucacuuaaaacaugcaa

SEQ ID NO: 99075 - RNA, 22 nt, Human
cagcuauuguucuguauaauga

SEQ ID NO: 99076 - RNA, 22 nt, Human
cagcgguggcaaggugacugug

SEQ ID NO: 99077 - RNA, 22 nt, Human
cagccgcucaugggcccggagc

SEQ ID NO: 99078 - RNA, 22 nt, Human
cagaggagcgaguuggacgcca

SEQ ID NO: 99079 - RNA, 22 nt, Human
cagagcugagucuucaagguug

SEQ ID NO: 99080 - RNA, 22 nt, Human
cagagcagaaaccugggugauu

SEQ ID NO: 99081 - RNA, 22 nt, Human
cauaagaauauuuaguggcagc

SEQ ID NO: 99082 - RNA, 22 nt, Human
cauaaauuuuaccuuguaagug

SEQ ID NO: 99083 - RNA, 22 nt, Human
caguuuuucaaaauuacaugau

SEQ ID NO: 99084 - RNA, 22 nt, Human
caggugcucugauauggggcug

SEQ ID NO: 99085 - RNA, 22 nt, Human
cagguggauggcgagcccugca

SEQ ID NO: 99086 - RNA, 22 nt, Human
cauauacauauacaugcauaca

SEQ ID NO: 99087 - RNA, 22 nt, Human
caggugggauuuugcugcuuga

SEQ ID NO: 99088 - RNA, 22 nt, Human
cauaucuuaaacaucaucucug

SEQ ID NO: 99089 - RNA, 22 nt, Human
cauaucuccagguucugcugga

SEQ ID NO: 99090 - RNA, 22 nt, Human
caguguuuagcacagugcuugg

SEQ ID NO: 99091 - RNA, 22 nt, Human
cagugguaaaugucguuccugu

SEQ ID NO: 99092 - RNA, 22 nt, Human
caggggcuccaggugagccugg

SEQ ID NO: 99093 - RNA, 22 nt, Human
caguguugcuaaugaauucauu

SEQ ID NO: 99094 - RNA, 22 nt, Human
caguggggcuuccagacgcuga

SEQ ID NO: 99095 - RNA, 22 nt, Human
caguggagaccugccugcugga

SEQ ID NO: 99096 - RNA, 22 nt, Human
caguucuguaccaggagaagcu

SEQ ID NO: 99097 - RNA, 22 nt, Human
caguucacggcugguaugaauu

SEQ ID NO: 99098 - RNA, 21 nt, Human
caguucuaagugucaucuuuu

SEQ ID NO: 99099 - RNA, 22 nt, Human
caguuuccagacauuauugaua

SEQ ID NO: 99100 - RNA, 22 nt, Human
cagguuuggaagucacgaagcu

SEQ ID NO: 99101 - RNA, 22 nt, Human
caggcacaagaucggcuagaua

SEQ ID NO: 99102 - RNA, 22 nt, Human
cagguuucuggaugcagcccca

SEQ ID NO: 99103 - RNA, 22 nt, Human
caggauuuaauaagauaguguu

SEQ ID NO: 99104 - RNA, 22 nt, Human
caggcacagcuaagacuggcca

SEQ ID NO: 99105 - RNA, 22 nt, Human
cagucucuugcuucauuaguug

SEQ ID NO: 99106 - RNA, 22 nt, Human
cagucugcuggcuuuuucagca

SEQ ID NO: 99107 - RNA, 22 nt, Human
cagucucuggugaguugacagu

SEQ ID NO: 99108 - RNA, 22 nt, Human
caggagaaauucacauuaguga

SEQ ID NO: 99109 - RNA, 22 nt, Human
caggagagucucugucuguacu

SEQ ID NO: 99110 - RNA, 22 nt, Human
cagguuguucugggcauggagg

SEQ ID NO: 99111 - RNA, 22 nt, Human
cagguguugcaguugaagacug

SEQ ID NO: 99112 - RNA, 22 nt, Human
cagguggccggguaggaggugg

SEQ ID NO: 99113 - RNA, 22 nt, Human
cagguugaagagguuaacgaua

SEQ ID NO: 99114 - RNA, 22 nt, Human
caggaagucugaauucugagag

SEQ ID NO: 99115 - RNA, 22 nt, Human
caggaacagcaccaggagcuag

SEQ ID NO: 99116 - RNA, 19 nt, Human
caggacaguuugccaagaa

SEQ ID NO: 99117 - RNA, 22 nt, Human
caggacacaaaagguggagaag

SEQ ID NO: 99118 - RNA, 22 nt, Human
caggacagaaauaaggaauaua

SEQ ID NO: 99119 - RNA, 22 nt, Human
cacuuauuuuuccuuugugauu

SEQ ID NO: 99120 - RNA, 22 nt, Human
cagaaagugauuugcuauucca

SEQ ID NO: 99121 - RNA, 22 nt, Human
cagaaaguauguucuaguaguu

SEQ ID NO: 99122 - RNA, 22 nt, Human
cagcacaggugugaggccugau

SEQ ID NO: 99123 - RNA, 22 nt, Human
cacuugauugucagaaaaaugg

SEQ ID NO: 99124 - RNA, 22 nt, Human
cagcagccuccccggccgaccu

SEQ ID NO: 99125 - RNA, 22 nt, Human
cagcacuuccuccgugagcccc

SEQ ID NO: 99126 - RNA, 22 nt, Human
cagcagaggagguggcagcacc

SEQ ID NO: 99127 - RNA, 21 nt, Human
cagcagaaaugagaggagaaa

SEQ ID NO: 99128 - RNA, 21 nt, Human
cagcagaugccagggucucug

SEQ ID NO: 99129 - RNA, 22 nt, Human
cagcagaugacuauuggagcug

SEQ ID NO: 99130 - RNA, 22 nt, Human
cagcccugagagaaccaucuau

SEQ ID NO: 99131 - RNA, 22 nt, Human
cagcccuguugcgcuuccggcg

SEQ ID NO: 99132 - RNA, 22 nt, Human
cagcccuggccucuucgcuuuc

SEQ ID NO: 99133 - RNA, 22 nt, Human
cagaaugugacaucaaaggcuc

SEQ ID NO: 99134 - RNA, 22 nt, Human
cagaaguugcuugagagagagc

SEQ ID NO: 99135 - RNA, 23 nt, Human
cagaccccuggcucugacccccu

SEQ ID NO: 99136 - RNA, 22 nt, Human
cacgggcgacgugaucuaggac

SEQ ID NO: 99137 - RNA, 22 nt, Human
caccugcaaauuccagauuucu

SEQ ID NO: 99138 - RNA, 20 nt, Human
caccggguugcugguuucuu

SEQ ID NO: 99139 - RNA, 20 nt, Human
cacccgguccucagcgacuc

SEQ ID NO: 99140 - RNA, 22 nt, Human
caccaucugaauauucuccaag

SEQ ID NO: 99141 - RNA, 22 nt, Human
caccaucagacuucugggcagg

SEQ ID NO: 99142 - RNA, 22 nt, Human
caccagcgacugugaccagcaa

SEQ ID NO: 99143 - RNA, 22 nt, Human
caccaccaguaccaucacacgc

SEQ ID NO: 99144 - RNA, 22 nt, Human
cacugcacuccagccugggcaa

SEQ ID NO: 99145 - RNA, 22 nt, Human
cacucuucucucauuuuccuuu

SEQ ID NO: 99146 - RNA, 23 nt, Human
cacuggugggguuuaaaagaagc

SEQ ID NO: 99147 - RNA, 22 nt, Human
cacugcugaggcccguguuacu

SEQ ID NO: 99148 - RNA, 22 nt, Human
cacugguugccucuuucuguuc

SEQ ID NO: 99149 - RNA, 22 nt, Human
cagagagcguccauccggugcc

SEQ ID NO: 99150 - RNA, 22 nt, Human
cagagaggagcacaaagugaag

SEQ ID NO: 99151 - RNA, 23 nt, Human
cacucgcaggcccagcucucagg

SEQ ID NO: 99152 - RNA, 22 nt, Human
cagacugagaaagugccacagg

SEQ ID NO: 99153 - RNA, 22 nt, Human
cagacugugagcuccuugaggg

SEQ ID NO: 99154 - RNA, 22 nt, Human
cagaccuggaaaacaggcuugc

SEQ ID NO: 99155 - RNA, 22 nt, Human
cagacgguuaaacgauuuugcu

SEQ ID NO: 99156 - RNA, 22 nt, Human
cagacuccugcuccucuggggc

SEQ ID NO: 99157 - RNA, 22 nt, Human
cagaaauuggcagagaagaccu

SEQ ID NO: 99158 - RNA, 22 nt, Human
cagaacugaauaaagccaggau

SEQ ID NO: 99159 - RNA, 22 nt, Human
cagacaaauccuuaugagacug

SEQ ID NO: 99160 - RNA, 22 nt, Human
cagacagagcucacaagucuuu

SEQ ID NO: 99161 - RNA, 22 nt, Human
cagaccagaaggaagccgacaa

SEQ ID NO: 99162 - RNA, 22 nt, Human
cacauuuuccagaagaaucaga

SEQ ID NO: 99163 - RNA, 22 nt, Human
cacauuguuuggucagagcaua

SEQ ID NO: 99164 - RNA, 22 nt, Human
cacaugugugugccuacaugca

SEQ ID NO: 99165 - RNA, 22 nt, Human
cacauaaggacauuauugaaag

SEQ ID NO: 99166 - RNA, 22 nt, Human
cacauaguuuaucuucauuuuc

SEQ ID NO: 99167 - RNA, 22 nt, Human
cagaaaaaaaugcagacuagca

SEQ ID NO: 99168 - RNA, 22 nt, Human
cacuugagagcugaagaagucu

SEQ ID NO: 99169 - RNA, 23 nt, Human
cacaggcagaaaucaagacggua

SEQ ID NO: 99170 - RNA, 22 nt, Human
cacugcguaguggcccgaagcu

SEQ ID NO: 99171 - RNA, 22 nt, Human
cacacguuucuacugcugccaa

SEQ ID NO: 99172 - RNA, 22 nt, Human
cacuuaaaauucagggcuuaua

SEQ ID NO: 99173 - RNA, 22 nt, Human
cacuguugaagauacuuccucu

SEQ ID NO: 99174 - RNA, 22 nt, Human
cacuguugagcaauguacagug

SEQ ID NO: 99175 - RNA, 19 nt, Human
cacuguccuagucgaggcc

SEQ ID NO: 99176 - RNA, 21 nt, Human
cacuguauagcaggagaaaac

SEQ ID NO: 99177 - RNA, 22 nt, Human
cacuauguacauaauagcugcu

SEQ ID NO: 99178 - RNA, 22 nt, Human
cacuauaaugugauuucgcccu

SEQ ID NO: 99179 - RNA, 22 nt, Human
cacugcaaccuccaccucccgg

SEQ ID NO: 99180 - RNA, 22 nt, Human
caauguuuuuccuuccuuaaua

SEQ ID NO: 99181 - RNA, 22 nt, Human
caauggguuuucuauagagugc

SEQ ID NO: 99182 - RNA, 20 nt, Human
caauguuggcaguauagagc

SEQ ID NO: 99183 - RNA, 22 nt, Human
caauggagccaagaggaggaaa

SEQ ID NO: 99184 - RNA, 22 nt, Human
caauggaguccucuuccucuuu

SEQ ID NO: 99185 - RNA, 22 nt, Human
caaaauuguugaugcugcuuug

SEQ ID NO: 99186 - RNA, 22 nt, Human
caaagaaccuucgagacagggc

SEQ ID NO: 99187 - RNA, 22 nt, Human
caaugcacauggacaucaggcu

SEQ ID NO: 99188 - RNA, 22 nt, Human
caagcagauauuuuagucaaga

SEQ ID NO: 99189 - RNA, 22 nt, Human
caaaagcaaagaucuuugauug

SEQ ID NO: 99190 - RNA, 22 nt, Human
cauuuacguaacaguaacgcug

SEQ ID NO: 99191 - RNA, 22 nt, Human
cauuucaaacaguuacagcugc

SEQ ID NO: 99192 - RNA, 22 nt, Human
caucuuuguuuuggauauaauc

SEQ ID NO: 99193 - RNA, 22 nt, Human
cauuggaugagggccucaucga

SEQ ID NO: 99194 - RNA, 22 nt, Human
cauccuauuacugaggcucccc

SEQ ID NO: 99195 - RNA, 22 nt, Human
caucugcagccucugcauuccc

SEQ ID NO: 99196 - RNA, 22 nt, Human
cauuugcuuaucacucuucuuu

SEQ ID NO: 99197 - RNA, 23 nt, Human
cauuugauccucacaauaaaugg

SEQ ID NO: 99198 - RNA, 22 nt, Human
cauuugacaauugggauagauc

SEQ ID NO: 99199 - RNA, 22 nt, Human
caugaugacagcauuccuuuua

SEQ ID NO: 99200 - RNA, 22 nt, Human
caugauaacacuucuguuuaau

SEQ ID NO: 99201 - RNA, 22 nt, Human
caugaccauuuggguuugugcg

SEQ ID NO: 99202 - RNA, 22 nt, Human
caugaagugaaaagguuaauuu

SEQ ID NO: 99203 - RNA, 22 nt, Human
caugaauaauucuuuuucuugg

SEQ ID NO: 99204 - RNA, 22 nt, Human
cauuucuggccuggggagcggg

SEQ ID NO: 99205 - RNA, 22 nt, Human
caucaguaaaguacuuuuaugu

SEQ ID NO: 99206 - RNA, 22 nt, Human
cauugcugugggcauuugcugc

SEQ ID NO: 99207 - RNA, 22 nt, Human
cauugcugccaaggugagcugg

SEQ ID NO: 99208 - RNA, 22 nt, Human
cauugcaaccccaaaaagaaca

SEQ ID NO: 99209 - RNA, 23 nt, Human
cagguuacacuuuaaaauaugca

SEQ ID NO: 99210 - RNA, 20 nt, Human
cauuccaugcaucuuggucc

SEQ ID NO: 99211 - RNA, 21 nt, Human
caucaagaucaauggagggcu

SEQ ID NO: 99212 - RNA, 22 nt, Human
caucaacagucuacuuuuugcc

SEQ ID NO: 99213 - RNA, 22 nt, Human
cagguuuuccuuuuaaaaggaa

SEQ ID NO: 99214 - RNA, 22 nt, Human
caucagucugaaagccagggag

SEQ ID NO: 99215 - RNA, 22 nt, Human
caucaggcugggaacacagauc

SEQ ID NO: 99216 - RNA, 22 nt, Human
caucacggagcaugagaagaca

SEQ ID NO: 99217 - RNA, 22 nt, Human
cagguugaaaguggaggagcua

SEQ ID NO: 99218 - RNA, 22 nt, Human
cagguuuuuauuacaacuuuga

SEQ ID NO: 99219 - RNA, 22 nt, Human
cauguggaaaugcaugcuuuuu

SEQ ID NO: 99220 - RNA, 22 nt, Human
cauguguuucuuaagccaggcc

SEQ ID NO: 99221 - RNA, 22 nt, Human
ccaccacugaggcacaggagcc

SEQ ID NO: 99222 - RNA, 22 nt, Human
ccaccccagaaagggaaggcca

SEQ ID NO: 99223 - RNA, 22 nt, Human
cauuauacaugaagacucaccc

SEQ ID NO: 99224 - RNA, 22 nt, Human
cauuagugaggggcugccugcu

SEQ ID NO: 99225 - RNA, 22 nt, Human
cauucauaagacuuugcucuug

SEQ ID NO: 99226 - RNA, 22 nt, Human
cauuauucaggcuuuggaauuu

SEQ ID NO: 99227 - RNA, 22 nt, Human
ccacucucucccucuguagggg

SEQ ID NO: 99228 - RNA, 22 nt, Human
cauuccaaguauauacaugaua

SEQ ID NO: 99229 - RNA, 22 nt, Human
ccacuauaucaaggauuuuguu

SEQ ID NO: 99230 - RNA, 23 nt, Human
cauguacacacagcuguacagug

SEQ ID NO: 99231 - RNA, 22 nt, Human
caugugacuuagguuuuaucac

SEQ ID NO: 99232 - RNA, 21 nt, Human
caugguaaguacaaagaugac

SEQ ID NO: 99233 - RNA, 22 nt, Human
caugguaaucggggccaucugu

SEQ ID NO: 99234 - RNA, 22 nt, Human
cauguaaguucacagucgaugu

SEQ ID NO: 99235 - RNA, 22 nt, Human
ccacagcauugaaaucuauaau

SEQ ID NO: 99236 - RNA, 22 nt, Human
ccacagugauucacuuuugaag

SEQ ID NO: 99237 - RNA, 19 nt, Human
ccacacacuggucucuggg

SEQ ID NO: 99238 - RNA, 22 nt, Human
caugugguauugugagauccac

SEQ ID NO: 99239 - RNA, 22 nt, Human
caugugcaucagccaauuggag

SEQ ID NO: 99240 - RNA, 21 nt, Human
ccacaucaugucaccuccuag

SEQ ID NO: 99241 - RNA, 22 nt, Human
caugggcucuucuggacugcac

SEQ ID NO: 99242 - RNA, 22 nt, Human
caugcuucccacauuccgauuu

SEQ ID NO: 99243 - RNA, 22 nt, Human
cauggccaaagaauuauauuuu

SEQ ID NO: 99244 - RNA, 22 nt, Human
caugcuggcacugaccagccua

SEQ ID NO: 99245 - RNA, 22 nt, Human
cauuuugguccucauguguagc

SEQ ID NO: 99246 - RNA, 20 nt, Human
caugaugcaaacaguaacgu

SEQ ID NO: 99247 - RNA, 22 nt, Human
caugauguuaucaagcacaaag

SEQ ID NO: 99248 - RNA, 22 nt, Human
cauuuuuccucaggcaauuuga

SEQ ID NO: 99249 - RNA, 22 nt, Human
ccaaagaagcaaugagaauagu

SEQ ID NO: 99250 - RNA, 22 nt, Human
ccaaauuguuguuguuguuguu

SEQ ID NO: 99251 - RNA, 22 nt, Human
ccaaacauuucaaauuuagaga

SEQ ID NO: 99252 - RNA, 22 nt, Human
ccaugugaccugugucaguugc

SEQ ID NO: 99253 - RNA, 23 nt, Human
ccaugugcaggguucagcacuua

SEQ ID NO: 99254 - RNA, 22 nt, Human
ccauuucacaucccugacaugu

SEQ ID NO: 99255 - RNA, 22 nt, Human
ccauggauacuaagguauguga

SEQ ID NO: 99256 - RNA, 22 nt, Human
ccauggaugcucagauguuagc

SEQ ID NO: 99257 - RNA, 22 nt, Human
ccaugggugucuggagcacccu

SEQ ID NO: 99258 - RNA, 22 nt, Human
ccacuguuggcccgaagggguc

SEQ ID NO: 99259 - RNA, 20 nt, Human
ccacuucucugcucugccca

SEQ ID NO: 99260 - RNA, 22 nt, Human
ccacuuucuaaauuggcgauuu

SEQ ID NO: 99261 - RNA, 20 nt, Human
ccagaagagaagaaaaggaa

SEQ ID NO: 99262 - RNA, 19 nt, Human
ccagaagggcaagcaaagg

SEQ ID NO: 99263 - RNA, 22 nt, Human
ccaccuggcagcaggcucggca

SEQ ID NO: 99264 - RNA, 22 nt, Human
ccacccugguuacugugccagg

SEQ ID NO: 99265 - RNA, 19 nt, Human
ccaguuuuuuaauauucaa

SEQ ID NO: 99266 - RNA, 22 nt, Human
ccaguuuuuccagugcuuucug

SEQ ID NO: 99267 - RNA, 22 nt, Human
ccaucuuugcucuuuuauugca

SEQ ID NO: 99268 - RNA, 22 nt, Human
ccaucccugagucacaggaggg

SEQ ID NO: 99269 - RNA, 22 nt, Human
ccaauuuuggaauuauuaggca

SEQ ID NO: 99270 - RNA, 21 nt, Human
ccacaauucuaguuacauaug

SEQ ID NO: 99271 - RNA, 22 nt, Human
ccaguguguuuuucucugacuc

SEQ ID NO: 99272 - RNA, 22 nt, Human
ccaaucaacuguguggcuuucu

SEQ ID NO: 99273 - RNA, 22 nt, Human
ccaaccaguuucuuggcuuuag

SEQ ID NO: 99274 - RNA, 22 nt, Human
ccaaaguauuaaaucuuagcaa

SEQ ID NO: 99275 - RNA, 19 nt, Human
ccaacaguacugaagcacu

SEQ ID NO: 99276 - RNA, 22 nt, Human
ccaagcguguuuaggaaaugcu

SEQ ID NO: 99277 - RNA, 22 nt, Human
ccaaccaguuaucuccuaaggu

SEQ ID NO: 99278 - RNA, 22 nt, Human
ccagggcuggaccagugcuugg

SEQ ID NO: 99279 - RNA, 22 nt, Human
ccagggcggacaaggucuuuga

SEQ ID NO: 99280 - RNA, 22 nt, Human
ccagcugcugcaccgugcaugg

SEQ ID NO: 99281 - RNA, 17 nt, Human
ccagcugcucccucaga

SEQ ID NO: 99282 - RNA, 23 nt, Human
ccagcugugccuggcccaggagc

SEQ ID NO: 99283 - RNA, 22 nt, Human
ccagcugggucccugcuggggc

SEQ ID NO: 99284 - RNA, 22 nt, Human
ccagcuuuucagaaucugccug

SEQ ID NO: 99285 - RNA, 22 nt, Human
ccaggcccugccugugguuccu

SEQ ID NO: 99286 - RNA, 22 nt, Human
cauuuugguaauguucguuugc

SEQ ID NO: 99287 - RNA, 22 nt, Human
cauuuuuuuuccccuccuggua

SEQ ID NO: 99288 - RNA, 22 nt, Human
ccaaaauauuagugcuuaagua

SEQ ID NO: 99289 - RNA, 22 nt, Human
ccaaagaauuuggaaaaucuga

SEQ ID NO: 99290 - RNA, 22 nt, Human
ccaggcuaggaccgauuucccu

SEQ ID NO: 99291 - RNA, 22 nt, Human
cauuucuugugagccgcauccu

SEQ ID NO: 99292 - RNA, 22 nt, Human
cauuuuccucugcugguguuca

SEQ ID NO: 99293 - RNA, 22 nt, Human
cauuuuaucagcacacgucacu

SEQ ID NO: 99294 - RNA, 22 nt, Human
cauuuucugcaagucugcucaa

SEQ ID NO: 99295 - RNA, 22 nt, Human
ccagcaugcucagucuaaauug

SEQ ID NO: 99296 - RNA, 22 nt, Human
ccagcaaguaagucagugucag

SEQ ID NO: 99297 - RNA, 22 nt, Human
ccagcaggagacuagcaacaua

SEQ ID NO: 99298 - RNA, 22 nt, Human
cauuggcacauguauucugggc

SEQ ID NO: 99299 - RNA, 22 nt, Human
cauugcaucuuuuauggguaag

SEQ ID NO: 99300 - RNA, 22 nt, Human
ccagacuggggauuuugccagg

SEQ ID NO: 99301 - RNA, 22 nt, Human
ccagagcacaccguuugccuuc

SEQ ID NO: 99302 - RNA, 22 nt, Human
ccagaggcuuaugcagcugcug

SEQ ID NO: 99303 - RNA, 22 nt, Human
ccagauaaacauuccuuggccu

SEQ ID NO: 99304 - RNA, 22 nt, Human
ccagaugggggcugugggaggg

SEQ ID NO: 99305 - RNA, 22 nt, Human
cauuuacauaacaguaacgcug

SEQ ID NO: 99306 - RNA, 22 nt, Human
cauuuaaccccuugguacugaa

SEQ ID NO: 99307 - RNA, 22 nt, Human
cauugucaaguggccgggucuu

SEQ ID NO: 99308 - RNA, 22 nt, Human
cauuuagagaagauuacaagga

SEQ ID NO: 99309 - RNA, 22 nt, Human
cauuuaucacuugcuaaacaua

SEQ ID NO: 99310 - RNA, 18 nt, Human
cauuguacaaugcuuuau

SEQ ID NO: 99311 - RNA, 22 nt, Human
cauugggcggggaccucggcug

SEQ ID NO: 99312 - RNA, 22 nt, Human
cauuccuucucagguacuggca

SEQ ID NO: 99313 - RNA, 20 nt, Human
cauuccugaggaauucaugu

SEQ ID NO: 99314 - RNA, 22 nt, Human
cauugcaaccauuccaaauggc

SEQ ID NO: 99315 - RNA, 22 nt, Human
ccacuuugagaagcugaugaaa

SEQ ID NO: 99316 - RNA, 19 nt, Human
ccacuucuuugugugugag

SEQ ID NO: 99317 - RNA, 22 nt, Human
ccagaacguuugugcgaggcag

SEQ ID NO: 99318 - RNA, 22 nt, Human
ccagaacgacgggcagaggcgc

SEQ ID NO: 99319 - RNA, 22 nt, Human
cauugcuguuaauugucucuag

SEQ ID NO: 99320 - RNA, 22 nt, Human
ccuugauaugcuucagagaauu

SEQ ID NO: 99321 - RNA, 22 nt, Human
ccuugcuucuagcauucccaug

SEQ ID NO: 99322 - RNA, 22 nt, Human
ccuucugcuggucaucccagug

SEQ ID NO: 99323 - RNA, 22 nt, Human
ccuuccaguucuugguuguaau

SEQ ID NO: 99324 - RNA, 22 nt, Human
ccuucgcuggcaucuccaggua

SEQ ID NO: 99325 - RNA, 22 nt, Human
ccuucaguguuacuagaaagcg

SEQ ID NO: 99326 - RNA, 22 nt, Human
ccuuggaucugcauaucagcua

SEQ ID NO: 99327 - RNA, 17 nt, Human
ccuuucugaucaucuga

SEQ ID NO: 99328 - RNA, 22 nt, Human
ccuuucuaacagauuguggauc

SEQ ID NO: 99329 - RNA, 22 nt, Human
ccgcggcuguaguggaggugga

SEQ ID NO: 99330 - RNA, 22 nt, Human
ccgcucgggugcagagggcaga

SEQ ID NO: 99331 - RNA, 22 nt, Human
ccgcuggccgacuuccgagagc

SEQ ID NO: 99332 - RNA, 22 nt, Human
ccgggcuuccuuagagcaagau

SEQ ID NO: 99333 - RNA, 22 nt, Human
ccgggcggcauccagccguucc

SEQ ID NO: 99334 - RNA, 20 nt, Human
ccuuuuguugcuguuuggau

SEQ ID NO: 99335 - RNA, 22 nt, Human
ccuuugcugggccucuccaucu

SEQ ID NO: 99336 - RNA, 22 nt, Human
ccagagcaccgaaacgagcuuu

SEQ ID NO: 99337 - RNA, 21 nt, Human
ccuggagacaaagacagggug

SEQ ID NO: 99338 - RNA, 22 nt, Human
ccuggaccgacacaggaaggga

SEQ ID NO: 99339 - RNA, 22 nt, Human
ccagacuggggcuccuugaggg

SEQ ID NO: 99340 - RNA, 22 nt, Human
ccgcggcagaggcgggggcgcc

SEQ ID NO: 99341 - RNA, 21 nt, Human
ccgacggcgcagaugccggcc

SEQ ID NO: 99342 - RNA, 19 nt, Human
ccgagcagauugauguuuc

SEQ ID NO: 99343 - RNA, 22 nt, Human
ccgagaucagaguaggauuugg

SEQ ID NO: 99344 - RNA, 22 nt, Human
ccuguguucguccucaccuugc

SEQ ID NO: 99345 - RNA, 22 nt, Human
ccuguuccaacccucccuggcu

SEQ ID NO: 99346 - RNA, 20 nt, Human
ccuguucacugcgcaguuuc

SEQ ID NO: 99347 - RNA, 22 nt, Human
ccuuaauaguguucuaauguuu

SEQ ID NO: 99348 - RNA, 19 nt, Human
ccugugaguuaagcuaugu

SEQ ID NO: 99349 - RNA, 22 nt, Human
ccugugcaugccaggguacacc

SEQ ID NO: 99350 - RNA, 22 nt, Human
ccugugucaucagcuguggcua

SEQ ID NO: 99351 - RNA, 22 nt, Human
ccugggcauuuguuucacaggu

SEQ ID NO: 99352 - RNA, 22 nt, Human
ccuggcccagcuggaagcggga

SEQ ID NO: 99353 - RNA, 22 nt, Human
ccugggccuaaacaaacaagag

SEQ ID NO: 99354 - RNA, 22 nt, Human
ccugggcucgcgcacuucaccc

SEQ ID NO: 99355 - RNA, 22 nt, Human
ccugucugaaggcagggggaug

SEQ ID NO: 99356 - RNA, 22 nt, Human
ccuggguccucacaaucccagg

SEQ ID NO: 99357 - RNA, 22 nt, Human
cgcuuugacuuuagaaggccaa

SEQ ID NO: 99358 - RNA, 22 nt, Human
cgcuuuccaggcacauccucuu

SEQ ID NO: 99359 - RNA, 22 nt, Human
cggagcauacugccuggagaug

SEQ ID NO: 99360 - RNA, 22 nt, Human
cggagagacaagucugcuuugg

SEQ ID NO: 99361 - RNA, 22 nt, Human
cggaggagcugcgcggaggggg

SEQ ID NO: 99362 - RNA, 20 nt, Human
cgggacacucaagcucuggg

SEQ ID NO: 99363 - RNA, 22 nt, Human
cgggagagacagaggaggcgcc

SEQ ID NO: 99364 - RNA, 22 nt, Human
cggcuucucgggucggauuccg

SEQ ID NO: 99365 - RNA, 22 nt, Human
cggagggcccucaggacugggu

SEQ ID NO: 99366 - RNA, 22 nt, Human
cggcugcgguucaccuagggca

SEQ ID NO: 99367 - RNA, 22 nt, Human
cggcugcagcggagcaggcugg

SEQ ID NO: 99368 - RNA, 22 nt, Human
ccucuccuugcuccccuuccuu

SEQ ID NO: 99369 - RNA, 22 nt, Human
ccucuggacuugggacagugag

SEQ ID NO: 99370 - RNA, 22 nt, Human
cgccgugcagucagcccagaag

SEQ ID NO: 99371 - RNA, 22 nt, Human
ccucuccucugugcagacugcc

SEQ ID NO: 99372 - RNA, 22 nt, Human
ccugagccgagcgcucuuucuc

SEQ ID NO: 99373 - RNA, 19 nt, Human
cgcugcucccgcuguggcu

SEQ ID NO: 99374 - RNA, 22 nt, Human
cgccgugucuggucuguacguc

SEQ ID NO: 99375 - RNA, 22 nt, Human
cgcugcugucaucgucuacggu

SEQ ID NO: 99376 - RNA, 22 nt, Human
cgagguacuuacccuggucugu

SEQ ID NO: 99377 - RNA, 22 nt, Human
cgaguaauuggaaauuugcuau

SEQ ID NO: 99378 - RNA, 22 nt, Human
cgagguuuaugaguuuguguuc

SEQ ID NO: 99379 - RNA, 22 nt, Human
cgcacaggcacagacacuggga

SEQ ID NO: 99380 - RNA, 22 nt, Human
cgcccggcugagacgcucgccc

SEQ ID NO: 99381 - RNA, 22 nt, Human
ccuccuuuccuguuuuccugag

SEQ ID NO: 99382 - RNA, 22 nt, Human
ccuccugggccuugcucuguga

SEQ ID NO: 99383 - RNA, 22 nt, Human
ccucccuucccggcauggcucu

SEQ ID NO: 99384 - RNA, 19 nt, Human
ccuccgcauccucaucugu

SEQ ID NO: 99385 - RNA, 22 nt, Human
cgaagcuuuuguuggcgugucg

SEQ ID NO: 99386 - RNA, 22 nt, Human
ccguuugugcugcaggagaucg

SEQ ID NO: 99387 - RNA, 22 nt, Human
ccguaugacuuuuuguuguugu

SEQ ID NO: 99388 - RNA, 22 nt, Human
ccgugcaguuucucacacacau

SEQ ID NO: 99389 - RNA, 22 nt, Human
ccggguucuuguucuaggaugu

SEQ ID NO: 99390 - RNA, 22 nt, Human
ccgguguggguuucucgguagu

SEQ ID NO: 99391 - RNA, 22 nt, Human
cgaaaaagaagugcaccauguu

SEQ ID NO: 99392 - RNA, 22 nt, Human
cgaacggcagagagcccguccc

SEQ ID NO: 99393 - RNA, 22 nt, Human
ccuuuuuagaugugcgaauguu

SEQ ID NO: 99394 - RNA, 22 nt, Human
ccuauuuucaaaauuguuuauc

SEQ ID NO: 99395 - RNA, 22 nt, Human
ccuauauaaaugacauauagga

SEQ ID NO: 99396 - RNA, 22 nt, Human
cgugaagaaguaauagguggug

SEQ ID NO: 99397 - RNA, 17 nt, Human
cgugaggaccaggcagc

SEQ ID NO: 99398 - RNA, 22 nt, Human
ccuuuccuggaaaugguaaguu

SEQ ID NO: 99399 - RNA, 22 nt, Human
ccuuucuggucucugagagacu

SEQ ID NO: 99400 - RNA, 22 nt, Human
cgucauuuguaaaugaucaaga

SEQ ID NO: 99401 - RNA, 22 nt, Human
ccuuugcccugagaaauguucc

SEQ ID NO: 99402 - RNA, 22 nt, Human
ccuuggcuuaccuucugugugg

SEQ ID NO: 99403 - RNA, 22 nt, Human
ccuugguuuagcaauuuuucuu

SEQ ID NO: 99404 - RNA, 22 nt, Human
cgucauguuauggcucauucua

SEQ ID NO: 99405 - RNA, 22 nt, Human
ccuucuuaaacaucauuuuggc

SEQ ID NO: 99406 - RNA, 22 nt, Human
ccuggcauuagaaauuccguca

SEQ ID NO: 99407 - RNA, 22 nt, Human
ccuggccacagggcucugcauu

SEQ ID NO: 99408 - RNA, 22 nt, Human
ccuggcccugcugcuugccagc

SEQ ID NO: 99409 - RNA, 22 nt, Human
cgggagaugaggagagcuucgg

SEQ ID NO: 99410 - RNA, 22 nt, Human
cgauuccugauaagugaauaag

SEQ ID NO: 99411 - RNA, 22 nt, Human
cgcacuugugagcgacagggcu

SEQ ID NO: 99412 - RNA, 22 nt, Human
cgcacuggagcuggaacgaguc

SEQ ID NO: 99413 - RNA, 22 nt, Human
cgagggcuggaggggagacaga

SEQ ID NO: 99414 - RNA, 22 nt, Human
cgagugauuauucuggcugaga

SEQ ID NO: 99415 - RNA, 22 nt, Human
cuacugaagcaugcuuauaugu

SEQ ID NO: 99416 - RNA, 18 nt, Human
cgauguguaugugauuug

SEQ ID NO: 99417 - RNA, 22 nt, Human
cuacuguaguuaaaguuuugua

SEQ ID NO: 99418 - RNA, 22 nt, Human
cuacuucuguggcucuaagaga

SEQ ID NO: 99419 - RNA, 22 nt, Human
cgaggcuugcaaggacgaggag

SEQ ID NO: 99420 - RNA, 22 nt, Human
cuaacuuugucuugguaauugc

SEQ ID NO: 99421 - RNA, 22 nt, Human
cuaaacuucauauguugcuuua

SEQ ID NO: 99422 - RNA, 22 nt, Human
cuaaagacagcaagacaucauc

SEQ ID NO: 99423 - RNA, 22 nt, Human
cuaaaccaauauauuuucuucc

SEQ ID NO: 99424 - RNA, 22 nt, Human
cgugugcguauguguuuguaug

SEQ ID NO: 99425 - RNA, 22 nt, Human
cgugugugugcgugugcgugug

SEQ ID NO: 99426 - RNA, 22 nt, Human
cuccggggacgcagucgccgcc

SEQ ID NO: 99427 - RNA, 22 nt, Human
cuccucccagcccaggcgccac

SEQ ID NO: 99428 - RNA, 22 nt, Human
cggagcgagaaggggaaagccc

SEQ ID NO: 99429 - RNA, 22 nt, Human
cggaggcugcuuucuguugcua

SEQ ID NO: 99430 - RNA, 22 nt, Human
cucuaccugcacaugccugacu

SEQ ID NO: 99431 - RNA, 22 nt, Human
cucugauuuuucuaauacuuca

SEQ ID NO: 99432 - RNA, 22 nt, Human
cucugagcucgugcaguacuuc

SEQ ID NO: 99433 - RNA, 22 nt, Human
cucucugcugucuuucgggaaa

SEQ ID NO: 99434 - RNA, 22 nt, Human
cggccuuugcccgucauucugg

SEQ ID NO: 99435 - RNA, 22 nt, Human
cggccgcgggauggcgggcagc

SEQ ID NO: 99436 - RNA, 22 nt, Human
cuccagcagaaagggcgagugg

SEQ ID NO: 99437 - RNA, 22 nt, Human
cucccucauaugguugcuuauc

SEQ ID NO: 99438 - RNA, 22 nt, Human
cuccgcagcugggguuggcgcu

SEQ ID NO: 99439 - RNA, 22 nt, Human
cuccgccuguccugggcccacg

SEQ ID NO: 99440 - RNA, 22 nt, Human
cucauugacagagcagcucuac

SEQ ID NO: 99441 - RNA, 22 nt, Human
cgcugggugguugauguacagc

SEQ ID NO: 99442 - RNA, 22 nt, Human
cucaucagagcccuccucuggc

SEQ ID NO: 99443 - RNA, 22 nt, Human
cucaugaauggcucuuugugcu

SEQ ID NO: 99444 - RNA, 22 nt, Human
cgcuggagagcaagugcgugca

SEQ ID NO: 99445 - RNA, 22 nt, Human
cucaauuguuuggucucugguu

SEQ ID NO: 99446 - RNA, 22 nt, Human
cucaaagcagacuuuucccuuu

SEQ ID NO: 99447 - RNA, 22 nt, Human
cucaauuuuuauugcuuuuuug

SEQ ID NO: 99448 - RNA, 22 nt, Human
cucagcgagggaaagaggccgc

SEQ ID NO: 99449 - RNA, 22 nt, Human
cgcgggcuugggcaccugcgga

SEQ ID NO: 99450 - RNA, 22 nt, Human
cgcuagggagcacuuggcagug

SEQ ID NO: 99451 - RNA, 22 nt, Human
cuauguuucagauauauauaua

SEQ ID NO: 99452 - RNA, 22 nt, Human
cgccaguggcagcuggaacagg

SEQ ID NO: 99453 - RNA, 22 nt, Human
cgccgccgccugcccgcgcccc

SEQ ID NO: 99454 - RNA, 22 nt, Human
cgcccguacuuugccggcauga

SEQ ID NO: 99455 - RNA, 22 nt, Human
cuagcaggacucagcagauauu

SEQ ID NO: 99456 - RNA, 22 nt, Human
cgcaucggguagaggagcugga

SEQ ID NO: 99457 - RNA, 22 nt, Human
cguauauaaauguauauacaca

SEQ ID NO: 99458 - RNA, 22 nt, Human
cggugcuuuccauaucagcagc

SEQ ID NO: 99459 - RNA, 22 nt, Human
cugagcugcucccgcugcagcg

SEQ ID NO: 99460 - RNA, 22 nt, Human
cgucauacagaugaacaaucuc

SEQ ID NO: 99461 - RNA, 22 nt, Human
cugagcuauauauuaugcauag

SEQ ID NO: 99462 - RNA, 23 nt, Human
cugagggcuggucugaagucugc

SEQ ID NO: 99463 - RNA, 22 nt, Human
cugaguuuuucaaaucugaauu

SEQ ID NO: 99464 - RNA, 22 nt, Human
cgugaucuguuauauagugagc

SEQ ID NO: 99465 - RNA, 22 nt, Human
cgugaaaugcagaaaguugugg

SEQ ID NO: 99466 - RNA, 22 nt, Human
cgugccugguggagagcgaggg

SEQ ID NO: 99467 - RNA, 22 nt, Human
cguggcaguagagcuggaacuu

SEQ ID NO: 99468 - RNA, 22 nt, Human
cguggccacaguggagcugagc

SEQ ID NO: 99469 - RNA, 22 nt, Human
cugauccuauauugguaugagg

SEQ ID NO: 99470 - RNA, 22 nt, Human
cugaucccuuuucauuugcagg

SEQ ID NO: 99471 - RNA, 22 nt, Human
cugauaauaaccauuuuaaaau

SEQ ID NO: 99472 - RNA, 22 nt, Human
cguuuugaguagauagccauau

SEQ ID NO: 99473 - RNA, 22 nt, Human
cugcaguaacuauuuucaauaa

SEQ ID NO: 99474 - RNA, 22 nt, Human
cugcaguguccgcuugcucagc

SEQ ID NO: 99475 - RNA, 22 nt, Human
cuaaacacuauucuggaaauag

SEQ ID NO: 99476 - RNA, 22 nt, Human
cuaaauguuuuaucuuccuggc

SEQ ID NO: 99477 - RNA, 22 nt, Human
cugcagagaccuaggucagguu

SEQ ID NO: 99478 - RNA, 21 nt, Human
cugcacugugauuuaaaaugu

SEQ ID NO: 99479 - RNA, 20 nt, Human
cugauguucgugcuuccugg

SEQ ID NO: 99480 - RNA, 22 nt, Human
cguugguggguguguggucgga

SEQ ID NO: 99481 - RNA, 17 nt, Human
cguuccagaacaaauga

SEQ ID NO: 99482 - RNA, 20 nt, Human
cguugccagcccggcccggg

SEQ ID NO: 99483 - RNA, 22 nt, Human
cugaugugcauguggggggaug

SEQ ID NO: 99484 - RNA, 20 nt, Human
cguguacauuuaugccccug

SEQ ID NO: 99485 - RNA, 22 nt, Human
cgugggggcaacgaccccuccc

SEQ ID NO: 99486 - RNA, 22 nt, Human
cgugcuaccugagcugacagcu

SEQ ID NO: 99487 - RNA, 22 nt, Human
cugcugugcagacagacucucu

SEQ ID NO: 99488 - RNA, 22 nt, Human
cuauuaauggccaggagucaug

SEQ ID NO: 99489 - RNA, 22 nt, Human
cugcuguuuuccccaccaucuc

SEQ ID NO: 99490 - RNA, 22 nt, Human
cugcuguuuucugggcuucuua

SEQ ID NO: 99491 - RNA, 22 nt, Human
cuauaucuguggauaguguaug

SEQ ID NO: 99492 - RNA, 22 nt, Human
cugcugcuugauugcaggaagu

SEQ ID NO: 99493 - RNA, 22 nt, Human
cuaggucagaggacacagcuua

SEQ ID NO: 99494 - RNA, 22 nt, Human
cugcgguucuguuuaguggcga

SEQ ID NO: 99495 - RNA, 22 nt, Human
cugcguugaccagacuccuggg

SEQ ID NO: 99496 - RNA, 22 nt, Human
cuaguuuucacaaaggaagggc

SEQ ID NO: 99497 - RNA, 22 nt, Human
cuaguucugccauucaguguca

SEQ ID NO: 99498 - RNA, 22 nt, Human
cugcucugagaggcucuuccua

SEQ ID NO: 99499 - RNA, 21 nt, Human
cugcugaaggaaccccaugga

SEQ ID NO: 99500 - RNA, 22 nt, Human
cugcugccagcuuaauacucac

SEQ ID NO: 99501 - RNA, 22 nt, Human
cuagaucuggcaggcacaaggu

SEQ ID NO: 99502 - RNA, 22 nt, Human
cuagaucuuuaaaaaucuggaa

SEQ ID NO: 99503 - RNA, 22 nt, Human
cugcggcaccaaccccuucaug

SEQ ID NO: 99504 - RNA, 22 nt, Human
cuacuuucuucuucagaauugu

SEQ ID NO: 99505 - RNA, 22 nt, Human
cuacuucucccuagaucagaaa

SEQ ID NO: 99506 - RNA, 22 nt, Human
cugccuggggaaugugaggauu

SEQ ID NO: 99507 - RNA, 22 nt, Human
cugccugugcgccaagugcacg

SEQ ID NO: 99508 - RNA, 22 nt, Human
cuacauaaauuuaucacagacu

SEQ ID NO: 99509 - RNA, 22 nt, Human
cuaccccaggccccucgaugcc

SEQ ID NO: 99510 - RNA, 22 nt, Human
cuaccagcacgccuuccucuac

SEQ ID NO: 99511 - RNA, 22 nt, Human
cuacugaugccccgcugugccu

SEQ ID NO: 99512 - RNA, 22 nt, Human
cugcccgcaugcaggaaugcug

SEQ ID NO: 99513 - RNA, 22 nt, Human
cugcccugcagcuccacggacu

SEQ ID NO: 99514 - RNA, 22 nt, Human
cuaauugcuggcugcuggcaga

SEQ ID NO: 99515 - RNA, 22 nt, Human
cuuaggcgugugcgggugaggc

SEQ ID NO: 99516 - RNA, 22 nt, Human
cuuacauuuguuuaguguuucc

SEQ ID NO: 99517 - RNA, 22 nt, Human
cugagggagcugcuggccuugg

SEQ ID NO: 99518 - RNA, 22 nt, Human
cugagggagacagugcggacua

SEQ ID NO: 99519 - RNA, 22 nt, Human
cuuauuugcccauguuucuuua

SEQ ID NO: 99520 - RNA, 22 nt, Human
cuuauucuucuggacuuggagu

SEQ ID NO: 99521 - RNA, 22 nt, Human
cuguuuggaugccauggucaag

SEQ ID NO: 99522 - RNA, 22 nt, Human
cugagcaucaaaugggcaauua

SEQ ID NO: 99523 - RNA, 19 nt, Human
cugagcagggaaaaacccu

SEQ ID NO: 99524 - RNA, 22 nt, Human
cugucucugauaagcucgaggg

SEQ ID NO: 99525 - RNA, 22 nt, Human
cuuacaauuuucuuggacuuuu

SEQ ID NO: 99526 - RNA, 22 nt, Human
cuguuuuugccugugacaaaaa

SEQ ID NO: 99527 - RNA, 22 nt, Human
cuguuucucugccugcacacau

SEQ ID NO: 99528 - RNA, 22 nt, Human
cuguuguguuauuugcagugca

SEQ ID NO: 99529 - RNA, 20 nt, Human
cugaccagcagccugucucc

SEQ ID NO: 99530 - RNA, 22 nt, Human
cugaagaaagaaaauggccauc

SEQ ID NO: 99531 - RNA, 22 nt, Human
cugaagcugggcacuuccuuuu

SEQ ID NO: 99532 - RNA, 20 nt, Human
cugaaaggaaagaaauuuuu

SEQ ID NO: 99533 - RNA, 22 nt, Human
cuguuccuccaccucaacaaac

SEQ ID NO: 99534 - RNA, 22 nt, Human
cuguucagugcauauguauuga

SEQ ID NO: 99535 - RNA, 22 nt, Human
cuguuaucaggaguuuucacgg

SEQ ID NO: 99536 - RNA, 22 nt, Human
cuguuaauugugaauuuuacau

SEQ ID NO: 99537 - RNA, 22 nt, Human
cugugggcucucaugggaccug

SEQ ID NO: 99538 - RNA, 22 nt, Human
cugaaacuauggggaggggagc

SEQ ID NO: 99539 - RNA, 22 nt, Human
cugugcuguuagcgauuuuuaa

SEQ ID NO: 99540 - RNA, 19 nt, Human
cugaaacacagagagggcu

SEQ ID NO: 99541 - RNA, 21 nt, Human
cugugggaaggccugaggucu

SEQ ID NO: 99542 - RNA, 22 nt, Human
cugugcauguucucuagcugau

SEQ ID NO: 99543 - RNA, 22 nt, Human
cugugccagucagggggcaagu

SEQ ID NO: 99544 - RNA, 22 nt, Human
cucuuucauucuguccuuguuu

SEQ ID NO: 99545 - RNA, 22 nt, Human
cucuguggucugaagccuguga

SEQ ID NO: 99546 - RNA, 22 nt, Human
cucugugggcauauuuguaaaa

SEQ ID NO: 99547 - RNA, 22 nt, Human
cuguccuguggccugcuccggu

SEQ ID NO: 99548 - RNA, 22 nt, Human
cugucagcaaaucagugucugg

SEQ ID NO: 99549 - RNA, 22 nt, Human
cuggugagaccgacuuccacuu

SEQ ID NO: 99550 - RNA, 22 nt, Human
cugguuuauuucauaguuuguu

SEQ ID NO: 99551 - RNA, 22 nt, Human
cugguuacuucagaucaguagu

SEQ ID NO: 99552 - RNA, 22 nt, Human
cuggugcuguagccugauugag

SEQ ID NO: 99553 - RNA, 22 nt, Human
cuggugggucacgugugggugg

SEQ ID NO: 99554 - RNA, 22 nt, Human
cugggggacagagagaggcggu

SEQ ID NO: 99555 - RNA, 22 nt, Human
cugggguaucugccacaacucu

SEQ ID NO: 99556 - RNA, 22 nt, Human
cugggaguugacgaggcuugua

SEQ ID NO: 99557 - RNA, 22 nt, Human
cuggucuugguauucgcagaag

SEQ ID NO: 99558 - RNA, 22 nt, Human
cuggguuuggcugugcuugaau

SEQ ID NO: 99559 - RNA, 22 nt, Human
cuggguaaauauguauuccuga

SEQ ID NO: 99560 - RNA, 22 nt, Human
cuggguaaggaaacuccuuugu

SEQ ID NO: 99561 - RNA, 22 nt, Human
cugggugugugugaacagagau

SEQ ID NO: 99562 - RNA, 22 nt, Human
cuggcgauugcgagagucgccu

SEQ ID NO: 99563 - RNA, 20 nt, Human
cucauugcuuucauuuucuu

SEQ ID NO: 99564 - RNA, 22 nt, Human
cugggagggguagccaauccua

SEQ ID NO: 99565 - RNA, 22 nt, Human
cuggcuaaugugcugauagcca

SEQ ID NO: 99566 - RNA, 22 nt, Human
cucagcaauuaccugugucucu

SEQ ID NO: 99567 - RNA, 22 nt, Human
cucagcacauuccuaagggaug

SEQ ID NO: 99568 - RNA, 22 nt, Human
cucagcgggagucuggccgaac

SEQ ID NO: 99569 - RNA, 22 nt, Human
cucacugugggcuaugaauggg

SEQ ID NO: 99570 - RNA, 22 nt, Human
cucaugagucugucagagucau

SEQ ID NO: 99571 - RNA, 22 nt, Human
cucagugacuuccugcucaauu

SEQ ID NO: 99572 - RNA, 22 nt, Human
cuggcaguguccagcucgugau

SEQ ID NO: 99573 - RNA, 22 nt, Human
cucaguauugacgaaagagauu

SEQ ID NO: 99574 - RNA, 22 nt, Human
cugcuugguuuggagggcccac

SEQ ID NO: 99575 - RNA, 22 nt, Human
cucagcugcuuuguuuugcuuu

SEQ ID NO: 99576 - RNA, 22 nt, Human
cugcuucacccugccugagaac

SEQ ID NO: 99577 - RNA, 22 nt, Human
cucaaaauccauaaaaucaggu

SEQ ID NO: 99578 - RNA, 22 nt, Human
cucacgguuugcaucaagagug

SEQ ID NO: 99579 - RNA, 22 nt, Human
cucaagugacucagccugguug

SEQ ID NO: 99580 - RNA, 22 nt, Human
gaaaaucaggauggaugugagg

SEQ ID NO: 99581 - RNA, 22 nt, Human
gaaaaucaugaaaguguguugu

SEQ ID NO: 99582 - RNA, 22 nt, Human
cugguuuuccaauguuuugacu

SEQ ID NO: 99583 - RNA, 22 nt, Human
cuguagaugucagguuaaugag

SEQ ID NO: 99584 - RNA, 22 nt, Human
cuguauggaggaggugcuagcc

SEQ ID NO: 99585 - RNA, 22 nt, Human
gaaaaggaggggaggcagaugg

SEQ ID NO: 99586 - RNA, 22 nt, Human
gaaaagcucuuuagaagagguu

SEQ ID NO: 99587 - RNA, 22 nt, Human
cuggucaauaaucauguaguac

SEQ ID NO: 99588 - RNA, 22 nt, Human
cuggguguuccuuucauuuuaa

SEQ ID NO: 99589 - RNA, 22 nt, Human
cugguacuggaggaguucagag

SEQ ID NO: 99590 - RNA, 22 nt, Human
cuggugaagccuucggagaccc

SEQ ID NO: 99591 - RNA, 22 nt, Human
gaaaacccuguauguagcguuu

SEQ ID NO: 99592 - RNA, 22 nt, Human
gaaccauuuaauggagaugcuc

SEQ ID NO: 99593 - RNA, 22 nt, Human
cuguuacggaggcuuucuaguu

SEQ ID NO: 99594 - RNA, 22 nt, Human
cuguguuguuugaguagcuuga

SEQ ID NO: 99595 - RNA, 22 nt, Human
gaagaggaagaggagccagagc

SEQ ID NO: 99596 - RNA, 22 nt, Human
gaacuuaauauacaaucaguuc

SEQ ID NO: 99597 - RNA, 22 nt, Human
gaacuugagugugcuauuucuu

SEQ ID NO: 99598 - RNA, 22 nt, Human
cuguuguucacuuugcugguga

SEQ ID NO: 99599 - RNA, 19 nt, Human
gaacuaaggggagcucugg

SEQ ID NO: 99600 - RNA, 22 nt, Human
gaacugggguagggguagcuuu

SEQ ID NO: 99601 - RNA, 20 nt, Human
gaacauaaauaacucuuuac

SEQ ID NO: 99602 - RNA, 22 nt, Human
gaacaguuucccuguagaaaau

SEQ ID NO: 99603 - RNA, 22 nt, Human
cugugguuucuaugggccuuga

SEQ ID NO: 99604 - RNA, 22 nt, Human
cugugguuuuauuuauuugaag

SEQ ID NO: 99605 - RNA, 22 nt, Human
cuguggguggcugugccccagg

SEQ ID NO: 99606 - RNA, 22 nt, Human
gaaagaggcugucagggaaugg

SEQ ID NO: 99607 - RNA, 22 nt, Human
gaaaugaaacacacaugcagcu

SEQ ID NO: 99608 - RNA, 22 nt, Human
cuguccugauggugccacuggu

SEQ ID NO: 99609 - RNA, 22 nt, Human
cugggguaucuggugucuuggu

SEQ ID NO: 99610 - RNA, 22 nt, Human
cugggugagcuggccagagggu

SEQ ID NO: 99611 - RNA, 22 nt, Human
cugggguggugcaggccucaug

SEQ ID NO: 99612 - RNA, 22 nt, Human
cuggguguggugggugcugccg

SEQ ID NO: 99613 - RNA, 22 nt, Human
cugggugggcacccagccuggg

SEQ ID NO: 99614 - RNA, 22 nt, Human
gaaaaauggguuguuugaagau

SEQ ID NO: 99615 - RNA, 22 nt, Human
gaaaaaccacaauugguauuuu

SEQ ID NO: 99616 - RNA, 22 nt, Human
gaaaaacucagugggggucuuu

SEQ ID NO: 99617 - RNA, 22 nt, Human
gaaaaagagaaggaguucagua

SEQ ID NO: 99618 - RNA, 22 nt, Human
cuuuuugccuugaagugaccuc

SEQ ID NO: 99619 - RNA, 22 nt, Human
cugggcaugggaacuucaaggc

SEQ ID NO: 99620 - RNA, 22 nt, Human
cuuuuugcccuugggcuuccug

SEQ ID NO: 99621 - RNA, 22 nt, Human
cuuuuucuuaucuuuuucuaug

SEQ ID NO: 99622 - RNA, 22 nt, Human
cugggaugagcuguuuccuggu

SEQ ID NO: 99623 - RNA, 22 nt, Human
cugggaggagacaggggauggg

SEQ ID NO: 99624 - RNA, 22 nt, Human
cugggagaugacucagagcagg

SEQ ID NO: 99625 - RNA, 19 nt, Human
cugggacaaugaaagcauc

SEQ ID NO: 99626 - RNA, 22 nt, Human
cugggagaggaaccucgagggu

SEQ ID NO: 99627 - RNA, 22 nt, Human
cuggauagaccccuuauugcau

SEQ ID NO: 99628 - RNA, 20 nt, Human
cuggaguguagcaguggcug

SEQ ID NO: 99629 - RNA, 22 nt, Human
cuggaucgccccgaugugcccc

SEQ ID NO: 99630 - RNA, 22 nt, Human
cuggagucagcaaggacgaggc

SEQ ID NO: 99631 - RNA, 20 nt, Human
cuuauuuuggagaacuuuuc

SEQ ID NO: 99632 - RNA, 22 nt, Human
cugaugcucuggauguagucaa

SEQ ID NO: 99633 - RNA, 23 nt, Human
cuucagaccucagaaggucuguu

SEQ ID NO: 99634 - RNA, 22 nt, Human
cuucagagugacucagcaucuu

SEQ ID NO: 99635 - RNA, 22 nt, Human
cugaucuuaaguaacauuauuu

SEQ ID NO: 99636 - RNA, 22 nt, Human
cugauggagagugugauuuggg

SEQ ID NO: 99637 - RNA, 22 nt, Human
cuggcuuucauggcgcaguuga

SEQ ID NO: 99638 - RNA, 22 nt, Human
cuggcuguguguuugugcaucu

SEQ ID NO: 99639 - RNA, 21 nt, Human
cuggcucgccaugguucuuuu

SEQ ID NO: 99640 - RNA, 21 nt, Human
cugggaacccgaccaaggccu

SEQ ID NO: 99641 - RNA, 22 nt, Human
cugggaaggaagggaaaaacag

SEQ ID NO: 99642 - RNA, 22 nt, Human
cuuuucuuuucuucucuuccca

SEQ ID NO: 99643 - RNA, 22 nt, Human
cuggcggugaucccgauggugu

SEQ ID NO: 99644 - RNA, 22 nt, Human
cuuuugcaauagugacacugau

SEQ ID NO: 99645 - RNA, 22 nt, Human
cuggcggcccgaggcagaggag

SEQ ID NO: 99646 - RNA, 22 nt, Human
cuuuuaccuuaauuucgacaca

SEQ ID NO: 99647 - RNA, 22 nt, Human
cuggcgagcugggccuggggga

SEQ ID NO: 99648 - RNA, 22 nt, Human
cuggccuuaucacaaagcuaga

SEQ ID NO: 99649 - RNA, 22 nt, Human
cuuuuccuccaggaagccaagc

SEQ ID NO: 99650 - RNA, 22 nt, Human
gacaagaugacaucauggcuuc

SEQ ID NO: 99651 - RNA, 22 nt, Human
cuuguaccuuuguguuuauuuu

SEQ ID NO: 99652 - RNA, 20 nt, Human
gacaagccacagcucccaga

SEQ ID NO: 99653 - RNA, 22 nt, Human
gacacaacuauccaguauggga

SEQ ID NO: 99654 - RNA, 22 nt, Human
gacaccuucuacugacuaugga

SEQ ID NO: 99655 - RNA, 22 nt, Human
cuugggguuugggggcuugacc

SEQ ID NO: 99656 - RNA, 22 nt, Human
gaauggcagaaugaagcagugu

SEQ ID NO: 99657 - RNA, 22 nt, Human
cuugccaguguugcagaagcuc

SEQ ID NO: 99658 - RNA, 22 nt, Human
cuugccagggacucagucaggg

SEQ ID NO: 99659 - RNA, 22 nt, Human
gaaugguuauaugauguuuaaa

SEQ ID NO: 99660 - RNA, 22 nt, Human
gaauuccaggugagagaaggua

SEQ ID NO: 99661 - RNA, 22 nt, Human
gaauuagguaauagaacuagua

SEQ ID NO: 99662 - RNA, 22 nt, Human
gaauuacuccaguguguggguu

SEQ ID NO: 99663 - RNA, 22 nt, Human
gaauguuugagugccaugugac

SEQ ID NO: 99664 - RNA, 22 nt, Human
cuuggggcuugcuguuguagcc

SEQ ID NO: 99665 - RNA, 16 nt, Human
gaauuccauugcucug

SEQ ID NO: 99666 - RNA, 22 nt, Human
gaagucaggaaggagauugaag

SEQ ID NO: 99667 - RNA, 22 nt, Human
cuucucuuggguguggugucuu

SEQ ID NO: 99668 - RNA, 22 nt, Human
gaagguuuuguuugcaaaucau

SEQ ID NO: 99669 - RNA, 22 nt, Human
gaaguaaaacaguaacuuuguu

SEQ ID NO: 99670 - RNA, 22 nt, Human
cuucucuuccuucucauccuca

SEQ ID NO: 99671 - RNA, 22 nt, Human
cuucuagucaaaauggauaagc

SEQ ID NO: 99672 - RNA, 22 nt, Human
gaauaagaauccacuucuggca

SEQ ID NO: 99673 - RNA, 22 nt, Human
gaagugagcauccuaguuaacc

SEQ ID NO: 99674 - RNA, 20 nt, Human
cuugaguucagagcugucau

SEQ ID NO: 99675 - RNA, 22 nt, Human
gaaggugcugaaacagaaauuu

SEQ ID NO: 99676 - RNA, 22 nt, Human
gaagggccaggggcaggcugga

SEQ ID NO: 99677 - RNA, 22 nt, Human
gaagaugacaucggaucugucu

SEQ ID NO: 99678 - RNA, 22 nt, Human
gaagauuauuacucauugcagg

SEQ ID NO: 99679 - RNA, 22 nt, Human
gaagcaagagggaucaggaucu

SEQ ID NO: 99680 - RNA, 22 nt, Human
cuuauuagaaagaaaagacaug

SEQ ID NO: 99681 - RNA, 22 nt, Human
gaagcaccuggacggugccugg

SEQ ID NO: 99682 - RNA, 18 nt, Human
gaagcaacaguucugagu

SEQ ID NO: 99683 - RNA, 22 nt, Human
gaagauucugacccugacucag

SEQ ID NO: 99684 - RNA, 22 nt, Human
gagaccuuaagagaugucagcu

SEQ ID NO: 99685 - RNA, 22 nt, Human
gagagaaggaagugaauuuccc

SEQ ID NO: 99686 - RNA, 22 nt, Human
gagacugcguggcucugacaca

SEQ ID NO: 99687 - RNA, 22 nt, Human
gagaacaaggaagagucggcag

SEQ ID NO: 99688 - RNA, 22 nt, Human
gagaacagauaugaugacuuca

SEQ ID NO: 99689 - RNA, 22 nt, Human
gagaaggagcagaaaaucuccu

SEQ ID NO: 99690 - RNA, 22 nt, Human
gagaaagggagaaaaagaucuu

SEQ ID NO: 99691 - RNA, 16 nt, Human
gacuuucuacgacucu

SEQ ID NO: 99692 - RNA, 22 nt, Human
gagaaaacauacuuaguguccu

SEQ ID NO: 99693 - RNA, 22 nt, Human
cuuuuucaugggugaugagugg

SEQ ID NO: 99694 - RNA, 22 nt, Human
gacuggaaucucugcuuguuaa

SEQ ID NO: 99695 - RNA, 22 nt, Human
gacugacagugguacuguaauu

SEQ ID NO: 99696 - RNA, 18 nt, Human
gacugccuugaacuauug

SEQ ID NO: 99697 - RNA, 22 nt, Human
cuuuuuuucuccauauuucugg

SEQ ID NO: 99698 - RNA, 22 nt, Human
gacuugauugguuugucaaguu

SEQ ID NO: 99699 - RNA, 22 nt, Human
gacuugcucaaaucagauuuua

SEQ ID NO: 99700 - RNA, 21 nt, Human
cuuugccuccagcagccgcag

SEQ ID NO: 99701 - RNA, 21 nt, Human
cuuuggcaagggagaagucac

SEQ ID NO: 99702 - RNA, 22 nt, Human
gaccuuucccuaucucacucuc

SEQ ID NO: 99703 - RNA, 22 nt, Human
gaccuuguucuggcauucucag

SEQ ID NO: 99704 - RNA, 22 nt, Human
gaccugcucagcccuguguguu

SEQ ID NO: 99705 - RNA, 23 nt, Human
gaccucuuccuccagccucugaa

SEQ ID NO: 99706 - RNA, 22 nt, Human
gaccuccauucugucaugacug

SEQ ID NO: 99707 - RNA, 22 nt, Human
gacaucuguccauggcacugga

SEQ ID NO: 99708 - RNA, 22 nt, Human
gaccgggcucugcugacggucu

SEQ ID NO: 99709 - RNA, 22 nt, Human
gacagaccucugcugacuggag

SEQ ID NO: 99710 - RNA, 22 nt, Human
gacagcguaucaauugaacaua

SEQ ID NO: 99711 - RNA, 22 nt, Human
gacacugccaagugccccgaga

SEQ ID NO: 99712 - RNA, 22 nt, Human
gacagcaggaugugaggggaug

SEQ ID NO: 99713 - RNA, 22 nt, Human
cuuucugauguaaggaacuagg

SEQ ID NO: 99714 - RNA, 22 nt, Human
gacagguagacaugaauauuaa

SEQ ID NO: 99715 - RNA, 22 nt, Human
cuuucuuuuugguuucccccca

SEQ ID NO: 99716 - RNA, 22 nt, Human
gacagcguguuuugcaugaaca

SEQ ID NO: 99717 - RNA, 22 nt, Human
gagaagguggaccugaaggagc

SEQ ID NO: 99718 - RNA, 22 nt, Human
gagaaguagcgucuucccgggg

SEQ ID NO: 99719 - RNA, 22 nt, Human
gagaaguaggaauaucaggagu

SEQ ID NO: 99720 - RNA, 22 nt, Human
gagaagugggggucugggauga

SEQ ID NO: 99721 - RNA, 22 nt, Human
gagaaugagucagagcuggcug

SEQ ID NO: 99722 - RNA, 22 nt, Human
gauccagauauuugggcuggua

SEQ ID NO: 99723 - RNA, 22 nt, Human
gaucauauccagucaccacuau

SEQ ID NO: 99724 - RNA, 22 nt, Human
gaucacuuugauuagauguccu

SEQ ID NO: 99725 - RNA, 22 nt, Human
gauauggaaacuugauguugug

SEQ ID NO: 99726 - RNA, 22 nt, Human
gacuuguguagcuucagaauuu

SEQ ID NO: 99727 - RNA, 22 nt, Human
gagaaaaauuucuuugcugcac

SEQ ID NO: 99728 - RNA, 22 nt, Human
gagaaauagauucaugguagau

SEQ ID NO: 99729 - RNA, 22 nt, Human
gauauucauaggcagguauuua

SEQ ID NO: 99730 - RNA, 22 nt, Human
gagaaagauuguccuucagggg

SEQ ID NO: 99731 - RNA, 20 nt, Human
gacuucaauuucuaucuuuu

SEQ ID NO: 99732 - RNA, 22 nt, Human
gauacuugaggagaucaccaca

SEQ ID NO: 99733 - RNA, 22 nt, Human
gauaccugccaagcugcacuca

SEQ ID NO: 99734 - RNA, 22 nt, Human
gacuucaucagagcguacuguu

SEQ ID NO: 99735 - RNA, 22 nt, Human
gauacaugucacaaguugugca

SEQ ID NO: 99736 - RNA, 22 nt, Human
gauaaugcuuuggucagacaug

SEQ ID NO: 99737 - RNA, 22 nt, Human
gauaagugauucugauucacau

SEQ ID NO: 99738 - RNA, 22 nt, Human
gauaaauaguguuuggggacau

SEQ ID NO: 99739 - RNA, 22 nt, Human
gacuuaaccacggucacauggu

SEQ ID NO: 99740 - RNA, 22 nt, Human
gacuggguaaagcuuauccaaa

SEQ ID NO: 99741 - RNA, 22 nt, Human
gacuguuggcagauguuugagu

SEQ ID NO: 99742 - RNA, 22 nt, Human
gagugguaaaguguacugaaua

SEQ ID NO: 99743 - RNA, 22 nt, Human
gacuaaggaauagcuaguuguu

SEQ ID NO: 99744 - RNA, 22 nt, Human
gacuacauuugguauugacgag

SEQ ID NO: 99745 - RNA, 22 nt, Human
gaguugauggccauugaguuga

SEQ ID NO: 99746 - RNA, 22 nt, Human
gaguuucacguagaucaggguc

SEQ ID NO: 99747 - RNA, 22 nt, Human
gaguuggggcugcguguuucca

SEQ ID NO: 99748 - RNA, 22 nt, Human
gacuggucuuuugugauggaug

SEQ ID NO: 99749 - RNA, 22 nt, Human
gaguauuuaccacuaaaugguu

SEQ ID NO: 99750 - RNA, 20 nt, Human
gacgaacuagaacaguggua

SEQ ID NO: 99751 - RNA, 22 nt, Human
gagucaauucaccuuggugcuu

SEQ ID NO: 99752 - RNA, 22 nt, Human
gaccugguggccauugucccag

SEQ ID NO: 99753 - RNA, 22 nt, Human
gagucuuuuaagaugucuuacu

SEQ ID NO: 99754 - RNA, 22 nt, Human
gagucuacaugcaggcaauugu

SEQ ID NO: 99755 - RNA, 22 nt, Human
gagugaucuguaggcagcaugg

SEQ ID NO: 99756 - RNA, 22 nt, Human
gaguggcaaagagaacaaagau

SEQ ID NO: 99757 - RNA, 22 nt, Human
gacggagugcgcuugcuguuca

SEQ ID NO: 99758 - RNA, 22 nt, Human
gacgacgggccccguggccacc

SEQ ID NO: 99759 - RNA, 22 nt, Human
gaguagaacagauagucaagaa

SEQ ID NO: 99760 - RNA, 22 nt, Human
gaguagcaguucauccacaagc

SEQ ID NO: 99761 - RNA, 22 nt, Human
gacccugaggauucccugcuga

SEQ ID NO: 99762 - RNA, 22 nt, Human
gacccuuugacuugugacauua

SEQ ID NO: 99763 - RNA, 22 nt, Human
gaguauuagaagaguaguuauu

SEQ ID NO: 99764 - RNA, 22 nt, Human
gaguagccucagucugcaagug

SEQ ID NO: 99765 - RNA, 22 nt, Human
gacccggauguuguacucgagg

SEQ ID NO: 99766 - RNA, 20 nt, Human
gacaugagggagcaaagagc

SEQ ID NO: 99767 - RNA, 22 nt, Human
gacauuuauuggauuuuacgag

SEQ ID NO: 99768 - RNA, 22 nt, Human
gacauugaauugaauccagauu

SEQ ID NO: 99769 - RNA, 22 nt, Human
gacagugucccucuggggugga

SEQ ID NO: 99770 - RNA, 22 nt, Human
gaccaggagauuugagcuaggc

SEQ ID NO: 99771 - RNA, 22 nt, Human
gaggguuucagugggacggguu

SEQ ID NO: 99772 - RNA, 22 nt, Human
gacacucuuaauccuaucccug

SEQ ID NO: 99773 - RNA, 22 nt, Human
gacacucauauuaagccuauuu

SEQ ID NO: 99774 - RNA, 22 nt, Human
gaggucggaagugaggguaacu

SEQ ID NO: 99775 - RNA, 22 nt, Human
gaggucagugugggggcaaggg

SEQ ID NO: 99776 - RNA, 22 nt, Human
gacacccgccggcgccugccuc

SEQ ID NO: 99777 - RNA, 22 nt, Human
gacaauuucucaauauagaaac

SEQ ID NO: 99778 - RNA, 22 nt, Human
gaggguggagccuccuggaagu

SEQ ID NO: 99779 - RNA, 22 nt, Human
gagggggcggccccugugggca

SEQ ID NO: 99780 - RNA, 22 nt, Human
gacaguggagccacguugggag

SEQ ID NO: 99781 - RNA, 22 nt, Human
gagguuauucuucuaucaguau

SEQ ID NO: 99782 - RNA, 22 nt, Human
gacaggaauuaucuaaaguaga

SEQ ID NO: 99783 - RNA, 22 nt, Human
gacaggcagagaggaagagaga

SEQ ID NO: 99784 - RNA, 22 nt, Human
gacagggacacagccagugagg

SEQ ID NO: 99785 - RNA, 22 nt, Human
gaggggcugggguugacuccaa

SEQ ID NO: 99786 - RNA, 22 nt, Human
gaggggcuccagguguugagga

SEQ ID NO: 99787 - RNA, 22 nt, Human
gaggggaaggguguucaauggg

SEQ ID NO: 99788 - RNA, 22 nt, Human
gaggggaauguuccugagcugg

SEQ ID NO: 99789 - RNA, 22 nt, Human
gaggggcgaggacgcugaagua

SEQ ID NO: 99790 - RNA, 22 nt, Human
gaggggcggggcgggaggagag

SEQ ID NO: 99791 - RNA, 20 nt, Human
gaauucugaagauaauuugg

SEQ ID NO: 99792 - RNA, 22 nt, Human
gagggcucaacuacuacuaggc

SEQ ID NO: 99793 - RNA, 22 nt, Human
gaggggaagaacaauuuaauuu

SEQ ID NO: 99794 - RNA, 22 nt, Human
gaggggaacaggcauucuuaag

SEQ ID NO: 99795 - RNA, 22 nt, Human
gaauuacagaguuguuaaguca

SEQ ID NO: 99796 - RNA, 22 nt, Human
gaaugguuagugaacaaauuug

SEQ ID NO: 99797 - RNA, 22 nt, Human
gaaugggaauuauggugggacu

SEQ ID NO: 99798 - RNA, 22 nt, Human
gagggaggugacaaggacauag

SEQ ID NO: 99799 - RNA, 22 nt, Human
gagggagugggcccgugggcac

SEQ ID NO: 99800 - RNA, 22 nt, Human
gaagucugacucuuuguaagcu

SEQ ID NO: 99801 - RNA, 22 nt, Human
gaaguggggaggagaagacuga

SEQ ID NO: 99802 - RNA, 22 nt, Human
gaaguucuuagucucauuugca

SEQ ID NO: 99803 - RNA, 22 nt, Human
gaagucagaucuuuugacuccc

SEQ ID NO: 99804 - RNA, 22 nt, Human
gaaguauuucugaguugcccag

SEQ ID NO: 99805 - RNA, 22 nt, Human
gaggaucuuuagcgggacugcu

SEQ ID NO: 99806 - RNA, 22 nt, Human
gaauacaaauaauaccaaggug

SEQ ID NO: 99807 - RNA, 22 nt, Human
gaauaccauuuacauuugaaaa

SEQ ID NO: 99808 - RNA, 22 nt, Human
gaauccccugucggaacagugg

SEQ ID NO: 99809 - RNA, 22 nt, Human
gaaucucuuugucccugaguuu

SEQ ID NO: 99810 - RNA, 22 nt, Human
gaggcagaggaugggacuguau

SEQ ID NO: 99811 - RNA, 22 nt, Human
gaaugcacacgugugugcaugc

SEQ ID NO: 99812 - RNA, 22 nt, Human
gaggcggugguggcgagaguca

SEQ ID NO: 99813 - RNA, 22 nt, Human
gaggccuucauuucuccgucug

SEQ ID NO: 99814 - RNA, 22 nt, Human
gaauggaacauagcaacaucuu

SEQ ID NO: 99815 - RNA, 22 nt, Human
gaaugcauuuuuuaaaagcaua

SEQ ID NO: 99816 - RNA, 22 nt, Human
gaaggggacuccauggaaugau

SEQ ID NO: 99817 - RNA, 22 nt, Human
gaaggggccuggggcaaggcua

SEQ ID NO: 99818 - RNA, 22 nt, Human
gaggaggcuggagaggccagga

SEQ ID NO: 99819 - RNA, 22 nt, Human
gaggaggagacggaggccuggg

SEQ ID NO: 99820 - RNA, 22 nt, Human
gaaggcagucuggggagcagcc

SEQ ID NO: 99821 - RNA, 22 nt, Human
gaaggcugaauuauuuguuccu

SEQ ID NO: 99822 - RNA, 22 nt, Human
gaggaaaauggaguguaauuaa

SEQ ID NO: 99823 - RNA, 22 nt, Human
gaaggaaaagacgugcuaagua

SEQ ID NO: 99824 - RNA, 22 nt, Human
gagcuuuguuccgugguggcac

SEQ ID NO: 99825 - RNA, 22 nt, Human
gaagcuucucaacugguggaau

SEQ ID NO: 99826 - RNA, 22 nt, Human
gagcuggagaaacacauaagaa

SEQ ID NO: 99827 - RNA, 22 nt, Human
gaagccaugauaaccagugugg

SEQ ID NO: 99828 - RNA, 22 nt, Human
gagccuguuaggcaccuguguu

SEQ ID NO: 99829 - RNA, 22 nt, Human
gagccuuucuggagggcacuug

SEQ ID NO: 99830 - RNA, 22 nt, Human
gagcgacucuuuuaguccagag

SEQ ID NO: 99831 - RNA, 22 nt, Human
gagcgcgcaaucucuccagcug

SEQ ID NO: 99832 - RNA, 22 nt, Human
gaagcgugcagguccguauacu

SEQ ID NO: 99833 - RNA, 22 nt, Human
gagcguuucccugggggucugc

SEQ ID NO: 99834 - RNA, 22 nt, Human
gagcgugaggcagcuuucuaag

SEQ ID NO: 99835 - RNA, 22 nt, Human
gaagcuccaggaugccugcacu

SEQ ID NO: 99836 - RNA, 19 nt, Human
gagccgcucccgcagccgg

SEQ ID NO: 99837 - RNA, 22 nt, Human
gagccggggcucccugaggucc

SEQ ID NO: 99838 - RNA, 22 nt, Human
gaagcagguucuucaggaugaa

SEQ ID NO: 99839 - RNA, 22 nt, Human
gagagaguaucugcugguucac

SEQ ID NO: 99840 - RNA, 21 nt, Human
gaaaaucuaaugugacaaugc

SEQ ID NO: 99841 - RNA, 22 nt, Human
gaaaaugcacacauacacaccc

SEQ ID NO: 99842 - RNA, 22 nt, Human
gaaaauaguucaucacaaugau

SEQ ID NO: 99843 - RNA, 22 nt, Human
uuugugauaaguggauucaagg

SEQ ID NO: 99844 - RNA, 17 nt, Human
uuugugauggcagaugc

SEQ ID NO: 99845 - RNA, 22 nt, Human
uuugugguuuugagagaguugc

SEQ ID NO: 99846 - RNA, 22 nt, Human
uuuguggugagcagggaacguc

SEQ ID NO: 99847 - RNA, 22 nt, Human
uuuguggaaaagagcccaggag

SEQ ID NO: 99848 - RNA, 22 nt, Human
gcauggaaaagggaugcuaacu

SEQ ID NO: 99849 - RNA, 22 nt, Human
gcaugcuguuuggaaacgauaa

SEQ ID NO: 99850 - RNA, 22 nt, Human
gcucuagcuggcgcugaccugg

SEQ ID NO: 99851 - RNA, 22 nt, Human
gcauccaaggagcagaagugau

SEQ ID NO: 99852 - RNA, 22 nt, Human
gcaugcgugcgugcgugcaugu

SEQ ID NO: 99853 - RNA, 22 nt, Human
gcauccugacuauggugguggu

SEQ ID NO: 99854 - RNA, 20 nt, Human
gcucaguggagaaaugcacc

SEQ ID NO: 99855 - RNA, 22 nt, Human
gcaucacacgcacauacacaca

SEQ ID NO: 99856 - RNA, 22 nt, Human
gcaucccagaagauucugauuu

SEQ ID NO: 99857 - RNA, 22 nt, Human
gcucagagaaaacuggggcuug

SEQ ID NO: 99858 - RNA, 22 nt, Human
gcucagagaugucugcugccuu

SEQ ID NO: 99859 - RNA, 22 nt, Human
gcagugcugcgacagucgggug

SEQ ID NO: 99860 - RNA, 22 nt, Human
gcaguccuuaggagaggaagua

SEQ ID NO: 99861 - RNA, 22 nt, Human
gcuagauugucacuugaguguc

SEQ ID NO: 99862 - RNA, 22 nt, Human
gcagggcucuggagucaggcug

SEQ ID NO: 99863 - RNA, 22 nt, Human
gcaggggguaaggggcagggcu

SEQ ID NO: 99864 - RNA, 22 nt, Human
gcgguuggacguucgccucggg

SEQ ID NO: 99865 - RNA, 22 nt, Human
gcaguaaauugagagucauguu

SEQ ID NO: 99866 - RNA, 22 nt, Human
gcagguuguuuaaauuaggauu

SEQ ID NO: 99867 - RNA, 22 nt, Human
gcguggccugcugaaggacuuc

SEQ ID NO: 99868 - RNA, 22 nt, Human
gcaguaaggaggggaaggguuu

SEQ ID NO: 99869 - RNA, 22 nt, Human
gcaguagauccagcagccugca

SEQ ID NO: 99870 - RNA, 22 nt, Human
gcagugacagacaacuguuuga

SEQ ID NO: 99871 - RNA, 22 nt, Human
gcgcgggugagucacgggcgga

SEQ ID NO: 99872 - RNA, 21 nt, Human
gcagcucaggauauagacuug

SEQ ID NO: 99873 - RNA, 20 nt, Human
gcgcuucccuacgcucugcu

SEQ ID NO: 99874 - RNA, 23 nt, Human
gcgggcggagccgggaggcgggg

SEQ ID NO: 99875 - RNA, 22 nt, Human
gcgggcgcuguggccccggccu

SEQ ID NO: 99876 - RNA, 22 nt, Human
gcaggaagauugcagaaggcug

SEQ ID NO: 99877 - RNA, 22 nt, Human
gcaggaaugguacauaccuguu

SEQ ID NO: 99878 - RNA, 22 nt, Human
gcaggccuccccugcuggagcu

SEQ ID NO: 99879 - RNA, 22 nt, Human
gcaggcagauccagaagcacua

SEQ ID NO: 99880 - RNA, 22 nt, Human
gcagcaauaaaacugaaggugu

SEQ ID NO: 99881 - RNA, 22 nt, Human
gcagcaaucuucacagugucau

SEQ ID NO: 99882 - RNA, 22 nt, Human
gcagauuggguacauaaacagu

SEQ ID NO: 99883 - RNA, 22 nt, Human
gcgcggcgcggguccucggccu

SEQ ID NO: 99884 - RNA, 22 nt, Human
gcagcauuaccaagacauggca

SEQ ID NO: 99885 - RNA, 23 nt, Human
gcagccaacccacgugagagaag

SEQ ID NO: 99886 - RNA, 22 nt, Human
gcagcagugugggcugaaccua

SEQ ID NO: 99887 - RNA, 22 nt, Human
gcagauccaaauauaguucuug

SEQ ID NO: 99888 - RNA, 22 nt, Human
gcgcagugagguuaagaaugca

SEQ ID NO: 99889 - RNA, 22 nt, Human
gcgccuugccuguccucuaacc

SEQ ID NO: 99890 - RNA, 21 nt, Human
gcgcgcucgugcucgacgcgc

SEQ ID NO: 99891 - RNA, 21 nt, Human
gcagaguauagauuaggagcc

SEQ ID NO: 99892 - RNA, 22 nt, Human
gcagaguauaaguguggagcug

SEQ ID NO: 99893 - RNA, 22 nt, Human
gccugggguuugcggggcugca

SEQ ID NO: 99894 - RNA, 22 nt, Human
gcagauaaaauuuuugauggga

SEQ ID NO: 99895 - RNA, 22 nt, Human
gcagaugagagugugaucuggg

SEQ ID NO: 99896 - RNA, 21 nt, Human
gcagaaagugauuugcuauuc

SEQ ID NO: 99897 - RNA, 21 nt, Human
gccugcuguucacccugccac

SEQ ID NO: 99898 - RNA, 22 nt, Human
gccugcugggcucuuccugcug

SEQ ID NO: 99899 - RNA, 23 nt, Human
gcacuccgagggcacgugucucu

SEQ ID NO: 99900 - RNA, 22 nt, Human
gcagaaguauuguacgguggga

SEQ ID NO: 99901 - RNA, 21 nt, Human
gcagaacuaggacuugaacau

SEQ ID NO: 99902 - RNA, 22 nt, Human
gcaauuggaaugaauucuauuu

SEQ ID NO: 99903 - RNA, 22 nt, Human
gcaauagccuacaugcgucaga

SEQ ID NO: 99904 - RNA, 22 nt, Human
gccugcaggaaggugugccugu

SEQ ID NO: 99905 - RNA, 22 nt, Human
gcaccacccaaaggcggggcuc

SEQ ID NO: 99906 - RNA, 22 nt, Human
gcaccauagagaagagacacaa

SEQ ID NO: 99907 - RNA, 22 nt, Human
gcacuaccaguaauuaaaucug

SEQ ID NO: 99908 - RNA, 22 nt, Human
gcaccgagaaggaagcaugccu

SEQ ID NO: 99909 - RNA, 22 nt, Human
gcacaggcugcacgaccccagc

SEQ ID NO: 99910 - RNA, 22 nt, Human
gauuuugaaccuuauuuggaaa

SEQ ID NO: 99911 - RNA, 18 nt, Human
gccucuguugacagaguu

SEQ ID NO: 99912 - RNA, 22 nt, Human
gauuuuuaaaaguaguuuugaa

SEQ ID NO: 99913 - RNA, 22 nt, Human
gcaaaaacaguguagucuucug

SEQ ID NO: 99914 - RNA, 22 nt, Human
gauuaaaggucuugauuauaag

SEQ ID NO: 99915 - RNA, 22 nt, Human
gauuaagaaagauagaugugga

SEQ ID NO: 99916 - RNA, 22 nt, Human
gauuaagauuacauauuuaagu

SEQ ID NO: 99917 - RNA, 22 nt, Human
gauuaagugaauuggagaaaag

SEQ ID NO: 99918 - RNA, 22 nt, Human
gauuaucaccaaauggccuccu

SEQ ID NO: 99919 - RNA, 22 nt, Human
gcccuguuuucuggguuccuug

SEQ ID NO: 99920 - RNA, 22 nt, Human
gauguuaauauguuucaccaaa

SEQ ID NO: 99921 - RNA, 22 nt, Human
gaugucauguuggcagacaguu

SEQ ID NO: 99922 - RNA, 22 nt, Human
gccccgcgcgcguagcgccgcu

SEQ ID NO: 99923 - RNA, 22 nt, Human
gcccuggcauuucuauucaugu

SEQ ID NO: 99924 - RNA, 22 nt, Human
gauguuuugaaagaagaauaca

SEQ ID NO: 99925 - RNA, 22 nt, Human
gccaucugcuuagauugcuggg

SEQ ID NO: 99926 - RNA, 22 nt, Human
gcccagcucucuggccugucuu

SEQ ID NO: 99927 - RNA, 22 nt, Human
gcccagcuuuuugaggcaggca

SEQ ID NO: 99928 - RNA, 23 nt, Human
gccaucugcugggugccccggcc

SEQ ID NO: 99929 - RNA, 22 nt, Human
gccaguuuguuuacugaugguu

SEQ ID NO: 99930 - RNA, 22 nt, Human
gauggguuugagauguuugggu

SEQ ID NO: 99931 - RNA, 22 nt, Human
gauggugcaauuaucgugcaug

SEQ ID NO: 99932 - RNA, 22 nt, Human
gauggugauggcccuaagcuga

SEQ ID NO: 99933 - RNA, 22 nt, Human
gcccauggagaccucaggcugg

SEQ ID NO: 99934 - RNA, 22 nt, Human
gauggguugaguucauggagcc

SEQ ID NO: 99935 - RNA, 22 nt, Human
gaugggaaggugguaaaguuua

SEQ ID NO: 99936 - RNA, 22 nt, Human
gaucugguuccaggacauugca

SEQ ID NO: 99937 - RNA, 22 nt, Human
gaugaagaaacucaaccaagaa

SEQ ID NO: 99938 - RNA, 18 nt, Human
gccagcccuccaaccucc

SEQ ID NO: 99939 - RNA, 22 nt, Human
gauccucagacccuccucuggu

SEQ ID NO: 99940 - RNA, 21 nt, Human
gaucgcaaugugggaaucaug

SEQ ID NO: 99941 - RNA, 22 nt, Human
gaguggucacuaauuuccuuaa

SEQ ID NO: 99942 - RNA, 18 nt, Human
gaugaagaggaagaggag

SEQ ID NO: 99943 - RNA, 22 nt, Human
gccaggcagcagcgaggauggu

SEQ ID NO: 99944 - RNA, 22 nt, Human
gaugccggggucguagccgugg

SEQ ID NO: 99945 - RNA, 22 nt, Human
gccaggcggcccaggagauggc

SEQ ID NO: 99946 - RNA, 22 nt, Human
gccaaccagucgguccaggaag

SEQ ID NO: 99947 - RNA, 22 nt, Human
gccaaucaggaggcuguacauc

SEQ ID NO: 99948 - RNA, 21 nt, Human
gccacugcugcucauucucug

SEQ ID NO: 99949 - RNA, 19 nt, Human
gccacguuggcuaguugcc

SEQ ID NO: 99950 - RNA, 22 nt, Human
gccacucaguuuaggggcaagc

SEQ ID NO: 99951 - RNA, 22 nt, Human
gaguucaaagaucuaggaagag

SEQ ID NO: 99952 - RNA, 22 nt, Human
gaguuauuuuuccuguuuuuua

SEQ ID NO: 99953 - RNA, 22 nt, Human
gcaugcaggaagggcuugggga

SEQ ID NO: 99954 - RNA, 23 nt, Human
gcaucgcaggucuaagauuagcu

SEQ ID NO: 99955 - RNA, 22 nt, Human
gcaucuccugagucagauuuug

SEQ ID NO: 99956 - RNA, 22 nt, Human
gcaucuguuagagugugcaugc

SEQ ID NO: 99957 - RNA, 22 nt, Human
gcauaguuuucauagguguuuu

SEQ ID NO: 99958 - RNA, 22 nt, Human
gcauauuuuaaaguguaaccug

SEQ ID NO: 99959 - RNA, 19 nt, Human
gagugaggagcaucguuua

SEQ ID NO: 99960 - RNA, 22 nt, Human
gcauaauauugagaaauuauua

SEQ ID NO: 99961 - RNA, 22 nt, Human
gcauagauauguaaugcaucau

SEQ ID NO: 99962 - RNA, 22 nt, Human
gaguguuugcuguauaauugga

SEQ ID NO: 99963 - RNA, 22 nt, Human
gaguuaaauagcuuaggauuca

SEQ ID NO: 99964 - RNA, 21 nt, Human
gcauccucguacucuucaggu

SEQ ID NO: 99965 - RNA, 22 nt, Human
gaguggccugccccagccaggc

SEQ ID NO: 99966 - RNA, 22 nt, Human
gaguggugagaauacaacggaa

SEQ ID NO: 99967 - RNA, 22 nt, Human
gcaguuaccuauuuuguagaaa

SEQ ID NO: 99968 - RNA, 22 nt, Human
gcagugucacuaguaauagucu

SEQ ID NO: 99969 - RNA, 22 nt, Human
gcagugccauguggaggaucuc

SEQ ID NO: 99970 - RNA, 22 nt, Human
gcaguuguagcuguuucuacuc

SEQ ID NO: 99971 - RNA, 22 nt, Human
gaguauucuauguauauuauug

SEQ ID NO: 99972 - RNA, 22 nt, Human
gaguauuacuaaaauucgccua

SEQ ID NO: 99973 - RNA, 22 nt, Human
gcaguuugugauguggcaguca

SEQ ID NO: 99974 - RNA, 22 nt, Human
gagucaucucuagaaugaugau

SEQ ID NO: 99975 - RNA, 22 nt, Human
gagucaggucaggcuuguagau

SEQ ID NO: 99976 - RNA, 22 nt, Human
gaguaauuuucuuaaaacauca

SEQ ID NO: 99977 - RNA, 22 nt, Human
gaguaaaagaugaggcaguaga

SEQ ID NO: 99978 - RNA, 19 nt, Human
gaguacuuuacaaguuuuc

SEQ ID NO: 99979 - RNA, 22 nt, Human
gaguacagaagauaaaggcaca

SEQ ID NO: 99980 - RNA, 22 nt, Human
gaguaucagauuggaguccuca

SEQ ID NO: 99981 - RNA, 22 nt, Human
gcagucauggguagaacucaag

SEQ ID NO: 99982 - RNA, 22 nt, Human
gcagucuacuuaagaaucucag

SEQ ID NO: 99983 - RNA, 23 nt, Human
gcagugacugggauggaaguaga

SEQ ID NO: 99984 - RNA, 22 nt, Human
gcaguauuguguguggucaugg

SEQ ID NO: 99985 - RNA, 22 nt, Human
gcagguggaagcagcagacuca

SEQ ID NO: 99986 - RNA, 22 nt, Human
gagaauaauaauaggcauggug

SEQ ID NO: 99987 - RNA, 22 nt, Human
gaucuuacucacuucagcuggc

SEQ ID NO: 99988 - RNA, 22 nt, Human
gcagggcucagccgcucccacc

SEQ ID NO: 99989 - RNA, 22 nt, Human
gagaauuauacaugagcuauuu

SEQ ID NO: 99990 - RNA, 20 nt, Human
gagaaugucauuccuuuuuu

SEQ ID NO: 99991 - RNA, 22 nt, Human
gcaggucacagcugauuggcca

SEQ ID NO: 99992 - RNA, 22 nt, Human
gcaggguaggugacagguaguc

SEQ ID NO: 99993 - RNA, 21 nt, Human
gcaggggugugugagcugggg

SEQ ID NO: 99994 - RNA, 22 nt, Human
gcuuuguucauuuaguuuuuuu

SEQ ID NO: 99995 - RNA, 22 nt, Human
gcuuuucucccugcuuucuucc

SEQ ID NO: 99996 - RNA, 23 nt, Human
gcuuugaaaaugcuuucuuccag

SEQ ID NO: 99997 - RNA, 22 nt, Human
gccggagagccaacaccacgga

SEQ ID NO: 99998 - RNA, 22 nt, Human
gcuuuugagaaaguguuuuccc

SEQ ID NO: 99999 - RNA, 22 nt, Human
gcuuuugcaaagcuggagaauu

SEQ ID NO: 100000 - RNA, 22 nt, Human
gcuugaggaacucagacuugag

SEQ ID NO: 100001 - RNA, 22 nt, Human
gccgcgggucugggucuggcuc

SEQ ID NO: 100002 - RNA, 22 nt, Human
gcuugcugaacaggaaccuggc

SEQ ID NO: 100003 - RNA, 20 nt, Human
gcuugaauuugauggccaga

SEQ ID NO: 100004 - RNA, 20 nt, Human
gcuugcggacagguggcuca

SEQ ID NO: 100005 - RNA, 22 nt, Human
gcuuguuagcaaugcagaaucu

SEQ ID NO: 100006 - RNA, 22 nt, Human
gcuuggagaacguuuucuagaa

SEQ ID NO: 100007 - RNA, 22 nt, Human
gcuuucagggucacugucaaca

SEQ ID NO: 100008 - RNA, 22 nt, Human
gcuuucccaaccuucuugguau

SEQ ID NO: 100009 - RNA, 22 nt, Human
gccuagaagaaugagcgcaggg

SEQ ID NO: 100010 - RNA, 22 nt, Human
gccggguguuccugggaagaug

SEQ ID NO: 100011 - RNA, 20 nt, Human
gccggggcauaggggccguc

SEQ ID NO: 100012 - RNA, 22 nt, Human
gccgggagugcagcgggcgcgc

SEQ ID NO: 100013 - RNA, 22 nt, Human
gccgggagaggcggcgcagggg

SEQ ID NO: 100014 - RNA, 22 nt, Human
ggaaaaugcugaagcaucugaa

SEQ ID NO: 100015 - RNA, 22 nt, Human
gccucuuugcucuuugguuguu

SEQ ID NO: 100016 - RNA, 22 nt, Human
gccucucuggcaaagcggugau

SEQ ID NO: 100017 - RNA, 22 nt, Human
gccuccggagucgcagugucuu

SEQ ID NO: 100018 - RNA, 22 nt, Human
gccuccgccuuccugucucccc

SEQ ID NO: 100019 - RNA, 22 nt, Human
gccuccagaggggacaaaaauu

SEQ ID NO: 100020 - RNA, 22 nt, Human
ggaaaggggaaaauacagagag

SEQ ID NO: 100021 - RNA, 22 nt, Human
ggaaaggaagggaaggagaugc

SEQ ID NO: 100022 - RNA, 22 nt, Human
ggaaauauaagcaguuugugug

SEQ ID NO: 100023 - RNA, 22 nt, Human
ggaaauguguguaagaaaguau

SEQ ID NO: 100024 - RNA, 22 nt, Human
gccugagauuggacauuauuua

SEQ ID NO: 100025 - RNA, 22 nt, Human
gccugagucaagauguggcacc

SEQ ID NO: 100026 - RNA, 22 nt, Human
ggaacuaagcacauuaucugau

SEQ ID NO: 100027 - RNA, 22 nt, Human
gccugccucugacuggggcuga

SEQ ID NO: 100028 - RNA, 22 nt, Human
gccugcacucaaacacucucuu

SEQ ID NO: 100029 - RNA, 22 nt, Human
gccugcagccagggaguucucu

SEQ ID NO: 100030 - RNA, 18 nt, Human
gccugccagccgagggac

SEQ ID NO: 100031 - RNA, 22 nt, Human
gccgcaacggacccugggaguc

SEQ ID NO: 100032 - RNA, 22 nt, Human
gccgccgcucaccugggcgccg

SEQ ID NO: 100033 - RNA, 22 nt, Human
gcuucugugagugcagaugcug

SEQ ID NO: 100034 - RNA, 22 nt, Human
gcuuagaugcugucauucacca

SEQ ID NO: 100035 - RNA, 22 nt, Human
gcuuaugauguuuacauaaaag

SEQ ID NO: 100036 - RNA, 22 nt, Human
gcuuccuccaucuggggcuugc

SEQ ID NO: 100037 - RNA, 22 nt, Human
gcuguuguugcacggaaggugg

SEQ ID NO: 100038 - RNA, 22 nt, Human
gcuuacagauaaugaggagacu

SEQ ID NO: 100039 - RNA, 22 nt, Human
gcuguugugaggaucagcauau

SEQ ID NO: 100040 - RNA, 22 nt, Human
gcuguguucauccugcccaggu

SEQ ID NO: 100041 - RNA, 22 nt, Human
gcuguguaugaugcaggcaccu

SEQ ID NO: 100042 - RNA, 22 nt, Human
gcuguggacacagcucucuuca

SEQ ID NO: 100043 - RNA, 22 nt, Human
gcuguggguuccuccccugucc

SEQ ID NO: 100044 - RNA, 22 nt, Human
gcuguggcuccaauggugagcc

SEQ ID NO: 100045 - RNA, 22 nt, Human
gcuguggagaagcugccuaugg

SEQ ID NO: 100046 - RNA, 22 nt, Human
gcugugacaagaggcugcuucu

SEQ ID NO: 100047 - RNA, 22 nt, Human
gcuguauaucuuuugaagugau

SEQ ID NO: 100048 - RNA, 22 nt, Human
gcuguaacuuuuucauuuucaa

SEQ ID NO: 100049 - RNA, 21 nt, Human
gcuguagauucacaaagaggu

SEQ ID NO: 100050 - RNA, 22 nt, Human
gcugguggcagagcuccgcggc

SEQ ID NO: 100051 - RNA, 22 nt, Human
gcccuguguguuugcacugauu

SEQ ID NO: 100052 - RNA, 22 nt, Human
gcccugucagcucucauggaca

SEQ ID NO: 100053 - RNA, 22 nt, Human
gcccuguuauagucugaggccu

SEQ ID NO: 100054 - RNA, 22 nt, Human
gcccuggucguggagggcaaca

SEQ ID NO: 100055 - RNA, 22 nt, Human
gcccugccauugaucggcccag

SEQ ID NO: 100056 - RNA, 22 nt, Human
gcccuggagauggaaguucuga

SEQ ID NO: 100057 - RNA, 22 nt, Human
gcccugaaggccuccaggacuc

SEQ ID NO: 100058 - RNA, 22 nt, Human
gcauuuaaauuugaacuucaga

SEQ ID NO: 100059 - RNA, 22 nt, Human
gcauugcuauuucuguuagugu

SEQ ID NO: 100060 - RNA, 22 nt, Human
gccccaggggaggugcccugca

SEQ ID NO: 100061 - RNA, 22 nt, Human
gcccgaccgcgccggcccgcac

SEQ ID NO: 100062 - RNA, 22 nt, Human
gcccccgccuugcugggccagg

SEQ ID NO: 100063 - RNA, 22 nt, Human
gcauguucaaguuaguauauuu

SEQ ID NO: 100064 - RNA, 22 nt, Human
gcauuagacuaguacacggcag

SEQ ID NO: 100065 - RNA, 22 nt, Human
gcugacucugcuuuuagccucc

SEQ ID NO: 100066 - RNA, 22 nt, Human
gcugacuauaaggcugcucugu

SEQ ID NO: 100067 - RNA, 20 nt, Human
gcauggcuggcugcugucug

SEQ ID NO: 100068 - RNA, 22 nt, Human
gcugagcagaacaauuagaaau

SEQ ID NO: 100069 - RNA, 22 nt, Human
gcucugaacugucaugaauugg

SEQ ID NO: 100070 - RNA, 22 nt, Human
gcucucuggccugggaggagga

SEQ ID NO: 100071 - RNA, 23 nt, Human
gcucugauaccagcuacaucuag

SEQ ID NO: 100072 - RNA, 22 nt, Human
gcugacuguagcugggggaaga

SEQ ID NO: 100073 - RNA, 22 nt, Human
gcugacuuauuagaaaaggaca

SEQ ID NO: 100074 - RNA, 22 nt, Human
ggcaguguggauccuggagaag

SEQ ID NO: 100075 - RNA, 20 nt, Human
ggcaucugacaacuaguugc

SEQ ID NO: 100076 - RNA, 22 nt, Human
ggcagugguaggagcccaggag

SEQ ID NO: 100077 - RNA, 22 nt, Human
ggcaucuuuaaugaacaugaau

SEQ ID NO: 100078 - RNA, 22 nt, Human
ggcauuccgggguccccuucuc

SEQ ID NO: 100079 - RNA, 22 nt, Human
ggcauggugggggaggacuugg

SEQ ID NO: 100080 - RNA, 22 nt, Human
gcucaacuucuaggacuucagg

SEQ ID NO: 100081 - RNA, 22 nt, Human
gcuauacuugccuccucuccac

SEQ ID NO: 100082 - RNA, 22 nt, Human
gcucuccuugcuagagguucua

SEQ ID NO: 100083 - RNA, 22 nt, Human
gcucuccuugaugcccucuguu

SEQ ID NO: 100084 - RNA, 22 nt, Human
gcucggcuggcucaucucaugu

SEQ ID NO: 100085 - RNA, 19 nt, Human
gcuccugcagcuagagugc

SEQ ID NO: 100086 - RNA, 22 nt, Human
gcuaguaagugauagagcugag

SEQ ID NO: 100087 - RNA, 22 nt, Human
gcuaguguuccacgaugugugu

SEQ ID NO: 100088 - RNA, 22 nt, Human
gcuagcugugcuuggaaguuug

SEQ ID NO: 100089 - RNA, 22 nt, Human
ggcagguggcacugcugcuccc

SEQ ID NO: 100090 - RNA, 22 nt, Human
ggcagguccugaguccugaggc

SEQ ID NO: 100091 - RNA, 22 nt, Human
ggcagucaucacuuauucauca

SEQ ID NO: 100092 - RNA, 22 nt, Human
ggcagcagaacuggcccuguau

SEQ ID NO: 100093 - RNA, 22 nt, Human
ggcagcccuggacccuggagaa

SEQ ID NO: 100094 - RNA, 21 nt, Human
ggcagccuggcaggggcacug

SEQ ID NO: 100095 - RNA, 22 nt, Human
ggcagcagaaccaacuguggcu

SEQ ID NO: 100096 - RNA, 22 nt, Human
gcuagaaacuguuuaaucucuu

SEQ ID NO: 100097 - RNA, 22 nt, Human
gcuagaaggaagccccugcuga

SEQ ID NO: 100098 - RNA, 22 nt, Human
gcguaccugaaauuacggcacu

SEQ ID NO: 100099 - RNA, 22 nt, Human
ggcagaaaacaauaaccauuuc

SEQ ID NO: 100100 - RNA, 22 nt, Human
gcgguuguucugugugcaugga

SEQ ID NO: 100101 - RNA, 22 nt, Human
gcguggaugauuuugagucggu

SEQ ID NO: 100102 - RNA, 22 nt, Human
gcgugcauguguguaugcgugu

SEQ ID NO: 100103 - RNA, 22 nt, Human
ggcaauauuauaagggcauuua

SEQ ID NO: 100104 - RNA, 19 nt, Human
ggauaagguuggagugauc

SEQ ID NO: 100105 - RNA, 22 nt, Human
ggcacagcgacuaccaucgaaa

SEQ ID NO: 100106 - RNA, 22 nt, Human
ggcacuggguugcagagagaga

SEQ ID NO: 100107 - RNA, 22 nt, Human
ggcacgagccaguguguguguu

SEQ ID NO: 100108 - RNA, 22 nt, Human
ggaguucaaaucuuuuggaucu

SEQ ID NO: 100109 - RNA, 22 nt, Human
ggagugaagacagagugaacuu

SEQ ID NO: 100110 - RNA, 22 nt, Human
ggagugaguauguucugaugca

SEQ ID NO: 100111 - RNA, 22 nt, Human
ggagugauuugucuugucuggu

SEQ ID NO: 100112 - RNA, 22 nt, Human
ggaguucaaaucuggaccuugc

SEQ ID NO: 100113 - RNA, 22 nt, Human
ggauaaaugaaggcauacagau

SEQ ID NO: 100114 - RNA, 22 nt, Human
ggaguuucugucaucccguccc

SEQ ID NO: 100115 - RNA, 22 nt, Human
ggaggaaauccuuaguaaggca

SEQ ID NO: 100116 - RNA, 22 nt, Human
ggaggaugaggguggugguguu

SEQ ID NO: 100117 - RNA, 22 nt, Human
ggaggagggaguucaggaguau

SEQ ID NO: 100118 - RNA, 22 nt, Human
ggagugaaugguggccguguuu

SEQ ID NO: 100119 - RNA, 22 nt, Human
ggagucguguuugggaucggag

SEQ ID NO: 100120 - RNA, 22 nt, Human
ggagucugugucuugaagcagu

SEQ ID NO: 100121 - RNA, 22 nt, Human
ggaggggaguuugccucugggg

SEQ ID NO: 100122 - RNA, 22 nt, Human
ggagggaggggugggagaugga

SEQ ID NO: 100123 - RNA, 22 nt, Human
ggagggagugcaggcaggcaga

SEQ ID NO: 100124 - RNA, 23 nt, Human
ggagaaggaugucaucaaaagac

SEQ ID NO: 100125 - RNA, 22 nt, Human
gcgcgcucugcgaggacacgcu

SEQ ID NO: 100126 - RNA, 22 nt, Human
ggagagaacguaaucuaguauu

SEQ ID NO: 100127 - RNA, 22 nt, Human
ggagagcguggaugggcuucca

SEQ ID NO: 100128 - RNA, 22 nt, Human
gcggaucuccuugagugggcaa

SEQ ID NO: 100129 - RNA, 22 nt, Human
gcgcugagcuuuucuuauugaa

SEQ ID NO: 100130 - RNA, 22 nt, Human
gcggacaauggaagaugucauu

SEQ ID NO: 100131 - RNA, 22 nt, Human
gcgcucuccugcagacagccuc

SEQ ID NO: 100132 - RNA, 22 nt, Human
ggacagggagcaaaaacguccc

SEQ ID NO: 100133 - RNA, 23 nt, Human
ggacaugucucuggguauuuuga

SEQ ID NO: 100134 - RNA, 22 nt, Human
ggacauggaaagugugugauuu

SEQ ID NO: 100135 - RNA, 22 nt, Human
ggacuuucuccugcacaaagug

SEQ ID NO: 100136 - RNA, 22 nt, Human
ggacuucuggggacuguagauu

SEQ ID NO: 100137 - RNA, 22 nt, Human
ggaccagagcuaaugcgcgccc

SEQ ID NO: 100138 - RNA, 22 nt, Human
ggacuggugaagccuucggaga

SEQ ID NO: 100139 - RNA, 22 nt, Human
gccuuuugcaaugguguuggug

SEQ ID NO: 100140 - RNA, 22 nt, Human
ggaauuauuuuaaauagacauu

SEQ ID NO: 100141 - RNA, 22 nt, Human
ggaaugcagugagcauuagaua

SEQ ID NO: 100142 - RNA, 22 nt, Human
ggaauuaagaggcuggacaggg

SEQ ID NO: 100143 - RNA, 22 nt, Human
ggaaucuucagccaugccaaga

SEQ ID NO: 100144 - RNA, 22 nt, Human
ggaauauaaaucagaugcuccg

SEQ ID NO: 100145 - RNA, 22 nt, Human
gccugggauuggggauuuuuug

SEQ ID NO: 100146 - RNA, 22 nt, Human
gccugggccgggcgcggccccc

SEQ ID NO: 100147 - RNA, 22 nt, Human
ggaagaggaagaugaggcagca

SEQ ID NO: 100148 - RNA, 22 nt, Human
ggaagacuuagaguagcaucag

SEQ ID NO: 100149 - RNA, 19 nt, Human
ggaacgcugggcuccccuc

SEQ ID NO: 100150 - RNA, 22 nt, Human
gggggacagugugccuggugug

SEQ ID NO: 100151 - RNA, 22 nt, Human
gggggcagguuccaggccagcu

SEQ ID NO: 100152 - RNA, 22 nt, Human
ggagcaguggaggggccagggu

SEQ ID NO: 100153 - RNA, 19 nt, Human
ggagcagauaaacauacuu

SEQ ID NO: 100154 - RNA, 22 nt, Human
ggggcuggguuugcgcaggcuc

SEQ ID NO: 100155 - RNA, 22 nt, Human
ggggcuuccagcgcccgccggu

SEQ ID NO: 100156 - RNA, 22 nt, Human
ggagaugacaucccagcccggc

SEQ ID NO: 100157 - RNA, 22 nt, Human
ggagauggucacagguaaacau

SEQ ID NO: 100158 - RNA, 18 nt, Human
gggcuuugggguucuauc

SEQ ID NO: 100159 - RNA, 22 nt, Human
gggcuuuuccauuccaggguuc

SEQ ID NO: 100160 - RNA, 20 nt, Human
gggcuuugagcucagggcuu

SEQ ID NO: 100161 - RNA, 22 nt, Human
ggagcugaacccuuaacuggcu

SEQ ID NO: 100162 - RNA, 20 nt, Human
ggagcgggcauuuguguucc

SEQ ID NO: 100163 - RNA, 22 nt, Human
ggagguggagcuggaaguucca

SEQ ID NO: 100164 - RNA, 22 nt, Human
ggagguaagaggcccugggccg

SEQ ID NO: 100165 - RNA, 22 nt, Human
ggaggcggaaguccaagcaggu

SEQ ID NO: 100166 - RNA, 22 nt, Human
ggguggaaugugagugugugug

SEQ ID NO: 100167 - RNA, 22 nt, Human
gggugcuucauaggugaugcug

SEQ ID NO: 100168 - RNA, 22 nt, Human
gggugggguaggugacucucgc

SEQ ID NO: 100169 - RNA, 22 nt, Human
ggguuggaggcauugaaacaga

SEQ ID NO: 100170 - RNA, 22 nt, Human
ggguuccugaagugguucagga

SEQ ID NO: 100171 - RNA, 22 nt, Human
gguaagcugcuguagggucaga

SEQ ID NO: 100172 - RNA, 22 nt, Human
gguaagcacuucauguacauga

SEQ ID NO: 100173 - RNA, 22 nt, Human
gguaacagaagagcacuuggca

SEQ ID NO: 100174 - RNA, 22 nt, Human
ggguuuugugauugccucugaa

SEQ ID NO: 100175 - RNA, 22 nt, Human
ggguuuuggggaggaagugagc

SEQ ID NO: 100176 - RNA, 22 nt, Human
ggaugauacuuggagaaauauu

SEQ ID NO: 100177 - RNA, 22 nt, Human
ggguuuguuccuacuucuacuc

SEQ ID NO: 100178 - RNA, 22 nt, Human
ggaucguauuucaguuuuuugg

SEQ ID NO: 100179 - RNA, 23 nt, Human
ggauccugacauauaccaucacc

SEQ ID NO: 100180 - RNA, 22 nt, Human
ggaucaccagguuuguuguugg

SEQ ID NO: 100181 - RNA, 22 nt, Human
ggaucccaucgagcuggcuguc

SEQ ID NO: 100182 - RNA, 22 nt, Human
ggguuuccugcucgcggguagc

SEQ ID NO: 100183 - RNA, 22 nt, Human
ggaucagcgagaagggcugaaa

SEQ ID NO: 100184 - RNA, 22 nt, Human
ggugcuuuucacaagcauggga

SEQ ID NO: 100185 - RNA, 22 nt, Human
gguggcagaggaggcgggagag

SEQ ID NO: 100186 - RNA, 22 nt, Human
ggugaggggauccuguuaccau

SEQ ID NO: 100187 - RNA, 22 nt, Human
ggugaguagaaguaguuggcuu

SEQ ID NO: 100188 - RNA, 22 nt, Human
ggugaguaguggaaaugaauga

SEQ ID NO: 100189 - RNA, 22 nt, Human
ggugaucucagucuagaugguu

SEQ ID NO: 100190 - RNA, 22 nt, Human
ggugauaaaaagcauuuaaauu

SEQ ID NO: 100191 - RNA, 22 nt, Human
ggugcuggggaaauuaggguag

SEQ ID NO: 100192 - RNA, 22 nt, Human
gguggcauucaguaaguauaua

SEQ ID NO: 100193 - RNA, 22 nt, Human
ggcauuccucucuguucaugga

SEQ ID NO: 100194 - RNA, 22 nt, Human
ggcaugcaaaugugggugaccu

SEQ ID NO: 100195 - RNA, 22 nt, Human
gguguuaaccagcuaaaguuug

SEQ ID NO: 100196 - RNA, 22 nt, Human
ggcauugauggggucuugggga

SEQ ID NO: 100197 - RNA, 22 nt, Human
gguuauuucugauuauaugaua

SEQ ID NO: 100198 - RNA, 19 nt, Human
gguuaccagugugucuggc

SEQ ID NO: 100199 - RNA, 22 nt, Human
ggccaaagagcacaaugaauag

SEQ ID NO: 100200 - RNA, 20 nt, Human
ggcagcaaccauaugcuaca

SEQ ID NO: 100201 - RNA, 22 nt, Human
ggcagauaaacaauguuguaua

SEQ ID NO: 100202 - RNA, 21 nt, Human
ggcagagaagcuggaaguugg

SEQ ID NO: 100203 - RNA, 20 nt, Human
ggcagagcuaugucuguugc

SEQ ID NO: 100204 - RNA, 22 nt, Human
ggcaauuacguauuagucaugu

SEQ ID NO: 100205 - RNA, 22 nt, Human
ggcacccugcauuggcuugagu

SEQ ID NO: 100206 - RNA, 23 nt, Human
ggugagccuuucuaguagucuug

SEQ ID NO: 100207 - RNA, 22 nt, Human
ggauggaugugaucugccuccu

SEQ ID NO: 100208 - RNA, 22 nt, Human
ggaugggcuuggggaggucuag

SEQ ID NO: 100209 - RNA, 22 nt, Human
gguaaucuccucauugacguua

SEQ ID NO: 100210 - RNA, 22 nt, Human
ggaugcguuugaauguguuugu

SEQ ID NO: 100211 - RNA, 22 nt, Human
ggaugcugcuccacaucccaca

SEQ ID NO: 100212 - RNA, 23 nt, Human
ggauggacauacguaugcacagg

SEQ ID NO: 100213 - RNA, 22 nt, Human
ggaugauuuucaguuguguggg

SEQ ID NO: 100214 - RNA, 22 nt, Human
ggaugcagcagagaccuggagu

SEQ ID NO: 100215 - RNA, 22 nt, Human
ggucaucacugagagcagaucc

SEQ ID NO: 100216 - RNA, 22 nt, Human
ggucgagcagcacccguucggc

SEQ ID NO: 100217 - RNA, 22 nt, Human
ggaaugcuuggcaugagaaccu

SEQ ID NO: 100218 - RNA, 22 nt, Human
ggaauccugguguuuucugccu

SEQ ID NO: 100219 - RNA, 22 nt, Human
ggaauguuuuccagaccuagau

SEQ ID NO: 100220 - RNA, 22 nt, Human
ggaauugagcaagggguggggc

SEQ ID NO: 100221 - RNA, 22 nt, Human
gggcuguuugcauauguuuaua

SEQ ID NO: 100222 - RNA, 22 nt, Human
ggacggcuagcagcagaauuca

SEQ ID NO: 100223 - RNA, 22 nt, Human
gggcuuaaccuggguaugaggg

SEQ ID NO: 100224 - RNA, 22 nt, Human
ggacugggagaauggaggcaag

SEQ ID NO: 100225 - RNA, 22 nt, Human
ggaagcugucugcccggcgcuc

SEQ ID NO: 100226 - RNA, 22 nt, Human
ggaaguuaguucuuggcaaagg

SEQ ID NO: 100227 - RNA, 22 nt, Human
gggcugagagcuggaaucugag

SEQ ID NO: 100228 - RNA, 21 nt, Human
ggaauagcuuaaagugagggg

SEQ ID NO: 100229 - RNA, 22 nt, Human
ggaauacggguuuauuuagucu

SEQ ID NO: 100230 - RNA, 22 nt, Human
ggaauaaaaggagguggcgaga

SEQ ID NO: 100231 - RNA, 22 nt, Human
ggaagccugggcgcaggcaggg

SEQ ID NO: 100232 - RNA, 22 nt, Human
ggaagaagagggagcuguggga

SEQ ID NO: 100233 - RNA, 22 nt, Human
ggaaaaauggguggugauauga

SEQ ID NO: 100234 - RNA, 22 nt, Human
ggaaaggacuggagcccagcgc

SEQ ID NO: 100235 - RNA, 22 nt, Human
gggcaggcuggguggugguccc

SEQ ID NO: 100236 - RNA, 22 nt, Human
gggcaggacccguuagaguggc

SEQ ID NO: 100237 - RNA, 22 nt, Human
gggcagagagcuggaacuccuu

SEQ ID NO: 100238 - RNA, 22 nt, Human
ggaacaguacucggaggccaga

SEQ ID NO: 100239 - RNA, 22 nt, Human
gcuuuugaauacuacaggaguu

SEQ ID NO: 100240 - RNA, 22 nt, Human
gcuuuuuaauuugcuucccugg

SEQ ID NO: 100241 - RNA, 20 nt, Human
gggaucgaguaccuccgggu

SEQ ID NO: 100242 - RNA, 22 nt, Human
gggagaguagcuggaagguucu

SEQ ID NO: 100243 - RNA, 22 nt, Human
gcuuucauuauguuguguuuuu

SEQ ID NO: 100244 - RNA, 22 nt, Human
gcuuucacugcaauagaugaau

SEQ ID NO: 100245 - RNA, 19 nt, Human
gggagaaaaucuuuauccu

SEQ ID NO: 100246 - RNA, 22 nt, Human
gggacugguuguguguggugug

SEQ ID NO: 100247 - RNA, 22 nt, Human
gggagauuuguguaggaaaacu

SEQ ID NO: 100248 - RNA, 22 nt, Human
gggacaggacuccuggggccug

SEQ ID NO: 100249 - RNA, 22 nt, Human
gggacucugaaucuagauuccu

SEQ ID NO: 100250 - RNA, 22 nt, Human
gggaaguugguaagaggcuguu

SEQ ID NO: 100251 - RNA, 18 nt, Human
gcuuggguggcuauguuu

SEQ ID NO: 100252 - RNA, 22 nt, Human
gcuuguuuagcauaggucacug

SEQ ID NO: 100253 - RNA, 22 nt, Human
gcuugggcugaaggccuggguc

SEQ ID NO: 100254 - RNA, 22 nt, Human
gggacugcgagauucucaaggg

SEQ ID NO: 100255 - RNA, 22 nt, Human
gcuugcuuuguaaauaucugug

SEQ ID NO: 100256 - RNA, 22 nt, Human
gcuucuguuaggauguggcuua

SEQ ID NO: 100257 - RNA, 22 nt, Human
gcuugcaucaggggcuggggcc

SEQ ID NO: 100258 - RNA, 20 nt, Human
gcuugcgugggaggaggggg

SEQ ID NO: 100259 - RNA, 22 nt, Human
gcuuccucaccucaaauuuccg

SEQ ID NO: 100260 - RNA, 22 nt, Human
gggaacuuugugagacuggaga

SEQ ID NO: 100261 - RNA, 21 nt, Human
gcuucaauucauccaccucuc

SEQ ID NO: 100262 - RNA, 22 nt, Human
gcuucacucugagacuuggagc

SEQ ID NO: 100263 - RNA, 22 nt, Human
gggaagugagcuggaaucaagg

SEQ ID NO: 100264 - RNA, 22 nt, Human
gggaagaacugauuucacacca

SEQ ID NO: 100265 - RNA, 22 nt, Human
gggaagagggagcuggaaugau

SEQ ID NO: 100266 - RNA, 21 nt, Human
gggaagagaagagaaaggagg

SEQ ID NO: 100267 - RNA, 22 nt, Human
gcuguuuaaguggaauuuguuu

SEQ ID NO: 100268 - RNA, 22 nt, Human
gcuguuucuuuggcaaacugau

SEQ ID NO: 100269 - RNA, 22 nt, Human
gcuguuggaggaguucagugcu

SEQ ID NO: 100270 - RNA, 22 nt, Human
gggaaaaaggaguuagagauaa

SEQ ID NO: 100271 - RNA, 22 nt, Human
gcuguugcaaucaaggccaugg

SEQ ID NO: 100272 - RNA, 22 nt, Human
gggaacccaaauaggaaaauug

SEQ ID NO: 100273 - RNA, 22 nt, Human
gggaacuguaguuuacgcugcc

SEQ ID NO: 100274 - RNA, 22 nt, Human
gggaaaauguuucugagacaaa

SEQ ID NO: 100275 - RNA, 22 nt, Human
gggaaauagagcuggaaccuug

SEQ ID NO: 100276 - RNA, 22 nt, Human
gcuuacuguuccuguuggugcu

SEQ ID NO: 100277 - RNA, 22 nt, Human
gggaaaucugcuuccuagggcu

SEQ ID NO: 100278 - RNA, 22 nt, Human
ggcuuuuguuauaaucaggccu

SEQ ID NO: 100279 - RNA, 22 nt, Human
ggcuuugggaggaugaggcggu

SEQ ID NO: 100280 - RNA, 22 nt, Human
ggcuucuuaacauuuggacacc

SEQ ID NO: 100281 - RNA, 22 nt, Human
gcuguugagucagacaaguuuu

SEQ ID NO: 100282 - RNA, 20 nt, Human
ggcauuuuuuaguugagcuu

SEQ ID NO: 100283 - RNA, 22 nt, Human
ggccaauuuccuagacauuagu

SEQ ID NO: 100284 - RNA, 19 nt, Human
ggccacacuauuaaaagau

SEQ ID NO: 100285 - RNA, 22 nt, Human
ggccaccuaagguugugcauca

SEQ ID NO: 100286 - RNA, 21 nt, Human
ggccagauucucccauagcug

SEQ ID NO: 100287 - RNA, 21 nt, Human
ggcuguuaauagugauuagaa

SEQ ID NO: 100288 - RNA, 22 nt, Human
gugaaaauaguaaccuggcuag

SEQ ID NO: 100289 - RNA, 22 nt, Human
gucuuugagccucaguuuccuc

SEQ ID NO: 100290 - RNA, 22 nt, Human
ggcuguggcagcuggaaguggu

SEQ ID NO: 100291 - RNA, 22 nt, Human
ggcugugaaguacguugaaggu

SEQ ID NO: 100292 - RNA, 22 nt, Human
gucuuucuuuuacauauuugug

SEQ ID NO: 100293 - RNA, 22 nt, Human
gucuucugacacuguuaggagg

SEQ ID NO: 100294 - RNA, 18 nt, Human
gucuguuccuuuaauguc

SEQ ID NO: 100295 - RNA, 22 nt, Human
gucugugguccaaaauugccuc

SEQ ID NO: 100296 - RNA, 22 nt, Human
gucuguuggcacagggggaggu

SEQ ID NO: 100297 - RNA, 22 nt, Human
gugaaacuggaugugaaaacaa

SEQ ID NO: 100298 - RNA, 22 nt, Human
ggcuuauauguauucccagaga

SEQ ID NO: 100299 - RNA, 22 nt, Human
ggcuuaugaucugacccaucga

SEQ ID NO: 100300 - RNA, 22 nt, Human
ggcuucaaaacacaugucaaga

SEQ ID NO: 100301 - RNA, 22 nt, Human
gugaaauuguacacucaguacc

SEQ ID NO: 100302 - RNA, 23 nt, Human
gugaacaaugcuccaggagauac

SEQ ID NO: 100303 - RNA, 22 nt, Human
gugaaaugaagugacuggauau

SEQ ID NO: 100304 - RNA, 22 nt, Human
gugaagaugccucaggugaccc

SEQ ID NO: 100305 - RNA, 22 nt, Human
gugaagcaagggucaccugugg

SEQ ID NO: 100306 - RNA, 22 nt, Human
ggcuuguaggugauggagaacu

SEQ ID NO: 100307 - RNA, 19 nt, Human
ggcuuugcccuucgcuccg

SEQ ID NO: 100308 - RNA, 22 nt, Human
gggaagaaccucugcuaccaau

SEQ ID NO: 100309 - RNA, 22 nt, Human
gugagagugguuuauguccaug

SEQ ID NO: 100310 - RNA, 22 nt, Human
gugaguuuucgugacacuauuu

SEQ ID NO: 100311 - RNA, 17 nt, Human
gugagcugagucaggac

SEQ ID NO: 100312 - RNA, 22 nt, Human
gugaguguguccgacuccaagg

SEQ ID NO: 100313 - RNA, 22 nt, Human
gugaucagaagaaccugccgaa

SEQ ID NO: 100314 - RNA, 22 nt, Human
gggaagaagaaaagagguggga

SEQ ID NO: 100315 - RNA, 18 nt, Human
gggaagaugccacaguga

SEQ ID NO: 100316 - RNA, 22 nt, Human
gggaagugcaguuuucuuuugg

SEQ ID NO: 100317 - RNA, 22 nt, Human
gggaaaaaggaaccuuauuacu

SEQ ID NO: 100318 - RNA, 22 nt, Human
ggcuuuuucccuaggguaagag

SEQ ID NO: 100319 - RNA, 22 nt, Human
gugaaggggaagcagggagagg

SEQ ID NO: 100320 - RNA, 21 nt, Human
gugaccuguuaugcaaaggca

SEQ ID NO: 100321 - RNA, 22 nt, Human
gugaccagacagagucuagccc

SEQ ID NO: 100322 - RNA, 22 nt, Human
ggcuucucuuggccaugguccc

SEQ ID NO: 100323 - RNA, 22 nt, Human
gugacucuacuuaagauuaagc

SEQ ID NO: 100324 - RNA, 23 nt, Human
gggaaaucaaaagauauuucuuc

SEQ ID NO: 100325 - RNA, 22 nt, Human
gggaaaugugucuuggcauucu

SEQ ID NO: 100326 - RNA, 22 nt, Human
gggcaagaagcuggaagcauuc

SEQ ID NO: 100327 - RNA, 22 nt, Human
gugcucuagaaauugucagugg

SEQ ID NO: 100328 - RNA, 22 nt, Human
gggauggggagcuggaaagggg

SEQ ID NO: 100329 - RNA, 22 nt, Human
gggauguuuugcaggcaaagaa

SEQ ID NO: 100330 - RNA, 22 nt, Human
gugcucgagcugugcgcgcugc

SEQ ID NO: 100331 - RNA, 22 nt, Human
gugcucaucuucuguaacuguu

SEQ ID NO: 100332 - RNA, 22 nt, Human
gggagggggauucuggcgagaa

SEQ ID NO: 100333 - RNA, 21 nt, Human
gggagugaguaaugauggggg

SEQ ID NO: 100334 - RNA, 22 nt, Human
gggauacuuuguuucccugcca

SEQ ID NO: 100335 - RNA, 22 nt, Human
gggaugaaugccuggcuccccc

SEQ ID NO: 100336 - RNA, 22 nt, Human
gggagggcuuggacccagaugu

SEQ ID NO: 100337 - RNA, 22 nt, Human
gugccgaugaggccuggcauuc

SEQ ID NO: 100338 - RNA, 22 nt, Human
gugccaccagaugcuguugcua

SEQ ID NO: 100339 - RNA, 22 nt, Human
gugccaaauagcuugauuaaga

SEQ ID NO: 100340 - RNA, 22 nt, Human
gugcacagaaacauacaaugug

SEQ ID NO: 100341 - RNA, 22 nt, Human
gggaggcagacgcuggagccca

SEQ ID NO: 100342 - RNA, 22 nt, Human
gggagcuggagcuggaagacuc

SEQ ID NO: 100343 - RNA, 22 nt, Human
gggagcugagcuggaagagaau

SEQ ID NO: 100344 - RNA, 22 nt, Human
gggagccagcagggcauggagc

SEQ ID NO: 100345 - RNA, 22 nt, Human
gugcaaugaguguggcaaagcc

SEQ ID NO: 100346 - RNA, 21 nt, Human
gggagaguagcgguagggagg

SEQ ID NO: 100347 - RNA, 22 nt, Human
gugcagcugggcgcugaccuuc

SEQ ID NO: 100348 - RNA, 22 nt, Human
gugcacuugaucuagacagauu

SEQ ID NO: 100349 - RNA, 22 nt, Human
gugauucaucuggggccuuauu

SEQ ID NO: 100350 - RNA, 22 nt, Human
gggacgggcuagcugccguggc

SEQ ID NO: 100351 - RNA, 19 nt, Human
gugaugaugccacuccaac

SEQ ID NO: 100352 - RNA, 22 nt, Human
gugaugaaggccugcaccuggu

SEQ ID NO: 100353 - RNA, 20 nt, Human
gggaauggauggauugcucc

SEQ ID NO: 100354 - RNA, 22 nt, Human
gggaauguuaaccuuucuauuu

SEQ ID NO: 100355 - RNA, 22 nt, Human
gugauggggagagcgcagcuuu

SEQ ID NO: 100356 - RNA, 22 nt, Human
gucuauaaccuuuccaauuacc

SEQ ID NO: 100357 - RNA, 22 nt, Human
gucuauuuauagacagauccua

SEQ ID NO: 100358 - RNA, 22 nt, Human
gucugaaauaucuuuugucuug

SEQ ID NO: 100359 - RNA, 22 nt, Human
gucucuuuugauuuuucacuca

SEQ ID NO: 100360 - RNA, 22 nt, Human
gucugcacgugccagggagggg

SEQ ID NO: 100361 - RNA, 22 nt, Human
ggcuggacuuucugcugggcuc

SEQ ID NO: 100362 - RNA, 22 nt, Human
ggcuggagcaggcugcacagug

SEQ ID NO: 100363 - RNA, 22 nt, Human
gucugcucauguuugguuugug

SEQ ID NO: 100364 - RNA, 22 nt, Human
gucuggugguggguguagggca

SEQ ID NO: 100365 - RNA, 22 nt, Human
gucgguacuaguacugguguug

SEQ ID NO: 100366 - RNA, 22 nt, Human
gucgcuuuccugaggggucuca

SEQ ID NO: 100367 - RNA, 22 nt, Human
guccuuuauuugaacaugacau

SEQ ID NO: 100368 - RNA, 22 nt, Human
gucguagaaccuuuuccaaaca

SEQ ID NO: 100369 - RNA, 22 nt, Human
ggcugcuauuggucuggcuugg

SEQ ID NO: 100370 - RNA, 22 nt, Human
ggcugcugcccaccccugcaug

SEQ ID NO: 100371 - RNA, 22 nt, Human
ggcugcuggaguugggucucuc

SEQ ID NO: 100372 - RNA, 22 nt, Human
gucguuugucaauuuugaugug

SEQ ID NO: 100373 - RNA, 22 nt, Human
gucuauucaucauucaucaaac

SEQ ID NO: 100374 - RNA, 22 nt, Human
guccccugcuguggaucugugg

SEQ ID NO: 100375 - RNA, 22 nt, Human
guccuggugccaccugcgggau

SEQ ID NO: 100376 - RNA, 22 nt, Human
guccuguccuguccuggagaca

SEQ ID NO: 100377 - RNA, 22 nt, Human
guccuguguaaguacuugcuca

SEQ ID NO: 100378 - RNA, 22 nt, Human
ggcugcaagacguuauuagcgu

SEQ ID NO: 100379 - RNA, 22 nt, Human
ggcugaugacgccugagucuga

SEQ ID NO: 100380 - RNA, 22 nt, Human
ggcugagguguggggaacuaua

SEQ ID NO: 100381 - RNA, 22 nt, Human
ggcuccuuguaugauauuuugu

SEQ ID NO: 100382 - RNA, 22 nt, Human
ggcuccugggcgucuucgaaca

SEQ ID NO: 100383 - RNA, 22 nt, Human
ggcucuggcgagcuuuaguaca

SEQ ID NO: 100384 - RNA, 22 nt, Human
ggcucagaggagcuggaacggu

SEQ ID NO: 100385 - RNA, 22 nt, Human
ggcuccagauguccccuggcaa

SEQ ID NO: 100386 - RNA, 22 nt, Human
ggcgucuugcgggcgguagcgc

SEQ ID NO: 100387 - RNA, 22 nt, Human
ggcuaaggacgggcaaguccca

SEQ ID NO: 100388 - RNA, 22 nt, Human
guccauauuuauccuuaaagua

SEQ ID NO: 100389 - RNA, 19 nt, Human
guccaaauggaaccccuug

SEQ ID NO: 100390 - RNA, 23 nt, Human
gucauuacuguuaccuuauucuu

SEQ ID NO: 100391 - RNA, 22 nt, Human
gucacuuuuaagggccuuuucu

SEQ ID NO: 100392 - RNA, 22 nt, Human
gucagaagauagaggaaguuug

SEQ ID NO: 100393 - RNA, 23 nt, Human
gucagcuugaccaguggagaguc

SEQ ID NO: 100394 - RNA, 22 nt, Human
gucagauucuuucauuugcuga

SEQ ID NO: 100395 - RNA, 20 nt, Human
gucaucucagggacugucug

SEQ ID NO: 100396 - RNA, 22 nt, Human
ggcggcaagggaauggagaaga

SEQ ID NO: 100397 - RNA, 22 nt, Human
ggcggaggucacgcacccgcca

SEQ ID NO: 100398 - RNA, 22 nt, Human
ggcggugcgaggaugcagggcu

SEQ ID NO: 100399 - RNA, 22 nt, Human
gucacucuuuuucagcuagcuc

SEQ ID NO: 100400 - RNA, 22 nt, Human
gucaccgguuuuuagguaaaca

SEQ ID NO: 100401 - RNA, 22 nt, Human
gucaaaggcggugcaggaggag

SEQ ID NO: 100402 - RNA, 22 nt, Human
gucaaugcuuaguuugccugaa

SEQ ID NO: 100403 - RNA, 22 nt, Human
guauucugugugaucaagugau

SEQ ID NO: 100404 - RNA, 22 nt, Human
ggcgaguacagacggggccugg

SEQ ID NO: 100405 - RNA, 22 nt, Human
gguuuauucccacaaaggaagu

SEQ ID NO: 100406 - RNA, 22 nt, Human
gguuuguggagcuggaaacacu

SEQ ID NO: 100407 - RNA, 22 nt, Human
gguuugauauguuugugauucu

SEQ ID NO: 100408 - RNA, 22 nt, Human
gguuugccagugcuggaaugca

SEQ ID NO: 100409 - RNA, 22 nt, Human
ggcccgcgcugcuggcgcgcca

SEQ ID NO: 100410 - RNA, 22 nt, Human
ggccccggaggccguuagcuua

SEQ ID NO: 100411 - RNA, 22 nt, Human
guauaaauaucuauauuguuac

SEQ ID NO: 100412 - RNA, 22 nt, Human
guauggaguuuuguugcacuuc

SEQ ID NO: 100413 - RNA, 22 nt, Human
guaugucuuaggguucaguaac

SEQ ID NO: 100414 - RNA, 22 nt, Human
guaugugucuuagaacuuggga

SEQ ID NO: 100415 - RNA, 22 nt, Human
ggcgcuccccgccugcgucgcg

SEQ ID NO: 100416 - RNA, 22 nt, Human
ggcgccuuguggaaugagagcu

SEQ ID NO: 100417 - RNA, 22 nt, Human
ggcgaggcgggccgcggggucu

SEQ ID NO: 100418 - RNA, 22 nt, Human
ggcgaugaggucuuagaaucua

SEQ ID NO: 100419 - RNA, 22 nt, Human
ggcgcaguguucgcccucucgc

SEQ ID NO: 100420 - RNA, 22 nt, Human
guaucaggacuaaauuauggau

SEQ ID NO: 100421 - RNA, 22 nt, Human
guauccuccccgcuggccuuca

SEQ ID NO: 100422 - RNA, 19 nt, Human
ggucugcggggugaccgug

SEQ ID NO: 100423 - RNA, 22 nt, Human
guuguuuuuguuaaaacaguga

SEQ ID NO: 100424 - RNA, 22 nt, Human
ggucugauaccugcagguuguc

SEQ ID NO: 100425 - RNA, 22 nt, Human
guuuaucagagagcagaggugg

SEQ ID NO: 100426 - RNA, 22 nt, Human
guuuaaguuaaaauuuaccugc

SEQ ID NO: 100427 - RNA, 22 nt, Human
guuuaagcagauugcuguggug

SEQ ID NO: 100428 - RNA, 22 nt, Human
ggugaucucuggcucugcuugu

SEQ ID NO: 100429 - RNA, 22 nt, Human
guuuccuuuugugguuuuucua

SEQ ID NO: 100430 - RNA, 22 nt, Human
guuuccaggcuuugguaugguu

SEQ ID NO: 100431 - RNA, 22 nt, Human
guuucuguggacucugcuuagg

SEQ ID NO: 100432 - RNA, 22 nt, Human
guuucuguguugauugugcccu

SEQ ID NO: 100433 - RNA, 22 nt, Human
ggugagagaaaagaaacacugu

SEQ ID NO: 100434 - RNA, 22 nt, Human
guugucguucccccugcuuaaa

SEQ ID NO: 100435 - RNA, 22 nt, Human
guuggugagaguuagggauuua

SEQ ID NO: 100436 - RNA, 22 nt, Human
guugugcaaaacaggaaggucu

SEQ ID NO: 100437 - RNA, 22 nt, Human
gugcuuccuguauugauuccau

SEQ ID NO: 100438 - RNA, 19 nt, Human
guuguguuugguucuuuug

SEQ ID NO: 100439 - RNA, 22 nt, Human
ggucuagcucggugcuggcgac

SEQ ID NO: 100440 - RNA, 22 nt, Human
ggucgucuguccugucgccgcu

SEQ ID NO: 100441 - RNA, 22 nt, Human
ggucggggcuggccggcguggu

SEQ ID NO: 100442 - RNA, 22 nt, Human
ggucgguuggagagaucaugaa

SEQ ID NO: 100443 - RNA, 22 nt, Human
guuggguaauuaagcacagaaa

SEQ ID NO: 100444 - RNA, 22 nt, Human
guugggugccagaggcuucacg

SEQ ID NO: 100445 - RNA, 22 nt, Human
guugggcugaagugugugcuua

SEQ ID NO: 100446 - RNA, 22 nt, Human
guugggguuucaguggcaguca

SEQ ID NO: 100447 - RNA, 22 nt, Human
guugggauugaaggugccucua

SEQ ID NO: 100448 - RNA, 22 nt, Human
guuggaggaaggacaggaacag

SEQ ID NO: 100449 - RNA, 22 nt, Human
gugcuugaguaaaaauagucuu

SEQ ID NO: 100450 - RNA, 22 nt, Human
guugcuucuuggcuuuuccaac

SEQ ID NO: 100451 - RNA, 22 nt, Human
guuggaaauaucagucacguga

SEQ ID NO: 100452 - RNA, 22 nt, Human
gugcugucguggaacugggcug

SEQ ID NO: 100453 - RNA, 22 nt, Human
gugcucuauguugauuccuuga

SEQ ID NO: 100454 - RNA, 22 nt, Human
gugcuggcaaagagaacaucuu

SEQ ID NO: 100455 - RNA, 22 nt, Human
gugcugggaggcccaggaugga

SEQ ID NO: 100456 - RNA, 22 nt, Human
gguuuucagaaugcaguccugu

SEQ ID NO: 100457 - RNA, 22 nt, Human
uaaagugaaguucagaauggcu

SEQ ID NO: 100458 - RNA, 22 nt, Human
gguuucuuuccucucugugccu

SEQ ID NO: 100459 - RNA, 22 nt, Human
uaaacgaagcuucaugcuugaa

SEQ ID NO: 100460 - RNA, 22 nt, Human
uaaaggaguguauaauuguagu

SEQ ID NO: 100461 - RNA, 22 nt, Human
uaaaaucaugacagauugacau

SEQ ID NO: 100462 - RNA, 22 nt, Human
uaaaauaccacauauggugcuc

SEQ ID NO: 100463 - RNA, 22 nt, Human
uaaaaugcucagauaaauauau

SEQ ID NO: 100464 - RNA, 22 nt, Human
uaaaccuuauuugaauaccaac

SEQ ID NO: 100465 - RNA, 22 nt, Human
gguuuucuuguucauuuuuuaa

SEQ ID NO: 100466 - RNA, 22 nt, Human
guaagaauauacccaggaguca

SEQ ID NO: 100467 - RNA, 22 nt, Human
guaagcagcaugacgguuggau

SEQ ID NO: 100468 - RNA, 22 nt, Human
guaaccacuaugguuauugauu

SEQ ID NO: 100469 - RNA, 22 nt, Human
guaacuuuuuccucauuggcua

SEQ ID NO: 100470 - RNA, 22 nt, Human
uaaauuccuagucacaaacuuc

SEQ ID NO: 100471 - RNA, 22 nt, Human
uaaauuagauucccagcgcuau

SEQ ID NO: 100472 - RNA, 22 nt, Human
guacaaagucaaggugaaaaua

SEQ ID NO: 100473 - RNA, 22 nt, Human
guacauauccuuuacguuuugu

SEQ ID NO: 100474 - RNA, 22 nt, Human
guacuacagguuugguaguggg

SEQ ID NO: 100475 - RNA, 22 nt, Human
guacugggaauggagccugggc

SEQ ID NO: 100476 - RNA, 22 nt, Human
ggugugugugugugugugugug

SEQ ID NO: 100477 - RNA, 22 nt, Human
uaaaaauuagauauguauuuag

SEQ ID NO: 100478 - RNA, 22 nt, Human
uaaaaaccuuguauuuaacucu

SEQ ID NO: 100479 - RNA, 22 nt, Human
gguguggcaguggaccugugaa

SEQ ID NO: 100480 - RNA, 22 nt, Human
ggugugaauagagccuggagca

SEQ ID NO: 100481 - RNA, 22 nt, Human
ggugugggcagaugcccuacuu

SEQ ID NO: 100482 - RNA, 22 nt, Human
ggugucuuugauguugggcuga

SEQ ID NO: 100483 - RNA, 22 nt, Human
gguguggguguuaguuugcuua

SEQ ID NO: 100484 - RNA, 22 nt, Human
gguguguaggugaaggccaaga

SEQ ID NO: 100485 - RNA, 22 nt, Human
guuuuggagauguccauuuucc

SEQ ID NO: 100486 - RNA, 22 nt, Human
gguguagggaaacuugacuaau

SEQ ID NO: 100487 - RNA, 22 nt, Human
ggugucaucugggcuggagaua

SEQ ID NO: 100488 - RNA, 22 nt, Human
ggugucguuucacaugacccag

SEQ ID NO: 100489 - RNA, 22 nt, Human
guuuguuugccagcuuaguaaa

SEQ ID NO: 100490 - RNA, 22 nt, Human
guuuguguauauguguauuuuu

SEQ ID NO: 100491 - RNA, 22 nt, Human
ggugcaauaaaguuguagaacc

SEQ ID NO: 100492 - RNA, 22 nt, Human
ggugcagucuggggcacauuau

SEQ ID NO: 100493 - RNA, 19 nt, Human
ggugaucugucccuugcuc

SEQ ID NO: 100494 - RNA, 22 nt, Human
gugacugagugaagguugggua

SEQ ID NO: 100495 - RNA, 22 nt, Human
uacuuuaauugcaaaaauaaau

SEQ ID NO: 100496 - RNA, 22 nt, Human
uacuugaacaucacuaagagaa

SEQ ID NO: 100497 - RNA, 22 nt, Human
gugacugagcuggcaaaguaug

SEQ ID NO: 100498 - RNA, 22 nt, Human
gugaaggcaugugugcugugcu

SEQ ID NO: 100499 - RNA, 20 nt, Human
gugaaguuuucugaagacag

SEQ ID NO: 100500 - RNA, 22 nt, Human
gugaagguccugauuugugacc

SEQ ID NO: 100501 - RNA, 20 nt, Human
uacguguccgaugaucacag

SEQ ID NO: 100502 - RNA, 22 nt, Human
uacuaaacugcauuucuaucua

SEQ ID NO: 100503 - RNA, 22 nt, Human
uacugggugagcugggcuggga

SEQ ID NO: 100504 - RNA, 19 nt, Human
gucuuauggauagcuccuc

SEQ ID NO: 100505 - RNA, 22 nt, Human
uaccucauguucaggaggauca

SEQ ID NO: 100506 - RNA, 22 nt, Human
uaccuggauaaauguacaaccg

SEQ ID NO: 100507 - RNA, 22 nt, Human
uacugguguauuucuucuuauu

SEQ ID NO: 100508 - RNA, 22 nt, Human
uacuggguguucugagaaaaua

SEQ ID NO: 100509 - RNA, 22 nt, Human
uacuucauucaaguucgcuaua

SEQ ID NO: 100510 - RNA, 22 nt, Human
uacuucuuuuguaaaguauuga

SEQ ID NO: 100511 - RNA, 20 nt, Human
gugaacuggagaacugaugu

SEQ ID NO: 100512 - RNA, 22 nt, Human
uacauaauucauuagcuccucu

SEQ ID NO: 100513 - RNA, 22 nt, Human
uacauaauagcaaggugcuguc

SEQ ID NO: 100514 - RNA, 22 nt, Human
uacagauaaaaaugcuguucuu

SEQ ID NO: 100515 - RNA, 22 nt, Human
uaccaauuaaauagccaaucua

SEQ ID NO: 100516 - RNA, 22 nt, Human
gucuguacugccguuauucaga

SEQ ID NO: 100517 - RNA, 22 nt, Human
uacauggauguuauccuuacug

SEQ ID NO: 100518 - RNA, 22 nt, Human
gucuugugaagacggcagaaag

SEQ ID NO: 100519 - RNA, 22 nt, Human
uacauuugauuuuugcuucuuu

SEQ ID NO: 100520 - RNA, 22 nt, Human
uacauuccagaaaguuucugua

SEQ ID NO: 100521 - RNA, 22 nt, Human
gugaaaaauggccaucaggaca

SEQ ID NO: 100522 - RNA, 22 nt, Human
uacaaaauucaaauaauguuug

SEQ ID NO: 100523 - RNA, 22 nt, Human
gucuggagccacugcugcugcu

SEQ ID NO: 100524 - RNA, 22 nt, Human
gucugguggaguuguauauacu

SEQ ID NO: 100525 - RNA, 22 nt, Human
gucugcuuuuaucacaugucau

SEQ ID NO: 100526 - RNA, 22 nt, Human
gucgagaacauucauuaugcaa

SEQ ID NO: 100527 - RNA, 22 nt, Human
uaauuucauuuugcaaugaucu

SEQ ID NO: 100528 - RNA, 22 nt, Human
gucgccuaauuaggguauccua

SEQ ID NO: 100529 - RNA, 22 nt, Human
gucgcuugaacccaggaagugg

SEQ ID NO: 100530 - RNA, 22 nt, Human
gucgucgcucccaccuuccgcu

SEQ ID NO: 100531 - RNA, 22 nt, Human
gucguucugcuauucuaugagg

SEQ ID NO: 100532 - RNA, 20 nt, Human
gucguguauauagcuggggc

SEQ ID NO: 100533 - RNA, 22 nt, Human
guccaucuugcaaugagaccua

SEQ ID NO: 100534 - RNA, 22 nt, Human
guccaguaguguuugcaugugg

SEQ ID NO: 100535 - RNA, 22 nt, Human
gucccagaggacagggucacau

SEQ ID NO: 100536 - RNA, 22 nt, Human
gucaugaugauacagguggagg

SEQ ID NO: 100537 - RNA, 22 nt, Human
guauggggugacaaaaauuagu

SEQ ID NO: 100538 - RNA, 22 nt, Human
guccaauguggcaccacagggg

SEQ ID NO: 100539 - RNA, 22 nt, Human
uaaugaugaacacuuggaagaa

SEQ ID NO: 100540 - RNA, 22 nt, Human
uaauccaaaccaggaauucccu

SEQ ID NO: 100541 - RNA, 22 nt, Human
uaauauaacugccaguuaaggu

SEQ ID NO: 100542 - RNA, 22 nt, Human
gucccuggucuaccguggcuuc

SEQ ID NO: 100543 - RNA, 22 nt, Human
guccuaugggaagggauccugg

SEQ ID NO: 100544 - RNA, 22 nt, Human
guccucgggcucacucccaggg

SEQ ID NO: 100545 - RNA, 22 nt, Human
uaauggagggucugagucuggg

SEQ ID NO: 100546 - RNA, 22 nt, Human
guccuguccugcugagcuccug

SEQ ID NO: 100547 - RNA, 22 nt, Human
guccugaaaaaaaucccugagu

SEQ ID NO: 100548 - RNA, 22 nt, Human
guccucugggagccuugagccu

SEQ ID NO: 100549 - RNA, 22 nt, Human
uaaugcucauuuggcucugcaa

SEQ ID NO: 100550 - RNA, 22 nt, Human
guccuggagcagcuggaagaug

SEQ ID NO: 100551 - RNA, 22 nt, Human
guccuuuuuuuauacccaggcc

SEQ ID NO: 100552 - RNA, 22 nt, Human
uaauucuucaauccaguguuca

SEQ ID NO: 100553 - RNA, 22 nt, Human
uaauucuagauugacauuuuga

SEQ ID NO: 100554 - RNA, 22 nt, Human
uaagaccuuuuugaaaucacug

SEQ ID NO: 100555 - RNA, 22 nt, Human
uaacacauagauauuuuaacuu

SEQ ID NO: 100556 - RNA, 21 nt, Human
uaagaacauuaucuucuuccu

SEQ ID NO: 100557 - RNA, 22 nt, Human
uaagaauguuuguugaguaaau

SEQ ID NO: 100558 - RNA, 22 nt, Human
guagagccaccaccaccauagc

SEQ ID NO: 100559 - RNA, 22 nt, Human
guagaucaugaaaauucacugc

SEQ ID NO: 100560 - RNA, 22 nt, Human
guagauaauuuuggaaagcugg

SEQ ID NO: 100561 - RNA, 22 nt, Human
gucaucugagggacgagauuuc

SEQ ID NO: 100562 - RNA, 22 nt, Human
gucagugcuuuaguucaggaug

SEQ ID NO: 100563 - RNA, 22 nt, Human
gucagugaaccuucaccaaacc

SEQ ID NO: 100564 - RNA, 19 nt, Human
gucagucuuaaguuucagc

SEQ ID NO: 100565 - RNA, 22 nt, Human
gucacuccuucccagagggagc

SEQ ID NO: 100566 - RNA, 22 nt, Human
gucacgucgggacagacugggg

SEQ ID NO: 100567 - RNA, 22 nt, Human
guauuggcaguauacauagcac

SEQ ID NO: 100568 - RNA, 22 nt, Human
uaaggcuguuaggaggauuaaa

SEQ ID NO: 100569 - RNA, 19 nt, Human
uaaguagaugacugaugcu

SEQ ID NO: 100570 - RNA, 22 nt, Human
uaaguaauugugguuuuugcca

SEQ ID NO: 100571 - RNA, 22 nt, Human
guauuugacaccagugaauggu

SEQ ID NO: 100572 - RNA, 22 nt, Human
uaagggaagucuucaggagaca

SEQ ID NO: 100573 - RNA, 22 nt, Human
ucaacauguuuuuuaaaagaaa

SEQ ID NO: 100574 - RNA, 20 nt, Human
guugggagaagugucagcug

SEQ ID NO: 100575 - RNA, 22 nt, Human
ucaaaucugauaggcgacaccu

SEQ ID NO: 100576 - RNA, 22 nt, Human
guuggggccuggagucucuugg

SEQ ID NO: 100577 - RNA, 22 nt, Human
guugguggaggcgagagaagaa

SEQ ID NO: 100578 - RNA, 21 nt, Human
ucaaccagguguugaaggcac

SEQ ID NO: 100579 - RNA, 23 nt, Human
guugccuuugcaucuucauccau

SEQ ID NO: 100580 - RNA, 22 nt, Human
uauuuucucugccacacuucca

SEQ ID NO: 100581 - RNA, 22 nt, Human
guugggaauucggagagaaaua

SEQ ID NO: 100582 - RNA, 22 nt, Human
guuggcgaaggaccuggaggag

SEQ ID NO: 100583 - RNA, 23 nt, Human
uauuuuccccuguaauauguauu

SEQ ID NO: 100584 - RNA, 22 nt, Human
guucucuuaauccuaguuggua

SEQ ID NO: 100585 - RNA, 22 nt, Human
uauuuguuuuuaaugcugggug

SEQ ID NO: 100586 - RNA, 22 nt, Human
uauuuuaaaagcauuaauucuu

SEQ ID NO: 100587 - RNA, 22 nt, Human
guucuuagguacucauauuuaa

SEQ ID NO: 100588 - RNA, 23 nt, Human
guuauugcuggugcuggccagcc

SEQ ID NO: 100589 - RNA, 22 nt, Human
uauuauggguuuuuguguaaau

SEQ ID NO: 100590 - RNA, 18 nt, Human
guucaagcauuuugcucu

SEQ ID NO: 100591 - RNA, 22 nt, Human
uauucagugcugguucuuuuuc

SEQ ID NO: 100592 - RNA, 17 nt, Human
guucucaaacugacuga

SEQ ID NO: 100593 - RNA, 22 nt, Human
guuccugugcccuguucuuucc

SEQ ID NO: 100594 - RNA, 22 nt, Human
guucggcuuccuaugucaugag

SEQ ID NO: 100595 - RNA, 22 nt, Human
guuccugagcaguuccuggcca

SEQ ID NO: 100596 - RNA, 22 nt, Human
guguucuuuguagaggaucuug

SEQ ID NO: 100597 - RNA, 22 nt, Human
uauguauaacuugauaggauga

SEQ ID NO: 100598 - RNA, 19 nt, Human
guguucuguuauacaguug

SEQ ID NO: 100599 - RNA, 22 nt, Human
uauguauguauguauguauaug

SEQ ID NO: 100600 - RNA, 22 nt, Human
guguuuguauccuccauauaac

SEQ ID NO: 100601 - RNA, 21 nt, Human
guguugugagguugguguuag

SEQ ID NO: 100602 - RNA, 22 nt, Human
uaugucuauugacuuaggauuu

SEQ ID NO: 100603 - RNA, 22 nt, Human
uaugugaguaccugucaugugc

SEQ ID NO: 100604 - RNA, 22 nt, Human
guuaaaaugauuugugauuuau

SEQ ID NO: 100605 - RNA, 22 nt, Human
guguuuugagaggaugguuuua

SEQ ID NO: 100606 - RNA, 22 nt, Human
uaugugguuugucauuuaauau

SEQ ID NO: 100607 - RNA, 22 nt, Human
uauguggcaggugggagaucag

SEQ ID NO: 100608 - RNA, 22 nt, Human
uauguuugcaguucuaggucuu

SEQ ID NO: 100609 - RNA, 22 nt, Human
guuaucauccucagaggcaguu

SEQ ID NO: 100610 - RNA, 22 nt, Human
guuaauaugcaaaacggaugcg

SEQ ID NO: 100611 - RNA, 22 nt, Human
guuaaaugcagauucugacuca

SEQ ID NO: 100612 - RNA, 22 nt, Human
guuacagagcugcuaugugugc

SEQ ID NO: 100613 - RNA, 22 nt, Human
uaucauuaggagugcugcucgg

SEQ ID NO: 100614 - RNA, 23 nt, Human
gugguguaaaugccaaaaugaaa

SEQ ID NO: 100615 - RNA, 22 nt, Human
guggugguguuggugacaaguu

SEQ ID NO: 100616 - RNA, 22 nt, Human
gugguuugcugguguacguuua

SEQ ID NO: 100617 - RNA, 22 nt, Human
guggugaacauuugcaucugcu

SEQ ID NO: 100618 - RNA, 22 nt, Human
gugggugucaguaucuuuaacg

SEQ ID NO: 100619 - RNA, 22 nt, Human
guggucaagaccgggaauagga

SEQ ID NO: 100620 - RNA, 22 nt, Human
guguggcgacucagagcugccu

SEQ ID NO: 100621 - RNA, 20 nt, Human
uaugcgaagccuuucuggac

SEQ ID NO: 100622 - RNA, 22 nt, Human
uaugcaucaguaugguuggaaa

SEQ ID NO: 100623 - RNA, 19 nt, Human
uaugaaguugauaaaaguu

SEQ ID NO: 100624 - RNA, 22 nt, Human
guguagauuuguucaccuauua

SEQ ID NO: 100625 - RNA, 22 nt, Human
guguauaguggugucgguagaa

SEQ ID NO: 100626 - RNA, 22 nt, Human
guguagugugcuguucaguguu

SEQ ID NO: 100627 - RNA, 22 nt, Human
uaugaaggauacaccucugauu

SEQ ID NO: 100628 - RNA, 22 nt, Human
uauccaucuucuuugagaaugg

SEQ ID NO: 100629 - RNA, 22 nt, Human
guggcagguguacagcucagcu

SEQ ID NO: 100630 - RNA, 22 nt, Human
guggcaguaaagcuggaaaagu

SEQ ID NO: 100631 - RNA, 22 nt, Human
guggcauggggagcagcuagaa

SEQ ID NO: 100632 - RNA, 20 nt, Human
guggcagugguggcagcagu

SEQ ID NO: 100633 - RNA, 22 nt, Human
guggcagagccuugcggcuuug

SEQ ID NO: 100634 - RNA, 22 nt, Human
uagggggagugugcugaagcca

SEQ ID NO: 100635 - RNA, 22 nt, Human
uaggguagugggaaacuggacg

SEQ ID NO: 100636 - RNA, 22 nt, Human
uaggguuucaugcugguuucca

SEQ ID NO: 100637 - RNA, 22 nt, Human
uaggcuuuguuacuuucccuuu

SEQ ID NO: 100638 - RNA, 22 nt, Human
uaggcagggauuaggguugauu

SEQ ID NO: 100639 - RNA, 22 nt, Human
uagguggaaccauaugaaauuu

SEQ ID NO: 100640 - RNA, 22 nt, Human
uaguagcuguuguuuuuuaaac

SEQ ID NO: 100641 - RNA, 22 nt, Human
guggccugacagaucggaacag

SEQ ID NO: 100642 - RNA, 22 nt, Human
guggcuggguggaacugagucu

SEQ ID NO: 100643 - RNA, 22 nt, Human
guggcuuauguccagcagauau

SEQ ID NO: 100644 - RNA, 22 nt, Human
guggcuuaauauuuauagcaga

SEQ ID NO: 100645 - RNA, 22 nt, Human
gugggccaguuccucacaggua

SEQ ID NO: 100646 - RNA, 22 nt, Human
gugggcagauuaauuucucaau

SEQ ID NO: 100647 - RNA, 22 nt, Human
gugggcacguccuacugucacu

SEQ ID NO: 100648 - RNA, 18 nt, Human
gugggcacacacucuguu

SEQ ID NO: 100649 - RNA, 22 nt, Human
guggggcgggucccccgccugg

SEQ ID NO: 100650 - RNA, 22 nt, Human
gugggggauggcgugugggucu

SEQ ID NO: 100651 - RNA, 22 nt, Human
gugggggugaggaauguucuau

SEQ ID NO: 100652 - RNA, 22 nt, Human
uaguaugaaaauuagcgggagg

SEQ ID NO: 100653 - RNA, 22 nt, Human
uaguggaaacagacugagcccg

SEQ ID NO: 100654 - RNA, 22 nt, Human
uagugcuucauucuauugguuu

SEQ ID NO: 100655 - RNA, 22 nt, Human
guggguauauauaugugugcug

SEQ ID NO: 100656 - RNA, 22 nt, Human
uagugggguccacuuccuucac

SEQ ID NO: 100657 - RNA, 18 nt, Human
uaguggguccaagcacau

SEQ ID NO: 100658 - RNA, 22 nt, Human
uagugucuuccaggacauggua

SEQ ID NO: 100659 - RNA, 22 nt, Human
uagugauuuaagaaaggugacu

SEQ ID NO: 100660 - RNA, 22 nt, Human
uaguauuuguaauuaucaaagc

SEQ ID NO: 100661 - RNA, 22 nt, Human
guggagaagggaccgggaagga

SEQ ID NO: 100662 - RNA, 22 nt, Human
guggaggaagaucuuugaugau

SEQ ID NO: 100663 - RNA, 22 nt, Human
guggaguggguuguacucaggg

SEQ ID NO: 100664 - RNA, 22 nt, Human
uaggaaugcagaugcauaauaa

SEQ ID NO: 100665 - RNA, 22 nt, Human
guggauuucaggcuccccucag

SEQ ID NO: 100666 - RNA, 22 nt, Human
guggauuguaccacgaaaagug

SEQ ID NO: 100667 - RNA, 22 nt, Human
uaggcagauuccauauuuuggc

SEQ ID NO: 100668 - RNA, 22 nt, Human
gugcuuugcuaggaccgauugu

SEQ ID NO: 100669 - RNA, 22 nt, Human
guggaagggaaaccgcacuggc

SEQ ID NO: 100670 - RNA, 22 nt, Human
guggaaauuuuaggaucaucuu

SEQ ID NO: 100671 - RNA, 22 nt, Human
guggaaggaauuaacagacuag

SEQ ID NO: 100672 - RNA, 22 nt, Human
guggaagauauuucugguccag

SEQ ID NO: 100673 - RNA, 22 nt, Human
gugcugcaugagcaucacguag

SEQ ID NO: 100674 - RNA, 22 nt, Human
gugcuguuagcgguuuauaaca

SEQ ID NO: 100675 - RNA, 22 nt, Human
gugcuuuaccuuauuggucucg

SEQ ID NO: 100676 - RNA, 21 nt, Human
uagaagagggaauuugucuuu

SEQ ID NO: 100677 - RNA, 22 nt, Human
uacugucuuuuccuaaaugggu

SEQ ID NO: 100678 - RNA, 22 nt, Human
uagaacugcucucauacuugcu

SEQ ID NO: 100679 - RNA, 22 nt, Human
uagaagagcuuccaccuggggc

SEQ ID NO: 100680 - RNA, 17 nt, Human
uagccagcuugugauuu

SEQ ID NO: 100681 - RNA, 22 nt, Human
uagccguugggguaacuggaca

SEQ ID NO: 100682 - RNA, 22 nt, Human
gugcugcaaggauggagaggca

SEQ ID NO: 100683 - RNA, 20 nt, Human
uagcuucaccuagagauagc

SEQ ID NO: 100684 - RNA, 22 nt, Human
uaggaagagauuuucacauggc

SEQ ID NO: 100685 - RNA, 22 nt, Human
uagcguaugcugugugaugaau

SEQ ID NO: 100686 - RNA, 23 nt, Human
uagcggccaugacgggggucaca

SEQ ID NO: 100687 - RNA, 22 nt, Human
uagcguucuugcaugcuaaccu

SEQ ID NO: 100688 - RNA, 19 nt, Human
uagcuguucuugaguguga

SEQ ID NO: 100689 - RNA, 22 nt, Human
uagcuggaggggcaggaugcug

SEQ ID NO: 100690 - RNA, 22 nt, Human
uaacaguggucugugguaucug

SEQ ID NO: 100691 - RNA, 22 nt, Human
uaacauuagcuuugcucaugca

SEQ ID NO: 100692 - RNA, 22 nt, Human
uaaccaggaaaaagauaugcau

SEQ ID NO: 100693 - RNA, 22 nt, Human
uaacuguuuugaauauuguggu

SEQ ID NO: 100694 - RNA, 18 nt, Human
uaacugguuucuucccau

SEQ ID NO: 100695 - RNA, 19 nt, Human
ucagugggacauuugcuuu

SEQ ID NO: 100696 - RNA, 22 nt, Human
uaaaugcucuuuaaaagugcuu

SEQ ID NO: 100697 - RNA, 22 nt, Human
uaaauguugcuugugcugcuca

SEQ ID NO: 100698 - RNA, 22 nt, Human
ucagucauacuuuaugauugaa

SEQ ID NO: 100699 - RNA, 23 nt, Human
ucagugaaggaacaacuaaauag

SEQ ID NO: 100700 - RNA, 22 nt, Human
ucagugagauuuuuagcaguag

SEQ ID NO: 100701 - RNA, 22 nt, Human
ucagucugguggaugcucauug

SEQ ID NO: 100702 - RNA, 22 nt, Human
ucaggcaggaucccagggaagg

SEQ ID NO: 100703 - RNA, 22 nt, Human
ucaggucacugauaaaguggaa

SEQ ID NO: 100704 - RNA, 18 nt, Human
ucagggaaacuuugccug

SEQ ID NO: 100705 - RNA, 22 nt, Human
uaaagcauguuucaguaagguu

SEQ ID NO: 100706 - RNA, 22 nt, Human
ucaagcuggaaaugaagaaucu

SEQ ID NO: 100707 - RNA, 22 nt, Human
ucagucacugugaaaugaauuu

SEQ ID NO: 100708 - RNA, 22 nt, Human
ucagguuugcaaccucgggcaa

SEQ ID NO: 100709 - RNA, 22 nt, Human
ucagguuuaagcuacuggaauc

SEQ ID NO: 100710 - RNA, 22 nt, Human
ucagguuuaagugacuggaauc

SEQ ID NO: 100711 - RNA, 22 nt, Human
uaaaugaaaggguuuaauuuau

SEQ ID NO: 100712 - RNA, 22 nt, Human
uaaaugaaaugaagugaaagcu

SEQ ID NO: 100713 - RNA, 22 nt, Human
uaaauaugcaugugguauucau

SEQ ID NO: 100714 - RNA, 22 nt, Human
uaaaguguacaagucauaagua

SEQ ID NO: 100715 - RNA, 22 nt, Human
uaaaggcaaacucuccaaggau

SEQ ID NO: 100716 - RNA, 22 nt, Human
uccaagcgcuucuggagcuccu

SEQ ID NO: 100717 - RNA, 23 nt, Human
uacagccaugucgcugauuuaac

SEQ ID NO: 100718 - RNA, 18 nt, Human
uacagauguaugucuaca

SEQ ID NO: 100719 - RNA, 22 nt, Human
uacaaagugauuuuggaauuga

SEQ ID NO: 100720 - RNA, 21 nt, Human
uccaaaggagacugagugugu

SEQ ID NO: 100721 - RNA, 22 nt, Human
ucauuuaucgcugccuuuuaaa

SEQ ID NO: 100722 - RNA, 22 nt, Human
ucauuuaauuuggaacucagag

SEQ ID NO: 100723 - RNA, 22 nt, Human
ucauuguuucugcuuuucauga

SEQ ID NO: 100724 - RNA, 22 nt, Human
uacaaaugaucaucucuuugaa

SEQ ID NO: 100725 - RNA, 22 nt, Human
ucauuguuuacugucuuuuuuc

SEQ ID NO: 100726 - RNA, 22 nt, Human
uaauuuugucacagugacaugc

SEQ ID NO: 100727 - RNA, 22 nt, Human
uaauugaacguucauuuuuaau

SEQ ID NO: 100728 - RNA, 22 nt, Human
uaauugagauuucuggcugcuu

SEQ ID NO: 100729 - RNA, 22 nt, Human
uaauauccaguuauuucccuca

SEQ ID NO: 100730 - RNA, 22 nt, Human
uaauccaaaacugaaucugugg

SEQ ID NO: 100731 - RNA, 22 nt, Human
uaauaucuuuacacauuuucaa

SEQ ID NO: 100732 - RNA, 22 nt, Human
ucauuauuuugauguauuuccu

SEQ ID NO: 100733 - RNA, 22 nt, Human
uaauauauuuuuuaagggaugu

SEQ ID NO: 100734 - RNA, 22 nt, Human
uaagugcuagaauuccagguuu

SEQ ID NO: 100735 - RNA, 22 nt, Human
uaagugguagaaagagaaaggu

SEQ ID NO: 100736 - RNA, 22 nt, Human
ucaugcagauaagaauaaguaa

SEQ ID NO: 100737 - RNA, 22 nt, Human
ucaugagagaaaacgugcuucu

SEQ ID NO: 100738 - RNA, 22 nt, Human
uaaggaaaugcaaauuuaagaa

SEQ ID NO: 100739 - RNA, 22 nt, Human
ucaucagccaaagaguccuuca

SEQ ID NO: 100740 - RNA, 22 nt, Human
ucaugagcacaggugcagggac

SEQ ID NO: 100741 - RNA, 22 nt, Human
ucauggcucuaaagacauagau

SEQ ID NO: 100742 - RNA, 22 nt, Human
ucaugucagugucugugugugg

SEQ ID NO: 100743 - RNA, 22 nt, Human
ucauuauuuggaauaugggacu

SEQ ID NO: 100744 - RNA, 22 nt, Human
ucauaaaaucaguguccauugu

SEQ ID NO: 100745 - RNA, 22 nt, Human
ucaguuuaucuagcugggggaa

SEQ ID NO: 100746 - RNA, 22 nt, Human
uaagagauuuauugaggacuuc

SEQ ID NO: 100747 - RNA, 22 nt, Human
ucaguuguuggaaguagaugua

SEQ ID NO: 100748 - RNA, 17 nt, Human
ucaguugugcgagcagc

SEQ ID NO: 100749 - RNA, 22 nt, Human
ucaguuacucugauguccugug

SEQ ID NO: 100750 - RNA, 22 nt, Human
ucauaggaguagcagugagagg

SEQ ID NO: 100751 - RNA, 22 nt, Human
uccuggaagggaugguugagga

SEQ ID NO: 100752 - RNA, 22 nt, Human
uccugcuucaaucugcugcugg

SEQ ID NO: 100753 - RNA, 22 nt, Human
uccugguaaagaguaucagauu

SEQ ID NO: 100754 - RNA, 22 nt, Human
uccuugaccuccugacaguaac

SEQ ID NO: 100755 - RNA, 21 nt, Human
uccugccuuaguccagagcag

SEQ ID NO: 100756 - RNA, 20 nt, Human
uagcacuguauccucuucau

SEQ ID NO: 100757 - RNA, 22 nt, Human
uagcagaacaauagucaaugau

SEQ ID NO: 100758 - RNA, 22 nt, Human
uccucccugcacucagugaagu

SEQ ID NO: 100759 - RNA, 20 nt, Human
uagcacagacuuuugcuuac

SEQ ID NO: 100760 - RNA, 22 nt, Human
uagcacauaguaggcacaggcu

SEQ ID NO: 100761 - RNA, 22 nt, Human
uagaugaacagaaagccacugu

SEQ ID NO: 100762 - RNA, 22 nt, Human
uccuccauguugugcacuugaa

SEQ ID NO: 100763 - RNA, 23 nt, Human
uccuccccaccuuuguccccucc

SEQ ID NO: 100764 - RNA, 22 nt, Human
uagaagagcaugucaaacuaua

SEQ ID NO: 100765 - RNA, 22 nt, Human
uagaacuguaaauuaucucucc

SEQ ID NO: 100766 - RNA, 22 nt, Human
ucccuuuuuccugaucugugaa

SEQ ID NO: 100767 - RNA, 22 nt, Human
uagaacaaacagcauguuugau

SEQ ID NO: 100768 - RNA, 22 nt, Human
uagaagaacaugucaaacuaua

SEQ ID NO: 100769 - RNA, 22 nt, Human
ucccuguuuccugcgcuccuuc

SEQ ID NO: 100770 - RNA, 22 nt, Human
ucccuguggauuaaggagaugu

SEQ ID NO: 100771 - RNA, 23 nt, Human
ucccuguuucagggccagaacug

SEQ ID NO: 100772 - RNA, 22 nt, Human
uacuuuuuucacuucuagcccc

SEQ ID NO: 100773 - RNA, 22 nt, Human
uacuuugucauucuaaccuucc

SEQ ID NO: 100774 - RNA, 22 nt, Human
ucccuucccaccccugccuuuu

SEQ ID NO: 100775 - RNA, 22 nt, Human
uccgugguguuggcucuccggc

SEQ ID NO: 100776 - RNA, 22 nt, Human
uccgggagcccccggaggagga

SEQ ID NO: 100777 - RNA, 22 nt, Human
uccggcgaccuccagauguucc

SEQ ID NO: 100778 - RNA, 22 nt, Human
uccgggcagcuccuggagcugu

SEQ ID NO: 100779 - RNA, 22 nt, Human
uccgaccuuuacuucuugucuc

SEQ ID NO: 100780 - RNA, 22 nt, Human
uccgcguugguuagagagggcu

SEQ ID NO: 100781 - RNA, 22 nt, Human
uccccucucugcgcucccaggu

SEQ ID NO: 100782 - RNA, 22 nt, Human
uccguugaggcugccaggcgag

SEQ ID NO: 100783 - RNA, 22 nt, Human
uagaggccagggugucuugagu

SEQ ID NO: 100784 - RNA, 22 nt, Human
ucccugcagggccauugugcag

SEQ ID NO: 100785 - RNA, 22 nt, Human
ucccugccuccuggcagugcca

SEQ ID NO: 100786 - RNA, 22 nt, Human
ucccugagcucacauggcagga

SEQ ID NO: 100787 - RNA, 22 nt, Human
ucccguuucacuccuugccagc

SEQ ID NO: 100788 - RNA, 22 nt, Human
ucccucacacagcugggagaac

SEQ ID NO: 100789 - RNA, 22 nt, Human
ucccggcaccgggagccccugc

SEQ ID NO: 100790 - RNA, 22 nt, Human
uacuugaaaugggcaucaagag

SEQ ID NO: 100791 - RNA, 22 nt, Human
uacuucccacuggggucuacca

SEQ ID NO: 100792 - RNA, 22 nt, Human
uccccgcuccguagagaaagag

SEQ ID NO: 100793 - RNA, 22 nt, Human
uacugauggagauaggcuauca

SEQ ID NO: 100794 - RNA, 22 nt, Human
uacugcaguuccugcugucucc

SEQ ID NO: 100795 - RNA, 22 nt, Human
uacugccauuauccugcugaaa

SEQ ID NO: 100796 - RNA, 22 nt, Human
uacugaguuucacugucugugc

SEQ ID NO: 100797 - RNA, 22 nt, Human
uacugagcauaaaacccauacu

SEQ ID NO: 100798 - RNA, 22 nt, Human
uaccugguuucuuaaacccaaa

SEQ ID NO: 100799 - RNA, 22 nt, Human
uccagguccuacuggcccauag

SEQ ID NO: 100800 - RNA, 22 nt, Human
uccaugauauauaugugcacau

SEQ ID NO: 100801 - RNA, 22 nt, Human
uccaugcaguagaggcgcuggg

SEQ ID NO: 100802 - RNA, 22 nt, Human
uccaugcgcgauggccuggcuu

SEQ ID NO: 100803 - RNA, 22 nt, Human
uccaucaccacagaggacagag

SEQ ID NO: 100804 - RNA, 22 nt, Human
uccaggcagcugcuugaugaua

SEQ ID NO: 100805 - RNA, 22 nt, Human
uccagggaggggcggcaggggu

SEQ ID NO: 100806 - RNA, 21 nt, Human
uccaggagcacgggacuagga

SEQ ID NO: 100807 - RNA, 22 nt, Human
uacagcgaaaauuuagcuugau

SEQ ID NO: 100808 - RNA, 22 nt, Human
uccaaugugccuuauuuugagc

SEQ ID NO: 100809 - RNA, 22 nt, Human
uaugaucuuaggauggaacuuc

SEQ ID NO: 100810 - RNA, 22 nt, Human
uaugcagauaguuugccauuca

SEQ ID NO: 100811 - RNA, 22 nt, Human
ucugcagggcccuuggcuccug

SEQ ID NO: 100812 - RNA, 22 nt, Human
uaugccaccagucuggaacucu

SEQ ID NO: 100813 - RNA, 22 nt, Human
uaugccaaaaauaaguuuuaug

SEQ ID NO: 100814 - RNA, 22 nt, Human
uaugcauaauuggauaaguaga

SEQ ID NO: 100815 - RNA, 22 nt, Human
uaugcgguccaucaggggcacu

SEQ ID NO: 100816 - RNA, 22 nt, Human
ucugcggccggaauucccuuca

SEQ ID NO: 100817 - RNA, 22 nt, Human
ucugcgggccuggcucccagcg

SEQ ID NO: 100818 - RNA, 22 nt, Human
ucugcggccuagcgcccggcgc

SEQ ID NO: 100819 - RNA, 23 nt, Human
ucugccuccuaauuguugguguc

SEQ ID NO: 100820 - RNA, 22 nt, Human
ucugcccguucaaauccuuguu

SEQ ID NO: 100821 - RNA, 17 nt, Human
ucugccaguuuuagaau

SEQ ID NO: 100822 - RNA, 22 nt, Human
uaugaccuuaggaagcaagaag

SEQ ID NO: 100823 - RNA, 22 nt, Human
uaugaauauaccacaauuuagg

SEQ ID NO: 100824 - RNA, 22 nt, Human
ucugagugacguccugacagga

SEQ ID NO: 100825 - RNA, 22 nt, Human
ucugaugaccacaugugggacu

SEQ ID NO: 100826 - RNA, 17 nt, Human
ucugcagaggcaaaccu

SEQ ID NO: 100827 - RNA, 22 nt, Human
ucugaguuaaaauuccagaggu

SEQ ID NO: 100828 - RNA, 22 nt, Human
uaugagguuaucuaugucguau

SEQ ID NO: 100829 - RNA, 22 nt, Human
uaugaguauagugcaccauggu

SEQ ID NO: 100830 - RNA, 22 nt, Human
uaugugugaguauauaugcaca

SEQ ID NO: 100831 - RNA, 22 nt, Human
ucugggccacccgccuccaggg

SEQ ID NO: 100832 - RNA, 22 nt, Human
ucugggaccuagacccauuguu

SEQ ID NO: 100833 - RNA, 22 nt, Human
uaugugaaauggaauauagaaa

SEQ ID NO: 100834 - RNA, 22 nt, Human
uauguauauccagguaagggcu

SEQ ID NO: 100835 - RNA, 21 nt, Human
ucuggccuauaaaguagucgc

SEQ ID NO: 100836 - RNA, 22 nt, Human
uaugguuucuccugcagauuug

SEQ ID NO: 100837 - RNA, 22 nt, Human
uauguaacaccauuuacaaagu

SEQ ID NO: 100838 - RNA, 22 nt, Human
ucuggaggucucagggcgggaa

SEQ ID NO: 100839 - RNA, 22 nt, Human
ucuggcacuugccaguuucuau

SEQ ID NO: 100840 - RNA, 22 nt, Human
ucuggaaauggaaguaacuaug

SEQ ID NO: 100841 - RNA, 22 nt, Human
ucugcuuuucuuaaggggauca

SEQ ID NO: 100842 - RNA, 20 nt, Human
ucugcuugucuucagguucc

SEQ ID NO: 100843 - RNA, 22 nt, Human
uauggacagcuuucuuuguguu

SEQ ID NO: 100844 - RNA, 22 nt, Human
uauggcuucucagucaugaaaa

SEQ ID NO: 100845 - RNA, 22 nt, Human
uauggcuaguguguuuguaaca

SEQ ID NO: 100846 - RNA, 22 nt, Human
uaugcuguauucuguauguuag

SEQ ID NO: 100847 - RNA, 22 nt, Human
uaugguuagugcuguagauuau

SEQ ID NO: 100848 - RNA, 22 nt, Human
uaugggcaagagauaggugguc

SEQ ID NO: 100849 - RNA, 22 nt, Human
ucugcuggugucauuuuugcua

SEQ ID NO: 100850 - RNA, 22 nt, Human
ucugcguggcgugguucugugc

SEQ ID NO: 100851 - RNA, 22 nt, Human
uauuaugguuguagguuaacaa

SEQ ID NO: 100852 - RNA, 22 nt, Human
ucugugugugugcauaugcaug

SEQ ID NO: 100853 - RNA, 22 nt, Human
uauucauuuuuauuugugacug

SEQ ID NO: 100854 - RNA, 22 nt, Human
uauucccacuccucagcaauuu

SEQ ID NO: 100855 - RNA, 22 nt, Human
ucuguguguguggcuaaacaag

SEQ ID NO: 100856 - RNA, 21 nt, Human
uauucgcauuucugucuuuac

SEQ ID NO: 100857 - RNA, 19 nt, Human
ucuguugcuuuguguccuc

SEQ ID NO: 100858 - RNA, 22 nt, Human
ucuguuauaaaucacacugcau

SEQ ID NO: 100859 - RNA, 22 nt, Human
ucuguucaugucuuuuuaagug

SEQ ID NO: 100860 - RNA, 22 nt, Human
ucuguuuacaugucagcagcaa

SEQ ID NO: 100861 - RNA, 22 nt, Human
ucuuauucuuuuaaacaacgca

SEQ ID NO: 100862 - RNA, 22 nt, Human
ucuuauugguaaugauggcauu

SEQ ID NO: 100863 - RNA, 22 nt, Human
ucuuauugugaugaugaagaac

SEQ ID NO: 100864 - RNA, 22 nt, Human
ucuuaaauaugaaaaggauuau

SEQ ID NO: 100865 - RNA, 22 nt, Human
ucuguuuuuaucuauucuguua

SEQ ID NO: 100866 - RNA, 22 nt, Human
ucuuacuguccucuguuuuucu

SEQ ID NO: 100867 - RNA, 19 nt, Human
uauuagccucaucccagcc

SEQ ID NO: 100868 - RNA, 22 nt, Human
uauguugucuuguucagccaua

SEQ ID NO: 100869 - RNA, 22 nt, Human
uauguuuugcaaauaucaaaca

SEQ ID NO: 100870 - RNA, 22 nt, Human
ucugucucugucaggcugcugc

SEQ ID NO: 100871 - RNA, 20 nt, Human
ucugugugccaucaccuaac

SEQ ID NO: 100872 - RNA, 22 nt, Human
ucugugugugcauguguguaua

SEQ ID NO: 100873 - RNA, 22 nt, Human
ucuguauuuuuuacacacaugc

SEQ ID NO: 100874 - RNA, 22 nt, Human
ucuguagcuuuagaggacagga

SEQ ID NO: 100875 - RNA, 22 nt, Human
ucuguaaaugcaaguuuuccuc

SEQ ID NO: 100876 - RNA, 22 nt, Human
ucuggugcacucugauauuuga

SEQ ID NO: 100877 - RNA, 22 nt, Human
ucuggguaacugaggcuaauau

SEQ ID NO: 100878 - RNA, 22 nt, Human
ucuggggaugagugaugucgua

SEQ ID NO: 100879 - RNA, 22 nt, Human
uauguuaaauguuugauguuua

SEQ ID NO: 100880 - RNA, 21 nt, Human
ucugaggagaaacucuuggug

SEQ ID NO: 100881 - RNA, 22 nt, Human
ucugaggacagugcugugccug

SEQ ID NO: 100882 - RNA, 22 nt, Human
ucugaggaauaagaugucuaaa

SEQ ID NO: 100883 - RNA, 22 nt, Human
ucugagcaggaaagagcagaga

SEQ ID NO: 100884 - RNA, 22 nt, Human
uaugaaagguuuuuucuugaaa

SEQ ID NO: 100885 - RNA, 22 nt, Human
uaucuucaauagcccagaugug

SEQ ID NO: 100886 - RNA, 22 nt, Human
uaucuuugccuuggguuuuguu

SEQ ID NO: 100887 - RNA, 22 nt, Human
uaucuguagucucaugguuccu

SEQ ID NO: 100888 - RNA, 22 nt, Human
ucugacugucccguagaggaac

SEQ ID NO: 100889 - RNA, 22 nt, Human
ucugacguugguucugcccuuu

SEQ ID NO: 100890 - RNA, 22 nt, Human
ucugacuucuuuuauuaucauu

SEQ ID NO: 100891 - RNA, 22 nt, Human
ucucuucacuuguaugcuauca

SEQ ID NO: 100892 - RNA, 22 nt, Human
ucugaaauuuuaguuauagaaa

SEQ ID NO: 100893 - RNA, 22 nt, Human
ucugaccaggcucuuguagccu

SEQ ID NO: 100894 - RNA, 22 nt, Human
uauauauacauauagaauaugu

SEQ ID NO: 100895 - RNA, 22 nt, Human
uauauacacgcacauauacaua

SEQ ID NO: 100896 - RNA, 22 nt, Human
uauauacuugaaaauugcugag

SEQ ID NO: 100897 - RNA, 22 nt, Human
ucuccuuuacuggcuccuuuug

SEQ ID NO: 100898 - RNA, 22 nt, Human
uauaggugagugaagcucagga

SEQ ID NO: 100899 - RNA, 22 nt, Human
ucucucguuuuuugcagauaaa

SEQ ID NO: 100900 - RNA, 22 nt, Human
ucucuccuccacaccgggugcu

SEQ ID NO: 100901 - RNA, 22 nt, Human
uaucauuuuacugugacauuuu

SEQ ID NO: 100902 - RNA, 22 nt, Human
uauccaaaggaacaaucacagc

SEQ ID NO: 100903 - RNA, 22 nt, Human
uauauuuguccuagcuccuagc

SEQ ID NO: 100904 - RNA, 22 nt, Human
uauauuaaagugcuuugcagug

SEQ ID NO: 100905 - RNA, 22 nt, Human
uauaugcacucagguguaugug

SEQ ID NO: 100906 - RNA, 22 nt, Human
ucucuguacauagugaagcccg

SEQ ID NO: 100907 - RNA, 19 nt, Human
ucucugguggcuccaucag

SEQ ID NO: 100908 - RNA, 20 nt, Human
ucucugccaaccaccuccuc

SEQ ID NO: 100909 - RNA, 22 nt, Human
uaguuuucuuuuguguuauucu

SEQ ID NO: 100910 - RNA, 22 nt, Human
uaguuuucaagugaguuggaag

SEQ ID NO: 100911 - RNA, 22 nt, Human
uaguugguggagcgauuugucu

SEQ ID NO: 100912 - RNA, 22 nt, Human
uaguuucuaauguugaaauuau

SEQ ID NO: 100913 - RNA, 21 nt, Human
ucucauuuuaacacagaguug

SEQ ID NO: 100914 - RNA, 22 nt, Human
ucuccaggggcagggucuggag

SEQ ID NO: 100915 - RNA, 22 nt, Human
ucuccaccccugggaggcagaa

SEQ ID NO: 100916 - RNA, 16 nt, Human
ucucccuguucuccaa

SEQ ID NO: 100917 - RNA, 17 nt, Human
ucuccuggcucuaucag

SEQ ID NO: 100918 - RNA, 22 nt, Human
ucuccuuuggggccucaggguu

SEQ ID NO: 100919 - RNA, 22 nt, Human
ucuccucuuaaugcacguuucc

SEQ ID NO: 100920 - RNA, 22 nt, Human
uauaggaugaugucauguugcu

SEQ ID NO: 100921 - RNA, 18 nt, Human
ucuccgaccccgcggucc

SEQ ID NO: 100922 - RNA, 22 nt, Human
uauagcccaaucuggaugcagu

SEQ ID NO: 100923 - RNA, 22 nt, Human
uauagccuuacaagauauuaua

SEQ ID NO: 100924 - RNA, 22 nt, Human
uauaagggaaaagcagguuggu

SEQ ID NO: 100925 - RNA, 22 nt, Human
uauaagaaacaaggcaaauuuu

SEQ ID NO: 100926 - RNA, 22 nt, Human
uagcugucauuggaucagaagg

SEQ ID NO: 100927 - RNA, 22 nt, Human
uagcuucacuuuuguugaugcg

SEQ ID NO: 100928 - RNA, 22 nt, Human
uaggauauuuuagaaugguaca

SEQ ID NO: 100929 - RNA, 22 nt, Human
uaggauaacaauuuguaguuuc

SEQ ID NO: 100930 - RNA, 22 nt, Human
ucuaugaagucuuccuuuccuc

SEQ ID NO: 100931 - RNA, 22 nt, Human
uaguuccucuucucagggccau

SEQ ID NO: 100932 - RNA, 22 nt, Human
ucuauauucuauguucuucuuu

SEQ ID NO: 100933 - RNA, 22 nt, Human
ucucagaagaaacaucugcugg

SEQ ID NO: 100934 - RNA, 23 nt, Human
ucucacucauucuccucugucca

SEQ ID NO: 100935 - RNA, 22 nt, Human
ucucagggaugggaggccccag

SEQ ID NO: 100936 - RNA, 23 nt, Human
ucucaccaggauaugacugucac

SEQ ID NO: 100937 - RNA, 22 nt, Human
ucucaaagagcuacuggucuau

SEQ ID NO: 100938 - RNA, 22 nt, Human
ugauucacgcuucucuuuaaac

SEQ ID NO: 100939 - RNA, 22 nt, Human
ugauuccugugcuuauuccagu

SEQ ID NO: 100940 - RNA, 22 nt, Human
ugauugcucagcuagccucuuu

SEQ ID NO: 100941 - RNA, 22 nt, Human
ugauugcucgacacucugcuug

SEQ ID NO: 100942 - RNA, 22 nt, Human
ugauugauaaugaagacaguca

SEQ ID NO: 100943 - RNA, 22 nt, Human
ugauugaauaauguuaugugaa

SEQ ID NO: 100944 - RNA, 22 nt, Human
ugauuagauacuucagaugaca

SEQ ID NO: 100945 - RNA, 22 nt, Human
ugauaugguaauaagauauucu

SEQ ID NO: 100946 - RNA, 22 nt, Human
ugaucaacagggcuggaaagag

SEQ ID NO: 100947 - RNA, 22 nt, Human
ucauggguauaauuuuagaugu

SEQ ID NO: 100948 - RNA, 20 nt, Human
ugauaugcgguacagagagg

SEQ ID NO: 100949 - RNA, 22 nt, Human
ugaucaguacuguaugagggau

SEQ ID NO: 100950 - RNA, 22 nt, Human
ugaugaugauacauuucuucag

SEQ ID NO: 100951 - RNA, 22 nt, Human
ugaugaugaagaaauauuauca

SEQ ID NO: 100952 - RNA, 22 nt, Human
ugaugccauaguaaaauuugcu

SEQ ID NO: 100953 - RNA, 22 nt, Human
ugaugaugccaaaauuuggcau

SEQ ID NO: 100954 - RNA, 22 nt, Human
ucauuuguauucuacaaagcac

SEQ ID NO: 100955 - RNA, 22 nt, Human
ucauuuuaucaggaauggaauc

SEQ ID NO: 100956 - RNA, 22 nt, Human
ugauguaggacauuauuauuuc

SEQ ID NO: 100957 - RNA, 22 nt, Human
ugauggaucuguuggcggguuu

SEQ ID NO: 100958 - RNA, 18 nt, Human
ugauggcuaagagccggg

SEQ ID NO: 100959 - RNA, 22 nt, Human
ucaucuauaaguagcaucuggg

SEQ ID NO: 100960 - RNA, 22 nt, Human
ucaucggcugucaucuucacgu

SEQ ID NO: 100961 - RNA, 22 nt, Human
ucaucuuucuuuauggaaauac

SEQ ID NO: 100962 - RNA, 22 nt, Human
ucaucgauggggagcucuacaa

SEQ ID NO: 100963 - RNA, 22 nt, Human
ucauccugucucuguucggaau

SEQ ID NO: 100964 - RNA, 22 nt, Human
ucaguuccccaaagccuccuag

SEQ ID NO: 100965 - RNA, 22 nt, Human
ugagugccagugcuugcucuac

SEQ ID NO: 100966 - RNA, 22 nt, Human
ucaugcagaguagaaagggcaa

SEQ ID NO: 100967 - RNA, 22 nt, Human
ucaugggcaaacuuggggauca

SEQ ID NO: 100968 - RNA, 22 nt, Human
ucaugccugcgauugucccugg

SEQ ID NO: 100969 - RNA, 21 nt, Human
ugaggccugccagucucagaa

SEQ ID NO: 100970 - RNA, 22 nt, Human
ucauccgcaaccacuuuagccu

SEQ ID NO: 100971 - RNA, 21 nt, Human
ucauccagguccugcuucuuc

SEQ ID NO: 100972 - RNA, 22 nt, Human
ucauaaaggugccacucaguuu

SEQ ID NO: 100973 - RNA, 16 nt, Human
ucauaaacugcagcuu

SEQ ID NO: 100974 - RNA, 22 nt, Human
ugaggcaguucuuacuuguauu

SEQ ID NO: 100975 - RNA, 22 nt, Human
ugaggaugagaaggaagagaag

SEQ ID NO: 100976 - RNA, 22 nt, Human
ugaggaggugcuaccagcgucu

SEQ ID NO: 100977 - RNA, 22 nt, Human
ugagcuuugguaccuucauuug

SEQ ID NO: 100978 - RNA, 22 nt, Human
ugagccugaguguguauugaac

SEQ ID NO: 100979 - RNA, 22 nt, Human
ucagugguuaaguucuguccac

SEQ ID NO: 100980 - RNA, 22 nt, Human
ucagugugacccuucuauuuuu

SEQ ID NO: 100981 - RNA, 22 nt, Human
ucaguguccuucguucuuguug

SEQ ID NO: 100982 - RNA, 22 nt, Human
ucaguugauggcaguuaauguc

SEQ ID NO: 100983 - RNA, 22 nt, Human
ucaguugagguggucuauugcg

SEQ ID NO: 100984 - RNA, 22 nt, Human
ucaguuuaauuggaucuuuuuc

SEQ ID NO: 100985 - RNA, 22 nt, Human
ucagucuucaggacuaugaaaa

SEQ ID NO: 100986 - RNA, 23 nt, Human
ucagugccaaggagaacuuggug

SEQ ID NO: 100987 - RNA, 22 nt, Human
ucagugauccagauauuugagc

SEQ ID NO: 100988 - RNA, 22 nt, Human
ucagucugcuauagguauuugu

SEQ ID NO: 100989 - RNA, 22 nt, Human
ugagcaaacacagauaggcuua

SEQ ID NO: 100990 - RNA, 22 nt, Human
ugagcaccaggcaccacagcuc

SEQ ID NO: 100991 - RNA, 22 nt, Human
ugagauuuagaacuggauuuca

SEQ ID NO: 100992 - RNA, 22 nt, Human
ucaguggaacacacagaguggg

SEQ ID NO: 100993 - RNA, 20 nt, Human
ucaguggcauaguugcuaag

SEQ ID NO: 100994 - RNA, 22 nt, Human
ugagcuauuucaccauauagau

SEQ ID NO: 100995 - RNA, 22 nt, Human
ugagccauguucaugaguucau

SEQ ID NO: 100996 - RNA, 22 nt, Human
ucagguagugguuaaguucugu

SEQ ID NO: 100997 - RNA, 20 nt, Human
ucaggguuucccauucuugg

SEQ ID NO: 100998 - RNA, 22 nt, Human
ugagaacuguuuugguuugggu

SEQ ID NO: 100999 - RNA, 22 nt, Human
ugagaacacuuuucucuuugcu

SEQ ID NO: 101000 - RNA, 22 nt, Human
ugagaagaggucuuuugggaug

SEQ ID NO: 101001 - RNA, 22 nt, Human
ugagaauuuaacuugauuagga

SEQ ID NO: 101002 - RNA, 22 nt, Human
ucuucaucucuaaaaugggaac

SEQ ID NO: 101003 - RNA, 23 nt, Human
ucagggaucgucagaaaaugaaa

SEQ ID NO: 101004 - RNA, 22 nt, Human
ucagggaggagaggcaggggga

SEQ ID NO: 101005 - RNA, 22 nt, Human
ucaggguacuuguggccaaagu

SEQ ID NO: 101006 - RNA, 22 nt, Human
ucaggcuagcccagugcuuggg

SEQ ID NO: 101007 - RNA, 22 nt, Human
ucaguauuagugcauuaucagg

SEQ ID NO: 101008 - RNA, 22 nt, Human
ucaguaagauugauauuucccc

SEQ ID NO: 101009 - RNA, 22 nt, Human
ugagacucuccugugcagccuc

SEQ ID NO: 101010 - RNA, 22 nt, Human
ucaguagcauuuaauguucagu

SEQ ID NO: 101011 - RNA, 22 nt, Human
ugagaagucagucuauugugaa

SEQ ID NO: 101012 - RNA, 22 nt, Human
ucagguuuuuaaggagcuagga

SEQ ID NO: 101013 - RNA, 22 nt, Human
ugagacuugaacuccagugcca

SEQ ID NO: 101014 - RNA, 22 nt, Human
ucagucacugucucagacagga

SEQ ID NO: 101015 - RNA, 22 nt, Human
ugagacuuggggggcugagggc

SEQ ID NO: 101016 - RNA, 22 nt, Human
ucagucauguuuaccagacgua

SEQ ID NO: 101017 - RNA, 22 nt, Human
ugagagaauuacuaaagggcuu

SEQ ID NO: 101018 - RNA, 22 nt, Human
ugagagguagaacuuguagugu

SEQ ID NO: 101019 - RNA, 22 nt, Human
ugagaggaagggaaagaugauu

SEQ ID NO: 101020 - RNA, 22 nt, Human
ugauuugaaaccuuuggcaaga

SEQ ID NO: 101021 - RNA, 22 nt, Human
ugauuucauaugacagcuuuuu

SEQ ID NO: 101022 - RNA, 22 nt, Human
ugauugguauguauguuuguca

SEQ ID NO: 101023 - RNA, 22 nt, Human
ugauuguauuuauccucuguuc

SEQ ID NO: 101024 - RNA, 22 nt, Human
uccagcuccugaguucacugcu

SEQ ID NO: 101025 - RNA, 22 nt, Human
uccagcugugcuccaggaggug

SEQ ID NO: 101026 - RNA, 22 nt, Human
uccagcacacagguggcucuca

SEQ ID NO: 101027 - RNA, 22 nt, Human
ugauugggacauuuuguuuucu

SEQ ID NO: 101028 - RNA, 22 nt, Human
uccccgcugcgcccgcugcugc

SEQ ID NO: 101029 - RNA, 19 nt, Human
ugcacucauggagggucug

SEQ ID NO: 101030 - RNA, 22 nt, Human
uccccugccccccauccucugg

SEQ ID NO: 101031 - RNA, 22 nt, Human
ugcacugccuuucuuggcauga

SEQ ID NO: 101032 - RNA, 22 nt, Human
ugcacagagggaggcauaaaau

SEQ ID NO: 101033 - RNA, 22 nt, Human
ucccacugucuucucgugcucg

SEQ ID NO: 101034 - RNA, 22 nt, Human
ugcacacaguucucaggaaaga

SEQ ID NO: 101035 - RNA, 23 nt, Human
uccccagcugcccgugucccggg

SEQ ID NO: 101036 - RNA, 22 nt, Human
uccccaugaacuuguggcugcu

SEQ ID NO: 101037 - RNA, 22 nt, Human
ucccccuugucguuugagguuu

SEQ ID NO: 101038 - RNA, 22 nt, Human
ugcauaugcauguaccuguguu

SEQ ID NO: 101039 - RNA, 22 nt, Human
ugcaguugcguuugcauuccau

SEQ ID NO: 101040 - RNA, 22 nt, Human
ugcagugcagcuggaauaucuu

SEQ ID NO: 101041 - RNA, 22 nt, Human
ugcagguuuucagauguguguu

SEQ ID NO: 101042 - RNA, 22 nt, Human
ugcaggucuggacccccacuuu

SEQ ID NO: 101043 - RNA, 22 nt, Human
uccgugggucuugaagugucac

SEQ ID NO: 101044 - RNA, 18 nt, Human
uccggaggucagaguaaa

SEQ ID NO: 101045 - RNA, 22 nt, Human
ugcaggguuucaauacacagga

SEQ ID NO: 101046 - RNA, 22 nt, Human
ugcaggaacucgaaaacuauag

SEQ ID NO: 101047 - RNA, 22 nt, Human
ugcaggaagcucagcggggccg

SEQ ID NO: 101048 - RNA, 22 nt, Human
uccgacacacgugcucgcagcg

SEQ ID NO: 101049 - RNA, 22 nt, Human
ugcaggagcccaggaauacuau

SEQ ID NO: 101050 - RNA, 22 nt, Human
ugcaggagaaaguacggagcgu

SEQ ID NO: 101051 - RNA, 22 nt, Human
ugcagggucuccuguacuuggg

SEQ ID NO: 101052 - RNA, 22 nt, Human
ucccugcgugagaaagcacuua

SEQ ID NO: 101053 - RNA, 22 nt, Human
ucccugcugggcgaucuucucu

SEQ ID NO: 101054 - RNA, 22 nt, Human
ucccucugccugcaguccugcu

SEQ ID NO: 101055 - RNA, 22 nt, Human
ugcagcuuuugguuucuagaug

SEQ ID NO: 101056 - RNA, 21 nt, Human
ucccugcagccccaggccccc

SEQ ID NO: 101057 - RNA, 22 nt, Human
ucccugcaggcauguacucuga

SEQ ID NO: 101058 - RNA, 22 nt, Human
ugcauuuuuaauuuggaaaaaa

SEQ ID NO: 101059 - RNA, 22 nt, Human
ugcauuuucuaccacacccacu

SEQ ID NO: 101060 - RNA, 22 nt, Human
uccuacccccuucuccagcucc

SEQ ID NO: 101061 - RNA, 22 nt, Human
ugcauaagguuaaauuagcaga

SEQ ID NO: 101062 - RNA, 22 nt, Human
ugcaucccaaacaugguuuccu

SEQ ID NO: 101063 - RNA, 22 nt, Human
ugccccuggaggagagcaaugg

SEQ ID NO: 101064 - RNA, 22 nt, Human
ugcccagcagggagcuaccugg

SEQ ID NO: 101065 - RNA, 22 nt, Human
uccugcaugcuagugagugcuu

SEQ ID NO: 101066 - RNA, 22 nt, Human
ugccaguaauuguccuguagcu

SEQ ID NO: 101067 - RNA, 22 nt, Human
ugcccacuuugucuccaugcug

SEQ ID NO: 101068 - RNA, 22 nt, Human
ugcauuugcaauggguacacaa

SEQ ID NO: 101069 - RNA, 22 nt, Human
uccucuccaggugagccgaaau

SEQ ID NO: 101070 - RNA, 22 nt, Human
uccuccuggagacuuucucucu

SEQ ID NO: 101071 - RNA, 22 nt, Human
uccuccucgccacgacucugcu

SEQ ID NO: 101072 - RNA, 22 nt, Human
uccucgccgucacgcagccucu

SEQ ID NO: 101073 - RNA, 22 nt, Human
ugcgcgcaccugcauauauaug

SEQ ID NO: 101074 - RNA, 22 nt, Human
ucgagcacaccagacuugcaga

SEQ ID NO: 101075 - RNA, 22 nt, Human
ugccuuuggcuguucugugacc

SEQ ID NO: 101076 - RNA, 22 nt, Human
ugccuuuuguguuuggcuaauc

SEQ ID NO: 101077 - RNA, 22 nt, Human
ugccuggacgacaucacaguga

SEQ ID NO: 101078 - RNA, 19 nt, Human
ugccuggcaccagcuccac

SEQ ID NO: 101079 - RNA, 22 nt, Human
uccuuguuggaauauccuuacc

SEQ ID NO: 101080 - RNA, 22 nt, Human
uccuuuauuuaugggcagugua

SEQ ID NO: 101081 - RNA, 21 nt, Human
uccuuguuucuuccaaaacug

SEQ ID NO: 101082 - RNA, 22 nt, Human
ugccuguguuugggguggggaa

SEQ ID NO: 101083 - RNA, 22 nt, Human
ugccucucucugucauuaugcu

SEQ ID NO: 101084 - RNA, 22 nt, Human
ugccucucuggaucugcuguga

SEQ ID NO: 101085 - RNA, 20 nt, Human
ugccugagcgcagcuccagg

SEQ ID NO: 101086 - RNA, 22 nt, Human
uccuuguaccauuugcucacag

SEQ ID NO: 101087 - RNA, 22 nt, Human
uccugcccuguccuugccucug

SEQ ID NO: 101088 - RNA, 22 nt, Human
ugcccugaagcugucaauuuug

SEQ ID NO: 101089 - RNA, 22 nt, Human
ugcccuagaucacauuacaggu

SEQ ID NO: 101090 - RNA, 21 nt, Human
uccugccuggccuucugacua

SEQ ID NO: 101091 - RNA, 22 nt, Human
uccuggccucugagucaagaac

SEQ ID NO: 101092 - RNA, 22 nt, Human
uccugcucucuccauuccuucc

SEQ ID NO: 101093 - RNA, 22 nt, Human
uccuggcgugggcuggcugcag

SEQ ID NO: 101094 - RNA, 22 nt, Human
uccuggcuguuagagaggcaag

SEQ ID NO: 101095 - RNA, 22 nt, Human
uccuggccuuggggagagaagu

SEQ ID NO: 101096 - RNA, 22 nt, Human
ucgcuuuaauggucuucacagc

SEQ ID NO: 101097 - RNA, 21 nt, Human
ucuagaugggaugaaaggugc

SEQ ID NO: 101098 - RNA, 20 nt, Human
ucuaggguuugguuaucauc

SEQ ID NO: 101099 - RNA, 22 nt, Human
ucgcuauuauuuuagguucuca

SEQ ID NO: 101100 - RNA, 22 nt, Human
ucgcgcgugccacgcgccgcgg

SEQ ID NO: 101101 - RNA, 22 nt, Human
ugcggaaggcagcgcagggugg

SEQ ID NO: 101102 - RNA, 22 nt, Human
ucuauuauauuuacacgagagu

SEQ ID NO: 101103 - RNA, 22 nt, Human
ucucaaagguuuuccucuuuuu

SEQ ID NO: 101104 - RNA, 22 nt, Human
ugcugcucaagcugcagcaaaa

SEQ ID NO: 101105 - RNA, 23 nt, Human
ugcugcgggacccgagcgcgcgc

SEQ ID NO: 101106 - RNA, 22 nt, Human
ugcugcggcgcaggcacuccag

SEQ ID NO: 101107 - RNA, 22 nt, Human
ugcugcuguuuccuacaucuca

SEQ ID NO: 101108 - RNA, 22 nt, Human
ugcugcuguuaucauuuuacca

SEQ ID NO: 101109 - RNA, 23 nt, Human
ugcugcuggaguaucuacaaugc

SEQ ID NO: 101110 - RNA, 22 nt, Human
ugcuuaaagcauuucucuuuaa

SEQ ID NO: 101111 - RNA, 22 nt, Human
ucuccucuauuucuguauguau

SEQ ID NO: 101112 - RNA, 22 nt, Human
ugcugugcuggcggcagaggcc

SEQ ID NO: 101113 - RNA, 22 nt, Human
ucucccuggccagcccuuuccc

SEQ ID NO: 101114 - RNA, 22 nt, Human
ucucccuuuggauuuguuuugg

SEQ ID NO: 101115 - RNA, 22 nt, Human
ugcuguacaagacccucuguuu

SEQ ID NO: 101116 - RNA, 22 nt, Human
ugcugguuucugaguaaccaca

SEQ ID NO: 101117 - RNA, 22 nt, Human
ucuccagcugaggccuucuucc

SEQ ID NO: 101118 - RNA, 22 nt, Human
ucucauacguuuccagguguca

SEQ ID NO: 101119 - RNA, 22 nt, Human
ugcugcucuucaccauggccuc

SEQ ID NO: 101120 - RNA, 22 nt, Human
ucucaggcuuccuggugcugug

SEQ ID NO: 101121 - RNA, 22 nt, Human
ucucagaaaugacaggagguac

SEQ ID NO: 101122 - RNA, 20 nt, Human
ucucauuuugauuucgcauu

SEQ ID NO: 101123 - RNA, 22 nt, Human
ugcuggagucucuugacccugg

SEQ ID NO: 101124 - RNA, 22 nt, Human
ugcuggaaggguaguauuaacu

SEQ ID NO: 101125 - RNA, 20 nt, Human
ugcugggccaucuugcaugc

SEQ ID NO: 101126 - RNA, 22 nt, Human
ucuccaggaaagacacuggacu

SEQ ID NO: 101127 - RNA, 22 nt, Human
ugcuggugauuaaauccugaag

SEQ ID NO: 101128 - RNA, 22 nt, Human
uggaaaauuuagaaagauuuau

SEQ ID NO: 101129 - RNA, 17 nt, Human
ucugaccuuuacuccug

SEQ ID NO: 101130 - RNA, 21 nt, Human
ugcuuuuguugucagcugcug

SEQ ID NO: 101131 - RNA, 22 nt, Human
ugcuuuuggcagcaguguuuau

SEQ ID NO: 101132 - RNA, 22 nt, Human
ucugaguagaaucauucauaaa

SEQ ID NO: 101133 - RNA, 22 nt, Human
ucugagugggaacucucaugac

SEQ ID NO: 101134 - RNA, 22 nt, Human
ucugaguaauacucuugccuug

SEQ ID NO: 101135 - RNA, 22 nt, Human
ucugagucgcucccuggaucca

SEQ ID NO: 101136 - RNA, 22 nt, Human
ucugagagcuguagaagccuau

SEQ ID NO: 101137 - RNA, 22 nt, Human
ucucuuuuuuuaaaacucuaug

SEQ ID NO: 101138 - RNA, 22 nt, Human
ucugaaaggagaguagggcaga

SEQ ID NO: 101139 - RNA, 22 nt, Human
ugcuuuggcccaacauugaugc

SEQ ID NO: 101140 - RNA, 21 nt, Human
ugcuuucugugcuuuuucugc

SEQ ID NO: 101141 - RNA, 22 nt, Human
ucugaauauguuuaucaucucu

SEQ ID NO: 101142 - RNA, 18 nt, Human
ucugaaggaaugauucca

SEQ ID NO: 101143 - RNA, 22 nt, Human
ucugaagagaacucuuaguguu

SEQ ID NO: 101144 - RNA, 22 nt, Human
ugcuuuauucgacaucugguag

SEQ ID NO: 101145 - RNA, 22 nt, Human
ugcuuucaaaacucagaggaau

SEQ ID NO: 101146 - RNA, 22 nt, Human
ugcuuucagauaucuguuucaa

SEQ ID NO: 101147 - RNA, 22 nt, Human
ucucugugaauggcgucaccug

SEQ ID NO: 101148 - RNA, 22 nt, Human
ugcuuuaccuuccauuuaagga

SEQ ID NO: 101149 - RNA, 22 nt, Human
ucucugguggcuccaucaguag

SEQ ID NO: 101150 - RNA, 22 nt, Human
ucucugaggaagcgaucuuuag

SEQ ID NO: 101151 - RNA, 22 nt, Human
ucucuguaguugggcagcugcu

SEQ ID NO: 101152 - RNA, 22 nt, Human
ugcuugggucuguuuugcaaag

SEQ ID NO: 101153 - RNA, 22 nt, Human
ucucuggcuuuuuuuccauuuu

SEQ ID NO: 101154 - RNA, 22 nt, Human
ucucugguagcucugugcucug

SEQ ID NO: 101155 - RNA, 22 nt, Human
ugcuuguuuguuuucuuccauu

SEQ ID NO: 101156 - RNA, 22 nt, Human
ucucucugcuguccagcguuau

SEQ ID NO: 101157 - RNA, 22 nt, Human
ucucucucucuuccagcauguu

SEQ ID NO: 101158 - RNA, 22 nt, Human
ucucucggagcuaccggaaguu

SEQ ID NO: 101159 - RNA, 22 nt, Human
ucucucgguacagcuggcugga

SEQ ID NO: 101160 - RNA, 22 nt, Human
ucucuggacggacauuuaaggu

SEQ ID NO: 101161 - RNA, 22 nt, Human
ugcuugacucagcaucggcaau

SEQ ID NO: 101162 - RNA, 22 nt, Human
ugcuuacauuuugcuggucucc

SEQ ID NO: 101163 - RNA, 22 nt, Human
ugcuuaucuccuuaguuuuugc

SEQ ID NO: 101164 - RNA, 22 nt, Human
ucucuacugcuucugugaguga

SEQ ID NO: 101165 - RNA, 22 nt, Human
ucucuacuuggcuuguguucac

SEQ ID NO: 101166 - RNA, 20 nt, Human
ucucuaacaugaaugcuauc

SEQ ID NO: 101167 - RNA, 22 nt, Human
ucucgcuguuccugcuucaggu

SEQ ID NO: 101168 - RNA, 22 nt, Human
ucuccuuugaaaguuaggacug

SEQ ID NO: 101169 - RNA, 22 nt, Human
ucucuagcuuccuuaggaacac

SEQ ID NO: 101170 - RNA, 21 nt, Human
ucucuaucguauaccagccgg

SEQ ID NO: 101171 - RNA, 22 nt, Human
ucucuccauguuuucuguccag

SEQ ID NO: 101172 - RNA, 22 nt, Human
ugcuucucucuaggaagacgcu

SEQ ID NO: 101173 - RNA, 22 nt, Human
ucuucaaauacagucauauuga

SEQ ID NO: 101174 - RNA, 22 nt, Human
ucuucacagaugcauauacuuc

SEQ ID NO: 101175 - RNA, 22 nt, Human
ucuuauuucuuucuuuuccugu

SEQ ID NO: 101176 - RNA, 22 nt, Human
ucuucagacuguuguucuuuug

SEQ ID NO: 101177 - RNA, 22 nt, Human
ucuucacugaagcuuugcaucu

SEQ ID NO: 101178 - RNA, 20 nt, Human
ucuucagcuccaagucuggc

SEQ ID NO: 101179 - RNA, 22 nt, Human
ucuucaggaaaaccaaaguugu

SEQ ID NO: 101180 - RNA, 22 nt, Human
uggcaaaaccugcaauuacuuu

SEQ ID NO: 101181 - RNA, 22 nt, Human
uggaugacaaccauuggaagag

SEQ ID NO: 101182 - RNA, 22 nt, Human
uggcaaacacaauauggguaca

SEQ ID NO: 101183 - RNA, 22 nt, Human
uggcaagcuguuggcagauagc

SEQ ID NO: 101184 - RNA, 22 nt, Human
uggauuuuggaauguuucagua

SEQ ID NO: 101185 - RNA, 20 nt, Human
uggaugacuucaggcagccu

SEQ ID NO: 101186 - RNA, 22 nt, Human
uggaucuugaugcuccaagagu

SEQ ID NO: 101187 - RNA, 20 nt, Human
uggaucgaccucacuuccau

SEQ ID NO: 101188 - RNA, 22 nt, Human
ucuucccgggcaucucugcuca

SEQ ID NO: 101189 - RNA, 22 nt, Human
ucuucuauaucuacauaugcaa

SEQ ID NO: 101190 - RNA, 22 nt, Human
uggcagugggaagcuggaaguc

SEQ ID NO: 101191 - RNA, 22 nt, Human
uggcaaggccacaggugcaguu

SEQ ID NO: 101192 - RNA, 22 nt, Human
ucuucauuucuggggaauuggc

SEQ ID NO: 101193 - RNA, 19 nt, Human
ucuuccaucuauccuccuc

SEQ ID NO: 101194 - RNA, 22 nt, Human
ucuuccagauacuuccugacuu

SEQ ID NO: 101195 - RNA, 22 nt, Human
uggcuacauuuauacucucauu

SEQ ID NO: 101196 - RNA, 22 nt, Human
uggcgugaagcuggaaggcgga

SEQ ID NO: 101197 - RNA, 22 nt, Human
uggcucaggccuacgacgccuu

SEQ ID NO: 101198 - RNA, 22 nt, Human
uggcucacaggaggcagaggug

SEQ ID NO: 101199 - RNA, 22 nt, Human
uggcgcgcucgcucucgcugag

SEQ ID NO: 101200 - RNA, 22 nt, Human
uggcggcggggagguaggcaga

SEQ ID NO: 101201 - RNA, 22 nt, Human
uggcggagacauggacuucaga

SEQ ID NO: 101202 - RNA, 22 nt, Human
uggccaaucagcugugaccugc

SEQ ID NO: 101203 - RNA, 22 nt, Human
uggcauuugagcuggaaggaug

SEQ ID NO: 101204 - RNA, 22 nt, Human
uggccgaugagcaugcgcugau

SEQ ID NO: 101205 - RNA, 23 nt, Human
uggccguccccugacucucuggc

SEQ ID NO: 101206 - RNA, 22 nt, Human
uggcccugaaucaaggccagca

SEQ ID NO: 101207 - RNA, 20 nt, Human
uggccgacccugaggaguug

SEQ ID NO: 101208 - RNA, 22 nt, Human
uggcaguugcaguaacuuguau

SEQ ID NO: 101209 - RNA, 22 nt, Human
uggcaucucggugcugguucuu

SEQ ID NO: 101210 - RNA, 22 nt, Human
uggcaucacagacaaggcagca

SEQ ID NO: 101211 - RNA, 22 nt, Human
uggcaucuggugauauggacua

SEQ ID NO: 101212 - RNA, 22 nt, Human
ucuguuuuucagaccuuuuugg

SEQ ID NO: 101213 - RNA, 22 nt, Human
ucuguuuugugcuuuguuuucu

SEQ ID NO: 101214 - RNA, 22 nt, Human
ucuguuuuccaggaaucucaua

SEQ ID NO: 101215 - RNA, 22 nt, Human
ucuguuucaggggucuggaaug

SEQ ID NO: 101216 - RNA, 21 nt, Human
ucuguuguguguugaggacuu

SEQ ID NO: 101217 - RNA, 20 nt, Human
uggaucaccauccuguugcu

SEQ ID NO: 101218 - RNA, 22 nt, Human
ucuguuguauggcugucuaauu

SEQ ID NO: 101219 - RNA, 22 nt, Human
ucuguguuccuggcaccaaacu

SEQ ID NO: 101220 - RNA, 22 nt, Human
ucuguucagaagaggugaaagu

SEQ ID NO: 101221 - RNA, 22 nt, Human
ucuguucacaauuacacacacu

SEQ ID NO: 101222 - RNA, 22 nt, Human
ucugucaguguccucguguggu

SEQ ID NO: 101223 - RNA, 22 nt, Human
ucuguaauccacacagguggau

SEQ ID NO: 101224 - RNA, 22 nt, Human
ucugggagaguagauaaaggaa

SEQ ID NO: 101225 - RNA, 22 nt, Human
ucuguaccuuauguucagagug

SEQ ID NO: 101226 - RNA, 17 nt, Human
ucuguguccgcucaguc

SEQ ID NO: 101227 - RNA, 20 nt, Human
ucuguggcagguggcgcuug

SEQ ID NO: 101228 - RNA, 19 nt, Human
ucuguggagcucagaguag

SEQ ID NO: 101229 - RNA, 19 nt, Human
ucuguggccuucccugaug

SEQ ID NO: 101230 - RNA, 22 nt, Human
ucugugcuggacugauuucaua

SEQ ID NO: 101231 - RNA, 21 nt, Human
ucugugcuuuuuuggcuccua

SEQ ID NO: 101232 - RNA, 22 nt, Human
ucuguggcaaacacagugacca

SEQ ID NO: 101233 - RNA, 21 nt, Human
ucugucuaguuaccaccgccc

SEQ ID NO: 101234 - RNA, 22 nt, Human
ucugugcuccuuccuugucauc

SEQ ID NO: 101235 - RNA, 22 nt, Human
ucugguagauuauuuagaguac

SEQ ID NO: 101236 - RNA, 17 nt, Human
ucuggguuucugauuua

SEQ ID NO: 101237 - RNA, 22 nt, Human
ucuggucugccgagauccauuu

SEQ ID NO: 101238 - RNA, 22 nt, Human
ucugggucuaucccaugccuuu

SEQ ID NO: 101239 - RNA, 22 nt, Human
ucuggguuuccuucacaagcac

SEQ ID NO: 101240 - RNA, 22 nt, Human
ucugguuccugcauucauucaa

SEQ ID NO: 101241 - RNA, 22 nt, Human
ucugguuaggcuugugaggucc

SEQ ID NO: 101242 - RNA, 22 nt, Human
ucugguuucccaguuccuccgu

SEQ ID NO: 101243 - RNA, 22 nt, Human
uggaagucuucucucccaugga

SEQ ID NO: 101244 - RNA, 22 nt, Human
uggaaguggcaggggagacgua

SEQ ID NO: 101245 - RNA, 22 nt, Human
uggaagugggcaucaccaucca

SEQ ID NO: 101246 - RNA, 22 nt, Human
ucuggcucuccagugcucuuag

SEQ ID NO: 101247 - RNA, 22 nt, Human
ucuggcucaggagcuguguuca

SEQ ID NO: 101248 - RNA, 22 nt, Human
ucuggcuucaguaggguucacu

SEQ ID NO: 101249 - RNA, 22 nt, Human
uggaaggugauucucugguuaa

SEQ ID NO: 101250 - RNA, 22 nt, Human
ucugcuguugaucaugacuagc

SEQ ID NO: 101251 - RNA, 22 nt, Human
ucugcuuaguuuucuugaacag

SEQ ID NO: 101252 - RNA, 22 nt, Human
uggaagcuggcugaucugacuu

SEQ ID NO: 101253 - RNA, 20 nt, Human
uggaaggaaagguguaucuu

SEQ ID NO: 101254 - RNA, 22 nt, Human
ucuggcaguugccgcuucaguc

SEQ ID NO: 101255 - RNA, 22 nt, Human
ucugauucucuuguugaccuag

SEQ ID NO: 101256 - RNA, 22 nt, Human
ucugauucauucugguaaaugg

SEQ ID NO: 101257 - RNA, 22 nt, Human
ucugauaaggaaggauuaaaag

SEQ ID NO: 101258 - RNA, 22 nt, Human
ucugaucagaagacaaaugagg

SEQ ID NO: 101259 - RNA, 22 nt, Human
ugcagccuuuguccuugggcua

SEQ ID NO: 101260 - RNA, 22 nt, Human
ugcagcgugaggacagcugagc

SEQ ID NO: 101261 - RNA, 22 nt, Human
ugugaugagaugaacuguagac

SEQ ID NO: 101262 - RNA, 22 nt, Human
ugcagcuucucugcaacaggag

SEQ ID NO: 101263 - RNA, 22 nt, Human
ugugcagaaaacacuuaagaac

SEQ ID NO: 101264 - RNA, 18 nt, Human
ugcagcuuugugauuggc

SEQ ID NO: 101265 - RNA, 22 nt, Human
ugcaucugagcacuacggugga

SEQ ID NO: 101266 - RNA, 22 nt, Human
ugcaugacugaucuguuuguca

SEQ ID NO: 101267 - RNA, 17 nt, Human
ugcaugcgucugugaua

SEQ ID NO: 101268 - RNA, 22 nt, Human
ugcaugcagcuggucgggcgcc

SEQ ID NO: 101269 - RNA, 22 nt, Human
ugugcuugucuguuuugauugu

SEQ ID NO: 101270 - RNA, 22 nt, Human
uguggcaauauggaauguguuu

SEQ ID NO: 101271 - RNA, 22 nt, Human
uguggauauauuuuaaaaggaa

SEQ ID NO: 101272 - RNA, 22 nt, Human
ugcagugcagcuggaaguuggc

SEQ ID NO: 101273 - RNA, 22 nt, Human
ugccgcaggaggggcgauuucu

SEQ ID NO: 101274 - RNA, 22 nt, Human
uguggugcagcgggaacagcuu

SEQ ID NO: 101275 - RNA, 22 nt, Human
uguguggaaaugcuguauaugu

SEQ ID NO: 101276 - RNA, 22 nt, Human
uguguggccuccauaggguacu

SEQ ID NO: 101277 - RNA, 17 nt, Human
uguguauucuccaggug

SEQ ID NO: 101278 - RNA, 22 nt, Human
ugcaugguuauauacuacuagu

SEQ ID NO: 101279 - RNA, 22 nt, Human
ugcauguuauuguggcaagaau

SEQ ID NO: 101280 - RNA, 22 nt, Human
ugcauguuuuaagugaagcuga

SEQ ID NO: 101281 - RNA, 23 nt, Human
ugccaggaagaaugaccucugcu

SEQ ID NO: 101282 - RNA, 20 nt, Human
ugccagagagcucauacccu

SEQ ID NO: 101283 - RNA, 22 nt, Human
ugccagucggcacuuuaucugg

SEQ ID NO: 101284 - RNA, 22 nt, Human
ugcccccggcugcccaggggaa

SEQ ID NO: 101285 - RNA, 22 nt, Human
ugucagacagggcugcagucag

SEQ ID NO: 101286 - RNA, 19 nt, Human
ugcagcacuaaaaacuuuc

SEQ ID NO: 101287 - RNA, 22 nt, Human
ugcagcagaauauggcugcagg

SEQ ID NO: 101288 - RNA, 22 nt, Human
ugcagcaucuccuugugccaug

SEQ ID NO: 101289 - RNA, 22 nt, Human
ugugagucuugcaggucgcuca

SEQ ID NO: 101290 - RNA, 22 nt, Human
ugugaaggaaaguaggagggac

SEQ ID NO: 101291 - RNA, 22 nt, Human
ugucuuuuaaaaauguguaaaa

SEQ ID NO: 101292 - RNA, 22 nt, Human
ugugaagugaugggugaccgag

SEQ ID NO: 101293 - RNA, 22 nt, Human
ugcagacuguuucuugacugaa

SEQ ID NO: 101294 - RNA, 22 nt, Human
ugcagaggagcuggaaggcugg

SEQ ID NO: 101295 - RNA, 22 nt, Human
ugcagaauauucuggugacaau

SEQ ID NO: 101296 - RNA, 22 nt, Human
ugcagaacacaguagacagaac

SEQ ID NO: 101297 - RNA, 23 nt, Human
ugcaaugcagcuagauguaaaau

SEQ ID NO: 101298 - RNA, 21 nt, Human
ugucugcaauuccagggaacc

SEQ ID NO: 101299 - RNA, 22 nt, Human
ugcaauggauaucugaacgugg

SEQ ID NO: 101300 - RNA, 21 nt, Human
ugcaaugcauugacagcagca

SEQ ID NO: 101301 - RNA, 22 nt, Human
ugucugauccuucaggagcccc

SEQ ID NO: 101302 - RNA, 22 nt, Human
ugucauuuauucucuuauucua

SEQ ID NO: 101303 - RNA, 22 nt, Human
ugucauuggugaucugaugccu

SEQ ID NO: 101304 - RNA, 22 nt, Human
ugcaagugccauggauucaggu

SEQ ID NO: 101305 - RNA, 22 nt, Human
ugcaaugagcuucuuugauaaa

SEQ ID NO: 101306 - RNA, 22 nt, Human
ugucguaaaagggccgcagugg

SEQ ID NO: 101307 - RNA, 21 nt, Human
ugucaucucuaaaaagauugu

SEQ ID NO: 101308 - RNA, 22 nt, Human
ugucagccacggugugaccggc

SEQ ID NO: 101309 - RNA, 21 nt, Human
ugucagaaagccugugacuuu

SEQ ID NO: 101310 - RNA, 22 nt, Human
ugucacuuaagguuggugucuc

SEQ ID NO: 101311 - RNA, 22 nt, Human
ugauuuguuuaaauugcucguu

SEQ ID NO: 101312 - RNA, 22 nt, Human
ugucacggccggguggcaccga

SEQ ID NO: 101313 - RNA, 22 nt, Human
ugauuugauuuguuuaugccug

SEQ ID NO: 101314 - RNA, 22 nt, Human
ugauaguaucugauuauuucac

SEQ ID NO: 101315 - RNA, 23 nt, Human
uguaaaacaccguuauugcaccu

SEQ ID NO: 101316 - RNA, 22 nt, Human
ugagugggaggugggaagggua

SEQ ID NO: 101317 - RNA, 22 nt, Human
uguaaucaugguagaggcaaag

SEQ ID NO: 101318 - RNA, 20 nt, Human
ugauccacucucauugcucu

SEQ ID NO: 101319 - RNA, 22 nt, Human
uguacuguuuucuaggcaaaaa

SEQ ID NO: 101320 - RNA, 23 nt, Human
ugguuuucagaagaccuuguuag

SEQ ID NO: 101321 - RNA, 21 nt, Human
ugguuuuaucuugguggcugc

SEQ ID NO: 101322 - RNA, 22 nt, Human
ugguuuucuuaauuagcaguca

SEQ ID NO: 101323 - RNA, 22 nt, Human
ugguuuguauauguuugugaga

SEQ ID NO: 101324 - RNA, 21 nt, Human
ugagucuuagagaacuucagg

SEQ ID NO: 101325 - RNA, 22 nt, Human
ugagugacuguugucaagaugg

SEQ ID NO: 101326 - RNA, 22 nt, Human
ugagugcacaggccacucuuca

SEQ ID NO: 101327 - RNA, 22 nt, Human
ugagugcuuuucgguguaccgu

SEQ ID NO: 101328 - RNA, 22 nt, Human
ugagugugugcugcuuacauuc

SEQ ID NO: 101329 - RNA, 22 nt, Human
ugagucaccucucagaagccac

SEQ ID NO: 101330 - RNA, 22 nt, Human
ugaguacauuugauuaucagag

SEQ ID NO: 101331 - RNA, 22 nt, Human
ugagucuguugcuagggggaau

SEQ ID NO: 101332 - RNA, 22 nt, Human
uggucuccucuuaauugccuac

SEQ ID NO: 101333 - RNA, 22 nt, Human
uggugccuuccgagagcuguga

SEQ ID NO: 101334 - RNA, 22 nt, Human
ugagcagccagucauucaaaaa

SEQ ID NO: 101335 - RNA, 22 nt, Human
ugagccauguucaugagguuca

SEQ ID NO: 101336 - RNA, 22 nt, Human
ugagcagagcacuugggaacga

SEQ ID NO: 101337 - RNA, 19 nt, Human
ugagauuguaugaggagau

SEQ ID NO: 101338 - RNA, 22 nt, Human
ugguucugccacuuuccccuug

SEQ ID NO: 101339 - RNA, 22 nt, Human
ugguucuagaugagaugaugag

SEQ ID NO: 101340 - RNA, 22 nt, Human
ugguucggcuguaaguauaucu

SEQ ID NO: 101341 - RNA, 22 nt, Human
ugguuacagaugaagaucggcc

SEQ ID NO: 101342 - RNA, 20 nt, Human
ugguguccuaugcuugugcu

SEQ ID NO: 101343 - RNA, 22 nt, Human
ugguuagucaugguacugcagc

SEQ ID NO: 101344 - RNA, 22 nt, Human
ugaggaugaggaagaagaagaa

SEQ ID NO: 101345 - RNA, 20 nt, Human
ugguguacauuuccauaguu

SEQ ID NO: 101346 - RNA, 22 nt, Human
uggugguaggggugguuucuga

SEQ ID NO: 101347 - RNA, 22 nt, Human
uggucaaauccuagauccuuug

SEQ ID NO: 101348 - RNA, 22 nt, Human
ugguaugaaggaggccggcagc

SEQ ID NO: 101349 - RNA, 22 nt, Human
uggucaagcaaugaauuuauuu

SEQ ID NO: 101350 - RNA, 22 nt, Human
ugguccaugcuccaggcacauu

SEQ ID NO: 101351 - RNA, 22 nt, Human
ugguccaaaccagugcuguggu

SEQ ID NO: 101352 - RNA, 22 nt, Human
ugguauaaaaauuugugaaugu

SEQ ID NO: 101353 - RNA, 22 nt, Human
ugagacugaguuugguuuuguu

SEQ ID NO: 101354 - RNA, 22 nt, Human
ugagagaggugaaaugacuuuc

SEQ ID NO: 101355 - RNA, 22 nt, Human
ugagagacggagccccggcucg

SEQ ID NO: 101356 - RNA, 22 nt, Human
ugguauaaaaaaaugaguauaa

SEQ ID NO: 101357 - RNA, 22 nt, Human
ugguaauuuaacaaaauuguca

SEQ ID NO: 101358 - RNA, 22 nt, Human
ugguaacgguuuccuugccauu

SEQ ID NO: 101359 - RNA, 22 nt, Human
ugagacaaaguuguuggauguu

SEQ ID NO: 101360 - RNA, 23 nt, Human
uggguuucagugccaaugcugcc

SEQ ID NO: 101361 - RNA, 22 nt, Human
uggguuuaccaguguuucuucc

SEQ ID NO: 101362 - RNA, 22 nt, Human
uggguucugaucccaggacugc

SEQ ID NO: 101363 - RNA, 20 nt, Human
ugagaaacaagggcuggucu

SEQ ID NO: 101364 - RNA, 22 nt, Human
ugagaaauauacaccagacaca

SEQ ID NO: 101365 - RNA, 22 nt, Human
ugacuuauuaaaaguuuuuauu

SEQ ID NO: 101366 - RNA, 22 nt, Human
uggguguggaagcagcgugggg

SEQ ID NO: 101367 - RNA, 22 nt, Human
uggguuaaaguuugucacugac

SEQ ID NO: 101368 - RNA, 22 nt, Human
ugggugccgcaucuugcuguuc

SEQ ID NO: 101369 - RNA, 22 nt, Human
ugggugggcagagucuaagaua

SEQ ID NO: 101370 - RNA, 22 nt, Human
uggguggugaaauggaugggaa

SEQ ID NO: 101371 - RNA, 19 nt, Human
ugacuggguucuaggcagg

SEQ ID NO: 101372 - RNA, 22 nt, Human
ugacguuugcgccgcgcacgac

SEQ ID NO: 101373 - RNA, 22 nt, Human
ugggucagauugagccccuggu

SEQ ID NO: 101374 - RNA, 22 nt, Human
ugggucaguagccuugcagaac

SEQ ID NO: 101375 - RNA, 22 nt, Human
ugaccuuuuuaaauuauuuuua

SEQ ID NO: 101376 - RNA, 22 nt, Human
ugaccuacauuuauagcuguca

SEQ ID NO: 101377 - RNA, 22 nt, Human
ugaccuccuaagugacagaauu

SEQ ID NO: 101378 - RNA, 22 nt, Human
ugaccuuaguuuuuucaaugag

SEQ ID NO: 101379 - RNA, 22 nt, Human
ugaaaaauauuuuuagaaauaa

SEQ ID NO: 101380 - RNA, 22 nt, Human
ucuuuuucccugguuccuuuuu

SEQ ID NO: 101381 - RNA, 22 nt, Human
ugaaagccuacagcucacuguu

SEQ ID NO: 101382 - RNA, 22 nt, Human
uggcucaguaaucgagucuccu

SEQ ID NO: 101383 - RNA, 22 nt, Human
uuacuguguguaaaauaucuuu

SEQ ID NO: 101384 - RNA, 21 nt, Human
uuacuggcagcagaaaccuga

SEQ ID NO: 101385 - RNA, 22 nt, Human
uggaaaagaugucuuccugaau

SEQ ID NO: 101386 - RNA, 20 nt, Human
uuacugagguauuuuuauca

SEQ ID NO: 101387 - RNA, 22 nt, Human
ugcuuuuguaucagaguauuca

SEQ ID NO: 101388 - RNA, 22 nt, Human
uggaaaacgcaguuuaauuuuu

SEQ ID NO: 101389 - RNA, 20 nt, Human
uuacucaaccaggcuucuac

SEQ ID NO: 101390 - RNA, 23 nt, Human
uuacuaugaaaauuccagucacu

SEQ ID NO: 101391 - RNA, 21 nt, Human
uuacuaagagagcagagggac

SEQ ID NO: 101392 - RNA, 22 nt, Human
uuaccugagcggauuuguugca

SEQ ID NO: 101393 - RNA, 22 nt, Human
uuaccugccucaaacacgaaug

SEQ ID NO: 101394 - RNA, 22 nt, Human
ugcuuucaaugaauuguauacu

SEQ ID NO: 101395 - RNA, 22 nt, Human
uuaccuaagaaacucauuucgu

SEQ ID NO: 101396 - RNA, 22 nt, Human
ugcuuuccuucccuauguugag

SEQ ID NO: 101397 - RNA, 22 nt, Human
uuaccauaguacuaucaguuua

SEQ ID NO: 101398 - RNA, 22 nt, Human
uuacaguuuacauaagaauugu

SEQ ID NO: 101399 - RNA, 19 nt, Human
uuacaugacauaugaagga

SEQ ID NO: 101400 - RNA, 22 nt, Human
ugcuuguuuuguggcuucagcu

SEQ ID NO: 101401 - RNA, 22 nt, Human
uuagaugcugugauuuuucaaa

SEQ ID NO: 101402 - RNA, 22 nt, Human
uggaagaaaacuuggaaggcau

SEQ ID NO: 101403 - RNA, 22 nt, Human
uggaaauaguugugagucaggc

SEQ ID NO: 101404 - RNA, 20 nt, Human
uuagaggccaugucuuguuu

SEQ ID NO: 101405 - RNA, 22 nt, Human
uggaaagaagacugugguugag

SEQ ID NO: 101406 - RNA, 22 nt, Human
uggaaagauuuaaaauaacgag

SEQ ID NO: 101407 - RNA, 22 nt, Human
uuacuuuuuucccccuuagaug

SEQ ID NO: 101408 - RNA, 22 nt, Human
uuacuuaucugaugugauuuuu

SEQ ID NO: 101409 - RNA, 22 nt, Human
uggaaauagauguaggaaauug

SEQ ID NO: 101410 - RNA, 22 nt, Human
uggaaaggaguucuguuuauuu

SEQ ID NO: 101411 - RNA, 22 nt, Human
uggaaaguuggaagucucagga

SEQ ID NO: 101412 - RNA, 22 nt, Human
uggacccaccccagggccugcu

SEQ ID NO: 101413 - RNA, 22 nt, Human
uggacuguucauugauacugga

SEQ ID NO: 101414 - RNA, 22 nt, Human
uggagaaauaacauuuggauuc

SEQ ID NO: 101415 - RNA, 22 nt, Human
uggagcaagaagggaggcagaa

SEQ ID NO: 101416 - RNA, 22 nt, Human
uggagagcaggugaaggaaaga

SEQ ID NO: 101417 - RNA, 21 nt, Human
uggagcagggaggauuugggg

SEQ ID NO: 101418 - RNA, 19 nt, Human
uuauccacagggaauuuau

SEQ ID NO: 101419 - RNA, 19 nt, Human
uuauccggacuuaauuuau

SEQ ID NO: 101420 - RNA, 22 nt, Human
uuaucugugcuuuacugacaga

SEQ ID NO: 101421 - RNA, 22 nt, Human
uuauaucagaaggugagauuga

SEQ ID NO: 101422 - RNA, 22 nt, Human
uggacacugguggauauggaau

SEQ ID NO: 101423 - RNA, 22 nt, Human
uggacagguacuucacauuauu

SEQ ID NO: 101424 - RNA, 22 nt, Human
uggaauuaucugaagugauuug

SEQ ID NO: 101425 - RNA, 22 nt, Human
uggaaugccgggccaggcuccg

SEQ ID NO: 101426 - RNA, 22 nt, Human
uggaaugaaagaaaaauuguag

SEQ ID NO: 101427 - RNA, 22 nt, Human
uggaagugucagcaggcugguu

SEQ ID NO: 101428 - RNA, 20 nt, Human
uuaguuacuuagugagaguc

SEQ ID NO: 101429 - RNA, 22 nt, Human
uuaguuaccacugcagaucuuu

SEQ ID NO: 101430 - RNA, 22 nt, Human
uuagugucugacgcaggcgcca

SEQ ID NO: 101431 - RNA, 22 nt, Human
uggaaggaaauguguaucauaa

SEQ ID NO: 101432 - RNA, 22 nt, Human
uggaaggggagcuggaaagggg

SEQ ID NO: 101433 - RNA, 21 nt, Human
uggaagggaagucuugguugu

SEQ ID NO: 101434 - RNA, 19 nt, Human
uggaagugauaguauagua

SEQ ID NO: 101435 - RNA, 22 nt, Human
uggaaggggccaggcgcggagu

SEQ ID NO: 101436 - RNA, 22 nt, Human
uggaagggguuacgcagcagga

SEQ ID NO: 101437 - RNA, 22 nt, Human
uggaagaaaugguugagccaug

SEQ ID NO: 101438 - RNA, 22 nt, Human
uggaagaucugguguagcuccu

SEQ ID NO: 101439 - RNA, 23 nt, Human
uggaagaaaaugguuuggcugug

SEQ ID NO: 101440 - RNA, 22 nt, Human
uggaagaagcuacaagcgguga

SEQ ID NO: 101441 - RNA, 22 nt, Human
uuagguuuaugaggucugcauu

SEQ ID NO: 101442 - RNA, 22 nt, Human
uuaggagugccaucuuguggac

SEQ ID NO: 101443 - RNA, 22 nt, Human
uuaauaaggaccugugacaugc

SEQ ID NO: 101444 - RNA, 22 nt, Human
ugcuguugacuuuguuguucuu

SEQ ID NO: 101445 - RNA, 20 nt, Human
ugcuguggguaagcuuuaua

SEQ ID NO: 101446 - RNA, 20 nt, Human
ugcugugugucuacuguggg

SEQ ID NO: 101447 - RNA, 22 nt, Human
uuaaugcagguacuguuacaau

SEQ ID NO: 101448 - RNA, 22 nt, Human
ugcuuaaccagccccuucccuu

SEQ ID NO: 101449 - RNA, 22 nt, Human
ugcuucucacuucuugguuucc

SEQ ID NO: 101450 - RNA, 22 nt, Human
uuaaugcauguaaaugugcaaa

SEQ ID NO: 101451 - RNA, 22 nt, Human
ugcuucuuuccuuggugacuuc

SEQ ID NO: 101452 - RNA, 22 nt, Human
uuaauucuugagcugucuuucc

SEQ ID NO: 101453 - RNA, 22 nt, Human
uuaauguggaagaguuuggcua

SEQ ID NO: 101454 - RNA, 22 nt, Human
uuaauguugacacacuagcaca

SEQ ID NO: 101455 - RNA, 22 nt, Human
ugcuugaacccaggaaguggag

SEQ ID NO: 101456 - RNA, 22 nt, Human
ugcuugaggcuugucaucuaac

SEQ ID NO: 101457 - RNA, 22 nt, Human
ugcuugcuaucuaaguguuuca

SEQ ID NO: 101458 - RNA, 22 nt, Human
ugcuuggagaaucagucccagc

SEQ ID NO: 101459 - RNA, 22 nt, Human
ugcuuggauuuccaaaugguuu

SEQ ID NO: 101460 - RNA, 22 nt, Human
ugcuugugcacacacauguuau

SEQ ID NO: 101461 - RNA, 22 nt, Human
uuaaggcuguggggauuacugc

SEQ ID NO: 101462 - RNA, 22 nt, Human
uuaaggcauagcuuguguugac

SEQ ID NO: 101463 - RNA, 22 nt, Human
ugcugugagaccauuuguugag

SEQ ID NO: 101464 - RNA, 23 nt, Human
uuaagacuggcugaacuuaguag

SEQ ID NO: 101465 - RNA, 22 nt, Human
uuaacauuguccuuagcagauu

SEQ ID NO: 101466 - RNA, 22 nt, Human
ugcugggagcugggccucgaca

SEQ ID NO: 101467 - RNA, 22 nt, Human
ugcuggagccauguuuucucua

SEQ ID NO: 101468 - RNA, 22 nt, Human
ugcuggaguggcacuguguggc

SEQ ID NO: 101469 - RNA, 22 nt, Human
uuaaaauuguuaacuuugguga

SEQ ID NO: 101470 - RNA, 22 nt, Human
uuaaacauuuccacuugccagu

SEQ ID NO: 101471 - RNA, 22 nt, Human
uuaaaucaggcaucauuucagu

SEQ ID NO: 101472 - RNA, 22 nt, Human
uuaaaagaauccuguuauccuc

SEQ ID NO: 101473 - RNA, 22 nt, Human
ugcugcggauauacaggaucug

SEQ ID NO: 101474 - RNA, 22 nt, Human
uguuuuguuuagguuuguuuuu

SEQ ID NO: 101475 - RNA, 22 nt, Human
uguuuguuuuguauuuuuaauu

SEQ ID NO: 101476 - RNA, 22 nt, Human
uguuuucuuuccccuucuuuuc

SEQ ID NO: 101477 - RNA, 22 nt, Human
uguuugaugugcacgugugugu

SEQ ID NO: 101478 - RNA, 21 nt, Human
uguuugcuuuuggagcaacug

SEQ ID NO: 101479 - RNA, 22 nt, Human
uguuuaucaguagacucaaguu

SEQ ID NO: 101480 - RNA, 22 nt, Human
uguuuccuaagugucucugaag

SEQ ID NO: 101481 - RNA, 22 nt, Human
uguuucaguaugauuuucccuc

SEQ ID NO: 101482 - RNA, 22 nt, Human
uguuucaugcagcccccuguca

SEQ ID NO: 101483 - RNA, 20 nt, Human
uguuucccaacaccccaaag

SEQ ID NO: 101484 - RNA, 22 nt, Human
ugcucuuuguagcugcuuugcu

SEQ ID NO: 101485 - RNA, 22 nt, Human
uguuucguugguggagagcuac

SEQ ID NO: 101486 - RNA, 22 nt, Human
ugcugaccggccuccccccagc

SEQ ID NO: 101487 - RNA, 22 nt, Human
ugcugcacuuauggcucugagg

SEQ ID NO: 101488 - RNA, 22 nt, Human
uguuggauuuugugaaauauga

SEQ ID NO: 101489 - RNA, 22 nt, Human
uguuggcagugcuacagucagu

SEQ ID NO: 101490 - RNA, 22 nt, Human
ugcuccucugcaugucugcggc

SEQ ID NO: 101491 - RNA, 22 nt, Human
uguuggugcacugaaaggcagg

SEQ ID NO: 101492 - RNA, 23 nt, Human
uguuggcucccagucucccccuc

SEQ ID NO: 101493 - RNA, 22 nt, Human
ugugugugugugugugugugug

SEQ ID NO: 101494 - RNA, 22 nt, Human
ugugugggcgaagacagccuuu

SEQ ID NO: 101495 - RNA, 22 nt, Human
uguguguguauacauguauaua

SEQ ID NO: 101496 - RNA, 22 nt, Human
ugccugucuaucuuugucaucu

SEQ ID NO: 101497 - RNA, 21 nt, Human
ugccuggccuuugcuuuuccu

SEQ ID NO: 101498 - RNA, 22 nt, Human
ugccuggugcggagugaguggc

SEQ ID NO: 101499 - RNA, 22 nt, Human
uguugucaugcagucaguggua

SEQ ID NO: 101500 - RNA, 22 nt, Human
uguuguaaacagaggagccauu

SEQ ID NO: 101501 - RNA, 22 nt, Human
uguuguagacaguucacucgug

SEQ ID NO: 101502 - RNA, 17 nt, Human
uguuguguggauuuucc

SEQ ID NO: 101503 - RNA, 23 nt, Human
ugcucgccuucaggacuugggcu

SEQ ID NO: 101504 - RNA, 22 nt, Human
ugcucgauuauuucauuuugca

SEQ ID NO: 101505 - RNA, 22 nt, Human
ugcucugguccucccucggcgc

SEQ ID NO: 101506 - RNA, 22 nt, Human
uguugguuucaagcaggagccu

SEQ ID NO: 101507 - RNA, 22 nt, Human
ugcucuguucaguguaucuugu

SEQ ID NO: 101508 - RNA, 22 nt, Human
uucggcagaaagucauuugucu

SEQ ID NO: 101509 - RNA, 22 nt, Human
uucggugagcugcgggcgagga

SEQ ID NO: 101510 - RNA, 22 nt, Human
uucgcucuucacacagugcuga

SEQ ID NO: 101511 - RNA, 22 nt, Human
uucgucauuaugcagccuguga

SEQ ID NO: 101512 - RNA, 22 nt, Human
uuccuucccccuucuuugccuu

SEQ ID NO: 101513 - RNA, 22 nt, Human
uggggcauacgugaaauaauuu

SEQ ID NO: 101514 - RNA, 21 nt, Human
uuccuggaggcagaaacguga

SEQ ID NO: 101515 - RNA, 22 nt, Human
uuccuguggggugucaucauag

SEQ ID NO: 101516 - RNA, 22 nt, Human
uucccugggggggccgcuuucc

SEQ ID NO: 101517 - RNA, 22 nt, Human
uuccucauuuggcacaucugag

SEQ ID NO: 101518 - RNA, 22 nt, Human
uuccucauuuuguuaauuuuac

SEQ ID NO: 101519 - RNA, 22 nt, Human
uuccugaucuuuucccagaguu

SEQ ID NO: 101520 - RNA, 22 nt, Human
uuccugcuggucaaaguugccu

SEQ ID NO: 101521 - RNA, 22 nt, Human
uggcuuauggguccucccucuu

SEQ ID NO: 101522 - RNA, 21 nt, Human
uuccauggacccugucagugu

SEQ ID NO: 101523 - RNA, 22 nt, Human
uggcugagugaacauguccauu

SEQ ID NO: 101524 - RNA, 22 nt, Human
uggcugggagcuggaacugggc

SEQ ID NO: 101525 - RNA, 22 nt, Human
uuccauuacuaaugccugcaau

SEQ ID NO: 101526 - RNA, 22 nt, Human
ugggaagaggaggcagggggca

SEQ ID NO: 101527 - RNA, 22 nt, Human
ugggaaaauagcuauuuugaaa

SEQ ID NO: 101528 - RNA, 22 nt, Human
ugggaaaauugugauucuuucu

SEQ ID NO: 101529 - RNA, 22 nt, Human
ugggaauuuaugagaaaauaua

SEQ ID NO: 101530 - RNA, 22 nt, Human
ugggaagccaguaucagacuaa

SEQ ID NO: 101531 - RNA, 22 nt, Human
uggcugaggcuuuucuuaaaga

SEQ ID NO: 101532 - RNA, 22 nt, Human
uucauuuuauauuagagcuguu

SEQ ID NO: 101533 - RNA, 22 nt, Human
uggcugagcugcagcguggcuu

SEQ ID NO: 101534 - RNA, 22 nt, Human
uuccaacaugugcuuguguuga

SEQ ID NO: 101535 - RNA, 22 nt, Human
uuaugucauuugaauuaauuuu

SEQ ID NO: 101536 - RNA, 22 nt, Human
uggagcuggcuuguggaaguug

SEQ ID NO: 101537 - RNA, 22 nt, Human
uggucacgucgggguauugcca

SEQ ID NO: 101538 - RNA, 22 nt, Human
uggucacacugcauaacacgca

SEQ ID NO: 101539 - RNA, 22 nt, Human
uggucacagauuuacaggaaug

SEQ ID NO: 101540 - RNA, 22 nt, Human
uggucccuagugugggagcuug

SEQ ID NO: 101541 - RNA, 22 nt, Human
ugguccgagaacuguccugguu

SEQ ID NO: 101542 - RNA, 22 nt, Human
uucuggaguuugaagaucaggu

SEQ ID NO: 101543 - RNA, 19 nt, Human
uucugguacauacugccug

SEQ ID NO: 101544 - RNA, 22 nt, Human
uucuggggccgugacgaggggc

SEQ ID NO: 101545 - RNA, 22 nt, Human
uucugggguaagcacugaggau

SEQ ID NO: 101546 - RNA, 22 nt, Human
uucuggugauuugccucuuuag

SEQ ID NO: 101547 - RNA, 22 nt, Human
ugguauauuugaccauaugugu

SEQ ID NO: 101548 - RNA, 22 nt, Human
uucuggagacccagcaacaggg

SEQ ID NO: 101549 - RNA, 22 nt, Human
uucuggacuuccaaauggcuuc

SEQ ID NO: 101550 - RNA, 21 nt, Human
ugguaaggggauccuguuacu

SEQ ID NO: 101551 - RNA, 22 nt, Human
ugguacaaaaaagauuuuggac

SEQ ID NO: 101552 - RNA, 22 nt, Human
uucuggagucuauuuugaaaag

SEQ ID NO: 101553 - RNA, 22 nt, Human
uggguuuauuguauuucccuua

SEQ ID NO: 101554 - RNA, 22 nt, Human
ugguaaguuacaugucugccuc

SEQ ID NO: 101555 - RNA, 22 nt, Human
ugguagacaacagcagugggac

SEQ ID NO: 101556 - RNA, 22 nt, Human
ugguagcaggugcuaaaggccu

SEQ ID NO: 101557 - RNA, 21 nt, Human
uucugcuguucaccaccaccc

SEQ ID NO: 101558 - RNA, 22 nt, Human
ugguaaaugucuaacaaucacu

SEQ ID NO: 101559 - RNA, 17 nt, Human
uucugcucaggaacaga

SEQ ID NO: 101560 - RNA, 22 nt, Human
uucugcuagugguauauguuga

SEQ ID NO: 101561 - RNA, 22 nt, Human
ugguaaaguguacugaauauga

SEQ ID NO: 101562 - RNA, 22 nt, Human
uggguguuccuggggugcaagg

SEQ ID NO: 101563 - RNA, 22 nt, Human
ugggugugggguaggguaagag

SEQ ID NO: 101564 - RNA, 22 nt, Human
ugggugugcaccuacgaucucu

SEQ ID NO: 101565 - RNA, 22 nt, Human
uucucgaacaaccuacagggug

SEQ ID NO: 101566 - RNA, 22 nt, Human
ugggugaugagguccccagccc

SEQ ID NO: 101567 - RNA, 22 nt, Human
uggguggauucgggaacuuguu

SEQ ID NO: 101568 - RNA, 18 nt, Human
uucugcggugacagauau

SEQ ID NO: 101569 - RNA, 22 nt, Human
uggguguguccauauuuugacu

SEQ ID NO: 101570 - RNA, 22 nt, Human
uggguuaaaaguugaaugaauu

SEQ ID NO: 101571 - RNA, 20 nt, Human
uggguucaguuguuucuggc

SEQ ID NO: 101572 - RNA, 22 nt, Human
uggguuugcuuguucagguucu

SEQ ID NO: 101573 - RNA, 22 nt, Human
uggguauauauguugcuacaga

SEQ ID NO: 101574 - RNA, 22 nt, Human
ugggucacuggccaagcucgac

SEQ ID NO: 101575 - RNA, 22 nt, Human
uucuccucagcaaggcagcuuu

SEQ ID NO: 101576 - RNA, 22 nt, Human
uucuccucuuugucacugcuuu

SEQ ID NO: 101577 - RNA, 22 nt, Human
uucuccugcccuuggacuucca

SEQ ID NO: 101578 - RNA, 21 nt, Human
uucuauauugagaauuggcua

SEQ ID NO: 101579 - RNA, 22 nt, Human
uggggcuggccaggaggagucu

SEQ ID NO: 101580 - RNA, 22 nt, Human
uggggcuccaguagagaaggca

SEQ ID NO: 101581 - RNA, 22 nt, Human
uggggcuauggcccgaccacgu

SEQ ID NO: 101582 - RNA, 22 nt, Human
uggggcgccuggcugaggcugc

SEQ ID NO: 101583 - RNA, 22 nt, Human
uggggcggaaggaggagaggug

SEQ ID NO: 101584 - RNA, 22 nt, Human
uucuugcuucucugucugccuc

SEQ ID NO: 101585 - RNA, 19 nt, Human
ugguggaggugcaccugac

SEQ ID NO: 101586 - RNA, 22 nt, Human
ugguuauggaacuggcuauggc

SEQ ID NO: 101587 - RNA, 20 nt, Human
ugguuaaagugggugagcgg

SEQ ID NO: 101588 - RNA, 22 nt, Human
ugguuauauaaggauuaaauac

SEQ ID NO: 101589 - RNA, 23 nt, Human
uggugugaggaaggaagacuuua

SEQ ID NO: 101590 - RNA, 22 nt, Human
uggugugggauccugggaagga

SEQ ID NO: 101591 - RNA, 22 nt, Human
uucugugcugagaaauagagag

SEQ ID NO: 101592 - RNA, 22 nt, Human
uggugacaucuaccuagguaaa

SEQ ID NO: 101593 - RNA, 22 nt, Human
uggucugggaagaucacaauua

SEQ ID NO: 101594 - RNA, 22 nt, Human
uggucucuacggaggaaagcug

SEQ ID NO: 101595 - RNA, 22 nt, Human
uggucugauggucccaccaccg

SEQ ID NO: 101596 - RNA, 22 nt, Human
uggucggugguguggggaggca

SEQ ID NO: 101597 - RNA, 22 nt, Human
uucuguuuuuauucuaucucug

SEQ ID NO: 101598 - RNA, 22 nt, Human
uggugcucucgauauauaaggc

SEQ ID NO: 101599 - RNA, 22 nt, Human
uucuuaaugcauccuguguuca

SEQ ID NO: 101600 - RNA, 22 nt, Human
uggugcucuugauauauaaggc

SEQ ID NO: 101601 - RNA, 22 nt, Human
uggugcuuuuguggaugcuaac

SEQ ID NO: 101602 - RNA, 19 nt, Human
uggugcgcuguuccugagc

SEQ ID NO: 101603 - RNA, 22 nt, Human
uguaagaagaaaaccguaugga

SEQ ID NO: 101604 - RNA, 22 nt, Human
uugaaaaaauguguuuaaggag

SEQ ID NO: 101605 - RNA, 22 nt, Human
ugguuuuuuguaggauaaacau

SEQ ID NO: 101606 - RNA, 21 nt, Human
uucuuugcugcuguuuuugua

SEQ ID NO: 101607 - RNA, 22 nt, Human
ugguucugucugugcugggggg

SEQ ID NO: 101608 - RNA, 22 nt, Human
ugguugauuaauuuugccaagc

SEQ ID NO: 101609 - RNA, 22 nt, Human
uguaaauucuauacacuuaaaa

SEQ ID NO: 101610 - RNA, 22 nt, Human
uguacauuuacaaaagcuuuau

SEQ ID NO: 101611 - RNA, 22 nt, Human
uguagaaguuaauugaugagua

SEQ ID NO: 101612 - RNA, 23 nt, Human
uguacugucuuucagguucuuau

SEQ ID NO: 101613 - RNA, 22 nt, Human
uguacuacaugauuauugacca

SEQ ID NO: 101614 - RNA, 22 nt, Human
uugaaagucuaagaauagguau

SEQ ID NO: 101615 - RNA, 22 nt, Human
uguagggaucugccucuuccuc

SEQ ID NO: 101616 - RNA, 22 nt, Human
uguagugaaauuaaaccaaagc

SEQ ID NO: 101617 - RNA, 22 nt, Human
uguauaaaauggaaugucagaa

SEQ ID NO: 101618 - RNA, 22 nt, Human
uugcauauguccagccaugcau

SEQ ID NO: 101619 - RNA, 22 nt, Human
ugucuucauuccccaugaaguc

SEQ ID NO: 101620 - RNA, 22 nt, Human
uugcagcuguugcaaagucucu

SEQ ID NO: 101621 - RNA, 20 nt, Human
uugcaugcagccggaugcug

SEQ ID NO: 101622 - RNA, 22 nt, Human
ugugauugucuucugaaaguca

SEQ ID NO: 101623 - RNA, 22 nt, Human
uugcaugauuuaagaauaucug

SEQ ID NO: 101624 - RNA, 22 nt, Human
uugcaucaaauauguaccacag

SEQ ID NO: 101625 - RNA, 22 nt, Human
uugcaucagcaggcauaauugg

SEQ ID NO: 101626 - RNA, 22 nt, Human
ugugccuguugguguagacaua

SEQ ID NO: 101627 - RNA, 22 nt, Human
uugcaugugugaaaugcacaga

SEQ ID NO: 101628 - RNA, 22 nt, Human
ugucuuaaaauuuuagggcuau

SEQ ID NO: 101629 - RNA, 20 nt, Human
ugucugugugugauaauagu

SEQ ID NO: 101630 - RNA, 22 nt, Human
ugucuguauuugaggacauugu

SEQ ID NO: 101631 - RNA, 22 nt, Human
ugucugucugccauuuauucuc

SEQ ID NO: 101632 - RNA, 20 nt, Human
uugcaaagugaauagcaauu

SEQ ID NO: 101633 - RNA, 20 nt, Human
ugucugguaagacgcccauc

SEQ ID NO: 101634 - RNA, 22 nt, Human
uugauuggguauaaugacagga

SEQ ID NO: 101635 - RNA, 22 nt, Human
uugauucauuuguucccauuuu

SEQ ID NO: 101636 - RNA, 22 nt, Human
ugucugaauuguaauguugcgu

SEQ ID NO: 101637 - RNA, 22 nt, Human
uugaggaagggaggcaaaacug

SEQ ID NO: 101638 - RNA, 20 nt, Human
uugaggagauauugaauacu

SEQ ID NO: 101639 - RNA, 22 nt, Human
uugaggguggauugucagggga

SEQ ID NO: 101640 - RNA, 21 nt, Human
ugucagcaacaauacuuucuc

SEQ ID NO: 101641 - RNA, 22 nt, Human
uugaggucuguguaggcagcaa

SEQ ID NO: 101642 - RNA, 22 nt, Human
uugaguaaugcaagccuuugua

SEQ ID NO: 101643 - RNA, 22 nt, Human
uugauagauuuuagaggcaggc

SEQ ID NO: 101644 - RNA, 22 nt, Human
uugaugacauuuagcauaauug

SEQ ID NO: 101645 - RNA, 22 nt, Human
uugaugacuaaagaaagcugcu

SEQ ID NO: 101646 - RNA, 22 nt, Human
uugaugagucacuuucuguaaa

SEQ ID NO: 101647 - RNA, 23 nt, Human
uugaucuggaaaauacuuguuug

SEQ ID NO: 101648 - RNA, 22 nt, Human
uguccagcuauauguguaugug

SEQ ID NO: 101649 - RNA, 23 nt, Human
uguauacacccugugcaucuggg

SEQ ID NO: 101650 - RNA, 22 nt, Human
uugaauaguuuuggauagcaua

SEQ ID NO: 101651 - RNA, 22 nt, Human
uugaauaaggcauaaagauacu

SEQ ID NO: 101652 - RNA, 22 nt, Human
uugaaggugggaggauuuauau

SEQ ID NO: 101653 - RNA, 22 nt, Human
uugagauuuggagguaauuccc

SEQ ID NO: 101654 - RNA, 22 nt, Human
uugagaugacuuaaaucacugu

SEQ ID NO: 101655 - RNA, 22 nt, Human
ugucacagagcgugcaacagaa

SEQ ID NO: 101656 - RNA, 22 nt, Human
uugacucuuucauuuauuauuu

SEQ ID NO: 101657 - RNA, 22 nt, Human
uugacacauuagagcuuguaaa

SEQ ID NO: 101658 - RNA, 22 nt, Human
uugacguccucgauggggaacu

SEQ ID NO: 101659 - RNA, 22 nt, Human
uugacacauggcuucaauugca

SEQ ID NO: 101660 - RNA, 22 nt, Human
uuuaaaccuaucuaagaaauag

SEQ ID NO: 101661 - RNA, 23 nt, Human
uuuaaacaauguggucguggugg

SEQ ID NO: 101662 - RNA, 22 nt, Human
uuuaaaacaguacguuuucuua

SEQ ID NO: 101663 - RNA, 22 nt, Human
uuuaaaauguuuuauuuauuua

SEQ ID NO: 101664 - RNA, 22 nt, Human
uuuaaacuaacaguacacguug

SEQ ID NO: 101665 - RNA, 21 nt, Human
uuaaugcuaugcagaaaaucu

SEQ ID NO: 101666 - RNA, 21 nt, Human
uuaauugagggauggggguga

SEQ ID NO: 101667 - RNA, 22 nt, Human
uuaauguuuuagaaugagagug

SEQ ID NO: 101668 - RNA, 22 nt, Human
uuguuuuucucuagggaaggcu

SEQ ID NO: 101669 - RNA, 22 nt, Human
uuaaucuauuucauauaaggga

SEQ ID NO: 101670 - RNA, 22 nt, Human
uuguuugguugacugauuuacc

SEQ ID NO: 101671 - RNA, 22 nt, Human
uuaaugauuaauguggacccaa

SEQ ID NO: 101672 - RNA, 22 nt, Human
uuguuuuaguagaaguuacaug

SEQ ID NO: 101673 - RNA, 22 nt, Human
uuaauauuaagauauugagugg

SEQ ID NO: 101674 - RNA, 22 nt, Human
uuaauauuuauugguaaucacu

SEQ ID NO: 101675 - RNA, 22 nt, Human
uuaaucagacauucucaaguuu

SEQ ID NO: 101676 - RNA, 22 nt, Human
uuaauacugugucuuuuuuaau

SEQ ID NO: 101677 - RNA, 22 nt, Human
uuaauaaauugugguaccagag

SEQ ID NO: 101678 - RNA, 22 nt, Human
uuguuccuucuuuuuguaucag

SEQ ID NO: 101679 - RNA, 22 nt, Human
uuguucacuaugaagagguugg

SEQ ID NO: 101680 - RNA, 22 nt, Human
uuguuugcacuuuagagacugu

SEQ ID NO: 101681 - RNA, 22 nt, Human
uuguuuggcaaaugugugugug

SEQ ID NO: 101682 - RNA, 22 nt, Human
uuguuucauggggacgacuggc

SEQ ID NO: 101683 - RNA, 22 nt, Human
uuguuucagcuuccuccuccau

SEQ ID NO: 101684 - RNA, 22 nt, Human
uuguugcaagccuggaaucugg

SEQ ID NO: 101685 - RNA, 22 nt, Human
uuguuuaaagaacuucugacuu

SEQ ID NO: 101686 - RNA, 22 nt, Human
uuaagagaagaguaucuagaac

SEQ ID NO: 101687 - RNA, 22 nt, Human
uuaacuaguauuuuuaguccug

SEQ ID NO: 101688 - RNA, 23 nt, Human
uuaaggugccguguaauucaugc

SEQ ID NO: 101689 - RNA, 22 nt, Human
uuaagggauugagauggaauga

SEQ ID NO: 101690 - RNA, 22 nt, Human
uuaacccagccauuuucaauuu

SEQ ID NO: 101691 - RNA, 22 nt, Human
uuaacggugagacgccccaaau

SEQ ID NO: 101692 - RNA, 22 nt, Human
uuaacgaauugugcauaauucc

SEQ ID NO: 101693 - RNA, 22 nt, Human
uuaaagguacuccuaagcgggg

SEQ ID NO: 101694 - RNA, 22 nt, Human
uuaaagaguuuauuacuuguaa

SEQ ID NO: 101695 - RNA, 22 nt, Human
uuguuauaggaucagugucacu

SEQ ID NO: 101696 - RNA, 22 nt, Human
uugugugugcccaccuguggcc

SEQ ID NO: 101697 - RNA, 22 nt, Human
uuguguuuaaucuguuccacua

SEQ ID NO: 101698 - RNA, 22 nt, Human
uuaguauuuuuugaaugaugaa

SEQ ID NO: 101699 - RNA, 22 nt, Human
uuagucauucccucuugauauu

SEQ ID NO: 101700 - RNA, 22 nt, Human
uuuaugguacaggaaugcuguu

SEQ ID NO: 101701 - RNA, 22 nt, Human
uuuaugucaaaaguaaaaugaa

SEQ ID NO: 101702 - RNA, 22 nt, Human
uuuagugaagcuuugcauuuca

SEQ ID NO: 101703 - RNA, 22 nt, Human
uuuaguugcuuuaguugagcug

SEQ ID NO: 101704 - RNA, 22 nt, Human
uuagaugugaucagcuggcuua

SEQ ID NO: 101705 - RNA, 22 nt, Human
uuagauaguaaauagcacuaag

SEQ ID NO: 101706 - RNA, 22 nt, Human
uuagaguucaagcuuuaggaaa

SEQ ID NO: 101707 - RNA, 22 nt, Human
uuagaugaaaaucggaacaugu

SEQ ID NO: 101708 - RNA, 22 nt, Human
uuacuuucugggauaucaaaug

SEQ ID NO: 101709 - RNA, 22 nt, Human
uuagaaauguccuacuaauaug

SEQ ID NO: 101710 - RNA, 22 nt, Human
uuuagcaaaaaagcucugcgua

SEQ ID NO: 101711 - RNA, 22 nt, Human
uuuagauguucccucuacccug

SEQ ID NO: 101712 - RNA, 22 nt, Human
uuuagaugcuguauguuauuuc

SEQ ID NO: 101713 - RNA, 22 nt, Human
uuacuuacagggggucaggcug

SEQ ID NO: 101714 - RNA, 22 nt, Human
uuuaaucaguugguaauauuga

SEQ ID NO: 101715 - RNA, 22 nt, Human
uuuaaugaugucuaugccuguu

SEQ ID NO: 101716 - RNA, 22 nt, Human
uuacaucacuuuacuuaauaau

SEQ ID NO: 101717 - RNA, 22 nt, Human
uuaauuguuagauagauuauag

SEQ ID NO: 101718 - RNA, 22 nt, Human
uuacaacgcacacagauuucac

SEQ ID NO: 101719 - RNA, 22 nt, Human
uuaauugggugcuuuguaaaua

SEQ ID NO: 101720 - RNA, 22 nt, Human
uuuaauauuacacuuaccuugu

SEQ ID NO: 101721 - RNA, 22 nt, Human
uuuaccugucuguagaacauaa

SEQ ID NO: 101722 - RNA, 22 nt, Human
uuuaccuuauguaaauaagagu

SEQ ID NO: 101723 - RNA, 22 nt, Human
uuaccuuggaccggguaucaga

SEQ ID NO: 101724 - RNA, 22 nt, Human
uuuaaugguuuauggucuaaga

SEQ ID NO: 101725 - RNA, 22 nt, Human
uuuaaugucuuggaaaaagacu

SEQ ID NO: 101726 - RNA, 19 nt, Human
uuuaaugugugcugcaauc

SEQ ID NO: 101727 - RNA, 22 nt, Human
uuuaauuauaucugggcaguua

SEQ ID NO: 101728 - RNA, 22 nt, Human
uuuacuuuugguaaggucauuu

SEQ ID NO: 101729 - RNA, 22 nt, Human
uguuuuuauucuuaauguuuca

SEQ ID NO: 101730 - RNA, 22 nt, Human
uguuuuuagcuguuuuuuggau

SEQ ID NO: 101731 - RNA, 18 nt, Human
uugugccugagaaggugg

SEQ ID NO: 101732 - RNA, 23 nt, Human
uugugcggugcuuuggguuuaca

SEQ ID NO: 101733 - RNA, 22 nt, Human
uugugcauuugcuaugggccau

SEQ ID NO: 101734 - RNA, 22 nt, Human
uguuuuuuagagugauacuuuu

SEQ ID NO: 101735 - RNA, 22 nt, Human
uguuuuucaagcauuuauuaau

SEQ ID NO: 101736 - RNA, 22 nt, Human
uguuuuuucccccccuucuaaa

SEQ ID NO: 101737 - RNA, 22 nt, Human
uuguggagaggaagcaaggagg

SEQ ID NO: 101738 - RNA, 22 nt, Human
uuguggacgcaauucaaggaua

SEQ ID NO: 101739 - RNA, 22 nt, Human
uugucuguacuggcugcaucga

SEQ ID NO: 101740 - RNA, 22 nt, Human
uugucaguggccugaggacaga

SEQ ID NO: 101741 - RNA, 22 nt, Human
uguuuucaucucucacccagaa

SEQ ID NO: 101742 - RNA, 22 nt, Human
uguuuucuauuaccugagauug

SEQ ID NO: 101743 - RNA, 22 nt, Human
uguuuucccacugguuuguaca

SEQ ID NO: 101744 - RNA, 21 nt, Human
uguuuuguaauagauacuaug

SEQ ID NO: 101745 - RNA, 22 nt, Human
uugucauuuucuuaauguuccu

SEQ ID NO: 101746 - RNA, 22 nt, Human
uugucaugauccuucuguuagg

SEQ ID NO: 101747 - RNA, 19 nt, Human
uguugugggccacuaacua

SEQ ID NO: 101748 - RNA, 22 nt, Human
uugguugcugaugagcuuugag

SEQ ID NO: 101749 - RNA, 22 nt, Human
uugguauuuguuuaaauuacac

SEQ ID NO: 101750 - RNA, 22 nt, Human
uuggggcugcguauuuccaugu

SEQ ID NO: 101751 - RNA, 22 nt, Human
uuggggauugggugcaagggac

SEQ ID NO: 101752 - RNA, 22 nt, Human
uuggggaugccccuacgggcua

SEQ ID NO: 101753 - RNA, 22 nt, Human
uugggugcugcacccuucaaca

SEQ ID NO: 101754 - RNA, 22 nt, Human
uuggguguugguuccugggagg

SEQ ID NO: 101755 - RNA, 22 nt, Human
uugguaaccaaucaaaugugag

SEQ ID NO: 101756 - RNA, 22 nt, Human
uguuguucuuuuucuucuuguu

SEQ ID NO: 101757 - RNA, 22 nt, Human
uguuguuguuguuguuguuguu

SEQ ID NO: 101758 - RNA, 22 nt, Human
uguuuaaauagaacauacugca

SEQ ID NO: 101759 - RNA, 22 nt, Human
uuguauuguuugcgucuguguu

SEQ ID NO: 101760 - RNA, 22 nt, Human
uuguaagacuguagaaugcaaa

SEQ ID NO: 101761 - RNA, 22 nt, Human
uguuaguauuggcaaauuuguu

SEQ ID NO: 101762 - RNA, 23 nt, Human
uguuaucacauguuccuuuaaau

SEQ ID NO: 101763 - RNA, 22 nt, Human
uguuauugccucaugagacucc

SEQ ID NO: 101764 - RNA, 22 nt, Human
uuggcguuuccuguucugggug

SEQ ID NO: 101765 - RNA, 22 nt, Human
uguuccacgcguaguuccugcu

SEQ ID NO: 101766 - RNA, 22 nt, Human
uuggcuguguugaaaacgugga

SEQ ID NO: 101767 - RNA, 22 nt, Human
uguucugauggauuacaugucu

SEQ ID NO: 101768 - RNA, 22 nt, Human
uugggagaaaguuaacuuucua

SEQ ID NO: 101769 - RNA, 22 nt, Human
uuggggaggaagauagggugaa

SEQ ID NO: 101770 - RNA, 22 nt, Human
uuggcauuccagaugcuuuucu

SEQ ID NO: 101771 - RNA, 22 nt, Human
uguguuuuucauuuuaaguccu

SEQ ID NO: 101772 - RNA, 22 nt, Human
uuggcaggcugcauguuuaugu

SEQ ID NO: 101773 - RNA, 22 nt, Human
uguguuuaaacuauaugccugc

SEQ ID NO: 101774 - RNA, 21 nt, Human
uguguuuauauguguuuauau

SEQ ID NO: 101775 - RNA, 22 nt, Human
uguguuguuuggggauguccau

SEQ ID NO: 101776 - RNA, 22 nt, Human
uguguucagaagaggcugccgg

SEQ ID NO: 101777 - RNA, 22 nt, Human
uguguucuuugcuuaauuaaag

SEQ ID NO: 101778 - RNA, 22 nt, Human
uuggcagagaacagaaugauuu

SEQ ID NO: 101779 - RNA, 22 nt, Human
uuggcaaagagaugcauaagga

SEQ ID NO: 101780 - RNA, 22 nt, Human
uuggcaaaagauuggguacuua

SEQ ID NO: 101781 - RNA, 22 nt, Human
uugccuguuugagagcuguguu

SEQ ID NO: 101782 - RNA, 22 nt, Human
uuggaagacagccgucuuuauu

SEQ ID NO: 101783 - RNA, 22 nt, Human
uugcguaucuacauugccugua

SEQ ID NO: 101784 - RNA, 22 nt, Human
uuggagaaagcugcaggcucug

SEQ ID NO: 101785 - RNA, 22 nt, Human
uguguauguauguauguaugua

SEQ ID NO: 101786 - RNA, 22 nt, Human
uuggauugugaaaguauucucu

SEQ ID NO: 101787 - RNA, 22 nt, Human
uguguguguguguguaauauau

SEQ ID NO: 101788 - RNA, 22 nt, Human
ugugucuccacugugcuauuuu

SEQ ID NO: 101789 - RNA, 22 nt, Human
ugugucucucuuagguugucug

SEQ ID NO: 101790 - RNA, 22 nt, Human
uguguguguguguguguuugug

SEQ ID NO: 101791 - RNA, 19 nt, Human
uguguguguuuuguuugaa

SEQ ID NO: 101792 - RNA, 22 nt, Human
ugugucauuugagaggagacga

SEQ ID NO: 101793 - RNA, 22 nt, Human
ugugucgccaacaauugugucu

SEQ ID NO: 101794 - RNA, 22 nt, Human
ugugucuuuggcgaugucugga

SEQ ID NO: 101795 - RNA, 22 nt, Human
ugugugcacguacauacuguau

SEQ ID NO: 101796 - RNA, 22 nt, Human
ugugugcuaguuuugucaguau

SEQ ID NO: 101797 - RNA, 22 nt, Human
uguguguguccucauuugcaga

SEQ ID NO: 101798 - RNA, 22 nt, Human
uguguguguguguaugugcgug

SEQ ID NO: 101799 - RNA, 22 nt, Human
uuuuaaauggcuuuuacuuuuc

SEQ ID NO: 101800 - RNA, 22 nt, Human
uucgcggccaggcggggaggcc

SEQ ID NO: 101801 - RNA, 21 nt, Human
uucgaaugggucguugcugcc

SEQ ID NO: 101802 - RNA, 23 nt, Human
uuuuaauaguaugacaugagcug

SEQ ID NO: 101803 - RNA, 20 nt, Human
uuccuuucuuucuuuuuuuu

SEQ ID NO: 101804 - RNA, 20 nt, Human
uuccuuaucuguaaagugga

SEQ ID NO: 101805 - RNA, 22 nt, Human
uuccuggaguggagggagguga

SEQ ID NO: 101806 - RNA, 22 nt, Human
uuuguuuauuuacuuugggccu

SEQ ID NO: 101807 - RNA, 20 nt, Human
uuccucaaaagucugaugcu

SEQ ID NO: 101808 - RNA, 22 nt, Human
uuuguugucuucauaauacuuu

SEQ ID NO: 101809 - RNA, 22 nt, Human
uuuuaaaacaugucaaaaugug

SEQ ID NO: 101810 - RNA, 22 nt, Human
uuuguuugcugagugaauucaa

SEQ ID NO: 101811 - RNA, 22 nt, Human
uuuguuuuggugucaugcguga

SEQ ID NO: 101812 - RNA, 19 nt, Human
uuccacugcuuagcauugc

SEQ ID NO: 101813 - RNA, 22 nt, Human
uuccacuguucaguucugguca

SEQ ID NO: 101814 - RNA, 20 nt, Human
uuugugaggccagagaacag

SEQ ID NO: 101815 - RNA, 22 nt, Human
uuccacauucggaauuuucuga

SEQ ID NO: 101816 - RNA, 23 nt, Human
uuugggaaauagccuauaggcac

SEQ ID NO: 101817 - RNA, 22 nt, Human
uucauuauuaauaauagcagcu

SEQ ID NO: 101818 - RNA, 21 nt, Human
uucauucauggcauaauauag

SEQ ID NO: 101819 - RNA, 21 nt, Human
uuuguucaggggcaaaguuaa

SEQ ID NO: 101820 - RNA, 22 nt, Human
uucccagggaucucuaguauuu

SEQ ID NO: 101821 - RNA, 22 nt, Human
uucccaggugugagugagguga

SEQ ID NO: 101822 - RNA, 22 nt, Human
uuuguguuuucaggcacauggc

SEQ ID NO: 101823 - RNA, 22 nt, Human
uuccauggggcuguugcgcaga

SEQ ID NO: 101824 - RNA, 22 nt, Human
uucccgcugcuggaguuggggc

SEQ ID NO: 101825 - RNA, 22 nt, Human
uucccggccgccccccgcucgg

SEQ ID NO: 101826 - RNA, 23 nt, Human
uuuguugguuuaagaguagcaga

SEQ ID NO: 101827 - RNA, 22 nt, Human
uuuguugguugcacuggugggu

SEQ ID NO: 101828 - RNA, 22 nt, Human
uucauauuuaauuggucaucaa

SEQ ID NO: 101829 - RNA, 22 nt, Human
uucauaugaauuggguuuuuuu

SEQ ID NO: 101830 - RNA, 22 nt, Human
uucagguuuuaugguaaugcuu

SEQ ID NO: 101831 - RNA, 22 nt, Human
uuuggcuuugauccuaggauuc

SEQ ID NO: 101832 - RNA, 22 nt, Human
uucaggaaacaaauuugcaguu

SEQ ID NO: 101833 - RNA, 22 nt, Human
uuugcuguccaauauucagggu

SEQ ID NO: 101834 - RNA, 22 nt, Human
uucacuguucuuagagaagacc

SEQ ID NO: 101835 - RNA, 22 nt, Human
uuugccggaucugucuccagcu

SEQ ID NO: 101836 - RNA, 19 nt, Human
uuugccugugguucagaag

SEQ ID NO: 101837 - RNA, 22 nt, Human
uucagcauaggcugcucuucaa

SEQ ID NO: 101838 - RNA, 22 nt, Human
uucagcacuggacagcgagucu

SEQ ID NO: 101839 - RNA, 23 nt, Human
uucagcucuccugaagcaucugu

SEQ ID NO: 101840 - RNA, 22 nt, Human
uucagcauggcuguuuucccuu

SEQ ID NO: 101841 - RNA, 22 nt, Human
uucagcaagugucucuacuguc

SEQ ID NO: 101842 - RNA, 22 nt, Human
uucacccaaaucaagcuggccu

SEQ ID NO: 101843 - RNA, 23 nt, Human
uucaccaaugcuguccaaguacc

SEQ ID NO: 101844 - RNA, 22 nt, Human
uuugaauauacuucaaacaaag

SEQ ID NO: 101845 - RNA, 22 nt, Human
uucacuuuuucucugcuugaga

SEQ ID NO: 101846 - RNA, 22 nt, Human
uucagaaagugaaucuuguuau

SEQ ID NO: 101847 - RNA, 22 nt, Human
uucagaagguaggaaugucccu

SEQ ID NO: 101848 - RNA, 22 nt, Human
uucagaauguacugauagaaca

SEQ ID NO: 101849 - RNA, 22 nt, Human
uuagugaagaagcaucuuuagu

SEQ ID NO: 101850 - RNA, 22 nt, Human
uuaguccucaugaccaccaagu

SEQ ID NO: 101851 - RNA, 22 nt, Human
uuaguuaauaaauauugagugu

SEQ ID NO: 101852 - RNA, 22 nt, Human
uuuauuuggugguguuacuguu

SEQ ID NO: 101853 - RNA, 22 nt, Human
uuaguggguuccauuucuaugg

SEQ ID NO: 101854 - RNA, 22 nt, Human
uuaggucuugggccugccucca

SEQ ID NO: 101855 - RNA, 22 nt, Human
uucaaugcaagggaggucugaa

SEQ ID NO: 101856 - RNA, 20 nt, Human
uucacagaggacucagguca

SEQ ID NO: 101857 - RNA, 22 nt, Human
uucaaccuucagcuugaguugg

SEQ ID NO: 101858 - RNA, 22 nt, Human
uuaguuacuugacucaagaccc

SEQ ID NO: 101859 - RNA, 22 nt, Human
uuuuuuguggcuggaagaaaaa

SEQ ID NO: 101860 - RNA, 22 nt, Human
uugagcagccauuagcuggggu

SEQ ID NO: 101861 - RNA, 22 nt, Human
uuuuuugucuugaagaaauggu

SEQ ID NO: 101862 - RNA, 22 nt, Human
uugaccauguggcccaggccaa

SEQ ID NO: 101863 - RNA, 22 nt, Human
uugaccagaaaaguuaguaauu

SEQ ID NO: 101864 - RNA, 21 nt, Human
uugagcuuuuaguacagacag

SEQ ID NO: 101865 - RNA, 20 nt, Human
uugagccucauggauugucu

SEQ ID NO: 101866 - RNA, 22 nt, Human
uugagacucgagucucucagac

SEQ ID NO: 101867 - RNA, 22 nt, Human
uuuuuuccagcuucuagaggcc

SEQ ID NO: 101868 - RNA, 22 nt, Human
uugaaucauauguaauugacuu

SEQ ID NO: 101869 - RNA, 21 nt, Human
uugaaguggguagcuggcggg

SEQ ID NO: 101870 - RNA, 22 nt, Human
uuuuuguauaugcuucgaggau

SEQ ID NO: 101871 - RNA, 22 nt, Human
uuuuuguaaaugaaguuuuauu

SEQ ID NO: 101872 - RNA, 22 nt, Human
uuuuugggccaaauauauuuac

SEQ ID NO: 101873 - RNA, 22 nt, Human
uugaaaucuucccuccugucug

SEQ ID NO: 101874 - RNA, 22 nt, Human
uucuucuucuuccucauccuca

SEQ ID NO: 101875 - RNA, 22 nt, Human
uucuugcgaaagaaugagcuga

SEQ ID NO: 101876 - RNA, 22 nt, Human
uucuugcuuccggugcuccagg

SEQ ID NO: 101877 - RNA, 22 nt, Human
uucuuuguccuagcauucuaca

SEQ ID NO: 101878 - RNA, 22 nt, Human
uucuuugcucaccugccgcucc

SEQ ID NO: 101879 - RNA, 22 nt, Human
uucuuugcccauguuuccuaag

SEQ ID NO: 101880 - RNA, 22 nt, Human
uucuuuucuucccuguuuauua

SEQ ID NO: 101881 - RNA, 22 nt, Human
uucuuuuaauuucugucugcag

SEQ ID NO: 101882 - RNA, 22 nt, Human
uuuuucugccucucucccacau

SEQ ID NO: 101883 - RNA, 22 nt, Human
uuuuuggacccaucuucuuuuu

SEQ ID NO: 101884 - RNA, 22 nt, Human
uuuucuuggaguggcuguccuu

SEQ ID NO: 101885 - RNA, 22 nt, Human
uucugugacgcaaagcugggaa

SEQ ID NO: 101886 - RNA, 22 nt, Human
uucugugacuccucagagauuu

SEQ ID NO: 101887 - RNA, 22 nt, Human
uucuguuuaaccuggaaagugu

SEQ ID NO: 101888 - RNA, 22 nt, Human
uuuugcuucuaguauauuuuuu

SEQ ID NO: 101889 - RNA, 22 nt, Human
uucuguuuauaauuugcaguug

SEQ ID NO: 101890 - RNA, 22 nt, Human
uuuugguuugaguauuuuuuuu

SEQ ID NO: 101891 - RNA, 22 nt, Human
uuuucuacaaaucuggacuuuu

SEQ ID NO: 101892 - RNA, 22 nt, Human
uuuucucucacuucacauauuu

SEQ ID NO: 101893 - RNA, 22 nt, Human
uuuucucaguuuuuuucaaaag

SEQ ID NO: 101894 - RNA, 22 nt, Human
uuuucuucggugcuggguugau

SEQ ID NO: 101895 - RNA, 22 nt, Human
uuuucuugagucacuccaguga

SEQ ID NO: 101896 - RNA, 22 nt, Human
uuuuauaauacccuugacuaau

SEQ ID NO: 101897 - RNA, 22 nt, Human
uucuaguuacucuuaaaugcug

SEQ ID NO: 101898 - RNA, 22 nt, Human
uuuuauguuccugaagcuaucu

SEQ ID NO: 101899 - RNA, 22 nt, Human
uuuuccgaccuuaggaaggaac

SEQ ID NO: 101900 - RNA, 23 nt, Human
uuuuccaaaucgacucucuaguu

SEQ ID NO: 101901 - RNA, 22 nt, Human
uuuucauuguuaguuucuccuu

SEQ ID NO: 101902 - RNA, 22 nt, Human
uucucugaagagccagcccuua

SEQ ID NO: 101903 - RNA, 22 nt, Human
uuuuccuuccugucucuuuauu

SEQ ID NO: 101904 - RNA, 18 nt, Human
uucgucauggggaucgua

SEQ ID NO: 101905 - RNA, 22 nt, Human
uuuuaauucaacauuugcuuuu

SEQ ID NO: 101906 - RNA, 22 nt, Human
uucgucauuguuguugguuuuc

SEQ ID NO: 101907 - RNA, 22 nt, Human
uuuuaauccucuugguaucuua

SEQ ID NO: 101908 - RNA, 22 nt, Human
uucuacuagugguugauggccu

SEQ ID NO: 101909 - RNA, 22 nt, Human
uuuuacauuuuauucguuuauu

SEQ ID NO: 101910 - RNA, 22 nt, Human
uuuuacaaugcaaauucuugcu

SEQ ID NO: 101911 - RNA, 23 nt, Human
uuuuacaagagugcauuugucuc

SEQ ID NO: 101912 - RNA, 22 nt, Human
uuuuacuuuucccacuuacagc

SEQ ID NO: 101913 - RNA, 22 nt, Human
uuggugauugggaauggauggg

SEQ ID NO: 101914 - RNA, 22 nt, Human
uugguguaauacaagcaauuug

SEQ ID NO: 101915 - RNA, 22 nt, Human
uugguguuucacuuccuugucg

SEQ ID NO: 101916 - RNA, 22 nt, Human
uugguuccauuuuaccagcucu

SEQ ID NO: 101917 - RNA, 22 nt, Human
uugguuaccuucagaaaugagu

SEQ ID NO: 101918 - RNA, 22 nt, Human
uuggggagaagagcuggucagg

SEQ ID NO: 101919 - RNA, 22 nt, Human
uuggggaaaaagaccuaaugac

SEQ ID NO: 101920 - RNA, 20 nt, Human
uuggggacaggagugugaug

SEQ ID NO: 101921 - RNA, 22 nt, Human
uugguuuuuugguguaucuuau

SEQ ID NO: 101922 - RNA, 19 nt, Human
uugguuuguugcuuaggug

SEQ ID NO: 101923 - RNA, 22 nt, Human
uugguuuuauucguauuuguau

SEQ ID NO: 101924 - RNA, 22 nt, Human
uugguuuacucuggggauaucu

SEQ ID NO: 101925 - RNA, 22 nt, Human
uugugcucaguuguggucuauu

SEQ ID NO: 101926 - RNA, 22 nt, Human
uugugccuuaauauaggcgcug

SEQ ID NO: 101927 - RNA, 22 nt, Human
uugugcauuuuguuuuacuuau

SEQ ID NO: 101928 - RNA, 22 nt, Human
uugugcagugccuggacccagg

SEQ ID NO: 101929 - RNA, 22 nt, Human
uugugcacauuucauugaccug

SEQ ID NO: 101930 - RNA, 22 nt, Human
uugugauuaauaacuuuucucu

SEQ ID NO: 101931 - RNA, 22 nt, Human
uuguauuaauacacuccuuuuc

SEQ ID NO: 101932 - RNA, 22 nt, Human
uugucaggaacuaugauuaugc

SEQ ID NO: 101933 - RNA, 22 nt, Human
uugucagcuagugaugcuguuc

SEQ ID NO: 101934 - RNA, 22 nt, Human
uuggccugcuccagaacaaggg

SEQ ID NO: 101935 - RNA, 22 nt, Human
uuggccuuacgcauggucggca

SEQ ID NO: 101936 - RNA, 22 nt, Human
uuggccguuucacugggcaguu

SEQ ID NO: 101937 - RNA, 22 nt, Human
uuggccuaggcacaggcaggug

SEQ ID NO: 101938 - RNA, 21 nt, Human
uuggcuacugcuucagaggga

SEQ ID NO: 101939 - RNA, 22 nt, Human
uugggauucugucagugugugu

SEQ ID NO: 101940 - RNA, 20 nt, Human
uugggaagccuacaccauuc

SEQ ID NO: 101941 - RNA, 22 nt, Human
uugggacuguugucuaaaccau

SEQ ID NO: 101942 - RNA, 22 nt, Human
uuggcuucuugcuaggaagcug

SEQ ID NO: 101943 - RNA, 21 nt, Human
uugauuuagcagaucuagcug

SEQ ID NO: 101944 - RNA, 20 nt, Human
uugauucacaaaaagcuuag

SEQ ID NO: 101945 - RNA, 22 nt, Human
uugauuccagcguuccaucagc

SEQ ID NO: 101946 - RNA, 22 nt, Human
uuggauguggggauggaguggg

SEQ ID NO: 101947 - RNA, 22 nt, Human
uuggaggcagagucuugcugag

SEQ ID NO: 101948 - RNA, 19 nt, Human
uuggagcaucccaaaggcu

SEQ ID NO: 101949 - RNA, 22 nt, Human
uuuagcaguuuauuuaaggggg

SEQ ID NO: 101950 - RNA, 22 nt, Human
uuuacuaauuaguuuuggaaca

SEQ ID NO: 101951 - RNA, 18 nt, Human
uuuacgaacucacuugag

SEQ ID NO: 101952 - RNA, 22 nt, Human
uuuaguauaguaugugcucaaa

SEQ ID NO: 101953 - RNA, 22 nt, Human
uuuagguuguguucuggcaugu

SEQ ID NO: 101954 - RNA, 22 nt, Human
uuuaggugucugcucauugaag

SEQ ID NO: 101955 - RNA, 22 nt, Human
uuuaggucacuccaccgaagag

SEQ ID NO: 101956 - RNA, 22 nt, Human
uuuagcugugugugucgcucca

SEQ ID NO: 101957 - RNA, 22 nt, Human
uuguguugaagugguuagggcg

SEQ ID NO: 101958 - RNA, 22 nt, Human
uuguggcaggauggacagcaga

SEQ ID NO: 101959 - RNA, 22 nt, Human
uuguuauuauuauuuucguucu

SEQ ID NO: 101960 - RNA, 23 nt, Human
uugugguuauauuugcccauuuu

SEQ ID NO: 101961 - RNA, 22 nt, Human
uuguuccuaguuguccaucaca

SEQ ID NO: 101962 - RNA, 22 nt, Human
uuguuccuuucuucuguagucg

SEQ ID NO: 101963 - RNA, 22 nt, Human
uuguuguuguuguuauuuaguu

SEQ ID NO: 101964 - RNA, 22 nt, Human
uuguugcuguugaacccugcug

SEQ ID NO: 101965 - RNA, 22 nt, Human
uuuauucacuuaucaggaacga

SEQ ID NO: 101966 - RNA, 22 nt, Human
uuuaucucugcauagaagugau

SEQ ID NO: 101967 - RNA, 22 nt, Human
uuuaucaucuucugaauuugga

SEQ ID NO: 101968 - RNA, 22 nt, Human
uuuauccacucauccaugccuc

SEQ ID NO: 101969 - RNA, 22 nt, Human
uuuaucaggccaucuuaugucu

SEQ ID NO: 101970 - RNA, 22 nt, Human
uuuauaauuacguaaaauauuu

SEQ ID NO: 101971 - RNA, 22 nt, Human
uuuauaauuguuauguuaccca

SEQ ID NO: 101972 - RNA, 22 nt, Human
uuuauaaacacaagaugggcuc

SEQ ID NO: 101973 - RNA, 22 nt, Human
uuuauaagccagacacugcguu

SEQ ID NO: 101974 - RNA, 22 nt, Human
uuuagugagugugaaucaaaug

SEQ ID NO: 101975 - RNA, 19 nt, Human
uuuauuugagacaugccuu

SEQ ID NO: 101976 - RNA, 22 nt, Human
uuuauuuagguaaacaugaguu

SEQ ID NO: 101977 - RNA, 22 nt, Human
uuuauuugggauuucucaucug

SEQ ID NO: 101978 - RNA, 22 nt, Human
uuuauucuuugcuagguuccau

SEQ ID NO: 101979 - RNA, 22 nt, Human
uuuauugaccugaguaucagca

SEQ ID NO: 101980 - RNA, 22 nt, Human
uuuauuuacuuucgguucugcu

SEQ ID NO: 101981 - RNA, 22 nt, Human
uuuauugcuaugucuugauugu

SEQ ID NO: 101982 - RNA, 22 nt, Human
uuucacuucgaucagaguuuuu

SEQ ID NO: 101983 - RNA, 22 nt, Human
uuucacugaguaggagagcacu

SEQ ID NO: 101984 - RNA, 22 nt, Human
uuugggguuuuuuggugaaauc

SEQ ID NO: 101985 - RNA, 22 nt, Human
uuugggcauuuuuaaggaucuu

SEQ ID NO: 101986 - RNA, 22 nt, Human
uuuggcuccccaggaucugaaa

SEQ ID NO: 101987 - RNA, 22 nt, Human
uuuggcugucauuugaaaaugu

SEQ ID NO: 101988 - RNA, 18 nt, Human
uuugggauccucuuuucu

SEQ ID NO: 101989 - RNA, 22 nt, Human
uuuggcgucucucaggagcuca

SEQ ID NO: 101990 - RNA, 22 nt, Human
uuuggcaccuccaaggacucgc

SEQ ID NO: 101991 - RNA, 22 nt, Human
uuugcuuugacuuugggaguau

SEQ ID NO: 101992 - RNA, 22 nt, Human
uuuggaugcugucauaugcugc

SEQ ID NO: 101993 - RNA, 22 nt, Human
uuugucaggaauugaaaaguuu

SEQ ID NO: 101994 - RNA, 20 nt, Human
uuugucaacugcauccagca

SEQ ID NO: 101995 - RNA, 22 nt, Human
uuuguauuguuuauuucauuuu

SEQ ID NO: 101996 - RNA, 22 nt, Human
uuuguauuucaaggcacucuca

SEQ ID NO: 101997 - RNA, 22 nt, Human
uuugucauuuagcccauggugg

SEQ ID NO: 101998 - RNA, 23 nt, Human
uuugucaucccucucacuuucug

SEQ ID NO: 101999 - RNA, 22 nt, Human
uuugucaucuuccauauuugca

SEQ ID NO: 102000 - RNA, 20 nt, Human
uuugguuggcuaggggaagc

SEQ ID NO: 102001 - RNA, 22 nt, Human
uuuggucuggaaucuucagggu

SEQ ID NO: 102002 - RNA, 22 nt, Human
uuuggguuaguuuuccaaucuu

SEQ ID NO: 102003 - RNA, 22 nt, Human
uuuggguauuaguuuagcuaga

SEQ ID NO: 102004 - RNA, 22 nt, Human
uuuggguuuuuccuuagggacu

SEQ ID NO: 102005 - RNA, 22 nt, Human
uuugcaaaguccauugaaguua

SEQ ID NO: 102006 - RNA, 22 nt, Human
uuugauuaccuggggcccucug

SEQ ID NO: 102007 - RNA, 22 nt, Human
uuugauuuuguuuauagugccg

SEQ ID NO: 102008 - RNA, 22 nt, Human
uuugauuuuuugagcaguguau

SEQ ID NO: 102009 - RNA, 22 nt, Human
uuugcugaaaaaccacuugagu

SEQ ID NO: 102010 - RNA, 22 nt, Human
uuugccccacaggcagcuuugg

SEQ ID NO: 102011 - RNA, 22 nt, Human
uuugcuccucuucauuuguauc

SEQ ID NO: 102012 - RNA, 22 nt, Human
uuugcuguaaugcaugucagag

SEQ ID NO: 102013 - RNA, 22 nt, Human
uuugcugggaagccuucacucu

SEQ ID NO: 102014 - RNA, 23 nt, Human
uuugccuaaugaagacuauguca

SEQ ID NO: 102015 - RNA, 22 nt, Human
uuugccaucagaugugguaggu

SEQ ID NO: 102016 - RNA, 22 nt, Human
uuugaauauuaugucccacuuu

SEQ ID NO: 102017 - RNA, 22 nt, Human
uuugagaaugucaaucacaaga

SEQ ID NO: 102018 - RNA, 22 nt, Human
uuugagugcccauguuucccag

SEQ ID NO: 102019 - RNA, 17 nt, Human
uuucugcaugauuggac

SEQ ID NO: 102020 - RNA, 23 nt, Human
uuucugaguuuuuuaaaagucca

SEQ ID NO: 102021 - RNA, 22 nt, Human
uuucugcuuucuaguugguguu

SEQ ID NO: 102022 - RNA, 22 nt, Human
uuucuggauaagcagggucucu

SEQ ID NO: 102023 - RNA, 22 nt, Human
uuucucuuucaaucugcaguac

SEQ ID NO: 102024 - RNA, 22 nt, Human
uuucugagccacauauaauuug

SEQ ID NO: 102025 - RNA, 22 nt, Human
uuucucuuguauuugaaucacu

SEQ ID NO: 102026 - RNA, 22 nt, Human
uuucucuccucgaaauucuuau

SEQ ID NO: 102027 - RNA, 19 nt, Human
uuucucacugagucguuug

SEQ ID NO: 102028 - RNA, 22 nt, Human
uuucucagcauauugccuuuga

SEQ ID NO: 102029 - RNA, 22 nt, Human
uuucucagccuccuugcuggag

SEQ ID NO: 102030 - RNA, 22 nt, Human
uuucuccauuuuguguguucug

SEQ ID NO: 102031 - RNA, 22 nt, Human
uuucuguuuguaacuccagcaa

SEQ ID NO: 102032 - RNA, 22 nt, Human
uuucuuccaucuggcuuuauuu

SEQ ID NO: 102033 - RNA, 22 nt, Human
uuucugguuuuauucugggguu

SEQ ID NO: 102034 - RNA, 22 nt, Human
uuugaaaggagcuuuauccaga

SEQ ID NO: 102035 - RNA, 22 nt, Human
uuucuuuuucuacaccuuagcu

SEQ ID NO: 102036 - RNA, 22 nt, Human
uuucuuugggcccuggcagucu

SEQ ID NO: 102037 - RNA, 22 nt, Human
uuucuugugauuuugaugaacu

SEQ ID NO: 102038 - RNA, 22 nt, Human
uuucaucccugucagugaaggc

SEQ ID NO: 102039 - RNA, 22 nt, Human
uuucaugauuaacuuagugaau

SEQ ID NO: 102040 - RNA, 22 nt, Human
uuucagcaugacuguuaucuuu

SEQ ID NO: 102041 - RNA, 22 nt, Human
uuucagguggaaguuuuagaug

SEQ ID NO: 102042 - RNA, 22 nt, Human
uuucacagcgucuuucucuugc

SEQ ID NO: 102043 - RNA, 22 nt, Human
uuucagacugcccauguuugcc

SEQ ID NO: 102044 - RNA, 22 nt, Human
uuucccuugcgcuugcucuccg

SEQ ID NO: 102045 - RNA, 22 nt, Human
uuuccaguuguucuagaaagcu

SEQ ID NO: 102046 - RNA, 22 nt, Human
uuucauggaggccaggacagag

SEQ ID NO: 102047 - RNA, 21 nt, Human
uuucauuaguacaucaauuug

SEQ ID NO: 102048 - RNA, 22 nt, Human
uuucuauauucaguuucauaaa

SEQ ID NO: 102049 - RNA, 22 nt, Human
uuucuaacacccuccuuccaga

SEQ ID NO: 102050 - RNA, 22 nt, Human
uuucuaaaaccagaguuuauaa

SEQ ID NO: 102051 - RNA, 22 nt, Human
uuucgcuuguucggagugcuuu

SEQ ID NO: 102052 - RNA, 22 nt, Human
uuuccuuacuuauaaaaugggg

SEQ ID NO: 102053 - RNA, 22 nt, Human
uuuccuuuguuuugguauaugu

SEQ ID NO: 102054 - RNA, 22 nt, Human
uuuccuguccugguacuuggca

SEQ ID NO: 102055 - RNA, 22 nt, Human
uuuccugcagacaguuuaagca

SEQ ID NO: 102056 - RNA, 22 nt, Human
uuguuauaggaucagugucacu

SEQ ID NO: 102057 - RNA, 22 nt, Human
agcaauucugaaauuacuugac

SEQ ID NO: 102058 - RNA, 22 nt, Human
uagcauuuagaacaccuugaga

SEQ ID NO: 102059 - RNA, 20 nt, Human
cucuuucugcuuuaugccuc

SEQ ID NO: 102060 - RNA, 22 nt, Human
uccuuguuggaauauccuuacc

SEQ ID NO: 102061 - RNA, 22 nt, Human
ccagcaggagacuagcaacaua

SEQ ID NO: 102062 - RNA, 20 nt, Human
acuagaaagucacugggggg

SEQ ID NO: 102063 - RNA, 22 nt, Human
gcuuccuuagcuuaccaaguau

SEQ ID NO: 102064 - RNA, 23 nt, Human
uuuuccaaaucgacucucuaguu

SEQ ID NO: 102065 - RNA, 22 nt, Human
gcagaggcugccgugggcagga

SEQ ID NO: 102066 - RNA, 22 nt, Human
cuucucuuggguguggugucuu

SEQ ID NO: 102067 - RNA, 22 nt, Human
caugcuucccacauuccgauuu

SEQ ID NO: 102068 - RNA, 22 nt, Human
uuaagagaagaguaucuagaac

SEQ ID NO: 102069 - RNA, 22 nt, Human
uuuccuuuguuuugguauaugu

SEQ ID NO: 102070 - RNA, 22 nt, Human
uugucuuucguauggaacacua

SEQ ID NO: 102071 - RNA, 19 nt, Human
ucaggaggucgaccuggca

SEQ ID NO: 102072 - RNA, 22 nt, Human
cuccuuccuccgcccuuccucg

SEQ ID NO: 102073 - RNA, 22 nt, Human
gagugaucuguaggcagcaugg

SEQ ID NO: 102074 - RNA, 22 nt, Human
uccacagggaugccugcggcuu

SEQ ID NO: 102075 - RNA, 22 nt, Human
uuauuuuguagcucugaucuuu

SEQ ID NO: 102076 - RNA, 20 nt, Human
ccuuguggaugucuuuuuug

SEQ ID NO: 102077 - RNA, 22 nt, Human
agauuuucuuuuccaucuuugu

SEQ ID NO: 102078 - RNA, 22 nt, Human
gcacccagggcaggaagugagg

SEQ ID NO: 102079 - RNA, 22 nt, Human
gcuguggacacagcucucuuca

SEQ ID NO: 102080 - RNA, 22 nt, Human
aagugaggagaccucuucuuca

SEQ ID NO: 102081 - RNA, 22 nt, Human
uucuuaaugcauccuguguuca

SEQ ID NO: 102082 - RNA, 22 nt, Human
uuaucuuuuaaaaacacuugug

SEQ ID NO: 102083 - RNA, 22 nt, Human
uuccacaugaucauuguaauaa

SEQ ID NO: 102084 - RNA, 22 nt, Human
aucccacaccccuacaacauau

SEQ ID NO: 102085 - RNA, 22 nt, Human
uucuggggccgugacgaggggc

SEQ ID NO: 102086 - RNA, 22 nt, Human
ccauuucacaucccugacaugu

SEQ ID NO: 102087 - RNA, 22 nt, Human
cacuguugagcaauguacagug

SEQ ID NO: 102088 - RNA, 22 nt, Human
aaaguaaagccuauuuaauaau

SEQ ID NO: 102089 - RNA, 22 nt, Human
ggcuccaggguaccccuggaug

SEQ ID NO: 102090 - RNA, 22 nt, Human
acucacuguuuugaaauugaac

SEQ ID NO: 102091 - RNA, 22 nt, Human
aaggcuuguugucacgcucuug

SEQ ID NO: 102092 - RNA, 22 nt, Human
uucaugucuuugauucugauaa

SEQ ID NO: 102093 - RNA, 22 nt, Human
ggcucccccauggcugacagac

SEQ ID NO: 102094 - RNA, 22 nt, Human
cauuuugguaauguucguuugc

SEQ ID NO: 102095 - RNA, 22 nt, Human
gggggagcuacaggucccuugg

SEQ ID NO: 102096 - RNA, 22 nt, Human
guuuuguagucuggagacuguc

SEQ ID NO: 102097 - RNA, 22 nt, Human
uccauguauugcuaacaaauag

SEQ ID NO: 102098 - RNA, 22 nt, Human
gcugcuacagagcuggaggggg

SEQ ID NO: 102099 - RNA, 22 nt, Human
gcuggccugcgagggcaggcug

SEQ ID NO: 102100 - RNA, 22 nt, Human
uagagaaauuacagcuuucuuu

SEQ ID NO: 102101 - RNA, 22 nt, Human
agcaaaauuccaaaaugcuaau

SEQ ID NO: 102102 - RNA, 22 nt, Human
uuuugcuucuaguauauuuuuu

SEQ ID NO: 102103 - RNA, 22 nt, Human
auuuuguugaaacccuuguugu

SEQ ID NO: 102104 - RNA, 22 nt, Human
augugagcuggaugaauuuaua

SEQ ID NO: 102105 - RNA, 22 nt, Human
guuuauucuuuuauuugugaga

SEQ ID NO: 102106 - RNA, 22 nt, Human
aggucagacagggugucuuucu

SEQ ID NO: 102107 - RNA, 22 nt, Human
aauauuuaaauagaauuacauc

SEQ ID NO: 102108 - RNA, 22 nt, Human
cuucucuuccuucucauccuca

SEQ ID NO: 102109 - RNA, 22 nt, Human
guucaaucucucaugcauuuuc

SEQ ID NO: 102110 - RNA, 22 nt, Human
ggcuccagauguccccuggcaa

SEQ ID NO: 102111 - RNA, 22 nt, Human
ucgcccagguuggagugcagug

SEQ ID NO: 102112 - RNA, 22 nt, Human
cugagcugcucccgcugcagcg

SEQ ID NO: 102113 - RNA, 22 nt, Human
ugcuuucaaugaauuguauacu

SEQ ID NO: 102114 - RNA, 22 nt, Human
auuucacucuuaauugcuuccu

SEQ ID NO: 102115 - RNA, 22 nt, Human
ccagggcuggaggaggucagga

SEQ ID NO: 102116 - RNA, 17 nt, Human
auucuuauacucuguga

SEQ ID NO: 102117 - RNA, 22 nt, Human
ucaggcaggaucccagggaagg

SEQ ID NO: 102118 - RNA, 22 nt, Human
uccaaggacucuugucagcugu

SEQ ID NO: 102119 - RNA, 22 nt, Human
uugguuuacucuggggauaucu

SEQ ID NO: 102120 - RNA, 21 nt, Human
aaguuuuggcuguacaguugu

SEQ ID NO: 102121 - RNA, 22 nt, Human
ucucugaggaagcgaucuuuag

SEQ ID NO: 102122 - RNA, 20 nt, Human
uucucugcagcaggcggccc

SEQ ID NO: 102123 - RNA, 22 nt, Human
ucuucaucucuaaaaugggaac

SEQ ID NO: 102124 - RNA, 22 nt, Human
guuauuguuauugcguugucga

SEQ ID NO: 102125 - RNA, 22 nt, Human
agugucugcgggcagaggagcg

SEQ ID NO: 102126 - RNA, 22 nt, Human
uggucucaaagcaaggaaggaa

SEQ ID NO: 102127 - RNA, 22 nt, Human
uuuuaaaguaauugaagcuugu

SEQ ID NO: 102128 - RNA, 17 nt, Human
uuuguuucauacuucau

SEQ ID NO: 102129 - RNA, 22 nt, Human
cauggcaggugcagauucugug

SEQ ID NO: 102130 - RNA, 22 nt, Human
ucauuguuucugcuuuucauga

SEQ ID NO: 102131 - RNA, 22 nt, Human
ggcucccgugggaugguggagc

SEQ ID NO: 102132 - RNA, 22 nt, Human
auauuuuacagcucucguugaa

SEQ ID NO: 102133 - RNA, 22 nt, Human
ggaauuauuuuaaauagacauu

SEQ ID NO: 102134 - RNA, 22 nt, Human
gcuguggaaaaugggucuccaa

SEQ ID NO: 102135 - RNA, 22 nt, Human
gagaacagauaugaugacuuca

SEQ ID NO: 102136 - RNA, 22 nt, Human
caaggaaaacagaugaucaaca

SEQ ID NO: 102137 - RNA, 22 nt, Human
uuggggagaagagcuggucagg

SEQ ID NO: 102138 - RNA, 22 nt, Human
uaaguuguagaacguuuucuua

SEQ ID NO: 102139 - RNA, 22 nt, Human
ugccuuuggcuguucugugacc

SEQ ID NO: 102140 - RNA, 21 nt, Human
caguucuaagugucaucuuuu

SEQ ID NO: 102141 - RNA, 22 nt, Human
cauuucaaacaguuacagcugc

SEQ ID NO: 102142 - RNA, 22 nt, Human
agggcccaccuuggugcugagg

SEQ ID NO: 102143 - RNA, 22 nt, Human
uagguuuugugucagaguagaa

SEQ ID NO: 102144 - RNA, 22 nt, Human
caggggaagccagcugccaugu

SEQ ID NO: 102145 - RNA, 22 nt, Human
ugucuuugaccuuaagaaguuu

SEQ ID NO: 102146 - RNA, 22 nt, Human
guggguauauauaugugugcug

SEQ ID NO: 102147 - RNA, 22 nt, Human
uuuacaaggcaguuauuuuccu

SEQ ID NO: 102148 - RNA, 22 nt, Human
uuggaggcagagucuugcugag

SEQ ID NO: 102149 - RNA, 22 nt, Human
cguuuugaguagauagccauau

SEQ ID NO: 102150 - RNA, 22 nt, Human
gcagguuguuuaaauuaggauu

SEQ ID NO: 102151 - RNA, 22 nt, Human
guuuguuugccagcuuaguaaa

SEQ ID NO: 102152 - RNA, 22 nt, Human
gggcugcuccgcccgcugcgcc

SEQ ID NO: 102153 - RNA, 22 nt, Human
uggggggacagauggagaggac

SEQ ID NO: 102154 - RNA, 22 nt, Human
agugugaguuacaaagugugaa

SEQ ID NO: 102155 - RNA, 22 nt, Human
gaugcauccuuucugucuucuc

SEQ ID NO: 102156 - RNA, 21 nt, Human
ugcuuucugugcuuuuucugc

SEQ ID NO: 102157 - RNA, 22 nt, Human
aauguaaauaauuguaaaauuu

SEQ ID NO: 102158 - RNA, 22 nt, Human
agcaggagagacuggcccaaaa

SEQ ID NO: 102159 - RNA, 22 nt, Human
aagcugccugggaggaagggcu

SEQ ID NO: 102160 - RNA, 20 nt, Human
cuguucucuugccacaugag

SEQ ID NO: 102161 - RNA, 22 nt, Human
cugggagaggaaccucgagggu

SEQ ID NO: 102162 - RNA, 22 nt, Human
uuuguuugcugagugaauucaa

SEQ ID NO: 102163 - RNA, 20 nt, Human
ugccagagagcucauacccu

SEQ ID NO: 102164 - RNA, 22 nt, Human
uuuucauagccagaaacugaaa

SEQ ID NO: 102165 - RNA, 20 nt, Human
aaaaauguguuuauggagau

SEQ ID NO: 102166 - RNA, 22 nt, Human
ucauggucucccagcccccucu

SEQ ID NO: 102167 - RNA, 22 nt, Human
auuaaauagcagaagaaagaug

SEQ ID NO: 102168 - RNA, 22 nt, Human
uucucaauggcaacuuguugcu

SEQ ID NO: 102169 - RNA, 22 nt, Human
uuggaggucucugugguggugg

SEQ ID NO: 102170 - RNA, 18 nt, Human
aguaaauguuaaauauug

SEQ ID NO: 102171 - RNA, 22 nt, Human
uguuuuuauucuuaauguuuca

SEQ ID NO: 102172 - RNA, 19 nt, Human
acacaccagugccugugac

SEQ ID NO: 102173 - RNA, 22 nt, Human
guguucuuuguagaggaucuug

SEQ ID NO: 102174 - RNA, 22 nt, Human
uguuuagcucugacuaugugau

SEQ ID NO: 102175 - RNA, 22 nt, Human
aacauuuccggccuuuuguucu

SEQ ID NO: 102176 - RNA, 22 nt, Human
ucuugugguggaucccucauuu

SEQ ID NO: 102177 - RNA, 22 nt, Human
ugccuucugccaaggacggugc

SEQ ID NO: 102178 - RNA, 22 nt, Human
uauaagaaaagucauuaucaaa

SEQ ID NO: 102179 - RNA, 22 nt, Human
auaguaaauguuaacagcaaca

SEQ ID NO: 102180 - RNA, 21 nt, Human
gggagugaguaaugauggggg

SEQ ID NO: 102181 - RNA, 22 nt, Human
agaugaugugugucuucagcua

SEQ ID NO: 102182 - RNA, 22 nt, Human
uaguauuuguaauuaucaaagc

SEQ ID NO: 102183 - RNA, 22 nt, Human
uuggaggccacagucaucuuua

SEQ ID NO: 102184 - RNA, 22 nt, Human
ugagggaguguggauacaguag

SEQ ID NO: 102185 - RNA, 22 nt, Human
gugcccaguugaggccaggacu

SEQ ID NO: 102186 - RNA, 22 nt, Human
auuugcuuguucaccaguacuu

SEQ ID NO: 102187 - RNA, 22 nt, Human
cugcagagaccuaggucagguu

SEQ ID NO: 102188 - RNA, 22 nt, Human
auuuuuauuugccuaugauaua

SEQ ID NO: 102189 - RNA, 22 nt, Human
uuaaacauuuccacuugccagu

SEQ ID NO: 102190 - RNA, 18 nt, Human
acaaaaauagugcuuugg

SEQ ID NO: 102191 - RNA, 22 nt, Human
uucacugugauguuuaagagaa

SEQ ID NO: 102192 - RNA, 21 nt, Human
gaaaaucuaaugugacaaugc

SEQ ID NO: 102193 - RNA, 22 nt, Human
agggggaauccugcuuauggau

SEQ ID NO: 102194 - RNA, 22 nt, Human
ggggcaucguugauugcauggu

SEQ ID NO: 102195 - RNA, 22 nt, Human
uugucaggaacuaugauuaugc

SEQ ID NO: 102196 - RNA, 22 nt, Human
gcuuuggcuucuccuggcagga

SEQ ID NO: 102197 - RNA, 22 nt, Human
augcugugccuggaaagcggcu

SEQ ID NO: 102198 - RNA, 22 nt, Human
uguuuucuuuccccuucuuuuc

SEQ ID NO: 102199 - RNA, 22 nt, Human
uggaaaauuuagaaagauuuau

SEQ ID NO: 102200 - RNA, 22 nt, Human
ggaggccagagaagagccaggc

SEQ ID NO: 102201 - RNA, 22 nt, Human
aucuucuuucaucagccccuca

SEQ ID NO: 102202 - RNA, 22 nt, Human
ugagacagaccuuggaccaugu

SEQ ID NO: 102203 - RNA, 22 nt, Human
uuuuccuugagucggggcacag

SEQ ID NO: 102204 - RNA, 22 nt, Human
cuguggcuaggaagcuguggga

SEQ ID NO: 102205 - RNA, 22 nt, Human
agcugacagugcauggagggac

SEQ ID NO: 102206 - RNA, 22 nt, Human
uugauagauuuuagaggcaggc

SEQ ID NO: 102207 - RNA, 22 nt, Human
agauggggccugaggacacugu

SEQ ID NO: 102208 - RNA, 22 nt, Human
aaaauauaaaggauguggguuu

SEQ ID NO: 102209 - RNA, 22 nt, Human
uggggcugguaccguaauauau

SEQ ID NO: 102210 - RNA, 20 nt, Human
uacaauauucccacuuugcu

SEQ ID NO: 102211 - RNA, 22 nt, Human
uguuccucuuagucuuaugugu

SEQ ID NO: 102212 - RNA, 22 nt, Human
aauucuguugguuagaguugga

SEQ ID NO: 102213 - RNA, 22 nt, Human
uggcccaucagggcaccugaga

SEQ ID NO: 102214 - RNA, 22 nt, Human
uuuugccuauuguaucaucgua

SEQ ID NO: 102215 - RNA, 22 nt, Human
gucugcagcacugugcacgguc

SEQ ID NO: 102216 - RNA, 22 nt, Human
ucagccuugguuuugguguugg

SEQ ID NO: 102217 - RNA, 22 nt, Human
uggaguuuuaaucuguacagaa

SEQ ID NO: 102218 - RNA, 22 nt, Human
cagggacugcaggaggacaggu

SEQ ID NO: 102219 - RNA, 22 nt, Human
ucacuucuaugaucugucucuu

SEQ ID NO: 102220 - RNA, 22 nt, Human
gguugccuguggcucccuguua

SEQ ID NO: 102221 - RNA, 22 nt, Human
gaguggccugccccagccaggc

SEQ ID NO: 102222 - RNA, 21 nt, Human
cuauaaaaaugguucuuugcg

SEQ ID NO: 102223 - RNA, 22 nt, Human
acauuccugaagguaaugagaa

SEQ ID NO: 102224 - RNA, 22 nt, Human
gaggcaggcggggcccaggugg

SEQ ID NO: 102225 - RNA, 22 nt, Human
ccccccaaauguuacagugacc

SEQ ID NO: 102226 - RNA, 22 nt, Human
auggaggugagccccccauccu

SEQ ID NO: 102227 - RNA, 20 nt, Human
uuccuuucuuucuuuuuuuu

SEQ ID NO: 102228 - RNA, 22 nt, Human
gaggggaacaggcauucuuaag

SEQ ID NO: 102229 - RNA, 22 nt, Human
cggugcuuuccauaucagcagc

SEQ ID NO: 102230 - RNA, 22 nt, Human
auucuguaggcuuuuguuaaaa

SEQ ID NO: 102231 - RNA, 22 nt, Human
uuagaaauguccuacuaauaug

SEQ ID NO: 102232 - RNA, 22 nt, Human
aaaaacuuaccccagggcaagg

SEQ ID NO: 102233 - RNA, 22 nt, Human
uuuaaucaguugguaauauuga

SEQ ID NO: 102234 - RNA, 22 nt, Human
agugccaucuuuaacuguccca

SEQ ID NO: 102235 - RNA, 22 nt, Human
uuauaucagaaggugagauuga

SEQ ID NO: 102236 - RNA, 22 nt, Human
cugcccauggcuccuggcugug

SEQ ID NO: 102237 - RNA, 23 nt, Human
aaguggugacugugcuacugaga

SEQ ID NO: 102238 - RNA, 22 nt, Human
cucuucauguuggugcagaagc

SEQ ID NO: 102239 - RNA, 22 nt, Human
aauuaaauguuugguuugagcu

SEQ ID NO: 102240 - RNA, 22 nt, Human
ugggaagaguuagagacagcug

SEQ ID NO: 102241 - RNA, 22 nt, Human
caauccccaggucccagaacag

SEQ ID NO: 102242 - RNA, 22 nt, Human
caaggaguuuggggaccaagga

SEQ ID NO: 102243 - RNA, 22 nt, Human
aggcaggggagcuggaagggua

SEQ ID NO: 102244 - RNA, 22 nt, Human
uuauuuuuaggaauguagaggu

SEQ ID NO: 102245 - RNA, 22 nt, Human
gccagggcucgagcaggccagc

SEQ ID NO: 102246 - RNA, 22 nt, Human
ugaaugcuacccugcuggcucu

SEQ ID NO: 102247 - RNA, 22 nt, Human
gccuccuuccgaccucaguccu

SEQ ID NO: 102248 - RNA, 22 nt, Human
uuccuuuuuaauuaaucuaauu

SEQ ID NO: 102249 - RNA, 22 nt, Human
cagcuuguucugaccugugauu

SEQ ID NO: 102250 - RNA, 19 nt, Human
agcucaggcccaucguccc

SEQ ID NO: 102251 - RNA, 22 nt, Human
uuggugauguagcagcaauugu

SEQ ID NO: 102252 - RNA, 22 nt, Human
cuuucuuuuugguuucccccca

SEQ ID NO: 102253 - RNA, 22 nt, Human
cugcugugcagacagacucucu

SEQ ID NO: 102254 - RNA, 22 nt, Human
cugguuuauuucauaguuuguu

SEQ ID NO: 102255 - RNA, 22 nt, Human
uguuuucuauuaccugagauug

SEQ ID NO: 102256 - RNA, 22 nt, Human
gccccaggggaggugcccugca

SEQ ID NO: 102257 - RNA, 22 nt, Human
ugaguucugacugagcaugggg

SEQ ID NO: 102258 - RNA, 22 nt, Human
auuguuuugugaaacauaguga

SEQ ID NO: 102259 - RNA, 22 nt, Human
auguuccaugacuaugcaugaa

SEQ ID NO: 102260 - RNA, 22 nt, Human
gaggugauuccucccauguaau

SEQ ID NO: 102261 - RNA, 22 nt, Human
ucuucaaauacagucauauuga

SEQ ID NO: 102262 - RNA, 22 nt, Human
ggggcucauuugcaggggggag

SEQ ID NO: 102263 - RNA, 22 nt, Human
uuauuuucgugugugugugugu

SEQ ID NO: 102264 - RNA, 22 nt, Human
gguuuucacgauccucccuuuu

SEQ ID NO: 102265 - RNA, 22 nt, Human
aucuguuccccuaugcucucua

SEQ ID NO: 102266 - RNA, 22 nt, Human
auacaucuuaacgcgcucuugg

SEQ ID NO: 102267 - RNA, 19 nt, Human
ggaggguguccucaguguc

SEQ ID NO: 102268 - RNA, 22 nt, Human
uuugcaggaaauguacugaaug

SEQ ID NO: 102269 - RNA, 22 nt, Human
gggcaugcagcaauucuguggu

SEQ ID NO: 102270 - RNA, 22 nt, Human
uaauauaacugccaguuaaggu

SEQ ID NO: 102271 - RNA, 22 nt, Human
agucccugauggacuggaugag

SEQ ID NO: 102272 - RNA, 17 nt, Human
ucuuuuacuuucucucc

SEQ ID NO: 102273 - RNA, 17 nt, Human
uuagagcuacauguuga

SEQ ID NO: 102274 - RNA, 22 nt, Human
aaagggagauaaaguaauuuua

SEQ ID NO: 102275 - RNA, 22 nt, Human
gucuuucuuuuacauauuugug

SEQ ID NO: 102276 - RNA, 22 nt, Human
uuuuuaagguuuguuuauauau

SEQ ID NO: 102277 - RNA, 22 nt, Human
uuucacuucgaucagaguuuuu

SEQ ID NO: 102278 - RNA, 22 nt, Human
cuguggcugcgcccugggggag

SEQ ID NO: 102279 - RNA, 22 nt, Human
ggagccucuaaacaguuaucaa

SEQ ID NO: 102280 - RNA, 22 nt, Human
ggugcuucgauagguguccaua

SEQ ID NO: 102281 - RNA, 22 nt, Human
cccuguccugcuaggcccuggu

SEQ ID NO: 102282 - RNA, 21 nt, Human
uaagcuaaacauucaguuaac

SEQ ID NO: 102283 - RNA, 22 nt, Human
ucccuugacauuacuugggagg

SEQ ID NO: 102284 - RNA, 22 nt, Human
auuucauuuuagaaauaagugu

SEQ ID NO: 102285 - RNA, 22 nt, Human
ucaucuuucuuuauggaaauac

SEQ ID NO: 102286 - RNA, 22 nt, Human
accuggcccugggucuccugac

SEQ ID NO: 102287 - RNA, 22 nt, Human
cugcccgcaugcaggaaugcug

SEQ ID NO: 102288 - RNA, 22 nt, Human
gcuucucacccuuacuaucucu

SEQ ID NO: 102289 - RNA, 22 nt, Human
agggcugggcuuggcaggcugg

SEQ ID NO: 102290 - RNA, 22 nt, Human
uacagaccaguaguucucagcg

SEQ ID NO: 102291 - RNA, 22 nt, Human
uccaggagucagacagauggug

SEQ ID NO: 102292 - RNA, 22 nt, Human
gggcaggcuggguggugguccc

SEQ ID NO: 102293 - RNA, 22 nt, Human
ccuccuuuccuguuuuccugag

SEQ ID NO: 102294 - RNA, 22 nt, Human
uucauagaagggaguuuuuccu

SEQ ID NO: 102295 - RNA, 22 nt, Human
guucucuuaauccuaguuggua

SEQ ID NO: 102296 - RNA, 22 nt, Human
gaggagggagcuggaagcucuu

SEQ ID NO: 102297 - RNA, 22 nt, Human
ucuccuuuacuggcuccuuuug

SEQ ID NO: 102298 - RNA, 22 nt, Human
aauaucuugaguuauaaauuca

SEQ ID NO: 102299 - RNA, 22 nt, Human
uuuuccuucugauacuccauuu

SEQ ID NO: 102300 - RNA, 22 nt, Human
cuggagaacucugugcuucacu

SEQ ID NO: 102301 - RNA, 22 nt, Human
uggcucaggccuacgacgccuu

SEQ ID NO: 102302 - RNA, 22 nt, Human
aagcauuuuagauaaagcauca

SEQ ID NO: 102303 - RNA, 22 nt, Human
ggaggcccagaaggaagcccag

SEQ ID NO: 102304 - RNA, 23 nt, Human
ugggagcuauguuuggaaugggg

SEQ ID NO: 102305 - RNA, 22 nt, Human
gcagggcucagccgcucccacc

SEQ ID NO: 102306 - RNA, 22 nt, Human
agagcuccaggguuuuguagug

SEQ ID NO: 102307 - RNA, 22 nt, Human
ccuccugggccuugcucuguga

SEQ ID NO: 102308 - RNA, 22 nt, Human
ugaauucaaacuuuuuaacaag

SEQ ID NO: 102309 - RNA, 22 nt, Human
aaauguauuagccuaugugaga

SEQ ID NO: 102310 - RNA, 22 nt, Human
aaugcuaaagaagaaggaguag

SEQ ID NO: 102311 - RNA, 22 nt, Human
uucacuuuuucucugcuugaga

SEQ ID NO: 102312 - RNA, 22 nt, Human
agaacauaucuguuuucuaacu

SEQ ID NO: 102313 - RNA, 22 nt, Human
uaugaggagaacauuccugaac

SEQ ID NO: 102314 - RNA, 22 nt, Human
ucccagguugaggccuugccug

SEQ ID NO: 102315 - RNA, 22 nt, Human
uguggacaccuauuaccaguga

SEQ ID NO: 102316 - RNA, 20 nt, Human
gacaugagggagcaaagagc

SEQ ID NO: 102317 - RNA, 22 nt, Human
cguggccacaguggagcugagc

SEQ ID NO: 102318 - RNA, 22 nt, Human
uuuaggucacuccaccgaagag

SEQ ID NO: 102319 - RNA, 22 nt, Human
uaaaugaaaggguuuaauuuau

SEQ ID NO: 102320 - RNA, 22 nt, Human
ccuuuccucuucaugacuuucu

SEQ ID NO: 102321 - RNA, 22 nt, Human
ucuugcuguggcagaucuggag

SEQ ID NO: 102322 - RNA, 22 nt, Human
gagggcugccacguugggcgag

SEQ ID NO: 102323 - RNA, 22 nt, Human
cccagagggcugaggauaugaa

SEQ ID NO: 102324 - RNA, 22 nt, Human
ucauuggagcauaugaugguua

SEQ ID NO: 102325 - RNA, 19 nt, Human
aacaaaauaguucuaguua

SEQ ID NO: 102326 - RNA, 22 nt, Human
uaaaaguuagcuaggacaaagu

SEQ ID NO: 102327 - RNA, 22 nt, Human
ggaaguggauucagggcugcua

SEQ ID NO: 102328 - RNA, 22 nt, Human
ccagucuuggugucuguagcac

SEQ ID NO: 102329 - RNA, 17 nt, Human
auuguuuuuaauuugca

SEQ ID NO: 102330 - RNA, 22 nt, Human
gugugugucuacuuucaucucu

SEQ ID NO: 102331 - RNA, 22 nt, Human
aggggaggcugggcuggggggc

SEQ ID NO: 102332 - RNA, 20 nt, Human
acacaccugcucagacugag

SEQ ID NO: 102333 - RNA, 22 nt, Human
ccucuagaauuaucacuuuuaa

SEQ ID NO: 102334 - RNA, 22 nt, Human
caucucagguuuguucugagac

SEQ ID NO: 102335 - RNA, 22 nt, Human
auauauguauauaugugugugu

SEQ ID NO: 102336 - RNA, 22 nt, Human
ucauccugaagaaccugcuucc

SEQ ID NO: 102337 - RNA, 22 nt, Human
augggagggugaggaggcagcu

SEQ ID NO: 102338 - RNA, 22 nt, Human
ccccccaaaacuacuggccugu

SEQ ID NO: 102339 - RNA, 22 nt, Human
aggugagaacguggaggggcgg

SEQ ID NO: 102340 - RNA, 20 nt, Human
cuggaguguagcaguggcug

SEQ ID NO: 102341 - RNA, 22 nt, Human
uguauuuuuucccugaaauaaa

SEQ ID NO: 102342 - RNA, 22 nt, Human
uucuucgacuguauaaaaguau

SEQ ID NO: 102343 - RNA, 22 nt, Human
gcacaaaagguacuucauguag

SEQ ID NO: 102344 - RNA, 22 nt, Human
uucuugugugaauauaauuaca

SEQ ID NO: 102345 - RNA, 22 nt, Human
guuuauuucuuaucaucacuau

SEQ ID NO: 102346 - RNA, 22 nt, Human
agcaagggucucucauggcuug

SEQ ID NO: 102347 - RNA, 22 nt, Human
uaguucugaauagcauugaaga

SEQ ID NO: 102348 - RNA, 22 nt, Human
ucauacuuuuuugacccuugug

SEQ ID NO: 102349 - RNA, 22 nt, Human
cuucucugcugccugccucuuu

SEQ ID NO: 102350 - RNA, 22 nt, Human
aagcugcagacccccugucuca

SEQ ID NO: 102351 - RNA, 22 nt, Human
ccugugucaucagcuguggcua

SEQ ID NO: 102352 - RNA, 22 nt, Human
ucugaggacagugcugugccug

SEQ ID NO: 102353 - RNA, 22 nt, Human
ucaccccagccuuaugacucag

SEQ ID NO: 102354 - RNA, 22 nt, Human
guucuucagcccucagguccua

SEQ ID NO: 102355 - RNA, 22 nt, Human
guaguuuuucuugcaagaguag

SEQ ID NO: 102356 - RNA, 22 nt, Human
ucgagcucagcagggaggugcg

SEQ ID NO: 102357 - RNA, 22 nt, Human
acuuuuccuggguagcuccugg

SEQ ID NO: 102358 - RNA, 22 nt, Human
cagcuguggagauggggugcau

SEQ ID NO: 102359 - RNA, 22 nt, Human
caaagaugccaaaaggaagaca

SEQ ID NO: 102360 - RNA, 20 nt, Human
uucacagaggacucagguca

SEQ ID NO: 102361 - RNA, 22 nt, Human
cagagagcguccauccggugcc

SEQ ID NO: 102362 - RNA, 22 nt, Human
uacauuccagaaaguuucugua

SEQ ID NO: 102363 - RNA, 22 nt, Human
uccagguccuacuggcccauag

SEQ ID NO: 102364 - RNA, 22 nt, Human
cuucagagugacucagcaucuu

SEQ ID NO: 102365 - RNA, 22 nt, Human
ucaccaugcccuucucugcucu

SEQ ID NO: 102366 - RNA, 22 nt, Human
gccaggcagcagcgaggauggu

SEQ ID NO: 102367 - RNA, 19 nt, Human
ucagcagauuuugcaaaca

SEQ ID NO: 102368 - RNA, 22 nt, Human
guuuccaggcuuugguaugguu

SEQ ID NO: 102369 - RNA, 22 nt, Human
agugaaauaugcccauugcugu

SEQ ID NO: 102370 - RNA, 20 nt, Human
agcauucaacuuucuauguu

SEQ ID NO: 102371 - RNA, 22 nt, Human
auguucucagguuguauuuauu

SEQ ID NO: 102372 - RNA, 22 nt, Human
guuauuuugucuuguucaugaa

SEQ ID NO: 102373 - RNA, 22 nt, Human
gcaggaagauugcagaaggcug

SEQ ID NO: 102374 - RNA, 22 nt, Human
agcugaggccccgcagcagggu

SEQ ID NO: 102375 - RNA, 22 nt, Human
uaauaaaaauuuaauucacauu

SEQ ID NO: 102376 - RNA, 22 nt, Human
ugauucacagacuucacaaggc

SEQ ID NO: 102377 - RNA, 22 nt, Human
caugggaauaaaguuauuucaa

SEQ ID NO: 102378 - RNA, 20 nt, Human
uugauucacaaaaagcuuag

SEQ ID NO: 102379 - RNA, 22 nt, Human
ugagagggagacagcucuagca

SEQ ID NO: 102380 - RNA, 22 nt, Human
uuugauuuuguuuauagugccg

SEQ ID NO: 102381 - RNA, 22 nt, Human
auggaguguggccaggcaguaa

SEQ ID NO: 102382 - RNA, 22 nt, Human
aucguuaugauagagaaagaga

SEQ ID NO: 102383 - RNA, 22 nt, Human
auuuucauauggguuauuugua

SEQ ID NO: 102384 - RNA, 22 nt, Human
uuccuuuucuucuaccacaugu

SEQ ID NO: 102385 - RNA, 22 nt, Human
auuuaaaaacugguacaacagg

SEQ ID NO: 102386 - RNA, 22 nt, Human
ugugccuguugguguagacaua

SEQ ID NO: 102387 - RNA, 20 nt, Human
gcagcugacccuagugcuug

SEQ ID NO: 102388 - RNA, 19 nt, Human
agcaucuccacagaaaaag

SEQ ID NO: 102389 - RNA, 22 nt, Human
uucacccuucucuggcuuucag

SEQ ID NO: 102390 - RNA, 22 nt, Human
agggagucuggccgucggcugg

SEQ ID NO: 102391 - RNA, 22 nt, Human
cugggagaugacucagagcagg

SEQ ID NO: 102392 - RNA, 22 nt, Human
acauaaaccccccuuccccagg

SEQ ID NO: 102393 - RNA, 22 nt, Human
ccugccagaaaagagggaguuc

SEQ ID NO: 102394 - RNA, 22 nt, Human
cucugugucugauucugggaag

SEQ ID NO: 102395 - RNA, 22 nt, Human
agcaggaaggcuagaagcagga

SEQ ID NO: 102396 - RNA, 22 nt, Human
ucacucuuuaucuuuuaugucu

SEQ ID NO: 102397 - RNA, 22 nt, Human
acaggcgucgccugcucuugcc

SEQ ID NO: 102398 - RNA, 22 nt, Human
agguuuuugucauuuucuggua

SEQ ID NO: 102399 - RNA, 22 nt, Human
cugggggacagagagaggcggu

SEQ ID NO: 102400 - RNA, 22 nt, Human
uuucuugugauuuugaugaacu

SEQ ID NO: 102401 - RNA, 22 nt, Human
guuguuuuuguuaaaacaguga

SEQ ID NO: 102402 - RNA, 22 nt, Human
augaaaacggaccagagcuauu

SEQ ID NO: 102403 - RNA, 22 nt, Human
gaauucuaguucuguaucucug

SEQ ID NO: 102404 - RNA, 22 nt, Human
aggaaauaggaccagacaaagc

SEQ ID NO: 102405 - RNA, 22 nt, Human
ccaaccaguuucuuggcuuuag

SEQ ID NO: 102406 - RNA, 22 nt, Human
ugugaagaauuaaugugaauca

SEQ ID NO: 102407 - RNA, 19 nt, Human
ucuuugcuuuucuaagagg

SEQ ID NO: 102408 - RNA, 22 nt, Human
ugguugauuaauuuugccaagc

SEQ ID NO: 102409 - RNA, 22 nt, Human
acagcugagaugcuacuugugg

SEQ ID NO: 102410 - RNA, 22 nt, Human
uugaaaauuaauagguguacaa

SEQ ID NO: 102411 - RNA, 16 nt, Human
gaauuccauugcucug

SEQ ID NO: 102412 - RNA, 22 nt, Human
auucuucauguugaagcuguca

SEQ ID NO: 102413 - RNA, 22 nt, Human
agagggagagauuggcaaucag

SEQ ID NO: 102414 - RNA, 18 nt, Human
acuguccucaggacguug

SEQ ID NO: 102415 - RNA, 22 nt, Human
auagagcuggggaagaagcugg

SEQ ID NO: 102416 - RNA, 22 nt, Human
uauuuuuacuguuugaugauuc

SEQ ID NO: 102417 - RNA, 22 nt, Human
uauauauacauauagaauaugu

SEQ ID NO: 102418 - RNA, 22 nt, Human
uuuauaauuacguaaaauauuu

SEQ ID NO: 102419 - RNA, 22 nt, Human
uuccuaauugccaugaaguuau

SEQ ID NO: 102420 - RNA, 21 nt, Human
cuccuguaaaucaccuccgca

SEQ ID NO: 102421 - RNA, 22 nt, Human
augugugugcgagcgugugugu

SEQ ID NO: 102422 - RNA, 22 nt, Human
gagggaggugacaaggacauag

SEQ ID NO: 102423 - RNA, 22 nt, Human
uuuguuuccagccuuuugucuu

SEQ ID NO: 102424 - RNA, 22 nt, Human
ggugaguagaaguaguuggcuu

SEQ ID NO: 102425 - RNA, 19 nt, Human
agcuccucaccucucgcgg

SEQ ID NO: 102426 - RNA, 23 nt, Human
uucuuuccuuaucccauuuacuu

SEQ ID NO: 102427 - RNA, 22 nt, Human
uccaaggacuaaauucuagauu

SEQ ID NO: 102428 - RNA, 22 nt, Human
gggaggcagacgcuggagccca

SEQ ID NO: 102429 - RNA, 22 nt, Human
aaacuuuugaaggaggaaaaag

SEQ ID NO: 102430 - RNA, 20 nt, Human
ugcugugugucuacuguggg

SEQ ID NO: 102431 - RNA, 22 nt, Human
uucuucuuuccuauaauuaauu

SEQ ID NO: 102432 - RNA, 22 nt, Human
uauuucuagggcaugaaaauaa

SEQ ID NO: 102433 - RNA, 22 nt, Human
uauuguuuuaagguguauuaau

SEQ ID NO: 102434 - RNA, 22 nt, Human
uauaaagaccuuauccuucaua

SEQ ID NO: 102435 - RNA, 22 nt, Human
uuuaaaauguuuuauuuauuua

SEQ ID NO: 102436 - RNA, 22 nt, Human
cauaggcucuucagagaacuga

SEQ ID NO: 102437 - RNA, 22 nt, Human
aacaguuaagaggaggcagaga

SEQ ID NO: 102438 - RNA, 22 nt, Human
uucuugucuuuguuauguagga

SEQ ID NO: 102439 - RNA, 22 nt, Human
caugcuaacacguugcucaccg

SEQ ID NO: 102440 - RNA, 22 nt, Human
gaaccauuuaauggagaugcuc

SEQ ID NO: 102441 - RNA, 22 nt, Human
caggaagagaacugcucagccu

SEQ ID NO: 102442 - RNA, 22 nt, Human
auuugccaguuacucacaccac

SEQ ID NO: 102443 - RNA, 22 nt, Human
aaagcugaaacgaaaugacaac

SEQ ID NO: 102444 - RNA, 22 nt, Human
aggcgaagggaccagacgguag

SEQ ID NO: 102445 - RNA, 22 nt, Human
auucuuuucucuaaaugaugaa

SEQ ID NO: 102446 - RNA, 22 nt, Human
uagcuucccagcuaaccauguc

SEQ ID NO: 102447 - RNA, 22 nt, Human
ugucugggauguuggcagccac

SEQ ID NO: 102448 - RNA, 22 nt, Human
aguuauuuuucacuauuaggcu

SEQ ID NO: 102449 - RNA, 16 nt, Human
aaguuuuaucuucuca

SEQ ID NO: 102450 - RNA, 22 nt, Human
agggcaggguuggugcuggugc

SEQ ID NO: 102451 - RNA, 22 nt, Human
aaauauauccuucuguccugcc

SEQ ID NO: 102452 - RNA, 20 nt, Human
uuggggacaggagugugaug

SEQ ID NO: 102453 - RNA, 22 nt, Human
gaggggaaggauuucuucagaa

SEQ ID NO: 102454 - RNA, 22 nt, Human
gcucucuggccugggaggagga

SEQ ID NO: 102455 - RNA, 22 nt, Human
auuuucuugucucuguuguagg

SEQ ID NO: 102456 - RNA, 22 nt, Human
augaggaacagcaagaauauuu

SEQ ID NO: 102457 - RNA, 20 nt, Human
aggcagacaaggagucuguu

SEQ ID NO: 102458 - RNA, 23 nt, Human
ucagaccaaccucuugcuggaac

SEQ ID NO: 102459 - RNA, 22 nt, Human
ucaguggaacacacagaguggg

SEQ ID NO: 102460 - RNA, 22 nt, Human
gcuuauuagguuauuucaagga

SEQ ID NO: 102461 - RNA, 22 nt, Human
uacuuuaauugcaaaaauaaau

SEQ ID NO: 102462 - RNA, 22 nt, Human
uagcacauaguaggcacaggcu

SEQ ID NO: 102463 - RNA, 22 nt, Human
uaguuccucuucucagggccau

SEQ ID NO: 102464 - RNA, 22 nt, Human
aaaauaaccuucauuugcauug

SEQ ID NO: 102465 - RNA, 22 nt, Human
uagcauuuauugggcuagcaaa

SEQ ID NO: 102466 - RNA, 22 nt, Human
uggaagaucugguguagcuccu

SEQ ID NO: 102467 - RNA, 22 nt, Human
uucuuuucuucccuguuuauua

SEQ ID NO: 102468 - RNA, 22 nt, Human
ggagaggaaguuuaaagaauug

SEQ ID NO: 102469 - RNA, 22 nt, Human
agcuuucuauauaugaguugcu

SEQ ID NO: 102470 - RNA, 22 nt, Human
aagcucuuuccacuaaaccacu

SEQ ID NO: 102471 - RNA, 22 nt, Human
agcacagugccugacauauaug

SEQ ID NO: 102472 - RNA, 22 nt, Human
uucuuuuaauuucugucugcag

SEQ ID NO: 102473 - RNA, 21 nt, Human
uccugccuuaguccagagcag

SEQ ID NO: 102474 - RNA, 22 nt, Human
uucccugugcaguauguuccaa

SEQ ID NO: 102475 - RNA, 22 nt, Human
aaaacauuuaggguuuuuuuua

SEQ ID NO: 102476 - RNA, 22 nt, Human
guuuaaaagcaaccaacaggcu

SEQ ID NO: 102477 - RNA, 22 nt, Human
ugcagcuuuugguuucuagaug

SEQ ID NO: 102478 - RNA, 22 nt, Human
uuuuaaaacaugucaaaaugug

SEQ ID NO: 102479 - RNA, 22 nt, Human
uagggaggguuugggguggagg

SEQ ID NO: 102480 - RNA, 22 nt, Human
caccucagagcuccuucuucuc

SEQ ID NO: 102481 - RNA, 22 nt, Human
gcucagagaaaacuggggcuug

SEQ ID NO: 102482 - RNA, 22 nt, Human
gaggggcugggguugacuccaa

SEQ ID NO: 102483 - RNA, 20 nt, Human
ggcagagcuaugucuguugc

SEQ ID NO: 102484 - RNA, 22 nt, Human
uaguuuuaagcugacauuguuc

SEQ ID NO: 102485 - RNA, 22 nt, Human
gugggaguggagcucagcaugu

SEQ ID NO: 102486 - RNA, 22 nt, Human
aggcaguggcuuuuguuguguu

SEQ ID NO: 102487 - RNA, 22 nt, Human
uuuauguuuguuuuugaaauaa

SEQ ID NO: 102488 - RNA, 22 nt, Human
uuuccuaggaaaugauugaagu

SEQ ID NO: 102489 - RNA, 22 nt, Human
ucuggggaugagugaugucgua

SEQ ID NO: 102490 - RNA, 22 nt, Human
ggccugcuaccagcugugaccu

SEQ ID NO: 102491 - RNA, 22 nt, Human
ugggaagccaguaucagacuaa

SEQ ID NO: 102492 - RNA, 22 nt, Human
aggauggaaguaacuggauaau

SEQ ID NO: 102493 - RNA, 22 nt, Human
uugaaaaaaucugaggaggacc

SEQ ID NO: 102494 - RNA, 22 nt, Human
agguggucccaauggcugggca

SEQ ID NO: 102495 - RNA, 22 nt, Human
caguggagaccugccugcugga

SEQ ID NO: 102496 - RNA, 22 nt, Human
aggccagggacaaugaggcaga

SEQ ID NO: 102497 - RNA, 22 nt, Human
acagacuuuuagacuuaugagu

SEQ ID NO: 102498 - RNA, 22 nt, Human
uggccccauuuuucuggagccu

SEQ ID NO: 102499 - RNA, 22 nt, Human
uuuuguuuacauuaaauuuuga

SEQ ID NO: 102500 - RNA, 22 nt, Human
guauauuuaugagcauuagccu

SEQ ID NO: 102501 - RNA, 22 nt, Human
uuucagagaaagcccaaagacu

SEQ ID NO: 102502 - RNA, 20 nt, Human
agagaacaguuuggucacag

SEQ ID NO: 102503 - RNA, 21 nt, Human
uaaaagaugacaagacagcuc

SEQ ID NO: 102504 - RNA, 22 nt, Human
gacuggggcauuagaguagcuu

SEQ ID NO: 102505 - RNA, 20 nt, Human
ucaucuuucaaauuugugac

SEQ ID NO: 102506 - RNA, 22 nt, Human
uacaaaugaucaucucuuugaa

SEQ ID NO: 102507 - RNA, 22 nt, Human
cauuccaagaaguaguucugca

SEQ ID NO: 102508 - RNA, 22 nt, Human
cuaagguuggcaguggaauugg

SEQ ID NO: 102509 - RNA, 22 nt, Human
agagacuguaaugagagguaca

SEQ ID NO: 102510 - RNA, 22 nt, Human
cuucuuuucuacuggccuagaa

SEQ ID NO: 102511 - RNA, 22 nt, Human
aaauuaaaguuuuauuuagagc

SEQ ID NO: 102512 - RNA, 22 nt, Human
uacauguggagauaacugaagc

SEQ ID NO: 102513 - RNA, 22 nt, Human
aauaauuuuuuugugauuaugu

SEQ ID NO: 102514 - RNA, 22 nt, Human
cuccuugguuccggcguuggag

SEQ ID NO: 102515 - RNA, 19 nt, Human
agaacccccuuccucugcu

SEQ ID NO: 102516 - RNA, 22 nt, Human
cagcucugcugggaggaugcag

SEQ ID NO: 102517 - RNA, 22 nt, Human
uaugggcaagagauaggugguc

SEQ ID NO: 102518 - RNA, 22 nt, Human
gugucuuauugauguuggcacu

SEQ ID NO: 102519 - RNA, 22 nt, Human
auuuuuuuggucauaugagaua

SEQ ID NO: 102520 - RNA, 22 nt, Human
aggcuccucugggggccccgga

SEQ ID NO: 102521 - RNA, 22 nt, Human
ggggaggugugcaggacaccuc

SEQ ID NO: 102522 - RNA, 22 nt, Human
uuuacuuuugguaaggucauuu

SEQ ID NO: 102523 - RNA, 21 nt, Human
uggggaugcauugcagaggca

SEQ ID NO: 102524 - RNA, 22 nt, Human
auauguuaugccauuuucaagg

SEQ ID NO: 102525 - RNA, 22 nt, Human
gaauuagguaauagaacuagua

SEQ ID NO: 102526 - RNA, 22 nt, Human
aaggugggacugagaggggaca

SEQ ID NO: 102527 - RNA, 21 nt, Human
gcagcaugagaaagccccaaa

SEQ ID NO: 102528 - RNA, 22 nt, Human
acucugcaguaaggaauuguuu

SEQ ID NO: 102529 - RNA, 23 nt, Human
ccagcugugccuggcccaggagc

SEQ ID NO: 102530 - RNA, 22 nt, Human
cauaaucaagggguugugaugu

SEQ ID NO: 102531 - RNA, 22 nt, Human
cuccagagagaaaggaggccgc

SEQ ID NO: 102532 - RNA, 22 nt, Human
ucacaucugugugauugucauu

SEQ ID NO: 102533 - RNA, 22 nt, Human
gcccugucagcucucauggaca

SEQ ID NO: 102534 - RNA, 23 nt, Human
ucuuuccuuucauacagucagcu

SEQ ID NO: 102535 - RNA, 22 nt, Human
acuuuaaauaucauuugguagg

SEQ ID NO: 102536 - RNA, 22 nt, Human
cccuggcucaggcagcuuuguu

SEQ ID NO: 102537 - RNA, 22 nt, Human
guguugaugugucuguauucua

SEQ ID NO: 102538 - RNA, 22 nt, Human
uccuuccucuuucaaauuuguu

SEQ ID NO: 102539 - RNA, 22 nt, Human
ugcacacaguucucaggaaaga

SEQ ID NO: 102540 - RNA, 18 nt, Human
acuguggcucagaguugc

SEQ ID NO: 102541 - RNA, 20 nt, Human
gccugggagaagaucaggga

SEQ ID NO: 102542 - RNA, 22 nt, Human
acauucucuuuuagaaagcugu

SEQ ID NO: 102543 - RNA, 22 nt, Human
ggcuggagcaggcugcacagug

SEQ ID NO: 102544 - RNA, 22 nt, Human
gggggacagugugccuggugug

SEQ ID NO: 102545 - RNA, 22 nt, Human
aagacagugacagucacaauug

SEQ ID NO: 102546 - RNA, 22 nt, Human
uuaccuuggaccggguaucaga

SEQ ID NO: 102547 - RNA, 22 nt, Human
guugagaaucucuagcuuagga

SEQ ID NO: 102548 - RNA, 22 nt, Human
aaucacuucuuugucuucuuca

SEQ ID NO: 102549 - RNA, 21 nt, Human
uccucucuaaguuccgccccg

SEQ ID NO: 102550 - RNA, 22 nt, Human
gaggagcuucagaggaaucuua

SEQ ID NO: 102551 - RNA, 20 nt, Human
gccaaggaggagaaacaggc

SEQ ID NO: 102552 - RNA, 22 nt, Human
agguggcuaugaggaugcaguc

SEQ ID NO: 102553 - RNA, 22 nt, Human
cugccucucaugccugcuugcu

SEQ ID NO: 102554 - RNA, 22 nt, Human
gggcuguggggccugcagaagg

SEQ ID NO: 102555 - RNA, 22 nt, Human
ccauuuggccauucaguuguuc

SEQ ID NO: 102556 - RNA, 22 nt, Human
uggucuuuccuucauuguccag

SEQ ID NO: 102557 - RNA, 22 nt, Human
ucuucaugaaauugauugcuua

SEQ ID NO: 102558 - RNA, 22 nt, Human
gcaguuugugauguggcaguca

SEQ ID NO: 102559 - RNA, 22 nt, Human
ggaagaggaagaugaggcagca

SEQ ID NO: 102560 - RNA, 22 nt, Human
aacacuaaaggucaguuagaag

SEQ ID NO: 102561 - RNA, 22 nt, Human
gggagggaggagccccggccau

SEQ ID NO: 102562 - RNA, 22 nt, Human
uucacauucauuucuuauguuu

SEQ ID NO: 102563 - RNA, 22 nt, Human
uucucagagaaagcuccucaug

SEQ ID NO: 102564 - RNA, 22 nt, Human
uucuucuucuuccucauccuca

SEQ ID NO: 102565 - RNA, 22 nt, Human
uggcagccugcgugaaggagcu

SEQ ID NO: 102566 - RNA, 22 nt, Human
uuauuucauguaaaauuuaugu

SEQ ID NO: 102567 - RNA, 22 nt, Human
agccagugucgugugacaugag

SEQ ID NO: 102568 - RNA, 22 nt, Human
guuuucuuguuaauuuugaacg

SEQ ID NO: 102569 - RNA, 20 nt, Human
cccuggaaugagaugcauau

SEQ ID NO: 102570 - RNA, 20 nt, Human
cuccuccccucggccccacc

SEQ ID NO: 102571 - RNA, 22 nt, Human
uuuuacauuuuauucguuuauu

SEQ ID NO: 102572 - RNA, 22 nt, Human
aagaaggaaggcaagagauggg

SEQ ID NO: 102573 - RNA, 22 nt, Human
agauaagaacauuaguaagccg

SEQ ID NO: 102574 - RNA, 22 nt, Human
ucugagugacguccugacagga

SEQ ID NO: 102575 - RNA, 22 nt, Human
auuuuugguuucaccugcacgc

SEQ ID NO: 102576 - RNA, 22 nt, Human
gcuuucacugcaauagaugaau

SEQ ID NO: 102577 - RNA, 22 nt, Human
guggaaggaauuaacagacuag

SEQ ID NO: 102578 - RNA, 20 nt, Human
uuuuuuaaauagagcuguug

SEQ ID NO: 102579 - RNA, 20 nt, Human
gggccagguggaccaggggc

SEQ ID NO: 102580 - RNA, 22 nt, Human
agagggagagaccuccgugccu

SEQ ID NO: 102581 - RNA, 22 nt, Human
uauuuccugcguuucugugagc

SEQ ID NO: 102582 - RNA, 22 nt, Human
aggaaauaagggcacuucagau

SEQ ID NO: 102583 - RNA, 22 nt, Human
cuagcagaagcuccuugagggu

SEQ ID NO: 102584 - RNA, 22 nt, Human
gcuguguaugaugcaggcaccu

SEQ ID NO: 102585 - RNA, 22 nt, Human
uuuuuauaagauuuaaaaugua

SEQ ID NO: 102586 - RNA, 23 nt, Human
caggggacaggugaccugggcuc

SEQ ID NO: 102587 - RNA, 22 nt, Human
acuugggaaaugaaaauacaga

SEQ ID NO: 102588 - RNA, 19 nt, Human
uccuacaugagacagagag

SEQ ID NO: 102589 - RNA, 22 nt, Human
ucagaaggagagacagcgugga

SEQ ID NO: 102590 - RNA, 22 nt, Human
aagagggguggucugugaggau

SEQ ID NO: 102591 - RNA, 22 nt, Human
gaggcugguucccuugaucuuu

SEQ ID NO: 102592 - RNA, 22 nt, Human
gcuggggaucgaaggcagagcc

SEQ ID NO: 102593 - RNA, 19 nt, Human
auagcagaagucauuuuca

SEQ ID NO: 102594 - RNA, 22 nt, Human
uuaaagaguuuauuacuuguaa

SEQ ID NO: 102595 - RNA, 18 nt, Human
auucauuugcguuuggcu

SEQ ID NO: 102596 - RNA, 19 nt, Human
agggaggcaagagaaaugu

SEQ ID NO: 102597 - RNA, 22 nt, Human
gucuugugaagacggcagaaag

SEQ ID NO: 102598 - RNA, 22 nt, Human
aagugauuuucccaccaucuac

SEQ ID NO: 102599 - RNA, 22 nt, Human
augggagggagcagugaguguu

SEQ ID NO: 102600 - RNA, 22 nt, Human
uucucuugccuucucuuuuauc

SEQ ID NO: 102601 - RNA, 22 nt, Human
uccaugauauauaugugcacau

SEQ ID NO: 102602 - RNA, 20 nt, Human
auucuuguuccauuucccag

SEQ ID NO: 102603 - RNA, 22 nt, Human
uuuaacauaugaaagaauauuu

SEQ ID NO: 102604 - RNA, 22 nt, Human
aagaaauagauagaggaauacu

SEQ ID NO: 102605 - RNA, 22 nt, Human
gcagagcugucuaagucacuuc

SEQ ID NO: 102606 - RNA, 22 nt, Human
uguugaaacagcuauugacuuu

SEQ ID NO: 102607 - RNA, 22 nt, Human
aagccucaugccagauccaggu

SEQ ID NO: 102608 - RNA, 22 nt, Human
gagcagcugagcuggaaugaga

SEQ ID NO: 102609 - RNA, 22 nt, Human
auuaaaaaaagauaaugaguua

SEQ ID NO: 102610 - RNA, 22 nt, Human
uggagccuugugagaccacaau

SEQ ID NO: 102611 - RNA, 22 nt, Human
cuucuuaaaguugucacagcug

SEQ ID NO: 102612 - RNA, 22 nt, Human
caaaacauucagagagcucacu

SEQ ID NO: 102613 - RNA, 22 nt, Human
uuauuuaaguauuuauugaagu

SEQ ID NO: 102614 - RNA, 22 nt, Human
uuaacauuguccuuagcagauu

SEQ ID NO: 102615 - RNA, 23 nt, Human
gaugauggcaacuacauccggug

SEQ ID NO: 102616 - RNA, 22 nt, Human
uauuuuauuuagguuuaguugu

SEQ ID NO: 102617 - RNA, 22 nt, Human
aaacucaucaguuuagaaaccu

SEQ ID NO: 102618 - RNA, 20 nt, Human
uccaguuuuggagacauucu

SEQ ID NO: 102619 - RNA, 22 nt, Human
ugaauuacacugggaucagggc

SEQ ID NO: 102620 - RNA, 22 nt, Human
cuccccuuauuccucaacauga

SEQ ID NO: 102621 - RNA, 22 nt, Human
agacuucucuuggcuauauuau

SEQ ID NO: 102622 - RNA, 22 nt, Human
gugaucagaagaaccugccgaa

SEQ ID NO: 102623 - RNA, 22 nt, Human
aggagguagggugugaaacagc

SEQ ID NO: 102624 - RNA, 22 nt, Human
aggcucagcaucugauucauau

SEQ ID NO: 102625 - RNA, 22 nt, Human
auaaaguaaugcauauaaugug

SEQ ID NO: 102626 - RNA, 22 nt, Human
gcagcccucuuggucacuaggc

SEQ ID NO: 102627 - RNA, 22 nt, Human
accuccauggcccacaucuagu

SEQ ID NO: 102628 - RNA, 22 nt, Human
cuccaggacugaggacagagcu

SEQ ID NO: 102629 - RNA, 22 nt, Human
aaauguuucauucuauuuuuag

SEQ ID NO: 102630 - RNA, 18 nt, Human
uucuagaggucucaucca

SEQ ID NO: 102631 - RNA, 22 nt, Human
agagcaucgguggaguccccac

SEQ ID NO: 102632 - RNA, 22 nt, Human
aggggcugugucauuuguccua

SEQ ID NO: 102633 - RNA, 22 nt, Human
uuuauuuacuuucgguucugcu

SEQ ID NO: 102634 - RNA, 22 nt, Human
guaauucugugugaaucuauua

SEQ ID NO: 102635 - RNA, 22 nt, Human
uuucauguuggauacuguuuca

SEQ ID NO: 102636 - RNA, 22 nt, Human
aagaggcuacagcccugugucu

SEQ ID NO: 102637 - RNA, 22 nt, Human
cccccauccccugaaggagcug

SEQ ID NO: 102638 - RNA, 22 nt, Human
uggagggaagcaaacacuagau

SEQ ID NO: 102639 - RNA, 22 nt, Human
ccagaugggggcugugggaggg

SEQ ID NO: 102640 - RNA, 22 nt, Human
ugggcagggagcuggaaccaca

SEQ ID NO: 102641 - RNA, 22 nt, Human
uguccuuucagagcuccuuuug

SEQ ID NO: 102642 - RNA, 22 nt, Human
cacugcacuccagccugggcaa

SEQ ID NO: 102643 - RNA, 22 nt, Human
uuuuagaagcauuuaugagauu

SEQ ID NO: 102644 - RNA, 22 nt, Human
uuuaucaggccaucuuaugucu

SEQ ID NO: 102645 - RNA, 22 nt, Human
ucagucucuggggcuucuguuu

SEQ ID NO: 102646 - RNA, 22 nt, Human
cuggaagcgucggaggaagggc

SEQ ID NO: 102647 - RNA, 22 nt, Human
gucaguggugcuuaaaguuuca

SEQ ID NO: 102648 - RNA, 23 nt, Human
cagagaaaauagaauaugcugug

SEQ ID NO: 102649 - RNA, 22 nt, Human
uacaggaggaugugcagccagg

SEQ ID NO: 102650 - RNA, 22 nt, Human
aagagaggcccaaguggcuggc

SEQ ID NO: 102651 - RNA, 22 nt, Human
gggggcagguuccaggccagcu

SEQ ID NO: 102652 - RNA, 22 nt, Human
uuccuucccccuucuuugccuu

SEQ ID NO: 102653 - RNA, 22 nt, Human
cacugcaaccuccaccucccgg

SEQ ID NO: 102654 - RNA, 22 nt, Human
ggcuagggagacagagggcaug

SEQ ID NO: 102655 - RNA, 22 nt, Human
ugggggagggagaguugauggg

SEQ ID NO: 102656 - RNA, 22 nt, Human
uccucaaauccuagccucaucg

SEQ ID NO: 102657 - RNA, 18 nt, Human
uucucucuggauaguagu

SEQ ID NO: 102658 - RNA, 22 nt, Human
agccccaauuacagcugugcug

SEQ ID NO: 102659 - RNA, 22 nt, Human
augugccuuaauauaggcgcug

SEQ ID NO: 102660 - RNA, 21 nt, Human
acugggcuagccugacuucug

SEQ ID NO: 102661 - RNA, 22 nt, Human
gcuguggagaagcugccuaugg

SEQ ID NO: 102662 - RNA, 20 nt, Human
ucugugugccaucaccuaac

SEQ ID NO: 102663 - RNA, 22 nt, Human
auaaggaaagugagugcuuaaa

SEQ ID NO: 102664 - RNA, 22 nt, Human
guuuugaugugauuucucaugu

SEQ ID NO: 102665 - RNA, 22 nt, Human
gcucagcuggagagggacgggu

SEQ ID NO: 102666 - RNA, 21 nt, Human
uccccugugccuggcauacag

SEQ ID NO: 102667 - RNA, 22 nt, Human
agggaagaggaccagagucucu

SEQ ID NO: 102668 - RNA, 22 nt, Human
uuauuuuuguuuguuaagccua

SEQ ID NO: 102669 - RNA, 22 nt, Human
gggcaagaagcuggaagcauuc

SEQ ID NO: 102670 - RNA, 22 nt, Human
auggagugggaggacaugaagg

SEQ ID NO: 102671 - RNA, 22 nt, Human
cggggcucugcacaggccagga

SEQ ID NO: 102672 - RNA, 22 nt, Human
gaaacauuuguugaguacuugc

SEQ ID NO: 102673 - RNA, 22 nt, Human
agggaguuccgaucugugcacc

SEQ ID NO: 102674 - RNA, 22 nt, Human
ccaggcuccccaggaggcccuu

SEQ ID NO: 102675 - RNA, 19 nt, Human
caggucuucuuggaggacu

SEQ ID NO: 102676 - RNA, 19 nt, Human
augaaauagcauuuucuga

SEQ ID NO: 102677 - RNA, 22 nt, Human
gaaggagaggauugugaggcug

SEQ ID NO: 102678 - RNA, 20 nt, Human
ucucuuuuucuucuuuucuc

SEQ ID NO: 102679 - RNA, 22 nt, Human
uggagccugauggauaggaacg

SEQ ID NO: 102680 - RNA, 22 nt, Human
cuagcacagugcuuggcacaca

SEQ ID NO: 102681 - RNA, 21 nt, Human
gggagaguagcgguagggagg

SEQ ID NO: 102682 - RNA, 22 nt, Human
uuuguauuguuuauuucauuuu

SEQ ID NO: 102683 - RNA, 22 nt, Human
uuuccuucccuccugggccuuc

SEQ ID NO: 102684 - RNA, 22 nt, Human
cuuucuuucaaguucugcuuua

SEQ ID NO: 102685 - RNA, 22 nt, Human
cugucucugauaagcucgaggg

SEQ ID NO: 102686 - RNA, 22 nt, Human
caggaggugugucccaccgggu

SEQ ID NO: 102687 - RNA, 22 nt, Human
agggaggagggacagaaagagg

SEQ ID NO: 102688 - RNA, 22 nt, Human
gagggagugggcccgugggcac

SEQ ID NO: 102689 - RNA, 22 nt, Human
ggagugaguauguucugaugca

SEQ ID NO: 102690 - RNA, 22 nt, Human
ggaagcuguugugagugcagca

SEQ ID NO: 102691 - RNA, 22 nt, Human
cagcccugagagaaccaucuau

SEQ ID NO: 102692 - RNA, 22 nt, Human
cucagcgagggaaagaggccgc

SEQ ID NO: 102693 - RNA, 22 nt, Human
uucuuuguccuagcauucuaca

SEQ ID NO: 102694 - RNA, 22 nt, Human
gauuccuuucgccugccgagcu

SEQ ID NO: 102695 - RNA, 22 nt, Human
aucuuuguaaguaaucaaagcu

SEQ ID NO: 102696 - RNA, 22 nt, Human
cagguggauggcgagcccugca

SEQ ID NO: 102697 - RNA, 21 nt, Human
uccugccuggccuucugacua

SEQ ID NO: 102698 - RNA, 23 nt, Human
acaaguguuuccaauauggcugg

SEQ ID NO: 102699 - RNA, 22 nt, Human
gauguuggugcauucacuucug

SEQ ID NO: 102700 - RNA, 22 nt, Human
cuccugcuuuuucuucuuccga

SEQ ID NO: 102701 - RNA, 22 nt, Human
gucacuuugcuugcgaugcucc

SEQ ID NO: 102702 - RNA, 21 nt, Human
acaaaaccuaacuuggcugcu

SEQ ID NO: 102703 - RNA, 22 nt, Human
uuuuaaauaaacuacacugauu

SEQ ID NO: 102704 - RNA, 22 nt, Human
auuuucuucauuuugauuguau

SEQ ID NO: 102705 - RNA, 22 nt, Human
caucuaaaauaagccuuauaau

SEQ ID NO: 102706 - RNA, 22 nt, Human
ucaccauguacaugaagggcgg

SEQ ID NO: 102707 - RNA, 22 nt, Human
agucugugguccucuguaucuc

SEQ ID NO: 102708 - RNA, 22 nt, Human
guuaaaaugauuugugauuuau

SEQ ID NO: 102709 - RNA, 22 nt, Human
auuuccagcagcauauuugucu

SEQ ID NO: 102710 - RNA, 22 nt, Human
auguggaaagcuugucuuagag

SEQ ID NO: 102711 - RNA, 22 nt, Human
uuuuuuuguagguguaugaaaa

SEQ ID NO: 102712 - RNA, 22 nt, Human
uccagcugugcuccaggaggug

SEQ ID NO: 102713 - RNA, 22 nt, Human
aguaggaauucaaagagacaaa

SEQ ID NO: 102714 - RNA, 22 nt, Human
uguugaagcaccucugucuuuc

SEQ ID NO: 102715 - RNA, 22 nt, Human
agggcaguuaugaaugucucca

SEQ ID NO: 102716 - RNA, 22 nt, Human
cacaaggagaaauagauauuga

SEQ ID NO: 102717 - RNA, 22 nt, Human
uggcaaggccacaggugcaguu

SEQ ID NO: 102718 - RNA, 22 nt, Human
augcccagaacccccuggaugg

SEQ ID NO: 102719 - RNA, 22 nt, Human
uuucuacauuuguaaccagauu

SEQ ID NO: 102720 - RNA, 22 nt, Human
ccccauggaaaacccaccuagg

SEQ ID NO: 102721 - RNA, 22 nt, Human
ugcauucugggucgcagagugg

SEQ ID NO: 102722 - RNA, 23 nt, Human
gugugccuuuaucuucuguacuc

SEQ ID NO: 102723 - RNA, 22 nt, Human
aggggcugagaguuugaugugg

SEQ ID NO: 102724 - RNA, 22 nt, Human
acuguugagggaagcagaugaa

SEQ ID NO: 102725 - RNA, 22 nt, Human
uuuuuguuauuuagguguagag

SEQ ID NO: 102726 - RNA, 22 nt, Human
ugugucuccacugugcuauuuu

SEQ ID NO: 102727 - RNA, 22 nt, Human
acaggaaugaagaugagagagu

SEQ ID NO: 102728 - RNA, 22 nt, Human
gggcagagagcuggaacuccuu

SEQ ID NO: 102729 - RNA, 22 nt, Human
aauauuuugggacugaggaauu

SEQ ID NO: 102730 - RNA, 22 nt, Human
gugucccaaagauuagaaauca

SEQ ID NO: 102731 - RNA, 22 nt, Human
guuuucuccugcuauacagugc

SEQ ID NO: 102732 - RNA, 22 nt, Human
ucucucucucuuccagcauguu

SEQ ID NO: 102733 - RNA, 22 nt, Human
cugcaucacagcaggaggcaca

SEQ ID NO: 102734 - RNA, 22 nt, Human
aacugcauaagcuucgggaccu

SEQ ID NO: 102735 - RNA, 22 nt, Human
gaggcaggaagggaggguugug

SEQ ID NO: 102736 - RNA, 22 nt, Human
cagguugaaaguggaggagcua

SEQ ID NO: 102737 - RNA, 22 nt, Human
auagaguucucuuuggaggagu

SEQ ID NO: 102738 - RNA, 22 nt, Human
acagccaacgucuuucuuacuu

SEQ ID NO: 102739 - RNA, 22 nt, Human
ccugcccaucccaccccagcau

SEQ ID NO: 102740 - RNA, 22 nt, Human
ggcugcagugcaacucuuucua

SEQ ID NO: 102741 - RNA, 22 nt, Human
gcugggagucgcgucuguggcc

SEQ ID NO: 102742 - RNA, 22 nt, Human
ggggaaggaaggggagggcacg

SEQ ID NO: 102743 - RNA, 22 nt, Human
uauuucaugagugaauaucuag

SEQ ID NO: 102744 - RNA, 22 nt, Human
agcacauguuucuuuugcaauu

SEQ ID NO: 102745 - RNA, 22 nt, Human
gauagcacacuuguugcuucug

SEQ ID NO: 102746 - RNA, 22 nt, Human
ccuccuggaguuacuuccaaaa

SEQ ID NO: 102747 - RNA, 22 nt, Human
gugucacuuucaggagcucuaa

SEQ ID NO: 102748 - RNA, 22 nt, Human
aguuugauuugucuaucuucau

SEQ ID NO: 102749 - RNA, 22 nt, Human
uuuuaaaagguugcuguuauaa

SEQ ID NO: 102750 - RNA, 20 nt, Human
gaacauaaauaacucuuuac

SEQ ID NO: 102751 - RNA, 22 nt, Human
aauguuuuucaaguguggagca

SEQ ID NO: 102752 - RNA, 22 nt, Human
gaggaggcuggagaggccagga

SEQ ID NO: 102753 - RNA, 22 nt, Human
caaaaaauccauagaaagaggu

SEQ ID NO: 102754 - RNA, 22 nt, Human
cauuccuucucagguacuggca

SEQ ID NO: 102755 - RNA, 22 nt, Human
auauucaaugaggucauauaag

SEQ ID NO: 102756 - RNA, 22 nt, Human
guuguuuucagcccagcauuag

SEQ ID NO: 102757 - RNA, 22 nt, Human
aaucauaacaaaagcaauuaua

SEQ ID NO: 102758 - RNA, 22 nt, Human
uaggaagagauuuucacauggc

SEQ ID NO: 102759 - RNA, 22 nt, Human
aauaugaugccaaauugcuaca

SEQ ID NO: 102760 - RNA, 22 nt, Human
uuuuccuuaacagagggagaaa

SEQ ID NO: 102761 - RNA, 22 nt, Human
ccuuuuaucgcgaagaacucca

SEQ ID NO: 102762 - RNA, 22 nt, Human
agauggaggaaagcaguuagaa

SEQ ID NO: 102763 - RNA, 19 nt, Human
aggaaggggauaaguaaca

SEQ ID NO: 102764 - RNA, 22 nt, Human
aggauggauagcaaggaagccg

SEQ ID NO: 102765 - RNA, 22 nt, Human
auguguuuccaacagagaggga

SEQ ID NO: 102766 - RNA, 22 nt, Human
gagaugugguucaaggguguuu

SEQ ID NO: 102767 - RNA, 22 nt, Human
ucuuuaucugugagcagucucc

SEQ ID NO: 102768 - RNA, 22 nt, Human
ggcuuguccuucugguugucuu

SEQ ID NO: 102769 - RNA, 23 nt, Human
agauaaggaagcauuugagccag

SEQ ID NO: 102770 - RNA, 22 nt, Human
cagcccaucaaggggauccuga

SEQ ID NO: 102771 - RNA, 22 nt, Human
ucccuguggauuaaggagaugu

SEQ ID NO: 102772 - RNA, 22 nt, Human
guuuuaucuauguaauuauaaa

SEQ ID NO: 102773 - RNA, 22 nt, Human
uguuuuuuagagugauacuuuu

SEQ ID NO: 102774 - RNA, 21 nt, Human
uuccuccucuggagaagaaga

SEQ ID NO: 102775 - RNA, 22 nt, Human
aagugugugugcgcaugugcau

SEQ ID NO: 102776 - RNA, 22 nt, Human
caauaccucuuggugauugggc

SEQ ID NO: 102777 - RNA, 22 nt, Human
ccucuccuugcuccccuuccuu

SEQ ID NO: 102778 - RNA, 22 nt, Human
cacaugugugugccuacaugca

SEQ ID NO: 102779 - RNA, 21 nt, Human
acauccaggguccucacugcc

SEQ ID NO: 102780 - RNA, 23 nt, Human
gcugagcaccagccauaucuuuu

SEQ ID NO: 102781 - RNA, 22 nt, Human
uuuuuuuuacuccggacagcuc

SEQ ID NO: 102782 - RNA, 22 nt, Human
uuuuuaaaagaugauuuaauga

SEQ ID NO: 102783 - RNA, 22 nt, Human
uacuuacacugaagcaaagaua

SEQ ID NO: 102784 - RNA, 22 nt, Human
uaaaaucaugacagauugacau

SEQ ID NO: 102785 - RNA, 22 nt, Human
uggacacugguggauauggaau

SEQ ID NO: 102786 - RNA, 22 nt, Human
gcuggcgauggccgagucuccg

SEQ ID NO: 102787 - RNA, 22 nt, Human
ugcuuggauuuccaaaugguuu

SEQ ID NO: 102788 - RNA, 22 nt, Human
cuggccagccucccagguaccc

SEQ ID NO: 102789 - RNA, 22 nt, Human
auaguuuuagauacugagaaaa

SEQ ID NO: 102790 - RNA, 22 nt, Human
auagggaggcggagggagcugg

SEQ ID NO: 102791 - RNA, 22 nt, Human
uggguauauauguugcuacaga

SEQ ID NO: 102792 - RNA, 22 nt, Human
uucucuuguaaaauuccuuuuu

SEQ ID NO: 102793 - RNA, 22 nt, Human
uauauuaaagugcuuugcagug

SEQ ID NO: 102794 - RNA, 20 nt, Human
agaaggagagaugaggcaaa

SEQ ID NO: 102795 - RNA, 21 nt, Human
gcagcucaggauauagacuug

SEQ ID NO: 102796 - RNA, 22 nt, Human
uggguucaaauccugguuccac

SEQ ID NO: 102797 - RNA, 22 nt, Human
aguuuucugccucuggaugcgu

SEQ ID NO: 102798 - RNA, 21 nt, Human
caguuugcuauuuuaguauga

SEQ ID NO: 102799 - RNA, 22 nt, Human
aaaacuuucagggauacagaaa

SEQ ID NO: 102800 - RNA, 18 nt, Human
ggccucagccuggccgga

SEQ ID NO: 102801 - RNA, 22 nt, Human
cagaccagaaggaagccgacaa

SEQ ID NO: 102802 - RNA, 22 nt, Human
gggcaggggcagugguggcauu

SEQ ID NO: 102803 - RNA, 22 nt, Human
agauucucccuccuggcgcugu

SEQ ID NO: 102804 - RNA, 22 nt, Human
cagagcugucauuugccaguga

SEQ ID NO: 102805 - RNA, 22 nt, Human
uuguuauuauuauuuucguucu

SEQ ID NO: 102806 - RNA, 22 nt, Human
ugucccaucacagaggagacua

SEQ ID NO: 102807 - RNA, 22 nt, Human
aagcccucagagccucuuugac

SEQ ID NO: 102808 - RNA, 23 nt, Human
ucacugccaagaaaaguuacaga

SEQ ID NO: 102809 - RNA, 22 nt, Human
ugaaguuuagaaaaagugccuu

SEQ ID NO: 102810 - RNA, 22 nt, Human
uuucuggacuaaagggagagau

SEQ ID NO: 102811 - RNA, 22 nt, Human
ucccucuuccuacccucccuuu

SEQ ID NO: 102812 - RNA, 22 nt, Human
acuauauaaugcacacaguaua

SEQ ID NO: 102813 - RNA, 22 nt, Human
ugggagagaaauuuaaguuuuu

SEQ ID NO: 102814 - RNA, 23 nt, Human
ucucacucauucuccucugucca

SEQ ID NO: 102815 - RNA, 22 nt, Human
ccaggcucaccuggagccccug

SEQ ID NO: 102816 - RNA, 22 nt, Human
gggcuggcaguuuucugaguuc

SEQ ID NO: 102817 - RNA, 22 nt, Human
uuuuuaaaauuaggacggcacg

SEQ ID NO: 102818 - RNA, 22 nt, Human
ucccaaaacuugaagcaagccu

SEQ ID NO: 102819 - RNA, 22 nt, Human
cagaaguugcuugagagagagc

SEQ ID NO: 102820 - RNA, 22 nt, Human
aguucauucuagcugggagcag

SEQ ID NO: 102821 - RNA, 22 nt, Human
uaaagugaaguucagaauggcu

SEQ ID NO: 102822 - RNA, 20 nt, Human
agugauuuguuaguacauug

SEQ ID NO: 102823 - RNA, 22 nt, Human
uccuuucaaauuuauuugacau

SEQ ID NO: 102824 - RNA, 20 nt, Human
uugaggagauauugaauacu

SEQ ID NO: 102825 - RNA, 22 nt, Human
uuuguacuuucuaauguauuua

SEQ ID NO: 102826 - RNA, 22 nt, Human
aaacccaggguuuugucuuccc

SEQ ID NO: 102827 - RNA, 22 nt, Human
ggcugugguggacgcgggaaac

SEQ ID NO: 102828 - RNA, 22 nt, Human
guaguuuucaugguuagaaaua

SEQ ID NO: 102829 - RNA, 22 nt, Human
cuucuuucuuuucuucuucucu

SEQ ID NO: 102830 - RNA, 23 nt, Human
uaguguuauuaauuaguaaggau

SEQ ID NO: 102831 - RNA, 22 nt, Human
aagagaggaaagggugugaggu

SEQ ID NO: 102832 - RNA, 22 nt, Human
ggugucuuugauguugggcuga

SEQ ID NO: 102833 - RNA, 22 nt, Human
uauuaaaagagaaaaagccacc

SEQ ID NO: 102834 - RNA, 22 nt, Human
aaauagucagaaaucaacgugc

SEQ ID NO: 102835 - RNA, 22 nt, Human
ugggcccaucauugcugugggc

SEQ ID NO: 102836 - RNA, 22 nt, Human
gcugcagggagcuggaaggcuc

SEQ ID NO: 102837 - RNA, 22 nt, Human
uuucucuuguauuugaaucacu

SEQ ID NO: 102838 - RNA, 19 nt, Human
uggugcgcuguuccugagc

SEQ ID NO: 102839 - RNA, 21 nt, Human
aacaaaagggaagaacagcug

SEQ ID NO: 102840 - RNA, 22 nt, Human
cuccacagccccuccaguggca

SEQ ID NO: 102841 - RNA, 22 nt, Human
guuuggguggcuagagaaagaa

SEQ ID NO: 102842 - RNA, 22 nt, Human
uccuuaggaccuagagguagua

SEQ ID NO: 102843 - RNA, 22 nt, Human
auuuuucuuucacauuuucuua

SEQ ID NO: 102844 - RNA, 22 nt, Human
cucuugugucaccauggauaaa

SEQ ID NO: 102845 - RNA, 22 nt, Human
ggagacagauggcgucucaguu

SEQ ID NO: 102846 - RNA, 22 nt, Human
ugaaauuuuuuggagauaauuu

SEQ ID NO: 102847 - RNA, 22 nt, Human
gggacugguuguguguggugug

SEQ ID NO: 102848 - RNA, 22 nt, Human
uucauggauuugugaaauuuag

SEQ ID NO: 102849 - RNA, 22 nt, Human
ggaagauagaaguucaaaaguu

SEQ ID NO: 102850 - RNA, 22 nt, Human
ucuuccuuacucuggauguuau

SEQ ID NO: 102851 - RNA, 22 nt, Human
ggacauaguugcuauggagagu

SEQ ID NO: 102852 - RNA, 22 nt, Human
ucucagggaugggaggccccag

SEQ ID NO: 102853 - RNA, 22 nt, Human
aauucuuuguuccucugccaag

SEQ ID NO: 102854 - RNA, 22 nt, Human
ucuuucugaugggaagggucaa

SEQ ID NO: 102855 - RNA, 22 nt, Human
uugccaggagacaucuggagcc

SEQ ID NO: 102856 - RNA, 22 nt, Human
gagcagacugcacaguucuugc

SEQ ID NO: 102857 - RNA, 22 nt, Human
aaaggaaacuaugaaucucugg

SEQ ID NO: 102858 - RNA, 22 nt, Human
gcaggggguaaggggcagggcu

SEQ ID NO: 102859 - RNA, 22 nt, Human
ggcugguggcgggcagcacaga

SEQ ID NO: 102860 - RNA, 22 nt, Human
aaaauacuaggaaaauaaauca

SEQ ID NO: 102861 - RNA, 22 nt, Human
cuuuuuuucuccauauuucugg

SEQ ID NO: 102862 - RNA, 22 nt, Human
ggaaauauaagcaguuugugug

SEQ ID NO: 102863 - RNA, 22 nt, Human
uccucccugcacucagugaagu

SEQ ID NO: 102864 - RNA, 22 nt, Human
ugagacucuccugugcagccuc

SEQ ID NO: 102865 - RNA, 19 nt, Human
agugaacuccauaucaggu

SEQ ID NO: 102866 - RNA, 22 nt, Human
ugagauguaauguaguacuuug

SEQ ID NO: 102867 - RNA, 22 nt, Human
agauauucugccuaacagguuu

SEQ ID NO: 102868 - RNA, 21 nt, Human
uuccauggacccugucagugu

SEQ ID NO: 102869 - RNA, 22 nt, Human
gaacaaaagauagcccaaacau

SEQ ID NO: 102870 - RNA, 22 nt, Human
ugcugcacucacaggaagaguu

SEQ ID NO: 102871 - RNA, 22 nt, Human
uucugggguaagcacugaggau

SEQ ID NO: 102872 - RNA, 22 nt, Human
uggggcauacgugaaauaauuu

SEQ ID NO: 102873 - RNA, 22 nt, Human
uuucuaaaauuacugcagucgg

SEQ ID NO: 102874 - RNA, 22 nt, Human
uuuuucuuugcuuuccacuggc

SEQ ID NO: 102875 - RNA, 22 nt, Human
auauuuuugcagaauuuuucgu

SEQ ID NO: 102876 - RNA, 22 nt, Human
uggcccugaaucaaggccagca

SEQ ID NO: 102877 - RNA, 22 nt, Human
agccccuucuuuggggagcuga

SEQ ID NO: 102878 - RNA, 22 nt, Human
uguggccaccagagcugcuauu

SEQ ID NO: 102879 - RNA, 21 nt, Human
ucuggggacaagguccaggaa

SEQ ID NO: 102880 - RNA, 19 nt, Human
acuggggcaggcugggcuu

SEQ ID NO: 102881 - RNA, 22 nt, Human
cucagaugcacacaggugaggg

SEQ ID NO: 102882 - RNA, 22 nt, Human
acacgguggccagcaguaggug

SEQ ID NO: 102883 - RNA, 21 nt, Human
uuccuggaggcagaaacguga

SEQ ID NO: 102884 - RNA, 22 nt, Human
gcacagauaaucugccuuacca

SEQ ID NO: 102885 - RNA, 22 nt, Human
aggcaguguggagggcuguugc

SEQ ID NO: 102886 - RNA, 22 nt, Human
auguaugagagauucuuuuauu

SEQ ID NO: 102887 - RNA, 22 nt, Human
ggagagcuagugagcuggaggu

SEQ ID NO: 102888 - RNA, 22 nt, Human
gccuggccaaucgccgucuagg

SEQ ID NO: 102889 - RNA, 22 nt, Human
uccaugaguuuuuuaguuucac

SEQ ID NO: 102890 - RNA, 22 nt, Human
auuugcauguuuauuucuuaga

SEQ ID NO: 102891 - RNA, 22 nt, Human
ggcagucuuucccuugagcucu

SEQ ID NO: 102892 - RNA, 22 nt, Human
auuuuuaucuaaaauccacuuu

SEQ ID NO: 102893 - RNA, 22 nt, Human
ugaaaaauauuuuuagaaauaa

SEQ ID NO: 102894 - RNA, 22 nt, Human
cagccuuuucuuaaaaugcaag

SEQ ID NO: 102895 - RNA, 21 nt, Human
ugccuggccuuugcuuuuccu

SEQ ID NO: 102896 - RNA, 23 nt, Human
cuuauauaaucauuagaaaccau

SEQ ID NO: 102897 - RNA, 22 nt, Human
uggaaauacaagaaguauguca

SEQ ID NO: 102898 - RNA, 19 nt, Human
uagaggagaauggcaaaga

SEQ ID NO: 102899 - RNA, 20 nt, Human
cucugggaggcuugucaccu

SEQ ID NO: 102900 - RNA, 22 nt, Human
ggaggccgugcugugcugccag

SEQ ID NO: 102901 - RNA, 22 nt, Human
caguuuuauacacugcagcucc

SEQ ID NO: 102902 - RNA, 22 nt, Human
uugcaagcccugaagggcugga

SEQ ID NO: 102903 - RNA, 22 nt, Human
uggagucuugcuuugggagugc

SEQ ID NO: 102904 - RNA, 22 nt, Human
guaaauaucucacgaaugauuc

SEQ ID NO: 102905 - RNA, 22 nt, Human
cuugucuaguuccuggugaugu

SEQ ID NO: 102906 - RNA, 22 nt, Human
cacacaccagaaagccugggac

SEQ ID NO: 102907 - RNA, 22 nt, Human
caagggcagaggcagggccccg

SEQ ID NO: 102908 - RNA, 22 nt, Human
aucuucaaagcacaucguuugu

SEQ ID NO: 102909 - RNA, 22 nt, Human
ccuucccagacggcucagcugu

SEQ ID NO: 102910 - RNA, 22 nt, Human
aauuauguugaaauaugagaac

SEQ ID NO: 102911 - RNA, 22 nt, Human
gcuggaaauaacuuguguagaa

SEQ ID NO: 102912 - RNA, 22 nt, Human
uuauuuuuguaacacuguauag

SEQ ID NO: 102913 - RNA, 22 nt, Human
ucuucacagaugcauauacuuc

SEQ ID NO: 102914 - RNA, 22 nt, Human
ccucaggaauuuauucuucugu

SEQ ID NO: 102915 - RNA, 22 nt, Human
gaaaaguuuaaccuuguacauu

SEQ ID NO: 102916 - RNA, 22 nt, Human
auucuuuauuuucuguacuugc

SEQ ID NO: 102917 - RNA, 22 nt, Human
gccucucuggcaaagcggugau

SEQ ID NO: 102918 - RNA, 22 nt, Human
uuccagauguuuaaguucugcu

SEQ ID NO: 102919 - RNA, 21 nt, Human
cugggaacccgaccaaggccu

SEQ ID NO: 102920 - RNA, 22 nt, Human
uuccacauucggaauuuucuga

SEQ ID NO: 102921 - RNA, 22 nt, Human
gagggugguggcggccggcacc

SEQ ID NO: 102922 - RNA, 23 nt, Human
uccuccccaccuuuguccccucc

SEQ ID NO: 102923 - RNA, 23 nt, Human
aacugcaagguugcugggaagua

SEQ ID NO: 102924 - RNA, 22 nt, Human
uucugugacuccucagagauuu

SEQ ID NO: 102925 - RNA, 22 nt, Human
ucuccaggaaagacacuggacu

SEQ ID NO: 102926 - RNA, 22 nt, Human
uauuuucucugccacacuucca

SEQ ID NO: 102927 - RNA, 22 nt, Human
cagacacgucccuguugaccug

SEQ ID NO: 102928 - RNA, 22 nt, Human
cacaugugggcacagggcugca

SEQ ID NO: 102929 - RNA, 22 nt, Human
gugauggucgagcgcuuguugu

SEQ ID NO: 102930 - RNA, 22 nt, Human
cuccaugagccaggagggcuac

SEQ ID NO: 102931 - RNA, 17 nt, Human
ucuguguccgcucaguc

SEQ ID NO: 102932 - RNA, 22 nt, Human
aggggaggcugcgggcugccgu

SEQ ID NO: 102933 - RNA, 22 nt, Human
aaauguuugguggauaaaagga

SEQ ID NO: 102934 - RNA, 22 nt, Human
cuuuaaaaauguauuuuugugg

SEQ ID NO: 102935 - RNA, 22 nt, Human
uucauuuccauuuuauagauaa

SEQ ID NO: 102936 - RNA, 22 nt, Human
augaaaacgugugugugugugu

SEQ ID NO: 102937 - RNA, 22 nt, Human
cuucuucaucuuuuggaggaac

SEQ ID NO: 102938 - RNA, 22 nt, Human
ugggcagggauuuggggaaacu

SEQ ID NO: 102939 - RNA, 22 nt, Human
cgcacaggcacagacacuggga

SEQ ID NO: 102940 - RNA, 22 nt, Human
cuacuucucccuagaucagaaa

SEQ ID NO: 102941 - RNA, 22 nt, Human
ggagcucacuacgaaauaagcu

SEQ ID NO: 102942 - RNA, 22 nt, Human
uugccaggggacaucuggagcc

SEQ ID NO: 102943 - RNA, 22 nt, Human
ucuccaggggcagggucuggag

SEQ ID NO: 102944 - RNA, 20 nt, Human
agucuucaggugugaggauu

SEQ ID NO: 102945 - RNA, 22 nt, Human
auggauggaagcagccugaacu

SEQ ID NO: 102946 - RNA, 22 nt, Human
aauguugaaccuuuuuggccug

SEQ ID NO: 102947 - RNA, 22 nt, Human
gauuuuaaaagauguauaaggu

SEQ ID NO: 102948 - RNA, 22 nt, Human
ccagaggcuuaugcagcugcug

SEQ ID NO: 102949 - RNA, 22 nt, Human
acagagcucccagccaucuccu

SEQ ID NO: 102950 - RNA, 22 nt, Human
auuaauaucaauauauuauaug

SEQ ID NO: 102951 - RNA, 22 nt, Human
aggucccauguccucccugacc

SEQ ID NO: 102952 - RNA, 22 nt, Human
uggagagcaaugaggggcaggc

SEQ ID NO: 102953 - RNA, 22 nt, Human
acuuccuuuuuuggggauagca

SEQ ID NO: 102954 - RNA, 22 nt, Human
uuuuuuccuguuugucuuuggg

SEQ ID NO: 102955 - RNA, 22 nt, Human
aaauauauauaauauauauauu

SEQ ID NO: 102956 - RNA, 22 nt, Human
uucagaauuaucauaauuuuga

SEQ ID NO: 102957 - RNA, 19 nt, Human
ccacacacuggucucuggg

SEQ ID NO: 102958 - RNA, 22 nt, Human
uuuauuuagguaaacaugaguu

SEQ ID NO: 102959 - RNA, 22 nt, Human
uaaggaaaugcaaauuuaagaa

SEQ ID NO: 102960 - RNA, 22 nt, Human
ucagcuucaucuugagcccaca

SEQ ID NO: 102961 - RNA, 22 nt, Human
uucuccaccugcuccucccacc

SEQ ID NO: 102962 - RNA, 22 nt, Human
uuuuucuccucucucuuucauu

SEQ ID NO: 102963 - RNA, 22 nt, Human
cacugguugccucuuucuguuc

SEQ ID NO: 102964 - RNA, 22 nt, Human
caggccccagggacugggcgcu

SEQ ID NO: 102965 - RNA, 22 nt, Human
aagagaaaaaucuuaaucuagu

SEQ ID NO: 102966 - RNA, 20 nt, Human
aauaaauauaacccauaauu

SEQ ID NO: 102967 - RNA, 22 nt, Human
ggggucccucucugugucaguu

SEQ ID NO: 102968 - RNA, 22 nt, Human
uuuguuuuggugucaugcguga

SEQ ID NO: 102969 - RNA, 22 nt, Human
auccuccuggggcagucuuccc

SEQ ID NO: 102970 - RNA, 22 nt, Human
uauauaauacacaaauauguac

SEQ ID NO: 102971 - RNA, 22 nt, Human
gugccugcucauucucaauauu

SEQ ID NO: 102972 - RNA, 22 nt, Human
cccaggucgucagcaguguggu

SEQ ID NO: 102973 - RNA, 22 nt, Human
uuauuuaaaauguagguuggga

SEQ ID NO: 102974 - RNA, 22 nt, Human
gugaaauuguacacucaguacc

SEQ ID NO: 102975 - RNA, 22 nt, Human
gaacauauuuagcaccuaauau

SEQ ID NO: 102976 - RNA, 22 nt, Human
guguuggugagcucauuuccac

SEQ ID NO: 102977 - RNA, 22 nt, Human
aaggccuaggaguugacauggg

SEQ ID NO: 102978 - RNA, 22 nt, Human
cucuggggaagugcacucgcug

SEQ ID NO: 102979 - RNA, 22 nt, Human
guccuguguaaguacuugcuca

SEQ ID NO: 102980 - RNA, 22 nt, Human
cuguucuccacuccugacuucu

SEQ ID NO: 102981 - RNA, 21 nt, Human
uguggccauuugaaaacaggg

SEQ ID NO: 102982 - RNA, 22 nt, Human
cuuuuuaaaguaaauggcuaga

SEQ ID NO: 102983 - RNA, 22 nt, Human
ugcuccucugcaugucugcggc

SEQ ID NO: 102984 - RNA, 22 nt, Human
cugaaagacagccaggcaaagc

SEQ ID NO: 102985 - RNA, 22 nt, Human
ccagaacguuugugcgaggcag

SEQ ID NO: 102986 - RNA, 22 nt, Human
uuuuaaauggcuuuuacuuuuc

SEQ ID NO: 102987 - RNA, 22 nt, Human
auucuuauaaaaaguguugacu

SEQ ID NO: 102988 - RNA, 22 nt, Human
gaggccagcacccagaugcaug

SEQ ID NO: 102989 - RNA, 22 nt, Human
uauuaauugugguuauuguauu

SEQ ID NO: 102990 - RNA, 22 nt, Human
ggcucacuguaccugccgccgc

SEQ ID NO: 102991 - RNA, 22 nt, Human
aaggucuucgaaccuuauguua

SEQ ID NO: 102992 - RNA, 22 nt, Human
cucuugacagcuuuaguaucau

SEQ ID NO: 102993 - RNA, 22 nt, Human
aaugaaaaucugucaguucaag

SEQ ID NO: 102994 - RNA, 22 nt, Human
uucacuguucuuagagaagacc

SEQ ID NO: 102995 - RNA, 22 nt, Human
ucaccauguuuucauaggaaca

SEQ ID NO: 102996 - RNA, 22 nt, Human
ggcugggagguggcgaggaggc

SEQ ID NO: 102997 - RNA, 22 nt, Human
ugguccuuuccauuggagacac

SEQ ID NO: 102998 - RNA, 18 nt, Human
uauuuacuguguguuacc

SEQ ID NO: 102999 - RNA, 22 nt, Human
gcagggcucuggagucaggcug

SEQ ID NO: 103000 - RNA, 21 nt, Human
auauuguugggguuuucuuuu

SEQ ID NO: 103001 - RNA, 22 nt, Human
gauauauuucaaauucuuuugc

SEQ ID NO: 103002 - RNA, 22 nt, Human
agggcugcugcuccgggcccag

SEQ ID NO: 103003 - RNA, 22 nt, Human
aaauguaaacuguauuuauaaa

SEQ ID NO: 103004 - RNA, 20 nt, Human
gggcucugcauccaucagcc

SEQ ID NO: 103005 - RNA, 22 nt, Human
uguauaaaauggaaugucagaa

SEQ ID NO: 103006 - RNA, 22 nt, Human
uucugcuuuaaagcucauguuu

SEQ ID NO: 103007 - RNA, 22 nt, Human
gggugcuucauaggugaugcug

SEQ ID NO: 103008 - RNA, 22 nt, Human
uggaagcccagaaggaagcaga

SEQ ID NO: 103009 - RNA, 22 nt, Human
uguguuguuggggauguuuuca

SEQ ID NO: 103010 - RNA, 22 nt, Human
ucucaaagagcuacuggucuau

SEQ ID NO: 103011 - RNA, 20 nt, Human
uggguucaguuguuucuggc

SEQ ID NO: 103012 - RNA, 22 nt, Human
ccagggaggucauagugcuggu

SEQ ID NO: 103013 - RNA, 22 nt, Human
uauuuuuaccuaauuuaugaga

SEQ ID NO: 103014 - RNA, 22 nt, Human
aauaacuuacucuaugcuuagu

SEQ ID NO: 103015 - RNA, 22 nt, Human
uuauuguuuggguauaauuuga

SEQ ID NO: 103016 - RNA, 22 nt, Human
ggcuagggaucuagaccaggac

SEQ ID NO: 103017 - RNA, 22 nt, Human
ggcagagguagcuggaaccagg

SEQ ID NO: 103018 - RNA, 22 nt, Human
acaaaaauauuguagaagugcu

SEQ ID NO: 103019 - RNA, 22 nt, Human
aaacaaauccaauaauaaaauu

SEQ ID NO: 103020 - RNA, 22 nt, Human
ucucaaagguuuuccucuuuuu

SEQ ID NO: 103021 - RNA, 22 nt, Human
gaaaagcucuuuagaagagguu

SEQ ID NO: 103022 - RNA, 22 nt, Human
uucuauaagagaugaauacagu

SEQ ID NO: 103023 - RNA, 22 nt, Human
aaaaggaacaauaugguauuuu

SEQ ID NO: 103024 - RNA, 22 nt, Human
uggagcugguucuggggaagcu

SEQ ID NO: 103025 - RNA, 22 nt, Human
caggaacagcaccaggagcuag

SEQ ID NO: 103026 - RNA, 22 nt, Human
agggggcuccugcaggccccca

SEQ ID NO: 103027 - RNA, 22 nt, Human
uauauauaauguguacagguga

SEQ ID NO: 103028 - RNA, 22 nt, Human
aggcaggcucaaugcccagucu

SEQ ID NO: 103029 - RNA, 22 nt, Human
uuucagugaaugaauggcuaac

SEQ ID NO: 103030 - RNA, 22 nt, Human
uggcucacuuccguggagaggu

SEQ ID NO: 103031 - RNA, 22 nt, Human
aggcaguggagcuggaauaggc

SEQ ID NO: 103032 - RNA, 22 nt, Human
ucacccagacugucugacucuu

SEQ ID NO: 103033 - RNA, 22 nt, Human
ccugaagaugguugauccccuu

SEQ ID NO: 103034 - RNA, 21 nt, Human
aggugaaggcgagggggacag

SEQ ID NO: 103035 - RNA, 22 nt, Human
gcugggacacacagucuucuuu

SEQ ID NO: 103036 - RNA, 17 nt, Human
ccacuagauagguugug

SEQ ID NO: 103037 - RNA, 20 nt, Human
cuuauuuuggagaacuuuuc

SEQ ID NO: 103038 - RNA, 22 nt, Human
aaugauuuucugcaaacaguga

SEQ ID NO: 103039 - RNA, 22 nt, Human
gaauauuuaucucagcugcaga

SEQ ID NO: 103040 - RNA, 22 nt, Human
gugcucuagaaauugucagugg

SEQ ID NO: 103041 - RNA, 22 nt, Human
uuccccaccagagacagagcug

SEQ ID NO: 103042 - RNA, 22 nt, Human
acauuuuaaaaacaguaccugg

SEQ ID NO: 103043 - RNA, 22 nt, Human
cauaaauuuuaccuuguaagug

SEQ ID NO: 103044 - RNA, 20 nt, Human
cagagccaggguuuuguuuu

SEQ ID NO: 103045 - RNA, 22 nt, Human
auuagugguguauuuggcacua

SEQ ID NO: 103046 - RNA, 22 nt, Human
uugaaaaaugcccagcagacaa

SEQ ID NO: 103047 - RNA, 20 nt, Human
aauagcacagcucaaacauu

SEQ ID NO: 103048 - RNA, 22 nt, Human
gcugucccccaaagaugcuccu

SEQ ID NO: 103049 - RNA, 19 nt, Human
ugccuggcaccagcuccac

SEQ ID NO: 103050 - RNA, 22 nt, Human
aagcucagcugguggugauugc

SEQ ID NO: 103051 - RNA, 22 nt, Human
uuuugaauaauucagaaacagc

SEQ ID NO: 103052 - RNA, 19 nt, Human
ccaguuuuuuaauauucaa

SEQ ID NO: 103053 - RNA, 22 nt, Human
uggggcuccuccuggcaggagg

SEQ ID NO: 103054 - RNA, 22 nt, Human
uagcugucauuggaucagaagg

SEQ ID NO: 103055 - RNA, 22 nt, Human
aaggacaccaaacuaauuggga

SEQ ID NO: 103056 - RNA, 22 nt, Human
gcucagagaugucugcugccuu

SEQ ID NO: 103057 - RNA, 18 nt, Human
aggcuggggaucacaggg

SEQ ID NO: 103058 - RNA, 22 nt, Human
gugggggugaggaauguucuau

SEQ ID NO: 103059 - RNA, 22 nt, Human
ucuaaagcuccuuccacuaaaa

SEQ ID NO: 103060 - RNA, 22 nt, Human
agcggccucgcugccugcucag

SEQ ID NO: 103061 - RNA, 22 nt, Human
ccucccuucccggcauggcucu

SEQ ID NO: 103062 - RNA, 22 nt, Human
gugguuuagccuucauuaaccu

SEQ ID NO: 103063 - RNA, 23 nt, Human
aaggugaagccaccaggugagga

SEQ ID NO: 103064 - RNA, 22 nt, Human
ugcaggagcccaggaauacuau

SEQ ID NO: 103065 - RNA, 22 nt, Human
agaggcaggcagcagagaagau

SEQ ID NO: 103066 - RNA, 22 nt, Human
gucugcccuuggccugggacuu

SEQ ID NO: 103067 - RNA, 22 nt, Human
ccaggaguccgugggucuugag

SEQ ID NO: 103068 - RNA, 22 nt, Human
gagggggaaaagggcagcagag

SEQ ID NO: 103069 - RNA, 22 nt, Human
ggauggugauguacccagucau

SEQ ID NO: 103070 - RNA, 22 nt, Human
uucucugcgcuccggcccaguu

SEQ ID NO: 103071 - RNA, 21 nt, Human
ggccagauucucccauagcug

SEQ ID NO: 103072 - RNA, 22 nt, Human
acuggagcccguggaggcgcag

SEQ ID NO: 103073 - RNA, 17 nt, Human
augcccagggcucccug

SEQ ID NO: 103074 - RNA, 22 nt, Human
gaggggacugucuggcuccgag

SEQ ID NO: 103075 - RNA, 22 nt, Human
ucuuuuucccugguuccuuuuu

SEQ ID NO: 103076 - RNA, 22 nt, Human
uuuucacugacuuggucuggaa

SEQ ID NO: 103077 - RNA, 22 nt, Human
uggugccuuccgagagcuguga

SEQ ID NO: 103078 - RNA, 22 nt, Human
caagaaaaaacaugaugagugu

SEQ ID NO: 103079 - RNA, 22 nt, Human
gagaaaaauuucuuugcugcac

SEQ ID NO: 103080 - RNA, 21 nt, Human
gggagccucauuuucuucauc

SEQ ID NO: 103081 - RNA, 23 nt, Human
ucugccuccuaauuguugguguc

SEQ ID NO: 103082 - RNA, 22 nt, Human
uuuaaaacagcauuuaaaaggu

SEQ ID NO: 103083 - RNA, 22 nt, Human
cuuuccaugucuucuuucucca

SEQ ID NO: 103084 - RNA, 22 nt, Human
ugcccacuucaaaaucuucauu

SEQ ID NO: 103085 - RNA, 22 nt, Human
ugcucacugcuuguguucaguu

SEQ ID NO: 103086 - RNA, 22 nt, Human
auagaaauagacaaugcaaaga

SEQ ID NO: 103087 - RNA, 22 nt, Human
ugagucuguugcuagggggaau

SEQ ID NO: 103088 - RNA, 22 nt, Human
uauguggcaggugggagaucag

SEQ ID NO: 103089 - RNA, 22 nt, Human
uuacuuaucugaugugauuuuu

SEQ ID NO: 103090 - RNA, 22 nt, Human
cuguguguauaauguuugauaa

SEQ ID NO: 103091 - RNA, 22 nt, Human
ugaggcaguucuuacuuguauu

SEQ ID NO: 103092 - RNA, 22 nt, Human
gcccagacaucuguugggaccu

SEQ ID NO: 103093 - RNA, 17 nt, Human
ugucuuuuuccuccucc

SEQ ID NO: 103094 - RNA, 22 nt, Human
auuuauuuucccucaaguaccu

SEQ ID NO: 103095 - RNA, 22 nt, Human
uguguuguuuggggauguccau

SEQ ID NO: 103096 - RNA, 22 nt, Human
ggaucccaucgagcuggcuguc

SEQ ID NO: 103097 - RNA, 22 nt, Human
uccuuuauuuaugggcagugua

SEQ ID NO: 103098 - RNA, 22 nt, Human
agggaugugcagggcuugccau

SEQ ID NO: 103099 - RNA, 22 nt, Human
cuccuagagcacaaaaggccau

SEQ ID NO: 103100 - RNA, 20 nt, Human
uuguacuuaugugagaagga

SEQ ID NO: 103101 - RNA, 22 nt, Human
cauguguauuauucuuguggaa

SEQ ID NO: 103102 - RNA, 22 nt, Human
ugaauuuuggcaauuuucugug

SEQ ID NO: 103103 - RNA, 22 nt, Human
uuuuccuucuuccugccuugcc

SEQ ID NO: 103104 - RNA, 22 nt, Human
aggccccacaaacucgccuuug

SEQ ID NO: 103105 - RNA, 22 nt, Human
aucaaaauguguagucuugauc

SEQ ID NO: 103106 - RNA, 22 nt, Human
uuacuuuuuucccccuuagaug

SEQ ID NO: 103107 - RNA, 22 nt, Human
uaggauugguguauguagguuu

SEQ ID NO: 103108 - RNA, 22 nt, Human
ucuugccuuuucuagcuucuag

SEQ ID NO: 103109 - RNA, 22 nt, Human
ugaggaagugguuguaugguuu

SEQ ID NO: 103110 - RNA, 22 nt, Human
agauggaguccugaagccagaa

SEQ ID NO: 103111 - RNA, 22 nt, Human
cucucugcugucuuucgggaaa

SEQ ID NO: 103112 - RNA, 22 nt, Human
auuaaacuaaauuaugaauugg

SEQ ID NO: 103113 - RNA, 22 nt, Human
guuuuauguuuuauagacacaa

SEQ ID NO: 103114 - RNA, 20 nt, Human
gaauucugaagauaauuugg

SEQ ID NO: 103115 - RNA, 22 nt, Human
ugagguauuuggauuuauauuu

SEQ ID NO: 103116 - RNA, 22 nt, Human
gcuagcugugcuuggaaguuug

SEQ ID NO: 103117 - RNA, 22 nt, Human
aacgagcugggggggccggggg

SEQ ID NO: 103118 - RNA, 22 nt, Human
caaggaaaugucagaaaggcaa

SEQ ID NO: 103119 - RNA, 22 nt, Human
uugcuuucuuuguagguuuucc

SEQ ID NO: 103120 - RNA, 22 nt, Human
acgugugugugcacguguguau

SEQ ID NO: 103121 - RNA, 22 nt, Human
cggggcuggcguuagggaggca

SEQ ID NO: 103122 - RNA, 20 nt, Human
cauuccaugcaucuuggucc

SEQ ID NO: 103123 - RNA, 22 nt, Human
uucauaugaauuggguuuuuuu

SEQ ID NO: 103124 - RNA, 21 nt, Human
auuauagugacuaaauugaua

SEQ ID NO: 103125 - RNA, 22 nt, Human
gagccggggcucccugaggucc

SEQ ID NO: 103126 - RNA, 22 nt, Human
uccaggucgggggugggccggc

SEQ ID NO: 103127 - RNA, 20 nt, Human
uaguggaccuugaaggccuc

SEQ ID NO: 103128 - RNA, 22 nt, Human
uagcauuucacugaucuucacu

SEQ ID NO: 103129 - RNA, 22 nt, Human
caguagcuuuuugcagacaaga

SEQ ID NO: 103130 - RNA, 22 nt, Human
gggagguaaugggggugcaggg

SEQ ID NO: 103131 - RNA, 22 nt, Human
aaaauaauauuauaccacugcu

SEQ ID NO: 103132 - RNA, 22 nt, Human
ggacuggugaagccuucggaga

SEQ ID NO: 103133 - RNA, 22 nt, Human
uucaaacaguguagaauauaug

SEQ ID NO: 103134 - RNA, 22 nt, Human
uucugcuagugguauauguuga

SEQ ID NO: 103135 - RNA, 22 nt, Human
uuucagaaauggcacugaaauc

SEQ ID NO: 103136 - RNA, 22 nt, Human
uggcucagcgcggccuggucuu

SEQ ID NO: 103137 - RNA, 22 nt, Human
cauccagcuccugggggccacc

SEQ ID NO: 103138 - RNA, 22 nt, Human
ugucuaaggaaaaagucuauuu

SEQ ID NO: 103139 - RNA, 22 nt, Human
ggcugggaggcggaggcugaga

SEQ ID NO: 103140 - RNA, 22 nt, Human
uguuggaaucuucuagucuucc

SEQ ID NO: 103141 - RNA, 22 nt, Human
uuuucaauuuucauuugcaaga

SEQ ID NO: 103142 - RNA, 22 nt, Human
uugaauaaggcauaaagauacu

SEQ ID NO: 103143 - RNA, 22 nt, Human
augcggcugugggggaauggga

SEQ ID NO: 103144 - RNA, 22 nt, Human
aagaaaccauauuaguuccugg

SEQ ID NO: 103145 - RNA, 22 nt, Human
uguuugaggugacucuggaaug

SEQ ID NO: 103146 - RNA, 22 nt, Human
ucaaauaugggccagaggaaau

SEQ ID NO: 103147 - RNA, 19 nt, Human
auguuuccauuucuggaua

SEQ ID NO: 103148 - RNA, 22 nt, Human
cuaaaccaauauauuuucuucc

SEQ ID NO: 103149 - RNA, 22 nt, Human
ggagagaacguaaucuaguauu

SEQ ID NO: 103150 - RNA, 22 nt, Human
aagaugaguuacaaaggaguaa

SEQ ID NO: 103151 - RNA, 22 nt, Human
ccaaggcuguggggcugugcag

SEQ ID NO: 103152 - RNA, 22 nt, Human
gaggggaauguuccugagcugg

SEQ ID NO: 103153 - RNA, 22 nt, Human
aauaagaguuaagaaguauauu

SEQ ID NO: 103154 - RNA, 22 nt, Human
cacccccaggcuccccuucugg

SEQ ID NO: 103155 - RNA, 22 nt, Human
agggaaauaggagaagaaagga

SEQ ID NO: 103156 - RNA, 22 nt, Human
caaaucuguuaauuucaaguug

SEQ ID NO: 103157 - RNA, 20 nt, Human
cccuggcuggcaucuggacu

SEQ ID NO: 103158 - RNA, 22 nt, Human
uuccgcuuucaauggcuuggcu

SEQ ID NO: 103159 - RNA, 22 nt, Human
ggaggaugaggguggugguguu

SEQ ID NO: 103160 - RNA, 22 nt, Human
aggcaggauuugcgaugugguu

SEQ ID NO: 103161 - RNA, 22 nt, Human
ucccaaguguuuggcgaggaga

SEQ ID NO: 103162 - RNA, 22 nt, Human
aacucaggagagaguaacaggg

SEQ ID NO: 103163 - RNA, 22 nt, Human
aaauauuugaaugguguaagau

SEQ ID NO: 103164 - RNA, 22 nt, Human
gcccagccucagggcaucagcu

SEQ ID NO: 103165 - RNA, 22 nt, Human
aucaugggauagugggacgagc

SEQ ID NO: 103166 - RNA, 22 nt, Human
acugucuuguuguaugugagcu

SEQ ID NO: 103167 - RNA, 22 nt, Human
uacugcaguuccugcugucucc

SEQ ID NO: 103168 - RNA, 22 nt, Human
aaauauuagacauaccuggaga

SEQ ID NO: 103169 - RNA, 22 nt, Human
uaugucuauugacuuaggauuu

SEQ ID NO: 103170 - RNA, 18 nt, Human
cccagaggaaugccugga

SEQ ID NO: 103171 - RNA, 22 nt, Human
aucauguauauuuuugcuauua

SEQ ID NO: 103172 - RNA, 22 nt, Human
uuguuuuaguagaaguuacaug

SEQ ID NO: 103173 - RNA, 22 nt, Human
ucuccucucugaucuugcuccg

SEQ ID NO: 103174 - RNA, 21 nt, Human
aucagaaucucuagauuugga

SEQ ID NO: 103175 - RNA, 22 nt, Human
cacacgagcccuggagccagca

SEQ ID NO: 103176 - RNA, 22 nt, Human
ugggggaggaggagacagacug

SEQ ID NO: 103177 - RNA, 22 nt, Human
ggcaaggaagaaagcagaaguu

SEQ ID NO: 103178 - RNA, 22 nt, Human
uuggugaugcccaccuuuucau

SEQ ID NO: 103179 - RNA, 22 nt, Human
uaguuucuucaacugucccagc

SEQ ID NO: 103180 - RNA, 22 nt, Human
cucuuucauucuguccuuguuu

SEQ ID NO: 103181 - RNA, 22 nt, Human
ccgccccaggcccugagccaag

SEQ ID NO: 103182 - RNA, 22 nt, Human
gcauaauauugagaaauuauua

SEQ ID NO: 103183 - RNA, 22 nt, Human
cuccucccagcccaggcgccac

SEQ ID NO: 103184 - RNA, 22 nt, Human
uccuccuggagacuuucucucu

SEQ ID NO: 103185 - RNA, 22 nt, Human
ggaggaagagaccagggggcuu

SEQ ID NO: 103186 - RNA, 22 nt, Human
cauguggaaaugcaugcuuuuu

SEQ ID NO: 103187 - RNA, 22 nt, Human
uaauuccacacucccgcaagcg

SEQ ID NO: 103188 - RNA, 22 nt, Human
gagccucaggguuuuguugaca

SEQ ID NO: 103189 - RNA, 22 nt, Human
uauuuuagccaacagaaugaug

SEQ ID NO: 103190 - RNA, 22 nt, Human
gagaagguggaccugaaggagc

SEQ ID NO: 103191 - RNA, 22 nt, Human
cagaccuggaaaacaggcuugc

SEQ ID NO: 103192 - RNA, 22 nt, Human
cugggaaucuagagggcucauu

SEQ ID NO: 103193 - RNA, 22 nt, Human
uacaaaauucaaauaauguuug

SEQ ID NO: 103194 - RNA, 22 nt, Human
agauaaaucauuuauuaagcgg

SEQ ID NO: 103195 - RNA, 22 nt, Human
uucauuagcacauuuccuuggu

SEQ ID NO: 103196 - RNA, 22 nt, Human
ucagcucacaauguugagaaag

SEQ ID NO: 103197 - RNA, 22 nt, Human
uuuuagagacagcauggagaaa

SEQ ID NO: 103198 - RNA, 22 nt, Human
aaauuuuguugaaaaauauuuu

SEQ ID NO: 103199 - RNA, 22 nt, Human
ucucuagaggaauuguucuagg

SEQ ID NO: 103200 - RNA, 22 nt, Human
auuuuagagaaacaaacguagg

SEQ ID NO: 103201 - RNA, 22 nt, Human
aaaugcuuuaauugaguucaug

SEQ ID NO: 103202 - RNA, 22 nt, Human
cugaggaguaguucuggaggac

SEQ ID NO: 103203 - RNA, 22 nt, Human
gugugucucaguugcuccgaag

SEQ ID NO: 103204 - RNA, 17 nt, Human
ugguucuuuuccugacc

SEQ ID NO: 103205 - RNA, 22 nt, Human
gauuucuucauuuaaaaauauu

SEQ ID NO: 103206 - RNA, 22 nt, Human
augaagguggacagauuuuuuu

SEQ ID NO: 103207 - RNA, 22 nt, Human
uucacugugauugggguggauu

SEQ ID NO: 103208 - RNA, 22 nt, Human
augcuuucucuucuauuucuca

SEQ ID NO: 103209 - RNA, 22 nt, Human
ugccagcuccgaggagcugcag

SEQ ID NO: 103210 - RNA, 22 nt, Human
auaaaucaagggcaguauuucc

SEQ ID NO: 103211 - RNA, 22 nt, Human
cccauggaaggguuggcccaga

SEQ ID NO: 103212 - RNA, 22 nt, Human
uuuuccuuagaaauacauugau

SEQ ID NO: 103213 - RNA, 22 nt, Human
ugggagagauaggcuucuggac

SEQ ID NO: 103214 - RNA, 20 nt, Human
ucagugggaaagugagagug

SEQ ID NO: 103215 - RNA, 22 nt, Human
uguuuccuaagugucucugaag

SEQ ID NO: 103216 - RNA, 22 nt, Human
aaaauauguugagauacugaaa

SEQ ID NO: 103217 - RNA, 22 nt, Human
auguguuuugaccccugcuaaa

SEQ ID NO: 103218 - RNA, 22 nt, Human
ucugggccaacccuuccauggg

SEQ ID NO: 103219 - RNA, 21 nt, Human
agaugaggauacugaggccua

SEQ ID NO: 103220 - RNA, 22 nt, Human
gcacuguauuuaaauauuuaaa

SEQ ID NO: 103221 - RNA, 22 nt, Human
uggcuugagcugggcccaccug

SEQ ID NO: 103222 - RNA, 22 nt, Human
ucugcgggccuggcucccagcg

SEQ ID NO: 103223 - RNA, 22 nt, Human
ccagggcuggaccagugcuugg

SEQ ID NO: 103224 - RNA, 22 nt, Human
gggagcucaccaugcucugcau

SEQ ID NO: 103225 - RNA, 22 nt, Human
ugcuuucaaaacucagaggaau

SEQ ID NO: 103226 - RNA, 22 nt, Human
aagugaaaaaagucaguacuga

SEQ ID NO: 103227 - RNA, 22 nt, Human
cuugccaguguugcagaagcuc

SEQ ID NO: 103228 - RNA, 22 nt, Human
aaggcugaccaguuuacacuuu

SEQ ID NO: 103229 - RNA, 22 nt, Human
cucaaagcagacuuuucccuuu

SEQ ID NO: 103230 - RNA, 20 nt, Human
ucacuguaauugccuacauu

SEQ ID NO: 103231 - RNA, 22 nt, Human
uggcucaguaaucgagucuccu

SEQ ID NO: 103232 - RNA, 22 nt, Human
gggagggucugagagcugcacc

SEQ ID NO: 103233 - RNA, 22 nt, Human
ucugcaugccucaggaggccug

SEQ ID NO: 103234 - RNA, 22 nt, Human
gccugccucugacuggggcuga

SEQ ID NO: 103235 - RNA, 22 nt, Human
uggugcccguggaaagagggag

SEQ ID NO: 103236 - RNA, 22 nt, Human
cacagcuggggaagcugaggcc

SEQ ID NO: 103237 - RNA, 22 nt, Human
uuuacuguuuacagcuaaugca

SEQ ID NO: 103238 - RNA, 22 nt, Human
ucauuguuuacugucuuuuuuc

SEQ ID NO: 103239 - RNA, 22 nt, Human
uggggcuggccaggaggagucu

SEQ ID NO: 103240 - RNA, 22 nt, Human
gguagacugagcuccuugagga

SEQ ID NO: 103241 - RNA, 22 nt, Human
cuccuuuuccuacucauacuau

SEQ ID NO: 103242 - RNA, 22 nt, Human
gggauggggagcuggaaagggg

SEQ ID NO: 103243 - RNA, 22 nt, Human
cugguacuggaggaguucagag

SEQ ID NO: 103244 - RNA, 22 nt, Human
ggcugugaaguacguugaaggu

SEQ ID NO: 103245 - RNA, 22 nt, Human
augccucuugagagccagugcu

SEQ ID NO: 103246 - RNA, 22 nt, Human
auuuuacuaugauaguugagaa

SEQ ID NO: 103247 - RNA, 22 nt, Human
cuccuuugagcaaaucuuugau

SEQ ID NO: 103248 - RNA, 22 nt, Human
aaauauagugacacuuauaguc

SEQ ID NO: 103249 - RNA, 20 nt, Human
ugauuauuccaacaagaaug

SEQ ID NO: 103250 - RNA, 22 nt, Human
ggcagguccugaguccugaggc

SEQ ID NO: 103251 - RNA, 22 nt, Human
uuuuuuuaaguuuugauuuuag

SEQ ID NO: 103252 - RNA, 22 nt, Human
uaagggagcagaagcugugaaa

SEQ ID NO: 103253 - RNA, 22 nt, Human
auaaaaauguuuuuguguggua

SEQ ID NO: 103254 - RNA, 22 nt, Human
ggcugcagggaacaggaugggu

SEQ ID NO: 103255 - RNA, 21 nt, Human
ugagcccaaagcuguauuggu

SEQ ID NO: 103256 - RNA, 22 nt, Human
ccagcugggucccugcuggggc

SEQ ID NO: 103257 - RNA, 22 nt, Human
uggaaauagauguaggaaauug

SEQ ID NO: 103258 - RNA, 22 nt, Human
cagcuccagcccaggcagcucc

SEQ ID NO: 103259 - RNA, 22 nt, Human
cacauuuuccagaagaaucaga

SEQ ID NO: 103260 - RNA, 22 nt, Human
aucucacuucugucauguggca

SEQ ID NO: 103261 - RNA, 22 nt, Human
ugcagaggagcuggaaggcugg

SEQ ID NO: 103262 - RNA, 22 nt, Human
acaugugugucugugugugugu

SEQ ID NO: 103263 - RNA, 22 nt, Human
uuaucaaaaaauaguacuuuga

SEQ ID NO: 103264 - RNA, 22 nt, Human
gcccauggagaccucaggcugg

SEQ ID NO: 103265 - RNA, 22 nt, Human
acauaaauagcacugugaauuu

SEQ ID NO: 103266 - RNA, 22 nt, Human
gaagcuccaggaugccugcacu

SEQ ID NO: 103267 - RNA, 22 nt, Human
guccccugcguguucauccugg

SEQ ID NO: 103268 - RNA, 22 nt, Human
uuuuggauugcuaacucagggu

SEQ ID NO: 103269 - RNA, 22 nt, Human
ucauugugugugcuucuugggc

SEQ ID NO: 103270 - RNA, 22 nt, Human
ugcauucugaacguaaauguga

SEQ ID NO: 103271 - RNA, 22 nt, Human
cacauuaagcccaagcauagaa

SEQ ID NO: 103272 - RNA, 22 nt, Human
ucuugccccugcuuuggaacaa

SEQ ID NO: 103273 - RNA, 22 nt, Human
agacacagcaauaacuacuguu

SEQ ID NO: 103274 - RNA, 22 nt, Human
ugcugcacuuauggcucugagg

SEQ ID NO: 103275 - RNA, 22 nt, Human
uguaaauucuauacacuuaaaa

SEQ ID NO: 103276 - RNA, 22 nt, Human
gaggcuugccacuguccauggc

SEQ ID NO: 103277 - RNA, 22 nt, Human
ucucucugcuguccagcguuau

SEQ ID NO: 103278 - RNA, 22 nt, Human
uggggagacauggaguaaaaga

SEQ ID NO: 103279 - RNA, 22 nt, Human
uuggaagagagauggggagaga

SEQ ID NO: 103280 - RNA, 22 nt, Human
ucuggcaguugccgcuucaguc

SEQ ID NO: 103281 - RNA, 22 nt, Human
caaauguuugguggcauuuugu

SEQ ID NO: 103282 - RNA, 22 nt, Human
uauuuuaaaagcauuaauucuu

SEQ ID NO: 103283 - RNA, 19 nt, Human
cuuguggcuaugcagauac

SEQ ID NO: 103284 - RNA, 22 nt, Human
uagucucagaauauuugcugau

SEQ ID NO: 103285 - RNA, 22 nt, Human
uacaagcucuuguagggggaaa

SEQ ID NO: 103286 - RNA, 22 nt, Human
gcucagccuuuuguucuauuca

SEQ ID NO: 103287 - RNA, 22 nt, Human
ggcagguggcacugcugcuccc

SEQ ID NO: 103288 - RNA, 22 nt, Human
auccuccuuugcccugagauca

SEQ ID NO: 103289 - RNA, 22 nt, Human
uuuaaauuucugaaucuugagg

SEQ ID NO: 103290 - RNA, 22 nt, Human
ggcugcuauuggucuggcuugg

SEQ ID NO: 103291 - RNA, 22 nt, Human
acugcagauccucugagaaacc

SEQ ID NO: 103292 - RNA, 22 nt, Human
cucugcuuguaucacauuugcu

SEQ ID NO: 103293 - RNA, 22 nt, Human
cgguuuuuaaaagucucuucua

SEQ ID NO: 103294 - RNA, 22 nt, Human
cacauguguaccugccucucug

SEQ ID NO: 103295 - RNA, 22 nt, Human
uucaaaaugcagaauaguuugg

SEQ ID NO: 103296 - RNA, 22 nt, Human
agggcaguuuuacugaaaggug

SEQ ID NO: 103297 - RNA, 22 nt, Human
guggggguaggggguuuucugg

SEQ ID NO: 103298 - RNA, 23 nt, Human
uuucugaguuuuuuaaaagucca

SEQ ID NO: 103299 - RNA, 22 nt, Human
ucccuucccaccccugccuuuu

SEQ ID NO: 103300 - RNA, 22 nt, Human
ggaaggggagcuggaaagggua

SEQ ID NO: 103301 - RNA, 22 nt, Human
uucuaauauuaugauuucuaag

SEQ ID NO: 103302 - RNA, 22 nt, Human
uaugaauauaccacaauuuagg

SEQ ID NO: 103303 - RNA, 22 nt, Human
aucacuagaguuacauugccag

SEQ ID NO: 103304 - RNA, 22 nt, Human
guggggguaggggguuuccugg

SEQ ID NO: 103305 - RNA, 22 nt, Human
aggaagccuggaguccugccca

SEQ ID NO: 103306 - RNA, 22 nt, Human
ggagacagugacuuagagacug

SEQ ID NO: 103307 - RNA, 22 nt, Human
auguuuucuugucuggagaagu

SEQ ID NO: 103308 - RNA, 22 nt, Human
ccuuuccuggaaaugguaaguu

SEQ ID NO: 103309 - RNA, 22 nt, Human
aucuaaaacuacgaauacuacc

SEQ ID NO: 103310 - RNA, 22 nt, Human
cagauaagcuauaaguaguacc

SEQ ID NO: 103311 - RNA, 22 nt, Human
uuuuuugucuugaagaaauggu

SEQ ID NO: 103312 - RNA, 22 nt, Human
cuccagcucgcgagcucugcuc

SEQ ID NO: 103313 - RNA, 22 nt, Human
aggggaggggaguaucaggauu

SEQ ID NO: 103314 - RNA, 22 nt, Human
auuuuuagucuugcugcaauca

SEQ ID NO: 103315 - RNA, 22 nt, Human
aguauuuuaaaauacauuaucc

SEQ ID NO: 103316 - RNA, 22 nt, Human
aaugcuuuuugcgaaaugugca

SEQ ID NO: 103317 - RNA, 22 nt, Human
uggcaagcuguuggcagauagc

SEQ ID NO: 103318 - RNA, 22 nt, Human
cggcugcagcggagcaggcugg

SEQ ID NO: 103319 - RNA, 22 nt, Human
uagacugugagcuccuugaggg

SEQ ID NO: 103320 - RNA, 18 nt, Human
aguuuuuuuggcaaaagg

SEQ ID NO: 103321 - RNA, 22 nt, Human
cagggcagaguuaagaugcugg

SEQ ID NO: 103322 - RNA, 21 nt, Human
ggcugcucgugaugaacuuca

SEQ ID NO: 103323 - RNA, 22 nt, Human
ugcuuucagauaucuguuucaa

SEQ ID NO: 103324 - RNA, 22 nt, Human
agugccuggcugauggguccug

SEQ ID NO: 103325 - RNA, 22 nt, Human
uaguuucuaauguugaaauuau

SEQ ID NO: 103326 - RNA, 19 nt, Human
uuccuuucuauccugggua

SEQ ID NO: 103327 - RNA, 22 nt, Human
cccuguccuucccuccaucuga

SEQ ID NO: 103328 - RNA, 22 nt, Human
agcuugagauaauucaagcuga

SEQ ID NO: 103329 - RNA, 22 nt, Human
gcuuucagggucacugucaaca

SEQ ID NO: 103330 - RNA, 22 nt, Human
ugguuuuuuguaggauaaacau

SEQ ID NO: 103331 - RNA, 22 nt, Human
uaaaacuaugcaaccuacuacc

SEQ ID NO: 103332 - RNA, 22 nt, Human
uuucacugaguaggagagcacu

SEQ ID NO: 103333 - RNA, 22 nt, Human
cucacugucagcugcagggcuu

SEQ ID NO: 103334 - RNA, 22 nt, Human
auacauauaugcacauuaauau

SEQ ID NO: 103335 - RNA, 22 nt, Human
gagcagcucgagaaggaagcag

SEQ ID NO: 103336 - RNA, 22 nt, Human
ugugugcuaguuuugucaguau

SEQ ID NO: 103337 - RNA, 22 nt, Human
ggcuguggcagcuggaaguggu

SEQ ID NO: 103338 - RNA, 22 nt, Human
cuaaauucuauauccuugcuuc

SEQ ID NO: 103339 - RNA, 22 nt, Human
uauauacacgcacauauacaua

SEQ ID NO: 103340 - RNA, 22 nt, Human
cucuguguguuugugugugugu

SEQ ID NO: 103341 - RNA, 22 nt, Human
caggcacagcuaagacuggcca

SEQ ID NO: 103342 - RNA, 22 nt, Human
guggaguggguuguacucaggg

SEQ ID NO: 103343 - RNA, 22 nt, Human
uuuuugaauaagugcaucauca

SEQ ID NO: 103344 - RNA, 22 nt, Human
gcuguugugaggaucagcauau

SEQ ID NO: 103345 - RNA, 22 nt, Human
auugaaauuugcuuccucacug

SEQ ID NO: 103346 - RNA, 22 nt, Human
ugggaagcugagccucgaugug

SEQ ID NO: 103347 - RNA, 22 nt, Human
cggggcuccgaagagcucgguu

SEQ ID NO: 103348 - RNA, 22 nt, Human
gcuucuguuaggauguggcuua

SEQ ID NO: 103349 - RNA, 22 nt, Human
ggcagggaauucagagggaagg

SEQ ID NO: 103350 - RNA, 19 nt, Human
gauauugagcugagaauuc

SEQ ID NO: 103351 - RNA, 22 nt, Human
aggauagacuucagaaggcaua

SEQ ID NO: 103352 - RNA, 23 nt, Human
uggaaguugagagucugcuuugu

SEQ ID NO: 103353 - RNA, 22 nt, Human
ccuaggcuggcugucuucaggu

SEQ ID NO: 103354 - RNA, 22 nt, Human
ugcuuggagaaucagucccagc

SEQ ID NO: 103355 - RNA, 22 nt, Human
agagacaggguuuugucguguu

SEQ ID NO: 103356 - RNA, 22 nt, Human
aggcauauaguguuuaaaaaaa

SEQ ID NO: 103357 - RNA, 22 nt, Human
uuauauuuuauuuaauuaaaua

SEQ ID NO: 103358 - RNA, 22 nt, Human
uuauaguuuucaaggauuggag

SEQ ID NO: 103359 - RNA, 22 nt, Human
agggcucacuacaacccuggga

SEQ ID NO: 103360 - RNA, 22 nt, Human
auaaaagcacaauagaguuaug

SEQ ID NO: 103361 - RNA, 22 nt, Human
cagagccagcuguccuuggcau

SEQ ID NO: 103362 - RNA, 22 nt, Human
acauuucuccuacuuguuauuu

SEQ ID NO: 103363 - RNA, 22 nt, Human
auaaauucuaugauggauuggg

SEQ ID NO: 103364 - RNA, 22 nt, Human
uguacauacauagauauacaca

SEQ ID NO: 103365 - RNA, 22 nt, Human
uuuuauaauacccuugacuaau

SEQ ID NO: 103366 - RNA, 22 nt, Human
ugggaaggggagcuggaaagga

SEQ ID NO: 103367 - RNA, 22 nt, Human
agcugugaccuucaagagcuac

SEQ ID NO: 103368 - RNA, 22 nt, Human
cugggacccagcccaagucuuu

SEQ ID NO: 103369 - RNA, 22 nt, Human
uauuuguauugucuuaucacuu

SEQ ID NO: 103370 - RNA, 22 nt, Human
cacacacacacacacucucaca

SEQ ID NO: 103371 - RNA, 22 nt, Human
uggaugccuugggggaggagga

SEQ ID NO: 103372 - RNA, 20 nt, Human
aggggcuguaguuagaugac

SEQ ID NO: 103373 - RNA, 22 nt, Human
aggccaggcgccggcgcgagac

SEQ ID NO: 103374 - RNA, 22 nt, Human
uaggggguuuuucuagagauug

SEQ ID NO: 103375 - RNA, 22 nt, Human
agauaaacaacucuuagcuguu

SEQ ID NO: 103376 - RNA, 22 nt, Human
agcgcucauuuuccuccugcuc

SEQ ID NO: 103377 - RNA, 22 nt, Human
uuuuauuuguauguugaaugua

SEQ ID NO: 103378 - RNA, 22 nt, Human
uuuauuugggauuucucaucug

SEQ ID NO: 103379 - RNA, 22 nt, Human
aaggggaauaguaggaccuggg

SEQ ID NO: 103380 - RNA, 22 nt, Human
ugguggcuuuucguagguucac

SEQ ID NO: 103381 - RNA, 22 nt, Human
aaaucauagccaugaacauuug

SEQ ID NO: 103382 - RNA, 22 nt, Human
cuuacauuuguuuaguguuucc

SEQ ID NO: 103383 - RNA, 22 nt, Human
gguaccuggcccuggggcugcu

SEQ ID NO: 103384 - RNA, 22 nt, Human
auccugugggguauugcugcau

SEQ ID NO: 103385 - RNA, 22 nt, Human
ucugggaccuagacccauuguu

SEQ ID NO: 103386 - RNA, 22 nt, Human
ugugucuuuggcgaugucugga

SEQ ID NO: 103387 - RNA, 22 nt, Human
guacauauccuuuacguuuugu

SEQ ID NO: 103388 - RNA, 22 nt, Human
acauauaugugcauacaacuau

SEQ ID NO: 103389 - RNA, 22 nt, Human
aaugaauaaauuuuaaagacag

SEQ ID NO: 103390 - RNA, 22 nt, Human
agagaacaggcagcuggugccg

SEQ ID NO: 103391 - RNA, 22 nt, Human
agaucugucaccauccuggagc

SEQ ID NO: 103392 - RNA, 22 nt, Human
uggcucacaggaggcagaggug

SEQ ID NO: 103393 - RNA, 22 nt, Human
ccuuucuaacagauuguggauc

SEQ ID NO: 103394 - RNA, 22 nt, Human
ggugugaauagagccuggagca

SEQ ID NO: 103395 - RNA, 22 nt, Human
ucuugugagcugagauaaagcc

SEQ ID NO: 103396 - RNA, 22 nt, Human
uuauuugcccauguuuagcaga

SEQ ID NO: 103397 - RNA, 19 nt, Human
cccagaggaaugccuggaa

SEQ ID NO: 103398 - RNA, 19 nt, Human
cagagacuguaacacuuuu

SEQ ID NO: 103399 - RNA, 22 nt, Human
uuguuuucuaguguuuugaaua

SEQ ID NO: 103400 - RNA, 22 nt, Human
gcaggucacagcugauuggcca

SEQ ID NO: 103401 - RNA, 22 nt, Human
uguuuuuucccccccuucuaaa

SEQ ID NO: 103402 - RNA, 20 nt, Human
ccugggcuccaggagccccg

SEQ ID NO: 103403 - RNA, 22 nt, Human
gucuccuucauuuacuguuucc

SEQ ID NO: 103404 - RNA, 22 nt, Human
cagcuggggagagacauggcag

SEQ ID NO: 103405 - RNA, 22 nt, Human
cucaagugacucagccugguug

SEQ ID NO: 103406 - RNA, 22 nt, Human
uucuagcucauggugacagauc

SEQ ID NO: 103407 - RNA, 20 nt, Human
uucacagaucucuaacugag

SEQ ID NO: 103408 - RNA, 22 nt, Human
gaggcucagagggacuuucaag

SEQ ID NO: 103409 - RNA, 22 nt, Human
uuuuccuuccugucucuuuauu

SEQ ID NO: 103410 - RNA, 22 nt, Human
cgcugcagcggcugagucccgc

SEQ ID NO: 103411 - RNA, 22 nt, Human
ucccugcugggcgaucuucucu

SEQ ID NO: 103412 - RNA, 22 nt, Human
aaggcuguuugagcacuggagc

SEQ ID NO: 103413 - RNA, 22 nt, Human
aggcagagaggucuuccuggaa

SEQ ID NO: 103414 - RNA, 22 nt, Human
ugggagagaagcugaggcaggg

SEQ ID NO: 103415 - RNA, 22 nt, Human
auauaguacauguauauauaua

SEQ ID NO: 103416 - RNA, 22 nt, Human
ucugaccccccuugccuccacu

SEQ ID NO: 103417 - RNA, 19 nt, Human
agagucuccacuccacuug

SEQ ID NO: 103418 - RNA, 22 nt, Human
aguuuccacuggagacacugug

SEQ ID NO: 103419 - RNA, 22 nt, Human
uuauuuuauaaagagaagacuu

SEQ ID NO: 103420 - RNA, 22 nt, Human
aacagaauaucaaaagauuaug

SEQ ID NO: 103421 - RNA, 22 nt, Human
agcaaggguugguuuucugaca

SEQ ID NO: 103422 - RNA, 22 nt, Human
aaauucuuccaggaggaaauac

SEQ ID NO: 103423 - RNA, 22 nt, Human
uuauuucaggcauuuguaaaug

SEQ ID NO: 103424 - RNA, 22 nt, Human
ugucuuuuaaaaauguguaaaa

SEQ ID NO: 103425 - RNA, 22 nt, Human
uuugaagaaacagucuuaagag

SEQ ID NO: 103426 - RNA, 22 nt, Human
ggacggggagcuggaaagggga

SEQ ID NO: 103427 - RNA, 22 nt, Human
agagauacugcaggccauaaau

SEQ ID NO: 103428 - RNA, 21 nt, Human
cuuugccuccagcagccgcag

SEQ ID NO: 103429 - RNA, 20 nt, Human
acacagccuagaguuuggcu

SEQ ID NO: 103430 - RNA, 22 nt, Human
auguguguaugacugaaucuau

SEQ ID NO: 103431 - RNA, 22 nt, Human
gaggcagaggaugggacuguau

SEQ ID NO: 103432 - RNA, 22 nt, Human
uccaggucauucucuccgaccg

SEQ ID NO: 103433 - RNA, 23 nt, Human
aggcugcagaagaauagggucau

SEQ ID NO: 103434 - RNA, 22 nt, Human
augcaaaaucuuauuuuuucua

SEQ ID NO: 103435 - RNA, 22 nt, Human
uggagagauagucauucuagag

SEQ ID NO: 103436 - RNA, 22 nt, Human
uacauuugauuuuugcuucuuu

SEQ ID NO: 103437 - RNA, 22 nt, Human
uauuuuuuuaacauuuauugua

SEQ ID NO: 103438 - RNA, 22 nt, Human
ggaguuucugucaucccguccc

SEQ ID NO: 103439 - RNA, 22 nt, Human
auggagguuugucugguuuugu

SEQ ID NO: 103440 - RNA, 22 nt, Human
guuuuucuuugauuuagaacca

SEQ ID NO: 103441 - RNA, 22 nt, Human
cuguuaauugugaauuuuacau

SEQ ID NO: 103442 - RNA, 22 nt, Human
ggcagagcugugcgcccaccca

SEQ ID NO: 103443 - RNA, 22 nt, Human
ucauuauuuugauguauuuccu

SEQ ID NO: 103444 - RNA, 21 nt, Human
uggcaggcagcuggaagcuug

SEQ ID NO: 103445 - RNA, 22 nt, Human
uggaagugggcaucaccaucca

SEQ ID NO: 103446 - RNA, 22 nt, Human
aagagaaaugcuuuaacuuuau

SEQ ID NO: 103447 - RNA, 22 nt, Human
aaccaggcgagagagcggucag

SEQ ID NO: 103448 - RNA, 22 nt, Human
caauggagccaagaggaggaaa

SEQ ID NO: 103449 - RNA, 22 nt, Human
uuucuaaaaccagaguuuauaa

SEQ ID NO: 103450 - RNA, 22 nt, Human
acuuccuuccagcaaauggcau

SEQ ID NO: 103451 - RNA, 22 nt, Human
agugaggggagaaugaggugga

SEQ ID NO: 103452 - RNA, 22 nt, Human
ggcagaggagcuggaaacaugg

SEQ ID NO: 103453 - RNA, 22 nt, Human
ccauggaaaagacgggcaggcc

SEQ ID NO: 103454 - RNA, 22 nt, Human
cucagaauugucaccucaaaaa

SEQ ID NO: 103455 - RNA, 22 nt, Human
gacauuuauuggauuuuacgag

SEQ ID NO: 103456 - RNA, 22 nt, Human
gaguucuagauguauuauuaau

SEQ ID NO: 103457 - RNA, 22 nt, Human
uuuagaguucuaaggacggguu

SEQ ID NO: 103458 - RNA, 22 nt, Human
aggucuugcggaagauauggcu

SEQ ID NO: 103459 - RNA, 22 nt, Human
uuaggggcuuaggcagaguuug

SEQ ID NO: 103460 - RNA, 22 nt, Human
aggggagggcuggccuuuggau

SEQ ID NO: 103461 - RNA, 22 nt, Human
ugcugcacccuucauuuuccca

SEQ ID NO: 103462 - RNA, 22 nt, Human
agcagggagacagugcagcauu

SEQ ID NO: 103463 - RNA, 22 nt, Human
guguucucagcacccacuucau

SEQ ID NO: 103464 - RNA, 22 nt, Human
guucuguauauauccuagcaaa

SEQ ID NO: 103465 - RNA, 22 nt, Human
aaaucuuucacauauuuuuuau

SEQ ID NO: 103466 - RNA, 22 nt, Human
ugagggaggggaaugugugcag

SEQ ID NO: 103467 - RNA, 22 nt, Human
acuuuauacuagugauaguuug

SEQ ID NO: 103468 - RNA, 22 nt, Human
ugaccucaagcaugcggagggc

SEQ ID NO: 103469 - RNA, 22 nt, Human
auuuauuugaagagccauugca

SEQ ID NO: 103470 - RNA, 22 nt, Human
cccagaggcugaguugggagca

SEQ ID NO: 103471 - RNA, 22 nt, Human
aaaauauucuauaucaaagaua

SEQ ID NO: 103472 - RNA, 22 nt, Human
uuauuuaagaucuuaauauaua

SEQ ID NO: 103473 - RNA, 23 nt, Human
uugcuuuugccccaaaagaguua

SEQ ID NO: 103474 - RNA, 22 nt, Human
uccucagcaagacgcuggcagc

SEQ ID NO: 103475 - RNA, 22 nt, Human
cuauguuucagauauauauaua

SEQ ID NO: 103476 - RNA, 22 nt, Human
uggaggcccagcugggggccgg

SEQ ID NO: 103477 - RNA, 22 nt, Human
ggcuggggccuguugaagaugc

SEQ ID NO: 103478 - RNA, 22 nt, Human
uguaaagugguauuuaauuuua

SEQ ID NO: 103479 - RNA, 22 nt, Human
auggugaugaugaugaugauaa

SEQ ID NO: 103480 - RNA, 18 nt, Human
uucaggcucuugcaugaa

SEQ ID NO: 103481 - RNA, 22 nt, Human
gccugggguuugcggggcugca

SEQ ID NO: 103482 - RNA, 23 nt, Human
agagggaagagcuuagaugggga

SEQ ID NO: 103483 - RNA, 22 nt, Human
ucaggguacuuguggccaaagu

SEQ ID NO: 103484 - RNA, 20 nt, Human
gggaauggauggauugcucc

SEQ ID NO: 103485 - RNA, 20 nt, Human
uuggagaucacguguccagg

SEQ ID NO: 103486 - RNA, 22 nt, Human
ugcagcagaauauggcugcagg

SEQ ID NO: 103487 - RNA, 22 nt, Human
gcagguccgagagggucgggua

SEQ ID NO: 103488 - RNA, 22 nt, Human
cuucuuuuggggaugaaaaugg

SEQ ID NO: 103489 - RNA, 22 nt, Human
uaccuggauaaauguacaaccg

SEQ ID NO: 103490 - RNA, 22 nt, Human
auuuuauuuugggaucuuuuua

SEQ ID NO: 103491 - RNA, 22 nt, Human
cuccccacucaacucccagacc

SEQ ID NO: 103492 - RNA, 22 nt, Human
augauuauuugaaugaagagga

SEQ ID NO: 103493 - RNA, 22 nt, Human
ggagauggucacagguaaacau

SEQ ID NO: 103494 - RNA, 22 nt, Human
gaauuccaggugagagaaggua

SEQ ID NO: 103495 - RNA, 21 nt, Human
acuuccacaucacugaguaga

SEQ ID NO: 103496 - RNA, 22 nt, Human
uguccuuuauauguuuuuuagu

SEQ ID NO: 103497 - RNA, 22 nt, Human
uaaaugauaguauugaagguag

SEQ ID NO: 103498 - RNA, 22 nt, Human
aggcaguguguagcuggaagag

SEQ ID NO: 103499 - RNA, 22 nt, Human
uuuuacaaugcaaauucuugcu

SEQ ID NO: 103500 - RNA, 22 nt, Human
uucuucuguuggcagagcauac

SEQ ID NO: 103501 - RNA, 22 nt, Human
gggaaauagagcuggaaccuug

SEQ ID NO: 103502 - RNA, 22 nt, Human
cagcuccaucuugcuuauacca

SEQ ID NO: 103503 - RNA, 22 nt, Human
agugagaguauuaaugugaacu

SEQ ID NO: 103504 - RNA, 22 nt, Human
acauuuccaaagaugccaguca

SEQ ID NO: 103505 - RNA, 22 nt, Human
uucugugacgcaaagcugggaa

SEQ ID NO: 103506 - RNA, 20 nt, Human
auccuggucuuuggaagcuu

SEQ ID NO: 103507 - RNA, 22 nt, Human
gugaaaaauggccaucaggaca

SEQ ID NO: 103508 - RNA, 22 nt, Human
gaggagcugggucagggagaca

SEQ ID NO: 103509 - RNA, 22 nt, Human
ucucugaccuccaccccaggag

SEQ ID NO: 103510 - RNA, 22 nt, Human
uuuuuuaaucaaguaggaaaca

SEQ ID NO: 103511 - RNA, 22 nt, Human
ccagggagggccacagggccau

SEQ ID NO: 103512 - RNA, 22 nt, Human
ugggugccgcaucuugcuguuc

SEQ ID NO: 103513 - RNA, 22 nt, Human
uugugugugcccaccuguggcc

SEQ ID NO: 103514 - RNA, 22 nt, Human
agagaaauguacuagucuaacu

SEQ ID NO: 103515 - RNA, 22 nt, Human
uggaaggugauucucugguuaa

SEQ ID NO: 103516 - RNA, 23 nt, Human
gucucacaaccaccugagaaaau

SEQ ID NO: 103517 - RNA, 22 nt, Human
aguaggauguuuagcccuucuu

SEQ ID NO: 103518 - RNA, 22 nt, Human
aggaaauaguuuagucccaaaa

SEQ ID NO: 103519 - RNA, 21 nt, Human
guucuuaguuauauucucaau

SEQ ID NO: 103520 - RNA, 22 nt, Human
agaggcagagcugggguuugac

SEQ ID NO: 103521 - RNA, 22 nt, Human
uguacagauaucaggagugagg

SEQ ID NO: 103522 - RNA, 22 nt, Human
cuguccauuuucgugccuccuu

SEQ ID NO: 103523 - RNA, 22 nt, Human
agucacuguucugucaugucaa

SEQ ID NO: 103524 - RNA, 21 nt, Human
uuucauuaguacaucaauuug

SEQ ID NO: 103525 - RNA, 22 nt, Human
ccuucugcuggucaucccagug

SEQ ID NO: 103526 - RNA, 22 nt, Human
cuuuacauuaauuucuacugau

SEQ ID NO: 103527 - RNA, 22 nt, Human
gccaguggucagugggagggug

SEQ ID NO: 103528 - RNA, 22 nt, Human
ucagagccagacacacagcaga

SEQ ID NO: 103529 - RNA, 22 nt, Human
cucagaagaacaaaggcucuac

SEQ ID NO: 103530 - RNA, 22 nt, Human
ucacuguuucaccgucugaagg

SEQ ID NO: 103531 - RNA, 22 nt, Human
gggggcugugugcccgcucccc

SEQ ID NO: 103532 - RNA, 18 nt, Human
ggagaagaacagaugugg

SEQ ID NO: 103533 - RNA, 22 nt, Human
aguguccaacucagcuugucaa

SEQ ID NO: 103534 - RNA, 22 nt, Human
ggggaggguuuggaugagaguc

SEQ ID NO: 103535 - RNA, 22 nt, Human
gggagccucccacugggggaag

SEQ ID NO: 103536 - RNA, 22 nt, Human
uacuauuuugacaugaaauuga

SEQ ID NO: 103537 - RNA, 22 nt, Human
uaauauauuuuuuaagggaugu

SEQ ID NO: 103538 - RNA, 22 nt, Human
ggcagggagagcgccgccaugc

SEQ ID NO: 103539 - RNA, 22 nt, Human
cuauauucuggaauguccauuu

SEQ ID NO: 103540 - RNA, 22 nt, Human
gauauuuugugaaaaaacaacu

SEQ ID NO: 103541 - RNA, 22 nt, Human
ucuuccuuguaagggcuuuaga

SEQ ID NO: 103542 - RNA, 22 nt, Human
uuuucauuguuaguuucuccuu

SEQ ID NO: 103543 - RNA, 22 nt, Human
ucuuuuaucuguuguguaacaa

SEQ ID NO: 103544 - RNA, 22 nt, Human
gucucacuucauuuucuuagcc

SEQ ID NO: 103545 - RNA, 22 nt, Human
uuaaaagaauccuguuauccuc

SEQ ID NO: 103546 - RNA, 22 nt, Human
gaagaaggaagaucaugcuuga

SEQ ID NO: 103547 - RNA, 22 nt, Human
cuguuucucugccugcacacau

SEQ ID NO: 103548 - RNA, 22 nt, Human
gaaggaaaagacgugcuaagua

SEQ ID NO: 103549 - RNA, 22 nt, Human
cacacagcuagugacaggagaa

SEQ ID NO: 103550 - RNA, 22 nt, Human
acaugggggugggacggcagag

SEQ ID NO: 103551 - RNA, 22 nt, Human
acccccuuucuugaccucaugu

SEQ ID NO: 103552 - RNA, 22 nt, Human
cauggcggcgcucucccugccu

SEQ ID NO: 103553 - RNA, 22 nt, Human
gaggggcucuugggcaugaagg

SEQ ID NO: 103554 - RNA, 22 nt, Human
acucauuuggauuuuggaguuu

SEQ ID NO: 103555 - RNA, 22 nt, Human
auuuuuuuuccugucucuuuca

SEQ ID NO: 103556 - RNA, 22 nt, Human
agcuccucagauuuggguggcg

SEQ ID NO: 103557 - RNA, 22 nt, Human
uucuuuuaauagagauccugug

SEQ ID NO: 103558 - RNA, 22 nt, Human
ugguucuagaugagaugaugag

SEQ ID NO: 103559 - RNA, 17 nt, Human
auucaugaacauguccu

SEQ ID NO: 103560 - RNA, 22 nt, Human
auagcacuuaauaugaaacagu

SEQ ID NO: 103561 - RNA, 22 nt, Human
auguacugacuguacuuuuaaa

SEQ ID NO: 103562 - RNA, 19 nt, Human
ccuccguguuaccuguccu

SEQ ID NO: 103563 - RNA, 18 nt, Human
guucaagcauuuugcucu

SEQ ID NO: 103564 - RNA, 22 nt, Human
uuuucucuuugcuucucuaaaa

SEQ ID NO: 103565 - RNA, 22 nt, Human
gggcugagagcuggaaucugag

SEQ ID NO: 103566 - RNA, 22 nt, Human
ugaaagcuggcucugcagagug

SEQ ID NO: 103567 - RNA, 22 nt, Human
agggaggcccagcagacuggcg

SEQ ID NO: 103568 - RNA, 22 nt, Human
uccauuuacuauucucauaucg

SEQ ID NO: 103569 - RNA, 22 nt, Human
gcugcaggaggugguagggucu

SEQ ID NO: 103570 - RNA, 22 nt, Human
augccugcugucaggaacucuu

SEQ ID NO: 103571 - RNA, 22 nt, Human
gaggggaaggguguucaauggg

SEQ ID NO: 103572 - RNA, 21 nt, Human
cugugggaaggccugaggucu

SEQ ID NO: 103573 - RNA, 22 nt, Human
cagcccuugcgacacccuggcu

SEQ ID NO: 103574 - RNA, 22 nt, Human
gucuuuguaguuuuaauuugag

SEQ ID NO: 103575 - RNA, 22 nt, Human
ucacuuccuugcagcuguagaa

SEQ ID NO: 103576 - RNA, 22 nt, Human
ucagcucucucuuggugaucuc

SEQ ID NO: 103577 - RNA, 22 nt, Human
guucuucagauuccauuucagu

SEQ ID NO: 103578 - RNA, 22 nt, Human
cuuccuuucagaggaaggccug

SEQ ID NO: 103579 - RNA, 22 nt, Human
aggguggaggacaggccaguga

SEQ ID NO: 103580 - RNA, 22 nt, Human
agucaccuacagcucaugcuuc

SEQ ID NO: 103581 - RNA, 17 nt, Human
ugaggcugucucccugg

SEQ ID NO: 103582 - RNA, 22 nt, Human
gugcugggaggcccaggaugga

SEQ ID NO: 103583 - RNA, 22 nt, Human
caguggacacuuccucuacaau

SEQ ID NO: 103584 - RNA, 22 nt, Human
cugaccucuaaguaacagagaa

SEQ ID NO: 103585 - RNA, 22 nt, Human
aaaauauuuaucuagcucuuaa

SEQ ID NO: 103586 - RNA, 22 nt, Human
ugcaggagcaccagcucacccu

SEQ ID NO: 103587 - RNA, 22 nt, Human
cagggggacuuguuagguuuua

SEQ ID NO: 103588 - RNA, 22 nt, Human
guucuacaugacacucaacauu

SEQ ID NO: 103589 - RNA, 22 nt, Human
uaguggaaccuucuaaaugacg

SEQ ID NO: 103590 - RNA, 22 nt, Human
aguaaaugaaagcaauuuuaga

SEQ ID NO: 103591 - RNA, 22 nt, Human
ucacaggagucaaggaauagua

SEQ ID NO: 103592 - RNA, 22 nt, Human
aggaacaguuucaaagagugaa

SEQ ID NO: 103593 - RNA, 22 nt, Human
uuuucucaguuuuuuucaaaag

SEQ ID NO: 103594 - RNA, 20 nt, Human
uggagggaggaggggcccaa

SEQ ID NO: 103595 - RNA, 22 nt, Human
ucugggagaguagauaaaggaa

SEQ ID NO: 103596 - RNA, 22 nt, Human
aguuucuugaagacugauguuu

SEQ ID NO: 103597 - RNA, 22 nt, Human
cuuggggauuuuaaagaccucu

SEQ ID NO: 103598 - RNA, 22 nt, Human
gcagguggaagcagcagacuca

SEQ ID NO: 103599 - RNA, 22 nt, Human
aacccugaacuuaguucuagga

SEQ ID NO: 103600 - RNA, 22 nt, Human
ggcucagaggagcuggaacggu

SEQ ID NO: 103601 - RNA, 22 nt, Human
gaaagugaauguaacauguuau

SEQ ID NO: 103602 - RNA, 22 nt, Human
caggggcuccaggugagccugg

SEQ ID NO: 103603 - RNA, 22 nt, Human
auucauucugaccucaagagaa

SEQ ID NO: 103604 - RNA, 22 nt, Human
uuuauuuuccaugucucuaggu

SEQ ID NO: 103605 - RNA, 22 nt, Human
aagggagagggagaagguggga

SEQ ID NO: 103606 - RNA, 22 nt, Human
uauuuaaagucagcaacuuuuc

SEQ ID NO: 103607 - RNA, 22 nt, Human
gacacugccaagugccccgaga

SEQ ID NO: 103608 - RNA, 22 nt, Haemophilus influenzae Rd
ugucauaguugcguggcugcca

SEQ ID NO: 103609 - RNA, 22 nt, Haemophilus influenzae Rd
cuucaguuguuaguuuagucac

SEQ ID NO: 103610 - RNA, 21 nt, Haemophilus influenzae Rd
aaaucgcgauugguggcagug

SEQ ID NO: 103611 - RNA, 20 nt, Haemophilus influenzae Rd
aagcgugguuaauuuuuaua

SEQ ID NO: 103612 - RNA, 22 nt, Haemophilus influenzae Rd
accauuuuaguucguucauuaa

SEQ ID NO: 103613 - RNA, 21 nt, Haemophilus influenzae Rd
auuuaucgauuucgaucuuaa

SEQ ID NO: 103614 - RNA, 22 nt, Haemophilus influenzae Rd
gcggcagaguuauuagauguuu

SEQ ID NO: 103615 - RNA, 22 nt, Haemophilus influenzae Rd
uuuugcaccaagcuguuguaau

SEQ ID NO: 103616 - RNA, 22 nt, Haemophilus influenzae Rd
caauuuaucuugaucuagggcu

SEQ ID NO: 103617 - RNA, 22 nt, Haemophilus influenzae Rd
uggcuuuacgcaaaagcugcau

SEQ ID NO: 103618 - RNA, 22 nt, Haemophilus influenzae Rd
ucuguaauuauugguaaauucg

SEQ ID NO: 103619 - RNA, 18 nt, Haemophilus influenzae Rd
agcguauuauuucuggcg

SEQ ID NO: 103620 - RNA, 22 nt, Haemophilus influenzae Rd
ugcaggggacucaaucacaauu

SEQ ID NO: 103621 - RNA, 22 nt, Haemophilus influenzae Rd
gguaaaagcacuuauaugcgcc

SEQ ID NO: 103622 - RNA, 20 nt, Haemophilus influenzae Rd
ucgccguuaauuuuuacuaa

SEQ ID NO: 103623 - RNA, 22 nt, Haemophilus influenzae Rd
aagcugauugugcguagggcaa

SEQ ID NO: 103624 - RNA, 19 nt, Haemophilus influenzae Rd
uggugcagccaguggcgug

SEQ ID NO: 103625 - RNA, 23 nt, Haemophilus influenzae Rd
ggcguagaaaaagauaaacgugc

SEQ ID NO: 103626 - RNA, 22 nt, Haemophilus influenzae Rd
aaaaaugaccgcacuuuaguuu

SEQ ID NO: 103627 - RNA, 21 nt, Haemophilus influenzae Rd
guagaaaacgcgaaacguuuu

SEQ ID NO: 103628 - RNA, 22 nt, Haemophilus influenzae Rd
uaguuuccuacgucaguauuaa

SEQ ID NO: 103629 - RNA, 22 nt, Haemophilus influenzae Rd
uucgcuguauuagcuaauuuaa

SEQ ID NO: 103630 - RNA, 22 nt, Haemophilus influenzae Rd
gcaauugcaacaguaauuggua

SEQ ID NO: 103631 - RNA, 22 nt, Haemophilus influenzae Rd
cugguugggcgugguuaguauu

SEQ ID NO: 103632 - RNA, 22 nt, Haemophilus influenzae Rd
gcuuuaacugcaggucauagca

SEQ ID NO: 103633 - RNA, 22 nt, Haemophilus influenzae Rd
auuuaacgccaagccguggcuu

SEQ ID NO: 103634 - RNA, 22 nt, Haemophilus influenzae Rd
ucgugguagauugugcaaaugg

SEQ ID NO: 103635 - RNA, 22 nt, Haemophilus influenzae Rd
aguuuaccaaauaugguagaac

SEQ ID NO: 103636 - RNA, 22 nt, Haemophilus influenzae Rd
gcuguugagaauacuugcgauu

SEQ ID NO: 103637 - RNA, 22 nt, Haemophilus influenzae Rd
uugguggaaagaaucucaauua

SEQ ID NO: 103638 - RNA, 19 nt, Haemophilus influenzae Rd
auaagcagaauuuuggauu

SEQ ID NO: 103639 - RNA, 21 nt, Haemophilus influenzae Rd
gcaaaugugauuugccccuac

SEQ ID NO: 103640 - RNA, 22 nt, Haemophilus influenzae Rd
agaaucugccauuguugcagca

SEQ ID NO: 103641 - RNA, 22 nt, Haemophilus influenzae Rd
gauggugcggcgaaaagccauu

SEQ ID NO: 103642 - RNA, 22 nt, Haemophilus influenzae Rd
uagaauuuaaugauauuugcca

SEQ ID NO: 103643 - RNA, 22 nt, Haemophilus influenzae Rd
ucaguuaagcguucuugaaccu

SEQ ID NO: 103644 - RNA, 22 nt, Haemophilus influenzae Rd
aauguuaaacauugaauugguu

SEQ ID NO: 103645 - RNA, 22 nt, Haemophilus influenzae Rd
uaacguugggaaauauugucgg

SEQ ID NO: 103646 - RNA, 22 nt, Haemophilus influenzae Rd
cguuauuauucaaguuuaaaua

SEQ ID NO: 103647 - RNA, 22 nt, Haemophilus influenzae Rd
uuagcgcgccaauuugaauuag

SEQ ID NO: 103648 - RNA, 22 nt, Haemophilus influenzae Rd
uacggagauucuguuacauuag

SEQ ID NO: 103649 - RNA, 22 nt, Haemophilus influenzae Rd
aucgcauugauaauaaguuguu

SEQ ID NO: 103650 - RNA, 22 nt, Haemophilus influenzae Rd
uuucuuccauugacucuucaga

SEQ ID NO: 103651 - RNA, 22 nt, Haemophilus influenzae Rd
agaaaucaaauuugcugauucc

SEQ ID NO: 103652 - RNA, 22 nt, Haemophilus influenzae Rd
gcuucaauuuugccuucaaaca

SEQ ID NO: 103653 - RNA, 19 nt, Haemophilus influenzae Rd
aaucuucuggacaacgagu

SEQ ID NO: 103654 - RNA, 22 nt, Haemophilus influenzae Rd
agcacuguaacgauuaaucauc

SEQ ID NO: 103655 - RNA, 22 nt, Haemophilus influenzae Rd
gccguaacccaauguauuuaag

SEQ ID NO: 103656 - RNA, 22 nt, Haemophilus influenzae Rd
guuuaaccauugcaccagcauu

SEQ ID NO: 103657 - RNA, 18 nt, Haemophilus influenzae Rd
ugauggugauacaaaaau

SEQ ID NO: 103658 - RNA, 22 nt, Haemophilus influenzae Rd
ggauaaaauuucugaugaacaa

SEQ ID NO: 103659 - RNA, 22 nt, Haemophilus influenzae Rd
ggggcguuuacguaaauuggcu

SEQ ID NO: 103660 - RNA, 16 nt, Haemophilus influenzae Rd
aagguuuuucagguaa

SEQ ID NO: 103661 - RNA, 22 nt, Haemophilus influenzae Rd
uuuugcuucuucucgugauggu

SEQ ID NO: 103662 - RNA, 23 nt, Haemophilus influenzae Rd
gcacuuaauaauaaggugagcag

SEQ ID NO: 103663 - RNA, 22 nt, Haemophilus influenzae Rd
uuauuuggcacagagguuuuac

SEQ ID NO: 103664 - RNA, 22 nt, Haemophilus influenzae Rd
aacaaugccacugccauaacga

SEQ ID NO: 103665 - RNA, 22 nt, Haemophilus influenzae Rd
uugacaauggguuuugaugaug

SEQ ID NO: 103666 - RNA, 22 nt, Haemophilus influenzae Rd
uaugggcgugaccgcacuuuua

SEQ ID NO: 103667 - RNA, 22 nt, Haemophilus influenzae Rd
cagcccugugccuuauaucucc

SEQ ID NO: 103668 - RNA, 22 nt, Haemophilus influenzae Rd
uugugaaauuugcauuuggaau

SEQ ID NO: 103669 - RNA, 22 nt, Haemophilus influenzae Rd
uuguggaucuuugccugaauaa

SEQ ID NO: 103670 - RNA, 22 nt, Haemophilus influenzae Rd
ucgcuagaaugaggcguuuaau

SEQ ID NO: 103671 - RNA, 22 nt, Haemophilus influenzae Rd
aaugcuuuaccauaauuugcac

SEQ ID NO: 103672 - RNA, 22 nt, Haemophilus influenzae Rd
auacaauauuggcuaugaugca

SEQ ID NO: 103673 - RNA, 22 nt, Haemophilus influenzae Rd
gcgaugaaaaaugcgaauguug

SEQ ID NO: 103674 - RNA, 18 nt, Haemophilus influenzae Rd
gcuuucgcggaauucauc

SEQ ID NO: 103675 - RNA, 22 nt, Haemophilus influenzae Rd
uacagccgagccuuugccuuag

SEQ ID NO: 103676 - RNA, 22 nt, Haemophilus influenzae Rd
aagcgaagaaaggcuuugccuu

SEQ ID NO: 103677 - RNA, 21 nt, Haemophilus influenzae Rd
caacaacgccauaaucuuacc

SEQ ID NO: 103678 - RNA, 22 nt, Haemophilus influenzae Rd
uuauaaauaucaguauagcaac

SEQ ID NO: 103679 - RNA, 22 nt, Haemophilus influenzae Rd
cgagaaaaagcggauaaacucg

SEQ ID NO: 103680 - RNA, 19 nt, Haemophilus influenzae Rd
auuuucuaccaacauugca

SEQ ID NO: 103681 - RNA, 22 nt, Haemophilus influenzae Rd
uucaggcuguaguaaugaugau

SEQ ID NO: 103682 - RNA, 22 nt, Haemophilus influenzae Rd
gcauaacagaacccaguuaaac

SEQ ID NO: 103683 - RNA, 21 nt, Haemophilus influenzae Rd
uugauugcaauguugugcuga

SEQ ID NO: 103684 - RNA, 22 nt, Haemophilus influenzae Rd
aagcaacugcugaacgcuuagg

SEQ ID NO: 103685 - RNA, 22 nt, Haemophilus influenzae Rd
accgauuuuaaauucuccccga

SEQ ID NO: 103686 - RNA, 22 nt, Haemophilus influenzae Rd
uuucagaaggugacaauguuuu

SEQ ID NO: 103687 - RNA, 22 nt, Haemophilus influenzae Rd
ugguaagcaaaggaugaucugg

SEQ ID NO: 103688 - RNA, 22 nt, Haemophilus influenzae Rd
ucuuggcuagucuugguaugga

SEQ ID NO: 103689 - RNA, 18 nt, Haemophilus influenzae Rd
ugguguuggacgaacagu

SEQ ID NO: 103690 - RNA, 22 nt, Haemophilus influenzae Rd
aauguaggugaaauuacugaac

SEQ ID NO: 103691 - RNA, 22 nt, Haemophilus influenzae Rd
uuacggguaaaauucgcaaugu

SEQ ID NO: 103692 - RNA, 22 nt, Haemophilus influenzae Rd
uauuagcagcuaaagaauuaaa

SEQ ID NO: 103693 - RNA, 20 nt, Haemophilus influenzae Rd
accaaaugcaauuguagcaa

SEQ ID NO: 103694 - RNA, 22 nt, Haemophilus influenzae Rd
auuauuugaugaaccaacggcu

SEQ ID NO: 103695 - RNA, 22 nt, Haemophilus influenzae Rd
ucgaacaauuucguaguguagg

SEQ ID NO: 103696 - RNA, 22 nt, Haemophilus influenzae Rd
gccauucuauuacaaauuuagc

SEQ ID NO: 103697 - RNA, 22 nt, Haemophilus influenzae Rd
gacuuuuaaugcaauuagugau

SEQ ID NO: 103698 - RNA, 22 nt, Haemophilus influenzae Rd
uuggaaaccuucaauuugcuca

SEQ ID NO: 103699 - RNA, 22 nt, Haemophilus influenzae Rd
acguuuagauauggcauuugau

SEQ ID NO: 103700 - RNA, 22 nt, Haemophilus influenzae Rd
aaucaucgaccauuacgcguaa

SEQ ID NO: 103701 - RNA, 22 nt, Haemophilus influenzae Rd
gcauuuugaugaacgcgguuua

SEQ ID NO: 103702 - RNA, 22 nt, Haemophilus influenzae Rd
guaucagaaauagagcauaaug

SEQ ID NO: 103703 - RNA, 22 nt, Haemophilus influenzae Rd
gauccaccauauucgcuaaugc

SEQ ID NO: 103704 - RNA, 22 nt, Haemophilus influenzae Rd
uuuuaaccgcacuuucaucuuc

SEQ ID NO: 103705 - RNA, 22 nt, Haemophilus influenzae Rd
uggauugugugagguagauuuu

SEQ ID NO: 103706 - RNA, 22 nt, Haemophilus influenzae Rd
ccguuagaugcuggaaaugacg

SEQ ID NO: 103707 - RNA, 22 nt, Haemophilus influenzae Rd
caauauucguuacugaaagagc

SEQ ID NO: 103708 - RNA, 22 nt, Haemophilus influenzae Rd
uauuagugucauuaguucguga

SEQ ID NO: 103709 - RNA, 22 nt, Haemophilus influenzae Rd
uuuccuuggcaaggauuucaaa

SEQ ID NO: 103710 - RNA, 22 nt, Haemophilus influenzae Rd
gaauuucagcauauuguuguga

SEQ ID NO: 103711 - RNA, 22 nt, Haemophilus influenzae Rd
uacugcgauuccauuagccgcu

SEQ ID NO: 103712 - RNA, 22 nt, Haemophilus influenzae Rd
aaaaucacauuaaauaucgcug

SEQ ID NO: 103713 - RNA, 18 nt, Haemophilus influenzae Rd
ggcuuaagcccacccuac

SEQ ID NO: 103714 - RNA, 21 nt, Haemophilus influenzae Rd
aguguauuucauuacauaagc

SEQ ID NO: 103715 - RNA, 21 nt, Haemophilus influenzae Rd
auuuuugcauaauaccgacua

SEQ ID NO: 103716 - RNA, 22 nt, Haemophilus influenzae Rd
aaaaagccagcguuugaaacag

SEQ ID NO: 103717 - RNA, 22 nt, Haemophilus influenzae Rd
gcuguuuugccacaaagcaaau

SEQ ID NO: 103718 - RNA, 22 nt, Haemophilus influenzae Rd
guaaagcgauuaguauucgaac

SEQ ID NO: 103719 - RNA, 22 nt, Haemophilus influenzae Rd
ucugcaauuuuuacaagguugg

SEQ ID NO: 103720 - RNA, 22 nt, Haemophilus influenzae Rd
gagcagcauuauaaagcguugu

SEQ ID NO: 103721 - RNA, 22 nt, Haemophilus influenzae Rd
uuuauuaggaaguuacaucaug

SEQ ID NO: 103722 - RNA, 22 nt, Haemophilus influenzae Rd
ucuuuauaaagcacuaaagcaa

SEQ ID NO: 103723 - RNA, 22 nt, Haemophilus influenzae Rd
auuuauuugcaggcgaagugga

SEQ ID NO: 103724 - RNA, 22 nt, Haemophilus influenzae Rd
guaaguauauccuagguucagu

SEQ ID NO: 103725 - RNA, 22 nt, Haemophilus influenzae Rd
uggguuaucaaaagcuuaucga

SEQ ID NO: 103726 - RNA, 22 nt, Haemophilus influenzae Rd
uguugaugaaagcguacuucau

SEQ ID NO: 103727 - RNA, 22 nt, Haemophilus influenzae Rd
uucguuauuuuccgccgaaauu

SEQ ID NO: 103728 - RNA, 22 nt, Haemophilus influenzae Rd
uugagauuuucgacaccuaaau

SEQ ID NO: 103729 - RNA, 17 nt, Haemophilus influenzae Rd
uucugacuuauaucaag

SEQ ID NO: 103730 - RNA, 22 nt, Haemophilus influenzae Rd
caccauauuuaauaaaguaaau

SEQ ID NO: 103731 - RNA, 22 nt, Haemophilus influenzae Rd
aauugagugauggcaaauuaga

SEQ ID NO: 103732 - RNA, 22 nt, Haemophilus influenzae Rd
gggcugaauggcaucaaauaaa

SEQ ID NO: 103733 - RNA, 19 nt, Haemophilus influenzae Rd
ugcuuugcccaaugccgca

SEQ ID NO: 103734 - RNA, 22 nt, Haemophilus influenzae Rd
aacccgaagaacuugauagagc

SEQ ID NO: 103735 - RNA, 22 nt, Haemophilus influenzae Rd
guguuuuaauacuguguuaaug

SEQ ID NO: 103736 - RNA, 22 nt, Haemophilus influenzae Rd
ccaucuuguaauuguagaaagu

SEQ ID NO: 103737 - RNA, 19 nt, Haemophilus influenzae Rd
ucguauuuggacgaggaug

SEQ ID NO: 103738 - RNA, 22 nt, Haemophilus influenzae Rd
uuacguccuuauggcuuaauua

SEQ ID NO: 103739 - RNA, 22 nt, Haemophilus influenzae Rd
accauuuacuaauaagcgauug

SEQ ID NO: 103740 - RNA, 22 nt, Haemophilus influenzae Rd
uuuguuauagauaaagugcggu

SEQ ID NO: 103741 - RNA, 22 nt, Haemophilus influenzae Rd
gcgucuauggcaaacagugcua

SEQ ID NO: 103742 - RNA, 22 nt, Haemophilus influenzae Rd
augguugguuacgugcagaaag

SEQ ID NO: 103743 - RNA, 22 nt, Haemophilus influenzae Rd
acuuuaccacgugauucuagcc

SEQ ID NO: 103744 - RNA, 22 nt, Haemophilus influenzae Rd
acggucggcaauauugguguua

SEQ ID NO: 103745 - RNA, 22 nt, Haemophilus influenzae Rd
uucuccuugcugauuauaauaa

SEQ ID NO: 103746 - RNA, 22 nt, Haemophilus influenzae Rd
uuggcggagauuaugcguuuuc

SEQ ID NO: 103747 - RNA, 22 nt, Haemophilus influenzae Rd
gaggagaaauaguacagcaagg

SEQ ID NO: 103748 - RNA, 22 nt, Haemophilus influenzae Rd
cguuuauuccauugaugaaaga

SEQ ID NO: 103749 - RNA, 22 nt, Haemophilus influenzae Rd
uuuuuaacacgcuuuugucuga

SEQ ID NO: 103750 - RNA, 22 nt, Haemophilus influenzae Rd
aucgaccgaaaaaacuuuccuu

SEQ ID NO: 103751 - RNA, 22 nt, Haemophilus influenzae Rd
uuaaauuuaggaguauagccaa

SEQ ID NO: 103752 - RNA, 22 nt, Haemophilus influenzae Rd
cggguuuagguuuaaaucaagu

SEQ ID NO: 103753 - RNA, 22 nt, Haemophilus influenzae Rd
cgaguuauuagugguaauacug

SEQ ID NO: 103754 - RNA, 22 nt, Haemophilus influenzae Rd
cagaagaaaacuacaaaggucg

SEQ ID NO: 103755 - RNA, 22 nt, Haemophilus influenzae Rd
gcauucauucauuuugucguaa

SEQ ID NO: 103756 - RNA, 22 nt, Haemophilus influenzae Rd
agcaacuuuuacuuuaaugagu

SEQ ID NO: 103757 - RNA, 22 nt, Haemophilus influenzae Rd
aaaaccuuucgaguguuuuauu

SEQ ID NO: 103758 - RNA, 22 nt, Haemophilus influenzae Rd
aguuuguaaucuuuacgacgcc

SEQ ID NO: 103759 - RNA, 22 nt, Haemophilus influenzae Rd
gcggauuuccaauugauugacg

SEQ ID NO: 103760 - RNA, 22 nt, Haemophilus influenzae Rd
uucaucgcuuuaauagcugaaa

SEQ ID NO: 103761 - RNA, 22 nt, Haemophilus influenzae Rd
ggugcaguaaaugaauugggcg

SEQ ID NO: 103762 - RNA, 22 nt, Haemophilus influenzae Rd
cgauauaaccuucagcagcuaa

SEQ ID NO: 103763 - RNA, 22 nt, Haemophilus influenzae Rd
uggcaggauugguuguguugau

SEQ ID NO: 103764 - RNA, 22 nt, Haemophilus influenzae Rd
agugggguauucugucagcggu

SEQ ID NO: 103765 - RNA, 22 nt, Haemophilus influenzae Rd
gcaaucgguaauccauuugguu

SEQ ID NO: 103766 - RNA, 22 nt, Haemophilus influenzae Rd
gauuggugaaguaauaaccgau

SEQ ID NO: 103767 - RNA, 22 nt, Haemophilus influenzae Rd
caacuugcacauuuucaucgcc

SEQ ID NO: 103768 - RNA, 22 nt, Haemophilus influenzae Rd
aguguugauaaauuucgucgug

SEQ ID NO: 103769 - RNA, 22 nt, Haemophilus influenzae Rd
auugcagccaguguauuugugg

SEQ ID NO: 103770 - RNA, 22 nt, Haemophilus influenzae Rd
cauaucaaugcuaccauuguug

SEQ ID NO: 103771 - RNA, 22 nt, Haemophilus influenzae Rd
cuuuugcaaaauauagcacaga

SEQ ID NO: 103772 - RNA, 22 nt, Haemophilus influenzae Rd
cauggcauugaaggcauugaua

SEQ ID NO: 103773 - RNA, 22 nt, Haemophilus influenzae Rd
gcgguggaagucugcuacaagu

SEQ ID NO: 103774 - RNA, 22 nt, Haemophilus influenzae Rd
gugaugaucgcacugaugugau

SEQ ID NO: 103775 - RNA, 22 nt, Haemophilus influenzae Rd
uugcaagaaucacuucguggaa

SEQ ID NO: 103776 - RNA, 22 nt, Haemophilus influenzae Rd
guaaccauuaccuuaaaugccg

SEQ ID NO: 103777 - RNA, 22 nt, Haemophilus influenzae Rd
ucugauauucagcuacucaaua

SEQ ID NO: 103778 - RNA, 22 nt, Haemophilus influenzae Rd
accacaagaaguaauggauaaa

SEQ ID NO: 103779 - RNA, 22 nt, Haemophilus influenzae Rd
cuuucuacgggugaagcuauug

SEQ ID NO: 103780 - RNA, 22 nt, Haemophilus influenzae Rd
aguuaaaguuguugguucaggu

SEQ ID NO: 103781 - RNA, 22 nt, Haemophilus influenzae Rd
uuguaggugggcuuuagcccac

SEQ ID NO: 103782 - RNA, 22 nt, Haemophilus influenzae Rd
gugcauuaggcauccgugguug

SEQ ID NO: 103783 - RNA, 22 nt, Haemophilus influenzae Rd
uucaauaucuacuaaacguggu

SEQ ID NO: 103784 - RNA, 22 nt, Haemophilus influenzae Rd
aaggaaugugaauuucgguuua

SEQ ID NO: 103785 - RNA, 22 nt, Haemophilus influenzae Rd
uuuguauuagcaaugccguugu

SEQ ID NO: 103786 - RNA, 22 nt, Haemophilus influenzae Rd
cauuaggcaauauugccgagcg

SEQ ID NO: 103787 - RNA, 22 nt, Haemophilus influenzae Rd
auauugcguauuuuggaaucau

SEQ ID NO: 103788 - RNA, 22 nt, Haemophilus influenzae Rd
accgcacuuuauucauuuuaga

SEQ ID NO: 103789 - RNA, 22 nt, Haemophilus influenzae Rd
uuaauguugcgcaucgcagagg

SEQ ID NO: 103790 - RNA, 22 nt, Haemophilus influenzae Rd
gauuauuucugaugcaggaagc

SEQ ID NO: 103791 - RNA, 22 nt, Haemophilus influenzae Rd
ugcaaugacguuagcgcguggu

SEQ ID NO: 103792 - RNA, 22 nt, Haemophilus influenzae Rd
uuuucguaaauguuuaccaagc

SEQ ID NO: 103793 - RNA, 22 nt, Haemophilus influenzae Rd
aacagcuugaauuuauccgaac

SEQ ID NO: 103794 - RNA, 22 nt, Haemophilus influenzae Rd
aggcguguuagaacuuguucgu

SEQ ID NO: 103795 - RNA, 22 nt, Haemophilus influenzae Rd
uggucguauuaaucgcuauugc

SEQ ID NO: 103796 - RNA, 22 nt, Haemophilus influenzae Rd
agcugauauugccauuauccau

SEQ ID NO: 103797 - RNA, 22 nt, Haemophilus influenzae Rd
gagcggauuauucagaugcaca

SEQ ID NO: 103798 - RNA, 22 nt, Haemophilus influenzae Rd
uaauguagggugggcuuuagcc

SEQ ID NO: 103799 - RNA, 22 nt, Haemophilus influenzae Rd
gaaaaugugcggugcaaaacau

SEQ ID NO: 103800 - RNA, 22 nt, Haemophilus influenzae Rd
gccuguuuuagagaguaucggc

SEQ ID NO: 103801 - RNA, 22 nt, Haemophilus influenzae Rd
ggggcaaauuuaucuuaauacu

SEQ ID NO: 103802 - RNA, 22 nt, Haemophilus influenzae Rd
ugcugacggaauguauuuaaug

SEQ ID NO: 103803 - RNA, 22 nt, Haemophilus influenzae Rd
cagugauagaacagauccugaa

SEQ ID NO: 103804 - RNA, 22 nt, Haemophilus influenzae Rd
uaucuguucgcugaauugguua

SEQ ID NO: 103805 - RNA, 22 nt, Haemophilus influenzae Rd
gcaaugguuccuuuaguuaugg

SEQ ID NO: 103806 - RNA, 22 nt, Haemophilus influenzae Rd
ugguggaauugguugaucguga

SEQ ID NO: 103807 - RNA, 22 nt, Haemophilus influenzae Rd
gauuuugcgucauauucaagaa

SEQ ID NO: 103808 - RNA, 22 nt, Haemophilus influenzae Rd
aaagucccucaauagaauccac

SEQ ID NO: 103809 - RNA, 22 nt, Haemophilus influenzae Rd
acuguuuucuaacaucgcaaag

SEQ ID NO: 103810 - RNA, 21 nt, Haemophilus influenzae Rd
aagaauagguuucaaacuugc

SEQ ID NO: 103811 - RNA, 22 nt, Haemophilus influenzae Rd
gcacuucuugguggcugguuaa

SEQ ID NO: 103812 - RNA, 22 nt, Haemophilus influenzae Rd
ugguguuuaugugugagcauaa

SEQ ID NO: 103813 - RNA, 22 nt, Haemophilus influenzae Rd
acuuuauaaguugcggguuuuu

SEQ ID NO: 103814 - RNA, 22 nt, Haemophilus influenzae Rd
uuuaggugcuaaaauauaacgg

SEQ ID NO: 103815 - RNA, 22 nt, Haemophilus influenzae Rd
cgugcaacccagaagaagauga

SEQ ID NO: 103816 - RNA, 22 nt, Haemophilus influenzae Rd
aaaacgcauuccagugauucaa

SEQ ID NO: 103817 - RNA, 22 nt, Haemophilus influenzae Rd
caaugccacauuuagacgauua

SEQ ID NO: 103818 - RNA, 22 nt, Haemophilus influenzae Rd
guaacaaugauugcuucucucu

SEQ ID NO: 103819 - RNA, 22 nt, Haemophilus influenzae Rd
agaugcaguggguauucaauau

SEQ ID NO: 103820 - RNA, 22 nt, Haemophilus influenzae Rd
aauauuguaagcucaucggguc

SEQ ID NO: 103821 - RNA, 22 nt, Haemophilus influenzae Rd
uuuuucuucccaaccuaaacga

SEQ ID NO: 103822 - RNA, 20 nt, Haemophilus influenzae Rd
cgccacauauuucuaaagau

SEQ ID NO: 103823 - RNA, 22 nt, Haemophilus influenzae Rd
uuggcgauggggcaaaugacuu

SEQ ID NO: 103824 - RNA, 22 nt, Haemophilus influenzae Rd
aaguuuuucauauaacguugac

SEQ ID NO: 103825 - RNA, 22 nt, Haemophilus influenzae Rd
auccgcuuaaggaucuugacca

SEQ ID NO: 103826 - RNA, 22 nt, Haemophilus influenzae Rd
gacuaaaucaggcgaacgcaaa

SEQ ID NO: 103827 - RNA, 22 nt, Haemophilus influenzae Rd
guuccagucuuauuaccagugu

SEQ ID NO: 103828 - RNA, 22 nt, Haemophilus influenzae Rd
gugggcuuuagcccacaauuua

SEQ ID NO: 103829 - RNA, 20 nt, Haemophilus influenzae Rd
ggcaauguuuuacaaggcgu

SEQ ID NO: 103830 - RNA, 22 nt, Haemophilus influenzae Rd
gaaucugcgcaccugcagcuuu

SEQ ID NO: 103831 - RNA, 22 nt, Haemophilus influenzae Rd
uaucuuuaggugcaagagaaug

SEQ ID NO: 103832 - RNA, 22 nt, Haemophilus influenzae Rd
uuuuagcacuagguuuauugcu

SEQ ID NO: 103833 - RNA, 23 nt, Haemophilus influenzae Rd
uaucauuauuaugaccgaugcug

SEQ ID NO: 103834 - RNA, 22 nt, Haemophilus influenzae Rd
acggugaucauguaggcgguga

SEQ ID NO: 103835 - RNA, 22 nt, Haemophilus influenzae Rd
uuuuguuggaagccuguagggu

SEQ ID NO: 103836 - RNA, 22 nt, Haemophilus influenzae Rd
uguggcauaggaccaucuguug

SEQ ID NO: 103837 - RNA, 20 nt, Haemophilus influenzae Rd
ugcuugauaaaccuguugau

SEQ ID NO: 103838 - RNA, 22 nt, Haemophilus influenzae Rd
aacguuuugcugaagaugcggg

SEQ ID NO: 103839 - RNA, 22 nt, Haemophilus influenzae Rd
aaagugauggcgacuguuggau

SEQ ID NO: 103840 - RNA, 22 nt, Haemophilus influenzae Rd
ucuugggguuuaggcagcauug

SEQ ID NO: 103841 - RNA, 19 nt, Haemophilus influenzae Rd
aaagauugaggaaagccaa

SEQ ID NO: 103842 - RNA, 22 nt, Haemophilus influenzae Rd
ggagaacuaccugaaacuauuu

SEQ ID NO: 103843 - RNA, 22 nt, Haemophilus influenzae Rd
aaggaucgaaagcugaauguug

SEQ ID NO: 103844 - RNA, 22 nt, Haemophilus influenzae Rd
gauugcgauugguucuggugga

SEQ ID NO: 103845 - RNA, 22 nt, Haemophilus influenzae Rd
acgguagaagcggcagcgguaa

SEQ ID NO: 103846 - RNA, 19 nt, Haemophilus influenzae Rd
uuggacgcuuugguuaggu

SEQ ID NO: 103847 - RNA, 22 nt, Haemophilus influenzae Rd
guugggugagcaaauaacugaa

SEQ ID NO: 103848 - RNA, 22 nt, Haemophilus influenzae Rd
ggugcaauguugguagaaaaug

SEQ ID NO: 103849 - RNA, 22 nt, Haemophilus influenzae Rd
aagugcgguuaaaaaucucaca

SEQ ID NO: 103850 - RNA, 22 nt, Haemophilus influenzae Rd
gguaaugaaauuauucaaucaa

SEQ ID NO: 103851 - RNA, 19 nt, Haemophilus influenzae Rd
uugauuucuuccauggaaa

SEQ ID NO: 103852 - RNA, 22 nt, Haemophilus influenzae Rd
gaugaaugguaaaauugaugaa

SEQ ID NO: 103853 - RNA, 22 nt, Haemophilus influenzae Rd
uuuuucuugggcaaagcucgau

SEQ ID NO: 103854 - RNA, 22 nt, Haemophilus influenzae Rd
uugaugcggcaggauuaucagg

SEQ ID NO: 103855 - RNA, 22 nt, Haemophilus influenzae Rd
uuugcagaaauuuaaauuagau

SEQ ID NO: 103856 - RNA, 22 nt, Haemophilus influenzae Rd
guuugaugauuaucgaaaaugc

SEQ ID NO: 103857 - RNA, 22 nt, Haemophilus influenzae Rd
uaagagcguggcuaaagcccac

SEQ ID NO: 103858 - RNA, 22 nt, Haemophilus influenzae Rd
ggagaaaauaaagugcgguuga

SEQ ID NO: 103859 - RNA, 22 nt, Haemophilus influenzae Rd
uggcauuaaucaacaaaagcca

SEQ ID NO: 103860 - RNA, 22 nt, Haemophilus influenzae Rd
uggcuuuauuugcucacugaaa

SEQ ID NO: 103861 - RNA, 22 nt, Haemophilus influenzae Rd
aguaaaauaggcuauuuugagc

SEQ ID NO: 103862 - RNA, 21 nt, Haemophilus influenzae Rd
aauuaugagcaguaauaaaua

SEQ ID NO: 103863 - RNA, 22 nt, Haemophilus influenzae Rd
aaucugcgcaaucugcaacaag

SEQ ID NO: 103864 - RNA, 22 nt, Haemophilus influenzae Rd
auaugcuuaaagugaaacagaa

SEQ ID NO: 103865 - RNA, 22 nt, Haemophilus influenzae Rd
augcgguugcaauacguuuuac

SEQ ID NO: 103866 - RNA, 22 nt, Haemophilus influenzae Rd
guugccauuugcaaaauacgag

SEQ ID NO: 103867 - RNA, 22 nt, Haemophilus influenzae Rd
auugcucuauuuuuaauuguga

SEQ ID NO: 103868 - RNA, 22 nt, Haemophilus influenzae Rd
uaaagugguugcacauugguug

SEQ ID NO: 103869 - RNA, 22 nt, Haemophilus influenzae Rd
cuggguuugcuuuugagaaugc

SEQ ID NO: 103870 - RNA, 22 nt, Haemophilus influenzae Rd
aaugaaagugcgguuaauuuga

SEQ ID NO: 103871 - RNA, 22 nt, Haemophilus influenzae Rd
uuuaaccgcacuuggguuucaa

SEQ ID NO: 103872 - RNA, 22 nt, Haemophilus influenzae Rd
ugcuuacagugcaucaauuggu

SEQ ID NO: 103873 - RNA, 22 nt, Haemophilus influenzae Rd
uuggcaaacugguucugguaca

SEQ ID NO: 103874 - RNA, 22 nt, Haemophilus influenzae Rd
uuaaacugauaggcaaggauaa

SEQ ID NO: 103875 - RNA, 22 nt, Haemophilus influenzae Rd
aaauuguaauuguuccaaugaa

SEQ ID NO: 103876 - RNA, 22 nt, Haemophilus influenzae Rd
uuagugcaaaugcucggggugu

SEQ ID NO: 103877 - RNA, 22 nt, Haemophilus influenzae Rd
gcaauuugcaucacuuguucuu

SEQ ID NO: 103878 - RNA, 22 nt, Haemophilus influenzae Rd
ugaaauugaccgcacuuuuuua

SEQ ID NO: 103879 - RNA, 22 nt, Haemophilus influenzae Rd
aguuacugcauuagguucugug

SEQ ID NO: 103880 - RNA, 22 nt, Haemophilus influenzae Rd
uaaauaguucucguggcagugc

SEQ ID NO: 103881 - RNA, 22 nt, Haemophilus influenzae Rd
uagucguguaagaaucgcucua

SEQ ID NO: 103882 - RNA, 22 nt, Haemophilus influenzae Rd
aaauauugugacaaaugauauu

SEQ ID NO: 103883 - RNA, 22 nt, Haemophilus influenzae Rd
uuggcuugcucgguaaauucaa

SEQ ID NO: 103884 - RNA, 22 nt, Haemophilus influenzae Rd
uuagcuuggaagaaggcauauu

SEQ ID NO: 103885 - RNA, 22 nt, Haemophilus influenzae Rd
caccaaauuaacgcccauuuuu

SEQ ID NO: 103886 - RNA, 22 nt, Haemophilus influenzae Rd
uccgugauuauuuagcgaaaaa

SEQ ID NO: 103887 - RNA, 22 nt, Haemophilus influenzae Rd
auagcuaauuaucuucgauuuu

SEQ ID NO: 103888 - RNA, 22 nt, Haemophilus influenzae Rd
uauuuaucauucuuaucguugc

SEQ ID NO: 103889 - RNA, 22 nt, Haemophilus influenzae Rd
guauuagugauuuuacuuugug

SEQ ID NO: 103890 - RNA, 19 nt, Haemophilus influenzae Rd
guaucgcucaauuuacgcc

SEQ ID NO: 103891 - RNA, 22 nt, Haemophilus influenzae Rd
ugauccuuuuggcauucguccu

SEQ ID NO: 103892 - RNA, 22 nt, Haemophilus influenzae Rd
uauguuuauuugaaauuguacg

SEQ ID NO: 103893 - RNA, 22 nt, Haemophilus influenzae Rd
aauucaacuugucgauaaaaug

SEQ ID NO: 103894 - RNA, 22 nt, Haemophilus influenzae Rd
auagccuuggguaauuaacauu

SEQ ID NO: 103895 - RNA, 22 nt, Haemophilus influenzae Rd
agucguagccuaauucuguugc

SEQ ID NO: 103896 - RNA, 22 nt, Haemophilus influenzae Rd
uaauauaacggacguagaugac

SEQ ID NO: 103897 - RNA, 22 nt, Haemophilus influenzae Rd
uucaaaugcggcaaaagcgaua

SEQ ID NO: 103898 - RNA, 22 nt, Haemophilus influenzae Rd
aauccgcagauugaauugcaau

SEQ ID NO: 103899 - RNA, 22 nt, Haemophilus influenzae Rd
caaauuguguugaugaaauugg

SEQ ID NO: 103900 - RNA, 22 nt, Haemophilus influenzae Rd
uguuugauaaaugaguaagcgu

SEQ ID NO: 103901 - RNA, 22 nt, Haemophilus influenzae Rd
aucaacaacgcauucugaccca

SEQ ID NO: 103902 - RNA, 22 nt, Haemophilus influenzae Rd
cuuaaucgaugaagcgcguacg

SEQ ID NO: 103903 - RNA, 22 nt, Haemophilus influenzae Rd
uacaaauaauagccaucggcaa

SEQ ID NO: 103904 - RNA, 22 nt, Haemophilus influenzae Rd
aacgcaauuacaggcacaauuu

SEQ ID NO: 103905 - RNA, 22 nt, Haemophilus influenzae Rd
auuuacguuaugggagcaaaug

SEQ ID NO: 103906 - RNA, 22 nt, Haemophilus influenzae Rd
auuacagaaacaccuugauuga

SEQ ID NO: 103907 - RNA, 22 nt, Haemophilus influenzae Rd
gauacauuaaugguguuuugga

SEQ ID NO: 103908 - RNA, 22 nt, Haemophilus influenzae Rd
gugagaaucgguaaaagucgcu

SEQ ID NO: 103909 - RNA, 22 nt, Haemophilus influenzae Rd
gcccuuuuguuauuauagagca

SEQ ID NO: 103910 - RNA, 22 nt, Haemophilus influenzae Rd
ugcgguaguaaugcaaugauua

SEQ ID NO: 103911 - RNA, 22 nt, Haemophilus influenzae Rd
cuuuauuugcaagagauugcaa

SEQ ID NO: 103912 - RNA, 22 nt, Haemophilus influenzae Rd
gugggcugaagcccacccuacg

SEQ ID NO: 103913 - RNA, 22 nt, Haemophilus influenzae Rd
auggcaagauauaauaaaccug

SEQ ID NO: 103914 - RNA, 22 nt, Haemophilus influenzae Rd
uuguaauguugaaaggguuugc

SEQ ID NO: 103915 - RNA, 22 nt, Haemophilus influenzae Rd
gugcguuauuuuccauuugcgu

SEQ ID NO: 103916 - RNA, 22 nt, Haemophilus influenzae Rd
uuaccguuccuguuauuuguac

SEQ ID NO: 103917 - RNA, 21 nt, Haemophilus influenzae Rd
guauaucggcaguuuugugcc

SEQ ID NO: 103918 - RNA, 22 nt, Haemophilus influenzae Rd
agaacuugcucaacuugguguu

SEQ ID NO: 103919 - RNA, 22 nt, Haemophilus influenzae Rd
gaccgcacuuuggcacguggaa

SEQ ID NO: 103920 - RNA, 21 nt, Haemophilus influenzae Rd
gucuguaggaugauuagcuau

SEQ ID NO: 103921 - RNA, 22 nt, Haemophilus influenzae Rd
auguauuccguucaagaacaaa

SEQ ID NO: 103922 - RNA, 22 nt, Haemophilus influenzae Rd
ucaucuuuuacgaagugcaucg

SEQ ID NO: 103923 - RNA, 22 nt, Haemophilus influenzae Rd
uucagcaaguuuuuccuguuga

SEQ ID NO: 103924 - RNA, 22 nt, Haemophilus influenzae Rd
aacggcacgucauuguucccga

SEQ ID NO: 103925 - RNA, 22 nt, Haemophilus influenzae Rd
ugccuguuaaaagcaugguuaa

SEQ ID NO: 103926 - RNA, 22 nt, Haemophilus influenzae Rd
aguacgaauauggucagacacg

SEQ ID NO: 103927 - RNA, 22 nt, Haemophilus influenzae Rd
augauccuauucauaucguagg

SEQ ID NO: 103928 - RNA, 22 nt, Haemophilus influenzae Rd
accuugaguuucuugcugaauu

SEQ ID NO: 103929 - RNA, 19 nt, Haemophilus influenzae Rd
uugcagauugcgcagauuu

SEQ ID NO: 103930 - RNA, 19 nt, Haemophilus influenzae Rd
uuugaguaacggaauauug

SEQ ID NO: 103931 - RNA, 20 nt, Haemophilus influenzae Rd
uugguucuggcgagcuaaag

SEQ ID NO: 103932 - RNA, 22 nt, Haemophilus influenzae Rd
uugcucuauuuuagcagaagau

SEQ ID NO: 103933 - RNA, 22 nt, Haemophilus influenzae Rd
aucaaguagcuggcgcauugac

SEQ ID NO: 103934 - RNA, 22 nt, Haemophilus influenzae Rd
gucagcacaacugcauuugccg

SEQ ID NO: 103935 - RNA, 22 nt, Haemophilus influenzae Rd
uagauucuuuuauugugaauca

SEQ ID NO: 103936 - RNA, 22 nt, Haemophilus influenzae Rd
uuagcuuggcauggcguacacg

SEQ ID NO: 103937 - RNA, 22 nt, Haemophilus influenzae Rd
ucaaggugcugucgcaggccca

SEQ ID NO: 103938 - RNA, 19 nt, Haemophilus influenzae Rd
augaauggcaauuuagcuu

SEQ ID NO: 103939 - RNA, 22 nt, Haemophilus influenzae Rd
auuaaucauauuuugccuagcg

SEQ ID NO: 103940 - RNA, 21 nt, Haemophilus influenzae Rd
agcuuuuaccgugggcgacca

SEQ ID NO: 103941 - RNA, 22 nt, Haemophilus influenzae Rd
aauaaauugaagcaauugguug

SEQ ID NO: 103942 - RNA, 21 nt, Haemophilus influenzae Rd
aggugcaguggaugcugcaau

SEQ ID NO: 103943 - RNA, 20 nt, Haemophilus influenzae Rd
auuaaagugcgguuauuuuu

SEQ ID NO: 103944 - RNA, 20 nt, Haemophilus influenzae Rd
cauuaguggcauuaaaucag

SEQ ID NO: 103945 - RNA, 22 nt, Haemophilus influenzae Rd
aaucuuaauagucaugaagggc

SEQ ID NO: 103946 - RNA, 22 nt, Haemophilus influenzae Rd
uauuagauccuuuugcugguag

SEQ ID NO: 103947 - RNA, 22 nt, Haemophilus influenzae Rd
auguuguaaaguucgcaaacau

SEQ ID NO: 103948 - RNA, 22 nt, Haemophilus influenzae Rd
uauuaguguuagucgcugcacc

SEQ ID NO: 103949 - RNA, 22 nt, Haemophilus influenzae Rd
ugcacguuuggcauucgauagc

SEQ ID NO: 103950 - RNA, 22 nt, Haemophilus influenzae Rd
uuuuugccgaucgacauuauau

SEQ ID NO: 103951 - RNA, 22 nt, Haemophilus influenzae Rd
agguuuugucuagauaaagugc

SEQ ID NO: 103952 - RNA, 22 nt, Haemophilus influenzae Rd
uuuaugaaggugcauuuggguu

SEQ ID NO: 103953 - RNA, 23 nt, Haemophilus influenzae Rd
aggaaaauggcaaaaccgauuau

SEQ ID NO: 103954 - RNA, 22 nt, Haemophilus influenzae Rd
uguucuuucucaauaguuuuau

SEQ ID NO: 103955 - RNA, 22 nt, Haemophilus influenzae Rd
gcacauaauguucauauuggca

SEQ ID NO: 103956 - RNA, 22 nt, Haemophilus influenzae Rd
uucuauggcgaacaaaaaggcu

SEQ ID NO: 103957 - RNA, 23 nt, Haemophilus influenzae Rd
ucugaauauaaggaaacucuuau

SEQ ID NO: 103958 - RNA, 22 nt, Haemophilus influenzae Rd
uuuacgugaaaauaucgagcaa

SEQ ID NO: 103959 - RNA, 22 nt, Haemophilus influenzae Rd
aagauugauaaccgaaaaccga

SEQ ID NO: 103960 - RNA, 22 nt, Haemophilus influenzae Rd
caaaauuuagcugccuuguugc

SEQ ID NO: 103961 - RNA, 22 nt, Haemophilus influenzae Rd
aguuggaaauauugaucaaggg

SEQ ID NO: 103962 - RNA, 22 nt, Haemophilus influenzae Rd
uggugguuucacguugguuggu

SEQ ID NO: 103963 - RNA, 22 nt, Haemophilus influenzae Rd
uuuagccaacggauuagaugaa

SEQ ID NO: 103964 - RNA, 22 nt, Haemophilus influenzae Rd
auauucuuauugcaacuuaugc

SEQ ID NO: 103965 - RNA, 22 nt, Haemophilus influenzae Rd
uuccaucuggcaaugcggugcg

SEQ ID NO: 103966 - RNA, 19 nt, Haemophilus influenzae Rd
ugcaguuggaucuggguuu

SEQ ID NO: 103967 - RNA, 19 nt, Haemophilus influenzae Rd
cuugauacaaugcuucauu

SEQ ID NO: 103968 - RNA, 22 nt, Haemophilus influenzae Rd
uaaauauuacguaacugaaaug

SEQ ID NO: 103969 - RNA, 22 nt, Haemophilus influenzae Rd
guguuguucaaaaaauucgcag

SEQ ID NO: 103970 - RNA, 18 nt, Haemophilus influenzae Rd
uugcugauuauaaagcaa

SEQ ID NO: 103971 - RNA, 22 nt, Haemophilus influenzae Rd
uacuuaaugugauuaggcuuac

SEQ ID NO: 103972 - RNA, 22 nt, Haemophilus influenzae Rd
uucaucagauaauucacggggu

SEQ ID NO: 103973 - RNA, 20 nt, Haemophilus influenzae Rd
agauuguuguggcaaauuuc

SEQ ID NO: 103974 - RNA, 22 nt, Haemophilus influenzae Rd
agcccugugccguaaaacuccg

SEQ ID NO: 103975 - RNA, 21 nt, Haemophilus influenzae Rd
uugguagaguaaauucucggu

SEQ ID NO: 103976 - RNA, 22 nt, Haemophilus influenzae Rd
gcgguuuggcugugauguugcc

SEQ ID NO: 103977 - RNA, 22 nt, Haemophilus influenzae Rd
cgcaaaaacuucuaugguaaau

SEQ ID NO: 103978 - RNA, 22 nt, Haemophilus influenzae Rd
augcucgccauuugcgugaugc

SEQ ID NO: 103979 - RNA, 22 nt, Haemophilus influenzae Rd
aguuguagauauuauuaaagaa

SEQ ID NO: 103980 - RNA, 22 nt, Haemophilus influenzae Rd
uagcuauuauugcgcauccauu

SEQ ID NO: 103981 - RNA, 22 nt, Haemophilus influenzae Rd
uuuuguaguauccauucauuug

SEQ ID NO: 103982 - RNA, 20 nt, Haemophilus influenzae Rd
aacacggcauuguguuagga

SEQ ID NO: 103983 - RNA, 22 nt, Haemophilus influenzae Rd
ggaaaaacgccuuaaucgccga

SEQ ID NO: 103984 - RNA, 22 nt, Haemophilus influenzae Rd
uucgauuagugaucaaugcugg

SEQ ID NO: 103985 - RNA, 22 nt, Haemophilus influenzae Rd
aauccgugcuuauucuuuacaa

SEQ ID NO: 103986 - RNA, 22 nt, Haemophilus influenzae Rd
aaugccaacccguaacgcacgu

SEQ ID NO: 103987 - RNA, 22 nt, Haemophilus influenzae Rd
gcggucaaauucuucucauuau

SEQ ID NO: 103988 - RNA, 22 nt, Haemophilus influenzae Rd
uuuucaaugagaucaagauguu

SEQ ID NO: 103989 - RNA, 22 nt, Haemophilus influenzae Rd
aauucgugaacauacgcauuug

SEQ ID NO: 103990 - RNA, 22 nt, Haemophilus influenzae Rd
ugcggaucguuugguacagcau

SEQ ID NO: 103991 - RNA, 22 nt, Haemophilus influenzae Rd
aucaguggcaugguaauagcca

SEQ ID NO: 103992 - RNA, 22 nt, Haemophilus influenzae Rd
ucuugauauuaaggcguguuag

SEQ ID NO: 103993 - RNA, 18 nt, Haemophilus influenzae Rd
ugcggcuuuauugguaaa

SEQ ID NO: 103994 - RNA, 22 nt, Haemophilus influenzae Rd
uuuauggguugcuucuacugau

SEQ ID NO: 103995 - RNA, 22 nt, Haemophilus influenzae Rd
gcuggugcuauuuguuugugca

SEQ ID NO: 103996 - RNA, 23 nt, Haemophilus influenzae Rd
agaacuucauccgcguaccuugg

SEQ ID NO: 103997 - RNA, 16 nt, Haemophilus influenzae Rd
ugaugcaacuuuagcu

SEQ ID NO: 103998 - RNA, 22 nt, Haemophilus influenzae Rd
cgccuuguuccguuaaaauuug

SEQ ID NO: 103999 - RNA, 23 nt, Haemophilus influenzae Rd
aaacgcaccgcacuuuuggagug

SEQ ID NO: 104000 - RNA, 22 nt, Haemophilus influenzae Rd
gucaauuucggguaaagguuuu

SEQ ID NO: 104001 - RNA, 22 nt, Haemophilus influenzae Rd
ggcuaaagcccacccuacggaa

SEQ ID NO: 104002 - RNA, 23 nt, Haemophilus influenzae Rd
agguggucuuuauuuucgaugaa

SEQ ID NO: 104003 - RNA, 22 nt, Haemophilus influenzae Rd
guuaauccauucacgacugaaa

SEQ ID NO: 104004 - RNA, 22 nt, Haemophilus influenzae Rd
gagacaauuucaguuggaacgg

SEQ ID NO: 104005 - RNA, 22 nt, Haemophilus influenzae Rd
cgucaaucaauuggaaauccgc

SEQ ID NO: 104006 - RNA, 22 nt, Haemophilus influenzae Rd
uuagcuggugggguuuagcuuu

SEQ ID NO: 104007 - RNA, 18 nt, Haemophilus influenzae Rd
cuguaccgaauucacgau

SEQ ID NO: 104008 - RNA, 22 nt, Haemophilus influenzae Rd
gcgaaggcgguucgggcggugc

SEQ ID NO: 104009 - RNA, 22 nt, Haemophilus influenzae Rd
agccaaguagggcaaaagugcg

SEQ ID NO: 104010 - RNA, 22 nt, Haemophilus influenzae Rd
aaaaaguuauguucgccuuucu

SEQ ID NO: 104011 - RNA, 22 nt, Haemophilus influenzae Rd
uuugccaauggaaugugccaca

SEQ ID NO: 104012 - RNA, 22 nt, Haemophilus influenzae Rd
gcacaaaauggccauuuauuua

SEQ ID NO: 104013 - RNA, 22 nt, Haemophilus influenzae Rd
gugcaguaaucgcaaucuucgg

SEQ ID NO: 104014 - RNA, 22 nt, Haemophilus influenzae Rd
ucagugauggacgaaauggaaa

SEQ ID NO: 104015 - RNA, 22 nt, Haemophilus influenzae Rd
ugcguuuaucuuacagcuauuu

SEQ ID NO: 104016 - RNA, 22 nt, Haemophilus influenzae Rd
uuucacaacgcauugaaagcga

SEQ ID NO: 104017 - RNA, 22 nt, Haemophilus influenzae Rd
auuuuugugaaaucucaucagg

SEQ ID NO: 104018 - RNA, 22 nt, Haemophilus influenzae Rd
gucgauuguuagauuuaccaac

SEQ ID NO: 104019 - RNA, 22 nt, Haemophilus influenzae Rd
aguaauaguaauauuagcgacu

SEQ ID NO: 104020 - RNA, 22 nt, Haemophilus influenzae Rd
uaaauaugcaacagaauuaggc

SEQ ID NO: 104021 - RNA, 22 nt, Haemophilus influenzae Rd
guaagaguuuccuauuuagaau

SEQ ID NO: 104022 - RNA, 22 nt, Haemophilus influenzae Rd
agauaaauuuauuacuaaaagu

SEQ ID NO: 104023 - RNA, 22 nt, Haemophilus influenzae Rd
aucgcgugcuuguuucagcgug

SEQ ID NO: 104024 - RNA, 22 nt, Haemophilus influenzae Rd
uuguuaugggaucggugcuuuc

SEQ ID NO: 104025 - RNA, 22 nt, Haemophilus influenzae Rd
caaggcuuucgcggguucuuuu

SEQ ID NO: 104026 - RNA, 22 nt, Haemophilus influenzae Rd
gcggcagauauuuuaggugcau

SEQ ID NO: 104027 - RNA, 22 nt, Haemophilus influenzae Rd
uuugaagaauggcgguaacauu

SEQ ID NO: 104028 - RNA, 22 nt, Haemophilus influenzae Rd
uuuguaauagaauggcgucacu

SEQ ID NO: 104029 - RNA, 22 nt, Haemophilus influenzae Rd
cgguacauucuggguuaauuaa

SEQ ID NO: 104030 - RNA, 22 nt, Haemophilus influenzae Rd
uaucggaugucagcuuaucugu

SEQ ID NO: 104031 - RNA, 22 nt, Haemophilus influenzae Rd
agagaaagauuugauugguaua

SEQ ID NO: 104032 - RNA, 22 nt, Haemophilus influenzae Rd
aaacaucacaucagaaagauca

SEQ ID NO: 104033 - RNA, 22 nt, Haemophilus influenzae Rd
ugucuugccuguaccaguuuga

SEQ ID NO: 104034 - RNA, 22 nt, Haemophilus influenzae Rd
cacugaugcccaaaaauaacgu

SEQ ID NO: 104035 - RNA, 22 nt, Haemophilus influenzae Rd
agaaccaauggcagcugcaauu

SEQ ID NO: 104036 - RNA, 22 nt, Haemophilus influenzae Rd
uaggaaaauaaaaugccgucua

SEQ ID NO: 104037 - RNA, 20 nt, Haemophilus influenzae Rd
cuuugcugaacuacucgcuc

SEQ ID NO: 104038 - RNA, 22 nt, Haemophilus influenzae Rd
uuauaguuccaaccuuuuuagu

SEQ ID NO: 104039 - RNA, 20 nt, Haemophilus influenzae Rd
uuguucuggcgugauuguuu

SEQ ID NO: 104040 - RNA, 22 nt, Haemophilus influenzae Rd
gaaaauuguccaugucaaucua

SEQ ID NO: 104041 - RNA, 22 nt, Haemophilus influenzae Rd
uaagcuaucgcaccgugagguu

SEQ ID NO: 104042 - RNA, 22 nt, Haemophilus influenzae Rd
ggauuguuuaaucguaaaaauc

SEQ ID NO: 104043 - RNA, 22 nt, Haemophilus influenzae Rd
uugugaaguaaugacuauucgc

SEQ ID NO: 104044 - RNA, 20 nt, Haemophilus influenzae Rd
gaaaguuuuguauugaugau

SEQ ID NO: 104045 - RNA, 22 nt, Haemophilus influenzae Rd
uauuguuaaagugaaaaauggu

SEQ ID NO: 104046 - RNA, 22 nt, Haemophilus influenzae Rd
auauggucaagauacuuuggaa

SEQ ID NO: 104047 - RNA, 22 nt, Haemophilus influenzae Rd
augacuuaugccuucguaaaua

SEQ ID NO: 104048 - RNA, 22 nt, Haemophilus influenzae Rd
ugauuuuacccguuacuuuauc

SEQ ID NO: 104049 - RNA, 22 nt, Haemophilus influenzae Rd
uuguaacuggcuuuuaucugua

SEQ ID NO: 104050 - RNA, 22 nt, Haemophilus influenzae Rd
gauugcauuuuuagucaauggc

SEQ ID NO: 104051 - RNA, 22 nt, Haemophilus influenzae Rd
augcuuuaauugaagguguaga

SEQ ID NO: 104052 - RNA, 22 nt, Haemophilus influenzae Rd
ggaguuuuacggcacagggcug

SEQ ID NO: 104053 - RNA, 22 nt, Haemophilus influenzae Rd
gcugcacucauccaguuggcag

SEQ ID NO: 104054 - RNA, 22 nt, Haemophilus influenzae Rd
gugauuuaucuuuaauuacauc

SEQ ID NO: 104055 - RNA, 22 nt, Haemophilus influenzae Rd
auucguauuaccuuaaacaaga

SEQ ID NO: 104056 - RNA, 22 nt, Haemophilus influenzae Rd
uucacgcucaacaguuauaucu

SEQ ID NO: 104057 - RNA, 22 nt, Haemophilus influenzae Rd
uuguugcguacuggaugaaccc

SEQ ID NO: 104058 - RNA, 22 nt, Haemophilus influenzae Rd
ccacuuauuuugguucaguugc

SEQ ID NO: 104059 - RNA, 22 nt, Haemophilus influenzae Rd
ccgcacuuuuuguucauauucu

SEQ ID NO: 104060 - RNA, 22 nt, Haemophilus influenzae Rd
agcagacgaauaggcguuggcg

SEQ ID NO: 104061 - RNA, 22 nt, Haemophilus influenzae Rd
aaugggugcguaagcugauagu

SEQ ID NO: 104062 - RNA, 18 nt, Haemophilus influenzae Rd
uguguauaugauuggcuu

SEQ ID NO: 104063 - RNA, 22 nt, Haemophilus influenzae Rd
uaaggcauccauuaacauuaca

SEQ ID NO: 104064 - RNA, 22 nt, Haemophilus influenzae Rd
ucaucuucuucuggguugcacg

SEQ ID NO: 104065 - RNA, 23 nt, Haemophilus influenzae Rd
ucucgguacuucugguaccuugu

SEQ ID NO: 104066 - RNA, 22 nt, Haemophilus influenzae Rd
guauuucaucacgucuuacuuu

SEQ ID NO: 104067 - RNA, 22 nt, Haemophilus influenzae Rd
auuacgccccauuuguguaaga

SEQ ID NO: 104068 - RNA, 22 nt, Haemophilus influenzae Rd
cagcgcaaugucuuuaccugau

SEQ ID NO: 104069 - RNA, 22 nt, Haemophilus influenzae Rd
auaugcguauuuagauaaggau

SEQ ID NO: 104070 - RNA, 22 nt, Haemophilus influenzae Rd
uuggcuuaucaguaaauguacu

SEQ ID NO: 104071 - RNA, 22 nt, Haemophilus influenzae Rd
aaacccucuguuuaaguagcga

SEQ ID NO: 104072 - RNA, 22 nt, Haemophilus influenzae Rd
ucacuugcacguuguugcaauu

SEQ ID NO: 104073 - RNA, 22 nt, Haemophilus influenzae Rd
uggaaaauaaucaaacgcaagg

SEQ ID NO: 104074 - RNA, 22 nt, Haemophilus influenzae Rd
aagaaugucguacuagaaaaaa

SEQ ID NO: 104075 - RNA, 23 nt, Haemophilus influenzae Rd
ucaacucgacuauuuucaugcac

SEQ ID NO: 104076 - RNA, 22 nt, Haemophilus influenzae Rd
auuuacguauugauguuuaucg

SEQ ID NO: 104077 - RNA, 22 nt, Haemophilus influenzae Rd
aauaacaugguacgagaugcgu

SEQ ID NO: 104078 - RNA, 22 nt, Haemophilus influenzae Rd
aucguuuuaaucauauuggaac

SEQ ID NO: 104079 - RNA, 19 nt, Haemophilus influenzae Rd
aagucuuaauaggugcuua

SEQ ID NO: 104080 - RNA, 22 nt, Haemophilus influenzae Rd
aaaccauuuggucauuucaauu

SEQ ID NO: 104081 - RNA, 22 nt, Haemophilus influenzae Rd
ccauauugccccuaauguacua

SEQ ID NO: 104082 - RNA, 22 nt, Haemophilus influenzae Rd
uucaguuucaucauuaaaugua

SEQ ID NO: 104083 - RNA, 21 nt, Haemophilus influenzae Rd
uugcaaggcuugaaucauugc

SEQ ID NO: 104084 - RNA, 22 nt, Haemophilus influenzae Rd
ugaguuuccacauuuagaugau

SEQ ID NO: 104085 - RNA, 22 nt, Haemophilus influenzae Rd
augaugaaagccguacgcauuu

SEQ ID NO: 104086 - RNA, 22 nt, Haemophilus influenzae Rd
auuguagggugggcuuuagccc

SEQ ID NO: 104087 - RNA, 22 nt, Haemophilus influenzae Rd
aaugauguggaauaugcagggc

SEQ ID NO: 104088 - RNA, 22 nt, Haemophilus influenzae Rd
auacaaugaucguuuguacuug

SEQ ID NO: 104089 - RNA, 22 nt, Haemophilus influenzae Rd
cauugcugauuucgucagugag

SEQ ID NO: 104090 - RNA, 22 nt, Haemophilus influenzae Rd
cuucauuuucuacggugcaaug

SEQ ID NO: 104091 - RNA, 22 nt, Haemophilus influenzae Rd
gcaaucaguugaguguauugug

SEQ ID NO: 104092 - RNA, 22 nt, Haemophilus influenzae Rd
ugcuacguucaauuuguugaau

SEQ ID NO: 104093 - RNA, 22 nt, Haemophilus influenzae Rd
gguuucaucuuuaugaucuuaa

SEQ ID NO: 104094 - RNA, 22 nt, Haemophilus influenzae Rd
auuacgucagagaaaucaauau

SEQ ID NO: 104095 - RNA, 22 nt, Haemophilus influenzae Rd
uacucggcgcauuuggcauuau

SEQ ID NO: 104096 - RNA, 22 nt, Haemophilus influenzae Rd
aagccguacguuugcaaaaugc

SEQ ID NO: 104097 - RNA, 22 nt, Haemophilus influenzae Rd
uauuuugaaaucuuuacggauu

SEQ ID NO: 104098 - RNA, 21 nt, Haemophilus influenzae Rd
ggcauugcucauuuaguugaa

SEQ ID NO: 104099 - RNA, 22 nt, Haemophilus influenzae Rd
agcagcugauuguauuggaaga

SEQ ID NO: 104100 - RNA, 22 nt, Haemophilus influenzae Rd
aaaaaaagaggcgugauuauag

SEQ ID NO: 104101 - RNA, 22 nt, Haemophilus influenzae Rd
auuuaaaauggcaucggcuugu

SEQ ID NO: 104102 - RNA, 22 nt, Haemophilus influenzae Rd
ucgcaguacacaccgauuucac

SEQ ID NO: 104103 - RNA, 22 nt, Haemophilus influenzae Rd
uggguauucguuuauuuaucac

SEQ ID NO: 104104 - RNA, 22 nt, Haemophilus influenzae Rd
ggucaaaaugccauugacuggu

SEQ ID NO: 104105 - RNA, 21 nt, Haemophilus influenzae Rd
cggcuuaucauccugaaucuc

SEQ ID NO: 104106 - RNA, 22 nt, Haemophilus influenzae Rd
gucagcgaaaugguacaaguga

SEQ ID NO: 104107 - RNA, 22 nt, Haemophilus influenzae Rd
ugcuuuugcaccauauucugca

SEQ ID NO: 104108 - RNA, 22 nt, Haemophilus influenzae Rd
cuuggguucauuugaaaugagu

SEQ ID NO: 104109 - RNA, 22 nt, Haemophilus influenzae Rd
uuaauuugccgauugugccgcu

SEQ ID NO: 104110 - RNA, 22 nt, Haemophilus influenzae Rd
auugcguggauuaaugaaucca

SEQ ID NO: 104111 - RNA, 22 nt, Haemophilus influenzae Rd
uacagacaauaaacauuuuaau

SEQ ID NO: 104112 - RNA, 22 nt, Haemophilus influenzae Rd
cugaugugggucagcaucaaau

SEQ ID NO: 104113 - RNA, 22 nt, Haemophilus influenzae Rd
gaagauucggugauuuuagucg

SEQ ID NO: 104114 - RNA, 22 nt, Haemophilus influenzae Rd
acuuuuagauuauucuaaccgu

SEQ ID NO: 104115 - RNA, 22 nt, Haemophilus influenzae Rd
auuacguuuuagcaagguaauu

SEQ ID NO: 104116 - RNA, 22 nt, Haemophilus influenzae Rd
guugagcaagguaaaguacgug

SEQ ID NO: 104117 - RNA, 23 nt, Haemophilus influenzae Rd
ugagcaugcucaucaaaaagugc

SEQ ID NO: 104118 - RNA, 22 nt, Haemophilus influenzae Rd
cacuagaacaguuuuagaaugc

SEQ ID NO: 104119 - RNA, 22 nt, Haemophilus influenzae Rd
cagcuauugcugacuuugauau

SEQ ID NO: 104120 - RNA, 22 nt, Haemophilus influenzae Rd
agcagcaaaucuugcagcagcu

SEQ ID NO: 104121 - RNA, 18 nt, Haemophilus influenzae Rd
uuagaacuuuaucaugcu

SEQ ID NO: 104122 - RNA, 22 nt, Haemophilus influenzae Rd
guugggaacccuggauguggug

SEQ ID NO: 104123 - RNA, 22 nt, Haemophilus influenzae Rd
cuguuggauucguuuccauaca

SEQ ID NO: 104124 - RNA, 22 nt, Haemophilus influenzae Rd
acuuguaugccaggcgauuugc

SEQ ID NO: 104125 - RNA, 22 nt, Haemophilus influenzae Rd
aaucaaccaaugggcgaaaaug

SEQ ID NO: 104126 - RNA, 22 nt, Haemophilus influenzae Rd
uggcaauucauucucuuuuugc

SEQ ID NO: 104127 - RNA, 22 nt, Haemophilus influenzae Rd
uuauuagaacaauuggaaacgg

SEQ ID NO: 104128 - RNA, 22 nt, Haemophilus influenzae Rd
aucauuuaaccuaucuugcuga

SEQ ID NO: 104129 - RNA, 22 nt, Haemophilus influenzae Rd
cgccaaaucggcuuggauuacg

SEQ ID NO: 104130 - RNA, 22 nt, Haemophilus influenzae Rd
ugcgauugaagcaguggucggu

SEQ ID NO: 104131 - RNA, 22 nt, Haemophilus influenzae Rd
cacaagauaaagauauuaaaca

SEQ ID NO: 104132 - RNA, 22 nt, Haemophilus influenzae Rd
ugugugguuuuacgcuuaucac

SEQ ID NO: 104133 - RNA, 22 nt, Haemophilus influenzae Rd
agccgauucucguuaucguacu

SEQ ID NO: 104134 - RNA, 22 nt, Haemophilus influenzae Rd
ugauagcaauaauagcguggcg

SEQ ID NO: 104135 - RNA, 23 nt, Haemophilus influenzae Rd
acuugugaacaucauuuugugac

SEQ ID NO: 104136 - RNA, 22 nt, Haemophilus influenzae Rd
auucagaaauggcgaagccuau

SEQ ID NO: 104137 - RNA, 22 nt, Haemophilus influenzae Rd
caguaacaauaguuuuaacauu

SEQ ID NO: 104138 - RNA, 22 nt, Haemophilus influenzae Rd
aaguuugaaaacggcgauaaau

SEQ ID NO: 104139 - RNA, 22 nt, Haemophilus influenzae Rd
auuacuuauaugaucauagccu

SEQ ID NO: 104140 - RNA, 22 nt, Haemophilus influenzae Rd
uuaucgugaaagaucuugaagc

SEQ ID NO: 104141 - RNA, 22 nt, Haemophilus influenzae Rd
uugauuuacgguaacgguauca

SEQ ID NO: 104142 - RNA, 22 nt, Haemophilus influenzae Rd
gaaguugugauccaguuggcgu

SEQ ID NO: 104143 - RNA, 22 nt, Haemophilus influenzae Rd
agccagaugcaaaaucaauggc

SEQ ID NO: 104144 - RNA, 19 nt, Haemophilus influenzae Rd
gauaauggauacuauaagg

SEQ ID NO: 104145 - RNA, 22 nt, Haemophilus influenzae Rd
guucugauuuagugccuaggua

SEQ ID NO: 104146 - RNA, 22 nt, Haemophilus influenzae Rd
uugguacaggaaauauucgaga

SEQ ID NO: 104147 - RNA, 22 nt, Haemophilus influenzae Rd
gugauaaaaaugaagcggcuuu

SEQ ID NO: 104148 - RNA, 22 nt, Haemophilus influenzae Rd
uauuauugaaugguucuuucaa

SEQ ID NO: 104149 - RNA, 22 nt, Haemophilus influenzae Rd
ucuguuguuauuaauguagaag

SEQ ID NO: 104150 - RNA, 22 nt, Haemophilus influenzae Rd
uaauggugcuuuguauuguauu

SEQ ID NO: 104151 - RNA, 22 nt, Haemophilus influenzae Rd
uuuuugaccgcugauugcugcu

SEQ ID NO: 104152 - RNA, 18 nt, Haemophilus influenzae Rd
aaaaucuuuggaauuggc

SEQ ID NO: 104153 - RNA, 22 nt, Haemophilus influenzae Rd
ucgccguauucgugguaucacu

SEQ ID NO: 104154 - RNA, 22 nt, Haemophilus influenzae Rd
cuggguuagauaaaguccaguu

SEQ ID NO: 104155 - RNA, 22 nt, Haemophilus influenzae Rd
uagggugggcuucagcccaccg

SEQ ID NO: 104156 - RNA, 22 nt, Haemophilus influenzae Rd
cgcguauugcugauguguuacu

SEQ ID NO: 104157 - RNA, 22 nt, Haemophilus influenzae Rd
augguugguugccacucuuuga

SEQ ID NO: 104158 - RNA, 22 nt, Haemophilus influenzae Rd
cgccaauauuuaaugcaauuuu

SEQ ID NO: 104159 - RNA, 22 nt, Haemophilus influenzae Rd
uggggugugccgaugacguugu

SEQ ID NO: 104160 - RNA, 22 nt, Haemophilus influenzae Rd
uuagcgcaauaugcggauuuaa

SEQ ID NO: 104161 - RNA, 22 nt, Haemophilus influenzae Rd
aauuaauuguagagcaucgcug

SEQ ID NO: 104162 - RNA, 22 nt, Haemophilus influenzae Rd
agcuauugaagauaaacaaggu

SEQ ID NO: 104163 - RNA, 22 nt, Haemophilus influenzae Rd
aggcaguaacucaaucucgauc

SEQ ID NO: 104164 - RNA, 22 nt, Haemophilus influenzae Rd
auuagcaggguuaucucgcaaa

SEQ ID NO: 104165 - RNA, 22 nt, Haemophilus influenzae Rd
agcgaaacuuuaugcugaucca

SEQ ID NO: 104166 - RNA, 22 nt, Haemophilus influenzae Rd
auauuucacaaugucagaagau

SEQ ID NO: 104167 - RNA, 22 nt, Haemophilus influenzae Rd
ugauuuuuuaauagaaaguagu

SEQ ID NO: 104168 - RNA, 22 nt, Haemophilus influenzae Rd
uugauuucguccucacucgccc

SEQ ID NO: 104169 - RNA, 22 nt, Haemophilus influenzae Rd
aagaauuacgcaacagcgguug

SEQ ID NO: 104170 - RNA, 22 nt, Haemophilus influenzae Rd
cguaucaaucucaccauuuacc

SEQ ID NO: 104171 - RNA, 22 nt, Haemophilus influenzae Rd
cuugugugguuaagccuugcgc

SEQ ID NO: 104172 - RNA, 22 nt, Haemophilus influenzae Rd
uuagcauuuaugcuuuucagcg

SEQ ID NO: 104173 - RNA, 22 nt, Haemophilus influenzae Rd
uuugagcaaaguaaguugaauu

SEQ ID NO: 104174 - RNA, 22 nt, Haemophilus influenzae Rd
uagcggaaauugaucgcauuga

SEQ ID NO: 104175 - RNA, 22 nt, Haemophilus influenzae Rd
uugcccaaauuuccauuggguu

SEQ ID NO: 104176 - RNA, 22 nt, Haemophilus influenzae Rd
uucaccgccuacaugaucaccg

SEQ ID NO: 104177 - RNA, 22 nt, Haemophilus influenzae Rd
uguugggcaaucugguguuggu

SEQ ID NO: 104178 - RNA, 21 nt, Haemophilus influenzae Rd
cgucguaugcuuggcacagag

SEQ ID NO: 104179 - RNA, 22 nt, Haemophilus influenzae Rd
uuuuuccguugagcaaguugaa

SEQ ID NO: 104180 - RNA, 22 nt, Haemophilus influenzae Rd
caaccugugaugguuucuuuua

SEQ ID NO: 104181 - RNA, 22 nt, Haemophilus influenzae Rd
ugagcaagguuuccaaugccgu

SEQ ID NO: 104182 - RNA, 22 nt, Haemophilus influenzae Rd
uugugugcguucuauugcuuaa

SEQ ID NO: 104183 - RNA, 22 nt, Haemophilus influenzae Rd
uguguauaucaccgauguugca

SEQ ID NO: 104184 - RNA, 22 nt, Haemophilus influenzae Rd
auuguguuagcccgugaaauga

SEQ ID NO: 104185 - RNA, 21 nt, Haemophilus influenzae Rd
ugggcagaaacccauccuaua

SEQ ID NO: 104186 - RNA, 22 nt, Haemophilus influenzae Rd
cacguucaagaguuaccugugu

SEQ ID NO: 104187 - RNA, 22 nt, Haemophilus influenzae Rd
gggcaaaauugcauuaaauauu

SEQ ID NO: 104188 - RNA, 22 nt, Haemophilus influenzae Rd
auuuaguauucguucauuucga

SEQ ID NO: 104189 - RNA, 22 nt, Haemophilus influenzae Rd
gguaagauuauggcguuguuga

SEQ ID NO: 104190 - RNA, 22 nt, Haemophilus influenzae Rd
acugaauuaagcaaagugaacg

SEQ ID NO: 104191 - RNA, 22 nt, Haemophilus influenzae Rd
gcaguagauucgauuauuguga

SEQ ID NO: 104192 - RNA, 22 nt, Haemophilus influenzae Rd
cuauucuaaauucuuguucgau

SEQ ID NO: 104193 - RNA, 19 nt, Haemophilus influenzae Rd
guucuacauguuucacaau

SEQ ID NO: 104194 - RNA, 22 nt, Haemophilus influenzae Rd
cgguugauuuuguuugaauaau

SEQ ID NO: 104195 - RNA, 18 nt, Haemophilus influenzae Rd
cggcauuuuuucuuccua

SEQ ID NO: 104196 - RNA, 22 nt, Haemophilus influenzae Rd
gguauuggucgugaugaauaua

SEQ ID NO: 104197 - RNA, 22 nt, Haemophilus influenzae Rd
uuguaauuuaagcacuugaagc

SEQ ID NO: 104198 - RNA, 22 nt, Haemophilus influenzae Rd
gaauggcauuuugcgcaccguu

SEQ ID NO: 104199 - RNA, 22 nt, Haemophilus influenzae Rd
uucuguugcuuucgucuuguau

SEQ ID NO: 104200 - RNA, 22 nt, Haemophilus influenzae Rd
agaaaugcaagcgauguguuuu

SEQ ID NO: 104201 - RNA, 22 nt, Haemophilus influenzae Rd
aauuuauccucugauguagggc

SEQ ID NO: 104202 - RNA, 22 nt, Haemophilus influenzae Rd
uugaaacuuuugaagaagguaa

SEQ ID NO: 104203 - RNA, 22 nt, Haemophilus influenzae Rd
aaagggguggcugauaauugua

SEQ ID NO: 104204 - RNA, 22 nt, Haemophilus influenzae Rd
gaauuuauccauuacuucuugu

SEQ ID NO: 104205 - RNA, 22 nt, Haemophilus influenzae Rd
agaaauggguucguuauuggcu

SEQ ID NO: 104206 - RNA, 22 nt, Haemophilus influenzae Rd
uugcuaauuuaauugcugauuu

SEQ ID NO: 104207 - RNA, 22 nt, Haemophilus influenzae Rd
augaacaaaguaaauucaaucg

SEQ ID NO: 104208 - RNA, 22 nt, Haemophilus influenzae Rd
augacuuuagugggauugucgg

SEQ ID NO: 104209 - RNA, 22 nt, Haemophilus influenzae Rd
auguauuuaccgauuuugguug

SEQ ID NO: 104210 - RNA, 22 nt, Haemophilus influenzae Rd
acgauuauuuagugauugccau

SEQ ID NO: 104211 - RNA, 22 nt, Haemophilus influenzae Rd
guaaaaccuaaugcauauagau

SEQ ID NO: 104212 - RNA, 22 nt, Haemophilus influenzae Rd
acugaaccuaggauauacuuac

SEQ ID NO: 104213 - RNA, 22 nt, Haemophilus influenzae Rd
uugggcaaauguaauuugccua

SEQ ID NO: 104214 - RNA, 22 nt, Haemophilus influenzae Rd
guuugguaaguaaaugcacuag

SEQ ID NO: 104215 - RNA, 22 nt, Haemophilus influenzae Rd
gguaagauuacgguaaggguug

SEQ ID NO: 104216 - RNA, 22 nt, Haemophilus influenzae Rd
guggauuucgagcauuggggaa

SEQ ID NO: 104217 - RNA, 22 nt, Haemophilus influenzae Rd
aacuuaugauuucuauuuugaa

SEQ ID NO: 104218 - RNA, 22 nt, Haemophilus influenzae Rd
ugaucguuaaaugugguguuuu

SEQ ID NO: 104219 - RNA, 22 nt, Haemophilus influenzae Rd
accgaacuuucucacauuaaca

SEQ ID NO: 104220 - RNA, 22 nt, Haemophilus influenzae Rd
ugccauuaauuuuauuugccgu

SEQ ID NO: 104221 - RNA, 21 nt, Haemophilus influenzae Rd
uggaaacgccauacauuagcu

SEQ ID NO: 104222 - RNA, 22 nt, Haemophilus influenzae Rd
agguuuaguuaaagaauauacg

SEQ ID NO: 104223 - RNA, 22 nt, Haemophilus influenzae Rd
caacaauuuuugacaauaaggg

SEQ ID NO: 104224 - RNA, 22 nt, Haemophilus influenzae Rd
aaugauaauguggccaacguuu

SEQ ID NO: 104225 - RNA, 22 nt, Haemophilus influenzae Rd
uugguuaagugaaagugaaaac

SEQ ID NO: 104226 - RNA, 22 nt, Haemophilus influenzae Rd
uaguuuguguuugcagagaucg

SEQ ID NO: 104227 - RNA, 22 nt, Haemophilus influenzae Rd
caaggcaaaaaauuucgcugaa

SEQ ID NO: 104228 - RNA, 22 nt, Haemophilus influenzae Rd
auuuuccagcucugcugcgaaa

SEQ ID NO: 104229 - RNA, 22 nt, Haemophilus influenzae Rd
uaugcguaaagugucuguugcg

SEQ ID NO: 104230 - RNA, 22 nt, Haemophilus influenzae Rd
caggugguuagagcgcaccccu

SEQ ID NO: 104231 - RNA, 22 nt, Haemophilus influenzae Rd
uugggcaagagucgaugccaag

SEQ ID NO: 104232 - RNA, 22 nt, Haemophilus influenzae Rd
uaaagguauucaagaacaacuu

SEQ ID NO: 104233 - RNA, 22 nt, Haemophilus influenzae Rd
ucgcugcuaugaccugcaguua

SEQ ID NO: 104234 - RNA, 20 nt, Haemophilus influenzae Rd
ggacaaggucgauuuguugg

SEQ ID NO: 104235 - RNA, 20 nt, Haemophilus influenzae Rd
cagaaggucgaauuucgcgg

SEQ ID NO: 104236 - RNA, 22 nt, Haemophilus influenzae Rd
ucaauguguuuagauuuugcgg

SEQ ID NO: 104237 - RNA, 22 nt, Haemophilus influenzae Rd
aagccagcaacagauuuacgag

SEQ ID NO: 104238 - RNA, 22 nt, Haemophilus influenzae Rd
aaguacaaaagagcgguugaaa

SEQ ID NO: 104239 - RNA, 22 nt, Haemophilus influenzae Rd
uuaauaaagguggugcgaccgu

SEQ ID NO: 104240 - RNA, 22 nt, Haemophilus influenzae Rd
ucagccaaugcauucaccgaaa

SEQ ID NO: 104241 - RNA, 22 nt, Haemophilus influenzae Rd
aauaugccuucuuccaagcuaa

SEQ ID NO: 104242 - RNA, 17 nt, Haemophilus influenzae Rd
uuuaaaugcuaacucag

SEQ ID NO: 104243 - RNA, 22 nt, Haemophilus influenzae Rd
gguuaaugugaaauguauucca

SEQ ID NO: 104244 - RNA, 22 nt, Haemophilus influenzae Rd
gugaauauuuaccgugaaccac

SEQ ID NO: 104245 - RNA, 22 nt, Haemophilus influenzae Rd
aucaacuugcuaaagauuuagu

SEQ ID NO: 104246 - RNA, 22 nt, Haemophilus influenzae Rd
ugcguuuugaaggagauauuuu

SEQ ID NO: 104247 - RNA, 22 nt, Haemophilus influenzae Rd
gcgaugaaaaugugcaaguuga

SEQ ID NO: 104248 - RNA, 22 nt, Haemophilus influenzae Rd
gguguuuacgauaugaaaacug

SEQ ID NO: 104249 - RNA, 23 nt, Haemophilus influenzae Rd
cgcuugucaucguuauuuuucag

SEQ ID NO: 104250 - RNA, 22 nt, Haemophilus influenzae Rd
ugacguggaauuaucaaaaauu

SEQ ID NO: 104251 - RNA, 22 nt, Haemophilus influenzae Rd
ugggcgaugguaauggccgagu

SEQ ID NO: 104252 - RNA, 22 nt, Haemophilus influenzae Rd
auuuuacgcguagcacgucacu

SEQ ID NO: 104253 - RNA, 22 nt, Haemophilus influenzae Rd
guuuaaccgcauuagcaaauga

SEQ ID NO: 104254 - RNA, 22 nt, Haemophilus influenzae Rd
uuuacgcaauguuucggaaagu

SEQ ID NO: 104255 - RNA, 22 nt, Haemophilus influenzae Rd
uugauauugaagugaaugaaca

SEQ ID NO: 104256 - RNA, 22 nt, Haemophilus influenzae Rd
aaaguaaaaauagggcauugcg

SEQ ID NO: 104257 - RNA, 22 nt, Haemophilus influenzae Rd
ugcuuuauuguuuaucguuagc

SEQ ID NO: 104258 - RNA, 22 nt, Haemophilus influenzae Rd
ucuugaauagcuuuguuacgua

SEQ ID NO: 104259 - RNA, 20 nt, Haemophilus influenzae Rd
gugagaaaccgaaccaacag

SEQ ID NO: 104260 - RNA, 23 nt, Haemophilus influenzae Rd
uuagcugcugaagguuauaucga

SEQ ID NO: 104261 - RNA, 22 nt, Haemophilus influenzae Rd
gaucacuuuagcauguguugaa

SEQ ID NO: 104262 - RNA, 22 nt, Haemophilus influenzae Rd
augaaauuugccacaacaaucu

SEQ ID NO: 104263 - RNA, 22 nt, Haemophilus influenzae Rd
ugccuacauaaccucaggcgga

SEQ ID NO: 104264 - RNA, 22 nt, Haemophilus influenzae Rd
agagcguauuaaucaacaagcg

SEQ ID NO: 104265 - RNA, 22 nt, Haemophilus influenzae Rd
gugaagaacgugaauuugaagg

SEQ ID NO: 104266 - RNA, 22 nt, Haemophilus influenzae Rd
caacggcuauuucuuggacaaa

SEQ ID NO: 104267 - RNA, 22 nt, Haemophilus influenzae Rd
aauuaaaacaucagguuuauua

SEQ ID NO: 104268 - RNA, 22 nt, Haemophilus influenzae Rd
acguauugaauguggcgauuuu

SEQ ID NO: 104269 - RNA, 22 nt, Haemophilus influenzae Rd
agcaguggaguuugcuggaauu

SEQ ID NO: 104270 - RNA, 22 nt, Haemophilus influenzae Rd
guguuauuuugacuuggggugu

SEQ ID NO: 104271 - RNA, 22 nt, Haemophilus influenzae Rd
aacuugcacagauucuucaagc

SEQ ID NO: 104272 - RNA, 22 nt, Haemophilus influenzae Rd
aaauuagccguaguaucaacag

SEQ ID NO: 104273 - RNA, 22 nt, Haemophilus influenzae Rd
guaguggauuauaugguggcuc

SEQ ID NO: 104274 - RNA, 22 nt, Haemophilus influenzae Rd
cugguuuaggcucuagugcuug

SEQ ID NO: 104275 - RNA, 22 nt, Haemophilus influenzae Rd
auagguuuuuucugcaucagga

SEQ ID NO: 104276 - RNA, 22 nt, Haemophilus influenzae Rd
ucaguggcgaauugcccaaaaa

SEQ ID NO: 104277 - RNA, 22 nt, Haemophilus influenzae Rd
aguucauucagcguagauugau

SEQ ID NO: 104278 - RNA, 21 nt, Haemophilus influenzae Rd
uuuuggcgauuggcuauguga

SEQ ID NO: 104279 - RNA, 22 nt, Haemophilus influenzae Rd
auuucagcucguuuaggagaua

SEQ ID NO: 104280 - RNA, 22 nt, Haemophilus influenzae Rd
uacguuauuaauugcugaccaa

SEQ ID NO: 104281 - RNA, 22 nt, Haemophilus influenzae Rd
ggcuuggaauuauuugggcaga

SEQ ID NO: 104282 - RNA, 22 nt, Haemophilus influenzae Rd
acuaaccuagaguauacuaccc

SEQ ID NO: 104283 - RNA, 22 nt, Haemophilus influenzae Rd
ugcaauuugaaucauuuucuga

SEQ ID NO: 104284 - RNA, 22 nt, Haemophilus influenzae Rd
acgcaaauuugacaacgauaug

SEQ ID NO: 104285 - RNA, 22 nt, Haemophilus influenzae Rd
cguuauaucaauuggacaggcu

SEQ ID NO: 104286 - RNA, 22 nt, Haemophilus influenzae Rd
caauaaagaagcucucugcguu

SEQ ID NO: 104287 - RNA, 22 nt, Haemophilus influenzae Rd
gugggauugcagauagucuuga

SEQ ID NO: 104288 - RNA, 22 nt, Haemophilus influenzae Rd
ugaauguugguagagaguuucc

SEQ ID NO: 104289 - RNA, 22 nt, Haemophilus influenzae Rd
ggaugauacgucuaaauccgcg

SEQ ID NO: 104290 - RNA, 22 nt, Haemophilus influenzae Rd
aucgugaagaaggucgcggaau

SEQ ID NO: 104291 - RNA, 22 nt, Haemophilus influenzae Rd
ucgcccuuguuuacaacaugcu

SEQ ID NO: 104292 - RNA, 22 nt, Haemophilus influenzae Rd
uggugggcuaaagcccaccuac

SEQ ID NO: 104293 - RNA, 22 nt, Haemophilus influenzae Rd
uaaaaaagaaguggaacgccgu

SEQ ID NO: 104294 - RNA, 22 nt, Haemophilus influenzae Rd
gcuggugcuauuugcuugcgca

SEQ ID NO: 104295 - RNA, 18 nt, Haemophilus influenzae Rd
ucuaccaacauucaaucc

SEQ ID NO: 104296 - RNA, 22 nt, Haemophilus influenzae Rd
cacuuuggcaaggaauuucaca

SEQ ID NO: 104297 - RNA, 22 nt, Haemophilus influenzae Rd
acacugaucgguaaucgacagc

SEQ ID NO: 104298 - RNA, 22 nt, Haemophilus influenzae Rd
ggugggcuuaaagcccaccuac

SEQ ID NO: 104299 - RNA, 22 nt, Haemophilus influenzae Rd
uauuuuaacggugaugacaauc

SEQ ID NO: 104300 - RNA, 22 nt, Haemophilus influenzae Rd
aauccguuuuuguagaaauaca

SEQ ID NO: 104301 - RNA, 22 nt, Haemophilus influenzae Rd
cuugaagaaucugugcaaguug

SEQ ID NO: 104302 - RNA, 22 nt, Haemophilus influenzae Rd
cugaaaaggcucauaauuucac

SEQ ID NO: 104303 - RNA, 23 nt, Haemophilus influenzae Rd
ugcggguggcguuauuauggcag

SEQ ID NO: 104304 - RNA, 22 nt, Haemophilus influenzae Rd
gcuaaauaggcuguuuuaugau

SEQ ID NO: 104305 - RNA, 22 nt, Haemophilus influenzae Rd
auuguucuaauaauugaugcgu

SEQ ID NO: 104306 - RNA, 22 nt, Haemophilus influenzae Rd
uuuucguagauucugcauuugu

SEQ ID NO: 104307 - RNA, 22 nt, Haemophilus influenzae Rd
uaguggcuguacuugaaaacua

SEQ ID NO: 104308 - RNA, 22 nt, Haemophilus influenzae Rd
aagcagaacaaaugagcgauuu

SEQ ID NO: 104309 - RNA, 22 nt, Haemophilus influenzae Rd
ugugaagauguauuuguuaaaa

SEQ ID NO: 104310 - RNA, 22 nt, Haemophilus influenzae Rd
cggcacagaacaauuagaagaa

SEQ ID NO: 104311 - RNA, 22 nt, Haemophilus influenzae Rd
uugguaaaagaugggcgagauc

SEQ ID NO: 104312 - RNA, 22 nt, Haemophilus influenzae Rd
guuauuaccgcauuagaucaac

SEQ ID NO: 104313 - RNA, 22 nt, Haemophilus influenzae Rd
gaagaagugcgguugguuuuuu

SEQ ID NO: 104314 - RNA, 22 nt, Haemophilus influenzae Rd
agcaaugaaagugcgguagauu

SEQ ID NO: 104315 - RNA, 22 nt, Haemophilus influenzae Rd
aaauauugugacaaaugauauu

SEQ ID NO: 104316 - RNA, 22 nt, Haemophilus influenzae Rd
aaacaucacaucagaaagauca

SEQ ID NO: 104317 - RNA, 22 nt, Haemophilus influenzae Rd
aacagcuugaauuuauccgaac

SEQ ID NO: 104318 - RNA, 22 nt, Haemophilus influenzae Rd
aacaaugccacugccauaacga

SEQ ID NO: 104319 - RNA, 22 nt, Haemophilus influenzae Rd
aauuaaaacaucagguuuauua

SEQ ID NO: 104320 - RNA, 22 nt, Haemophilus influenzae Rd
aauugagugauggcaaauuaga

SEQ ID NO: 104321 - RNA, 22 nt, Haemophilus influenzae Rd
aauuuauccucugauguagggc

SEQ ID NO: 104322 - RNA, 22 nt, Haemophilus influenzae Rd
cagcccugugccuuauaucucc

SEQ ID NO: 104323 - RNA, 22 nt, Haemophilus influenzae Rd
caccaaauuaacgcccauuuuu

SEQ ID NO: 104324 - RNA, 22 nt, Haemophilus influenzae Rd
caauuuaucuugaucuagggcu

SEQ ID NO: 104325 - RNA, 22 nt, Haemophilus influenzae Rd
cacuagaacaguuuuagaaugc

SEQ ID NO: 104326 - RNA, 22 nt, Haemophilus influenzae Rd
auuuaaaauggcaucggcuugu

SEQ ID NO: 104327 - RNA, 21 nt, Haemophilus influenzae Rd
auuuaucgauuucgaucuuaa

SEQ ID NO: 104328 - RNA, 22 nt, Haemophilus influenzae Rd
auuuauuugcaggcgaagugga

SEQ ID NO: 104329 - RNA, 19 nt, Haemophilus influenzae Rd
auuuucuaccaacauugca

SEQ ID NO: 104330 - RNA, 22 nt, Haemophilus influenzae Rd
auuacuuauaugaucauagccu

SEQ ID NO: 104331 - RNA, 22 nt, Haemophilus influenzae Rd
auguauuccguucaagaacaaa

SEQ ID NO: 104332 - RNA, 22 nt, Haemophilus influenzae Rd
auauuucacaaugucagaagau

SEQ ID NO: 104333 - RNA, 22 nt, Haemophilus influenzae Rd
aucaacuugcuaaagauuuagu

SEQ ID NO: 104334 - RNA, 22 nt, Haemophilus influenzae Rd
auaggauggguuucugcccacc

SEQ ID NO: 104335 - RNA, 22 nt, Haemophilus influenzae Rd
auauucuuauugcaacuuaugc

SEQ ID NO: 104336 - RNA, 22 nt, Haemophilus influenzae Rd
auacaauauuggcuaugaugca

SEQ ID NO: 104337 - RNA, 22 nt, Haemophilus influenzae Rd
agaaccaauggcagcugcaauu

SEQ ID NO: 104338 - RNA, 22 nt, Haemophilus influenzae Rd
acuguuuucuaacaucgcaaag

SEQ ID NO: 104339 - RNA, 22 nt, Haemophilus influenzae Rd
cuauucuaaauucuuguucgau

SEQ ID NO: 104340 - RNA, 22 nt, Haemophilus influenzae Rd
cuuuugcaaaauauagcacaga

SEQ ID NO: 104341 - RNA, 22 nt, Haemophilus influenzae Rd
cuuuauuugcaagagauugcaa

SEQ ID NO: 104342 - RNA, 22 nt, Haemophilus influenzae Rd
cuugugugguuaagccuugcgc

SEQ ID NO: 104343 - RNA, 22 nt, Haemophilus influenzae Rd
gcauucauucauuuugucguaa

SEQ ID NO: 104344 - RNA, 22 nt, Haemophilus influenzae Rd
gcauaacagaacccaguuaaac

SEQ ID NO: 104345 - RNA, 22 nt, Haemophilus influenzae Rd
gaaaaugugcggugcaaaacau

SEQ ID NO: 104346 - RNA, 22 nt, Haemophilus influenzae Rd
gaauuuauccauuacuucuugu

SEQ ID NO: 104347 - RNA, 22 nt, Haemophilus influenzae Rd
ggcugcacacccugacauugaa

SEQ ID NO: 104348 - RNA, 22 nt, Haemophilus influenzae Rd
guggauuucgagcauuggggaa

SEQ ID NO: 104349 - RNA, 22 nt, Haemophilus influenzae Rd
ggguaguauacucuagguuagu

SEQ ID NO: 104350 - RNA, 22 nt, Haemophilus influenzae Rd
uauuauugaaugguucuuucaa

SEQ ID NO: 104351 - RNA, 22 nt, Haemophilus influenzae Rd
uauguuuauuugaaauuguacg

SEQ ID NO: 104352 - RNA, 22 nt, Haemophilus influenzae Rd
uauuuaucauucuuaucguugc

SEQ ID NO: 104353 - RNA, 22 nt, Haemophilus influenzae Rd
uauuguuaaagugaaaaauggu

SEQ ID NO: 104354 - RNA, 22 nt, Haemophilus influenzae Rd
uaauauaacggacguagaugac

SEQ ID NO: 104355 - RNA, 22 nt, Haemophilus influenzae Rd
uaaauauuacguaacugaaaug

SEQ ID NO: 104356 - RNA, 22 nt, Haemophilus influenzae Rd
gugggauugcagauagucuuga

SEQ ID NO: 104357 - RNA, 22 nt, Haemophilus influenzae Rd
ucugcaauuuuuacaagguugg

SEQ ID NO: 104358 - RNA, 22 nt, Haemophilus influenzae Rd
ucccaauuuagcugccgugauu

SEQ ID NO: 104359 - RNA, 22 nt, Haemophilus influenzae Rd
ucaucuuuuacgaagugcaucg

SEQ ID NO: 104360 - RNA, 22 nt, Haemophilus influenzae Rd
ugguucaauuaccgugccagaa

SEQ ID NO: 104361 - RNA, 22 nt, Haemophilus influenzae Rd
uggugguuucacguugguuggu

SEQ ID NO: 104362 - RNA, 22 nt, Haemophilus influenzae Rd
uggcaggauugguuguguugau

SEQ ID NO: 104363 - RNA, 22 nt, Haemophilus influenzae Rd
uguucuuucucaauaguuuuau

SEQ ID NO: 104364 - RNA, 18 nt, Haemophilus influenzae Rd
uuagaacuuuaucaugcu

SEQ ID NO: 104365 - RNA, 22 nt, Haemophilus influenzae Rd
uuaauaaagguggugcgaccgu

SEQ ID NO: 104366 - RNA, 22 nt, Haemophilus influenzae Rd
uuauaaauaucaguauagcaac

SEQ ID NO: 104367 - RNA, 22 nt, Haemophilus influenzae Rd
aagccucaguuucuggaacagu

SEQ ID NO: 104368 - RNA, 22 nt, Haemophilus influenzae Rd
aagcagaacaaaugagcgauuu

SEQ ID NO: 104369 - RNA, 22 nt, Haemophilus influenzae Rd
aaguuuuucauauaacguugac

SEQ ID NO: 104370 - RNA, 22 nt, Haemophilus influenzae Rd
aauaaauugaagcaauugguug

SEQ ID NO: 104371 - RNA, 22 nt, Haemophilus influenzae Rd
aauaacaugguacgagaugcgu

SEQ ID NO: 104372 - RNA, 22 nt, Haemophilus influenzae Rd
aaaaaugaccgcacuuuaguuu

SEQ ID NO: 104373 - RNA, 22 nt, Haemophilus influenzae Rd
aaaaaaagaggcgugauuauag

SEQ ID NO: 104374 - RNA, 20 nt, Haemophilus influenzae Rd
agauuguuguggcaaauuuc

SEQ ID NO: 104375 - RNA, 22 nt, Haemophilus influenzae Rd
agcaacuuuuacuuuaaugagu

SEQ ID NO: 104376 - RNA, 22 nt, Haemophilus influenzae Rd
agauaaauuuauuacuaaaagu

SEQ ID NO: 104377 - RNA, 22 nt, Haemophilus influenzae Rd
accauuuuaguucguucauuaa

SEQ ID NO: 104378 - RNA, 22 nt, Haemophilus influenzae Rd
acgagcgugguaucaacguuug

SEQ ID NO: 104379 - RNA, 22 nt, Haemophilus influenzae Rd
accauuuacuaauaagcgauug

SEQ ID NO: 104380 - RNA, 22 nt, Haemophilus influenzae Rd
aaugaguauucgcacccaugau

SEQ ID NO: 104381 - RNA, 22 nt, Haemophilus influenzae Rd
agcaucuugucaucccauuguu

SEQ ID NO: 104382 - RNA, 22 nt, Haemophilus influenzae Rd
agcaguggaguuugcuggaauu

SEQ ID NO: 104383 - RNA, 22 nt, Haemophilus influenzae Rd
agcagcugauuguauuggaaga

SEQ ID NO: 104384 - RNA, 22 nt, Haemophilus influenzae Rd
uuuuucuucccaaccuaaacga

SEQ ID NO: 104385 - RNA, 22 nt, Haemophilus influenzae Rd
uuuuucuugggcaaagcucgau

SEQ ID NO: 104386 - RNA, 22 nt, Haemophilus influenzae Rd
uuuuguaguauccauucauuug

SEQ ID NO: 104387 - RNA, 22 nt, Haemophilus influenzae Rd
uuuguuauagauaaagugcggu

SEQ ID NO: 104388 - RNA, 22 nt, Haemophilus influenzae Rd
uuucacuaagcguggauucaca

SEQ ID NO: 104389 - RNA, 22 nt, Haemophilus influenzae Rd
uuucacaacgcauugaaagcga

SEQ ID NO: 104390 - RNA, 22 nt, Haemophilus influenzae Rd
uuucuuccauugacucuucaga

SEQ ID NO: 104391 - RNA, 22 nt, Haemophilus influenzae Rd
uuucagaaggugacaauguuuu

SEQ ID NO: 104392 - RNA, 22 nt, Haemophilus influenzae Rd
uucaggcuguaguaaugaugau

SEQ ID NO: 104393 - RNA, 22 nt, Haemophilus influenzae Rd
uucguuauuuuccgccgaaauu

SEQ ID NO: 104394 - RNA, 22 nt, Haemophilus influenzae Rd
uuguggaucuuugccugaauaa

SEQ ID NO: 104395 - RNA, 22 nt, Haemophilus influenzae Rd
uuuaugaaggugcauuuggguu

SEQ ID NO: 104396 - RNA, 21 nt, Haemophilus influenzae Rd
uucuuucguuuguccaggcaa

SEQ ID NO: 104397 - RNA, 22 nt, Haemophilus influenzae Rd
uugacaauggguuuugaugaug

SEQ ID NO: 104398 - RNA, 22 nt, Haemophilus influenzae Rd
caucuuguuuuuaugccugaaa

SEQ ID NO: 104399 - RNA, 22 nt, Haemophilus influenzae Rd
ccccuucaaauauaacgacguu

SEQ ID NO: 104400 - RNA, 22 nt, Haemophilus influenzae Rd
ccccuuccgcccuucgggcacc

SEQ ID NO: 104401 - RNA, 22 nt, Haemophilus influenzae Rd
ccauauugccccuaauguacua

SEQ ID NO: 104402 - RNA, 22 nt, Haemophilus influenzae Rd
cuggguuagauaaaguccaguu

SEQ ID NO: 104403 - RNA, 22 nt, Haemophilus influenzae Rd
cugguuuaggcucuagugcuug

SEQ ID NO: 104404 - RNA, 21 nt, Haemophilus influenzae Rd
gcaaaugugauuugccccuac

SEQ ID NO: 104405 - RNA, 22 nt, Haemophilus influenzae Rd
gcgaaggcgguucgggcggugc

SEQ ID NO: 104406 - RNA, 22 nt, Haemophilus influenzae Rd
gcuuuugggcgugggccuggua

SEQ ID NO: 104407 - RNA, 22 nt, Haemophilus influenzae Rd
ggaguuuuacggcacagggcug

SEQ ID NO: 104408 - RNA, 22 nt, Haemophilus influenzae Rd
gguuucaucuuuaugaucuuaa

SEQ ID NO: 104409 - RNA, 22 nt, Haemophilus influenzae Rd
guauuucaucacgucuuacuuu

SEQ ID NO: 104410 - RNA, 19 nt, Haemophilus influenzae Rd
guucuacauguuucacaau

SEQ ID NO: 104411 - RNA, 22 nt, Haemophilus influenzae Rd
guugggaacccuggauguggug

SEQ ID NO: 104412 - RNA, 22 nt, Haemophilus influenzae Rd
ucgcuagaaugaggcguuuaau

SEQ ID NO: 104413 - RNA, 22 nt, Haemophilus influenzae Rd
uauuuuaacggugaugacaauc

SEQ ID NO: 104414 - RNA, 22 nt, Haemophilus influenzae Rd
ugccauuaauuuuauuugccgu

SEQ ID NO: 104415 - RNA, 19 nt, Haemophilus influenzae Rd
ugccggcguggcgauugca

SEQ ID NO: 104416 - RNA, 22 nt, Haemophilus influenzae Rd
ugcaggggacucaaucacaauu

SEQ ID NO: 104417 - RNA, 22 nt, Haemophilus influenzae Rd
ugcguuuaucuuacagcuauuu

SEQ ID NO: 104418 - RNA, 22 nt, Haemophilus influenzae Rd
ugcgguaaaaaauucgaggguu

SEQ ID NO: 104419 - RNA, 22 nt, Human
aaaaaauugcuggcagagcugu

SEQ ID NO: 104420 - RNA, 20 nt, Human
aaaaacaguaaugcugaaga

SEQ ID NO: 104421 - RNA, 22 nt, Human
aaaaaguaccacuuggacacuu

SEQ ID NO: 104422 - RNA, 22 nt, Human
aaaaauuucuggugaaaugccu

SEQ ID NO: 104423 - RNA, 22 nt, Human
aaaacauuuaggguuuuuuuua

SEQ ID NO: 104424 - RNA, 22 nt, Human
aaaaaaacuaauuuuaaaugug

SEQ ID NO: 104425 - RNA, 22 nt, Human
aaaaaggagaaagagagggaga

SEQ ID NO: 104426 - RNA, 22 nt, Human
aaaaacuuaccccagggcaagg

SEQ ID NO: 104427 - RNA, 22 nt, Human
aaaacuuucagggauacagaaa

SEQ ID NO: 104428 - RNA, 22 nt, Human
aaaagacaaggaucuggaguga

SEQ ID NO: 104429 - RNA, 22 nt, Human
aaaagaaugaugggagcugggu

SEQ ID NO: 104430 - RNA, 22 nt, Human
aaaagauguaaacauauauuaa

SEQ ID NO: 104431 - RNA, 20 nt, Human
aaaaauguguuuauggagau

SEQ ID NO: 104432 - RNA, 22 nt, Human
aaacccuagcguuguuuauuga

SEQ ID NO: 104433 - RNA, 22 nt, Human
aaacagcugcaguacacggccu

SEQ ID NO: 104434 - RNA, 22 nt, Human
aaacagguuugaacuucuuaac

SEQ ID NO: 104435 - RNA, 22 nt, Human
aaaccagaguucauaguauuca

SEQ ID NO: 104436 - RNA, 18 nt, Human
aaacauggcuuaaaggcu

SEQ ID NO: 104437 - RNA, 22 nt, Human
aaacauguagugcaugaggauc

SEQ ID NO: 104438 - RNA, 18 nt, Human
aaacccacguauucaggc

SEQ ID NO: 104439 - RNA, 21 nt, Human
aaacaugcagccugccaauuc

SEQ ID NO: 104440 - RNA, 22 nt, Human
aaacauaugccuucuuuuguaa

SEQ ID NO: 104441 - RNA, 22 nt, Human
aaaauauaaaggauguggguuu

SEQ ID NO: 104442 - RNA, 22 nt, Human
aaacaccaagagcuagcuauua

SEQ ID NO: 104443 - RNA, 22 nt, Human
aaaauauguugagauacugaaa

SEQ ID NO: 104444 - RNA, 22 nt, Human
aaaauacuaggaaaauaaauca

SEQ ID NO: 104445 - RNA, 22 nt, Human
aaacaauaauaauuaggaagga

SEQ ID NO: 104446 - RNA, 22 nt, Human
aaacaagagcuuacauggcugc

SEQ ID NO: 104447 - RNA, 22 nt, Human
aaaauaauauuauaccacugcu

SEQ ID NO: 104448 - RNA, 22 nt, Human
aaacacacaacauauuuuggaa

SEQ ID NO: 104449 - RNA, 22 nt, Human
aaaagcucucuucuucggcuuu

SEQ ID NO: 104450 - RNA, 22 nt, Human
aaaaggaacaauaugguauuuu

SEQ ID NO: 104451 - RNA, 22 nt, Human
aaaagcauuauuagucugggug

SEQ ID NO: 104452 - RNA, 22 nt, Human
aaaaggauauuuggugcaaagc

SEQ ID NO: 104453 - RNA, 22 nt, Human
aaaaggaagaguuuucagagac

SEQ ID NO: 104454 - RNA, 22 nt, Human
aaacucaugccagagaacuuaa

SEQ ID NO: 104455 - RNA, 21 nt, Human
aaagaaguuaguucagugguu

SEQ ID NO: 104456 - RNA, 22 nt, Human
aaacuugaggcaaugaaggugu

SEQ ID NO: 104457 - RNA, 22 nt, Human
aaacugcuuucucugccuuucc

SEQ ID NO: 104458 - RNA, 22 nt, Human
aaacucuaagacuaaaauugaa

SEQ ID NO: 104459 - RNA, 20 nt, Human
aaacucuuuucuuacauuuu

SEQ ID NO: 104460 - RNA, 20 nt, Human
aaacucucugaucuuacagu

SEQ ID NO: 104461 - RNA, 22 nt, Human
aaacucaucaguuuagaaaccu

SEQ ID NO: 104462 - RNA, 22 nt, Human
aaacuagaacagagagagaagc

SEQ ID NO: 104463 - RNA, 22 nt, Human
aaacuuuaucaaguacucuuca

SEQ ID NO: 104464 - RNA, 21 nt, Human
aaagaagagcucagagguaga

SEQ ID NO: 104465 - RNA, 22 nt, Human
aaacugugcagucacauaagga

SEQ ID NO: 104466 - RNA, 22 nt, Human
aaacuuuaggcacauggaucua

SEQ ID NO: 104467 - RNA, 22 nt, Human
aaagaccuucacuuucuggcug

SEQ ID NO: 104468 - RNA, 22 nt, Human
aaagacuaaccaguugucaaaa

SEQ ID NO: 104469 - RNA, 22 nt, Human
aaagacaauaauucucucuagc

SEQ ID NO: 104470 - RNA, 22 nt, Human
aaagacagccuguuggcuuucu

SEQ ID NO: 104471 - RNA, 22 nt, Human
aagcauaucaaguuuuaugugc

SEQ ID NO: 104472 - RNA, 22 nt, Human
aagcaggaaaugaaaugcuugc

SEQ ID NO: 104473 - RNA, 18 nt, Human
aaggaggaaugaauagca

SEQ ID NO: 104474 - RNA, 22 nt, Human
aaggaggaugaauugucugcaa

SEQ ID NO: 104475 - RNA, 22 nt, Human
aaggaucuuucuuuuuaccauu

SEQ ID NO: 104476 - RNA, 22 nt, Human
aaggauguuuaaacuacuuucc

SEQ ID NO: 104477 - RNA, 22 nt, Human
aaggcuuugugcugaguugucg

SEQ ID NO: 104478 - RNA, 22 nt, Human
aaggcuguuugagcacuggagc

SEQ ID NO: 104479 - RNA, 22 nt, Human
aagguccaugaauaucuaagcc

SEQ ID NO: 104480 - RNA, 22 nt, Human
aagguauaucuuuaaaagugaa

SEQ ID NO: 104481 - RNA, 22 nt, Human
aagggaaguuugacacuuuuua

SEQ ID NO: 104482 - RNA, 22 nt, Human
aagggaaggaugggcauuuaca

SEQ ID NO: 104483 - RNA, 22 nt, Human
aagggaaacagccaggcccugu

SEQ ID NO: 104484 - RNA, 22 nt, Human
aagggcuucucgccugugugca

SEQ ID NO: 104485 - RNA, 22 nt, Human
aagggaaaagcugaaugagaug

SEQ ID NO: 104486 - RNA, 22 nt, Human
aagggaauagagcagcaaaaau

SEQ ID NO: 104487 - RNA, 22 nt, Human
aaguaauuugugaaggcauguu

SEQ ID NO: 104488 - RNA, 22 nt, Human
aagguuuuguaugaaaucucug

SEQ ID NO: 104489 - RNA, 21 nt, Human
aaguaaauuuuuacuuaggcc

SEQ ID NO: 104490 - RNA, 22 nt, Human
aagguuuuguuuucgguuuuuu

SEQ ID NO: 104491 - RNA, 22 nt, Human
aaguaaaucuuaugucagggag

SEQ ID NO: 104492 - RNA, 22 nt, Human
aaggucuuggcucuggccgcac

SEQ ID NO: 104493 - RNA, 22 nt, Human
aagugguuuauuguaugguuuu

SEQ ID NO: 104494 - RNA, 22 nt, Human
aaguguggguaagcauuucuug

SEQ ID NO: 104495 - RNA, 22 nt, Human
aagugugugagaaggggucgca

SEQ ID NO: 104496 - RNA, 22 nt, Human
aaguuaauugcuucuaguuaau

SEQ ID NO: 104497 - RNA, 22 nt, Human
aaguuaaaaaagcuggguaaaa

SEQ ID NO: 104498 - RNA, 22 nt, Human
aaguugaaugucuugcugaaug

SEQ ID NO: 104499 - RNA, 22 nt, Human
aaguugacuguuuuacuuaugu

SEQ ID NO: 104500 - RNA, 22 nt, Human
aaguucaccugcauuuacuaaa

SEQ ID NO: 104501 - RNA, 22 nt, Human
aaguguucucuguuuuaucuac

SEQ ID NO: 104502 - RNA, 17 nt, Human
aagugggcaaagugaga

SEQ ID NO: 104503 - RNA, 23 nt, Human
aaguggugacugugcuacugaga

SEQ ID NO: 104504 - RNA, 22 nt, Human
aaguggugagacccugcugaaa

SEQ ID NO: 104505 - RNA, 22 nt, Human
aaguauuccccaaguauucugg

SEQ ID NO: 104506 - RNA, 18 nt, Human
aaguaguuugagauuguu

SEQ ID NO: 104507 - RNA, 19 nt, Human
aaguauagucagccuucua

SEQ ID NO: 104508 - RNA, 22 nt, Human
aaguagccuguuauguaguuca

SEQ ID NO: 104509 - RNA, 22 nt, Human
aaggugccacuucccucagacu

SEQ ID NO: 104510 - RNA, 20 nt, Human
aaguagguuucaguugcugu

SEQ ID NO: 104511 - RNA, 22 nt, Human
aaguagaaaaccgcacuggacu

SEQ ID NO: 104512 - RNA, 22 nt, Human
aauaugaugccaaauugcuaca

SEQ ID NO: 104513 - RNA, 22 nt, Human
aauaugcaaagcguguuaucug

SEQ ID NO: 104514 - RNA, 22 nt, Human
aauaucuagccuuuagcagcuu

SEQ ID NO: 104515 - RNA, 22 nt, Human
aauaucuugaguuauaaauuca

SEQ ID NO: 104516 - RNA, 22 nt, Human
aauauauaugggugcaugucug

SEQ ID NO: 104517 - RNA, 22 nt, Human
aauaggaaggaaauguuuaccu

SEQ ID NO: 104518 - RNA, 22 nt, Human
aauaggguccuuuguguuauau

SEQ ID NO: 104519 - RNA, 22 nt, Human
aauagguaaaugaguaagaaau

SEQ ID NO: 104520 - RNA, 22 nt, Human
aauauagagcagaucuggcucu

SEQ ID NO: 104521 - RNA, 22 nt, Human
aauaguggcuuggacuaaauau

SEQ ID NO: 104522 - RNA, 22 nt, Human
aauaacuuaaugacuguguaca

SEQ ID NO: 104523 - RNA, 22 nt, Human
aauaacuuacucuaugcuuagu

SEQ ID NO: 104524 - RNA, 23 nt, Human
aaguugucauguaaaaugggcua

SEQ ID NO: 104525 - RNA, 22 nt, Human
aaguuuaagguagugaugauga

SEQ ID NO: 104526 - RNA, 21 nt, Human
aaguuucucccuaauuguugc

SEQ ID NO: 104527 - RNA, 22 nt, Human
aauaauacaugugaugagaauu

SEQ ID NO: 104528 - RNA, 22 nt, Human
aauacaaucagauuaugguagu

SEQ ID NO: 104529 - RNA, 22 nt, Human
aauaagaguuaagaaguauauu

SEQ ID NO: 104530 - RNA, 22 nt, Human
aauaauacaauuggugucaugu

SEQ ID NO: 104531 - RNA, 22 nt, Human
aauacagauggcaugugaagau

SEQ ID NO: 104532 - RNA, 22 nt, Human
aauguacucgaaugauguuaag

SEQ ID NO: 104533 - RNA, 22 nt, Human
aaugguuacuacccugggucuu

SEQ ID NO: 104534 - RNA, 22 nt, Human
aauguaaauaauuguaaaauuu

SEQ ID NO: 104535 - RNA, 22 nt, Human
aauguacucuguguuucucaug

SEQ ID NO: 104536 - RNA, 22 nt, Human
aaugggauuaagaaagaucuug

SEQ ID NO: 104537 - RNA, 22 nt, Human
aauggugaggagugcauugaga

SEQ ID NO: 104538 - RNA, 22 nt, Human
aaugguggaugucuguucugac

SEQ ID NO: 104539 - RNA, 22 nt, Human
aaugguagaguauuuuaauccu

SEQ ID NO: 104540 - RNA, 22 nt, Human
aauggaugauuaaauggaugaa

SEQ ID NO: 104541 - RNA, 22 nt, Human
aaugcugaaugcauguuuccau

SEQ ID NO: 104542 - RNA, 22 nt, Human
aaugccuucauuggcgaagugc

SEQ ID NO: 104543 - RNA, 22 nt, Human
aauucagguuauauuugcaacu

SEQ ID NO: 104544 - RNA, 21 nt, Human
aauuauuugcauuuuucuugu

SEQ ID NO: 104545 - RNA, 22 nt, Human
aauucaggacaaauguuuucaa

SEQ ID NO: 104546 - RNA, 22 nt, Human
aauucaacagucaguuaucuca

SEQ ID NO: 104547 - RNA, 22 nt, Human
aauuauucuugccuagguuuaa

SEQ ID NO: 104548 - RNA, 22 nt, Human
aauuagaagcuguuagcaaaau

SEQ ID NO: 104549 - RNA, 22 nt, Human
aauuauuaagcuuucuccagug

SEQ ID NO: 104550 - RNA, 22 nt, Human
aauuacuuuaggaaaacuccuc

SEQ ID NO: 104551 - RNA, 22 nt, Human
aauuauguuugcuuuagaugga

SEQ ID NO: 104552 - RNA, 22 nt, Human
aauguugaaccuuuuuggccug

SEQ ID NO: 104553 - RNA, 22 nt, Human
aauguugacguuggccagggcc

SEQ ID NO: 104554 - RNA, 22 nt, Human
aauguuguaaauauucuuugag

SEQ ID NO: 104555 - RNA, 23 nt, Human
aauguugaggguggguuuuuaac

SEQ ID NO: 104556 - RNA, 22 nt, Human
aauguuuaacuguggucagcag

SEQ ID NO: 104557 - RNA, 22 nt, Human
aauguuuaguuuuauuuuagua

SEQ ID NO: 104558 - RNA, 22 nt, Human
aauguuuaagcuuuuauuuaca

SEQ ID NO: 104559 - RNA, 22 nt, Human
aaucucuugggaagagugagug

SEQ ID NO: 104560 - RNA, 22 nt, Human
aaucuagagaacuguggggcag

SEQ ID NO: 104561 - RNA, 22 nt, Human
aauccucguagugguuagaaag

SEQ ID NO: 104562 - RNA, 22 nt, Human
aaucccaguugacagaacuguu

SEQ ID NO: 104563 - RNA, 23 nt, Human
aaucacuggauuugagcaugagg

SEQ ID NO: 104564 - RNA, 22 nt, Human
aauauuuaccuaccugucaucu

SEQ ID NO: 104565 - RNA, 22 nt, Human
aaucaaagccugcaaguugacu

SEQ ID NO: 104566 - RNA, 22 nt, Human
aaugaauaaauuuuaaagacag

SEQ ID NO: 104567 - RNA, 22 nt, Human
aaucuuguucaacauuaucugu

SEQ ID NO: 104568 - RNA, 22 nt, Human
aaucuugggacagggacacuau

SEQ ID NO: 104569 - RNA, 22 nt, Human
aaucuuuuugaaggaggagaga

SEQ ID NO: 104570 - RNA, 22 nt, Human
aaucugugugugagaaauggca

SEQ ID NO: 104571 - RNA, 22 nt, Human
aaucugacaaaauauuuccagu

SEQ ID NO: 104572 - RNA, 22 nt, Human
aaucugugaggaauaaugaguu

SEQ ID NO: 104573 - RNA, 22 nt, Human
aaucucguuaugaagaugguug

SEQ ID NO: 104574 - RNA, 22 nt, Human
aaugaaaaucugucaguucaag

SEQ ID NO: 104575 - RNA, 22 nt, Human
aaucuguugucaggaauccaca

SEQ ID NO: 104576 - RNA, 22 nt, Human
aaugacaguggcacagucacuu

SEQ ID NO: 104577 - RNA, 22 nt, Human
aaugaacuuugaagauggugaa

SEQ ID NO: 104578 - RNA, 22 nt, Human
aaugaacuuucaguucagagag

SEQ ID NO: 104579 - RNA, 22 nt, Human
aaugaaacuaguagaaucuuug

SEQ ID NO: 104580 - RNA, 22 nt, Human
aaugacagccuauacugucugc

SEQ ID NO: 104581 - RNA, 22 nt, Human
aaugaaugaaugaaugauuaug

SEQ ID NO: 104582 - RNA, 22 nt, Human
aaugagauggaggacucuuaau

SEQ ID NO: 104583 - RNA, 22 nt, Human
aaugaguccuuuagugccauug

SEQ ID NO: 104584 - RNA, 22 nt, Human
aaugcagaugugucuuuaauuu

SEQ ID NO: 104585 - RNA, 22 nt, Human
aaugaguuuguucuauuauuug

SEQ ID NO: 104586 - RNA, 22 nt, Human
aaugcauacguguuuguggcaa

SEQ ID NO: 104587 - RNA, 22 nt, Human
aaugagauaagaaaaccuuugc

SEQ ID NO: 104588 - RNA, 22 nt, Human
aaugaguucaucugaauucugg

SEQ ID NO: 104589 - RNA, 23 nt, Human
aaugaguugggcagcauacaggc

SEQ ID NO: 104590 - RNA, 22 nt, Human
aaugauuuucugcaaacaguga

SEQ ID NO: 104591 - RNA, 22 nt, Human
aaugagaauguaagugaagaga

SEQ ID NO: 104592 - RNA, 23 nt, Human
aacucuggcuagcauagaauaga

SEQ ID NO: 104593 - RNA, 22 nt, Human
aacucugagaaacuugcaguug

SEQ ID NO: 104594 - RNA, 22 nt, Human
aacugaaguuuucagauuuugc

SEQ ID NO: 104595 - RNA, 23 nt, Human
aacugcaagguugcugggaagua

SEQ ID NO: 104596 - RNA, 22 nt, Human
aacucugcaaugaaaucauguu

SEQ ID NO: 104597 - RNA, 22 nt, Human
aacuggguuuaucuaaugugua

SEQ ID NO: 104598 - RNA, 21 nt, Human
aacuaaugacugcagcaggaa

SEQ ID NO: 104599 - RNA, 22 nt, Human
aacuuuacagacuagagcuuuc

SEQ ID NO: 104600 - RNA, 21 nt, Human
aacuauuaauaccauuagcaa

SEQ ID NO: 104601 - RNA, 22 nt, Human
aacuguugucacgaauguggcu

SEQ ID NO: 104602 - RNA, 22 nt, Human
aacuugaagacaccccacauuc

SEQ ID NO: 104603 - RNA, 22 nt, Human
aacuuauacccagggcagaaau

SEQ ID NO: 104604 - RNA, 22 nt, Human
aacuuaaacaagcucccaaguu

SEQ ID NO: 104605 - RNA, 22 nt, Human
aacuuaacucugcaauccagcu

SEQ ID NO: 104606 - RNA, 22 nt, Human
aacuuagagcucuccuaaauga

SEQ ID NO: 104607 - RNA, 22 nt, Human
aagaaaagaaacauggguaugc

SEQ ID NO: 104608 - RNA, 22 nt, Human
aacugagugcuacauugugauu

SEQ ID NO: 104609 - RNA, 22 nt, Human
aacucugacgcugucaaauaca

SEQ ID NO: 104610 - RNA, 21 nt, Human
aacuuucccaauccagauuug

SEQ ID NO: 104611 - RNA, 22 nt, Human
aacuuucugaaaagcuugauca

SEQ ID NO: 104612 - RNA, 22 nt, Human
aacuuucuuugcaucuaaguuu

SEQ ID NO: 104613 - RNA, 22 nt, Human
aacuuuuaugaaggaaaucaua

SEQ ID NO: 104614 - RNA, 20 nt, Human
aacuuugagugcaugacuuu

SEQ ID NO: 104615 - RNA, 22 nt, Human
aacuuucagaauccuaugcauu

SEQ ID NO: 104616 - RNA, 22 nt, Human
aagaacaacugcuuuaaaagca

SEQ ID NO: 104617 - RNA, 22 nt, Human
aagaaaggagauauucuuuuag

SEQ ID NO: 104618 - RNA, 22 nt, Human
aagaaaggcacaagaaagaaaa

SEQ ID NO: 104619 - RNA, 22 nt, Human
aacuuguaaugaaaggcaauag

SEQ ID NO: 104620 - RNA, 22 nt, Human
aagaacaugggugugggcauuc

SEQ ID NO: 104621 - RNA, 22 nt, Human
aagaagagaauauauuuacguc

SEQ ID NO: 104622 - RNA, 22 nt, Human
aacuuuuucuuaggggaaagca

SEQ ID NO: 104623 - RNA, 22 nt, Human
aagagaaaugcuuuaacuuuau

SEQ ID NO: 104624 - RNA, 22 nt, Human
aagaggaauaauaaaaauugca

SEQ ID NO: 104625 - RNA, 22 nt, Human
aagaguggagcuggaaaguggg

SEQ ID NO: 104626 - RNA, 21 nt, Human
aagacguaguuggguggacca

SEQ ID NO: 104627 - RNA, 22 nt, Human
aagauucaguugguuuuggaaa

SEQ ID NO: 104628 - RNA, 22 nt, Human
aagagaaagggaaaaugguaaa

SEQ ID NO: 104629 - RNA, 22 nt, Human
aagaggaggacgguucccagaa

SEQ ID NO: 104630 - RNA, 22 nt, Human
aagauguuguagauuagugaga

SEQ ID NO: 104631 - RNA, 22 nt, Human
aagcagaaaaacugagcuccaa

SEQ ID NO: 104632 - RNA, 22 nt, Human
aagccgagggaggugauggaga

SEQ ID NO: 104633 - RNA, 22 nt, Human
aagcagcauaugacagcaucca

SEQ ID NO: 104634 - RNA, 22 nt, Human
aagauuugaaaguggugcauuu

SEQ ID NO: 104635 - RNA, 22 nt, Human
aagauuuaccacuuuauucaag

SEQ ID NO: 104636 - RNA, 22 nt, Human
aaccugaggguagacaaguuca

SEQ ID NO: 104637 - RNA, 22 nt, Human
aaccauauugauuauguuuuau

SEQ ID NO: 104638 - RNA, 22 nt, Human
aacauuguuuaaguuaaauugu

SEQ ID NO: 104639 - RNA, 22 nt, Human
aaccaauaagaggaugccauuu

SEQ ID NO: 104640 - RNA, 22 nt, Human
aaccaaaguugguauuuaauaa

SEQ ID NO: 104641 - RNA, 22 nt, Human
aaccaagcucaauggucugagu

SEQ ID NO: 104642 - RNA, 22 nt, Human
aaccaaucaaauuggaauugaa

SEQ ID NO: 104643 - RNA, 20 nt, Human
aaccuauuguaauauucuaa

SEQ ID NO: 104644 - RNA, 22 nt, Human
aacaguuaagaggaggcagaga

SEQ ID NO: 104645 - RNA, 22 nt, Human
aacaguaugugagauuuacaca

SEQ ID NO: 104646 - RNA, 22 nt, Human
aaccagaagucaucagagcuga

SEQ ID NO: 104647 - RNA, 22 nt, Human
aacaucaaaggaagaaugauau

SEQ ID NO: 104648 - RNA, 22 nt, Human
aacagguucaucuuggaagcag

SEQ ID NO: 104649 - RNA, 22 nt, Human
aacaguacaucaugaggucauc

SEQ ID NO: 104650 - RNA, 21 nt, Human
aacagguuuccuaccacuugc

SEQ ID NO: 104651 - RNA, 22 nt, Human
aaccaguacuucucuauucagu

SEQ ID NO: 104652 - RNA, 22 nt, Human
aaccaggcgagagagcggucag

SEQ ID NO: 104653 - RNA, 22 nt, Human
aacccuguuguguacaugcaua

SEQ ID NO: 104654 - RNA, 22 nt, Human
aacgcagagaguaaugcugaac

SEQ ID NO: 104655 - RNA, 22 nt, Human
aacgcaacaacuggagcuguag

SEQ ID NO: 104656 - RNA, 22 nt, Human
aacccugaacuuaguucuagga

SEQ ID NO: 104657 - RNA, 22 nt, Human
aacccguagaucaguucuaggu

SEQ ID NO: 104658 - RNA, 22 nt, Human
aacccacuaugauuguccucau

SEQ ID NO: 104659 - RNA, 22 nt, Human
aacccaagacaagcacuggcca

SEQ ID NO: 104660 - RNA, 22 nt, Human
aaccuuucucccugcacacugg

SEQ ID NO: 104661 - RNA, 22 nt, Human
aaccuuauuguguaucaccaua

SEQ ID NO: 104662 - RNA, 22 nt, Human
aacgauuugaguuaguuuuuag

SEQ ID NO: 104663 - RNA, 22 nt, Human
aacgaugauaaauuguucucug

SEQ ID NO: 104664 - RNA, 22 nt, Human
aacuagugucuguaugauaagg

SEQ ID NO: 104665 - RNA, 22 nt, Human
aacuacucugggguggcagguu

SEQ ID NO: 104666 - RNA, 22 nt, Human
aacguaauuuguggaaggggua

SEQ ID NO: 104667 - RNA, 19 nt, Human
aacuacagcgcacuguccu

SEQ ID NO: 104668 - RNA, 22 nt, Human
aacuaaggccacaagaggcaaa

SEQ ID NO: 104669 - RNA, 22 nt, Human
aaccuggaggaccuuaugcuaa

SEQ ID NO: 104670 - RNA, 22 nt, Human
aaauuuuguugaaaaauauuuu

SEQ ID NO: 104671 - RNA, 22 nt, Human
aacaaaacauuuuacgaauaua

SEQ ID NO: 104672 - RNA, 21 nt, Human
aacaaaagggaagaacagcug

SEQ ID NO: 104673 - RNA, 22 nt, Human
aacacuaaaggucaguuagaag

SEQ ID NO: 104674 - RNA, 22 nt, Human
aaauugcauuuuaaagguagau

SEQ ID NO: 104675 - RNA, 20 nt, Human
aaauugaacaagccaggcug

SEQ ID NO: 104676 - RNA, 22 nt, Human
aacacguuuauccuaagaacuc

SEQ ID NO: 104677 - RNA, 22 nt, Human
aacacugaaaugucuuaagauu

SEQ ID NO: 104678 - RNA, 22 nt, Human
aacacuguaucagucuucaaua

SEQ ID NO: 104679 - RNA, 21 nt, Human
aaauuucauauggccaaccua

SEQ ID NO: 104680 - RNA, 22 nt, Human
aaauuugggagaaaugggucau

SEQ ID NO: 104681 - RNA, 22 nt, Human
aacaggcuaaauuguccauuuc

SEQ ID NO: 104682 - RNA, 22 nt, Human
aacagaaaucauuuagggcucu

SEQ ID NO: 104683 - RNA, 20 nt, Human
aaauucgacuaaaaccagaa

SEQ ID NO: 104684 - RNA, 22 nt, Human
aaauucuuccaggaggaaauac

SEQ ID NO: 104685 - RNA, 22 nt, Human
aaauucagauggcuuucuuuuc

SEQ ID NO: 104686 - RNA, 22 nt, Human
aaauguuugguggauaaaagga

SEQ ID NO: 104687 - RNA, 22 nt, Human
aaauucagcagguuucaaaagc

SEQ ID NO: 104688 - RNA, 22 nt, Human
aaauguuucauucuauuuuuag

SEQ ID NO: 104689 - RNA, 22 nt, Human
aaaugucugagacuucugaacu

SEQ ID NO: 104690 - RNA, 22 nt, Human
aaauggauaaucaagauaauca

SEQ ID NO: 104691 - RNA, 22 nt, Human
aaauuaaaguuuuauuuagagc

SEQ ID NO: 104692 - RNA, 22 nt, Human
aaagaucaguuaacgccaucaa

SEQ ID NO: 104693 - RNA, 17 nt, Human
aaaugguccuagggauu

SEQ ID NO: 104694 - RNA, 22 nt, Human
aaaugguguucuuuagaugaaa

SEQ ID NO: 104695 - RNA, 23 nt, Human
aaagacuagaagccguggcugca

SEQ ID NO: 104696 - RNA, 22 nt, Human
aguauaagugaugcuaucuucu

SEQ ID NO: 104697 - RNA, 23 nt, Human
aguaucuugguguggugcagaga

SEQ ID NO: 104698 - RNA, 22 nt, Human
aguaucuuccucaugaacacgu

SEQ ID NO: 104699 - RNA, 22 nt, Human
aguauucaguuagugagcuaag

SEQ ID NO: 104700 - RNA, 22 nt, Human
aguaucugccagaaucucaguu

SEQ ID NO: 104701 - RNA, 22 nt, Human
aguaucuauaucaaaaauggcu

SEQ ID NO: 104702 - RNA, 22 nt, Human
aguaucgcuuuguaucaugagg

SEQ ID NO: 104703 - RNA, 22 nt, Human
aguauccauccugcuguuucua

SEQ ID NO: 104704 - RNA, 19 nt, Human
aguauauaucuuuaccuca

SEQ ID NO: 104705 - RNA, 22 nt, Human
aguacuuuuuguucaauugugc

SEQ ID NO: 104706 - RNA, 22 nt, Human
aguagagacgggguuuuaguag

SEQ ID NO: 104707 - RNA, 22 nt, Human
aguaggauguuuagcccuucuu

SEQ ID NO: 104708 - RNA, 22 nt, Human
aguaagaaagaaugauaggccu

SEQ ID NO: 104709 - RNA, 22 nt, Human
aguaacuuaagcaauuguguau

SEQ ID NO: 104710 - RNA, 22 nt, Human
aguaauggucucaauaaauucu

SEQ ID NO: 104711 - RNA, 22 nt, Human
aguaauuucuuacggagaccuu

SEQ ID NO: 104712 - RNA, 22 nt, Human
aguaaucgugaucgagagauca

SEQ ID NO: 104713 - RNA, 22 nt, Human
agguaguggaaccaaggcauca

SEQ ID NO: 104714 - RNA, 22 nt, Human
aggugguauuuaaaauuauuug

SEQ ID NO: 104715 - RNA, 18 nt, Human
agguuguguaaaaagaag

SEQ ID NO: 104716 - RNA, 22 nt, Human
agguuguugagaucaucuggcu

SEQ ID NO: 104717 - RNA, 22 nt, Human
agguuagcuguaugucuguaaa

SEQ ID NO: 104718 - RNA, 16 nt, Human
aggugugugguagaua

SEQ ID NO: 104719 - RNA, 18 nt, Human
aggugagaauuuggcuuu

SEQ ID NO: 104720 - RNA, 22 nt, Human
aguaaaugaaagcaauuuuaga

SEQ ID NO: 104721 - RNA, 22 nt, Human
aguaacagguguacagacuauc

SEQ ID NO: 104722 - RNA, 22 nt, Human
agguuuuagaagcugaagccaa

SEQ ID NO: 104723 - RNA, 22 nt, Human
agguuuuugucauuuucuggua

SEQ ID NO: 104724 - RNA, 22 nt, Human
aguauugguaaguguagcaaau

SEQ ID NO: 104725 - RNA, 22 nt, Human
agucaaaaaaccuagaaacacc

SEQ ID NO: 104726 - RNA, 23 nt, Human
aguauuguucaucuucaagacag

SEQ ID NO: 104727 - RNA, 22 nt, Human
aguauuuaguauucuauauuag

SEQ ID NO: 104728 - RNA, 22 nt, Human
aguauuuucuuuaguuuguuag

SEQ ID NO: 104729 - RNA, 22 nt, Human
aguauuuuaaaauacauuaucc

SEQ ID NO: 104730 - RNA, 21 nt, Human
agucaagcugccugcuuggca

SEQ ID NO: 104731 - RNA, 22 nt, Human
agucacuguuuaaucuagcuaa

SEQ ID NO: 104732 - RNA, 22 nt, Human
agucagaaggugucagaucuug

SEQ ID NO: 104733 - RNA, 22 nt, Human
agucacuguucugucaugucaa

SEQ ID NO: 104734 - RNA, 22 nt, Human
agucaacauuugagaugcaaug

SEQ ID NO: 104735 - RNA, 22 nt, Human
agucaagguggaccagaaaaau

SEQ ID NO: 104736 - RNA, 22 nt, Human
agucauuugaggcaugauuaug

SEQ ID NO: 104737 - RNA, 22 nt, Human
agucauuguguucaguaaaauc

SEQ ID NO: 104738 - RNA, 22 nt, Human
agucauuugucauuuuuuugag

SEQ ID NO: 104739 - RNA, 22 nt, Human
agucggauuucccagguuauug

SEQ ID NO: 104740 - RNA, 22 nt, Human
agucuagagcuuuuaucaggcc

SEQ ID NO: 104741 - RNA, 18 nt, Human
agucauguuuuagucacu

SEQ ID NO: 104742 - RNA, 19 nt, Human
agugaacuccauaucaggu

SEQ ID NO: 104743 - RNA, 22 nt, Human
agucugaaccagauggcaaggu

SEQ ID NO: 104744 - RNA, 21 nt, Human
agugaagagugggcuugauca

SEQ ID NO: 104745 - RNA, 22 nt, Human
agugaagauagagccaggucug

SEQ ID NO: 104746 - RNA, 20 nt, Human
agucuuaucugcauuuagaa

SEQ ID NO: 104747 - RNA, 22 nt, Human
agggcggucccugagacucucc

SEQ ID NO: 104748 - RNA, 20 nt, Human
agggauuugguugguauugu

SEQ ID NO: 104749 - RNA, 22 nt, Human
agggaaauuaaugugagcaaug

SEQ ID NO: 104750 - RNA, 17 nt, Human
agggaaguagggugggc

SEQ ID NO: 104751 - RNA, 22 nt, Human
aggggaggggaguaucaggauu

SEQ ID NO: 104752 - RNA, 22 nt, Human
aggggagaguuaaugugaaugu

SEQ ID NO: 104753 - RNA, 22 nt, Human
agggcuuacaucccacaguuag

SEQ ID NO: 104754 - RNA, 22 nt, Human
agggcuugggggccuugaaggc

SEQ ID NO: 104755 - RNA, 22 nt, Human
aggggaagagugagguuuuggu

SEQ ID NO: 104756 - RNA, 22 nt, Human
aggucuaaaugcugguuucacc

SEQ ID NO: 104757 - RNA, 19 nt, Human
aggucuaaucauaagacaa

SEQ ID NO: 104758 - RNA, 22 nt, Human
aggucgugggugagagagagac

SEQ ID NO: 104759 - RNA, 22 nt, Human
agguauuuuaugucgugugaug

SEQ ID NO: 104760 - RNA, 22 nt, Human
agguaugucccccgagugcagc

SEQ ID NO: 104761 - RNA, 22 nt, Human
aggguuugugaagacuuggcca

SEQ ID NO: 104762 - RNA, 22 nt, Human
aggguuaugcuccuucaucuug

SEQ ID NO: 104763 - RNA, 22 nt, Human
agguaagaagugagcaaguuua

SEQ ID NO: 104764 - RNA, 22 nt, Human
agguagaaggaccagaauuuau

SEQ ID NO: 104765 - RNA, 22 nt, Human
aggguuuucauauauuauuagu

SEQ ID NO: 104766 - RNA, 22 nt, Human
aggcguggcuucugcuggguug

SEQ ID NO: 104767 - RNA, 22 nt, Human
agggaagagaaacaaagauuca

SEQ ID NO: 104768 - RNA, 22 nt, Human
aggcgaagggaccagacgguag

SEQ ID NO: 104769 - RNA, 22 nt, Human
agggaagaggaccagagucucu

SEQ ID NO: 104770 - RNA, 22 nt, Human
aggcuuaaaugcucauaucagu

SEQ ID NO: 104771 - RNA, 22 nt, Human
aggcuucauuacagugguucaa

SEQ ID NO: 104772 - RNA, 22 nt, Human
agggaaguucuagggagucugg

SEQ ID NO: 104773 - RNA, 22 nt, Human
aggcgguuggcuuugucugggu

SEQ ID NO: 104774 - RNA, 22 nt, Human
aggcggguuuaggacaaugcuu

SEQ ID NO: 104775 - RNA, 22 nt, Human
aggcugaagcacacucaugcag

SEQ ID NO: 104776 - RNA, 22 nt, Human
aggccauuucacagguuuugga

SEQ ID NO: 104777 - RNA, 22 nt, Human
aggauggaaguaacuggauaau

SEQ ID NO: 104778 - RNA, 22 nt, Human
agcacggugguuaagagagugg

SEQ ID NO: 104779 - RNA, 22 nt, Human
agcagcugagccccagcuguga

SEQ ID NO: 104780 - RNA, 22 nt, Human
agauaagaacauuaguaagccg

SEQ ID NO: 104781 - RNA, 22 nt, Human
agcagguucaagggcaaagcug

SEQ ID NO: 104782 - RNA, 22 nt, Human
agcaggggcaggguuuugugcu

SEQ ID NO: 104783 - RNA, 22 nt, Human
agcagucagaucguggggaaaa

SEQ ID NO: 104784 - RNA, 19 nt, Human
agcagugaaaucuggugag

SEQ ID NO: 104785 - RNA, 22 nt, Human
agcaguuuauccucauaaugga

SEQ ID NO: 104786 - RNA, 18 nt, Human
agcaguugucucucucca

SEQ ID NO: 104787 - RNA, 22 nt, Human
agcaggaggguuuuguagaguc

SEQ ID NO: 104788 - RNA, 22 nt, Human
agcaggucagugguaaucaaaa

SEQ ID NO: 104789 - RNA, 22 nt, Human
agcaggauggaguaacgugaaa

SEQ ID NO: 104790 - RNA, 18 nt, Human
agcagugcggaucauuuu

SEQ ID NO: 104791 - RNA, 22 nt, Human
agcaguugcuuuguauauuaaa

SEQ ID NO: 104792 - RNA, 22 nt, Human
agcaugaauugccauuuauuaa

SEQ ID NO: 104793 - RNA, 22 nt, Human
agcaguuagauccugguuagcg

SEQ ID NO: 104794 - RNA, 22 nt, Human
agcauuugcuguucuagaaagu

SEQ ID NO: 104795 - RNA, 22 nt, Human
agcauuuuaaaacuaguuacca

SEQ ID NO: 104796 - RNA, 22 nt, Human
agcauuucuacugugucagaaa

SEQ ID NO: 104797 - RNA, 22 nt, Human
agcauugguggcauuugcagcu

SEQ ID NO: 104798 - RNA, 22 nt, Human
agcauucccuuugcagugucau

SEQ ID NO: 104799 - RNA, 22 nt, Human
agcaucuaucuucaaugugugu

SEQ ID NO: 104800 - RNA, 20 nt, Human
agcauucaacuuucuauguu

SEQ ID NO: 104801 - RNA, 22 nt, Human
agcgaaaagaauggaguggagu

SEQ ID NO: 104802 - RNA, 22 nt, Human
agccuugcaugauuucauucau

SEQ ID NO: 104803 - RNA, 22 nt, Human
agccuguacuuagagggauuaa

SEQ ID NO: 104804 - RNA, 22 nt, Human
agccgauaaauuguuuucuugg

SEQ ID NO: 104805 - RNA, 22 nt, Human
agcggcaggaagcgcgcaagcg

SEQ ID NO: 104806 - RNA, 22 nt, Human
agcggugacauccuucugugcu

SEQ ID NO: 104807 - RNA, 22 nt, Human
agcguaugaauauuugaagaga

SEQ ID NO: 104808 - RNA, 22 nt, Human
agcgagccugugcacuucuaac

SEQ ID NO: 104809 - RNA, 22 nt, Human
agcucagugugucuaugaggua

SEQ ID NO: 104810 - RNA, 22 nt, Human
agcucacucaaguaccuggggu

SEQ ID NO: 104811 - RNA, 22 nt, Human
agcuaauguauguugaaagcac

SEQ ID NO: 104812 - RNA, 22 nt, Human
agcuaaauauuuuuccugacac

SEQ ID NO: 104813 - RNA, 22 nt, Human
agcuaaaaugagguuuuuggau

SEQ ID NO: 104814 - RNA, 22 nt, Human
agcguucuguuccaugcuaaca

SEQ ID NO: 104815 - RNA, 22 nt, Human
agcugacagugcauggagggac

SEQ ID NO: 104816 - RNA, 22 nt, Human
agcucuuuggacuuuguuuuau

SEQ ID NO: 104817 - RNA, 22 nt, Human
agcucugugcaggcagaggcau

SEQ ID NO: 104818 - RNA, 22 nt, Human
agcucugauccuuuaaaggaga

SEQ ID NO: 104819 - RNA, 20 nt, Human
agcugaauaguuuugugaaa

SEQ ID NO: 104820 - RNA, 22 nt, Human
agcugcugcaaguggugcuaac

SEQ ID NO: 104821 - RNA, 19 nt, Human
agcugcugauugguggagg

SEQ ID NO: 104822 - RNA, 22 nt, Human
agcugaggccccgcagcagggu

SEQ ID NO: 104823 - RNA, 22 nt, Human
agcugcauucguaucauauugu

SEQ ID NO: 104824 - RNA, 22 nt, Human
agcuugauggauugcugaggca

SEQ ID NO: 104825 - RNA, 22 nt, Human
agcuugagauaauucaagcuga

SEQ ID NO: 104826 - RNA, 22 nt, Human
agcuugaaccuaaaacaauaau

SEQ ID NO: 104827 - RNA, 22 nt, Human
agcuggauuaaucacagugacu

SEQ ID NO: 104828 - RNA, 22 nt, Human
agcuguaacagguuaauaugga

SEQ ID NO: 104829 - RNA, 22 nt, Human
aggaaaaugaaggaagugggaa

SEQ ID NO: 104830 - RNA, 22 nt, Human
agcuuucaagaaauugucacaa

SEQ ID NO: 104831 - RNA, 22 nt, Human
agcugauugucuuuuuaaaagu

SEQ ID NO: 104832 - RNA, 22 nt, Human
agcugcauguauauucuuaaca

SEQ ID NO: 104833 - RNA, 22 nt, Human
agcugcuggcggauguuggacu

SEQ ID NO: 104834 - RNA, 22 nt, Human
aggaaagacgcauuucuguagg

SEQ ID NO: 104835 - RNA, 22 nt, Human
aggagaaagaccagccugccga

SEQ ID NO: 104836 - RNA, 22 nt, Human
aggacguaacccaggacagccu

SEQ ID NO: 104837 - RNA, 22 nt, Human
aggauaaaggucauuauuccca

SEQ ID NO: 104838 - RNA, 22 nt, Human
aggaaaguugagcugucuguag

SEQ ID NO: 104839 - RNA, 20 nt, Human
aggaagauccuuucuuuuaa

SEQ ID NO: 104840 - RNA, 22 nt, Human
aggaaaguugcuuguagugcug

SEQ ID NO: 104841 - RNA, 22 nt, Human
aggaaaggcucugugguuccua

SEQ ID NO: 104842 - RNA, 22 nt, Human
aggaaaauggaccagaguuguu

SEQ ID NO: 104843 - RNA, 22 nt, Human
aggaaauaggaccagacaaagc

SEQ ID NO: 104844 - RNA, 22 nt, Human
agcuggaaucucggcaaagcgu

SEQ ID NO: 104845 - RNA, 22 nt, Human
agcugugaccuucaagagcuac

SEQ ID NO: 104846 - RNA, 22 nt, Human
agcugugaccaguuacgaaauu

SEQ ID NO: 104847 - RNA, 22 nt, Human
agcuucuucugccuugucccug

SEQ ID NO: 104848 - RNA, 19 nt, Human
agcuuauuuacugcaggac

SEQ ID NO: 104849 - RNA, 22 nt, Human
agcuuucuauauaugaguugcu

SEQ ID NO: 104850 - RNA, 22 nt, Human
agcuuugcccaaugaguuaugu

SEQ ID NO: 104851 - RNA, 22 nt, Human
agcuugaugaaagugggugcuc

SEQ ID NO: 104852 - RNA, 22 nt, Human
aggaaaaagaagaaaagaauca

SEQ ID NO: 104853 - RNA, 22 nt, Human
acugccauauuaggagcuucag

SEQ ID NO: 104854 - RNA, 22 nt, Human
acuaaguagaggagugaugauu

SEQ ID NO: 104855 - RNA, 22 nt, Human
acguugaaaugggcauuuuccg

SEQ ID NO: 104856 - RNA, 20 nt, Human
acugcaagagacagaugaaa

SEQ ID NO: 104857 - RNA, 22 nt, Human
acugauuuuauauauuaccccg

SEQ ID NO: 104858 - RNA, 22 nt, Human
acuggauucucuuacacagaug

SEQ ID NO: 104859 - RNA, 22 nt, Human
acuggauuuugugguguaucuu

SEQ ID NO: 104860 - RNA, 23 nt, Human
acuggauuguucuugggcgcuga

SEQ ID NO: 104861 - RNA, 22 nt, Human
acuggcuuauuguuguggagcu

SEQ ID NO: 104862 - RNA, 22 nt, Human
acuggggauugguucuucaaca

SEQ ID NO: 104863 - RNA, 22 nt, Human
acugucauuaaugaauguaaua

SEQ ID NO: 104864 - RNA, 19 nt, Human
acugggaugggcagugcca

SEQ ID NO: 104865 - RNA, 22 nt, Human
acugguuucaaguuggacugaa

SEQ ID NO: 104866 - RNA, 22 nt, Human
acugugaagagcauucuggcug

SEQ ID NO: 104867 - RNA, 22 nt, Human
acugugauuuguuuuuguguuu

SEQ ID NO: 104868 - RNA, 22 nt, Human
acuguugagggaagcagaugaa

SEQ ID NO: 104869 - RNA, 22 nt, Human
acuguugugaauaaugaaaugc

SEQ ID NO: 104870 - RNA, 22 nt, Human
acuucaggacggcaguggaggg

SEQ ID NO: 104871 - RNA, 22 nt, Human
acuuagaacagccuaugggaag

SEQ ID NO: 104872 - RNA, 22 nt, Human
acuuauaaauuuaguacacugu

SEQ ID NO: 104873 - RNA, 22 nt, Human
acuucucuuuucauuaauuuug

SEQ ID NO: 104874 - RNA, 22 nt, Human
acuguuauugguguauguggca

SEQ ID NO: 104875 - RNA, 22 nt, Human
acugugcaugaaccgaaacaaa

SEQ ID NO: 104876 - RNA, 22 nt, Human
acugugauguaaagaaauaggc

SEQ ID NO: 104877 - RNA, 22 nt, Human
acuugaagcaugaaaauaagcc

SEQ ID NO: 104878 - RNA, 22 nt, Human
acuuagacaucuuuagugguua

SEQ ID NO: 104879 - RNA, 22 nt, Human
acuugagcuugaaagguaugcu

SEQ ID NO: 104880 - RNA, 22 nt, Human
acuuuaaaucuguugcuuagcu

SEQ ID NO: 104881 - RNA, 22 nt, Human
acuuggcuaggguuuuuaucuu

SEQ ID NO: 104882 - RNA, 22 nt, Human
acuuuuagccuucccacaacag

SEQ ID NO: 104883 - RNA, 22 nt, Human
acuuuuuugccaucccuccagc

SEQ ID NO: 104884 - RNA, 22 nt, Human
acuuuuaauaguagauuuuuaa

SEQ ID NO: 104885 - RNA, 22 nt, Human
acuuuugaguuacauaccugaa

SEQ ID NO: 104886 - RNA, 22 nt, Human
agaaaagaggcuuucuaagcau

SEQ ID NO: 104887 - RNA, 22 nt, Human
acuuuuaaggggccuugauuua

SEQ ID NO: 104888 - RNA, 22 nt, Human
acuuuggugcgaagucacuuua

SEQ ID NO: 104889 - RNA, 22 nt, Human
acuuugucuugaucaaaggugu

SEQ ID NO: 104890 - RNA, 22 nt, Human
acuuggucguggugcagcaugg

SEQ ID NO: 104891 - RNA, 22 nt, Human
acuuugccuucuuacuguguug

SEQ ID NO: 104892 - RNA, 22 nt, Human
agaagcaaagcaaacacauucu

SEQ ID NO: 104893 - RNA, 22 nt, Human
agaagauucagcaguagggugg

SEQ ID NO: 104894 - RNA, 22 nt, Human
agaaauggggugaagcaaaugg

SEQ ID NO: 104895 - RNA, 22 nt, Human
agaaauggccagacuugccccu

SEQ ID NO: 104896 - RNA, 22 nt, Human
agaagcauaagggcuuugccag

SEQ ID NO: 104897 - RNA, 22 nt, Human
agaagcagaaggaagcagggcc

SEQ ID NO: 104898 - RNA, 22 nt, Human
agaaagcacccugcacuuucug

SEQ ID NO: 104899 - RNA, 19 nt, Human
agaaacaacauucuggaga

SEQ ID NO: 104900 - RNA, 22 nt, Human
agacagaaaaguugucaaucau

SEQ ID NO: 104901 - RNA, 22 nt, Human
agaaucagagcagaaucuucau

SEQ ID NO: 104902 - RNA, 22 nt, Human
agaacaagaaacccgaaaagug

SEQ ID NO: 104903 - RNA, 20 nt, Human
agaaggagagaugaggcaaa

SEQ ID NO: 104904 - RNA, 22 nt, Human
agaacauaucuguuuucuaacu

SEQ ID NO: 104905 - RNA, 22 nt, Human
agacauuuggugugaagggagg

SEQ ID NO: 104906 - RNA, 22 nt, Human
agacauauuggcuugcuuuaau

SEQ ID NO: 104907 - RNA, 22 nt, Human
agacagaacauaauuaguacug

SEQ ID NO: 104908 - RNA, 21 nt, Human
agaaugaagaagaggucuuug

SEQ ID NO: 104909 - RNA, 22 nt, Human
agaaucugcauuuuaacaagau

SEQ ID NO: 104910 - RNA, 22 nt, Human
agacagcggugcaauaaauggu

SEQ ID NO: 104911 - RNA, 20 nt, Human
agacauugaggagagagcau

SEQ ID NO: 104912 - RNA, 22 nt, Human
agacuugguaacuagugaagaa

SEQ ID NO: 104913 - RNA, 22 nt, Human
agaccauuuuguagccagcaua

SEQ ID NO: 104914 - RNA, 22 nt, Human
agagaaauguacuagucuaacu

SEQ ID NO: 104915 - RNA, 22 nt, Human
agagacaggguuuugucguguu

SEQ ID NO: 104916 - RNA, 22 nt, Human
agagaauuugggaauauaaauc

SEQ ID NO: 104917 - RNA, 22 nt, Human
agacuguuuucccaucucuugg

SEQ ID NO: 104918 - RNA, 19 nt, Human
agacugaagggcccgaguc

SEQ ID NO: 104919 - RNA, 22 nt, Human
agagcuagaaggaagcauuucu

SEQ ID NO: 104920 - RNA, 22 nt, Human
agagcagcaaucuuugaaauua

SEQ ID NO: 104921 - RNA, 21 nt, Human
agagaccuaagcugagauucc

SEQ ID NO: 104922 - RNA, 22 nt, Human
agagacugauggaucaccaaau

SEQ ID NO: 104923 - RNA, 22 nt, Human
agagaccugaaugaguugaaca

SEQ ID NO: 104924 - RNA, 22 nt, Human
agagaagaauccccugguggag

SEQ ID NO: 104925 - RNA, 22 nt, Human
agagauugagcucagaagaccu

SEQ ID NO: 104926 - RNA, 22 nt, Human
agagaacauuuucaggguuuca

SEQ ID NO: 104927 - RNA, 22 nt, Human
agagauggugaugaggaaaaau

SEQ ID NO: 104928 - RNA, 19 nt, Human
agagauuuucuguuuuagu

SEQ ID NO: 104929 - RNA, 22 nt, Human
agagaaacauuaauugaugagg

SEQ ID NO: 104930 - RNA, 22 nt, Human
agacuuuggcagggccaguggu

SEQ ID NO: 104931 - RNA, 22 nt, Human
agaggagaauguaaauuuguca

SEQ ID NO: 104932 - RNA, 22 nt, Human
agagauuagagaagaugauaaa

SEQ ID NO: 104933 - RNA, 22 nt, Human
agaggaauuauugaguuagauu

SEQ ID NO: 104934 - RNA, 22 nt, Human
agagcuuuggaguaaguuuuga

SEQ ID NO: 104935 - RNA, 22 nt, Human
agaggugcuuaugcucaugguu

SEQ ID NO: 104936 - RNA, 22 nt, Human
agauaaucacaaucuagacuuu

SEQ ID NO: 104937 - RNA, 22 nt, Human
agauaacauguugcagauucug

SEQ ID NO: 104938 - RNA, 22 nt, Human
accgaauucuauucccaauacc

SEQ ID NO: 104939 - RNA, 21 nt, Human
acccagaauggagccaagccu

SEQ ID NO: 104940 - RNA, 22 nt, Human
accauccaaaagcuuuucauca

SEQ ID NO: 104941 - RNA, 22 nt, Human
accaugacugucacauuauuau

SEQ ID NO: 104942 - RNA, 20 nt, Human
acccaaagcucagcgugucc

SEQ ID NO: 104943 - RNA, 22 nt, Human
accauuauagaggacauuaugu

SEQ ID NO: 104944 - RNA, 22 nt, Human
acccugcacagagggcuuuaua

SEQ ID NO: 104945 - RNA, 22 nt, Human
accccuauugcuugugauuaug

SEQ ID NO: 104946 - RNA, 22 nt, Human
accccacucccuuucuuuugcu

SEQ ID NO: 104947 - RNA, 21 nt, Human
accgucaguacuaguauugac

SEQ ID NO: 104948 - RNA, 20 nt, Human
accccuccccacuccucgcc

SEQ ID NO: 104949 - RNA, 22 nt, Human
accccuuaaauuuguuguuuaa

SEQ ID NO: 104950 - RNA, 22 nt, Human
acccugacggugggcagcuuga

SEQ ID NO: 104951 - RNA, 22 nt, Human
accugauuuuauggauuuugag

SEQ ID NO: 104952 - RNA, 22 nt, Human
accucauucugcauagaacuuu

SEQ ID NO: 104953 - RNA, 22 nt, Human
accgauguggaaaauuucauuu

SEQ ID NO: 104954 - RNA, 22 nt, Human
accuguagcccaaucauggcag

SEQ ID NO: 104955 - RNA, 22 nt, Human
accuuagcuguuaaaacuaagu

SEQ ID NO: 104956 - RNA, 22 nt, Human
accuuaaacagauggcggcugg

SEQ ID NO: 104957 - RNA, 22 nt, Human
accuucugaccucucggacuuc

SEQ ID NO: 104958 - RNA, 22 nt, Human
accuugauggagugaugaauga

SEQ ID NO: 104959 - RNA, 22 nt, Human
accuuggauauucuuacucggu

SEQ ID NO: 104960 - RNA, 22 nt, Human
accuuguuguagguacaaaaga

SEQ ID NO: 104961 - RNA, 22 nt, Human
acgauaacaauaguagcaugua

SEQ ID NO: 104962 - RNA, 22 nt, Human
accugcucucccucucgcaguc

SEQ ID NO: 104963 - RNA, 22 nt, Human
accugcagguguuuccacacuu

SEQ ID NO: 104964 - RNA, 22 nt, Human
acgauuugguucagugaagaca

SEQ ID NO: 104965 - RNA, 22 nt, Human
acuaaacauaucacugcuuuac

SEQ ID NO: 104966 - RNA, 22 nt, Human
acgugaccuuauuugaaaaaug

SEQ ID NO: 104967 - RNA, 22 nt, Human
acguuauagaugcuucaugaaa

SEQ ID NO: 104968 - RNA, 22 nt, Human
acgguuuugugagguaguacuu

SEQ ID NO: 104969 - RNA, 22 nt, Human
acguuuuagccauguaguuucu

SEQ ID NO: 104970 - RNA, 22 nt, Human
acgaaugacaugugauuugaaa

SEQ ID NO: 104971 - RNA, 22 nt, Human
accuuagugauuuaaaaucaga

SEQ ID NO: 104972 - RNA, 22 nt, Human
acgaaauaaaauuaaagcccua

SEQ ID NO: 104973 - RNA, 22 nt, Human
accuuuuauuuucaugcuugcu

SEQ ID NO: 104974 - RNA, 22 nt, Human
acgcacuuuaugcuuuuaacaa

SEQ ID NO: 104975 - RNA, 22 nt, Human
aauucgcugcauuccaucuagg

SEQ ID NO: 104976 - RNA, 22 nt, Human
aauucuaaugaguucuuaucua

SEQ ID NO: 104977 - RNA, 21 nt, Human
aauucccagaaacagcacaag

SEQ ID NO: 104978 - RNA, 22 nt, Human
aaugcgcagaguggugugugca

SEQ ID NO: 104979 - RNA, 22 nt, Human
aauucugaggccauuuauuucc

SEQ ID NO: 104980 - RNA, 22 nt, Human
aauucugcagucguacuauaau

SEQ ID NO: 104981 - RNA, 22 nt, Human
acaguuuucugagaaucacagg

SEQ ID NO: 104982 - RNA, 22 nt, Human
acauaaacaugcagccugccaa

SEQ ID NO: 104983 - RNA, 22 nt, Human
acauggacugguccauuaugac

SEQ ID NO: 104984 - RNA, 22 nt, Human
acauauaugugcauacaacuau

SEQ ID NO: 104985 - RNA, 22 nt, Human
acaugggggugggacggcagag

SEQ ID NO: 104986 - RNA, 22 nt, Human
acauccaguaucagaagcauca

SEQ ID NO: 104987 - RNA, 23 nt, Human
acauuacacgcaguaauugcccc

SEQ ID NO: 104988 - RNA, 22 nt, Human
acauugcagcuccuaccuuguc

SEQ ID NO: 104989 - RNA, 22 nt, Human
acaucucacuucuuugaaggcu

SEQ ID NO: 104990 - RNA, 22 nt, Human
acaugacagugacuuuauaaga

SEQ ID NO: 104991 - RNA, 22 nt, Human
acauugguauuaguguggcuga

SEQ ID NO: 104992 - RNA, 22 nt, Human
acauuagaugacucuuucuuuc

SEQ ID NO: 104993 - RNA, 22 nt, Human
acaugggcaaucgcuuuauuca

SEQ ID NO: 104994 - RNA, 22 nt, Human
acauuuugggagaaaguuguua

SEQ ID NO: 104995 - RNA, 22 nt, Human
acauggcaugaauaauguguac

SEQ ID NO: 104996 - RNA, 22 nt, Human
acauuuuaaaaacaguaccugg

SEQ ID NO: 104997 - RNA, 22 nt, Human
acauuguuauuccucaggaguu

SEQ ID NO: 104998 - RNA, 22 nt, Human
acauggaauuucagaagagcau

SEQ ID NO: 104999 - RNA, 22 nt, Human
acaugcuucauauuauaaccaa

SEQ ID NO: 105000 - RNA, 22 nt, Human
acaugcuuucuagguccuucug

SEQ ID NO: 105001 - RNA, 22 nt, Human
accagguugagacuucggcuuu

SEQ ID NO: 105002 - RNA, 22 nt, Human
accaguucuauguagauaauga

SEQ ID NO: 105003 - RNA, 22 nt, Human
accauuuaucagaagagacacc

SEQ ID NO: 105004 - RNA, 22 nt, Human
accaaucugguauauuccagaa

SEQ ID NO: 105005 - RNA, 22 nt, Human
accaacacgucugaguauuucc

SEQ ID NO: 105006 - RNA, 18 nt, Human
acccauuauauuuguagc

SEQ ID NO: 105007 - RNA, 22 nt, Human
acaugugugucugugugugugu

SEQ ID NO: 105008 - RNA, 22 nt, Human
acauuuuguuuauggaaaagau

SEQ ID NO: 105009 - RNA, 22 nt, Human
acauuuuuggguugaugucuga

SEQ ID NO: 105010 - RNA, 22 nt, Human
accaacuuuccaaagugccugg

SEQ ID NO: 105011 - RNA, 22 nt, Human
acauuauuguguagugugggca

SEQ ID NO: 105012 - RNA, 22 nt, Human
acauucucuuuuagaaagcugu

SEQ ID NO: 105013 - RNA, 22 nt, Human
acauuccugaagguaaugagaa

SEQ ID NO: 105014 - RNA, 22 nt, Human
acauguuuacaaaccucaagcc

SEQ ID NO: 105015 - RNA, 22 nt, Human
accaauaaaagcaauucacagu

SEQ ID NO: 105016 - RNA, 22 nt, Human
accaagaguccaagugagguug

SEQ ID NO: 105017 - RNA, 22 nt, Human
acauuucuccuacuuguuauuu

SEQ ID NO: 105018 - RNA, 22 nt, Human
acauuuuaccaucuguggauga

SEQ ID NO: 105019 - RNA, 22 nt, Human
acauuugauauggaguugugua

SEQ ID NO: 105020 - RNA, 22 nt, Human
acauuuguuucucuagaguagg

SEQ ID NO: 105021 - RNA, 22 nt, Human
acauuguuuuugugacuucuau

SEQ ID NO: 105022 - RNA, 22 nt, Human
accaauguuuuauagaaaugcc

SEQ ID NO: 105023 - RNA, 22 nt, Human
ccccuuuguagcccagcaguug

SEQ ID NO: 105024 - RNA, 22 nt, Human
ccagcuuuucagaaucugccug

SEQ ID NO: 105025 - RNA, 22 nt, Human
ccccccaaauguuacagugacc

SEQ ID NO: 105026 - RNA, 22 nt, Human
cauauuaugcauguuguucuuu

SEQ ID NO: 105027 - RNA, 22 nt, Human
caugucaagacugaagauccag

SEQ ID NO: 105028 - RNA, 22 nt, Human
caucaaaugcaagagcguucuu

SEQ ID NO: 105029 - RNA, 22 nt, Human
cauuagugaggggcugccugcu

SEQ ID NO: 105030 - RNA, 22 nt, Human
cauuacaagaaauagcauaaug

SEQ ID NO: 105031 - RNA, 20 nt, Human
caucaacaccuugucagccu

SEQ ID NO: 105032 - RNA, 22 nt, Human
ccagcagaagcucccgcugggu

SEQ ID NO: 105033 - RNA, 22 nt, Human
ccccaaauuugugcuuucauag

SEQ ID NO: 105034 - RNA, 22 nt, Human
ccaguggugcauguuugagcaa

SEQ ID NO: 105035 - RNA, 22 nt, Human
ccaguuguggagaauuguuuga

SEQ ID NO: 105036 - RNA, 19 nt, Human
ccaguuuuuuaauauucaa

SEQ ID NO: 105037 - RNA, 22 nt, Human
ccaguuuuuccagugcuuucug

SEQ ID NO: 105038 - RNA, 22 nt, Human
ccagggcugcugccugggcugg

SEQ ID NO: 105039 - RNA, 22 nt, Human
ccagggcuggaccagugcuugg

SEQ ID NO: 105040 - RNA, 22 nt, Human
ccagggcuggaggaggucagga

SEQ ID NO: 105041 - RNA, 22 nt, Human
ccauaaaagagaaucuaaauga

SEQ ID NO: 105042 - RNA, 22 nt, Human
cccuuggaaaugguucuuaacu

SEQ ID NO: 105043 - RNA, 22 nt, Human
ccaucucaucugguugggggug

SEQ ID NO: 105044 - RNA, 21 nt, Human
ccaucuugaaccaugcccacu

SEQ ID NO: 105045 - RNA, 22 nt, Human
ccgauuuaugucucugacuuga

SEQ ID NO: 105046 - RNA, 22 nt, Human
cccaaccagaaauugacagaga

SEQ ID NO: 105047 - RNA, 22 nt, Human
ccucacuucuuucucuucacuu

SEQ ID NO: 105048 - RNA, 22 nt, Human
ccucaauucgugccucacauug

SEQ ID NO: 105049 - RNA, 23 nt, Human
ccuagcuuacugucaggugucuu

SEQ ID NO: 105050 - RNA, 22 nt, Human
ccccuuguuuuauucaaauugg

SEQ ID NO: 105051 - RNA, 22 nt, Human
ccuaauuuuagacccacuccua

SEQ ID NO: 105052 - RNA, 21 nt, Human
ccguuauucuucccaccccca

SEQ ID NO: 105053 - RNA, 22 nt, Human
cccauuuuuuggauguguggau

SEQ ID NO: 105054 - RNA, 22 nt, Human
cccauuaguuguuaaucaucaa

SEQ ID NO: 105055 - RNA, 22 nt, Human
ccccacaugaauacaguguagu

SEQ ID NO: 105056 - RNA, 22 nt, Human
cccaguuguuccuauucuucuu

SEQ ID NO: 105057 - RNA, 22 nt, Human
cccagcugaacuugcauuccaa

SEQ ID NO: 105058 - RNA, 22 nt, Human
ccugaaaugaguucugcucacu

SEQ ID NO: 105059 - RNA, 22 nt, Human
ccugaagaugguugauccccuu

SEQ ID NO: 105060 - RNA, 22 nt, Human
ccugaauuuaucugaauggugg

SEQ ID NO: 105061 - RNA, 22 nt, Human
ccugacuugguuuaggagaugg

SEQ ID NO: 105062 - RNA, 19 nt, Human
ccugcugaagugaugcagc

SEQ ID NO: 105063 - RNA, 22 nt, Human
ccugcugagccuggugggcagc

SEQ ID NO: 105064 - RNA, 22 nt, Human
ccgaaaaacagaaucuuggaac

SEQ ID NO: 105065 - RNA, 21 nt, Human
cccuugccugcacuccucggc

SEQ ID NO: 105066 - RNA, 22 nt, Human
cccuuuuuuauggaguuggcca

SEQ ID NO: 105067 - RNA, 22 nt, Human
ccugcuggagucuaguuggucu

SEQ ID NO: 105068 - RNA, 22 nt, Human
ccugcugcugaugcuguuucac

SEQ ID NO: 105069 - RNA, 22 nt, Human
ccucaguguguggauguuagag

SEQ ID NO: 105070 - RNA, 22 nt, Human
ccucucacucccucauggguuc

SEQ ID NO: 105071 - RNA, 22 nt, Human
cgccaguggcagcuggaacagg

SEQ ID NO: 105072 - RNA, 22 nt, Human
cgcacaggcacagacacuggga

SEQ ID NO: 105073 - RNA, 21 nt, Human
ccugcacuucccuccucaagu

SEQ ID NO: 105074 - RNA, 22 nt, Human
ccucuuuugaaccaguucuuca

SEQ ID NO: 105075 - RNA, 22 nt, Human
cggguccuucugucuucucugg

SEQ ID NO: 105076 - RNA, 19 nt, Human
cgguaugaauguacuaugg

SEQ ID NO: 105077 - RNA, 22 nt, Human
ccuuagaaaaucauggaauauu

SEQ ID NO: 105078 - RNA, 22 nt, Human
ccuguguucguccucaccuugc

SEQ ID NO: 105079 - RNA, 22 nt, Human
ccugucugaaggcagggggaug

SEQ ID NO: 105080 - RNA, 19 nt, Human
ccugugaguuaagcuaugu

SEQ ID NO: 105081 - RNA, 22 nt, Human
ccugugcuucacucaacaagcc

SEQ ID NO: 105082 - RNA, 22 nt, Human
cggugcuuuccauaucagcagc

SEQ ID NO: 105083 - RNA, 21 nt, Human
ccuuuggagacugcagcaaug

SEQ ID NO: 105084 - RNA, 22 nt, Human
ccuuuuaagggagacuagagau

SEQ ID NO: 105085 - RNA, 22 nt, Human
ccuuuuagagaagugcauccag

SEQ ID NO: 105086 - RNA, 22 nt, Human
cgguugcaggaugugcgggcag

SEQ ID NO: 105087 - RNA, 22 nt, Human
cgguggcccauuguacgcagcu

SEQ ID NO: 105088 - RNA, 19 nt, Human
cggugcugauuggugcagu

SEQ ID NO: 105089 - RNA, 19 nt, Human
cggugaagagaguuuagau

SEQ ID NO: 105090 - RNA, 22 nt, Human
cuaaaacuuuuccaaauuaugu

SEQ ID NO: 105091 - RNA, 22 nt, Human
cuaagguuggcaguggaauugg

SEQ ID NO: 105092 - RNA, 22 nt, Human
ccuuuuguuucccuuuauguuc

SEQ ID NO: 105093 - RNA, 22 nt, Human
cguuauagagcacucgaacuuu

SEQ ID NO: 105094 - RNA, 22 nt, Human
cuaaaaauguucuaguaguuca

SEQ ID NO: 105095 - RNA, 20 nt, Human
cuaaaacaggugucuaguga

SEQ ID NO: 105096 - RNA, 22 nt, Human
cuaaugaaaugauggcuccuac

SEQ ID NO: 105097 - RNA, 21 nt, Human
cuauaaaaaugguucuuugcg

SEQ ID NO: 105098 - RNA, 22 nt, Human
cuaguuuucacaaaggaagggc

SEQ ID NO: 105099 - RNA, 22 nt, Human
cuaauuguaagcuccuugaggg

SEQ ID NO: 105100 - RNA, 22 nt, Human
cuaugaaucaauuucugcaguu

SEQ ID NO: 105101 - RNA, 22 nt, Human
cuauaauuguacuuguuuuuua

SEQ ID NO: 105102 - RNA, 22 nt, Human
cgcugcagcggcugagucccgc

SEQ ID NO: 105103 - RNA, 22 nt, Human
cucagcaacccacacacggucu

SEQ ID NO: 105104 - RNA, 22 nt, Human
cucaggaaaauauugaagaagu

SEQ ID NO: 105105 - RNA, 22 nt, Human
cucacugucagcugcagggcuu

SEQ ID NO: 105106 - RNA, 22 nt, Human
cucacugugggcuaugaauggg

SEQ ID NO: 105107 - RNA, 22 nt, Human
cuauuuucccauaugguugaca

SEQ ID NO: 105108 - RNA, 22 nt, Human
cuauuauuauugucguuuuaca

SEQ ID NO: 105109 - RNA, 22 nt, Human
cuauugguaucacacugauuuc

SEQ ID NO: 105110 - RNA, 22 nt, Human
cggaagcacuagacacugacac

SEQ ID NO: 105111 - RNA, 22 nt, Human
cuccuuugagcaaaucuuugau

SEQ ID NO: 105112 - RNA, 22 nt, Human
cucuaaauguggucugcagaua

SEQ ID NO: 105113 - RNA, 22 nt, Human
cucuauuuuuucaucuuucagg

SEQ ID NO: 105114 - RNA, 22 nt, Human
cucuauucuaauggauucuggg

SEQ ID NO: 105115 - RNA, 22 nt, Human
cggccuuugcccgucauucugg

SEQ ID NO: 105116 - RNA, 22 nt, Human
cucuggcaacgauggugcuuau

SEQ ID NO: 105117 - RNA, 22 nt, Human
cucugugggcauauuuguaaaa

SEQ ID NO: 105118 - RNA, 22 nt, Human
cucuguggucugaagccuguga

SEQ ID NO: 105119 - RNA, 22 nt, Human
cucuugugucaccauggauaaa

SEQ ID NO: 105120 - RNA, 20 nt, Human
cucuuuaugagaccacuguc

SEQ ID NO: 105121 - RNA, 20 nt, Human
cucuuucugcuuuaugccuc

SEQ ID NO: 105122 - RNA, 22 nt, Human
cucuuucauucuuagguugccg

SEQ ID NO: 105123 - RNA, 23 nt, Human
cugaaauucagaugcuaaagaua

SEQ ID NO: 105124 - RNA, 22 nt, Human
cugaaagcaaaguaauucuuaa

SEQ ID NO: 105125 - RNA, 22 nt, Human
cugaacuaagcccaaagacacu

SEQ ID NO: 105126 - RNA, 20 nt, Human
cugaaaggaaagaaauuuuu

SEQ ID NO: 105127 - RNA, 22 nt, Human
cggggcaaggggggcuggugga

SEQ ID NO: 105128 - RNA, 19 nt, Human
cugacccaacauuaguuca

SEQ ID NO: 105129 - RNA, 22 nt, Human
cugaaggacacgugaggagcca

SEQ ID NO: 105130 - RNA, 20 nt, Human
cugaauaccacagagccauc

SEQ ID NO: 105131 - RNA, 22 nt, Human
cugaaucaaaugacuuagccau

SEQ ID NO: 105132 - RNA, 22 nt, Human
cugacacagccauuguccuugu

SEQ ID NO: 105133 - RNA, 22 nt, Human
cugaccgugccgcgguacugcu

SEQ ID NO: 105134 - RNA, 22 nt, Human
gaaagcuuggaaacgacuuuau

SEQ ID NO: 105135 - RNA, 22 nt, Human
cuuugugcagcagaaaugugug

SEQ ID NO: 105136 - RNA, 22 nt, Human
cuuuguaaucaauaagucuuuu

SEQ ID NO: 105137 - RNA, 22 nt, Human
cuuuuaaucuaauuuuuauauu

SEQ ID NO: 105138 - RNA, 22 nt, Human
cuguguugggauggugcgcgca

SEQ ID NO: 105139 - RNA, 22 nt, Human
gaaaugucaagauauguuugga

SEQ ID NO: 105140 - RNA, 22 nt, Human
cugugcuguuaagaaauuuagu

SEQ ID NO: 105141 - RNA, 22 nt, Human
cugugcuguuagcgauuuuuaa

SEQ ID NO: 105142 - RNA, 22 nt, Human
cuguggaaugcaguugcgagca

SEQ ID NO: 105143 - RNA, 22 nt, Human
cugugccagucagggggcaagu

SEQ ID NO: 105144 - RNA, 22 nt, Human
cuguuguauuuauuucccuuuc

SEQ ID NO: 105145 - RNA, 22 nt, Human
cuguuguguuauuugcagugca

SEQ ID NO: 105146 - RNA, 22 nt, Human
gaaauuucuuuguuaucuuggu

SEQ ID NO: 105147 - RNA, 22 nt, Human
cuguuaucaggaguuuucacgg

SEQ ID NO: 105148 - RNA, 20 nt, Human
cuguuugcuaucaugagcug

SEQ ID NO: 105149 - RNA, 22 nt, Human
cuguuuggcuuccacugcuucu

SEQ ID NO: 105150 - RNA, 22 nt, Human
cuguuuggaugccauggucaag

SEQ ID NO: 105151 - RNA, 22 nt, Human
gaacauauuuagcaccuaauau

SEQ ID NO: 105152 - RNA, 22 nt, Human
cuuauaucaacuggaaaaauua

SEQ ID NO: 105153 - RNA, 22 nt, Human
gaagcagguucuucaggaugaa

SEQ ID NO: 105154 - RNA, 23 nt, Human
cuuauauaaucauuagaaaccau

SEQ ID NO: 105155 - RNA, 22 nt, Human
cuuaggaaauccuguacucccc

SEQ ID NO: 105156 - RNA, 22 nt, Human
cuuacauuuguuuaguguuucc

SEQ ID NO: 105157 - RNA, 22 nt, Human
cuucacuccuggagugaguuuc

SEQ ID NO: 105158 - RNA, 22 nt, Human
gaagccaugauaaccagugugg

SEQ ID NO: 105159 - RNA, 22 nt, Human
cuuauuugcccauguuucuuua

SEQ ID NO: 105160 - RNA, 22 nt, Human
cuucacaaaauauuucauuaua

SEQ ID NO: 105161 - RNA, 22 nt, Human
cuucugaugugugcucuuaguu

SEQ ID NO: 105162 - RNA, 22 nt, Human
cuucucuuugacaguugggugu

SEQ ID NO: 105163 - RNA, 22 nt, Human
gaaggaagcugucuggaugugu

SEQ ID NO: 105164 - RNA, 22 nt, Human
cuuccguuacugacaaaauguu

SEQ ID NO: 105165 - RNA, 22 nt, Human
cuucccuaagggacuggcauag

SEQ ID NO: 105166 - RNA, 22 nt, Human
cuuccauucugauggcuaauua

SEQ ID NO: 105167 - RNA, 21 nt, Human
gaagcugcuaugaagggggac

SEQ ID NO: 105168 - RNA, 22 nt, Human
cuucaggaccugaagcccaucu

SEQ ID NO: 105169 - RNA, 22 nt, Human
gaagcuucgaaagagugauuuc

SEQ ID NO: 105170 - RNA, 22 nt, Human
gaagcucaguugcuuagaucuc

SEQ ID NO: 105171 - RNA, 22 nt, Human
cuucauguucaugcuaacauuu

SEQ ID NO: 105172 - RNA, 22 nt, Human
cuucauaagauuguugugagga

SEQ ID NO: 105173 - RNA, 22 nt, Human
gaagcuucucaacugguggaau

SEQ ID NO: 105174 - RNA, 22 nt, Human
gaaggaaaagacgugcuaagua

SEQ ID NO: 105175 - RNA, 22 nt, Human
gaauauuuaucucagcugcaga

SEQ ID NO: 105176 - RNA, 22 nt, Human
gaauagauuagaaagaguaugu

SEQ ID NO: 105177 - RNA, 21 nt, Human
gaaguagcucugagaaaagug

SEQ ID NO: 105178 - RNA, 22 nt, Human
cuucuuuccauguguuuugguu

SEQ ID NO: 105179 - RNA, 22 nt, Human
gaaguaaugugauugcucaggg

SEQ ID NO: 105180 - RNA, 22 nt, Human
cuugcuguccgaugggucugua

SEQ ID NO: 105181 - RNA, 22 nt, Human
cuuggcacccaucuuuccaccu

SEQ ID NO: 105182 - RNA, 22 nt, Human
cuuggcaaaguggcaaaauuag

SEQ ID NO: 105183 - RNA, 22 nt, Human
cuuggugagcuccuggcgcagc

SEQ ID NO: 105184 - RNA, 20 nt, Human
gaauucugaagauaauuugg

SEQ ID NO: 105185 - RNA, 22 nt, Human
gaauucuaguucuguaucucug

SEQ ID NO: 105186 - RNA, 22 nt, Human
gaauggaacauagcaacaucuu

SEQ ID NO: 105187 - RNA, 19 nt, Human
cuuugugguuuucagaacu

SEQ ID NO: 105188 - RNA, 22 nt, Human
cuuuuaccuuaauuucgacaca

SEQ ID NO: 105189 - RNA, 22 nt, Human
cuuuucuuuucuucucuuccca

SEQ ID NO: 105190 - RNA, 22 nt, Human
cuuuuucuuaucuuuuucuaug

SEQ ID NO: 105191 - RNA, 22 nt, Human
gacuaaauaaaagccaaacuuc

SEQ ID NO: 105192 - RNA, 22 nt, Human
cuuuacauuaauuucuacugau

SEQ ID NO: 105193 - RNA, 22 nt, Human
gacauuuauuggauuuuacgag

SEQ ID NO: 105194 - RNA, 18 nt, Human
gacaaaaguacagacaga

SEQ ID NO: 105195 - RNA, 22 nt, Human
cuuguuaaaagugacccuaaug

SEQ ID NO: 105196 - RNA, 20 nt, Human
cuuguuaaauaugcagguag

SEQ ID NO: 105197 - RNA, 22 nt, Human
cuuuaagugaaaggggauuaaa

SEQ ID NO: 105198 - RNA, 22 nt, Human
cuuguuuuaaacuguuguggcu

SEQ ID NO: 105199 - RNA, 22 nt, Human
gaaaaacucagugggggucuuu

SEQ ID NO: 105200 - RNA, 22 nt, Human
gaaaaagucuuaaaguaaggca

SEQ ID NO: 105201 - RNA, 20 nt, Human
gacuucaauuucuaucuuuu

SEQ ID NO: 105202 - RNA, 22 nt, Human
gaaaagaaaggaugguaugugu

SEQ ID NO: 105203 - RNA, 22 nt, Human
gaaaaggaggggaggcagaugg

SEQ ID NO: 105204 - RNA, 22 nt, Human
gaaacguuguggaaaauccucu

SEQ ID NO: 105205 - RNA, 22 nt, Human
gaaagcauucuggaggggcaga

SEQ ID NO: 105206 - RNA, 22 nt, Human
gagaaguaggaauaucaggagu

SEQ ID NO: 105207 - RNA, 22 nt, Human
gaaaaguauuaugugaggguuc

SEQ ID NO: 105208 - RNA, 22 nt, Human
gacuugaagcucucugguuuug

SEQ ID NO: 105209 - RNA, 22 nt, Human
gagaagguggaccugaaggagc

SEQ ID NO: 105210 - RNA, 22 nt, Human
gagaaugagucagagcuggcug

SEQ ID NO: 105211 - RNA, 22 nt, Human
gaaagugaauguaacauguuau

SEQ ID NO: 105212 - RNA, 22 nt, Human
gaaaucuggugauuuucuguug

SEQ ID NO: 105213 - RNA, 22 nt, Human
gaaauaggcccuuacauggaaa

SEQ ID NO: 105214 - RNA, 22 nt, Human
gaaauagagacaguaagugucu

SEQ ID NO: 105215 - RNA, 22 nt, Human
gaaauguacuuauagggagguu

SEQ ID NO: 105216 - RNA, 22 nt, Human
gaacaaaagauagcccaaacau

SEQ ID NO: 105217 - RNA, 22 nt, Human
gaacaguuucccuguagaaaau

SEQ ID NO: 105218 - RNA, 22 nt, Human
gagauuugaguuccuacugagu

SEQ ID NO: 105219 - RNA, 20 nt, Human
gaacauaaauaacucuuuac

SEQ ID NO: 105220 - RNA, 22 nt, Human
gaaccauuuaauggagaugcuc

SEQ ID NO: 105221 - RNA, 22 nt, Human
gaacucuugguggucauuagau

SEQ ID NO: 105222 - RNA, 22 nt, Human
gagcagacugcacaguucuugc

SEQ ID NO: 105223 - RNA, 22 nt, Human
gagcagcacagaccaaacagaa

SEQ ID NO: 105224 - RNA, 22 nt, Human
gaacaugaguuuuaugguauuu

SEQ ID NO: 105225 - RNA, 22 nt, Human
gaagaugacaucggaucugucu

SEQ ID NO: 105226 - RNA, 22 nt, Human
gaacuuuaauuagcuuuugucu

SEQ ID NO: 105227 - RNA, 22 nt, Human
gaagaagagauaauggggagca

SEQ ID NO: 105228 - RNA, 22 nt, Human
cugauuucaaauggugcuagau

SEQ ID NO: 105229 - RNA, 22 nt, Human
cuucauuacagcaaccauuuga

SEQ ID NO: 105230 - RNA, 22 nt, Human
cuucauuucaggcugaagaaua

SEQ ID NO: 105231 - RNA, 22 nt, Human
cuucaugucacugucuuaggua

SEQ ID NO: 105232 - RNA, 20 nt, Human
cugauguucgugcuuccugg

SEQ ID NO: 105233 - RNA, 22 nt, Human
cuucaguuaguuucaugugagc

SEQ ID NO: 105234 - RNA, 22 nt, Human
cuucauccguaccacggccaca

SEQ ID NO: 105235 - RNA, 22 nt, Human
cuuccuaaucuuggguuauuuu

SEQ ID NO: 105236 - RNA, 22 nt, Human
cuucuagucaaaauggauaagc

SEQ ID NO: 105237 - RNA, 22 nt, Human
cuucucuuccuucucauccuca

SEQ ID NO: 105238 - RNA, 22 nt, Human
cuucuggaggcugcagaaaaga

SEQ ID NO: 105239 - RNA, 22 nt, Human
cuucucuugugauguuagcgga

SEQ ID NO: 105240 - RNA, 22 nt, Human
cuucuggaggcucuagaggaga

SEQ ID NO: 105241 - RNA, 22 nt, Human
cuucuuaaaguugucacagcug

SEQ ID NO: 105242 - RNA, 22 nt, Human
cuucuuagugauuuaacaugua

SEQ ID NO: 105243 - RNA, 22 nt, Human
cuucuuuuggggaugaaaaugg

SEQ ID NO: 105244 - RNA, 22 nt, Human
cuugagcugaguuugcagcucu

SEQ ID NO: 105245 - RNA, 22 nt, Human
cuucuuuucuacuggccuagaa

SEQ ID NO: 105246 - RNA, 22 nt, Human
cuucuugucagugauuucuucc

SEQ ID NO: 105247 - RNA, 22 nt, Human
cugcccauggcuccuggcugug

SEQ ID NO: 105248 - RNA, 22 nt, Human
cuugccuuugaaagcauuucuc

SEQ ID NO: 105249 - RNA, 22 nt, Human
cuugauucauuuaagguuggag

SEQ ID NO: 105250 - RNA, 22 nt, Human
cuggaaagauuuacacggggaa

SEQ ID NO: 105251 - RNA, 22 nt, Human
cuugugggaucuggagacaccg

SEQ ID NO: 105252 - RNA, 22 nt, Human
cuggaaaaauggauccugucuu

SEQ ID NO: 105253 - RNA, 22 nt, Human
cuuguuuggccauaggugcugg

SEQ ID NO: 105254 - RNA, 22 nt, Human
cuuguuaacaauugguaucuuu

SEQ ID NO: 105255 - RNA, 22 nt, Human
cuuucauuuuugggcaucugag

SEQ ID NO: 105256 - RNA, 22 nt, Human
cuuuaaaaauguauuuuugugg

SEQ ID NO: 105257 - RNA, 22 nt, Human
cuuuccugaaaucucuucugca

SEQ ID NO: 105258 - RNA, 22 nt, Human
cuuuagugaguguggagcuaga

SEQ ID NO: 105259 - RNA, 22 nt, Human
cuuucuuuuugguuucccccca

SEQ ID NO: 105260 - RNA, 22 nt, Human
cuugucuaguuccuggugaugu

SEQ ID NO: 105261 - RNA, 22 nt, Human
cuugggguuugggggcuugacc

SEQ ID NO: 105262 - RNA, 22 nt, Human
cugcugugcagacagacucucu

SEQ ID NO: 105263 - RNA, 22 nt, Human
cugcuggugcugcccacacggu

SEQ ID NO: 105264 - RNA, 23 nt, Human
cuuggcuagccacuuccacgcuc

SEQ ID NO: 105265 - RNA, 22 nt, Human
cuuggcuccuucacagggagau

SEQ ID NO: 105266 - RNA, 22 nt, Human
cugcguugaccagacuccuggg

SEQ ID NO: 105267 - RNA, 22 nt, Human
cugcgguucuguuuaguggcga

SEQ ID NO: 105268 - RNA, 22 nt, Human
cuuggcauguucaucugcuugg

SEQ ID NO: 105269 - RNA, 22 nt, Human
cuuggcacauuuuguucuucug

SEQ ID NO: 105270 - RNA, 22 nt, Human
cuugcuuuaucugguuucucau

SEQ ID NO: 105271 - RNA, 22 nt, Human
cuugcugggagagcuuuagaga

SEQ ID NO: 105272 - RNA, 22 nt, Human
cucucuaacuagagacaggagu

SEQ ID NO: 105273 - RNA, 22 nt, Human
cucucuguuaugcuuucaugaa

SEQ ID NO: 105274 - RNA, 22 nt, Human
cuguacuuguuuuaggaugaug

SEQ ID NO: 105275 - RNA, 22 nt, Human
cuguauggaggaggugcuagcc

SEQ ID NO: 105276 - RNA, 22 nt, Human
cucugguuucgcaggaaauaga

SEQ ID NO: 105277 - RNA, 22 nt, Human
cuguggcuaggaagcuguggga

SEQ ID NO: 105278 - RNA, 22 nt, Human
cucuuuguauucuagaagcucu

SEQ ID NO: 105279 - RNA, 22 nt, Human
cucuuuucaaaccuguuuaugg

SEQ ID NO: 105280 - RNA, 22 nt, Human
cucuuuuuccuaugaaaucuau

SEQ ID NO: 105281 - RNA, 22 nt, Human
cugugcauaugucuugaggucu

SEQ ID NO: 105282 - RNA, 22 nt, Human
cugagaaauacccaagucuggu

SEQ ID NO: 105283 - RNA, 20 nt, Human
cuuaugcaaaauguuaggga

SEQ ID NO: 105284 - RNA, 22 nt, Human
cugagcuauauauuaugcauag

SEQ ID NO: 105285 - RNA, 22 nt, Human
cuucaacuucuguuuuaaggaa

SEQ ID NO: 105286 - RNA, 22 nt, Human
cuucacugcagucauggcucug

SEQ ID NO: 105287 - RNA, 22 nt, Human
cugauaauaaccauuuuaaaau

SEQ ID NO: 105288 - RNA, 22 nt, Human
cugaguuuuucaaaucugaauu

SEQ ID NO: 105289 - RNA, 22 nt, Human
cuguguuaggaucuugcuggca

SEQ ID NO: 105290 - RNA, 22 nt, Human
cugugugugcacacguguaugg

SEQ ID NO: 105291 - RNA, 22 nt, Human
cuguguguauaauguuugauaa

SEQ ID NO: 105292 - RNA, 22 nt, Human
cugaaggcuuugaauggaauga

SEQ ID NO: 105293 - RNA, 22 nt, Human
cugacagaucuggaucugaacu

SEQ ID NO: 105294 - RNA, 22 nt, Human
cucccaauaauaacaagcaggu

SEQ ID NO: 105295 - RNA, 22 nt, Human
cuggcuuucauggcgcaguuga

SEQ ID NO: 105296 - RNA, 22 nt, Human
cuccuuuuccuacucauacuau

SEQ ID NO: 105297 - RNA, 22 nt, Human
cucauguucuaagcuuucuuca

SEQ ID NO: 105298 - RNA, 22 nt, Human
cuggauuaaacaguuugauacu

SEQ ID NO: 105299 - RNA, 22 nt, Human
cuggaugagcuucgugcgcacg

SEQ ID NO: 105300 - RNA, 22 nt, Human
cuggagaagagguaguauguag

SEQ ID NO: 105301 - RNA, 22 nt, Human
cuggaauugcuugagcuaggaa

SEQ ID NO: 105302 - RNA, 22 nt, Human
cuggaaauggcagaguugcauu

SEQ ID NO: 105303 - RNA, 20 nt, Human
cagagccaggguuuuguuuu

SEQ ID NO: 105304 - RNA, 22 nt, Human
cagagaugaggcuggcgugguu

SEQ ID NO: 105305 - RNA, 22 nt, Human
caaucuucucuagaguauucua

SEQ ID NO: 105306 - RNA, 22 nt, Human
caaugaaaauuuaaguugcagc

SEQ ID NO: 105307 - RNA, 22 nt, Human
caauugcuuccuucuguaagua

SEQ ID NO: 105308 - RNA, 22 nt, Human
caauuuggaaagcaugcccccc

SEQ ID NO: 105309 - RNA, 22 nt, Human
cacaacaaaaaauaaguaugag

SEQ ID NO: 105310 - RNA, 22 nt, Human
cacaauuuccauugagcagcag

SEQ ID NO: 105311 - RNA, 22 nt, Human
cacacacacacacacucucaca

SEQ ID NO: 105312 - RNA, 22 nt, Human
cacuuuuucccccuggugucau

SEQ ID NO: 105313 - RNA, 22 nt, Human
cagaaaaaaaugcagacuagca

SEQ ID NO: 105314 - RNA, 22 nt, Human
cagauuuaauaaaaaaugcauc

SEQ ID NO: 105315 - RNA, 19 nt, Human
cagcaaacacuguaaaugg

SEQ ID NO: 105316 - RNA, 22 nt, Human
cagauggaguuaguuucuaaca

SEQ ID NO: 105317 - RNA, 22 nt, Human
cacuuguuaaaugccaauggca

SEQ ID NO: 105318 - RNA, 22 nt, Human
cagauacaacagcaggaaugaa

SEQ ID NO: 105319 - RNA, 22 nt, Human
cagauaagcuauaaguaguacc

SEQ ID NO: 105320 - RNA, 22 nt, Human
cagaguaaugugauuuccaugu

SEQ ID NO: 105321 - RNA, 22 nt, Human
cagagggagcuaaccagcagcc

SEQ ID NO: 105322 - RNA, 22 nt, Human
cagaucacauccauccgucacc

SEQ ID NO: 105323 - RNA, 22 nt, Human
cagauagccugguccuaacaug

SEQ ID NO: 105324 - RNA, 22 nt, Human
cagcccaggcucagauguuggg

SEQ ID NO: 105325 - RNA, 23 nt, Human
cagagaaaauagaauaugcugug

SEQ ID NO: 105326 - RNA, 22 nt, Human
cagacugagaaagugccacagg

SEQ ID NO: 105327 - RNA, 22 nt, Human
cagacagagcucacaagucuuu

SEQ ID NO: 105328 - RNA, 22 nt, Human
cagcauggagacaaagugggca

SEQ ID NO: 105329 - RNA, 22 nt, Human
cagaaacacuguauuuagggaa

SEQ ID NO: 105330 - RNA, 22 nt, Human
cagaaaacauuguguguauaag

SEQ ID NO: 105331 - RNA, 22 nt, Human
cagauuuagcacugauaggacu

SEQ ID NO: 105332 - RNA, 22 nt, Human
cagaaagaaguggggauagagg

SEQ ID NO: 105333 - RNA, 22 nt, Human
cagcacuuccuccgugagcccc

SEQ ID NO: 105334 - RNA, 22 nt, Human
cagcagaugacuauuggagcug

SEQ ID NO: 105335 - RNA, 22 nt, Human
cagauggagaaagagugaaugg

SEQ ID NO: 105336 - RNA, 22 nt, Human
cagauguuugaaugcuuaccac

SEQ ID NO: 105337 - RNA, 20 nt, Human
cagaucuuauguuuuucugu

SEQ ID NO: 105338 - RNA, 22 nt, Human
cagccagaucgccuuccgccuc

SEQ ID NO: 105339 - RNA, 22 nt, Human
cagcuuuugcagacuucuugcc

SEQ ID NO: 105340 - RNA, 22 nt, Human
cagcccaucaaggggauccuga

SEQ ID NO: 105341 - RNA, 22 nt, Human
cagccuuuucuuaaaaugcaag

SEQ ID NO: 105342 - RNA, 22 nt, Human
caggaagagaacugcucagccu

SEQ ID NO: 105343 - RNA, 22 nt, Human
caggaaaauaauggugauggga

SEQ ID NO: 105344 - RNA, 22 nt, Human
cagggcuugaaucaaggaaguc

SEQ ID NO: 105345 - RNA, 22 nt, Human
caggggaagccagcugccaugu

SEQ ID NO: 105346 - RNA, 22 nt, Human
cagggcuuuuuccuccucuuug

SEQ ID NO: 105347 - RNA, 22 nt, Human
cagugcaacguugugcauucaa

SEQ ID NO: 105348 - RNA, 22 nt, Human
cagucucuggugaguugacagu

SEQ ID NO: 105349 - RNA, 22 nt, Human
cagucaaauuugaaaacuuuga

SEQ ID NO: 105350 - RNA, 22 nt, Human
caucuuuguuuuggauauaauc

SEQ ID NO: 105351 - RNA, 22 nt, Human
caucuccaagucuguaagcagu

SEQ ID NO: 105352 - RNA, 22 nt, Human
caugaagugaaaagguuaauuu

SEQ ID NO: 105353 - RNA, 22 nt, Human
caugaauaauucuuuuucuugg

SEQ ID NO: 105354 - RNA, 22 nt, Human
caguucaagauuguugcuuucu

SEQ ID NO: 105355 - RNA, 22 nt, Human
caguggggaggccaggauagaa

SEQ ID NO: 105356 - RNA, 22 nt, Human
caugauguuaucaagcacaaag

SEQ ID NO: 105357 - RNA, 22 nt, Human
caguuaaugauaggaauucggu

SEQ ID NO: 105358 - RNA, 21 nt, Human
caguucuaagugucaucuuuu

SEQ ID NO: 105359 - RNA, 22 nt, Human
caugaugacagcauuccuuuua

SEQ ID NO: 105360 - RNA, 22 nt, Human
cauaagaauauuuaguggcagc

SEQ ID NO: 105361 - RNA, 22 nt, Human
caguuuuucaaaauuacaugau

SEQ ID NO: 105362 - RNA, 22 nt, Human
caguuuuggaagaaacaaggaa

SEQ ID NO: 105363 - RNA, 22 nt, Human
caguuuuauacacugcagcucc

SEQ ID NO: 105364 - RNA, 22 nt, Human
caguugcagagugauguguuug

SEQ ID NO: 105365 - RNA, 22 nt, Human
caguuuccagacauuauugaua

SEQ ID NO: 105366 - RNA, 22 nt, Human
cauaacuugguguuggaaacug

SEQ ID NO: 105367 - RNA, 22 nt, Human
cauaauuggugcuuauuaaaug

SEQ ID NO: 105368 - RNA, 22 nt, Human
cauaccuugguaagagugauca

SEQ ID NO: 105369 - RNA, 22 nt, Human
cauaguuuguucuuuuuuauug

SEQ ID NO: 105370 - RNA, 22 nt, Human
caugggaaauauaagaauuuuc

SEQ ID NO: 105371 - RNA, 23 nt, Human
cauauucagaaacaccuaguggu

SEQ ID NO: 105372 - RNA, 22 nt, Human
caguaaccaguaguuuuggaaa

SEQ ID NO: 105373 - RNA, 22 nt, Human
caguagcuuuuugcagacaaga

SEQ ID NO: 105374 - RNA, 22 nt, Human
cauccagagcugccugaccccg

SEQ ID NO: 105375 - RNA, 22 nt, Human
caucccaacaggugaucuggua

SEQ ID NO: 105376 - RNA, 22 nt, Human
cagggcagaguuaagaugcugg

SEQ ID NO: 105377 - RNA, 22 nt, Human
caguccaugaugacuuuugcuc

SEQ ID NO: 105378 - RNA, 22 nt, Human
caggcagagagggcagugugga

SEQ ID NO: 105379 - RNA, 22 nt, Human
caguauguuuauuagaacugca

SEQ ID NO: 105380 - RNA, 21 nt, Human
caggccaaaagguucaacauu

SEQ ID NO: 105381 - RNA, 22 nt, Human
caguaguucucauaacucauga

SEQ ID NO: 105382 - RNA, 22 nt, Human
caguaucucuaaaauuacucuu

SEQ ID NO: 105383 - RNA, 22 nt, Human
cagguauuugaaggcaguggga

SEQ ID NO: 105384 - RNA, 22 nt, Human
auuuaaaaacugguacaacagg

SEQ ID NO: 105385 - RNA, 22 nt, Human
auuuggggacagagugggggua

SEQ ID NO: 105386 - RNA, 23 nt, Human
auuuccuaaaagauaaucauuac

SEQ ID NO: 105387 - RNA, 22 nt, Human
auuucuguaauucugaggagug

SEQ ID NO: 105388 - RNA, 22 nt, Human
auuugaaaaucuaugaugugca

SEQ ID NO: 105389 - RNA, 22 nt, Human
auuuaaaggaagugggugauaa

SEQ ID NO: 105390 - RNA, 22 nt, Human
auuucaacagaguuugaaggca

SEQ ID NO: 105391 - RNA, 22 nt, Human
auuucagaaugaaaggaaaaau

SEQ ID NO: 105392 - RNA, 19 nt, Human
auuuccuggcauauaucac

SEQ ID NO: 105393 - RNA, 17 nt, Human
auuguuuuuaauuugca

SEQ ID NO: 105394 - RNA, 22 nt, Human
auuucaguuugcaguuucucuc

SEQ ID NO: 105395 - RNA, 22 nt, Human
auuucauaaaaacuuuaccuga

SEQ ID NO: 105396 - RNA, 22 nt, Human
auuucauccauuaagaguacuc

SEQ ID NO: 105397 - RNA, 22 nt, Human
auuucauuuuagaaauaagugu

SEQ ID NO: 105398 - RNA, 22 nt, Human
auuuccacaaauuaagauugca

SEQ ID NO: 105399 - RNA, 22 nt, Human
auuucacucuuaauugcuuccu

SEQ ID NO: 105400 - RNA, 22 nt, Human
auuuauuuucccucaaguaccu

SEQ ID NO: 105401 - RNA, 22 nt, Human
auuuauuugaagagccauugca

SEQ ID NO: 105402 - RNA, 22 nt, Human
auuuaucugcucuucgcguuga

SEQ ID NO: 105403 - RNA, 22 nt, Human
auuucagcagcccauguuugga

SEQ ID NO: 105404 - RNA, 22 nt, Human
auuucagaguagaucguuauuu

SEQ ID NO: 105405 - RNA, 22 nt, Human
auuuaaagaguaauacaaucca

SEQ ID NO: 105406 - RNA, 22 nt, Human
auuuauccuugggguagagcca

SEQ ID NO: 105407 - RNA, 22 nt, Human
auuuaggacagugucugaauug

SEQ ID NO: 105408 - RNA, 22 nt, Human
auuuagagaaguagcaaggucc

SEQ ID NO: 105409 - RNA, 22 nt, Human
auuacagaagauaugcucaaca

SEQ ID NO: 105410 - RNA, 22 nt, Human
auuaauguguaugauauaaauu

SEQ ID NO: 105411 - RNA, 22 nt, Human
auuagaagagcuuuuuacucuu

SEQ ID NO: 105412 - RNA, 22 nt, Human
auuagcaccccuggauguggga

SEQ ID NO: 105413 - RNA, 22 nt, Human
auuacagauuauaaauuugagc

SEQ ID NO: 105414 - RNA, 22 nt, Human
auuagugguguauuuggcacua

SEQ ID NO: 105415 - RNA, 22 nt, Human
auugugaaugccugucagucuu

SEQ ID NO: 105416 - RNA, 22 nt, Human
auuguuacuggguuaauuugga

SEQ ID NO: 105417 - RNA, 22 nt, Human
auuguagucuggacuuuuggga

SEQ ID NO: 105418 - RNA, 21 nt, Human
auuuguggugcaauuguggua

SEQ ID NO: 105419 - RNA, 22 nt, Human
auuuaagacuguggugcaguuu

SEQ ID NO: 105420 - RNA, 23 nt, Human
auuugcugaucguagaugacuag

SEQ ID NO: 105421 - RNA, 22 nt, Human
auuuccagcagcauauuugucu

SEQ ID NO: 105422 - RNA, 22 nt, Human
auuuuuaucuaaaauccacuuu

SEQ ID NO: 105423 - RNA, 22 nt, Human
auuugcaucagugagcgaugug

SEQ ID NO: 105424 - RNA, 22 nt, Human
auuugcauguuuauuucuuaga

SEQ ID NO: 105425 - RNA, 22 nt, Human
auuuuugugcuuuauuggggua

SEQ ID NO: 105426 - RNA, 22 nt, Human
auuuucuugucucuguuguagg

SEQ ID NO: 105427 - RNA, 22 nt, Human
auuuucuucauuuugauuguau

SEQ ID NO: 105428 - RNA, 22 nt, Human
auuuuugguuauaaaauaguuu

SEQ ID NO: 105429 - RNA, 18 nt, Human
auuuguggggguuauaga

SEQ ID NO: 105430 - RNA, 22 nt, Human
auuuuucuuucacauuuucuua

SEQ ID NO: 105431 - RNA, 21 nt, Human
auuuggucaaugucugcguga

SEQ ID NO: 105432 - RNA, 22 nt, Human
auuuggaaggcguuucucugua

SEQ ID NO: 105433 - RNA, 22 nt, Human
auuuggaaacaugcugaccaug

SEQ ID NO: 105434 - RNA, 22 nt, Human
caaagaugccaaaaggaagaca

SEQ ID NO: 105435 - RNA, 22 nt, Human
caaagagaugcaccauauuucu

SEQ ID NO: 105436 - RNA, 22 nt, Human
caaagaaccuucgagacagggc

SEQ ID NO: 105437 - RNA, 22 nt, Human
caaagaagagauuuacagagcu

SEQ ID NO: 105438 - RNA, 22 nt, Human
auuuuggguguuaacaaugaaa

SEQ ID NO: 105439 - RNA, 22 nt, Human
auuuugcuuuucuaguggguuu

SEQ ID NO: 105440 - RNA, 22 nt, Human
auuuuuuuggucauaugagaua

SEQ ID NO: 105441 - RNA, 22 nt, Human
auuuuucucucaugugcaacua

SEQ ID NO: 105442 - RNA, 22 nt, Human
auuuuucacauuuugggggaca

SEQ ID NO: 105443 - RNA, 22 nt, Human
caaccaguagcugaguucaaaa

SEQ ID NO: 105444 - RNA, 22 nt, Human
auuuuuuuaggcugucagccgc

SEQ ID NO: 105445 - RNA, 22 nt, Human
cacagaauuaagggagaaauau

SEQ ID NO: 105446 - RNA, 22 nt, Human
caaggaaaacagaugaucaaca

SEQ ID NO: 105447 - RNA, 22 nt, Human
cacauuaagcccaagcauagaa

SEQ ID NO: 105448 - RNA, 22 nt, Human
caagaugcaagaccagucaggc

SEQ ID NO: 105449 - RNA, 22 nt, Human
cacagcuggggaagcugaggcc

SEQ ID NO: 105450 - RNA, 22 nt, Human
cacauaguuuaucuucauuuuc

SEQ ID NO: 105451 - RNA, 22 nt, Human
caaggggagcugguauggaugg

SEQ ID NO: 105452 - RNA, 22 nt, Human
cacauuuuccagaagaaucaga

SEQ ID NO: 105453 - RNA, 22 nt, Human
cacauuguuuggucagagcaua

SEQ ID NO: 105454 - RNA, 22 nt, Human
caccacauguccgaaauucagc

SEQ ID NO: 105455 - RNA, 22 nt, Human
caccaaaauaucccuuuguaca

SEQ ID NO: 105456 - RNA, 22 nt, Human
caagguauugaggccagugucc

SEQ ID NO: 105457 - RNA, 22 nt, Human
caauaguaaucaaugcaguuag

SEQ ID NO: 105458 - RNA, 22 nt, Human
caagugaguauguauuguguag

SEQ ID NO: 105459 - RNA, 22 nt, Human
caagucucuagaaugcaauagu

SEQ ID NO: 105460 - RNA, 22 nt, Human
caccugcaaauuccagauuucu

SEQ ID NO: 105461 - RNA, 22 nt, Human
caaaucagaucagagacaggcu

SEQ ID NO: 105462 - RNA, 22 nt, Human
caaaucuguuaauuucaaguug

SEQ ID NO: 105463 - RNA, 22 nt, Human
caauggguuuucuauagagugc

SEQ ID NO: 105464 - RNA, 22 nt, Human
caaaugaugcauggcuagugag

SEQ ID NO: 105465 - RNA, 22 nt, Human
caauguuuuuccuuccuuaaua

SEQ ID NO: 105466 - RNA, 22 nt, Human
caauagcuauguaaccugaaga

SEQ ID NO: 105467 - RNA, 22 nt, Human
caaaguauuuagcugacucgcu

SEQ ID NO: 105468 - RNA, 22 nt, Human
caaauacaaauacgggcagcuu

SEQ ID NO: 105469 - RNA, 22 nt, Human
caaauacguuuggcuggagcac

SEQ ID NO: 105470 - RNA, 22 nt, Human
cacaagacuaaguggcagagca

SEQ ID NO: 105471 - RNA, 22 nt, Human
caacaaguugauuucacgcugc

SEQ ID NO: 105472 - RNA, 22 nt, Human
caacaagcgcucagagcaaagc

SEQ ID NO: 105473 - RNA, 22 nt, Human
cacaaagugucaggggagagaa

SEQ ID NO: 105474 - RNA, 22 nt, Human
caacacaucaguucagucuuga

SEQ ID NO: 105475 - RNA, 22 nt, Human
caacauuucaaggucuuuagga

SEQ ID NO: 105476 - RNA, 22 nt, Human
cacaaggagaaauagauauuga

SEQ ID NO: 105477 - RNA, 22 nt, Human
cacacagcuagugacaggagaa

SEQ ID NO: 105478 - RNA, 22 nt, Human
caacuucuauucagucugcagu

SEQ ID NO: 105479 - RNA, 22 nt, Human
caagcacaauuucuacauguua

SEQ ID NO: 105480 - RNA, 22 nt, Human
caaggaaaugucagaaaggcaa

SEQ ID NO: 105481 - RNA, 22 nt, Human
caagaaaaaacaugaugagugu

SEQ ID NO: 105482 - RNA, 22 nt, Human
caaaacauucagagagcucacu

SEQ ID NO: 105483 - RNA, 22 nt, Human
caagaaguugacagccagguga

SEQ ID NO: 105484 - RNA, 22 nt, Human
caagauauguccuguuacuaag

SEQ ID NO: 105485 - RNA, 22 nt, Human
caaagccuggggagaguaagga

SEQ ID NO: 105486 - RNA, 22 nt, Human
caauaauugcuuuccagaguua

SEQ ID NO: 105487 - RNA, 22 nt, Human
caaguugcaugugcuugaaaua

SEQ ID NO: 105488 - RNA, 22 nt, Human
caaaguaggcuaagaccuucca

SEQ ID NO: 105489 - RNA, 22 nt, Human
caaaggauguguagugcaacca

SEQ ID NO: 105490 - RNA, 22 nt, Human
caaggaagguugguugaaggua

SEQ ID NO: 105491 - RNA, 22 nt, Human
caaggcuaagcuuuggcuuucu

SEQ ID NO: 105492 - RNA, 22 nt, Human
caagggcagaggcagggccccg

SEQ ID NO: 105493 - RNA, 22 nt, Human
caagguugugacccaaugacca

SEQ ID NO: 105494 - RNA, 22 nt, Human
caagguuucgaguucccaacca

SEQ ID NO: 105495 - RNA, 22 nt, Human
caaguaugagaaagcuauuacc

SEQ ID NO: 105496 - RNA, 22 nt, Human
caaguauuuauugaggcccugu

SEQ ID NO: 105497 - RNA, 22 nt, Human
augugaaauuugggcucuggga

SEQ ID NO: 105498 - RNA, 22 nt, Human
augguugccugagauaagacug

SEQ ID NO: 105499 - RNA, 22 nt, Human
augguugggggaugucagcagg

SEQ ID NO: 105500 - RNA, 22 nt, Human
auguauguauguauauacacac

SEQ ID NO: 105501 - RNA, 22 nt, Human
auguaugagagauucuuuuauu

SEQ ID NO: 105502 - RNA, 22 nt, Human
auguauauauacauguauugua

SEQ ID NO: 105503 - RNA, 22 nt, Human
auggugaaaugauuugauguca

SEQ ID NO: 105504 - RNA, 22 nt, Human
auguaaauauuuauauaugcau

SEQ ID NO: 105505 - RNA, 22 nt, Human
augguuuugugaaaaugcuuug

SEQ ID NO: 105506 - RNA, 22 nt, Human
augguuuuguccucuuugguuc

SEQ ID NO: 105507 - RNA, 20 nt, Human
auggcgagucagcacaaaac

SEQ ID NO: 105508 - RNA, 19 nt, Human
augggaagcggccagcgga

SEQ ID NO: 105509 - RNA, 22 nt, Human
auggcuucugucuuggaaauuu

SEQ ID NO: 105510 - RNA, 22 nt, Human
auggcuguguuguuccucugaa

SEQ ID NO: 105511 - RNA, 22 nt, Human
auguuagcaucuggcacuaugg

SEQ ID NO: 105512 - RNA, 22 nt, Human
auguguuuccaacagagaggga

SEQ ID NO: 105513 - RNA, 22 nt, Human
augugggugaggaggccauugu

SEQ ID NO: 105514 - RNA, 22 nt, Human
augugaacuccagcugccaacc

SEQ ID NO: 105515 - RNA, 22 nt, Human
augugauacuccuucuagugga

SEQ ID NO: 105516 - RNA, 22 nt, Human
augugaaagagguguucagugg

SEQ ID NO: 105517 - RNA, 22 nt, Human
auguauuuauguauguguuaua

SEQ ID NO: 105518 - RNA, 22 nt, Human
auucauucugaccucaagagaa

SEQ ID NO: 105519 - RNA, 22 nt, Human
auucaguucuaaggucagugcc

SEQ ID NO: 105520 - RNA, 19 nt, Human
auucaagugcuuagagauc

SEQ ID NO: 105521 - RNA, 22 nt, Human
auuaagucugacuggauuguau

SEQ ID NO: 105522 - RNA, 22 nt, Human
auucaagauagaaggauuuuca

SEQ ID NO: 105523 - RNA, 21 nt, Human
auucaaagaagaggaaggccc

SEQ ID NO: 105524 - RNA, 22 nt, Human
auuaaagcaugaauaauaugua

SEQ ID NO: 105525 - RNA, 22 nt, Human
auuaaacuaaauuaugaauugg

SEQ ID NO: 105526 - RNA, 22 nt, Human
auuaaauagcagaagaaagaug

SEQ ID NO: 105527 - RNA, 22 nt, Human
auuaaagcuaguugagauuuaa

SEQ ID NO: 105528 - RNA, 22 nt, Human
auuaugcagcugccuccaaggu

SEQ ID NO: 105529 - RNA, 22 nt, Human
auuaugugagggacuuaaucau

SEQ ID NO: 105530 - RNA, 23 nt, Human
auuauuucaggguuuugacuugc

SEQ ID NO: 105531 - RNA, 20 nt, Human
auuauuucuucugcccaaag

SEQ ID NO: 105532 - RNA, 22 nt, Human
auuauuugcuuaagcuggucuc

SEQ ID NO: 105533 - RNA, 22 nt, Human
auuagaaaugacaugugggaau

SEQ ID NO: 105534 - RNA, 22 nt, Human
auuacugaggcaaaguaguuuu

SEQ ID NO: 105535 - RNA, 22 nt, Human
auuaauaucaauauauuauaug

SEQ ID NO: 105536 - RNA, 22 nt, Human
auuaaguuauuaagcuaaauau

SEQ ID NO: 105537 - RNA, 20 nt, Human
auuaauuuuuagggcucacc

SEQ ID NO: 105538 - RNA, 22 nt, Human
auuaagacugcccauguuuuua

SEQ ID NO: 105539 - RNA, 22 nt, Human
auguuccaugacuaugcaugaa

SEQ ID NO: 105540 - RNA, 22 nt, Human
auguuuuauacacauguaucac

SEQ ID NO: 105541 - RNA, 22 nt, Human
auguuuucauuuagaagcuaau

SEQ ID NO: 105542 - RNA, 22 nt, Human
auuauaauucauuaggcuuagu

SEQ ID NO: 105543 - RNA, 22 nt, Human
auuagguaguauaaucuuuguu

SEQ ID NO: 105544 - RNA, 22 nt, Human
auuauacauuaggagauugauu

SEQ ID NO: 105545 - RNA, 21 nt, Human
auuauagugacuaaauugaua

SEQ ID NO: 105546 - RNA, 22 nt, Human
auguuuuuugaaaauguauuuu

SEQ ID NO: 105547 - RNA, 22 nt, Human
auuaucuauccgccaacaguaa

SEQ ID NO: 105548 - RNA, 22 nt, Human
augauggagaacaaagaaaauc

SEQ ID NO: 105549 - RNA, 22 nt, Human
augaucaagaauuuuguauucc

SEQ ID NO: 105550 - RNA, 22 nt, Human
augcagagacugugggaaagca

SEQ ID NO: 105551 - RNA, 22 nt, Human
augcacaagguagauuauuauu

SEQ ID NO: 105552 - RNA, 19 nt, Human
augcaauguuaucaauaac

SEQ ID NO: 105553 - RNA, 22 nt, Human
augcacuugacucuauuccaca

SEQ ID NO: 105554 - RNA, 22 nt, Human
augcuagaaaauuucauauuau

SEQ ID NO: 105555 - RNA, 22 nt, Human
augcagcggucagaggaacuca

SEQ ID NO: 105556 - RNA, 22 nt, Human
augcagauguagauucugaaau

SEQ ID NO: 105557 - RNA, 22 nt, Human
augcuaaucaaacuuucugcag

SEQ ID NO: 105558 - RNA, 22 nt, Human
augcuacuugugaaaacccagg

SEQ ID NO: 105559 - RNA, 22 nt, Human
augcaguuagguaauagucuca

SEQ ID NO: 105560 - RNA, 22 nt, Human
augccugcugucaggaacucuu

SEQ ID NO: 105561 - RNA, 22 nt, Human
augcuugcccauguuucugaag

SEQ ID NO: 105562 - RNA, 22 nt, Human
augcggcugugggggaauggga

SEQ ID NO: 105563 - RNA, 22 nt, Human
augcucuuaauugcuagauaag

SEQ ID NO: 105564 - RNA, 22 nt, Human
augcuuuauuggagacagucau

SEQ ID NO: 105565 - RNA, 22 nt, Human
augcugugccuggaaagcggcu

SEQ ID NO: 105566 - RNA, 22 nt, Human
augcuugaaaguuauuucauuu

SEQ ID NO: 105567 - RNA, 22 nt, Human
auggccuguuuccucugaaaga

SEQ ID NO: 105568 - RNA, 23 nt, Human
augaacgcacugagaucauaauu

SEQ ID NO: 105569 - RNA, 22 nt, Human
aucuggaacuucucugcauuga

SEQ ID NO: 105570 - RNA, 22 nt, Human
augaaacuggagcgccuggagg

SEQ ID NO: 105571 - RNA, 22 nt, Human
augaaaacgugugugugugugu

SEQ ID NO: 105572 - RNA, 22 nt, Human
augaaacucuagcuuucagcac

SEQ ID NO: 105573 - RNA, 22 nt, Human
aucuauguaucucagaagcuag

SEQ ID NO: 105574 - RNA, 22 nt, Human
aucuaggguuuagggaccauuu

SEQ ID NO: 105575 - RNA, 22 nt, Human
aucuucaaggacgccaagaucc

SEQ ID NO: 105576 - RNA, 20 nt, Human
aucugguggggaauaacuuc

SEQ ID NO: 105577 - RNA, 22 nt, Human
augagaaauaauuguguacuga

SEQ ID NO: 105578 - RNA, 22 nt, Human
aucuucuauguguaggcauuuu

SEQ ID NO: 105579 - RNA, 22 nt, Human
augauucuaccaaugccaucuu

SEQ ID NO: 105580 - RNA, 19 nt, Human
augagccccaguucguucc

SEQ ID NO: 105581 - RNA, 22 nt, Human
augacugaugcugacucauggg

SEQ ID NO: 105582 - RNA, 22 nt, Human
augcagaaucucuuuccugagg

SEQ ID NO: 105583 - RNA, 22 nt, Human
augcacuaugaugagcuagucu

SEQ ID NO: 105584 - RNA, 22 nt, Human
augauaucuuguuuuucaugca

SEQ ID NO: 105585 - RNA, 22 nt, Human
augaggaacagcaagaauauuu

SEQ ID NO: 105586 - RNA, 22 nt, Human
augagcuaagcagaaagcacac

SEQ ID NO: 105587 - RNA, 22 nt, Human
augcacuacuagaugcaaaagu

SEQ ID NO: 105588 - RNA, 22 nt, Human
augaugaugguuuaacuucagg

SEQ ID NO: 105589 - RNA, 22 nt, Human
augaggauuagcaucugcaaau

SEQ ID NO: 105590 - RNA, 22 nt, Human
augaagguggacagauuuuuuu

SEQ ID NO: 105591 - RNA, 22 nt, Human
augaugauuauucauuuucugu

SEQ ID NO: 105592 - RNA, 22 nt, Human
augauuacagcaugauguuuca

SEQ ID NO: 105593 - RNA, 22 nt, Human
augauuaagguacgucauuucu

SEQ ID NO: 105594 - RNA, 22 nt, Human
augauguuggaauuuuaacuua

SEQ ID NO: 105595 - RNA, 22 nt, Human
augaauuaucugguguuggaaa

SEQ ID NO: 105596 - RNA, 22 nt, Human
augacagcuaaggaauguguag

SEQ ID NO: 105597 - RNA, 22 nt, Human
auauuguagcaucacugucuug

SEQ ID NO: 105598 - RNA, 22 nt, Human
auauguuuuaguagaaucccaa

SEQ ID NO: 105599 - RNA, 22 nt, Human
auauugagagagugagguguag

SEQ ID NO: 105600 - RNA, 22 nt, Human
auauucaaugaggucauauaag

SEQ ID NO: 105601 - RNA, 22 nt, Human
auauuauuaaaauagauggaua

SEQ ID NO: 105602 - RNA, 22 nt, Human
auauguuaugccauuuucaagg

SEQ ID NO: 105603 - RNA, 22 nt, Human
aucaaguuauuaaguagcuuuc

SEQ ID NO: 105604 - RNA, 20 nt, Human
aucaagugucuugccaggca

SEQ ID NO: 105605 - RNA, 22 nt, Human
aucaaacuaugguccaugggca

SEQ ID NO: 105606 - RNA, 22 nt, Human
auauuugucuguuuuaguggca

SEQ ID NO: 105607 - RNA, 22 nt, Human
aucaaaauguguagucuugauc

SEQ ID NO: 105608 - RNA, 22 nt, Human
aucaaaauuuucagauacuaca

SEQ ID NO: 105609 - RNA, 22 nt, Human
auauuuuugcagaauuuuucgu

SEQ ID NO: 105610 - RNA, 21 nt, Human
aucagaaucucuagauuugga

SEQ ID NO: 105611 - RNA, 22 nt, Human
aucacauggauuuuaucuuuug

SEQ ID NO: 105612 - RNA, 22 nt, Human
aucacaaauggaaucaccuccc

SEQ ID NO: 105613 - RNA, 22 nt, Human
aucaauaaccauagugguuaca

SEQ ID NO: 105614 - RNA, 22 nt, Human
aucacacaccuguuaaauugug

SEQ ID NO: 105615 - RNA, 22 nt, Human
auauuuuacagcucucguugaa

SEQ ID NO: 105616 - RNA, 22 nt, Human
auauuuguuuggcagaguucag

SEQ ID NO: 105617 - RNA, 22 nt, Human
auauuuguacagcuugugaguu

SEQ ID NO: 105618 - RNA, 21 nt, Human
auauuguugggguuuucuuuu

SEQ ID NO: 105619 - RNA, 22 nt, Human
auauuugcccccaugcccuggc

SEQ ID NO: 105620 - RNA, 22 nt, Human
aucauaugugauaccauaauga

SEQ ID NO: 105621 - RNA, 22 nt, Human
aucaaugggucaaagagaaggu

SEQ ID NO: 105622 - RNA, 22 nt, Human
aucaagacaaaggaaaggcuaa

SEQ ID NO: 105623 - RNA, 22 nt, Human
aucaucuaaaauuggcucagau

SEQ ID NO: 105624 - RNA, 22 nt, Human
aucaugugacuagguuuggcca

SEQ ID NO: 105625 - RNA, 22 nt, Human
aucauguauauuuuugcuauua

SEQ ID NO: 105626 - RNA, 19 nt, Human
aucagcaguuuugccugga

SEQ ID NO: 105627 - RNA, 22 nt, Human
aucgcagaguggaaauugauga

SEQ ID NO: 105628 - RNA, 22 nt, Human
aucauuuuuauuagcugggguu

SEQ ID NO: 105629 - RNA, 23 nt, Human
auccacauucuaguccuuuaugc

SEQ ID NO: 105630 - RNA, 22 nt, Human
auccacccugcaggccaacucu

SEQ ID NO: 105631 - RNA, 22 nt, Human
aucccacaccccuacaacauau

SEQ ID NO: 105632 - RNA, 22 nt, Human
aucauguuauguacaaauauga

SEQ ID NO: 105633 - RNA, 22 nt, Human
aucuaaaacuacgaauacuacc

SEQ ID NO: 105634 - RNA, 22 nt, Human
aucuaauguggcaaguugcuga

SEQ ID NO: 105635 - RNA, 22 nt, Human
auccugauggaaacugguauga

SEQ ID NO: 105636 - RNA, 22 nt, Human
auccucucuuaugaacaacugu

SEQ ID NO: 105637 - RNA, 22 nt, Human
auccucaaggaauuaaauaggg

SEQ ID NO: 105638 - RNA, 22 nt, Human
aucauugcuaguaaggaucuug

SEQ ID NO: 105639 - RNA, 22 nt, Human
aucauugaaaauuuaugcauuu

SEQ ID NO: 105640 - RNA, 22 nt, Human
aucauuugaacagaauuuguuu

SEQ ID NO: 105641 - RNA, 23 nt, Human
aucauuucuuagugagucccugc

SEQ ID NO: 105642 - RNA, 22 nt, Human
aucauuaacagugcagggguag

SEQ ID NO: 105643 - RNA, 22 nt, Human
auccuccuuugcccugagauca

SEQ ID NO: 105644 - RNA, 22 nt, Human
aucauguauaugcagcguuugu

SEQ ID NO: 105645 - RNA, 22 nt, Human
aucaugcugacacaguuuaucu

SEQ ID NO: 105646 - RNA, 22 nt, Human
auccagaaguauuuuggguacu

SEQ ID NO: 105647 - RNA, 22 nt, Human
auccacuagagggugaacucug

SEQ ID NO: 105648 - RNA, 22 nt, Human
aucauuuggaaauuuggccuaa

SEQ ID NO: 105649 - RNA, 22 nt, Human
aucagugcacgcgaugggcaga

SEQ ID NO: 105650 - RNA, 21 nt, Human
agugaguagagcacugaguca

SEQ ID NO: 105651 - RNA, 22 nt, Human
agugaauuagccuauuuguaaa

SEQ ID NO: 105652 - RNA, 22 nt, Human
agugacauuauuuuguguacua

SEQ ID NO: 105653 - RNA, 22 nt, Human
agugaaauaugcccauugcugu

SEQ ID NO: 105654 - RNA, 22 nt, Human
agugaaagaaaacuguuagaac

SEQ ID NO: 105655 - RNA, 22 nt, Human
agugaaaacugaaucaccuucc

SEQ ID NO: 105656 - RNA, 20 nt, Human
auacuuguuuucaggcuuuu

SEQ ID NO: 105657 - RNA, 18 nt, Human
auagacaggaaaaaugga

SEQ ID NO: 105658 - RNA, 22 nt, Human
auagacauuuauagagaaugac

SEQ ID NO: 105659 - RNA, 22 nt, Human
agugacuguccuacuuuguaga

SEQ ID NO: 105660 - RNA, 22 nt, Human
auacauauaugcacauuaauau

SEQ ID NO: 105661 - RNA, 21 nt, Human
auacaguucagcuuuuacuau

SEQ ID NO: 105662 - RNA, 22 nt, Human
auagaugacaguuaggaagcug

SEQ ID NO: 105663 - RNA, 22 nt, Human
auagauuuuaucagauuuuauc

SEQ ID NO: 105664 - RNA, 22 nt, Human
auaccaaugaaucccugagaau

SEQ ID NO: 105665 - RNA, 19 nt, Human
auagcagaagucauuuuca

SEQ ID NO: 105666 - RNA, 22 nt, Human
auacuuccuuaauuuggggaaa

SEQ ID NO: 105667 - RNA, 22 nt, Human
auagcuauuauuauuucuguua

SEQ ID NO: 105668 - RNA, 22 nt, Human
auaggcauaacacugauguccu

SEQ ID NO: 105669 - RNA, 22 nt, Human
auagauagaagggacguggugc

SEQ ID NO: 105670 - RNA, 22 nt, Human
auagcaacucugcuuccuugcc

SEQ ID NO: 105671 - RNA, 22 nt, Human
auacuagauaccucuucuaccu

SEQ ID NO: 105672 - RNA, 22 nt, Human
auacuucaccuaacccaguuuc

SEQ ID NO: 105673 - RNA, 22 nt, Human
auagaaauagacaaugcaaaga

SEQ ID NO: 105674 - RNA, 23 nt, Human
auacuuuuuuucuacguuaucuc

SEQ ID NO: 105675 - RNA, 22 nt, Human
auagagaggaacagcaagaacu

SEQ ID NO: 105676 - RNA, 22 nt, Human
auagaagugaaaagggaugacu

SEQ ID NO: 105677 - RNA, 22 nt, Human
auagacuagccaaagacuucug

SEQ ID NO: 105678 - RNA, 22 nt, Human
auagaauggcaccagcaucuac

SEQ ID NO: 105679 - RNA, 22 nt, Human
auauaagauaauaacuuuuuua

SEQ ID NO: 105680 - RNA, 22 nt, Human
auaguccuucuuuaacuuagau

SEQ ID NO: 105681 - RNA, 22 nt, Human
auauaguacauguauauauaua

SEQ ID NO: 105682 - RNA, 22 nt, Human
auauaguuggguuucauucuac

SEQ ID NO: 105683 - RNA, 22 nt, Human
auagauugcucauauauuacuu

SEQ ID NO: 105684 - RNA, 22 nt, Human
auagcacuuaauaugaaacagu

SEQ ID NO: 105685 - RNA, 22 nt, Human
auauaacccaaggcaggcugug

SEQ ID NO: 105686 - RNA, 22 nt, Human
auagaugaggaaauucaggugc

SEQ ID NO: 105687 - RNA, 22 nt, Human
auauaggcugaaaaauagaauu

SEQ ID NO: 105688 - RNA, 22 nt, Human
auagcaucaugcuaucccccuu

SEQ ID NO: 105689 - RNA, 22 nt, Human
auaggacuguacagaauacaag

SEQ ID NO: 105690 - RNA, 22 nt, Human
auauccugguucuaucaaaagg

SEQ ID NO: 105691 - RNA, 22 nt, Human
auauauacuuugacacauucug

SEQ ID NO: 105692 - RNA, 22 nt, Human
auauaagucacauuaaggaggu

SEQ ID NO: 105693 - RNA, 22 nt, Human
auaucugaugacgugacuaugu

SEQ ID NO: 105694 - RNA, 22 nt, Human
auaguuuuagauacugagaaaa

SEQ ID NO: 105695 - RNA, 22 nt, Human
auaguugcugucauuauuugag

SEQ ID NO: 105696 - RNA, 22 nt, Human
auaugaagaaugaucugaagua

SEQ ID NO: 105697 - RNA, 22 nt, Human
auaucuuguuuuugauuucuug

SEQ ID NO: 105698 - RNA, 22 nt, Human
auaugcagaaaauaaaggaauu

SEQ ID NO: 105699 - RNA, 22 nt, Human
auaggacuuuguaucaggauga

SEQ ID NO: 105700 - RNA, 22 nt, Human
auaguaaauguuaacagcaaca

SEQ ID NO: 105701 - RNA, 23 nt, Human
auagucuuaaaccagacuucacc

SEQ ID NO: 105702 - RNA, 22 nt, Human
auaguuaucuguggauaagguu

SEQ ID NO: 105703 - RNA, 22 nt, Human
auaguguguaaagugcagugau

SEQ ID NO: 105704 - RNA, 22 nt, Human
auaguuaagguguacugaagau

SEQ ID NO: 105705 - RNA, 22 nt, Human
auaugcacauguacauguauau

SEQ ID NO: 105706 - RNA, 21 nt, Human
auauggauauuauuuuguguc

SEQ ID NO: 105707 - RNA, 22 nt, Human
auauuucuacaggcugauuuua

SEQ ID NO: 105708 - RNA, 23 nt, Human
auaugucaugcaccagcacuuua

SEQ ID NO: 105709 - RNA, 22 nt, Human
auauuuguuagcugcuuuggag

SEQ ID NO: 105710 - RNA, 22 nt, Human
auauggugauuuuaugcaggaa

SEQ ID NO: 105711 - RNA, 22 nt, Human
auauaaugugugcuuuauugaa

SEQ ID NO: 105712 - RNA, 22 nt, Human
auauguaguuucagaaguggaa

SEQ ID NO: 105713 - RNA, 22 nt, Human
auauaaugcaguaggugauuaa

SEQ ID NO: 105714 - RNA, 22 nt, Human
auauaugcaacaagaaagcaua

SEQ ID NO: 105715 - RNA, 22 nt, Human
auauauguauauacacauauau

SEQ ID NO: 105716 - RNA, 22 nt, Human
auaucuaggcugaauguaaaau

SEQ ID NO: 105717 - RNA, 22 nt, Human
auauugcuuuauucuugaauau

SEQ ID NO: 105718 - RNA, 21 nt, Human
auauugguaucuuuuuaaauc

SEQ ID NO: 105719 - RNA, 22 nt, Human
uuuuuuuccaguuauucauuuu

SEQ ID NO: 105720 - RNA, 22 nt, Human
uuuuuuuuacuccggacagcuc

SEQ ID NO: 105721 - RNA, 18 nt, Human
uuuuuuguucuguuuugu

SEQ ID NO: 105722 - RNA, 22 nt, Human
uuuuuuaaucaaguaggaaaca

SEQ ID NO: 105723 - RNA, 20 nt, Human
uuuuuuaaauagagcuguug

SEQ ID NO: 105724 - RNA, 22 nt, Human
uuuuugggaagaauucugauau

SEQ ID NO: 105725 - RNA, 22 nt, Human
uuuuuguaaaugaaguuuuauu

SEQ ID NO: 105726 - RNA, 22 nt, Human
uuuuugcccuaaagaagucauu

SEQ ID NO: 105727 - RNA, 22 nt, Human
uuuuucuccauuccaggugccu

SEQ ID NO: 105728 - RNA, 22 nt, Human
uuuuucuuugcuuuccacuggc

SEQ ID NO: 105729 - RNA, 22 nt, Human
uuuuucugccucucucccacau

SEQ ID NO: 105730 - RNA, 22 nt, Human
uuuuucuuugguaacucuuccu

SEQ ID NO: 105731 - RNA, 22 nt, Human
uuuuucacacuccuuuccaguu

SEQ ID NO: 105732 - RNA, 22 nt, Human
uuuuuauguaaaauauuaaaag

SEQ ID NO: 105733 - RNA, 22 nt, Human
uuuuguagauuggaaaaucugg

SEQ ID NO: 105734 - RNA, 22 nt, Human
uuuuucagacuaauagggcaua

SEQ ID NO: 105735 - RNA, 22 nt, Human
uuuuuauaagauuuaaaaugua

SEQ ID NO: 105736 - RNA, 22 nt, Human
uuuuuauaagagcagcagaguu

SEQ ID NO: 105737 - RNA, 22 nt, Human
uuuuuagggauuaguguuugag

SEQ ID NO: 105738 - RNA, 22 nt, Human
uuuuuagcuguuauuguggaag

SEQ ID NO: 105739 - RNA, 22 nt, Human
uuuuuaagguuuguuuauauau

SEQ ID NO: 105740 - RNA, 22 nt, Human
uuuuggauugcuaacucagggu

SEQ ID NO: 105741 - RNA, 22 nt, Human
uuuugggugcaaauuguuuguu

SEQ ID NO: 105742 - RNA, 22 nt, Human
uuuugguauggcuugauagagu

SEQ ID NO: 105743 - RNA, 22 nt, Human
uuuugguaguccagaguuuagu

SEQ ID NO: 105744 - RNA, 22 nt, Human
uuuuguggacugugagggugca

SEQ ID NO: 105745 - RNA, 22 nt, Human
uuuuguggacugauccgaggac

SEQ ID NO: 105746 - RNA, 21 nt, Human
uuuuguguugcgcacuuugag

SEQ ID NO: 105747 - RNA, 22 nt, Human
uuuugucagggcaggaggaaga

SEQ ID NO: 105748 - RNA, 22 nt, Human
uuuugaauaauucagaaacagc

SEQ ID NO: 105749 - RNA, 22 nt, Human
uuuugccuauuguaucaucgua

SEQ ID NO: 105750 - RNA, 22 nt, Human
uuuugcuagaaaucaccaauac

SEQ ID NO: 105751 - RNA, 22 nt, Human
uuuugcaaauuacuaaauuucu

SEQ ID NO: 105752 - RNA, 22 nt, Human
uuuugaugaccauucuucuuuu

SEQ ID NO: 105753 - RNA, 22 nt, Human
uuuucuucggugcuggguugau

SEQ ID NO: 105754 - RNA, 22 nt, Human
uuuucuguuuaugaaauugugu

SEQ ID NO: 105755 - RNA, 22 nt, Human
uuuucauagccagaaacugaaa

SEQ ID NO: 105756 - RNA, 22 nt, Human
uuuuccaaaaguggagaggaau

SEQ ID NO: 105757 - RNA, 22 nt, Human
uuuuccccuacuaacacugagu

SEQ ID NO: 105758 - RNA, 22 nt, Human
uuuuccuucugauacuccauuu

SEQ ID NO: 105759 - RNA, 22 nt, Human
uuuucuacaaucacucuggaag

SEQ ID NO: 105760 - RNA, 22 nt, Human
uuuucucaguuuuuuucaaaag

SEQ ID NO: 105761 - RNA, 22 nt, Human
uuuuccuucuuccugccuugcc

SEQ ID NO: 105762 - RNA, 22 nt, Human
uuuucuacaaaucuggacuuuu

SEQ ID NO: 105763 - RNA, 22 nt, Human
uuuguuugcugagugaauucaa

SEQ ID NO: 105764 - RNA, 22 nt, Human
uuuguuuuggugucaugcguga

SEQ ID NO: 105765 - RNA, 22 nt, Human
uuuuaaaacaugucaaaaugug

SEQ ID NO: 105766 - RNA, 17 nt, Human
uuuguuucauacuucau

SEQ ID NO: 105767 - RNA, 22 nt, Human
uuuguuuccagccuuuugucuu

SEQ ID NO: 105768 - RNA, 22 nt, Human
uuuguugucuucauaauacuuu

SEQ ID NO: 105769 - RNA, 22 nt, Human
uuuguucaccuagcaaacuuuu

SEQ ID NO: 105770 - RNA, 21 nt, Human
uuuguucaggggcaaaguuaa

SEQ ID NO: 105771 - RNA, 22 nt, Human
uuuguucuagauaacugguaau

SEQ ID NO: 105772 - RNA, 22 nt, Human
uuuguucuucucaugcacacaa

SEQ ID NO: 105773 - RNA, 22 nt, Human
uuuguugaauggcaggauuuua

SEQ ID NO: 105774 - RNA, 22 nt, Human
uuuguucaguuuguugugggug

SEQ ID NO: 105775 - RNA, 22 nt, Human
uuuacuuguuuugcucuuuucc

SEQ ID NO: 105776 - RNA, 22 nt, Human
uuuacuuuugguaaggucauuu

SEQ ID NO: 105777 - RNA, 22 nt, Human
uuuaaugucuuuggccuuuaau

SEQ ID NO: 105778 - RNA, 22 nt, Human
uuuaaugucuuggaaaaagacu

SEQ ID NO: 105779 - RNA, 19 nt, Human
uuuaaugugugcugcaauc

SEQ ID NO: 105780 - RNA, 22 nt, Human
uuuacucagucugagcaggugu

SEQ ID NO: 105781 - RNA, 22 nt, Human
uuuguguuggaagaaaugcuac

SEQ ID NO: 105782 - RNA, 22 nt, Human
uuuguguuuugaggucuugcaa

SEQ ID NO: 105783 - RNA, 21 nt, Human
uuuguucacacacagggcagc

SEQ ID NO: 105784 - RNA, 19 nt, Human
uuuucaacguccgguucau

SEQ ID NO: 105785 - RNA, 22 nt, Human
uuuucaacuuuauuuuccccca

SEQ ID NO: 105786 - RNA, 22 nt, Human
uuuuauguuccugaagcuaucu

SEQ ID NO: 105787 - RNA, 22 nt, Human
uuuucaguuccaucucugcucu

SEQ ID NO: 105788 - RNA, 22 nt, Human
uuuucacugacuuggucuggaa

SEQ ID NO: 105789 - RNA, 22 nt, Human
uuuucaauuuucauuugcaaga

SEQ ID NO: 105790 - RNA, 22 nt, Human
uuuuaguaauacuuuggccuuu

SEQ ID NO: 105791 - RNA, 22 nt, Human
uuuuauaaaaccuguuugaccu

SEQ ID NO: 105792 - RNA, 22 nt, Human
uuuuagccagaguuuaucacag

SEQ ID NO: 105793 - RNA, 22 nt, Human
uuuuaaucagguauuugaguau

SEQ ID NO: 105794 - RNA, 22 nt, Human
uuuuaauccucuugguaucuua

SEQ ID NO: 105795 - RNA, 23 nt, Human
uuuuacaagagugcauuugucuc

SEQ ID NO: 105796 - RNA, 22 nt, Human
uuuuacaaugcaaauucuugcu

SEQ ID NO: 105797 - RNA, 22 nt, Human
uuuuacuuuucccacuuacagc

SEQ ID NO: 105798 - RNA, 22 nt, Human
uuuuaaguauuuucuuuuuuua

SEQ ID NO: 105799 - RNA, 22 nt, Human
uuuuaaaagguugcuguuauaa

SEQ ID NO: 105800 - RNA, 22 nt, Human
uuuuaaauaaacuacacugauu

SEQ ID NO: 105801 - RNA, 22 nt, Human
uucuccugcccuuggacuucca

SEQ ID NO: 105802 - RNA, 22 nt, Human
uucuaagaaauggaaaacgauu

SEQ ID NO: 105803 - RNA, 22 nt, Human
uucucaauggcaacuuguugcu

SEQ ID NO: 105804 - RNA, 22 nt, Human
uucuaggagucugguuccugcc

SEQ ID NO: 105805 - RNA, 22 nt, Human
uucuagauagucugauauuccu

SEQ ID NO: 105806 - RNA, 22 nt, Human
uuuuauuuguauguugaaugua

SEQ ID NO: 105807 - RNA, 22 nt, Human
uuuuacgucuuugcugccucgu

SEQ ID NO: 105808 - RNA, 18 nt, Human
uucuaaauucuguuuuua

SEQ ID NO: 105809 - RNA, 22 nt, Human
uucguugaagcaacgacuuugg

SEQ ID NO: 105810 - RNA, 22 nt, Human
uuuuaggauuugaguugcugga

SEQ ID NO: 105811 - RNA, 22 nt, Human
uuuucaaucaaguuuauuuaua

SEQ ID NO: 105812 - RNA, 22 nt, Human
uucucuugccuucucuuuuauc

SEQ ID NO: 105813 - RNA, 22 nt, Human
uuuuccuguccuugggucugca

SEQ ID NO: 105814 - RNA, 20 nt, Human
uucugcucuagagucuagaa

SEQ ID NO: 105815 - RNA, 22 nt, Human
uucugcccuugccagacaagua

SEQ ID NO: 105816 - RNA, 22 nt, Human
uucugaugccuggguugcuucu

SEQ ID NO: 105817 - RNA, 20 nt, Human
uucugcagcagguguugaag

SEQ ID NO: 105818 - RNA, 22 nt, Human
uucugcauaggcuauauuuguu

SEQ ID NO: 105819 - RNA, 23 nt, Human
uucugcuucccauagcacuuugu

SEQ ID NO: 105820 - RNA, 22 nt, Human
uuuuuuuguagguguaugaaaa

SEQ ID NO: 105821 - RNA, 22 nt, Human
uugacuauacucuggcggaaaa

SEQ ID NO: 105822 - RNA, 22 nt, Human
uugaggaagggaggcaaaacug

SEQ ID NO: 105823 - RNA, 22 nt, Human
uugaguaaugcaagccuuugua

SEQ ID NO: 105824 - RNA, 22 nt, Human
uugaauggaauuggaaucuuau

SEQ ID NO: 105825 - RNA, 22 nt, Human
uuuuuugguuuggggauuauuu

SEQ ID NO: 105826 - RNA, 22 nt, Human
uuuuuuguuccuugguuuuugu

SEQ ID NO: 105827 - RNA, 22 nt, Human
uuuuuuuagaaagaucauaguu

SEQ ID NO: 105828 - RNA, 22 nt, Human
uuuuuuuaaguuuugauuuuag

SEQ ID NO: 105829 - RNA, 22 nt, Human
uugaagaagucaaaagcugcag

SEQ ID NO: 105830 - RNA, 22 nt, Human
uugaacguguaggaagcugguu

SEQ ID NO: 105831 - RNA, 22 nt, Human
uuuuuucuucucuaucuuaaua

SEQ ID NO: 105832 - RNA, 22 nt, Human
uuuuuucuggaguuugggguuu

SEQ ID NO: 105833 - RNA, 22 nt, Human
uuuuuuccuguuugucuuuggg

SEQ ID NO: 105834 - RNA, 22 nt, Human
uugaaggugggaggauuuauau

SEQ ID NO: 105835 - RNA, 22 nt, Human
uugaaaaguuuguuacucacau

SEQ ID NO: 105836 - RNA, 22 nt, Human
uugaaaacugucaccuuuauuc

SEQ ID NO: 105837 - RNA, 20 nt, Human
uugaaagucagggcuccagu

SEQ ID NO: 105838 - RNA, 22 nt, Human
uuuuucugacugcuaacaaaaa

SEQ ID NO: 105839 - RNA, 22 nt, Human
uuuuuguggggggcggugugaa

SEQ ID NO: 105840 - RNA, 22 nt, Human
uuuuuguuauuuagguguagag

SEQ ID NO: 105841 - RNA, 22 nt, Human
uugaaaaaugcccagcagacaa

SEQ ID NO: 105842 - RNA, 22 nt, Human
uuuuucuccucucucuuucauu

SEQ ID NO: 105843 - RNA, 21 nt, Human
uuuuucuccagaguuuccacu

SEQ ID NO: 105844 - RNA, 22 nt, Human
uuuuuagcauaugucaaaucag

SEQ ID NO: 105845 - RNA, 22 nt, Human
uuuuuaccugguguccagcuuc

SEQ ID NO: 105846 - RNA, 22 nt, Human
uucuugagaacaaauuccugga

SEQ ID NO: 105847 - RNA, 22 nt, Human
uuuuuaauuuuaagcuauuugu

SEQ ID NO: 105848 - RNA, 22 nt, Human
uucuguguauggaagaaugucc

SEQ ID NO: 105849 - RNA, 22 nt, Human
uuuuguagauagggaaacagag

SEQ ID NO: 105850 - RNA, 18 nt, Human
uuuuguguuuauucugca

SEQ ID NO: 105851 - RNA, 22 nt, Human
uuuuuaaaagaugauuuaauga

SEQ ID NO: 105852 - RNA, 22 nt, Human
uuuuguuuacauuaaauuuuga

SEQ ID NO: 105853 - RNA, 22 nt, Human
uuuuguuacugauuauuaaaau

SEQ ID NO: 105854 - RNA, 22 nt, Human
uuguuuuaaaaagaauaacuac

SEQ ID NO: 105855 - RNA, 22 nt, Human
uuguuuucuaguguuuugaaua

SEQ ID NO: 105856 - RNA, 22 nt, Human
uuguuuuucucuagggaaggcu

SEQ ID NO: 105857 - RNA, 22 nt, Human
uuuaaaacagcauuuaaaaggu

SEQ ID NO: 105858 - RNA, 22 nt, Human
uuuaaaacaguacguuuucuua

SEQ ID NO: 105859 - RNA, 22 nt, Human
uuuaaaauguuuuauuuauuua

SEQ ID NO: 105860 - RNA, 22 nt, Human
uuguuuguaaggcucuuagaau

SEQ ID NO: 105861 - RNA, 22 nt, Human
uuguuugguugacugauuuacc

SEQ ID NO: 105862 - RNA, 21 nt, Human
uugugaaaguccaggaacaac

SEQ ID NO: 105863 - RNA, 22 nt, Human
uuuaaauaguugguuuuuuugc

SEQ ID NO: 105864 - RNA, 22 nt, Human
uuuaaugguuuauggucuaaga

SEQ ID NO: 105865 - RNA, 22 nt, Human
uuuaaucaguugguaauauuga

SEQ ID NO: 105866 - RNA, 22 nt, Human
uuguauguuucugugcacauga

SEQ ID NO: 105867 - RNA, 22 nt, Human
uuguauaaagauggcuagaucc

SEQ ID NO: 105868 - RNA, 22 nt, Human
uuguacaaauaggaaccucuga

SEQ ID NO: 105869 - RNA, 22 nt, Human
uuguacuuaaauaugcaaauag

SEQ ID NO: 105870 - RNA, 22 nt, Human
uuggugaugcccaccuuuucau

SEQ ID NO: 105871 - RNA, 22 nt, Human
uuggugaugcuaggaauguagu

SEQ ID NO: 105872 - RNA, 22 nt, Human
uuggugaugaaagugcugcgcu

SEQ ID NO: 105873 - RNA, 22 nt, Human
uuggcaaaaauacuguaggccu

SEQ ID NO: 105874 - RNA, 22 nt, Human
uuggccaaaaaagucauuagaa

SEQ ID NO: 105875 - RNA, 22 nt, Human
uugguauucaguuggauuugga

SEQ ID NO: 105876 - RNA, 22 nt, Human
uugguaaccaaucaaaugugag

SEQ ID NO: 105877 - RNA, 22 nt, Human
uugcucuuaccauuauguguga

SEQ ID NO: 105878 - RNA, 22 nt, Human
uugcugcgcugaccuccaguga

SEQ ID NO: 105879 - RNA, 21 nt, Human
uugcuggagcaauguaaauca

SEQ ID NO: 105880 - RNA, 22 nt, Human
uugcugggauucauugaagggu

SEQ ID NO: 105881 - RNA, 22 nt, Human
uugcuggaguagaaaacuuaac

SEQ ID NO: 105882 - RNA, 22 nt, Human
uugcuuaggccaaauggcgcau

SEQ ID NO: 105883 - RNA, 22 nt, Human
uugcuuaaaucgcuuaaacugg

SEQ ID NO: 105884 - RNA, 22 nt, Human
uugcugguggcucugauuucau

SEQ ID NO: 105885 - RNA, 22 nt, Human
uuggacugguuuacauuucaag

SEQ ID NO: 105886 - RNA, 22 nt, Human
uuggaagagagauggggagaga

SEQ ID NO: 105887 - RNA, 19 nt, Human
uuggacuaugaaaaaucag

SEQ ID NO: 105888 - RNA, 22 nt, Human
uuggaauuugagaccaagaaaa

SEQ ID NO: 105889 - RNA, 22 nt, Human
uugcuuuuuuggguuuacuggg

SEQ ID NO: 105890 - RNA, 22 nt, Human
uuggaagugucuaauacaggua

SEQ ID NO: 105891 - RNA, 22 nt, Human
uugcuuugcuucuuuaugguca

SEQ ID NO: 105892 - RNA, 23 nt, Human
uugcuugagcccaggaaguggag

SEQ ID NO: 105893 - RNA, 22 nt, Human
uugcuuuuugggguuuacuggg

SEQ ID NO: 105894 - RNA, 22 nt, Human
uuggaaaugcauuuguuauuau

SEQ ID NO: 105895 - RNA, 22 nt, Human
uuggaagacagccgucuuuauu

SEQ ID NO: 105896 - RNA, 22 nt, Human
uugcacgucacccuucccaccu

SEQ ID NO: 105897 - RNA, 20 nt, Human
uugcaaagugaauagcaauu

SEQ ID NO: 105898 - RNA, 22 nt, Human
uugauuuggaauuuuuagagcu

SEQ ID NO: 105899 - RNA, 22 nt, Human
uugaguuuacauuguauuagcc

SEQ ID NO: 105900 - RNA, 22 nt, Human
uugcauauguccagccaugcau

SEQ ID NO: 105901 - RNA, 22 nt, Human
uugcagagaacuaaagggagua

SEQ ID NO: 105902 - RNA, 22 nt, Human
uugcagauuucuuguccccauu

SEQ ID NO: 105903 - RNA, 22 nt, Human
uugcaugugugaaaugcacaga

SEQ ID NO: 105904 - RNA, 20 nt, Human
uugcaugcagccggaugcug

SEQ ID NO: 105905 - RNA, 22 nt, Human
uugcucaugucaccaaagcaca

SEQ ID NO: 105906 - RNA, 22 nt, Human
uugcucaccugagaagaauaga

SEQ ID NO: 105907 - RNA, 22 nt, Human
uugcguaauuugagauuguaaa

SEQ ID NO: 105908 - RNA, 22 nt, Human
uugcuaagguuuaacuauugga

SEQ ID NO: 105909 - RNA, 22 nt, Human
uugcguaucuacauugccugua

SEQ ID NO: 105910 - RNA, 22 nt, Human
uugccauacuugaaaggagaaa

SEQ ID NO: 105911 - RNA, 23 nt, Human
uugcauuaauguggaggcacagg

SEQ ID NO: 105912 - RNA, 22 nt, Human
uugccuacaaacgaaucuaucu

SEQ ID NO: 105913 - RNA, 22 nt, Human
uucauugauuuccuuggaauaa

SEQ ID NO: 105914 - RNA, 22 nt, Human
uuuguacuuucuaauguauuua

SEQ ID NO: 105915 - RNA, 22 nt, Human
uuuggugauuuuuaaucccccu

SEQ ID NO: 105916 - RNA, 20 nt, Human
uuugguuggcuaggggaagc

SEQ ID NO: 105917 - RNA, 22 nt, Human
uuugguguuuucaggaauauac

SEQ ID NO: 105918 - RNA, 22 nt, Human
uuuguaguuguggaugcugaag

SEQ ID NO: 105919 - RNA, 22 nt, Human
uuuguauuguuuauuucauuuu

SEQ ID NO: 105920 - RNA, 22 nt, Human
uucauuuuauauuagagcuguu

SEQ ID NO: 105921 - RNA, 22 nt, Human
uuuguauuucaaggcacucuca

SEQ ID NO: 105922 - RNA, 22 nt, Human
uuugugauaaguggauucaagg

SEQ ID NO: 105923 - RNA, 22 nt, Human
uuugucaucuuccauauuugca

SEQ ID NO: 105924 - RNA, 17 nt, Human
uuugugauggcagaugc

SEQ ID NO: 105925 - RNA, 22 nt, Human
uuuguuaggguuucagcuagcc

SEQ ID NO: 105926 - RNA, 22 nt, Human
uuuguuaugguuggaagcagga

SEQ ID NO: 105927 - RNA, 22 nt, Human
uuuguguuuucaggcacauggc

SEQ ID NO: 105928 - RNA, 22 nt, Human
uuuggcaccuccaaggacucgc

SEQ ID NO: 105929 - RNA, 22 nt, Human
uucaguagagguggaaauaaca

SEQ ID NO: 105930 - RNA, 22 nt, Human
uucaguuuugcuuuuaaucaug

SEQ ID NO: 105931 - RNA, 22 nt, Human
uuuggugacuguaggaaaggau

SEQ ID NO: 105932 - RNA, 22 nt, Human
uuugggcuuuguuuuaagguau

SEQ ID NO: 105933 - RNA, 22 nt, Human
uuugcauuaguuuagauuucaa

SEQ ID NO: 105934 - RNA, 22 nt, Human
uuugauuuuguuuauagugccg

SEQ ID NO: 105935 - RNA, 22 nt, Human
uuugauauaaaggcuugggcug

SEQ ID NO: 105936 - RNA, 22 nt, Human
uuugauuaccuggggcccucug

SEQ ID NO: 105937 - RNA, 22 nt, Human
uuuggcaagcagaugaagguag

SEQ ID NO: 105938 - RNA, 22 nt, Human
uuuggccauuuguaugcaugau

SEQ ID NO: 105939 - RNA, 22 nt, Human
uuugcauuugagagaggaaaca

SEQ ID NO: 105940 - RNA, 22 nt, Human
uuugaguacagcugccuuuuug

SEQ ID NO: 105941 - RNA, 22 nt, Human
uuugagaaugucaaucacaaga

SEQ ID NO: 105942 - RNA, 22 nt, Human
uuugaugauuuucuagagugua

SEQ ID NO: 105943 - RNA, 22 nt, Human
uucaaaccuaucuaagaaauag

SEQ ID NO: 105944 - RNA, 21 nt, Human
uuugacagaccagguauaguu

SEQ ID NO: 105945 - RNA, 22 nt, Human
uuugagaagauaggggaauacu

SEQ ID NO: 105946 - RNA, 22 nt, Human
uuugacaccaggagagaaaaca

SEQ ID NO: 105947 - RNA, 22 nt, Human
uuugaauauuaugucccacuuu

SEQ ID NO: 105948 - RNA, 22 nt, Human
uuucuuugggcccuggcagucu

SEQ ID NO: 105949 - RNA, 22 nt, Human
uuauuuuuaggaauguagaggu

SEQ ID NO: 105950 - RNA, 22 nt, Human
uuauuuucgugugugugugugu

SEQ ID NO: 105951 - RNA, 22 nt, Human
uuauuuuguagcucugaucuuu

SEQ ID NO: 105952 - RNA, 22 nt, Human
uuauuuuuguuuguuaagccua

SEQ ID NO: 105953 - RNA, 22 nt, Human
uucaaacaguguagaauauaug

SEQ ID NO: 105954 - RNA, 22 nt, Human
uuauuuaaaauguagguuggga

SEQ ID NO: 105955 - RNA, 22 nt, Human
uuauuuaagaucuuaauauaua

SEQ ID NO: 105956 - RNA, 22 nt, Human
uuucugcauuuguauuggaaaa

SEQ ID NO: 105957 - RNA, 17 nt, Human
uuucugcaugauuggac

SEQ ID NO: 105958 - RNA, 22 nt, Human
uuucugaugaaguagaaagacc

SEQ ID NO: 105959 - RNA, 23 nt, Human
uuucugaguuuuuuaaaagucca

SEQ ID NO: 105960 - RNA, 22 nt, Human
uuauuugcccauguuuagcaga

SEQ ID NO: 105961 - RNA, 22 nt, Human
uuucuuugcugguuggcucucc

SEQ ID NO: 105962 - RNA, 22 nt, Human
uuauuugguuuuggcuuuagcu

SEQ ID NO: 105963 - RNA, 22 nt, Human
uuucuugugauuuugaugaacu

SEQ ID NO: 105964 - RNA, 22 nt, Human
uuucuuccaucuggcuuuauuu

SEQ ID NO: 105965 - RNA, 22 nt, Human
uuucuuaaaagcuuuuaaaguu

SEQ ID NO: 105966 - RNA, 22 nt, Human
uuucuguuuguaacuccagcaa

SEQ ID NO: 105967 - RNA, 22 nt, Human
uuuaugauguagccuagagcug

SEQ ID NO: 105968 - RNA, 22 nt, Human
uuuauuuacuuucgguucugcu

SEQ ID NO: 105969 - RNA, 22 nt, Human
uuuauuuagguaaacaugaguu

SEQ ID NO: 105970 - RNA, 22 nt, Human
uuuauuugugguaguguaaucu

SEQ ID NO: 105971 - RNA, 22 nt, Human
uuuauaauuacguaaaauauuu

SEQ ID NO: 105972 - RNA, 22 nt, Human
uuuaucaggccaucuuaugucu

SEQ ID NO: 105973 - RNA, 22 nt, Human
uuuauaagccagacacugcguu

SEQ ID NO: 105974 - RNA, 22 nt, Human
uuaggaauugcuucauguuugg

SEQ ID NO: 105975 - RNA, 22 nt, Human
uuuaucucugcauagaagugau

SEQ ID NO: 105976 - RNA, 23 nt, Human
uuagcccaggcuggagguagccc

SEQ ID NO: 105977 - RNA, 22 nt, Human
uuagccuccaguuuucucauuu

SEQ ID NO: 105978 - RNA, 22 nt, Human
uuagcccaggacuuuuuauagc

SEQ ID NO: 105979 - RNA, 21 nt, Human
uuagcaguuguugauuuccag

SEQ ID NO: 105980 - RNA, 22 nt, Human
uuagagagaggagagagagaga

SEQ ID NO: 105981 - RNA, 22 nt, Human
uuuaggauaacuccaguuuucc

SEQ ID NO: 105982 - RNA, 22 nt, Human
uuaccuaagaaacucauuucgu

SEQ ID NO: 105983 - RNA, 22 nt, Human
uuuacuguuuacagcuaaugca

SEQ ID NO: 105984 - RNA, 22 nt, Human
uguuugagaauuugcugauguu

SEQ ID NO: 105985 - RNA, 21 nt, Human
uguuugcuuuuggagcaacug

SEQ ID NO: 105986 - RNA, 22 nt, Human
uuuacaaggcaguuauuuuccu

SEQ ID NO: 105987 - RNA, 22 nt, Human
uuacuggaauauaaagauaaga

SEQ ID NO: 105988 - RNA, 20 nt, Human
uuacucaaccaggcuucuac

SEQ ID NO: 105989 - RNA, 19 nt, Human
uuuacuuaggccacagaau

SEQ ID NO: 105990 - RNA, 22 nt, Human
uuacuguaggugggugaauuug

SEQ ID NO: 105991 - RNA, 21 nt, Human
uuacuggcagcagaaaccuga

SEQ ID NO: 105992 - RNA, 22 nt, Human
uuagagaauagacuuuacccug

SEQ ID NO: 105993 - RNA, 22 nt, Human
uuuagcaaggagaaauaauccu

SEQ ID NO: 105994 - RNA, 20 nt, Human
uuuagcacauuguacaaaac

SEQ ID NO: 105995 - RNA, 22 nt, Human
uuuagcauggacacugagggcu

SEQ ID NO: 105996 - RNA, 22 nt, Human
uuuagcugugugugucgcucca

SEQ ID NO: 105997 - RNA, 22 nt, Human
uuuagguccguguugcaguugg

SEQ ID NO: 105998 - RNA, 22 nt, Human
uuuaggaauuugcugggcauga

SEQ ID NO: 105999 - RNA, 22 nt, Human
uuaucugugcuuuacugacaga

SEQ ID NO: 106000 - RNA, 22 nt, Human
uuaucugcccauuguagaauug

SEQ ID NO: 106001 - RNA, 22 nt, Human
uuaugggcgaugcaaaccugau

SEQ ID NO: 106002 - RNA, 22 nt, Human
uuucauguuggauacuguuuca

SEQ ID NO: 106003 - RNA, 22 nt, Human
uuucauggaggccaggacagag

SEQ ID NO: 106004 - RNA, 21 nt, Human
uuucauuaguacaucaauuug

SEQ ID NO: 106005 - RNA, 22 nt, Human
uuuccagacaugguuuuucaaa

SEQ ID NO: 106006 - RNA, 22 nt, Human
uuaucagggaguuguguguucu

SEQ ID NO: 106007 - RNA, 22 nt, Human
uuuccacacucacugcacucau

SEQ ID NO: 106008 - RNA, 22 nt, Human
uuauacuucugccagaggacaa

SEQ ID NO: 106009 - RNA, 22 nt, Human
uuauaggugauuaauuuuaacc

SEQ ID NO: 106010 - RNA, 22 nt, Human
uuauaaguaagggucucuggca

SEQ ID NO: 106011 - RNA, 22 nt, Human
uuucacuucgaucagaguuuuu

SEQ ID NO: 106012 - RNA, 22 nt, Human
uuauacugaaagucuuuuaaua

SEQ ID NO: 106013 - RNA, 22 nt, Human
uuucagacugcccauguuugcc

SEQ ID NO: 106014 - RNA, 22 nt, Human
uuucagugaaugaauggcuaac

SEQ ID NO: 106015 - RNA, 22 nt, Human
uuucauagaggcagcggcggau

SEQ ID NO: 106016 - RNA, 22 nt, Human
uuauauuaaaaaucgcuaacag

SEQ ID NO: 106017 - RNA, 22 nt, Human
uuucagguggaaguuuuagaug

SEQ ID NO: 106018 - RNA, 22 nt, Human
uuauuggcagcuccugcacaug

SEQ ID NO: 106019 - RNA, 22 nt, Human
uuauuccauagaagucaaggaa

SEQ ID NO: 106020 - RNA, 22 nt, Human
uuaugugcuuuuugagcucuaa

SEQ ID NO: 106021 - RNA, 22 nt, Human
uuuccuguccugguacuuggca

SEQ ID NO: 106022 - RNA, 22 nt, Human
uuuccugacuucaccuuuuacc

SEQ ID NO: 106023 - RNA, 22 nt, Human
uuuccccugggaacauugauuc

SEQ ID NO: 106024 - RNA, 22 nt, Human
uuuccaguuguucuagaaagcu

SEQ ID NO: 106025 - RNA, 22 nt, Human
uuucccuugcgcuugcucuccg

SEQ ID NO: 106026 - RNA, 22 nt, Human
uuucuaguauauaacuagaucu

SEQ ID NO: 106027 - RNA, 19 nt, Human
uuucucacugagucguuug

SEQ ID NO: 106028 - RNA, 22 nt, Human
uuauuguuuggguauaauuuga

SEQ ID NO: 106029 - RNA, 22 nt, Human
uuauuguagcacuuuggcagug

SEQ ID NO: 106030 - RNA, 22 nt, Human
uuucuaaaaccagaguuuauaa

SEQ ID NO: 106031 - RNA, 22 nt, Human
uguggcaauauggaauguguuu

SEQ ID NO: 106032 - RNA, 22 nt, Human
uugcugccagcgcccugcaggg

SEQ ID NO: 106033 - RNA, 22 nt, Human
uugcugugucauuuguuuaauc

SEQ ID NO: 106034 - RNA, 22 nt, Human
uguggcuuaggugagcauguga

SEQ ID NO: 106035 - RNA, 22 nt, Human
ugugccuagauuccaugcacuc

SEQ ID NO: 106036 - RNA, 22 nt, Human
ugugcaucuggaggcaauguuu

SEQ ID NO: 106037 - RNA, 22 nt, Human
ugugcaguauugaaauauaugu

SEQ ID NO: 106038 - RNA, 22 nt, Human
ugugguuuguaagcaaagcaaa

SEQ ID NO: 106039 - RNA, 22 nt, Human
uuggaaauguagaaaagcagau

SEQ ID NO: 106040 - RNA, 22 nt, Human
uuggauguccucuguggaguau

SEQ ID NO: 106041 - RNA, 22 nt, Human
uuggauagaauuuaaauugucu

SEQ ID NO: 106042 - RNA, 22 nt, Human
ugugugcuaguuuugucaguau

SEQ ID NO: 106043 - RNA, 22 nt, Human
uuggaguucuucaugcucugua

SEQ ID NO: 106044 - RNA, 22 nt, Human
uuggaaaagaaauacucauaua

SEQ ID NO: 106045 - RNA, 22 nt, Human
uugcuugcggccuuugugccuu

SEQ ID NO: 106046 - RNA, 22 nt, Human
uugcuugaacccaggaagugga

SEQ ID NO: 106047 - RNA, 23 nt, Human
uugcuuuugccccaaaagaguua

SEQ ID NO: 106048 - RNA, 22 nt, Human
uugggaaauuugaaaauaaaag

SEQ ID NO: 106049 - RNA, 22 nt, Human
uuggcuucuugcuaggaagcug

SEQ ID NO: 106050 - RNA, 22 nt, Human
uguguguaugagcauuuguaug

SEQ ID NO: 106051 - RNA, 22 nt, Human
uguuaaaaagucccuguuuugu

SEQ ID NO: 106052 - RNA, 22 nt, Human
uguguguauauauggaauauug

SEQ ID NO: 106053 - RNA, 22 nt, Human
uguguguauauauauguaucau

SEQ ID NO: 106054 - RNA, 22 nt, Human
uugggauuggugggguggguuu

SEQ ID NO: 106055 - RNA, 22 nt, Human
uguugaagcaccucugucuuuc

SEQ ID NO: 106056 - RNA, 22 nt, Human
uguucuucaaacucaguuccac

SEQ ID NO: 106057 - RNA, 22 nt, Human
uguugaugaccacaauuuaugc

SEQ ID NO: 106058 - RNA, 22 nt, Human
uguugauuaauuuucccaaaca

SEQ ID NO: 106059 - RNA, 22 nt, Human
uguuggaauaagugcuugaagg

SEQ ID NO: 106060 - RNA, 22 nt, Human
uguuggaaucuucuagucuucc

SEQ ID NO: 106061 - RNA, 19 nt, Human
uuggugaagguucacugac

SEQ ID NO: 106062 - RNA, 22 nt, Human
uguugccaucuaaaauguuacu

SEQ ID NO: 106063 - RNA, 22 nt, Human
uuggugauguagcagcaauugu

SEQ ID NO: 106064 - RNA, 20 nt, Human
uuguacuuaugugagaagga

SEQ ID NO: 106065 - RNA, 22 nt, Human
uuguagaucagauggccaguag

SEQ ID NO: 106066 - RNA, 22 nt, Human
uuguacuuguucuguuuccuug

SEQ ID NO: 106067 - RNA, 22 nt, Human
uugguuccauuuuaccagcucu

SEQ ID NO: 106068 - RNA, 22 nt, Human
uguuggugcacugaaaggcagg

SEQ ID NO: 106069 - RNA, 21 nt, Human
uguugguugugggaaggagga

SEQ ID NO: 106070 - RNA, 22 nt, Human
uguugucaugcagucaguggua

SEQ ID NO: 106071 - RNA, 22 nt, Human
uugguguaauacaagcaauuug

SEQ ID NO: 106072 - RNA, 22 nt, Human
uguuguagaaaggaaaguggcc

SEQ ID NO: 106073 - RNA, 22 nt, Human
ugucauauagaauguucuauga

SEQ ID NO: 106074 - RNA, 22 nt, Human
uugauggaggaaaaguuggaau

SEQ ID NO: 106075 - RNA, 22 nt, Human
uugauuaauugaugaaccucuc

SEQ ID NO: 106076 - RNA, 22 nt, Human
ugucaucuuggugcugugagag

SEQ ID NO: 106077 - RNA, 22 nt, Human
ugucauuggugaucugaugccu

SEQ ID NO: 106078 - RNA, 22 nt, Human
uugauuuccauuguccagcauu

SEQ ID NO: 106079 - RNA, 22 nt, Human
uguauguguuuuauguguguuu

SEQ ID NO: 106080 - RNA, 19 nt, Human
uugaauguuugauagucuc

SEQ ID NO: 106081 - RNA, 18 nt, Human
uguauuguucacuucugu

SEQ ID NO: 106082 - RNA, 22 nt, Human
uguauugaggauucauuuuugu

SEQ ID NO: 106083 - RNA, 22 nt, Human
uguauauguguguagcauguua

SEQ ID NO: 106084 - RNA, 22 nt, Human
uguauauuccagggguagggcc

SEQ ID NO: 106085 - RNA, 22 nt, Human
ugucacaccuggcgauaauggg

SEQ ID NO: 106086 - RNA, 22 nt, Human
uguauuuauuuuucaacuacca

SEQ ID NO: 106087 - RNA, 22 nt, Human
ugugauuucaaagggugucuuu

SEQ ID NO: 106088 - RNA, 22 nt, Human
ugugcagaaggagguucuccgg

SEQ ID NO: 106089 - RNA, 22 nt, Human
ugugaaugacuuuguucuuugc

SEQ ID NO: 106090 - RNA, 22 nt, Human
ugugaaugacuguguucuuugc

SEQ ID NO: 106091 - RNA, 22 nt, Human
ugugaagcgugugcaggggaca

SEQ ID NO: 106092 - RNA, 17 nt, Human
ugucuuuuuccuccucc

SEQ ID NO: 106093 - RNA, 22 nt, Human
ugucuuuagagugaacagaaga

SEQ ID NO: 106094 - RNA, 22 nt, Human
ugucuuugaccuuaagaaguuu

SEQ ID NO: 106095 - RNA, 22 nt, Human
uugcaagcccugaagggcugga

SEQ ID NO: 106096 - RNA, 22 nt, Human
uugcaagauaguguauuuuuca

SEQ ID NO: 106097 - RNA, 22 nt, Human
uugcagaauucuucccacucag

SEQ ID NO: 106098 - RNA, 21 nt, Human
ugguuuuaucuugguggcugc

SEQ ID NO: 106099 - RNA, 23 nt, Human
uguaaaacaccguuauugcaccu

SEQ ID NO: 106100 - RNA, 23 nt, Human
uucuuuccuuaucccauuuacuu

SEQ ID NO: 106101 - RNA, 22 nt, Human
ugguuuacucuguaaaccagga

SEQ ID NO: 106102 - RNA, 22 nt, Human
ugguugugcucuguuugaaagu

SEQ ID NO: 106103 - RNA, 22 nt, Human
uucuuugcccauguuuccuaag

SEQ ID NO: 106104 - RNA, 22 nt, Human
uugaaaauuaauagguguacaa

SEQ ID NO: 106105 - RNA, 22 nt, Human
uugaaagaacaauucugugaug

SEQ ID NO: 106106 - RNA, 22 nt, Human
uugaaaucuucccuccugucug

SEQ ID NO: 106107 - RNA, 22 nt, Human
uguagcaauauaucagugcaca

SEQ ID NO: 106108 - RNA, 22 nt, Human
uguaauucuaauccagagcugg

SEQ ID NO: 106109 - RNA, 22 nt, Human
uugaaccaggauaaacauagaa

SEQ ID NO: 106110 - RNA, 22 nt, Human
ugguggcuuuucguagguucac

SEQ ID NO: 106111 - RNA, 22 nt, Human
uucuuaggauuauuuaaaauuc

SEQ ID NO: 106112 - RNA, 22 nt, Human
uucuuccagugaaacgugcauc

SEQ ID NO: 106113 - RNA, 22 nt, Human
uucuuauuuuucguaaauccug

SEQ ID NO: 106114 - RNA, 22 nt, Human
uucuucauucccuuacuuccga

SEQ ID NO: 106115 - RNA, 22 nt, Human
uucuuacuaaguagaguacuca

SEQ ID NO: 106116 - RNA, 22 nt, Human
uucuuagauuuuauuucuucug

SEQ ID NO: 106117 - RNA, 22 nt, Human
uucuguuuauaauuugcaguug

SEQ ID NO: 106118 - RNA, 22 nt, Human
uucugauacagucccaacacaa

SEQ ID NO: 106119 - RNA, 22 nt, Human
uucucuuguaaaauuccuuuuu

SEQ ID NO: 106120 - RNA, 22 nt, Human
uucugaaacauugcuauuuucc

SEQ ID NO: 106121 - RNA, 22 nt, Human
uuauucuuagccucgguauuuc

SEQ ID NO: 106122 - RNA, 22 nt, Human
uuauuaauacaugcaccugcau

SEQ ID NO: 106123 - RNA, 22 nt, Human
uuauguugauaggaaucugauu

SEQ ID NO: 106124 - RNA, 22 nt, Human
ugcuauucuuggagcugaugga

SEQ ID NO: 106125 - RNA, 22 nt, Human
ugcuauuuuguuuucaguccau

SEQ ID NO: 106126 - RNA, 22 nt, Human
uggaggaggaugcauuuguugu

SEQ ID NO: 106127 - RNA, 22 nt, Human
uggaggaggagaacuuggcacu

SEQ ID NO: 106128 - RNA, 22 nt, Human
uuauuuaaguauuuauugaagu

SEQ ID NO: 106129 - RNA, 22 nt, Human
uuauuucuucucgaagcuuggg

SEQ ID NO: 106130 - RNA, 22 nt, Human
uuauuucaggcauuuguaaaug

SEQ ID NO: 106131 - RNA, 22 nt, Human
uuauuucauguaaaauuuaugu

SEQ ID NO: 106132 - RNA, 22 nt, Human
uuauuuuauaaagagaagacuu

SEQ ID NO: 106133 - RNA, 22 nt, Human
uucacaauuuuaaaaaguggaa

SEQ ID NO: 106134 - RNA, 20 nt, Human
uucacagaggacucagguca

SEQ ID NO: 106135 - RNA, 20 nt, Human
uucacagaucucuaacugag

SEQ ID NO: 106136 - RNA, 22 nt, Human
uucacauucauuucuuauguuu

SEQ ID NO: 106137 - RNA, 23 nt, Human
uucaccaaugcuguccaaguacc

SEQ ID NO: 106138 - RNA, 22 nt, Human
uggauaugaaacaaaacaagag

SEQ ID NO: 106139 - RNA, 22 nt, Human
uucaaugcaagggaggucugaa

SEQ ID NO: 106140 - RNA, 22 nt, Human
uggauauuuuguaugugcguuu

SEQ ID NO: 106141 - RNA, 22 nt, Human
uggaugacaaccauuggaagag

SEQ ID NO: 106142 - RNA, 22 nt, Human
uuauuuuuguaacacuguauag

SEQ ID NO: 106143 - RNA, 21 nt, Human
uggaggcguaaucacuguuga

SEQ ID NO: 106144 - RNA, 22 nt, Human
uucaaacacugugcaauugggu

SEQ ID NO: 106145 - RNA, 22 nt, Human
uucaaaaugcagaauaguuugg

SEQ ID NO: 106146 - RNA, 22 nt, Human
uucaacaacuugguucaaaugg

SEQ ID NO: 106147 - RNA, 22 nt, Human
uggcacagcuugucauaaacuc

SEQ ID NO: 106148 - RNA, 18 nt, Human
uggcaaugccaaaggcuu

SEQ ID NO: 106149 - RNA, 15 nt, Human
uggauuugccacaua

SEQ ID NO: 106150 - RNA, 22 nt, Human
uggcaagcuguuggcagauagc

SEQ ID NO: 106151 - RNA, 22 nt, Human
uucacuuuuuccugguccauuu

SEQ ID NO: 106152 - RNA, 22 nt, Human
uucacucagagcaggacagccc

SEQ ID NO: 106153 - RNA, 22 nt, Human
uggcacugaagcuggaaagccu

SEQ ID NO: 106154 - RNA, 22 nt, Human
uggcacaguuaaaguuguagaa

SEQ ID NO: 106155 - RNA, 22 nt, Human
uggcagcauuuuuuccagaaca

SEQ ID NO: 106156 - RNA, 22 nt, Human
uucagaaagugaaucuuguuau

SEQ ID NO: 106157 - RNA, 22 nt, Human
uggcagugagauuucucuucug

SEQ ID NO: 106158 - RNA, 22 nt, Human
uggcaguagagcuggaacuuga

SEQ ID NO: 106159 - RNA, 22 nt, Human
uucagcaagugucucuacuguc

SEQ ID NO: 106160 - RNA, 22 nt, Human
uggcaucuggugauauggacua

SEQ ID NO: 106161 - RNA, 22 nt, Human
uggcaguugcaguaacuuguau

SEQ ID NO: 106162 - RNA, 22 nt, Human
uucagaugcuugauuauggcaa

SEQ ID NO: 106163 - RNA, 21 nt, Human
uggcaggcagcuggaagcuug

SEQ ID NO: 106164 - RNA, 22 nt, Human
uucagaagguaggaaugucccu

SEQ ID NO: 106165 - RNA, 18 nt, Human
uucaggcucuugcaugaa

SEQ ID NO: 106166 - RNA, 19 nt, Human
uucaggcuuuucauuuuuc

SEQ ID NO: 106167 - RNA, 22 nt, Human
uucaggugguuuaagaauugga

SEQ ID NO: 106168 - RNA, 18 nt, Human
uggcaugcuuugauacau

SEQ ID NO: 106169 - RNA, 22 nt, Human
uucagcacuggacagcgagucu

SEQ ID NO: 106170 - RNA, 22 nt, Human
uggcauuugagcuggaaggaug

SEQ ID NO: 106171 - RNA, 22 nt, Human
uucagcauaggcugcucuucaa

SEQ ID NO: 106172 - RNA, 22 nt, Human
uucauuuccauuuuauagauaa

SEQ ID NO: 106173 - RNA, 22 nt, Human
uggcgacuggaauuaaucuuuu

SEQ ID NO: 106174 - RNA, 22 nt, Human
uucauugcuacuuaaaauacca

SEQ ID NO: 106175 - RNA, 21 nt, Human
uucauucauggcauaauauag

SEQ ID NO: 106176 - RNA, 22 nt, Human
uucauggauuugugaaauuuag

SEQ ID NO: 106177 - RNA, 22 nt, Human
uucauuauuaauaauagcagcu

SEQ ID NO: 106178 - RNA, 22 nt, Human
uggcuucagacuucugcuacgu

SEQ ID NO: 106179 - RNA, 22 nt, Human
uuccagauguuuaaguucugcu

SEQ ID NO: 106180 - RNA, 22 nt, Human
uuccagcaaagguaguguguua

SEQ ID NO: 106181 - RNA, 22 nt, Human
uggcucacaggaggcagaggug

SEQ ID NO: 106182 - RNA, 18 nt, Human
uggcuagaagagcucuca

SEQ ID NO: 106183 - RNA, 22 nt, Human
uggcuacauuuauacucucauu

SEQ ID NO: 106184 - RNA, 23 nt, Human
uggcucugagcuuccugguggcc

SEQ ID NO: 106185 - RNA, 22 nt, Human
uucaucuucaaaccccagugcc

SEQ ID NO: 106186 - RNA, 22 nt, Human
uucaugcgcuuuucaggagugu

SEQ ID NO: 106187 - RNA, 20 nt, Human
uucaugcagugguugcugug

SEQ ID NO: 106188 - RNA, 22 nt, Human
uucauauuguggucuugcauuc

SEQ ID NO: 106189 - RNA, 22 nt, Human
uucauacuguuuaaguucuguu

SEQ ID NO: 106190 - RNA, 22 nt, Human
uggccaaauuggccugauguau

SEQ ID NO: 106191 - RNA, 22 nt, Human
uucaguaugcugaaugauuuuu

SEQ ID NO: 106192 - RNA, 22 nt, Human
uucagguuuuuaaguucugccu

SEQ ID NO: 106193 - RNA, 22 nt, Human
uucagguacuaagugcugauuc

SEQ ID NO: 106194 - RNA, 22 nt, Human
uucaguuugaauucuguagaac

SEQ ID NO: 106195 - RNA, 22 nt, Human
uggcuuuucaccugcuccucug

SEQ ID NO: 106196 - RNA, 22 nt, Human
uggcuuuugaaaaggugaugua

SEQ ID NO: 106197 - RNA, 22 nt, Human
uuccccgagccuggggaagcug

SEQ ID NO: 106198 - RNA, 20 nt, Human
uuccccauaaaaauguucca

SEQ ID NO: 106199 - RNA, 22 nt, Human
uuccccaccagagacagagcug

SEQ ID NO: 106200 - RNA, 22 nt, Human
uggcuugacaucaauacuuauu

SEQ ID NO: 106201 - RNA, 18 nt, Human
uuccauuuuucagucuuc

SEQ ID NO: 106202 - RNA, 22 nt, Human
uggcuucuggccaggcacagga

SEQ ID NO: 106203 - RNA, 19 nt, Human
uuccucaggugugaguuag

SEQ ID NO: 106204 - RNA, 22 nt, Human
ugggcacacugaaucugcuauu

SEQ ID NO: 106205 - RNA, 20 nt, Human
uuccucaaaagucugaugcu

SEQ ID NO: 106206 - RNA, 22 nt, Human
ugggcaguccagcuggaaacgg

SEQ ID NO: 106207 - RNA, 22 nt, Human
uggggagacauggaguaaaaga

SEQ ID NO: 106208 - RNA, 22 nt, Human
uuccuuuuuaauuaaucuaauu

SEQ ID NO: 106209 - RNA, 22 nt, Human
uucguucagcgcuugcgcaugc

SEQ ID NO: 106210 - RNA, 22 nt, Human
uggggcuuucgcggagcgucgg

SEQ ID NO: 106211 - RNA, 22 nt, Human
uucuacauugugaaguucuuua

SEQ ID NO: 106212 - RNA, 22 nt, Human
uucuaauauuaugauuucuaag

SEQ ID NO: 106213 - RNA, 20 nt, Human
uucguuucaguguuggauca

SEQ ID NO: 106214 - RNA, 22 nt, Human
uucuacuagugguugauggccu

SEQ ID NO: 106215 - RNA, 22 nt, Human
ugggggcacccagccgaugagg

SEQ ID NO: 106216 - RNA, 20 nt, Human
uucuccacaggguggaggag

SEQ ID NO: 106217 - RNA, 22 nt, Human
uucuagcucauggugacagauc

SEQ ID NO: 106218 - RNA, 22 nt, Human
uucuagccauagaaauuagauu

SEQ ID NO: 106219 - RNA, 22 nt, Human
ugcagggucuccuguacuuggg

SEQ ID NO: 106220 - RNA, 22 nt, Human
ugcaguugcguuugcauuccau

SEQ ID NO: 106221 - RNA, 22 nt, Human
ugcauuccagcucccuucuggc

SEQ ID NO: 106222 - RNA, 22 nt, Human
ugcauaugcauguaccuguguu

SEQ ID NO: 106223 - RNA, 22 nt, Human
ugcauuaguaaagagaggaggg

SEQ ID NO: 106224 - RNA, 22 nt, Human
ugcauuauaacaauaaggcuua

SEQ ID NO: 106225 - RNA, 22 nt, Human
ugugccuucuucauuuaauuua

SEQ ID NO: 106226 - RNA, 22 nt, Human
ugugccuguugguguagacaua

SEQ ID NO: 106227 - RNA, 22 nt, Human
ugugccuuucacuaugucauuc

SEQ ID NO: 106228 - RNA, 22 nt, Human
ugucuuaugcugcauagacuau

SEQ ID NO: 106229 - RNA, 20 nt, Human
ugucugugugugauaauagu

SEQ ID NO: 106230 - RNA, 22 nt, Human
ugucuucagguuccucaccacu

SEQ ID NO: 106231 - RNA, 22 nt, Human
uguguagagcaugggguugugg

SEQ ID NO: 106232 - RNA, 22 nt, Human
uguguauaugugugugugugug

SEQ ID NO: 106233 - RNA, 17 nt, Human
uguguaaguugcauaga

SEQ ID NO: 106234 - RNA, 22 nt, Human
uguguguauauauuuuuauaug

SEQ ID NO: 106235 - RNA, 22 nt, Human
uguggguggucagcgugugaug

SEQ ID NO: 106236 - RNA, 22 nt, Human
ugugggcugcuguuuccuugua

SEQ ID NO: 106237 - RNA, 22 nt, Human
uguggucuccucucugucuucc

SEQ ID NO: 106238 - RNA, 22 nt, Human
uguggugcucagggaggauggg

SEQ ID NO: 106239 - RNA, 22 nt, Human
ugccuaaaccauuccccuuccu

SEQ ID NO: 106240 - RNA, 22 nt, Human
ugugguuggggucagauaggga

SEQ ID NO: 106241 - RNA, 22 nt, Human
ugcauuguuuauggaauaaaau

SEQ ID NO: 106242 - RNA, 22 nt, Human
ugccaaagauagagguuugagu

SEQ ID NO: 106243 - RNA, 22 nt, Human
ugccaaugauuccacaauggaa

SEQ ID NO: 106244 - RNA, 22 nt, Human
ugcauuuuuaauuuggaaaaaa

SEQ ID NO: 106245 - RNA, 18 nt, Human
ugcccaccagaagaggga

SEQ ID NO: 106246 - RNA, 22 nt, Human
ugccauauuuugaggauguaca

SEQ ID NO: 106247 - RNA, 22 nt, Human
ugccaucaugucagauuuggga

SEQ ID NO: 106248 - RNA, 22 nt, Human
ugccauuggucuuaaggcuagc

SEQ ID NO: 106249 - RNA, 22 nt, Human
ugccaugguuguacaguagcag

SEQ ID NO: 106250 - RNA, 22 nt, Human
uguuccaacuacugaauuggca

SEQ ID NO: 106251 - RNA, 22 nt, Human
uguuaguauuggcaaauuuguu

SEQ ID NO: 106252 - RNA, 22 nt, Human
uguuauugccucaugagacucc

SEQ ID NO: 106253 - RNA, 22 nt, Human
uguuacugaaugucucugcuuu

SEQ ID NO: 106254 - RNA, 23 nt, Human
uguuaucacauguuccuuuaaau

SEQ ID NO: 106255 - RNA, 22 nt, Human
ugccuuuuguguuuggcuaauc

SEQ ID NO: 106256 - RNA, 22 nt, Human
uguuaacuuagcugaccuuaaa

SEQ ID NO: 106257 - RNA, 23 nt, Human
ugugugugugugugugugugugu

SEQ ID NO: 106258 - RNA, 22 nt, Human
uguguguguguguguguuugug

SEQ ID NO: 106259 - RNA, 19 nt, Human
uguguguguuuuguuugaa

SEQ ID NO: 106260 - RNA, 17 nt, Human
ugccuucgucuucaguu

SEQ ID NO: 106261 - RNA, 23 nt, Human
ugcuaaaggcagaauauucaccu

SEQ ID NO: 106262 - RNA, 22 nt, Human
ugcuaaguacauuccaggacuu

SEQ ID NO: 106263 - RNA, 21 nt, Human
ugcuaagugucacaugucugc

SEQ ID NO: 106264 - RNA, 22 nt, Human
uguugaucucuuuccaaauucu

SEQ ID NO: 106265 - RNA, 19 nt, Human
uguugcagcuugaucggua

SEQ ID NO: 106266 - RNA, 22 nt, Human
uguugcauguggcuguuugcca

SEQ ID NO: 106267 - RNA, 22 nt, Human
uguugaaacagcuauugacuuu

SEQ ID NO: 106268 - RNA, 22 nt, Human
uguucugaggaggguuucaagg

SEQ ID NO: 106269 - RNA, 22 nt, Human
uguucuuaacuuuuguguauau

SEQ ID NO: 106270 - RNA, 22 nt, Human
uguuccuuuuguuguuuuguuu

SEQ ID NO: 106271 - RNA, 22 nt, Human
ugggggauucaucucagagcgu

SEQ ID NO: 106272 - RNA, 22 nt, Human
uggggggacagauggagaggac

SEQ ID NO: 106273 - RNA, 22 nt, Human
ugggguuuuagagcaggcagag

SEQ ID NO: 106274 - RNA, 22 nt, Human
ugaccgucagcugucuuccauu

SEQ ID NO: 106275 - RNA, 22 nt, Human
ugagccugaguguguauugaac

SEQ ID NO: 106276 - RNA, 22 nt, Human
ugacaucuagauaaaugggaca

SEQ ID NO: 106277 - RNA, 22 nt, Human
ugacauuugagagagauauaca

SEQ ID NO: 106278 - RNA, 21 nt, Human
ugaggccugccagucucagaa

SEQ ID NO: 106279 - RNA, 19 nt, Human
ugaggauugagguccagua

SEQ ID NO: 106280 - RNA, 22 nt, Human
ugaggcuuucacuuggcaaaga

SEQ ID NO: 106281 - RNA, 22 nt, Human
uggugcaggauuuauuuaacua

SEQ ID NO: 106282 - RNA, 22 nt, Human
uggugcacgugggcagucggcc

SEQ ID NO: 106283 - RNA, 22 nt, Human
ugagccauguucaugaguucau

SEQ ID NO: 106284 - RNA, 22 nt, Human
ugaggaagugguuguaugguuu

SEQ ID NO: 106285 - RNA, 22 nt, Human
ugaggggaggggagaaaauggu

SEQ ID NO: 106286 - RNA, 23 nt, Human
uggugugaggaaggaagacuuua

SEQ ID NO: 106287 - RNA, 22 nt, Human
ugguugauuaauuuugccaagc

SEQ ID NO: 106288 - RNA, 22 nt, Human
ugguuucagacagacucgaacu

SEQ ID NO: 106289 - RNA, 22 nt, Human
ugguugcaguggugcuuauaca

SEQ ID NO: 106290 - RNA, 22 nt, Human
ugaguuuaggccaggauauggu

SEQ ID NO: 106291 - RNA, 22 nt, Human
uguaaagaaagacgcagaguua

SEQ ID NO: 106292 - RNA, 22 nt, Human
uguaaagugguauuuaauuuua

SEQ ID NO: 106293 - RNA, 22 nt, Human
uguaaauucuauacacuuaaaa

SEQ ID NO: 106294 - RNA, 22 nt, Human
ugaugaugauacauuucuucag

SEQ ID NO: 106295 - RNA, 22 nt, Human
uguaauuugguuagauuucuuu

SEQ ID NO: 106296 - RNA, 22 nt, Human
uguaguacuuagaaguauacug

SEQ ID NO: 106297 - RNA, 22 nt, Human
uguaggcacauguauauauccc

SEQ ID NO: 106298 - RNA, 22 nt, Human
ugauucaguacuuucucuaacu

SEQ ID NO: 106299 - RNA, 22 nt, Human
uguauugugggugucagagugc

SEQ ID NO: 106300 - RNA, 22 nt, Human
uguauggguaggaaacagcugg

SEQ ID NO: 106301 - RNA, 22 nt, Human
uguaucuguguguauguguuua

SEQ ID NO: 106302 - RNA, 22 nt, Human
uguauauuuucuguauaaaaua

SEQ ID NO: 106303 - RNA, 22 nt, Human
ugauguggaucuauaacuguaa

SEQ ID NO: 106304 - RNA, 22 nt, Human
ugauuagccguccuuuuauuaa

SEQ ID NO: 106305 - RNA, 22 nt, Human
uguauaugucugugagcuauua

SEQ ID NO: 106306 - RNA, 22 nt, Human
ugauguauaaaaagagugaaau

SEQ ID NO: 106307 - RNA, 23 nt, Human
ugcaaaauuugcagaguucgaug

SEQ ID NO: 106308 - RNA, 22 nt, Human
ugcaaauucuuuacucugugau

SEQ ID NO: 106309 - RNA, 22 nt, Human
uguccagcuauauguguaugug

SEQ ID NO: 106310 - RNA, 22 nt, Human
ugcaagauccagucuugagaag

SEQ ID NO: 106311 - RNA, 19 nt, Human
ugcaagcuuuuucuuguua

SEQ ID NO: 106312 - RNA, 22 nt, Human
ugcaagagcccaaacuauauac

SEQ ID NO: 106313 - RNA, 21 nt, Human
ugcaacugaaaggaauauggu

SEQ ID NO: 106314 - RNA, 22 nt, Human
ugucuguauuugaggacauugu

SEQ ID NO: 106315 - RNA, 22 nt, Human
ugcaaaaagagcgaggagcccu

SEQ ID NO: 106316 - RNA, 22 nt, Human
uguauuugaagaaagagcuucu

SEQ ID NO: 106317 - RNA, 22 nt, Human
uguauuuuuucccugaaauaaa

SEQ ID NO: 106318 - RNA, 22 nt, Human
ugauuccugugcuuauuccagu

SEQ ID NO: 106319 - RNA, 22 nt, Human
ugucacaccucguuuagcauuc

SEQ ID NO: 106320 - RNA, 22 nt, Human
ugauucacgcuucucuuuaaac

SEQ ID NO: 106321 - RNA, 22 nt, Human
ugucaaguuguuaaguucuggg

SEQ ID NO: 106322 - RNA, 19 nt, Human
uguauuuauauuucugugc

SEQ ID NO: 106323 - RNA, 22 nt, Human
ugauugauaaugaagacaguca

SEQ ID NO: 106324 - RNA, 22 nt, Human
ugauugcucagcuagccucuuu

SEQ ID NO: 106325 - RNA, 22 nt, Human
ugauucuuugaccaaaaaauug

SEQ ID NO: 106326 - RNA, 22 nt, Human
ugaaauugaguaccucuuuaua

SEQ ID NO: 106327 - RNA, 22 nt, Human
uggcuuauggguccucccucuu

SEQ ID NO: 106328 - RNA, 22 nt, Human
uggcuugagcugggcccaccug

SEQ ID NO: 106329 - RNA, 22 nt, Human
uggcugaugucuguucuguuau

SEQ ID NO: 106330 - RNA, 22 nt, Human
ugaaagcuggcucugcagagug

SEQ ID NO: 106331 - RNA, 22 nt, Human
ucuuuucagccagcugguagga

SEQ ID NO: 106332 - RNA, 22 nt, Human
ucuuuuaucuguuguguaacaa

SEQ ID NO: 106333 - RNA, 17 nt, Human
ucuuuuacuuucucucc

SEQ ID NO: 106334 - RNA, 22 nt, Human
ucuuuguuagucagaauugauc

SEQ ID NO: 106335 - RNA, 22 nt, Human
ugaacauuuuugcuugcagcuu

SEQ ID NO: 106336 - RNA, 22 nt, Human
ugaaccuaacauuucuggcagu

SEQ ID NO: 106337 - RNA, 22 nt, Human
ugaaccugagggcaaagggaca

SEQ ID NO: 106338 - RNA, 22 nt, Human
ugaacuuacauugaggaauucu

SEQ ID NO: 106339 - RNA, 22 nt, Human
ugggaagaguuagagacagcug

SEQ ID NO: 106340 - RNA, 22 nt, Human
ugaacagugugagggugugacc

SEQ ID NO: 106341 - RNA, 22 nt, Human
ugggaagaggaggcagggggca

SEQ ID NO: 106342 - RNA, 22 nt, Human
ugggaaacucuaaacuugagua

SEQ ID NO: 106343 - RNA, 22 nt, Human
ugggaaaauugugauucuuucu

SEQ ID NO: 106344 - RNA, 22 nt, Human
ugaagacuucuuuuggucacca

SEQ ID NO: 106345 - RNA, 22 nt, Human
ugaagccaugcuaaauguuaca

SEQ ID NO: 106346 - RNA, 21 nt, Human
ugaagcccugugaggugcuua

SEQ ID NO: 106347 - RNA, 22 nt, Human
ugggaugagcuauauagaaagu

SEQ ID NO: 106348 - RNA, 22 nt, Human
ugggcagagggugaggaaggcg

SEQ ID NO: 106349 - RNA, 23 nt, Human
ugaagugaaauuucacaagggac

SEQ ID NO: 106350 - RNA, 22 nt, Human
ugaagguggcuugcagcuaguc

SEQ ID NO: 106351 - RNA, 22 nt, Human
ugaaggaggugaauccaugcau

SEQ ID NO: 106352 - RNA, 22 nt, Human
ugggcaaaugcuuuuuagucaa

SEQ ID NO: 106353 - RNA, 22 nt, Human
uggggaagaacuugccauuuca

SEQ ID NO: 106354 - RNA, 22 nt, Human
ugaauagcaccuugaguaauga

SEQ ID NO: 106355 - RNA, 22 nt, Human
ugaauagucaaagcacaagagg

SEQ ID NO: 106356 - RNA, 22 nt, Human
ugaauaaucuuggguauuaaua

SEQ ID NO: 106357 - RNA, 22 nt, Human
ugaauaaauaaacuuuuacuac

SEQ ID NO: 106358 - RNA, 22 nt, Human
ugaaugaagcacuguaauucuc

SEQ ID NO: 106359 - RNA, 22 nt, Human
ugaaugcuacccugcuggcucu

SEQ ID NO: 106360 - RNA, 22 nt, Human
ugaaugaacugaugaacuuaac

SEQ ID NO: 106361 - RNA, 22 nt, Human
ugacaagagaccccuccgcagg

SEQ ID NO: 106362 - RNA, 22 nt, Human
ugacaguuugacugcaaccuuu

SEQ ID NO: 106363 - RNA, 22 nt, Human
ugaauguguacacgauuguuug

SEQ ID NO: 106364 - RNA, 22 nt, Human
ugaauuagagugaaggaaagcu

SEQ ID NO: 106365 - RNA, 22 nt, Human
ugaauguggucaggaaauuguu

SEQ ID NO: 106366 - RNA, 22 nt, Human
ugaauuucuuuuuaaaauauua

SEQ ID NO: 106367 - RNA, 22 nt, Human
ugaauucaaacuuuuuaacaag

SEQ ID NO: 106368 - RNA, 22 nt, Human
ugaauuuguaggaauucuccau

SEQ ID NO: 106369 - RNA, 22 nt, Human
uggaguuuauuugaauucuugg

SEQ ID NO: 106370 - RNA, 22 nt, Human
ucuguucaugucuuuuuaagug

SEQ ID NO: 106371 - RNA, 22 nt, Human
uggaugagugaauggauaaauc

SEQ ID NO: 106372 - RNA, 22 nt, Human
uggauuagugcugaaaugaugg

SEQ ID NO: 106373 - RNA, 22 nt, Human
uggaugcuccaaguagaccuua

SEQ ID NO: 106374 - RNA, 22 nt, Human
uggaugccauuugauuaaggcu

SEQ ID NO: 106375 - RNA, 22 nt, Human
uggauucucuguagccugguuc

SEQ ID NO: 106376 - RNA, 22 nt, Human
uggauuguauugauugguuggc

SEQ ID NO: 106377 - RNA, 22 nt, Human
ucuuagacagagaagacuauug

SEQ ID NO: 106378 - RNA, 22 nt, Human
uggcagaaugaagacuggggcc

SEQ ID NO: 106379 - RNA, 22 nt, Human
uggcaguaaagcuggaaaagug

SEQ ID NO: 106380 - RNA, 22 nt, Human
ucuucuuuccuuuugugcauuu

SEQ ID NO: 106381 - RNA, 22 nt, Human
uggcaugugaauuguuacauug

SEQ ID NO: 106382 - RNA, 22 nt, Human
ucuucuuugugguugcccaagg

SEQ ID NO: 106383 - RNA, 20 nt, Human
ucuugucuggcagccuggag

SEQ ID NO: 106384 - RNA, 22 nt, Human
ucuugggcaguccucuacuggu

SEQ ID NO: 106385 - RNA, 19 nt, Human
ucuuucauuucuagcucug

SEQ ID NO: 106386 - RNA, 22 nt, Human
ucuuuauuucccuaacuugcua

SEQ ID NO: 106387 - RNA, 19 nt, Human
ugcugcaggaauucucaag

SEQ ID NO: 106388 - RNA, 22 nt, Human
uggaaagauuuaaaauaacgag

SEQ ID NO: 106389 - RNA, 17 nt, Human
ucugcagaggcaaaccu

SEQ ID NO: 106390 - RNA, 22 nt, Human
uggaaauagauguaggaaauug

SEQ ID NO: 106391 - RNA, 22 nt, Human
uggaaauaguugugagucaggc

SEQ ID NO: 106392 - RNA, 22 nt, Human
uggaaauacaagaaguauguca

SEQ ID NO: 106393 - RNA, 22 nt, Human
uggaaagcagcccugcucccca

SEQ ID NO: 106394 - RNA, 22 nt, Human
uggaaaggaguucuguuuauuu

SEQ ID NO: 106395 - RNA, 22 nt, Human
uggaacugguuugcuucagacu

SEQ ID NO: 106396 - RNA, 22 nt, Human
uggaagaagcuacaagcgguga

SEQ ID NO: 106397 - RNA, 22 nt, Human
uggagccugauggauaggaacg

SEQ ID NO: 106398 - RNA, 22 nt, Human
uggagccuugugagaccacaau

SEQ ID NO: 106399 - RNA, 22 nt, Human
uggagagcaggugaaggaaaga

SEQ ID NO: 106400 - RNA, 21 nt, Human
uggagcagggaggauuugggg

SEQ ID NO: 106401 - RNA, 22 nt, Human
uggagcuuuguguauuuuuaau

SEQ ID NO: 106402 - RNA, 22 nt, Human
ucugguuuggguugcuauggcu

SEQ ID NO: 106403 - RNA, 22 nt, Human
uggaaugaaagaaaaauuguag

SEQ ID NO: 106404 - RNA, 22 nt, Human
uggaagcccagaaggaagcaga

SEQ ID NO: 106405 - RNA, 22 nt, Human
ucgaugcuggcgcagguuucac

SEQ ID NO: 106406 - RNA, 22 nt, Human
ugcguuuaguuucaagacacgu

SEQ ID NO: 106407 - RNA, 22 nt, Human
ugcguggauuuaggagugaggg

SEQ ID NO: 106408 - RNA, 22 nt, Human
ugcuaucuagaaauacuggguu

SEQ ID NO: 106409 - RNA, 22 nt, Human
ugcuauuaagagaaagugaaca

SEQ ID NO: 106410 - RNA, 22 nt, Human
ugcuaaugagugcugugugaag

SEQ ID NO: 106411 - RNA, 22 nt, Human
ugcuagggcaggaggugaggag

SEQ ID NO: 106412 - RNA, 23 nt, Human
ugcucgccuucaggacuugggcu

SEQ ID NO: 106413 - RNA, 22 nt, Human
ucggcgaccugucauggaccaa

SEQ ID NO: 106414 - RNA, 22 nt, Human
ugcucagaagacuuacugguua

SEQ ID NO: 106415 - RNA, 22 nt, Human
ugcucacugcuuguguucaguu

SEQ ID NO: 106416 - RNA, 22 nt, Human
ucguauucagugcaagucaacg

SEQ ID NO: 106417 - RNA, 22 nt, Human
ugcucuuucaggcauagaccuu

SEQ ID NO: 106418 - RNA, 22 nt, Human
ugcugcacuuauggcucugagg

SEQ ID NO: 106419 - RNA, 22 nt, Human
ucuaacuaagcuuuaaaagguc

SEQ ID NO: 106420 - RNA, 22 nt, Human
uccuaaauuuguacuagcauuu

SEQ ID NO: 106421 - RNA, 21 nt, Human
uccuaaaggaaauacucaauu

SEQ ID NO: 106422 - RNA, 22 nt, Human
ucccuuuuuccugaucugugaa

SEQ ID NO: 106423 - RNA, 22 nt, Human
ugccagauuaugucuccagggc

SEQ ID NO: 106424 - RNA, 22 nt, Human
ugccaauuaccuauuucugaga

SEQ ID NO: 106425 - RNA, 22 nt, Human
ugcauucugggucgcagagugg

SEQ ID NO: 106426 - RNA, 22 nt, Human
ugcauugccauagcagggggau

SEQ ID NO: 106427 - RNA, 22 nt, Human
ugcauugccucuauucauuaua

SEQ ID NO: 106428 - RNA, 22 nt, Human
ugcauuacuuugauaagcgucu

SEQ ID NO: 106429 - RNA, 22 nt, Human
ugcccaaucaauuguagcuauu

SEQ ID NO: 106430 - RNA, 22 nt, Human
ugcccugucccuagguuugugg

SEQ ID NO: 106431 - RNA, 22 nt, Human
ugacuuuucuccucugaaguuu

SEQ ID NO: 106432 - RNA, 22 nt, Human
ugacuuauuaaaaguuuuuauu

SEQ ID NO: 106433 - RNA, 22 nt, Human
ugagggaagguugauaauguuc

SEQ ID NO: 106434 - RNA, 22 nt, Human
ugagggaugccucuccuuccgg

SEQ ID NO: 106435 - RNA, 22 nt, Human
ugagggauuucuggccuuaacu

SEQ ID NO: 106436 - RNA, 22 nt, Human
ugagguauuuggauuuauauuu

SEQ ID NO: 106437 - RNA, 22 nt, Human
ugagguuacauuaggaauaacc

SEQ ID NO: 106438 - RNA, 22 nt, Human
ucauaucauuuugaaagcugag

SEQ ID NO: 106439 - RNA, 22 nt, Human
ugagugacuguugucaagaugg

SEQ ID NO: 106440 - RNA, 22 nt, Human
ugagugugugcugcuuacauuc

SEQ ID NO: 106441 - RNA, 22 nt, Human
ugaguguuguaaccauaugauu

SEQ ID NO: 106442 - RNA, 22 nt, Human
ugaguuagcucuauucuuuugg

SEQ ID NO: 106443 - RNA, 22 nt, Human
ugaguucugacugagcaugggg

SEQ ID NO: 106444 - RNA, 22 nt, Human
ugaguugucacaacgucacaag

SEQ ID NO: 106445 - RNA, 22 nt, Human
ugauagcaugcucucaguaaaa

SEQ ID NO: 106446 - RNA, 22 nt, Human
ugaguuuuggaagauguuacag

SEQ ID NO: 106447 - RNA, 22 nt, Human
ucauuagcuaucagaguggaac

SEQ ID NO: 106448 - RNA, 22 nt, Human
ucauuagaccucucugguucag

SEQ ID NO: 106449 - RNA, 22 nt, Human
ucauuagucuuuaauacauaau

SEQ ID NO: 106450 - RNA, 22 nt, Human
ucauuagauuccugugguggau

SEQ ID NO: 106451 - RNA, 22 nt, Human
ucauuauuuggaauaugggacu

SEQ ID NO: 106452 - RNA, 22 nt, Human
ugauaguaucugauuauuucac

SEQ ID NO: 106453 - RNA, 22 nt, Human
ucauucucucguauucgcgaau

SEQ ID NO: 106454 - RNA, 20 nt, Human
ucauucagaaucaguaugca

SEQ ID NO: 106455 - RNA, 22 nt, Human
ucauuauuuugauguauuuccu

SEQ ID NO: 106456 - RNA, 22 nt, Human
ucauuggagcauaugaugguua

SEQ ID NO: 106457 - RNA, 22 nt, Human
uccacaaagucuaugagaguug

SEQ ID NO: 106458 - RNA, 22 nt, Human
uccaaguuugagacugagagug

SEQ ID NO: 106459 - RNA, 22 nt, Human
uccaaauucccaugacagaagu

SEQ ID NO: 106460 - RNA, 22 nt, Human
ugaugcuagaacuuccaagaua

SEQ ID NO: 106461 - RNA, 22 nt, Human
uccaagcgcuucuggagcuccu

SEQ ID NO: 106462 - RNA, 22 nt, Human
ucauuuaucgcugccuuuuaaa

SEQ ID NO: 106463 - RNA, 22 nt, Human
ugaucuuugcuuuuggcuuagu

SEQ ID NO: 106464 - RNA, 22 nt, Human
ucauuuaauuuggaacucagag

SEQ ID NO: 106465 - RNA, 22 nt, Human
uccacuaucugagcuuaguugc

SEQ ID NO: 106466 - RNA, 23 nt, Human
uccaguagcuacgcaggguggag

SEQ ID NO: 106467 - RNA, 20 nt, Human
uccaguuuuggagacauucu

SEQ ID NO: 106468 - RNA, 22 nt, Human
ugcaaaaguuuuauacacagau

SEQ ID NO: 106469 - RNA, 22 nt, Human
uccagaaaucucuguugauugu

SEQ ID NO: 106470 - RNA, 22 nt, Human
uccagacucaaaaaccagaugg

SEQ ID NO: 106471 - RNA, 22 nt, Human
ugcacccacuuagcugaaguuc

SEQ ID NO: 106472 - RNA, 22 nt, Human
ugcacauuucucacaauguaca

SEQ ID NO: 106473 - RNA, 22 nt, Human
ugcacagagggaggcauaaaau

SEQ ID NO: 106474 - RNA, 22 nt, Human
uccauuuacuauucucauaucg

SEQ ID NO: 106475 - RNA, 22 nt, Human
ugcaaggcacccacucugcuuu

SEQ ID NO: 106476 - RNA, 22 nt, Human
uccauuagagaugcuaaaggac

SEQ ID NO: 106477 - RNA, 22 nt, Human
ugcaacuacccccaggauuuua

SEQ ID NO: 106478 - RNA, 22 nt, Human
ucccagaaccuuuuagcuucac

SEQ ID NO: 106479 - RNA, 22 nt, Human
ugcacgcacuugcucuccagcg

SEQ ID NO: 106480 - RNA, 22 nt, Human
ugcagcgugaggacagcugagc

SEQ ID NO: 106481 - RNA, 19 nt, Human
ugcagcuguaugagcuuaa

SEQ ID NO: 106482 - RNA, 21 nt, Human
ucuagaugggaugaaaggugc

SEQ ID NO: 106483 - RNA, 22 nt, Human
ucuacgugacagaacagacuga

SEQ ID NO: 106484 - RNA, 22 nt, Human
ucuaaucuacaaaaggaaauuc

SEQ ID NO: 106485 - RNA, 22 nt, Human
uagugggguccacuuccuucac

SEQ ID NO: 106486 - RNA, 22 nt, Human
uaguggaaacagacugagcccg

SEQ ID NO: 106487 - RNA, 22 nt, Human
ucuugcuggagucaaggcuaca

SEQ ID NO: 106488 - RNA, 19 nt, Human
ucuugaggaaaguaaggca

SEQ ID NO: 106489 - RNA, 22 nt, Human
ucuugauggugauguuguguca

SEQ ID NO: 106490 - RNA, 22 nt, Human
ucuucuuacauuaaguugaaac

SEQ ID NO: 106491 - RNA, 22 nt, Human
uauuguauuagcucuuggagau

SEQ ID NO: 106492 - RNA, 22 nt, Human
uauugguagauggagagagaca

SEQ ID NO: 106493 - RNA, 22 nt, Human
uauugauuuuguugcuaccugg

SEQ ID NO: 106494 - RNA, 22 nt, Human
ucuuuaaauucuuaugagugaa

SEQ ID NO: 106495 - RNA, 23 nt, Human
ucuuuccuuucauacagucagcu

SEQ ID NO: 106496 - RNA, 22 nt, Human
ucuuucucauccaaacuaguug

SEQ ID NO: 106497 - RNA, 22 nt, Human
ucuuuccagaccagccccagcu

SEQ ID NO: 106498 - RNA, 22 nt, Human
ucuuggcaguucuugugcuuuu

SEQ ID NO: 106499 - RNA, 22 nt, Human
ucuuguuaaagguuaaagguga

SEQ ID NO: 106500 - RNA, 22 nt, Human
ucuugugagcugagauaaagcc

SEQ ID NO: 106501 - RNA, 22 nt, Human
ucuuggggagacuaguguuugg

SEQ ID NO: 106502 - RNA, 22 nt, Human
ucuuugcauggacauguguuuu

SEQ ID NO: 106503 - RNA, 22 nt, Human
ucuuugcugacacuuacacugu

SEQ ID NO: 106504 - RNA, 19 nt, Human
ucuuugcuuuucuaagagg

SEQ ID NO: 106505 - RNA, 22 nt, Human
uauuuaggcagaaagugauauu

SEQ ID NO: 106506 - RNA, 20 nt, Human
uauuucaaugugccaaguuu

SEQ ID NO: 106507 - RNA, 22 nt, Human
ucuuucugaugggaagggucaa

SEQ ID NO: 106508 - RNA, 22 nt, Human
ucuuugcagaauuuaacuuugc

SEQ ID NO: 106509 - RNA, 18 nt, Human
uauuuacuguguguuacc

SEQ ID NO: 106510 - RNA, 22 nt, Human
uauuuacuguguucaucccucu

SEQ ID NO: 106511 - RNA, 22 nt, Human
uauugugaaggccaugugcuaa

SEQ ID NO: 106512 - RNA, 22 nt, Human
uauuucuagggcaugaaaauaa

SEQ ID NO: 106513 - RNA, 22 nt, Human
uauuuccugcguuucugugagc

SEQ ID NO: 106514 - RNA, 22 nt, Human
uauuucaugagugaauaucuag

SEQ ID NO: 106515 - RNA, 22 nt, Human
uauuucaucugaacuucccaac

SEQ ID NO: 106516 - RNA, 22 nt, Human
ucuuuugugauuuucugaagca

SEQ ID NO: 106517 - RNA, 18 nt, Human
uauuugugugugugugug

SEQ ID NO: 106518 - RNA, 22 nt, Human
uauuuguuucuaguggcagcaa

SEQ ID NO: 106519 - RNA, 22 nt, Human
uauuuguuuuuaaugcugggug

SEQ ID NO: 106520 - RNA, 22 nt, Human
ucuuuuuaugucaaaaucgaug

SEQ ID NO: 106521 - RNA, 22 nt, Human
ucuuuuucccugguuccuuuuu

SEQ ID NO: 106522 - RNA, 22 nt, Human
uauuugauggaacucuugcuuu

SEQ ID NO: 106523 - RNA, 22 nt, Human
uauuuuggaugcauugagaugc

SEQ ID NO: 106524 - RNA, 22 nt, Human
uauuuuagccaacagaaugaug

SEQ ID NO: 106525 - RNA, 22 nt, Human
uauuuuagaagauuuggagaaa

SEQ ID NO: 106526 - RNA, 22 nt, Human
uauuuuauuuagguuuaguugu

SEQ ID NO: 106527 - RNA, 23 nt, Human
uauuuuccccuguaauauguauu

SEQ ID NO: 106528 - RNA, 22 nt, Human
ugaaaaaugcuuuaaugcaugu

SEQ ID NO: 106529 - RNA, 22 nt, Human
ugaaaugccucuuugguucuaa

SEQ ID NO: 106530 - RNA, 22 nt, Human
ugaaaggaauuuaaauguuguu

SEQ ID NO: 106531 - RNA, 22 nt, Human
ugaaauguggagaugguaagua

SEQ ID NO: 106532 - RNA, 22 nt, Human
ugaacuguccuuguugucuaga

SEQ ID NO: 106533 - RNA, 22 nt, Human
ugaagaauuccauggcuuccau

SEQ ID NO: 106534 - RNA, 22 nt, Human
uauuuuuacuguuugaugauuc

SEQ ID NO: 106535 - RNA, 22 nt, Human
ugaaauuuuuuggagauaauuu

SEQ ID NO: 106536 - RNA, 21 nt, Human
ugaacaccaggagaaaucggu

SEQ ID NO: 106537 - RNA, 22 nt, Human
ugaaccgcuucauggugccugu

SEQ ID NO: 106538 - RNA, 22 nt, Human
ugaaccgacaggggaagauugu

SEQ ID NO: 106539 - RNA, 22 nt, Human
uauuuuuuuaacauuuauugua

SEQ ID NO: 106540 - RNA, 22 nt, Human
ucaaaaauaagauauucuggac

SEQ ID NO: 106541 - RNA, 22 nt, Human
ucaaaucuuuuuuccuucccug

SEQ ID NO: 106542 - RNA, 22 nt, Human
ucaaauaugggccagaggaaau

SEQ ID NO: 106543 - RNA, 22 nt, Human
ucaacauguuuuuuaaaagaaa

SEQ ID NO: 106544 - RNA, 22 nt, Human
ugaagccacacuagcuuguccu

SEQ ID NO: 106545 - RNA, 21 nt, Human
ugaagccuagagaauugggga

SEQ ID NO: 106546 - RNA, 21 nt, Human
ucaaccagguguugaaggcac

SEQ ID NO: 106547 - RNA, 22 nt, Human
ucaacagaagugauagcuauua

SEQ ID NO: 106548 - RNA, 22 nt, Human
ugaagcuaguauuaacucagau

SEQ ID NO: 106549 - RNA, 22 nt, Human
ucaagcaaggaauccuuuugua

SEQ ID NO: 106550 - RNA, 22 nt, Human
ucaagagauauaugcugguuua

SEQ ID NO: 106551 - RNA, 22 nt, Human
ucaagcuggaaaugaagaaucu

SEQ ID NO: 106552 - RNA, 22 nt, Human
ucaagcacugugcaaugagcuu

SEQ ID NO: 106553 - RNA, 22 nt, Human
ugaaguuuagaaaaagugccuu

SEQ ID NO: 106554 - RNA, 22 nt, Human
ucaaggaagggguaggaauaau

SEQ ID NO: 106555 - RNA, 21 nt, Human
ugaagggugagauauaaguga

SEQ ID NO: 106556 - RNA, 22 nt, Human
ugaaggggaaagucuugcuaua

SEQ ID NO: 106557 - RNA, 22 nt, Human
ugaaucuuguuuacugauuccu

SEQ ID NO: 106558 - RNA, 22 nt, Human
ugaaucugagccugcgcaaagu

SEQ ID NO: 106559 - RNA, 22 nt, Human
ugaaucaaugaauugcacuuca

SEQ ID NO: 106560 - RNA, 22 nt, Human
ucaauuggcuacaaauaaugua

SEQ ID NO: 106561 - RNA, 22 nt, Human
ucaauuuauguggcuauucauu

SEQ ID NO: 106562 - RNA, 22 nt, Human
ucacuggauucauguuucuuua

SEQ ID NO: 106563 - RNA, 22 nt, Human
ugaauuauaugguauugaacau

SEQ ID NO: 106564 - RNA, 22 nt, Human
ucacucuuuaucuuuuaugucu

SEQ ID NO: 106565 - RNA, 22 nt, Human
ucacugaacucucauagagaaa

SEQ ID NO: 106566 - RNA, 22 nt, Human
ugaaucagaccuucauugggua

SEQ ID NO: 106567 - RNA, 22 nt, Human
ucacauggauuaacucauuuau

SEQ ID NO: 106568 - RNA, 22 nt, Human
ugaauuacacugggaucagggc

SEQ ID NO: 106569 - RNA, 22 nt, Human
ugaauggugcccuagagggaug

SEQ ID NO: 106570 - RNA, 22 nt, Human
ucagaacuaacuuugcugaacc

SEQ ID NO: 106571 - RNA, 22 nt, Human
ucacuuccuugcagcuguagaa

SEQ ID NO: 106572 - RNA, 23 nt, Human
ucacuucucuuacccucucucug

SEQ ID NO: 106573 - RNA, 22 nt, Human
ugaauuuuaacauucugcugga

SEQ ID NO: 106574 - RNA, 22 nt, Human
ugaauuuuggcaauuuucugug

SEQ ID NO: 106575 - RNA, 18 nt, Human
ucagaaugauuuggugga

SEQ ID NO: 106576 - RNA, 22 nt, Human
ucagcaggugcuuuguuuacuc

SEQ ID NO: 106577 - RNA, 22 nt, Human
ugaccuuuuuaaauuauuuuua

SEQ ID NO: 106578 - RNA, 22 nt, Human
ucagcaaugggauucaggcuuu

SEQ ID NO: 106579 - RNA, 22 nt, Human
ucagauagcaagggauaccugu

SEQ ID NO: 106580 - RNA, 22 nt, Human
ucagcacagcugcuuuuacuuc

SEQ ID NO: 106581 - RNA, 22 nt, Human
ugacuaauacagaaacuacaag

SEQ ID NO: 106582 - RNA, 22 nt, Human
ucagcguuaguuuuucaucuaa

SEQ ID NO: 106583 - RNA, 22 nt, Human
uaguuagaucuccaguuugguu

SEQ ID NO: 106584 - RNA, 22 nt, Human
uaguuuucaagugaguuggaag

SEQ ID NO: 106585 - RNA, 22 nt, Human
uaguuucuaauguugaaauuau

SEQ ID NO: 106586 - RNA, 23 nt, Human
uaguuucaucuccacccugcccu

SEQ ID NO: 106587 - RNA, 22 nt, Human
uagcauacagauauuuaacucu

SEQ ID NO: 106588 - RNA, 22 nt, Human
gugcuaugugcugaacucaggu

SEQ ID NO: 106589 - RNA, 22 nt, Human
uauaaugucuuuguugaaaucu

SEQ ID NO: 106590 - RNA, 18 nt, Human
uauaaacacacuuagguu

SEQ ID NO: 106591 - RNA, 22 nt, Human
uauaaagaccuuauccuucaua

SEQ ID NO: 106592 - RNA, 22 nt, Human
uauaagaaacaaggcaaauuuu

SEQ ID NO: 106593 - RNA, 22 nt, Human
uauauauaauguguacagguga

SEQ ID NO: 106594 - RNA, 22 nt, Human
uauauauacauauagaauaugu

SEQ ID NO: 106595 - RNA, 22 nt, Human
uauaggugagugaagcucagga

SEQ ID NO: 106596 - RNA, 22 nt, Human
uauagcaagagaaccauuacca

SEQ ID NO: 106597 - RNA, 22 nt, Human
uauauguagcucaaaaauuccc

SEQ ID NO: 106598 - RNA, 22 nt, Human
uauauauaugcaccacaugugu

SEQ ID NO: 106599 - RNA, 22 nt, Human
uauaugcacucagguguaugug

SEQ ID NO: 106600 - RNA, 22 nt, Human
uaucaguccaggguuuugugac

SEQ ID NO: 106601 - RNA, 22 nt, Human
uauccuaaaggguaguguggga

SEQ ID NO: 106602 - RNA, 23 nt, Human
uaucccauacagagagugguaca

SEQ ID NO: 106603 - RNA, 22 nt, Human
uauccuaagguaguuuuaguuu

SEQ ID NO: 106604 - RNA, 22 nt, Human
uauuuugaggugaaagaguuug

SEQ ID NO: 106605 - RNA, 22 nt, Human
uauuuuggcuccugagcucuga

SEQ ID NO: 106606 - RNA, 22 nt, Human
guugauaauuaauagcuuuuga

SEQ ID NO: 106607 - RNA, 22 nt, Human
guugauuuaaccucaccuuuga

SEQ ID NO: 106608 - RNA, 22 nt, Human
guucuuuacuucgcaucugcua

SEQ ID NO: 106609 - RNA, 22 nt, Human
uauuuguauugucuuaucacuu

SEQ ID NO: 106610 - RNA, 22 nt, Human
uauuucaguuaagaugagguca

SEQ ID NO: 106611 - RNA, 22 nt, Human
uauuuaugcaucacuuuuuucc

SEQ ID NO: 106612 - RNA, 22 nt, Human
uauuuacgcaaacaauugugca

SEQ ID NO: 106613 - RNA, 22 nt, Human
uauuuaaagucagcaacuuuuc

SEQ ID NO: 106614 - RNA, 22 nt, Human
uauuuacuuugaggaaguuguu

SEQ ID NO: 106615 - RNA, 22 nt, Human
guucuacaugacacucaacauu

SEQ ID NO: 106616 - RNA, 22 nt, Human
uauugucuuuuucuuccaccug

SEQ ID NO: 106617 - RNA, 22 nt, Human
uauuggcucagucagaaguuuu

SEQ ID NO: 106618 - RNA, 22 nt, Human
uauucuucagcauaaaaauucu

SEQ ID NO: 106619 - RNA, 22 nt, Human
uauugaucuuugaaaccuuggu

SEQ ID NO: 106620 - RNA, 22 nt, Human
uauuguuuuaagguguauuaau

SEQ ID NO: 106621 - RNA, 22 nt, Human
uauggcucacaaauaauaaauu

SEQ ID NO: 106622 - RNA, 22 nt, Human
uaugggaaggauuugucuuuca

SEQ ID NO: 106623 - RNA, 22 nt, Human
uaugguuagugcuguagauuau

SEQ ID NO: 106624 - RNA, 22 nt, Human
gugugugucuacuuucaucucu

SEQ ID NO: 106625 - RNA, 22 nt, Human
guguuaaucauuuuugauuuug

SEQ ID NO: 106626 - RNA, 22 nt, Human
guguuagagucuugugcucauu

SEQ ID NO: 106627 - RNA, 23 nt, Human
guuaccgaccugauucggcagcc

SEQ ID NO: 106628 - RNA, 22 nt, Human
uauguaacaccauuuacaaagu

SEQ ID NO: 106629 - RNA, 22 nt, Human
uauguguaauuaaauacuauag

SEQ ID NO: 106630 - RNA, 22 nt, Human
uauguuaaauguuugauguuua

SEQ ID NO: 106631 - RNA, 22 nt, Human
guuauuuugucuuguucaugaa

SEQ ID NO: 106632 - RNA, 22 nt, Human
uauuaaaagagaaaaagccacc

SEQ ID NO: 106633 - RNA, 22 nt, Human
guuauugggagagggaauggga

SEQ ID NO: 106634 - RNA, 22 nt, Human
guucccuugccuuuaguuugau

SEQ ID NO: 106635 - RNA, 18 nt, Human
uauuccucuuccucuauc

SEQ ID NO: 106636 - RNA, 22 nt, Human
uauucccacuccucagcaauuu

SEQ ID NO: 106637 - RNA, 22 nt, Human
uauucuucaacuuuucuccucu

SEQ ID NO: 106638 - RNA, 22 nt, Human
guuguuuucagcccagcauuag

SEQ ID NO: 106639 - RNA, 22 nt, Human
ucaagggaccaagcauucauua

SEQ ID NO: 106640 - RNA, 22 nt, Human
guuguugcuauguuauuguuau

SEQ ID NO: 106641 - RNA, 22 nt, Human
uauuuuuaccuaauuuaugaga

SEQ ID NO: 106642 - RNA, 22 nt, Human
guugauauggaaacucuagguu

SEQ ID NO: 106643 - RNA, 22 nt, Human
guugcaaaugggaagaugguua

SEQ ID NO: 106644 - RNA, 22 nt, Human
guugauuuaggguuuugguuuu

SEQ ID NO: 106645 - RNA, 22 nt, Human
guugucuggcucugaccauucu

SEQ ID NO: 106646 - RNA, 22 nt, Human
ucacaucugugugauugucauu

SEQ ID NO: 106647 - RNA, 22 nt, Human
ucacaagaagaaauuaaacugu

SEQ ID NO: 106648 - RNA, 23 nt, Human
ucacaaggcuauguuauauguac

SEQ ID NO: 106649 - RNA, 22 nt, Human
guuucucuuugguggguugaga

SEQ ID NO: 106650 - RNA, 22 nt, Human
guuugagcaaucccucuauccc

SEQ ID NO: 106651 - RNA, 22 nt, Human
guuugcagacuauguaaacuuc

SEQ ID NO: 106652 - RNA, 22 nt, Human
ucaccugccuggguggucaccu

SEQ ID NO: 106653 - RNA, 22 nt, Human
guuuauuucuuaucaucacuau

SEQ ID NO: 106654 - RNA, 22 nt, Human
guuuccuuuugugguuuuucua

SEQ ID NO: 106655 - RNA, 22 nt, Human
guuuggguggcuagagaaagaa

SEQ ID NO: 106656 - RNA, 22 nt, Human
ucacuuuacaucuguaaaagga

SEQ ID NO: 106657 - RNA, 22 nt, Human
ucaccuguucaacagcaauaau

SEQ ID NO: 106658 - RNA, 22 nt, Human
ucaccuguuggauguauacugu

SEQ ID NO: 106659 - RNA, 22 nt, Human
ucaccuuuugaauugcuguugu

SEQ ID NO: 106660 - RNA, 22 nt, Human
ucacuaugcccagaauacaguu

SEQ ID NO: 106661 - RNA, 23 nt, Human
ucacugccaagaaaaguuacaga

SEQ ID NO: 106662 - RNA, 22 nt, Human
ucacugaauuucaagcuagugg

SEQ ID NO: 106663 - RNA, 22 nt, Human
ucagauaauccaauagagagga

SEQ ID NO: 106664 - RNA, 22 nt, Human
ucagagaaguaggcuaauggug

SEQ ID NO: 106665 - RNA, 22 nt, Human
guucacaguauaucuuuuaacu

SEQ ID NO: 106666 - RNA, 22 nt, Human
guuuuucuagaaaucuccuccu

SEQ ID NO: 106667 - RNA, 22 nt, Human
guuuuuaguuuaaguuuuugca

SEQ ID NO: 106668 - RNA, 22 nt, Human
guuuucuuguuaauuuugaacg

SEQ ID NO: 106669 - RNA, 22 nt, Human
guuuugaugugauuucucaugu

SEQ ID NO: 106670 - RNA, 22 nt, Human
guuuuggagauguccauuuucc

SEQ ID NO: 106671 - RNA, 22 nt, Human
guuuugugugugugcccacacg

SEQ ID NO: 106672 - RNA, 22 nt, Human
guuuuuacuuccaaugcuauga

SEQ ID NO: 106673 - RNA, 20 nt, Human
ucagaaugugacccccaugg

SEQ ID NO: 106674 - RNA, 22 nt, Human
ucacuguaggaaucucuaaauu

SEQ ID NO: 106675 - RNA, 22 nt, Human
ucagaaggagagacagcgugga

SEQ ID NO: 106676 - RNA, 22 nt, Human
ucagaaugaaauuucuuucaga

SEQ ID NO: 106677 - RNA, 21 nt, Human
ucagaaucguuccagguagau

SEQ ID NO: 106678 - RNA, 22 nt, Human
guuuucuccugcuauacagugc

SEQ ID NO: 106679 - RNA, 22 nt, Human
guuugguucucauuguuuuucu

SEQ ID NO: 106680 - RNA, 22 nt, Human
guuuguuugccagcuuaguaaa

SEQ ID NO: 106681 - RNA, 22 nt, Human
guuuuaaucuccuuauuccuaa

SEQ ID NO: 106682 - RNA, 22 nt, Human
guuuuaucuauguaauuauaaa

SEQ ID NO: 106683 - RNA, 19 nt, Human
ucagcagauuuugcaaaca

SEQ ID NO: 106684 - RNA, 21 nt, Human
uaaaagaugacaagacagcuc

SEQ ID NO: 106685 - RNA, 22 nt, Human
uaaaacuaugcaaccuacuacc

SEQ ID NO: 106686 - RNA, 22 nt, Human
uaaaaccauucauugaccuaug

SEQ ID NO: 106687 - RNA, 23 nt, Human
guuuuugcugcagcugaagaagg

SEQ ID NO: 106688 - RNA, 22 nt, Human
uaaaaaccuuguauuuaacucu

SEQ ID NO: 106689 - RNA, 22 nt, Human
uaaaauaccacauauggugcuc

SEQ ID NO: 106690 - RNA, 22 nt, Human
ucagcguuggccuccuccaggg

SEQ ID NO: 106691 - RNA, 22 nt, Human
ucagcucacaauguugagaaag

SEQ ID NO: 106692 - RNA, 21 nt, Human
ucaggaagagccaguucaugc

SEQ ID NO: 106693 - RNA, 22 nt, Human
uaauucuacagggaacucugga

SEQ ID NO: 106694 - RNA, 22 nt, Human
uaauggagggucugagucuggg

SEQ ID NO: 106695 - RNA, 22 nt, Human
uacaaauugccugacggcaggu

SEQ ID NO: 106696 - RNA, 22 nt, Human
uacaaaugaucaucucuuugaa

SEQ ID NO: 106697 - RNA, 22 nt, Human
ucauuugggauuuuuuauaauu

SEQ ID NO: 106698 - RNA, 22 nt, Human
uaauucuucaauccaguguuca

SEQ ID NO: 106699 - RNA, 22 nt, Human
uaauucuagauugacauuuuga

SEQ ID NO: 106700 - RNA, 22 nt, Human
uccaacuuaauugggaagauua

SEQ ID NO: 106701 - RNA, 22 nt, Human
uacaaauuguuuugccacaaag

SEQ ID NO: 106702 - RNA, 22 nt, Human
uacaaauguuucuucuccuuuu

SEQ ID NO: 106703 - RNA, 22 nt, Human
uacaacuuacuugaauggcuuu

SEQ ID NO: 106704 - RNA, 23 nt, Human
ucauugcucaagauaaugguuga

SEQ ID NO: 106705 - RNA, 22 nt, Human
ucauugguugcauaauuugauc

SEQ ID NO: 106706 - RNA, 22 nt, Human
ucauugguugcguaauuugauu

SEQ ID NO: 106707 - RNA, 22 nt, Human
uaauccaaaccaggaauucccu

SEQ ID NO: 106708 - RNA, 22 nt, Human
uaaugcucauuuggcucugcaa

SEQ ID NO: 106709 - RNA, 22 nt, Human
uaaguuguagaacguuuucuua

SEQ ID NO: 106710 - RNA, 22 nt, Human
uaauaaaaauuuaauucacauu

SEQ ID NO: 106711 - RNA, 22 nt, Human
uaagugguagaaagagaaaggu

SEQ ID NO: 106712 - RNA, 22 nt, Human
uaagugugcauguguauuauau

SEQ ID NO: 106713 - RNA, 22 nt, Human
uaauaagugcuggcuguacauc

SEQ ID NO: 106714 - RNA, 21 nt, Human
uaauaauugggggcagggugg

SEQ ID NO: 106715 - RNA, 19 nt, Human
uaagaaucaccaggggugu

SEQ ID NO: 106716 - RNA, 22 nt, Human
uaagauuuuuacaaauagagug

SEQ ID NO: 106717 - RNA, 22 nt, Human
uaagagcagacacaaccugaga

SEQ ID NO: 106718 - RNA, 22 nt, Human
uaaagcacucaaaauuguagcu

SEQ ID NO: 106719 - RNA, 22 nt, Human
uaaagaggagaauuaagucagc

SEQ ID NO: 106720 - RNA, 21 nt, Human
uaagaacauuaucuucuuccu

SEQ ID NO: 106721 - RNA, 22 nt, Human
ucaucuuuauaaugcaaguuuu

SEQ ID NO: 106722 - RNA, 22 nt, Human
uaaggcuuuggucaccauggag

SEQ ID NO: 106723 - RNA, 21 nt, Human
uaagccaccaugugaaaccag

SEQ ID NO: 106724 - RNA, 22 nt, Human
uccacuaucagaccuguagucu

SEQ ID NO: 106725 - RNA, 22 nt, Human
uacagauaaaaaugcuguucuu

SEQ ID NO: 106726 - RNA, 22 nt, Human
uacaccaugcuccagcaggaca

SEQ ID NO: 106727 - RNA, 22 nt, Human
uacauagaauauauaaaugucg

SEQ ID NO: 106728 - RNA, 22 nt, Human
uacauuguguuaaaacagaaga

SEQ ID NO: 106729 - RNA, 21 nt, Human
uaccacugaaauugaucguuc

SEQ ID NO: 106730 - RNA, 22 nt, Human
uaccaauuaaauagccaaucua

SEQ ID NO: 106731 - RNA, 22 nt, Human
uccagagcuguccuacugugag

SEQ ID NO: 106732 - RNA, 22 nt, Human
uccacuuaaaacucuuuuuguc

SEQ ID NO: 106733 - RNA, 22 nt, Human
uccagaaagccguugacuuauu

SEQ ID NO: 106734 - RNA, 22 nt, Human
uacugguguauuucuucuuauu

SEQ ID NO: 106735 - RNA, 22 nt, Human
ucccaaaacuugaagcaagccu

SEQ ID NO: 106736 - RNA, 22 nt, Human
uccauugucaauaguauugauu

SEQ ID NO: 106737 - RNA, 22 nt, Human
uacucgaaaucagagagaauaa

SEQ ID NO: 106738 - RNA, 21 nt, Human
uccauucuuggugguucugca

SEQ ID NO: 106739 - RNA, 22 nt, Human
uacucucuuccauacaaucugu

SEQ ID NO: 106740 - RNA, 22 nt, Human
ucccaccugcuaagauguaucc

SEQ ID NO: 106741 - RNA, 23 nt, Human
ucccacauuucacagcacuuucc

SEQ ID NO: 106742 - RNA, 22 nt, Human
ucccaagugcuccucuggcccc

SEQ ID NO: 106743 - RNA, 22 nt, Human
uacugucuuuuccuaaaugggu

SEQ ID NO: 106744 - RNA, 22 nt, Human
ucccagaacggguucuucccag

SEQ ID NO: 106745 - RNA, 17 nt, Human
ucccacuucauuuucca

SEQ ID NO: 106746 - RNA, 22 nt, Human
uccaguggcaccuuggcccuca

SEQ ID NO: 106747 - RNA, 22 nt, Human
uccagugaacaucauggcucca

SEQ ID NO: 106748 - RNA, 22 nt, Human
uacucauuggagaauuacgagg

SEQ ID NO: 106749 - RNA, 22 nt, Human
uacuauuuugacaugaaauuga

SEQ ID NO: 106750 - RNA, 22 nt, Human
uccauaugaucuguuguauggu

SEQ ID NO: 106751 - RNA, 22 nt, Human
uacuaucauuuuuuguugccaa

SEQ ID NO: 106752 - RNA, 22 nt, Human
uccacuuaauagguauggagcc

SEQ ID NO: 106753 - RNA, 22 nt, Human
uaccuaacauugugcagagguu

SEQ ID NO: 106754 - RNA, 22 nt, Human
uaccgaagcugcuuuugcaugu

SEQ ID NO: 106755 - RNA, 22 nt, Human
uccuuuuuagguuauuguacau

SEQ ID NO: 106756 - RNA, 22 nt, Human
ucgaaugccaacaccgaaguuu

SEQ ID NO: 106757 - RNA, 22 nt, Human
ucgaaacuucucauuuaucugu

SEQ ID NO: 106758 - RNA, 22 nt, Human
ucgagauguuuguuguggugau

SEQ ID NO: 106759 - RNA, 22 nt, Human
uaggauugguguauguagguuu

SEQ ID NO: 106760 - RNA, 22 nt, Human
uaggguuucaugcugguuucca

SEQ ID NO: 106761 - RNA, 22 nt, Human
ucgcuuuaauggucuucacagc

SEQ ID NO: 106762 - RNA, 22 nt, Human
uagguuguaagaggucuuuugu

SEQ ID NO: 106763 - RNA, 22 nt, Human
uagguuuugugucagaguagaa

SEQ ID NO: 106764 - RNA, 22 nt, Human
uagguuguuguggggauuaagu

SEQ ID NO: 106765 - RNA, 22 nt, Human
uagguauguuaacugugcaauu

SEQ ID NO: 106766 - RNA, 22 nt, Human
uagggucucccuuuaaucuaac

SEQ ID NO: 106767 - RNA, 22 nt, Human
ucgggcgaauguuguuuuucuc

SEQ ID NO: 106768 - RNA, 22 nt, Human
uaguaauauuccuacauuaugu

SEQ ID NO: 106769 - RNA, 22 nt, Human
ucuaaaugaccuccuugcccag

SEQ ID NO: 106770 - RNA, 22 nt, Human
ucuaaagcuccuuccacuaaaa

SEQ ID NO: 106771 - RNA, 22 nt, Human
ucuaaaaauuagaaauuagguc

SEQ ID NO: 106772 - RNA, 20 nt, Human
uagugaccaagagggcugcu

SEQ ID NO: 106773 - RNA, 22 nt, Human
uagucuuuguggucuuuagcua

SEQ ID NO: 106774 - RNA, 22 nt, Human
uagugcauaccuaacauuuuug

SEQ ID NO: 106775 - RNA, 22 nt, Human
ucuaauagauuuggaguggaaa

SEQ ID NO: 106776 - RNA, 22 nt, Human
uaguauuguguuguuugacagu

SEQ ID NO: 106777 - RNA, 22 nt, Human
uaguauuuguaauuaucaaagc

SEQ ID NO: 106778 - RNA, 20 nt, Human
uaguaugggagaagaucucc

SEQ ID NO: 106779 - RNA, 22 nt, Human
ucguguuggaacugcuuuguaa

SEQ ID NO: 106780 - RNA, 22 nt, Human
ucgugaagaaauguggacuuca

SEQ ID NO: 106781 - RNA, 22 nt, Human
uagccuguuuuuaugagaauuu

SEQ ID NO: 106782 - RNA, 22 nt, Human
uccuuggagaaucuuguuuuac

SEQ ID NO: 106783 - RNA, 23 nt, Human
uccugcagauaagcugguugaca

SEQ ID NO: 106784 - RNA, 21 nt, Human
uccugcagggcagcagagugg

SEQ ID NO: 106785 - RNA, 22 nt, Human
uagcaaucugugaugugugugu

SEQ ID NO: 106786 - RNA, 22 nt, Human
uagcauaaaguuucuguguggu

SEQ ID NO: 106787 - RNA, 22 nt, Human
uagcaggaggcaguuccucgcu

SEQ ID NO: 106788 - RNA, 22 nt, Human
uagcauuucacugaucuucacu

SEQ ID NO: 106789 - RNA, 22 nt, Human
uagccaaguguuuuucaugacc

SEQ ID NO: 106790 - RNA, 22 nt, Human
uagcauuuauugggcuagcaaa

SEQ ID NO: 106791 - RNA, 22 nt, Human
uagcauuuagaacaccuugaga

SEQ ID NO: 106792 - RNA, 22 nt, Human
uacuucauucaaguucgcuaua

SEQ ID NO: 106793 - RNA, 22 nt, Human
uacuucaguuacaugaagguau

SEQ ID NO: 106794 - RNA, 22 nt, Human
uacuuaauuuuaaaagcuagau

SEQ ID NO: 106795 - RNA, 22 nt, Human
uagaagaugccuuaaaguugaa

SEQ ID NO: 106796 - RNA, 22 nt, Human
uagaagagcuuccaccuggggc

SEQ ID NO: 106797 - RNA, 22 nt, Human
uagaaguagaaucauuagggcu

SEQ ID NO: 106798 - RNA, 22 nt, Human
uagaaugggaggggaaucaucc

SEQ ID NO: 106799 - RNA, 19 nt, Human
uagacagauuuguguuacu

SEQ ID NO: 106800 - RNA, 22 nt, Human
uccucacaugcaaaaugguauu

SEQ ID NO: 106801 - RNA, 19 nt, Human
uagagcagcuucagauucc

SEQ ID NO: 106802 - RNA, 19 nt, Human
uagacuaauucauccccuu

SEQ ID NO: 106803 - RNA, 22 nt, Human
uagagaaauuacagcuuucuuu

SEQ ID NO: 106804 - RNA, 22 nt, Human
gugauuucaaauauagagugag

SEQ ID NO: 106805 - RNA, 22 nt, Human
uagagaaauauuuguagugcug

SEQ ID NO: 106806 - RNA, 22 nt, Human
uagacuuggaagagacauugga

SEQ ID NO: 106807 - RNA, 19 nt, Human
gugaugaugccacuccaac

SEQ ID NO: 106808 - RNA, 22 nt, Human
gugauggucgagcgcuuguugu

SEQ ID NO: 106809 - RNA, 22 nt, Human
uacuuagagucgggaugcacaa

SEQ ID NO: 106810 - RNA, 22 nt, Human
gugaguguguccgacuccaagg

SEQ ID NO: 106811 - RNA, 22 nt, Human
gugaggcccaggugaaauuaac

SEQ ID NO: 106812 - RNA, 22 nt, Human
uagaaguuaaaggaauacagaa

SEQ ID NO: 106813 - RNA, 19 nt, Human
gugauauuuauuauuuauu

SEQ ID NO: 106814 - RNA, 22 nt, Human
uagacauuuacuuugaaaaaau

SEQ ID NO: 106815 - RNA, 22 nt, Human
gugccgcuggagcuggaauuga

SEQ ID NO: 106816 - RNA, 22 nt, Human
uagauuuaaaaagggugggaug

SEQ ID NO: 106817 - RNA, 20 nt, Human
uagcacagacuuuugcuuac

SEQ ID NO: 106818 - RNA, 22 nt, Human
uagcagcacuauuuguuguagu

SEQ ID NO: 106819 - RNA, 20 nt, Human
gugcggcucuaccacucggu

SEQ ID NO: 106820 - RNA, 22 nt, Human
gugcaaugaguguggcaaagcc

SEQ ID NO: 106821 - RNA, 22 nt, Human
gugcacagaaacauacaaugug

SEQ ID NO: 106822 - RNA, 22 nt, Human
uagaggccguagguggcugguu

SEQ ID NO: 106823 - RNA, 22 nt, Human
uagaguaagugugugcugagcu

SEQ ID NO: 106824 - RNA, 22 nt, Human
gugcaucuguaauuacaauggu

SEQ ID NO: 106825 - RNA, 22 nt, Human
uagaugcugagcuuaagagaau

SEQ ID NO: 106826 - RNA, 22 nt, Human
uacccauuuugguucuugaugc

SEQ ID NO: 106827 - RNA, 22 nt, Human
uaccauaaagcaggcaaaugag

SEQ ID NO: 106828 - RNA, 22 nt, Human
uacaggaggaugugcagccagg

SEQ ID NO: 106829 - RNA, 22 nt, Human
uacagugaggcgagauucacca

SEQ ID NO: 106830 - RNA, 22 nt, Human
uacagauggacacuguuucaag

SEQ ID NO: 106831 - RNA, 22 nt, Human
uacugaaagagugguggacucu

SEQ ID NO: 106832 - RNA, 22 nt, Human
uacugagcauaaaacccauacu

SEQ ID NO: 106833 - RNA, 22 nt, Human
gugaagcacaugggcguugggu

SEQ ID NO: 106834 - RNA, 21 nt, Human
uacugugccagggcagcucug

SEQ ID NO: 106835 - RNA, 22 nt, Human
uacuuaaaacacauuuagcauu

SEQ ID NO: 106836 - RNA, 22 nt, Human
uacugcaguuccugcugucucc

SEQ ID NO: 106837 - RNA, 22 nt, Human
uacuggaugcaacaaagcccag

SEQ ID NO: 106838 - RNA, 20 nt, Human
uacaauauucccacuuugcu

SEQ ID NO: 106839 - RNA, 22 nt, Human
gucucuuuugauuuuucacuca

SEQ ID NO: 106840 - RNA, 22 nt, Human
gucugaaauaucuuuugucuug

SEQ ID NO: 106841 - RNA, 22 nt, Human
uacacacacaugcauguacgug

SEQ ID NO: 106842 - RNA, 22 nt, Human
uacaagcucuuguagggggaaa

SEQ ID NO: 106843 - RNA, 22 nt, Human
uacaauguucgcauucucucug

SEQ ID NO: 106844 - RNA, 22 nt, Human
uacaaucaggcucuagcuucuc

SEQ ID NO: 106845 - RNA, 22 nt, Human
uaauaauuaacagugauggguc

SEQ ID NO: 106846 - RNA, 22 nt, Human
uaauaacuacacucagaggacc

SEQ ID NO: 106847 - RNA, 22 nt, Human
gucuauaaccuuuccaauuacc

SEQ ID NO: 106848 - RNA, 22 nt, Human
gucuauucaucauucaucaaac

SEQ ID NO: 106849 - RNA, 22 nt, Human
uaauagauagggagaguugcug

SEQ ID NO: 106850 - RNA, 22 nt, Human
guugcuaugaaauuaaaauuua

SEQ ID NO: 106851 - RNA, 22 nt, Human
guuuuagugauaagaacaccaa

SEQ ID NO: 106852 - RNA, 22 nt, Human
guuuuauaacuauagugagaau

SEQ ID NO: 106853 - RNA, 22 nt, Human
ggucaauuuggucaaucguuua

SEQ ID NO: 106854 - RNA, 22 nt, Human
ggucaaauaugaguaauuuccu

SEQ ID NO: 106855 - RNA, 22 nt, Human
gguauccaaauaaagcagguaa

SEQ ID NO: 106856 - RNA, 22 nt, Human
gguggcauucaguaaguauaua

SEQ ID NO: 106857 - RNA, 22 nt, Human
guuuucuaaaacacauauaagu

SEQ ID NO: 106858 - RNA, 22 nt, Human
guuuuauguuuuauagacacaa

SEQ ID NO: 106859 - RNA, 22 nt, Human
guuuuguucaugaacauugggu

SEQ ID NO: 106860 - RNA, 22 nt, Human
guuuuguagucuggagacuguc

SEQ ID NO: 106861 - RNA, 22 nt, Human
guuuugaagagaagcaagucug

SEQ ID NO: 106862 - RNA, 22 nt, Human
guuuugauggaguguguuaaau

SEQ ID NO: 106863 - RNA, 22 nt, Human
uaaagacaauuucgagcuguag

SEQ ID NO: 106864 - RNA, 23 nt, Human
uaaagauaguuuaaaggugaguu

SEQ ID NO: 106865 - RNA, 23 nt, Human
gguuggcuguacccaggcucccu

SEQ ID NO: 106866 - RNA, 21 nt, Human
gguuucugcaaaccuuguaca

SEQ ID NO: 106867 - RNA, 22 nt, Human
uaaaugaaaugaagugaaagcu

SEQ ID NO: 106868 - RNA, 22 nt, Human
uaaaugcucuuuaaaagugcuu

SEQ ID NO: 106869 - RNA, 22 nt, Human
uaaaggaccuguacuagguuua

SEQ ID NO: 106870 - RNA, 22 nt, Human
guaaauacuaugagauaaugaa

SEQ ID NO: 106871 - RNA, 22 nt, Human
guaaauaucucacgaaugauuc

SEQ ID NO: 106872 - RNA, 22 nt, Human
uaaagaagaaaaggcuucaggc

SEQ ID NO: 106873 - RNA, 22 nt, Human
uaaacugacagugagggagagu

SEQ ID NO: 106874 - RNA, 22 nt, Human
gguucaaagccugaugggguug

SEQ ID NO: 106875 - RNA, 22 nt, Human
gguuauuucugauuauaugaua

SEQ ID NO: 106876 - RNA, 22 nt, Human
gguguuaaccagcuaaaguuug

SEQ ID NO: 106877 - RNA, 22 nt, Human
uaaaaguuagcuaggacaaagu

SEQ ID NO: 106878 - RNA, 22 nt, Human
guuuuucuuugauuuagaacca

SEQ ID NO: 106879 - RNA, 21 nt, Human
uaaggaagagcauuuuagguc

SEQ ID NO: 106880 - RNA, 22 nt, Human
uaagcuauuccugaagaagguu

SEQ ID NO: 106881 - RNA, 22 nt, Human
gucaagaugcuacauaauggga

SEQ ID NO: 106882 - RNA, 22 nt, Human
gucagauucuuucauuugcuga

SEQ ID NO: 106883 - RNA, 22 nt, Human
gucaaugcuuaguuugccugaa

SEQ ID NO: 106884 - RNA, 22 nt, Human
guauuuggacugccuguucauu

SEQ ID NO: 106885 - RNA, 22 nt, Human
uaagcguuugggaguuaugaac

SEQ ID NO: 106886 - RNA, 23 nt, Human
uaagccacgugacccuuuauuug

SEQ ID NO: 106887 - RNA, 22 nt, Human
guaugugguaccaugcaacggg

SEQ ID NO: 106888 - RNA, 22 nt, Human
uaagauauugagugguaauuug

SEQ ID NO: 106889 - RNA, 23 nt, Human
uaagccugugccugcuaccugcu

SEQ ID NO: 106890 - RNA, 22 nt, Human
guauuaugaaugccgaggcggc

SEQ ID NO: 106891 - RNA, 21 nt, Human
guaucuuucuuuuaaaauauc

SEQ ID NO: 106892 - RNA, 22 nt, Human
uaagaaacauuuuuaugacagu

SEQ ID NO: 106893 - RNA, 22 nt, Human
uaacuuuuuauccuguuaaaug

SEQ ID NO: 106894 - RNA, 22 nt, Human
guauauuuaugagcauuagccu

SEQ ID NO: 106895 - RNA, 22 nt, Human
guaguuuucaugguuagaaaua

SEQ ID NO: 106896 - RNA, 22 nt, Human
guauaaagaugccauacuuacu

SEQ ID NO: 106897 - RNA, 22 nt, Human
uaacucugcuguggaaauggga

SEQ ID NO: 106898 - RNA, 22 nt, Human
uaacuuuucuguucaauuuucc

SEQ ID NO: 106899 - RNA, 22 nt, Human
guaggugggcuuccaagguccu

SEQ ID NO: 106900 - RNA, 22 nt, Human
guaguggaauuuagaguauaau

SEQ ID NO: 106901 - RNA, 22 nt, Human
guagucuuaggaaugauuuugu

SEQ ID NO: 106902 - RNA, 22 nt, Human
guaaugcuuuuauuucggggaa

SEQ ID NO: 106903 - RNA, 22 nt, Human
uaaauuugugaauuagcuauca

SEQ ID NO: 106904 - RNA, 23 nt, Human
uaaauuuuauucugauaacacag

SEQ ID NO: 106905 - RNA, 22 nt, Human
uaacauuuaguuuuaagauggu

SEQ ID NO: 106906 - RNA, 22 nt, Human
uaacccaaaggcaaugucucga

SEQ ID NO: 106907 - RNA, 22 nt, Human
uaacauuucggugacaguggga

SEQ ID NO: 106908 - RNA, 22 nt, Human
uaaccuugaagacugagcugac

SEQ ID NO: 106909 - RNA, 22 nt, Human
guguuuugagaggaugguuuua

SEQ ID NO: 106910 - RNA, 22 nt, Human
ggggauuucccaaugcgaagca

SEQ ID NO: 106911 - RNA, 17 nt, Human
ggggcguguauuugaug

SEQ ID NO: 106912 - RNA, 22 nt, Human
guuagaauggacaaagcugaaa

SEQ ID NO: 106913 - RNA, 21 nt, Human
guuaccacugaugcaacagga

SEQ ID NO: 106914 - RNA, 22 nt, Human
guuacagagcugcuaugugugc

SEQ ID NO: 106915 - RNA, 22 nt, Human
guuaaaggaagccauauguucg

SEQ ID NO: 106916 - RNA, 22 nt, Human
ggggaauaaacacuuugucacu

SEQ ID NO: 106917 - RNA, 22 nt, Human
guguugcaggaagauauagcug

SEQ ID NO: 106918 - RNA, 22 nt, Human
guguuggugagcucauuuccac

SEQ ID NO: 106919 - RNA, 22 nt, Human
guuauuguuauugcguugucga

SEQ ID NO: 106920 - RNA, 23 nt, Human
guuauugcuggugcuggccagcc

SEQ ID NO: 106921 - RNA, 22 nt, Human
guuauuaaauauuuuggugauu

SEQ ID NO: 106922 - RNA, 22 nt, Human
guucaaccaugauuaggaacug

SEQ ID NO: 106923 - RNA, 22 nt, Human
guucacauccuugugaggauuu

SEQ ID NO: 106924 - RNA, 22 nt, Human
guucaaggagcagcuugcuaca

SEQ ID NO: 106925 - RNA, 18 nt, Human
guucaagcauuuugcucu

SEQ ID NO: 106926 - RNA, 22 nt, Human
ggguauuugacaaacugacacu

SEQ ID NO: 106927 - RNA, 22 nt, Human
gggguuggaugccuuggaaauu

SEQ ID NO: 106928 - RNA, 22 nt, Human
gggggaaaguggagguucguga

SEQ ID NO: 106929 - RNA, 22 nt, Human
ggggcguugccacggggacggg

SEQ ID NO: 106930 - RNA, 22 nt, Human
guuacuacccacccuucucccc

SEQ ID NO: 106931 - RNA, 22 nt, Human
guucuguuguugaucuuuggag

SEQ ID NO: 106932 - RNA, 22 nt, Human
guucuccaggggcuguucaucu

SEQ ID NO: 106933 - RNA, 22 nt, Human
ggguggaaugugagugugugug

SEQ ID NO: 106934 - RNA, 22 nt, Human
ggguggcaagucuuucugcaac

SEQ ID NO: 106935 - RNA, 22 nt, Human
gggugcuucauaggugaugcug

SEQ ID NO: 106936 - RNA, 22 nt, Human
gggugguggagguuugacagac

SEQ ID NO: 106937 - RNA, 22 nt, Human
guucuuagguacucauauuuaa

SEQ ID NO: 106938 - RNA, 22 nt, Human
ggguggugauacugcuucugcc

SEQ ID NO: 106939 - RNA, 22 nt, Human
guucauuucaagucuaauccau

SEQ ID NO: 106940 - RNA, 22 nt, Human
guucuacaacuucgcuugcaga

SEQ ID NO: 106941 - RNA, 22 nt, Human
gguaacagaagagcacuuggca

SEQ ID NO: 106942 - RNA, 22 nt, Human
gguagauacaaaaagauugugg

SEQ ID NO: 106943 - RNA, 22 nt, Human
gguagggggaggagaagaaaaa

SEQ ID NO: 106944 - RNA, 22 nt, Human
guugagaaucucuagcuuagga

SEQ ID NO: 106945 - RNA, 22 nt, Human
guugagaagaccauuuuguuca

SEQ ID NO: 106946 - RNA, 22 nt, Human
guugaacagucacccugggagu

SEQ ID NO: 106947 - RNA, 22 nt, Human
guucuucucuuguaauggaauc

SEQ ID NO: 106948 - RNA, 22 nt, Human
ggguuuuaccagauguguggug

SEQ ID NO: 106949 - RNA, 22 nt, Human
guguguauguagguauauaugu

SEQ ID NO: 106950 - RNA, 22 nt, Human
gugugguguuaagcaaauuaau

SEQ ID NO: 106951 - RNA, 22 nt, Human
guguggcgacucagagcugccu

SEQ ID NO: 106952 - RNA, 22 nt, Human
gggcuguaggagcuggaauggg

SEQ ID NO: 106953 - RNA, 22 nt, Human
gggcuguggggccugcagaagg

SEQ ID NO: 106954 - RNA, 22 nt, Human
gggcuguuugcauauguuuaua

SEQ ID NO: 106955 - RNA, 22 nt, Human
gugucacuuucaggagcucuaa

SEQ ID NO: 106956 - RNA, 22 nt, Human
gugucuuauugauguuggcacu

SEQ ID NO: 106957 - RNA, 19 nt, Human
gggcucucugaauuuuuuu

SEQ ID NO: 106958 - RNA, 22 nt, Human
ggggaagaaauagaacauuuug

SEQ ID NO: 106959 - RNA, 22 nt, Human
ggggaaauauuucugaccugug

SEQ ID NO: 106960 - RNA, 22 nt, Human
guguuagcauggaacagaacgc

SEQ ID NO: 106961 - RNA, 22 nt, Human
guggugauuugggucuagcuuu

SEQ ID NO: 106962 - RNA, 22 nt, Human
guggucaagaccgggaauagga

SEQ ID NO: 106963 - RNA, 22 nt, Human
gggcgcaagcaugugucugggu

SEQ ID NO: 106964 - RNA, 22 nt, Human
guggguuggguuuuugaaggga

SEQ ID NO: 106965 - RNA, 22 nt, Human
guggugguguuggugacaaguu

SEQ ID NO: 106966 - RNA, 22 nt, Human
guguauuucuagaagaaaugaa

SEQ ID NO: 106967 - RNA, 22 nt, Human
guguagauuuguucaccuauua

SEQ ID NO: 106968 - RNA, 22 nt, Human
gugguuuagccuucauuaaccu

SEQ ID NO: 106969 - RNA, 23 nt, Human
gugguguaaaugccaaaaugaaa

SEQ ID NO: 106970 - RNA, 17 nt, Human
gugguguacauuuccau

SEQ ID NO: 106971 - RNA, 22 nt, Human
gugguuugacccuucagguaaa

SEQ ID NO: 106972 - RNA, 22 nt, Human
gugguuugcugguguacguuua

SEQ ID NO: 106973 - RNA, 22 nt, Human
guggcagagccuugcggcuuug

SEQ ID NO: 106974 - RNA, 22 nt, Human
guggcaguaaagcuggaaaagu

SEQ ID NO: 106975 - RNA, 22 nt, Human
guggauggagcuggaagccauu

SEQ ID NO: 106976 - RNA, 22 nt, Human
guggauuguaccacgaaaagug

SEQ ID NO: 106977 - RNA, 22 nt, Human
guggauuucaggcuccccucag

SEQ ID NO: 106978 - RNA, 22 nt, Human
guggcuuucuaccauuaaauug

SEQ ID NO: 106979 - RNA, 22 nt, Human
guggcuugguauuaaggugcca

SEQ ID NO: 106980 - RNA, 22 nt, Human
guggcuuaauauuuauagcaga

SEQ ID NO: 106981 - RNA, 18 nt, Human
guggccauugaccagcuu

SEQ ID NO: 106982 - RNA, 22 nt, Human
guggcauggggagcagcuagaa

SEQ ID NO: 106983 - RNA, 22 nt, Human
gugggggcuaaauugaggggug

SEQ ID NO: 106984 - RNA, 22 nt, Human
gugggagaaugggaggaguaau

SEQ ID NO: 106985 - RNA, 22 nt, Human
guggaguggguuguacucaggg

SEQ ID NO: 106986 - RNA, 22 nt, Human
guggaggaagaucuuugaugau

SEQ ID NO: 106987 - RNA, 22 nt, Human
guggagaaagcuggaaucugag

SEQ ID NO: 106988 - RNA, 22 nt, Human
guggacagacauaauccuaauu

SEQ ID NO: 106989 - RNA, 22 nt, Human
gggcagaaaggaaggcuggggg

SEQ ID NO: 106990 - RNA, 22 nt, Human
guggaaauuuuaggaucaucuu

SEQ ID NO: 106991 - RNA, 22 nt, Human
guggaaggaauuaacagacuag

SEQ ID NO: 106992 - RNA, 22 nt, Human
guggaagauauuucugguccag

SEQ ID NO: 106993 - RNA, 22 nt, Human
gugcuugcgcauaacuggggcc

SEQ ID NO: 106994 - RNA, 22 nt, Human
ggccuugauuccggucauugaa

SEQ ID NO: 106995 - RNA, 22 nt, Human
gcuggguaguucuuguuuggga

SEQ ID NO: 106996 - RNA, 19 nt, Human
gcugggauaggauguauuu

SEQ ID NO: 106997 - RNA, 22 nt, Human
ggaaguggauucagggcugcua

SEQ ID NO: 106998 - RNA, 22 nt, Human
ggaaguuaguucuuggcaaagg

SEQ ID NO: 106999 - RNA, 22 nt, Human
ggaaguuugagcaucuguuucc

SEQ ID NO: 107000 - RNA, 22 nt, Human
ggaauaaaaggagguggcgaga

SEQ ID NO: 107001 - RNA, 22 nt, Human
gccuuggacuaccacucccaca

SEQ ID NO: 107002 - RNA, 21 nt, Human
ggaauagcuuaaagugagggg

SEQ ID NO: 107003 - RNA, 22 nt, Human
ggacggcuagcagcagaauuca

SEQ ID NO: 107004 - RNA, 22 nt, Human
ggagauaugugaaaaagacagc

SEQ ID NO: 107005 - RNA, 18 nt, Human
ggagaagaacagaugugg

SEQ ID NO: 107006 - RNA, 22 nt, Human
ggagcaagagugagcaagcaga

SEQ ID NO: 107007 - RNA, 22 nt, Human
ggagcagaggaaagaguagcau

SEQ ID NO: 107008 - RNA, 22 nt, Human
ggaugaguuguauauaggauuc

SEQ ID NO: 107009 - RNA, 22 nt, Human
ggaugcagcagagaccuggagu

SEQ ID NO: 107010 - RNA, 22 nt, Human
ggaucgauuccaaauguagauc

SEQ ID NO: 107011 - RNA, 22 nt, Human
ggagccuuccgagucccagguu

SEQ ID NO: 107012 - RNA, 22 nt, Human
ggaucaccagguuuguuguugg

SEQ ID NO: 107013 - RNA, 22 nt, Human
ggagcaucuaccauuucuagau

SEQ ID NO: 107014 - RNA, 20 nt, Human
ggauugaacuauuucucagc

SEQ ID NO: 107015 - RNA, 22 nt, Human
ggauugaagggaaccucagaau

SEQ ID NO: 107016 - RNA, 22 nt, Human
ggauuucuucucauaacugaga

SEQ ID NO: 107017 - RNA, 22 nt, Human
gcggcaguccuuccaguacagg

SEQ ID NO: 107018 - RNA, 22 nt, Human
gcgggugagauucgagagaugg

SEQ ID NO: 107019 - RNA, 22 nt, Human
gcuacaaaaccagggcaaagga

SEQ ID NO: 107020 - RNA, 22 nt, Human
ggcagauaaacaauguuguaua

SEQ ID NO: 107021 - RNA, 22 nt, Human
ggcagaggagcuggaaacaugg

SEQ ID NO: 107022 - RNA, 22 nt, Human
ggcagaggaagcuggaaguggg

SEQ ID NO: 107023 - RNA, 20 nt, Human
gcucaguggagaaaugcacc

SEQ ID NO: 107024 - RNA, 22 nt, Human
gcuacaaauaaaaugggugacu

SEQ ID NO: 107025 - RNA, 22 nt, Human
gcuacauuagcuucaauggcua

SEQ ID NO: 107026 - RNA, 22 nt, Human
ggcgaugaggucuuagaaucua

SEQ ID NO: 107027 - RNA, 22 nt, Human
ggcgacuacugaaugcuugaaa

SEQ ID NO: 107028 - RNA, 22 nt, Human
ggccuugguggcuuugcugaug

SEQ ID NO: 107029 - RNA, 22 nt, Human
ggccuugggauguggcugcagc

SEQ ID NO: 107030 - RNA, 22 nt, Human
ggcggcaagggaauggagaaga

SEQ ID NO: 107031 - RNA, 22 nt, Human
ggcggcugcuccuugcccucgg

SEQ ID NO: 107032 - RNA, 22 nt, Human
gcugauucuucugcuuuuucuc

SEQ ID NO: 107033 - RNA, 18 nt, Human
gcugaaauucuaaacaaa

SEQ ID NO: 107034 - RNA, 22 nt, Human
ggcugcagggaacaggaugggu

SEQ ID NO: 107035 - RNA, 17 nt, Human
ggcugccaggcaacaua

SEQ ID NO: 107036 - RNA, 22 nt, Human
ggcugcuugauagauaugagua

SEQ ID NO: 107037 - RNA, 21 nt, Human
gcuggcugucucuuacacggu

SEQ ID NO: 107038 - RNA, 22 nt, Human
gcuggaagggccagcuuucagg

SEQ ID NO: 107039 - RNA, 22 nt, Human
gcugcuuacuauaggguuaacu

SEQ ID NO: 107040 - RNA, 22 nt, Human
gcuggauaaggaucaguuucuu

SEQ ID NO: 107041 - RNA, 21 nt, Human
gcuguagauucacaaagaggu

SEQ ID NO: 107042 - RNA, 21 nt, Human
ggcuguuaauagugauuagaa

SEQ ID NO: 107043 - RNA, 22 nt, Human
ggcugugaaguacguugaaggu

SEQ ID NO: 107044 - RNA, 18 nt, Human
gguacguuuugaucaaug

SEQ ID NO: 107045 - RNA, 22 nt, Human
ggguuaaauggauggcauuugc

SEQ ID NO: 107046 - RNA, 22 nt, Human
gguaauguucugaugaauuugu

SEQ ID NO: 107047 - RNA, 22 nt, Human
gguaauugaaaguuuguugaug

SEQ ID NO: 107048 - RNA, 22 nt, Human
ggauaauugaugauuuauaaga

SEQ ID NO: 107049 - RNA, 22 nt, Human
ggauaauguauuuuaaaauggg

SEQ ID NO: 107050 - RNA, 20 nt, Human
ggucuguuucuucuuuucau

SEQ ID NO: 107051 - RNA, 22 nt, Human
ggucuuauaauuaauuuaggcu

SEQ ID NO: 107052 - RNA, 22 nt, Human
ggcacgagccaguguguguguu

SEQ ID NO: 107053 - RNA, 22 nt, Human
ggucgguuggagagaucaugaa

SEQ ID NO: 107054 - RNA, 22 nt, Human
ggauuugaugagacuaucuacu

SEQ ID NO: 107055 - RNA, 22 nt, Human
ggcaagauccagcacaaacaca

SEQ ID NO: 107056 - RNA, 22 nt, Human
gguggcuucuguuugcaagagg

SEQ ID NO: 107057 - RNA, 22 nt, Human
ggcaguagucagaggguuuuac

SEQ ID NO: 107058 - RNA, 22 nt, Human
gguguaaucacaagcuggaauu

SEQ ID NO: 107059 - RNA, 22 nt, Human
ggcaggaaguaaggaugcuaca

SEQ ID NO: 107060 - RNA, 22 nt, Human
ggugcagucuggggcacauuau

SEQ ID NO: 107061 - RNA, 22 nt, Human
guaguuuuucuugcaagaguag

SEQ ID NO: 107062 - RNA, 22 nt, Human
guaguuuuugagcuguaaucuu

SEQ ID NO: 107063 - RNA, 22 nt, Human
ggccgcuuucuggggagugagg

SEQ ID NO: 107064 - RNA, 22 nt, Human
guagugauuguuccucaggggu

SEQ ID NO: 107065 - RNA, 22 nt, Human
guaguauuuucugaggacuggu

SEQ ID NO: 107066 - RNA, 22 nt, Human
guaggaaaugaauaagguaccu

SEQ ID NO: 107067 - RNA, 22 nt, Human
guacugguuuucuuacucuggc

SEQ ID NO: 107068 - RNA, 22 nt, Human
guagaaaauagauugucucuug

SEQ ID NO: 107069 - RNA, 22 nt, Human
guacuugauucauuauugcauu

SEQ ID NO: 107070 - RNA, 22 nt, Human
guagauaauuuuggaaagcugg

SEQ ID NO: 107071 - RNA, 22 nt, Human
gguuuuccaguagaucagaaga

SEQ ID NO: 107072 - RNA, 22 nt, Human
gguguauucuccaguuuuagca

SEQ ID NO: 107073 - RNA, 22 nt, Human
gguucuggaaaagaaagcaaag

SEQ ID NO: 107074 - RNA, 22 nt, Human
guaauaggagggagucugcuuu

SEQ ID NO: 107075 - RNA, 22 nt, Human
guaauucugugugaaucuauua

SEQ ID NO: 107076 - RNA, 22 nt, Human
guaauugcucauauggcaccug

SEQ ID NO: 107077 - RNA, 22 nt, Human
guaaaucuuggcaucugcuuuc

SEQ ID NO: 107078 - RNA, 22 nt, Human
guaaaucccucucuuuguagau

SEQ ID NO: 107079 - RNA, 22 nt, Human
guaaauuaugucugggucaguu

SEQ ID NO: 107080 - RNA, 22 nt, Human
guaacuuuuuccucauuggcua

SEQ ID NO: 107081 - RNA, 22 nt, Human
guaagaauauacccaggaguca

SEQ ID NO: 107082 - RNA, 23 nt, Human
gcuuugaaaaugcuuucuuccag

SEQ ID NO: 107083 - RNA, 22 nt, Human
gcuuuguucauuuaguuuuuuu

SEQ ID NO: 107084 - RNA, 22 nt, Human
gcuuuguugauggugagucugu

SEQ ID NO: 107085 - RNA, 22 nt, Human
gggcaagaggguuugacaugag

SEQ ID NO: 107086 - RNA, 22 nt, Human
ggaaaagccauauuauaggcaa

SEQ ID NO: 107087 - RNA, 22 nt, Human
gggauguauguuuguguggaga

SEQ ID NO: 107088 - RNA, 17 nt, Human
ggaagaaaaggaucauc

SEQ ID NO: 107089 - RNA, 22 nt, Human
ggaagcuguugugagugcagca

SEQ ID NO: 107090 - RNA, 20 nt, Human
ggaaguauccacaaauuccu

SEQ ID NO: 107091 - RNA, 18 nt, Human
ggaaggugcuggagugca

SEQ ID NO: 107092 - RNA, 22 nt, Human
ggaaggugagugcugugugauu

SEQ ID NO: 107093 - RNA, 22 nt, Human
gggcgccgggagugagagugag

SEQ ID NO: 107094 - RNA, 22 nt, Human
ggacaauuguacucgauuucaa

SEQ ID NO: 107095 - RNA, 23 nt, Human
ggaauuucagaugugaaauaaaa

SEQ ID NO: 107096 - RNA, 22 nt, Human
ggacuuggcagugucaaauuua

SEQ ID NO: 107097 - RNA, 22 nt, Human
ggggaagagagaagaaugaucu

SEQ ID NO: 107098 - RNA, 22 nt, Human
ggggaauuaaaugagaagccuu

SEQ ID NO: 107099 - RNA, 22 nt, Human
ggggacuugguuuuaaugagcu

SEQ ID NO: 107100 - RNA, 22 nt, Human
ggagaagaggagcuggaagccu

SEQ ID NO: 107101 - RNA, 22 nt, Human
ggagaggaaguuuaaagaauug

SEQ ID NO: 107102 - RNA, 22 nt, Human
gggguguuagucuuacccagag

SEQ ID NO: 107103 - RNA, 22 nt, Human
ggagaugaaugugguaaaacug

SEQ ID NO: 107104 - RNA, 21 nt, Human
gggugcacagcaaauuugaga

SEQ ID NO: 107105 - RNA, 22 nt, Human
gggugguuccuggaucugacug

SEQ ID NO: 107106 - RNA, 22 nt, Human
ggauaaaugaaggcauacagau

SEQ ID NO: 107107 - RNA, 22 nt, Human
gcagcguuaacauuuuuccugu

SEQ ID NO: 107108 - RNA, 22 nt, Human
gcgguuauggcagagauuacag

SEQ ID NO: 107109 - RNA, 22 nt, Human
gcagccauggcuggccgggcau

SEQ ID NO: 107110 - RNA, 22 nt, Human
gcgauugguuuggggccagagu

SEQ ID NO: 107111 - RNA, 22 nt, Human
gccuuuugcaaugguguuggug

SEQ ID NO: 107112 - RNA, 22 nt, Human
gccuuucuugguuugucaggca

SEQ ID NO: 107113 - RNA, 22 nt, Human
gcuauuggcuaauuguugcaac

SEQ ID NO: 107114 - RNA, 22 nt, Human
gcuacaggggucaguccuuugc

SEQ ID NO: 107115 - RNA, 22 nt, Human
gcuacaacugugucuguggggc

SEQ ID NO: 107116 - RNA, 22 nt, Human
gcguguauuccagaccuuaacg

SEQ ID NO: 107117 - RNA, 22 nt, Human
gcuaaccaaaccuguuguuugg

SEQ ID NO: 107118 - RNA, 22 nt, Human
gcuaagcuuugagucuggacag

SEQ ID NO: 107119 - RNA, 22 nt, Human
gcucaacucaacgucauuugaa

SEQ ID NO: 107120 - RNA, 22 nt, Human
gcaguugugguuucguuuccuu

SEQ ID NO: 107121 - RNA, 22 nt, Human
gcauaauauugagaaauuauua

SEQ ID NO: 107122 - RNA, 22 nt, Human
gcuauuuagaaaggcuuggaga

SEQ ID NO: 107123 - RNA, 22 nt, Human
gcaguuugugauguggcaguca

SEQ ID NO: 107124 - RNA, 22 nt, Human
gcucccaguucccaaagugacc

SEQ ID NO: 107125 - RNA, 22 nt, Human
gcaucuguuguguuaauuuaca

SEQ ID NO: 107126 - RNA, 22 nt, Human
gcucgauugucaguguuaggga

SEQ ID NO: 107127 - RNA, 23 nt, Human
gcugagcaccagccauaucuuuu

SEQ ID NO: 107128 - RNA, 22 nt, Human
gcauuuuaauuggggcaguuag

SEQ ID NO: 107129 - RNA, 23 nt, Human
gcugcagugaauguuguuguugu

SEQ ID NO: 107130 - RNA, 22 nt, Human
gcugcagggagcuggaaggcuc

SEQ ID NO: 107131 - RNA, 19 nt, Human
gccacguuggcuaguugcc

SEQ ID NO: 107132 - RNA, 22 nt, Human
gcauuucuguuuuuuuaaauga

SEQ ID NO: 107133 - RNA, 22 nt, Human
gccagcuuagaucccccagccc

SEQ ID NO: 107134 - RNA, 22 nt, Human
gcuggauuuaggguucccuccu

SEQ ID NO: 107135 - RNA, 22 nt, Human
gcugcuggcuuccugcuguuuu

SEQ ID NO: 107136 - RNA, 22 nt, Human
gcuggaaauaacuuguguagaa

SEQ ID NO: 107137 - RNA, 22 nt, Human
gauugauguaggugauaaaucu

SEQ ID NO: 107138 - RNA, 22 nt, Human
gauugauuuaauaugagaggau

SEQ ID NO: 107139 - RNA, 22 nt, Human
gauucugaaauuaacagacugg

SEQ ID NO: 107140 - RNA, 18 nt, Human
gccgccuugcucgugaac

SEQ ID NO: 107141 - RNA, 22 nt, Human
gcccuuuuaucaacuccuagaa

SEQ ID NO: 107142 - RNA, 22 nt, Human
gauguaucugagcugcuuaggu

SEQ ID NO: 107143 - RNA, 22 nt, Human
gccgcaacggacccugggaguc

SEQ ID NO: 107144 - RNA, 22 nt, Human
gauugcugccagcguguccgug

SEQ ID NO: 107145 - RNA, 20 nt, Human
gauuuaacgcugcgucuguc

SEQ ID NO: 107146 - RNA, 22 nt, Human
gauuguagacauauuagacugc

SEQ ID NO: 107147 - RNA, 22 nt, Human
gauuucuucauuuaaaaauauu

SEQ ID NO: 107148 - RNA, 22 nt, Human
gauugggagugugacauuguau

SEQ ID NO: 107149 - RNA, 22 nt, Human
gcacagauaaucugccuuacca

SEQ ID NO: 107150 - RNA, 22 nt, Human
gccuuuauauuacauuuggaag

SEQ ID NO: 107151 - RNA, 22 nt, Human
gccuucgauaugaggguuugcc

SEQ ID NO: 107152 - RNA, 22 nt, Human
gccuugagcucaugucccagcu

SEQ ID NO: 107153 - RNA, 22 nt, Human
gcacaaguccuccgacagcacg

SEQ ID NO: 107154 - RNA, 22 nt, Human
gcaagagaagaaagaauaguuu

SEQ ID NO: 107155 - RNA, 22 nt, Human
gcaaaugacuuagucacuccag

SEQ ID NO: 107156 - RNA, 22 nt, Human
gcaaagaauugauucauuuugc

SEQ ID NO: 107157 - RNA, 22 nt, Human
gcaaaaacaguguagucuucug

SEQ ID NO: 107158 - RNA, 22 nt, Human
gccucaaaaguguuguagaggg

SEQ ID NO: 107159 - RNA, 22 nt, Human
gauuuucauuauagcuaguuuc

SEQ ID NO: 107160 - RNA, 22 nt, Human
gaggugcaggggcccgggcugg

SEQ ID NO: 107161 - RNA, 22 nt, Human
gcagcuuuggagguggaacucu

SEQ ID NO: 107162 - RNA, 22 nt, Human
gauaagugauucugauucacau

SEQ ID NO: 107163 - RNA, 22 nt, Human
gauaaauaguguuuggggacau

SEQ ID NO: 107164 - RNA, 22 nt, Human
gcauuggaaacugcuuuaugcu

SEQ ID NO: 107165 - RNA, 22 nt, Human
gcauugcuauuucuguuagugu

SEQ ID NO: 107166 - RNA, 22 nt, Human
gauauauuucaaauucuuuugc

SEQ ID NO: 107167 - RNA, 22 nt, Human
gcauuccagaguugcuggaaaa

SEQ ID NO: 107168 - RNA, 22 nt, Human
gcauuagacuaguacacggcag

SEQ ID NO: 107169 - RNA, 22 nt, Human
gauacaugucacaaguugugca

SEQ ID NO: 107170 - RNA, 22 nt, Human
gcauguucaaguuaguauauuu

SEQ ID NO: 107171 - RNA, 22 nt, Human
gcaugguuuccugcaacguucu

SEQ ID NO: 107172 - RNA, 22 nt, Human
gauggcaaugcuagaaauuuag

SEQ ID NO: 107173 - RNA, 22 nt, Human
gauggacgguuuuaccagacag

SEQ ID NO: 107174 - RNA, 22 nt, Human
gaugauuuuguaacuggggaca

SEQ ID NO: 107175 - RNA, 18 nt, Human
gaugaagaggaagaggag

SEQ ID NO: 107176 - RNA, 22 nt, Human
gaucauuuucauuaauguugca

SEQ ID NO: 107177 - RNA, 22 nt, Human
gaugauaacagcauuucaacug

SEQ ID NO: 107178 - RNA, 23 nt, Human
gaugauggcaacuacauccggug

SEQ ID NO: 107179 - RNA, 19 nt, Human
gauauugagcugagaauuc

SEQ ID NO: 107180 - RNA, 22 nt, Human
gauauuuugugaaaaaacaacu

SEQ ID NO: 107181 - RNA, 22 nt, Human
gauauucauaggcagguauuua

SEQ ID NO: 107182 - RNA, 22 nt, Human
gagggggaaaagggcagcagag

SEQ ID NO: 107183 - RNA, 22 nt, Human
gcagauuggguacauaaacagu

SEQ ID NO: 107184 - RNA, 22 nt, Human
gcagauaguaggagcuaaucuu

SEQ ID NO: 107185 - RNA, 20 nt, Human
gcagcagacagacaggggac

SEQ ID NO: 107186 - RNA, 22 nt, Human
gcagcagugugggcugaaccua

SEQ ID NO: 107187 - RNA, 22 nt, Human
gcagcaauaaaacugaaggugu

SEQ ID NO: 107188 - RNA, 22 nt, Human
gaggggaaggauuucuucagaa

SEQ ID NO: 107189 - RNA, 22 nt, Human
gaggggaauguuccugagcugg

SEQ ID NO: 107190 - RNA, 22 nt, Human
gcagaggcugccgugggcagga

SEQ ID NO: 107191 - RNA, 22 nt, Human
gaggggaacaggcauucuuaag

SEQ ID NO: 107192 - RNA, 22 nt, Human
gagggauuuuagugcagcaacu

SEQ ID NO: 107193 - RNA, 22 nt, Human
gagggcauugucuucuuaguuu

SEQ ID NO: 107194 - RNA, 22 nt, Human
gcagagaaugucagauuuuguu

SEQ ID NO: 107195 - RNA, 22 nt, Human
gcagagcacccugcagugguau

SEQ ID NO: 107196 - RNA, 22 nt, Human
gcagcauuaccaagacauggca

SEQ ID NO: 107197 - RNA, 23 nt, Human
gcagccaacccacgugagagaag

SEQ ID NO: 107198 - RNA, 22 nt, Human
gcagccaugcacgucauuauga

SEQ ID NO: 107199 - RNA, 22 nt, Human
gcagccauuugcaucuaauuaa

SEQ ID NO: 107200 - RNA, 22 nt, Human
gaggguuagauuuuaagaaaga

SEQ ID NO: 107201 - RNA, 22 nt, Human
gaggugaacccaggugcuucac

SEQ ID NO: 107202 - RNA, 22 nt, Human
gcaggacuucuguuuaaccagu

SEQ ID NO: 107203 - RNA, 22 nt, Human
gcaggacugauggagcauaugu

SEQ ID NO: 107204 - RNA, 22 nt, Human
gcaggcaggauucagagauaca

SEQ ID NO: 107205 - RNA, 20 nt, Human
gcagcugacccuagugcuug

SEQ ID NO: 107206 - RNA, 22 nt, Human
gcagccugaguuuagcucgucg

SEQ ID NO: 107207 - RNA, 22 nt, Human
gcagcguguggcuaauggcucu

SEQ ID NO: 107208 - RNA, 22 nt, Human
gcacauaugcuguaagcacaug

SEQ ID NO: 107209 - RNA, 22 nt, Human
gcaccauagagaagagacacaa

SEQ ID NO: 107210 - RNA, 21 nt, Human
gcacucagucacuacucaaga

SEQ ID NO: 107211 - RNA, 22 nt, Human
gcacagucaacacuuauucacc

SEQ ID NO: 107212 - RNA, 22 nt, Human
gaggcagaggaugggacuguau

SEQ ID NO: 107213 - RNA, 22 nt, Human
gaggauuugagggucacuccac

SEQ ID NO: 107214 - RNA, 21 nt, Human
gcagaaagugauuugcuauuc

SEQ ID NO: 107215 - RNA, 22 nt, Human
gcacuguauuuaaauauuuaaa

SEQ ID NO: 107216 - RNA, 21 nt, Human
gcagaacuaggacuugaacau

SEQ ID NO: 107217 - RNA, 22 nt, Human
gagggaaauauggguuugguua

SEQ ID NO: 107218 - RNA, 22 nt, Human
gagggaaaggggccaugauugg

SEQ ID NO: 107219 - RNA, 22 nt, Human
gcacacaaaaauauguguugaa

SEQ ID NO: 107220 - RNA, 22 nt, Human
gcacacaagagauuguuauugc

SEQ ID NO: 107221 - RNA, 22 nt, Human
gcacagaguguaaaaguuucau

SEQ ID NO: 107222 - RNA, 22 nt, Human
gcacagcuaugagcugaauugu

SEQ ID NO: 107223 - RNA, 22 nt, Human
gcacaggcugcacgaccccagc

SEQ ID NO: 107224 - RNA, 21 nt, Human
gcacaacucucacauucuucu

SEQ ID NO: 107225 - RNA, 22 nt, Human
gaggaagucuuaucuggaugca

SEQ ID NO: 107226 - RNA, 22 nt, Human
gaggaaagcugguuuaaaguau

SEQ ID NO: 107227 - RNA, 22 nt, Human
gcaaggaagcagaguugcuauc

SEQ ID NO: 107228 - RNA, 22 nt, Human
gcaauuggaaugaauucuauuu

SEQ ID NO: 107229 - RNA, 22 nt, Human
gagcagcugagcuggaaugaga

SEQ ID NO: 107230 - RNA, 22 nt, Human
gauguuaauauguuucaccaaa

SEQ ID NO: 107231 - RNA, 22 nt, Human
gauguuuugaaagaagaauaca

SEQ ID NO: 107232 - RNA, 22 nt, Human
gauuaagugaauuggagaaaag

SEQ ID NO: 107233 - RNA, 22 nt, Human
gauuaagauuacauauuuaagu

SEQ ID NO: 107234 - RNA, 22 nt, Human
gauuaagaaagauagaugugga

SEQ ID NO: 107235 - RNA, 22 nt, Human
gauucuaucauucuguauauua

SEQ ID NO: 107236 - RNA, 22 nt, Human
gauucagagcugcaacaaagaa

SEQ ID NO: 107237 - RNA, 22 nt, Human
gagccgcagcugcguagggucc

SEQ ID NO: 107238 - RNA, 22 nt, Human
gagcagucuuugaaaggcacca

SEQ ID NO: 107239 - RNA, 22 nt, Human
gauugcaucaauauuuagagua

SEQ ID NO: 107240 - RNA, 22 nt, Human
gauugcauaugcauucugauac

SEQ ID NO: 107241 - RNA, 21 nt, Human
gauuuuagggcagccaaacac

SEQ ID NO: 107242 - RNA, 22 nt, Human
gauuugucuauauucaaauaug

SEQ ID NO: 107243 - RNA, 22 nt, Human
gauuuugaaccuuauuuggaaa

SEQ ID NO: 107244 - RNA, 22 nt, Human
gauuuuaaaagauguauaaggu

SEQ ID NO: 107245 - RNA, 22 nt, Human
gauuucauaaaacgagaaacuc

SEQ ID NO: 107246 - RNA, 22 nt, Human
gaggaaaauggaguguaauuaa

SEQ ID NO: 107247 - RNA, 22 nt, Human
gauuuuuaaaaguaguuuugaa

SEQ ID NO: 107248 - RNA, 22 nt, Human
gagcuaauagacagcaacauca

SEQ ID NO: 107249 - RNA, 22 nt, Human
gaugguuuuacauuuuaauguu

SEQ ID NO: 107250 - RNA, 22 nt, Human
gagcagcaggccagguugcagg

SEQ ID NO: 107251 - RNA, 22 nt, Human
gagcaacacauugaaugaggau

SEQ ID NO: 107252 - RNA, 22 nt, Human
gagcacuucagcauaaaucaca

SEQ ID NO: 107253 - RNA, 22 nt, Human
gaugguagauauagaaagggga

SEQ ID NO: 107254 - RNA, 22 nt, Human
gauggguuugagauguuugggu

SEQ ID NO: 107255 - RNA, 22 nt, Human
gauggguugaguucauggagcc

SEQ ID NO: 107256 - RNA, 22 nt, Human
gagauuuccauauuuuguaaca

SEQ ID NO: 107257 - RNA, 22 nt, Human
gagauuguggcagcagcuguuu

SEQ ID NO: 107258 - RNA, 22 nt, Human
gagauuaauuaaaaccuuuaug

SEQ ID NO: 107259 - RNA, 22 nt, Human
gagaguuggaggguauguuagu

SEQ ID NO: 107260 - RNA, 22 nt, Human
gaugggaaggugguaaaguuua

SEQ ID NO: 107261 - RNA, 22 nt, Human
gagaggugaagcuaauuaauuu

SEQ ID NO: 107262 - RNA, 22 nt, Human
gagagucuuaaguuacagaacu

SEQ ID NO: 107263 - RNA, 22 nt, Human
gauggcauucacaaacuuaacu

SEQ ID NO: 107264 - RNA, 22 nt, Human
gauggauuuuuuauuaaaucag

SEQ ID NO: 107265 - RNA, 22 nt, Human
gagagcaaaccuguguuuggag

SEQ ID NO: 107266 - RNA, 22 nt, Human
gaugcauccuuucugucuucuc

SEQ ID NO: 107267 - RNA, 22 nt, Human
gagagaaggaagugaauuuccc

SEQ ID NO: 107268 - RNA, 22 nt, Human
gaugauugaauaaauaugguca

SEQ ID NO: 107269 - RNA, 22 nt, Human
gagaccuuaagagaugucagcu

SEQ ID NO: 107270 - RNA, 22 nt, Human
gaagauuauuacucauugcagg

SEQ ID NO: 107271 - RNA, 22 nt, Human
gagcccuguagcaagucauguc

SEQ ID NO: 107272 - RNA, 22 nt, Human
gagcaugacgcaacaccaagug

SEQ ID NO: 107273 - RNA, 22 nt, Human
aaaaccugcaagaugaaaucag

SEQ ID NO: 107274 - RNA, 22 nt, Human
aaaacauuuuacugccaucuca

SEQ ID NO: 107275 - RNA, 22 nt, Human
aaaaguuguaauauuuccuuua

SEQ ID NO: 107276 - RNA, 22 nt, Human
aaaauaaccuucauuugcauug

SEQ ID NO: 107277 - RNA, 22 nt, Human
aaaagguuauagcuuugccuug

SEQ ID NO: 107278 - RNA, 22 nt, Human
aaaagguauuuagcgauugcau

SEQ ID NO: 107279 - RNA, 22 nt, Human
aaaagcgaagagaacugaaguu

SEQ ID NO: 107280 - RNA, 22 nt, Human
aaaaggacaguagccuugaggu

SEQ ID NO: 107281 - RNA, 22 nt, Human
aaacgcauucuuacaugcuucc

SEQ ID NO: 107282 - RNA, 22 nt, Human
aaaaugggaaaauuuuagauua

SEQ ID NO: 107283 - RNA, 22 nt, Human
aaaaucucagaaaaguuuaggu

SEQ ID NO: 107284 - RNA, 22 nt, Human
aaaauuuccuuggaccauuuuu

SEQ ID NO: 107285 - RNA, 22 nt, Human
aaacaaauccaauaauaaaauu

SEQ ID NO: 107286 - RNA, 22 nt, Human
aaaauauuuaucuagcucuuaa

SEQ ID NO: 107287 - RNA, 22 nt, Human
aaaaguauaagugucuccugau

SEQ ID NO: 107288 - RNA, 22 nt, Human
aaaaggucacuguaaaaugacg

SEQ ID NO: 107289 - RNA, 22 nt, Human
aaaauauucuauaucaaagaua

SEQ ID NO: 107290 - RNA, 17 nt, Human
aaaaucaaaggaggugc

SEQ ID NO: 107291 - RNA, 22 nt, Human
aaagcaaauaguugcuuaauau

SEQ ID NO: 107292 - RNA, 22 nt, Human
aaagagccaacuaccgcaaauu

SEQ ID NO: 107293 - RNA, 22 nt, Human
aaagaauuucaagauucccaca

SEQ ID NO: 107294 - RNA, 22 nt, Human
aaagaugucauacacauuaaga

SEQ ID NO: 107295 - RNA, 22 nt, Human
aaagaugaaguucagcgaagaa

SEQ ID NO: 107296 - RNA, 22 nt, Human
aaagcagguugcaauuacagug

SEQ ID NO: 107297 - RNA, 22 nt, Human
aaagcauucuaaccgaucgacg

SEQ ID NO: 107298 - RNA, 22 nt, Human
aaagcagucuguuuuaaccuga

SEQ ID NO: 107299 - RNA, 22 nt, Human
aaagaggacgugcuauuuuuua

SEQ ID NO: 107300 - RNA, 22 nt, Human
aaagaguuguauucuuuuugag

SEQ ID NO: 107301 - RNA, 22 nt, Human
aaacuuuugaaggaggaaaaag

SEQ ID NO: 107302 - RNA, 23 nt, Human
aaacuacauuuauaguuuuucuc

SEQ ID NO: 107303 - RNA, 18 nt, Human
aaacgguuucaugcugua

SEQ ID NO: 107304 - RNA, 22 nt, Human
aaacgcaauuucuugcauguca

SEQ ID NO: 107305 - RNA, 22 nt, Human
aaagaguuaagagucuuaagcu

SEQ ID NO: 107306 - RNA, 22 nt, Human
aaagaacguuucugggaaucag

SEQ ID NO: 107307 - RNA, 22 nt, Human
aaagagugugcauguaccugug

SEQ ID NO: 107308 - RNA, 22 nt, Human
aaagccaagguccauguacuuu

SEQ ID NO: 107309 - RNA, 22 nt, Human
aaagccauaucuauucuauucu

SEQ ID NO: 107310 - RNA, 22 nt, Human
aaaggcaugugcaacuacaaau

SEQ ID NO: 107311 - RNA, 22 nt, Human
aaagggaugauuucugaagaua

SEQ ID NO: 107312 - RNA, 22 nt, Human
aaagguggugguuagggaauau

SEQ ID NO: 107313 - RNA, 22 nt, Human
aaagguguagacucaguuaugc

SEQ ID NO: 107314 - RNA, 20 nt, Human
aaagauacuuuuuguaaugg

SEQ ID NO: 107315 - RNA, 22 nt, Human
aaagccaagucugauuuuguug

SEQ ID NO: 107316 - RNA, 22 nt, Human
aaagcauuuguuucuccuggaa

SEQ ID NO: 107317 - RNA, 22 nt, Human
aaagcccuccaggguauacauu

SEQ ID NO: 107318 - RNA, 22 nt, Human
aaagcaaagaucuguagcccaa

SEQ ID NO: 107319 - RNA, 22 nt, Human
aaagcugaaacgaaaugacaac

SEQ ID NO: 107320 - RNA, 22 nt, Human
aaaggaaacuaugaaucucugg

SEQ ID NO: 107321 - RNA, 23 nt, Human
aaaguacuuaaucugcaaaccac

SEQ ID NO: 107322 - RNA, 22 nt, Human
aaagccuacagucaugguuaga

SEQ ID NO: 107323 - RNA, 17 nt, Human
aaagccgaucagauguu

SEQ ID NO: 107324 - RNA, 22 nt, Human
aaagucgugucagaaguuggga

SEQ ID NO: 107325 - RNA, 22 nt, Human
aaaguagaugagaauuuuguug

SEQ ID NO: 107326 - RNA, 22 nt, Human
aaaguaaagccuauuuaauaau

SEQ ID NO: 107327 - RNA, 22 nt, Human
aaaggugccucuuacaaggcuu

SEQ ID NO: 107328 - RNA, 23 nt, Human
aaauaauaauuucucuguuggga

SEQ ID NO: 107329 - RNA, 22 nt, Human
aaaguuuguacugggaguuacu

SEQ ID NO: 107330 - RNA, 22 nt, Human
aaaguugcauccuaugaccuca

SEQ ID NO: 107331 - RNA, 22 nt, Human
aaaguagaauaauaaacccuug

SEQ ID NO: 107332 - RNA, 22 nt, Human
aaauagauuugacuacuuggug

SEQ ID NO: 107333 - RNA, 22 nt, Human
aaaucaaaagugguuauuuuau

SEQ ID NO: 107334 - RNA, 22 nt, Human
aaaucaagucagcugaauucca

SEQ ID NO: 107335 - RNA, 22 nt, Human
aaauagucagaaaucaacgugc

SEQ ID NO: 107336 - RNA, 22 nt, Human
aaauaggaguagugauguauua

SEQ ID NO: 107337 - RNA, 22 nt, Human
aaaguuguccuuugugccuuua

SEQ ID NO: 107338 - RNA, 22 nt, Human
aaauccaucaaaucuucuagaa

SEQ ID NO: 107339 - RNA, 21 nt, Human
aaauccagugaucuccucuaa

SEQ ID NO: 107340 - RNA, 22 nt, Human
aaaucauguuaaagagggaguu

SEQ ID NO: 107341 - RNA, 22 nt, Human
aaaucgcuugaacccaggaagu

SEQ ID NO: 107342 - RNA, 20 nt, Human
aaauccuugggaguggugca

SEQ ID NO: 107343 - RNA, 22 nt, Human
aaaguguuuaacaaauugcuuu

SEQ ID NO: 107344 - RNA, 22 nt, Human
aaaguuacacgacuauuuaugu

SEQ ID NO: 107345 - RNA, 22 nt, Human
aaauauagugacacuuauaguc

SEQ ID NO: 107346 - RNA, 22 nt, Human
aaaguguuaacacuggcuacuu

SEQ ID NO: 107347 - RNA, 22 nt, Human
aaaguguaagucccugguuguc

SEQ ID NO: 107348 - RNA, 21 nt, Human
aaagugguaaggauuauuuug

SEQ ID NO: 107349 - RNA, 22 nt, Human
aaagucugaaaaaguuuguggg

SEQ ID NO: 107350 - RNA, 22 nt, Human
aaauauugaauuugaggaugua

SEQ ID NO: 107351 - RNA, 22 nt, Human
aaauauuugaaugguguaagau

SEQ ID NO: 107352 - RNA, 22 nt, Human
aaauauauccuucuguccugcc

SEQ ID NO: 107353 - RNA, 22 nt, Human
aaaguuaauucuuguuuuuuau

SEQ ID NO: 107354 - RNA, 22 nt, Human
aaauaugguaucugccaaacua

SEQ ID NO: 107355 - RNA, 22 nt, Human
aacaggaagaauccagauggug

SEQ ID NO: 107356 - RNA, 19 nt, Human
aacaaaauaguucuaguua

SEQ ID NO: 107357 - RNA, 22 nt, Human
aacaaguagaauagguuuuuuu

SEQ ID NO: 107358 - RNA, 22 nt, Human
aacauuuccggccuuuuguucu

SEQ ID NO: 107359 - RNA, 22 nt, Human
aacauuuauguuuugaccaagu

SEQ ID NO: 107360 - RNA, 22 nt, Human
aacaaagaaaagcuugagguuu

SEQ ID NO: 107361 - RNA, 22 nt, Human
aacagaauaucaaaagauuaug

SEQ ID NO: 107362 - RNA, 22 nt, Human
aacaaagaacuuucuuccuuug

SEQ ID NO: 107363 - RNA, 20 nt, Human
aacagcucucgacuuaucuu

SEQ ID NO: 107364 - RNA, 22 nt, Human
aacaaccuaguaguaucuuuca

SEQ ID NO: 107365 - RNA, 22 nt, Human
aacagagauucuucccuucuuu

SEQ ID NO: 107366 - RNA, 22 nt, Human
aaauuuauaacuuaaagugaau

SEQ ID NO: 107367 - RNA, 22 nt, Human
aaauguauuagccuaugugaga

SEQ ID NO: 107368 - RNA, 22 nt, Human
aaauuagucacaccagugucuu

SEQ ID NO: 107369 - RNA, 22 nt, Human
aaauuaggcccugauuuuaugu

SEQ ID NO: 107370 - RNA, 22 nt, Human
aaauugucuuuaaucaggucau

SEQ ID NO: 107371 - RNA, 22 nt, Human
aaaucugaaggaaacagcuuca

SEQ ID NO: 107372 - RNA, 22 nt, Human
aaaucuuucacauauuuuuuau

SEQ ID NO: 107373 - RNA, 22 nt, Human
aaaucccacucacgaguuuugc

SEQ ID NO: 107374 - RNA, 22 nt, Human
aaaugggagucacacagguuua

SEQ ID NO: 107375 - RNA, 22 nt, Human
aaauguaaacuguauuuauaaa

SEQ ID NO: 107376 - RNA, 22 nt, Human
aaaugcuuuaauugaguucaug

SEQ ID NO: 107377 - RNA, 22 nt, Human
aaauuaacuaucacuuuuguga

SEQ ID NO: 107378 - RNA, 22 nt, Human
aaauggaaguuuguucucagcc

SEQ ID NO: 107379 - RNA, 22 nt, Human
aaaucauagccaugaacauuug

SEQ ID NO: 107380 - RNA, 22 nt, Human
aaauauuaaugaugaagguagu

SEQ ID NO: 107381 - RNA, 22 nt, Human
aaauauuagacauaccuggaga

SEQ ID NO: 107382 - RNA, 22 nt, Human
aaaguuacccaaucucuaugaa

SEQ ID NO: 107383 - RNA, 22 nt, Human
aaaucugaauuaaaaucugguu

SEQ ID NO: 107384 - RNA, 22 nt, Human
aaaucuuccugaaauuuguuca

SEQ ID NO: 107385 - RNA, 22 nt, Human
aaaugcacaauaaaguaaaggc

SEQ ID NO: 107386 - RNA, 22 nt, Human
aaaugcucgccagguuuuauua

SEQ ID NO: 107387 - RNA, 22 nt, Human
aaauauauauaauauauauauu

SEQ ID NO: 107388 - RNA, 22 nt, Human
aaugcugugauuuauuaaguau

SEQ ID NO: 107389 - RNA, 22 nt, Human
aaugcuaaagaagaaggaguag

SEQ ID NO: 107390 - RNA, 22 nt, Human
aaucuacaaugaaaaaauguuu

SEQ ID NO: 107391 - RNA, 22 nt, Human
aaucgguugaacccaggaagug

SEQ ID NO: 107392 - RNA, 22 nt, Human
aauccaaacaggauuaccuauc

SEQ ID NO: 107393 - RNA, 22 nt, Human
aaucaugagguguuucuuugca

SEQ ID NO: 107394 - RNA, 22 nt, Human
aaucaugguacaaguaagcacg

SEQ ID NO: 107395 - RNA, 22 nt, Human
aaucaagcugcuguuuguucua

SEQ ID NO: 107396 - RNA, 22 nt, Human
aaucacuucuuugucuucuuca

SEQ ID NO: 107397 - RNA, 22 nt, Human
aaucacuuagaacccaggaagu

SEQ ID NO: 107398 - RNA, 22 nt, Human
aauggaaaggagccugacuaua

SEQ ID NO: 107399 - RNA, 22 nt, Human
aauggaaaaagaacuguuuaaa

SEQ ID NO: 107400 - RNA, 22 nt, Human
aauggaaaaauccacagggaac

SEQ ID NO: 107401 - RNA, 22 nt, Human
aaugcuuuuugcgaaaugugca

SEQ ID NO: 107402 - RNA, 22 nt, Human
aauggauaacaccgguucuguc

SEQ ID NO: 107403 - RNA, 22 nt, Human
aauggagaaaagacaauguuga

SEQ ID NO: 107404 - RNA, 22 nt, Human
aauggcaauagugcauuaugua

SEQ ID NO: 107405 - RNA, 22 nt, Human
aauggcaagccacaugcuuuuc

SEQ ID NO: 107406 - RNA, 22 nt, Human
aauggcaaaaguuucggaaauu

SEQ ID NO: 107407 - RNA, 22 nt, Human
aauguguauguguauauauaug

SEQ ID NO: 107408 - RNA, 22 nt, Human
aauguuaguauuuaagagcuug

SEQ ID NO: 107409 - RNA, 22 nt, Human
aauguuugaacuuugcauauuu

SEQ ID NO: 107410 - RNA, 22 nt, Human
aauguuuuucaaguguggagca

SEQ ID NO: 107411 - RNA, 22 nt, Human
aauuaaggccuuuaaaugucuu

SEQ ID NO: 107412 - RNA, 22 nt, Human
aauuaaauguuugguuugagcu

SEQ ID NO: 107413 - RNA, 22 nt, Human
aauuauuauguggaagacgacg

SEQ ID NO: 107414 - RNA, 22 nt, Human
aauuauguugaaauaugagaac

SEQ ID NO: 107415 - RNA, 22 nt, Human
aauuaacuggguucucagaugc

SEQ ID NO: 107416 - RNA, 22 nt, Human
aauuauuaucauuaucuuccug

SEQ ID NO: 107417 - RNA, 23 nt, Human
aaugugaaauugaguuuuuguua

SEQ ID NO: 107418 - RNA, 22 nt, Human
aauguucauauggguagcagau

SEQ ID NO: 107419 - RNA, 22 nt, Human
aaugugugggagaacagucuuu

SEQ ID NO: 107420 - RNA, 22 nt, Human
aauguggaguugguuuccuucc

SEQ ID NO: 107421 - RNA, 22 nt, Human
aaugugguauuuuggcauucuu

SEQ ID NO: 107422 - RNA, 22 nt, Human
aaugugcauaacuuuauaaauu

SEQ ID NO: 107423 - RNA, 22 nt, Human
aauguauuuuuaggcagaauau

SEQ ID NO: 107424 - RNA, 23 nt, Human
aaugggcggaaguguuaaguugc

SEQ ID NO: 107425 - RNA, 22 nt, Human
aaugguaauauuucauaguugu

SEQ ID NO: 107426 - RNA, 22 nt, Human
aauggcuagcauguaaaauauc

SEQ ID NO: 107427 - RNA, 22 nt, Human
aaugggauaggucuucaggaau

SEQ ID NO: 107428 - RNA, 22 nt, Human
aauuuuagcuaaagauccaugg

SEQ ID NO: 107429 - RNA, 22 nt, Human
aauuuuauuagacaggcauaau

SEQ ID NO: 107430 - RNA, 21 nt, Human
acaaaaccuaacuuggcugcu

SEQ ID NO: 107431 - RNA, 22 nt, Human
aauuuuauuuuuuccccuagau

SEQ ID NO: 107432 - RNA, 22 nt, Human
aauuucuccuuuucaguuagau

SEQ ID NO: 107433 - RNA, 22 nt, Human
aauuucuuucagcugcuuuaag

SEQ ID NO: 107434 - RNA, 22 nt, Human
aauuucuuuagagguacugauc

SEQ ID NO: 107435 - RNA, 22 nt, Human
aauuugcuccaaugucaguucu

SEQ ID NO: 107436 - RNA, 22 nt, Human
acaaagugaaaagcaucgaauu

SEQ ID NO: 107437 - RNA, 22 nt, Human
acaaaaauauuguagaagugcu

SEQ ID NO: 107438 - RNA, 18 nt, Human
acaaaaauagugcuuugg

SEQ ID NO: 107439 - RNA, 22 nt, Human
acaaacugggauaggauccugu

SEQ ID NO: 107440 - RNA, 22 nt, Human
acaacccacacguuccgggugg

SEQ ID NO: 107441 - RNA, 22 nt, Human
acaaccaugucaguucaaacca

SEQ ID NO: 107442 - RNA, 22 nt, Human
aauuggagaguugugaaaggau

SEQ ID NO: 107443 - RNA, 20 nt, Human
acaaccacugcucacaguuu

SEQ ID NO: 107444 - RNA, 22 nt, Human
acaacagaacuccugggauuuu

SEQ ID NO: 107445 - RNA, 22 nt, Human
acaaauuuaaauguugucuguu

SEQ ID NO: 107446 - RNA, 22 nt, Human
acaaaucccuguaaacacagcu

SEQ ID NO: 107447 - RNA, 22 nt, Human
aauuauugucuuuuuuaaaagc

SEQ ID NO: 107448 - RNA, 22 nt, Human
aauuauucucucaacugagaug

SEQ ID NO: 107449 - RNA, 22 nt, Human
aauuauucaugucugggcagcc

SEQ ID NO: 107450 - RNA, 22 nt, Human
aauucuguugguuagaguugga

SEQ ID NO: 107451 - RNA, 22 nt, Human
aauucuuuguuccucugccaag

SEQ ID NO: 107452 - RNA, 22 nt, Human
aauugaggaaccuuagggcaaa

SEQ ID NO: 107453 - RNA, 22 nt, Human
aauugauauuagauuugucuca

SEQ ID NO: 107454 - RNA, 22 nt, Human
aauugcauucauuuguauauuu

SEQ ID NO: 107455 - RNA, 22 nt, Human
aauugccaagaauuagugauac

SEQ ID NO: 107456 - RNA, 21 nt, Human
aauugccuaauauaugggaag

SEQ ID NO: 107457 - RNA, 22 nt, Human
aauugcuuucacaaguguuaua

SEQ ID NO: 107458 - RNA, 22 nt, Human
aauuuauccuuuugcuaaagca

SEQ ID NO: 107459 - RNA, 22 nt, Human
aauuucagaccaacgagucagg

SEQ ID NO: 107460 - RNA, 22 nt, Human
aauuuaauugguuuuuacuugu

SEQ ID NO: 107461 - RNA, 20 nt, Human
aauuuagaguuuuaccaagg

SEQ ID NO: 107462 - RNA, 22 nt, Human
aauuucaucugagacugggagc

SEQ ID NO: 107463 - RNA, 22 nt, Human
aauuuaaguuauugcuaaugug

SEQ ID NO: 107464 - RNA, 22 nt, Human
aauuguuagaaaugacuguuuu

SEQ ID NO: 107465 - RNA, 22 nt, Human
aauugugagaguuagagagcau

SEQ ID NO: 107466 - RNA, 22 nt, Human
aauugguuugaauaaauaaaga

SEQ ID NO: 107467 - RNA, 22 nt, Human
acaagaaaggucugggaacaau

SEQ ID NO: 107468 - RNA, 22 nt, Human
acaaggaagaaaacauuacuuu

SEQ ID NO: 107469 - RNA, 22 nt, Human
acaauaauguuuuuagguuauu

SEQ ID NO: 107470 - RNA, 20 nt, Human
acaacuuaguugagagacua

SEQ ID NO: 107471 - RNA, 22 nt, Human
acaaucagcacugaguuuaucu

SEQ ID NO: 107472 - RNA, 22 nt, Human
acaaguuucauuguuuagaacc

SEQ ID NO: 107473 - RNA, 23 nt, Human
acaaguguuuccaauauggcugg

SEQ ID NO: 107474 - RNA, 22 nt, Human
acaagguugauucuggcaucug

SEQ ID NO: 107475 - RNA, 22 nt, Human
acaaugugcuuaugaaggcagu

SEQ ID NO: 107476 - RNA, 22 nt, Human
acaaucauuuuuccccuucagu

SEQ ID NO: 107477 - RNA, 21 nt, Human
acaaugaguuugaggcaucag

SEQ ID NO: 107478 - RNA, 22 nt, Human
acaaucuuauuaguaguauaga

SEQ ID NO: 107479 - RNA, 22 nt, Human
acacaacuuuauuaauuuauac

SEQ ID NO: 107480 - RNA, 17 nt, Human
acaaugggcaacaauau

SEQ ID NO: 107481 - RNA, 22 nt, Human
acacagugaccuacauuccaaa

SEQ ID NO: 107482 - RNA, 22 nt, Human
acacgugcaggagaauguagug

SEQ ID NO: 107483 - RNA, 22 nt, Human
acacuuuugcgagagcaugcag

SEQ ID NO: 107484 - RNA, 22 nt, Human
acagaucugcacagugaacaau

SEQ ID NO: 107485 - RNA, 22 nt, Human
acagaauugggguucuugggga

SEQ ID NO: 107486 - RNA, 22 nt, Human
acagacuugaccuuggagaggc

SEQ ID NO: 107487 - RNA, 23 nt, Human
acagcaagaggaccagaugugag

SEQ ID NO: 107488 - RNA, 23 nt, Human
acagaggcaucagagcagcaggc

SEQ ID NO: 107489 - RNA, 22 nt, Human
acagaucuauauuauauauaca

SEQ ID NO: 107490 - RNA, 22 nt, Human
acagcagguuauuguuauggca

SEQ ID NO: 107491 - RNA, 22 nt, Human
acagcuauuuaaaggcuuuagg

SEQ ID NO: 107492 - RNA, 22 nt, Human
acagccaacgucuuucuuacuu

SEQ ID NO: 107493 - RNA, 22 nt, Human
acagacuuuuagacuuaugagu

SEQ ID NO: 107494 - RNA, 20 nt, Human
acagagauccucucuuuauc

SEQ ID NO: 107495 - RNA, 22 nt, Human
acagcuggaggucugugagcac

SEQ ID NO: 107496 - RNA, 22 nt, Human
acaggaaaugaaaugguaucua

SEQ ID NO: 107497 - RNA, 22 nt, Human
acagccacuaugacagauuuag

SEQ ID NO: 107498 - RNA, 22 nt, Human
acagcucaggcccaucaacccc

SEQ ID NO: 107499 - RNA, 22 nt, Human
acaggauuuucagggaagguga

SEQ ID NO: 107500 - RNA, 22 nt, Human
acaggcgucgccugcucuugcc

SEQ ID NO: 107501 - RNA, 19 nt, Human
acaggaaggaaaauuucaa

SEQ ID NO: 107502 - RNA, 22 nt, Human
acagguauuaugaagccuauuu

SEQ ID NO: 107503 - RNA, 22 nt, Human
acauauggcagguugaucaaug

SEQ ID NO: 107504 - RNA, 22 nt, Human
acagguuggagguguggaguca

SEQ ID NO: 107505 - RNA, 22 nt, Human
acauaaauagcacugugaauuu

SEQ ID NO: 107506 - RNA, 22 nt, Human
acauagcuuaaaugagaagaua

SEQ ID NO: 107507 - RNA, 22 nt, Human
acaguuagguccuaaaauucug

SEQ ID NO: 107508 - RNA, 22 nt, Human
acaguuuuccuugguauagaac

SEQ ID NO: 107509 - RNA, 22 nt, Human
aaggaaaaaauggcuugugaua

SEQ ID NO: 107510 - RNA, 22 nt, Human
aaggaaaaccugacugaagaac

SEQ ID NO: 107511 - RNA, 22 nt, Human
aagcuuugggcagaagaggauu

SEQ ID NO: 107512 - RNA, 19 nt, Human
aaggcuuucugagugaaaa

SEQ ID NO: 107513 - RNA, 22 nt, Human
aaggcugaccaguuuacacuuu

SEQ ID NO: 107514 - RNA, 22 nt, Human
aaggggaauaguaggaccuggg

SEQ ID NO: 107515 - RNA, 22 nt, Human
aaggucaggggcuuuugaaaca

SEQ ID NO: 107516 - RNA, 22 nt, Human
aagggggacaagcauuggcuua

SEQ ID NO: 107517 - RNA, 22 nt, Human
aagggagaguauccagaaacag

SEQ ID NO: 107518 - RNA, 23 nt, Human
aagggcgauuaacauucgcucga

SEQ ID NO: 107519 - RNA, 22 nt, Human
aagguggugaucaucuugaagg

SEQ ID NO: 107520 - RNA, 23 nt, Human
aaggugaagccaccaggugagga

SEQ ID NO: 107521 - RNA, 22 nt, Human
aaguacugauucuguuccucaa

SEQ ID NO: 107522 - RNA, 22 nt, Human
aaggugcauuaguuuggagggg

SEQ ID NO: 107523 - RNA, 22 nt, Human
aagucauuaucucuucuaaucu

SEQ ID NO: 107524 - RNA, 22 nt, Human
aaguccaaaacauuucucugcu

SEQ ID NO: 107525 - RNA, 22 nt, Human
aagucgccuaaacaaaguaucu

SEQ ID NO: 107526 - RNA, 22 nt, Human
aagugagaugggagucagagga

SEQ ID NO: 107527 - RNA, 22 nt, Human
aagugauuuagagagcucuuag

SEQ ID NO: 107528 - RNA, 22 nt, Human
aagugauuuucccaccaucuac

SEQ ID NO: 107529 - RNA, 22 nt, Human
aagugaggagaccucuucuuca

SEQ ID NO: 107530 - RNA, 22 nt, Human
aagugaagccaauuuuuuuagg

SEQ ID NO: 107531 - RNA, 22 nt, Human
aagugaaaaaagucaguacuga

SEQ ID NO: 107532 - RNA, 22 nt, Human
aagucuuugagaucggacauag

SEQ ID NO: 107533 - RNA, 20 nt, Human
aauaaauauaacccauaauu

SEQ ID NO: 107534 - RNA, 16 nt, Human
aaguuuuaucuucuca

SEQ ID NO: 107535 - RNA, 21 nt, Human
aaguuuuggcuguacaguugu

SEQ ID NO: 107536 - RNA, 22 nt, Human
aauaagagaauaaaaucuguua

SEQ ID NO: 107537 - RNA, 22 nt, Human
aauaaugguuugauucucacau

SEQ ID NO: 107538 - RNA, 22 nt, Human
aagugauuuuccuacuugcuaa

SEQ ID NO: 107539 - RNA, 22 nt, Human
aagugcuggccuacucaaucga

SEQ ID NO: 107540 - RNA, 23 nt, Human
aagugcucaguggacagcauugc

SEQ ID NO: 107541 - RNA, 20 nt, Human
aaguugaaguuacuucaugg

SEQ ID NO: 107542 - RNA, 22 nt, Human
aaguucuuauguucugaugugc

SEQ ID NO: 107543 - RNA, 22 nt, Human
aauagcaauuacccuucaacuc

SEQ ID NO: 107544 - RNA, 22 nt, Human
aauaauuuuuuugugauuaugu

SEQ ID NO: 107545 - RNA, 22 nt, Human
aauagagacaguuuaacaauau

SEQ ID NO: 107546 - RNA, 20 nt, Human
aauagcacagcucaaacauu

SEQ ID NO: 107547 - RNA, 22 nt, Human
aauauuuugggacugaggaauu

SEQ ID NO: 107548 - RNA, 22 nt, Human
aaucaaauuucuugugguuguu

SEQ ID NO: 107549 - RNA, 22 nt, Human
aaucaauuauccauuuguuagu

SEQ ID NO: 107550 - RNA, 19 nt, Human
aaucacaagcaauaggggu

SEQ ID NO: 107551 - RNA, 22 nt, Human
aaucacuggcuccucacggcaa

SEQ ID NO: 107552 - RNA, 22 nt, Human
aaucauaacaaaagcaauuaua

SEQ ID NO: 107553 - RNA, 22 nt, Human
aauaugccaaauccugucacau

SEQ ID NO: 107554 - RNA, 22 nt, Human
aauaugucacacuccuuaauag

SEQ ID NO: 107555 - RNA, 22 nt, Human
aauauuuaaauagaauuacauc

SEQ ID NO: 107556 - RNA, 22 nt, Human
aagcacagggacucaggaccgg

SEQ ID NO: 107557 - RNA, 22 nt, Human
aagcaauucacaguucacuuaa

SEQ ID NO: 107558 - RNA, 22 nt, Human
aagcaaguucuaaaguaauucu

SEQ ID NO: 107559 - RNA, 22 nt, Human
aagcagugacucucagaggcag

SEQ ID NO: 107560 - RNA, 22 nt, Human
aagcaaaugguauugguauuau

SEQ ID NO: 107561 - RNA, 22 nt, Human
aagccagccaguuccagcagcu

SEQ ID NO: 107562 - RNA, 22 nt, Human
aagcauuuuagauaaagcauca

SEQ ID NO: 107563 - RNA, 22 nt, Human
aagcucagcugguggugauugc

SEQ ID NO: 107564 - RNA, 22 nt, Human
aagcaugagguggugagugaca

SEQ ID NO: 107565 - RNA, 22 nt, Human
aaggaaaguuaagguaaacucu

SEQ ID NO: 107566 - RNA, 22 nt, Human
aaggaacuucagggcgaaugga

SEQ ID NO: 107567 - RNA, 18 nt, Human
aagcugcauuauuuuggc

SEQ ID NO: 107568 - RNA, 22 nt, Human
aagcccuuugaaaauguguguc

SEQ ID NO: 107569 - RNA, 22 nt, Human
aagccuguugacagcugucagu

SEQ ID NO: 107570 - RNA, 22 nt, Human
aagcucugggacugaggcuccu

SEQ ID NO: 107571 - RNA, 22 nt, Human
aagcugaguaggaaugguaggu

SEQ ID NO: 107572 - RNA, 22 nt, Human
aagcucuuuccacuaaaccacu

SEQ ID NO: 107573 - RNA, 22 nt, Human
aagcgcaaggugucagcagguu

SEQ ID NO: 107574 - RNA, 22 nt, Human
aagccuuagauuggcgaugucg

SEQ ID NO: 107575 - RNA, 22 nt, Human
aaggcgauuuaaagauguuagg

SEQ ID NO: 107576 - RNA, 20 nt, Human
aagcuguguucaagauggga

SEQ ID NO: 107577 - RNA, 22 nt, Human
aaggacaaaacagcuguucuaa

SEQ ID NO: 107578 - RNA, 22 nt, Human
aaggaguggugaagucagaugu

SEQ ID NO: 107579 - RNA, 22 nt, Human
aaggaugguaacaguuucauuu

SEQ ID NO: 107580 - RNA, 22 nt, Human
aaggauuuccaggccugcgccu

SEQ ID NO: 107581 - RNA, 22 nt, Human
aaggcgaggggcacagcugaga

SEQ ID NO: 107582 - RNA, 22 nt, Human
aaggccuaggaguugacauggg

SEQ ID NO: 107583 - RNA, 22 nt, Human
aagaaaagcaucuuuguaguag

SEQ ID NO: 107584 - RNA, 22 nt, Human
aagaaaccauauuaguuccugg

SEQ ID NO: 107585 - RNA, 22 nt, Human
aagaaagaucugaaagaagcga

SEQ ID NO: 107586 - RNA, 22 nt, Human
aaccaaguaaagagguuucauu

SEQ ID NO: 107587 - RNA, 22 nt, Human
aagaaaagguaaccgcuuaucu

SEQ ID NO: 107588 - RNA, 22 nt, Human
aagaaauagauagaggaauacu

SEQ ID NO: 107589 - RNA, 22 nt, Human
aagaaauacagaaauggcagua

SEQ ID NO: 107590 - RNA, 19 nt, Human
aagaacaguucuaauuuca

SEQ ID NO: 107591 - RNA, 22 nt, Human
aagacagugacagucacaauug

SEQ ID NO: 107592 - RNA, 22 nt, Human
aagaacuagauagugguguaaa

SEQ ID NO: 107593 - RNA, 22 nt, Human
aagaaggaaggcaagagauggg

SEQ ID NO: 107594 - RNA, 22 nt, Human
aagaagcuacugucacuaucag

SEQ ID NO: 107595 - RNA, 22 nt, Human
aagagaaacauauggccagauu

SEQ ID NO: 107596 - RNA, 22 nt, Human
aagagaaaaaucuuaaucuagu

SEQ ID NO: 107597 - RNA, 22 nt, Human
aagaaggcggaccagaagggag

SEQ ID NO: 107598 - RNA, 22 nt, Human
aagaagguugaaugacuacuuu

SEQ ID NO: 107599 - RNA, 22 nt, Human
aagaggaggcuggaauccuaaa

SEQ ID NO: 107600 - RNA, 22 nt, Human
aagaaugaaaugaaagaacuaa

SEQ ID NO: 107601 - RNA, 23 nt, Human
aagaaugcuucugaagagcugcc

SEQ ID NO: 107602 - RNA, 22 nt, Human
aagacacuuucuaaauagaagu

SEQ ID NO: 107603 - RNA, 22 nt, Human
aagaugaucagagggcaagagg

SEQ ID NO: 107604 - RNA, 22 nt, Human
aagauauauaaggaaguucagu

SEQ ID NO: 107605 - RNA, 22 nt, Human
aagauagaaugauguuggcuca

SEQ ID NO: 107606 - RNA, 22 nt, Human
aagauauauaacccuuucacuu

SEQ ID NO: 107607 - RNA, 23 nt, Human
aagcaacagacuucaucagauau

SEQ ID NO: 107608 - RNA, 22 nt, Human
aagcagaacuguuuuguuuucu

SEQ ID NO: 107609 - RNA, 22 nt, Human
aagaugcaagcauuuugaacug

SEQ ID NO: 107610 - RNA, 22 nt, Human
aagcaacccagugcuuguauag

SEQ ID NO: 107611 - RNA, 21 nt, Human
aagcagcugcagaauuucagu

SEQ ID NO: 107612 - RNA, 22 nt, Human
aagaguuaggagugggcuuuga

SEQ ID NO: 107613 - RNA, 22 nt, Human
aagaggcagcuugguaggcauc

SEQ ID NO: 107614 - RNA, 22 nt, Human
aagaugcuucaugagaguuggg

SEQ ID NO: 107615 - RNA, 22 nt, Human
aagaugaguuacaaaggaguaa

SEQ ID NO: 107616 - RNA, 22 nt, Human
aagagggguggucugugaggau

SEQ ID NO: 107617 - RNA, 22 nt, Human
aagagugugagguugugcuuuu

SEQ ID NO: 107618 - RNA, 22 nt, Human
aagcaaaaucgcaucuggggcc

SEQ ID NO: 107619 - RNA, 22 nt, Human
aagcaaagucaucuagaguagu

SEQ ID NO: 107620 - RNA, 22 nt, Human
aagcaaaagguuacacuucugg

SEQ ID NO: 107621 - RNA, 22 nt, Human
aguucuguucccccaguuacau

SEQ ID NO: 107622 - RNA, 22 nt, Human
aguucugacucugaaucuggga

SEQ ID NO: 107623 - RNA, 22 nt, Human
aguucauucuagcugggagcag

SEQ ID NO: 107624 - RNA, 22 nt, Human
aguucuuugcucccugcuuuuu

SEQ ID NO: 107625 - RNA, 22 nt, Human
aguucuggcccugaaacaggga

SEQ ID NO: 107626 - RNA, 22 nt, Human
aguucucaagguuaggaaaagu

SEQ ID NO: 107627 - RNA, 22 nt, Human
aguugugagaaugaacacugaa

SEQ ID NO: 107628 - RNA, 22 nt, Human
aguuggaagacacccugaaauc

SEQ ID NO: 107629 - RNA, 22 nt, Human
aguugcuucccuauucuuagca

SEQ ID NO: 107630 - RNA, 22 nt, Human
aguugaggguuaguaaauagcu

SEQ ID NO: 107631 - RNA, 22 nt, Human
aguugcagguucacguaucuug

SEQ ID NO: 107632 - RNA, 22 nt, Human
aguugguggaagcuaagcuucu

SEQ ID NO: 107633 - RNA, 22 nt, Human
aguugguauuuacugcaguugg

SEQ ID NO: 107634 - RNA, 22 nt, Human
aguuggcauuuuauuuaaguau

SEQ ID NO: 107635 - RNA, 18 nt, Human
aguuuuuuuggcaaaagg

SEQ ID NO: 107636 - RNA, 22 nt, Human
auaaaaaguggcugcuauugga

SEQ ID NO: 107637 - RNA, 22 nt, Human
aguuugauuugucuaucuucau

SEQ ID NO: 107638 - RNA, 22 nt, Human
aguuucuugaagacugauguuu

SEQ ID NO: 107639 - RNA, 22 nt, Human
aguuuuugccucgaauucugcg

SEQ ID NO: 107640 - RNA, 22 nt, Human
aguuuuugagaauucuucugaa

SEQ ID NO: 107641 - RNA, 22 nt, Human
aguuuuguuuguuuguuuguua

SEQ ID NO: 107642 - RNA, 22 nt, Human
aguuuucugccucuggaugcgu

SEQ ID NO: 107643 - RNA, 22 nt, Human
aguuucaguuaguugggugaca

SEQ ID NO: 107644 - RNA, 22 nt, Human
aguuuccacuggagacacugug

SEQ ID NO: 107645 - RNA, 22 nt, Human
aguuuaaauuguucuaucagaa

SEQ ID NO: 107646 - RNA, 23 nt, Human
aguuuacguauucauucuuacuc

SEQ ID NO: 107647 - RNA, 22 nt, Human
aguugguucgucucgccuugag

SEQ ID NO: 107648 - RNA, 21 nt, Human
aguuguacuguauagcagaug

SEQ ID NO: 107649 - RNA, 22 nt, Human
aguuuacccacuguugaaauua

SEQ ID NO: 107650 - RNA, 22 nt, Human
aguuuggaggagaaagugcggg

SEQ ID NO: 107651 - RNA, 22 nt, Human
aguuguuuuucuuagauuuuag

SEQ ID NO: 107652 - RNA, 22 nt, Human
aguuguucucagcagaagaacu

SEQ ID NO: 107653 - RNA, 23 nt, Human
auaaugauaaugcuauuuuuugu

SEQ ID NO: 107654 - RNA, 22 nt, Human
auaaguuauuuuaguaaaucag

SEQ ID NO: 107655 - RNA, 22 nt, Human
auaaucuuuccagucaguuucc

SEQ ID NO: 107656 - RNA, 22 nt, Human
auaagguuuucuuuuguucccu

SEQ ID NO: 107657 - RNA, 22 nt, Human
auacaaaaaguggugaguguau

SEQ ID NO: 107658 - RNA, 22 nt, Human
auaccaaugacaggaguuaggg

SEQ ID NO: 107659 - RNA, 21 nt, Human
auaccaaaagaacaccuuguu

SEQ ID NO: 107660 - RNA, 22 nt, Human
auaauugaauaagagcugcagg

SEQ ID NO: 107661 - RNA, 22 nt, Human
auacacauguuauuguggaagc

SEQ ID NO: 107662 - RNA, 22 nt, Human
auacaauugcaauggaagauga

SEQ ID NO: 107663 - RNA, 22 nt, Human
auaagcuucucugcaguucagu

SEQ ID NO: 107664 - RNA, 22 nt, Human
auaaggaaagugagugcuuaaa

SEQ ID NO: 107665 - RNA, 22 nt, Human
auaaauuugccagcauauguuc

SEQ ID NO: 107666 - RNA, 22 nt, Human
auaaauuugacagcucuucaug

SEQ ID NO: 107667 - RNA, 22 nt, Human
auaaaucaagggcaguauuucc

SEQ ID NO: 107668 - RNA, 22 nt, Human
auaaauucuaugauggauuggg

SEQ ID NO: 107669 - RNA, 22 nt, Human
auaaagggccuuauuuuagcaa

SEQ ID NO: 107670 - RNA, 22 nt, Human
auaaaagcacaauagaguuaug

SEQ ID NO: 107671 - RNA, 22 nt, Human
auaaaaucugaagcaagaauaa

SEQ ID NO: 107672 - RNA, 22 nt, Human
auaaaaauguuuuuguguggua

SEQ ID NO: 107673 - RNA, 22 nt, Human
aguuuuuaacgccauguuugaa

SEQ ID NO: 107674 - RNA, 22 nt, Human
auaaggacuugaauuagacauu

SEQ ID NO: 107675 - RNA, 22 nt, Human
auaaucuuugaguagaguugag

SEQ ID NO: 107676 - RNA, 22 nt, Human
auaaccaaaaauaguuuaguac

SEQ ID NO: 107677 - RNA, 22 nt, Human
auaacgaaagcaauuauuuuca

SEQ ID NO: 107678 - RNA, 22 nt, Human
auaagccugccuuaucuccaga

SEQ ID NO: 107679 - RNA, 22 nt, Human
auaaaacagaucaggagaauga

SEQ ID NO: 107680 - RNA, 20 nt, Human
auaaauaggauuuucugaca

SEQ ID NO: 107681 - RNA, 22 nt, Human
auaaaguaaugcauauaaugug

SEQ ID NO: 107682 - RNA, 22 nt, Human
aguggcuguuccaggugaggac

SEQ ID NO: 107683 - RNA, 22 nt, Human
aguggcuggcaggggagggucc

SEQ ID NO: 107684 - RNA, 22 nt, Human
aguggcugugaaauacauggga

SEQ ID NO: 107685 - RNA, 22 nt, Human
aguggggaaauaucaauauuug

SEQ ID NO: 107686 - RNA, 22 nt, Human
aguguucaauuugagcucaaag

SEQ ID NO: 107687 - RNA, 22 nt, Human
aguguuaggaauuaauguaggg

SEQ ID NO: 107688 - RNA, 22 nt, Human
aguguggcccaugaauuauugg

SEQ ID NO: 107689 - RNA, 22 nt, Human
aguguauuugccuauaaaaaug

SEQ ID NO: 107690 - RNA, 22 nt, Human
agugucagcagcuucauugucu

SEQ ID NO: 107691 - RNA, 22 nt, Human
aguguuugggagagggugugag

SEQ ID NO: 107692 - RNA, 22 nt, Human
aguguuuuaugugccaguuuaa

SEQ ID NO: 107693 - RNA, 23 nt, Human
aguguucagcauguaguaaauac

SEQ ID NO: 107694 - RNA, 20 nt, Human
aguguugaacuacacuuccc

SEQ ID NO: 107695 - RNA, 22 nt, Human
aguuaacuugugguuuggcugu

SEQ ID NO: 107696 - RNA, 22 nt, Human
aguuaucuauaaaucccugagg

SEQ ID NO: 107697 - RNA, 22 nt, Human
aguuaaagggggcuacagugug

SEQ ID NO: 107698 - RNA, 22 nt, Human
aguuaggaaauaaguugaguuu

SEQ ID NO: 107699 - RNA, 22 nt, Human
aguuaauuauagugcuuaauau

SEQ ID NO: 107700 - RNA, 22 nt, Human
aguuacuauuacuuauuauuau

SEQ ID NO: 107701 - RNA, 23 nt, Human
aguuaucuaaugaaguucuucca

SEQ ID NO: 107702 - RNA, 22 nt, Human
aguguuuuaagaaaguaauuuu

SEQ ID NO: 107703 - RNA, 22 nt, Human
aguuaaucuuguauuaaugguu

SEQ ID NO: 107704 - RNA, 22 nt, Human
aguuaugcaagcaaguaccacu

SEQ ID NO: 107705 - RNA, 22 nt, Human
aguuauuuuucacuauuaggcu

SEQ ID NO: 107706 - RNA, 22 nt, Human
aguuauggguauguauuauaau

SEQ ID NO: 107707 - RNA, 22 nt, Human
aguucaugcuuagaucucauuu

SEQ ID NO: 107708 - RNA, 22 nt, Human
aguucauaucuacuuuuccauc

SEQ ID NO: 107709 - RNA, 22 nt, Human
aguucaugugguuuaacuuaau

SEQ ID NO: 107710 - RNA, 22 nt, Human
aguucaauuguuuuguaaaagu

SEQ ID NO: 107711 - RNA, 22 nt, Human
aguuauuaagaaaauuuugcca

SEQ ID NO: 107712 - RNA, 19 nt, Human
agugggcaaggaagaugac

SEQ ID NO: 107713 - RNA, 22 nt, Human
aguggugccuaagcgcggaggc

SEQ ID NO: 107714 - RNA, 22 nt, Human
agugauguaauggugaauguga

SEQ ID NO: 107715 - RNA, 22 nt, Human
agugccaucuuuaacuguccca

SEQ ID NO: 107716 - RNA, 23 nt, Human
agugaucuguguuugaagaaugc

SEQ ID NO: 107717 - RNA, 22 nt, Human
agugccauggcugcuagauggc

SEQ ID NO: 107718 - RNA, 22 nt, Human
agugcgagaugaggacagaagc

SEQ ID NO: 107719 - RNA, 22 nt, Human
agugcuuuauguuguugugcaa

SEQ ID NO: 107720 - RNA, 22 nt, Human
agugccuuaaaggucuugcagc

SEQ ID NO: 107721 - RNA, 22 nt, Human
agugccuucuagaaucucuuaa

SEQ ID NO: 107722 - RNA, 22 nt, Human
aguaggaauucaaagagacaaa

SEQ ID NO: 107723 - RNA, 22 nt, Human
aguagcaguuccauuugaugug

SEQ ID NO: 107724 - RNA, 22 nt, Human
aguagaauuacagguuuucucu

SEQ ID NO: 107725 - RNA, 22 nt, Human
aguagacuuuuuauuuguuuug

SEQ ID NO: 107726 - RNA, 22 nt, Human
agugagcuuuuaaaauuuacca

SEQ ID NO: 107727 - RNA, 22 nt, Human
agugagcauuagugcuuauauu

SEQ ID NO: 107728 - RNA, 21 nt, Human
agugagugacagaagaagguu

SEQ ID NO: 107729 - RNA, 22 nt, Human
agugaucugcugcagugcucug

SEQ ID NO: 107730 - RNA, 22 nt, Human
agugaugauccaaaugaauuga

SEQ ID NO: 107731 - RNA, 22 nt, Human
agugaugcuuuggagaagaucc

SEQ ID NO: 107732 - RNA, 20 nt, Human
agugauuuguuaguacauug

SEQ ID NO: 107733 - RNA, 22 nt, Human
agggcaguuuuacugaaaggug

SEQ ID NO: 107734 - RNA, 22 nt, Human
aggggcaaacuuguucuagggu

SEQ ID NO: 107735 - RNA, 22 nt, Human
agggaaauaggagaagaaagga

SEQ ID NO: 107736 - RNA, 21 nt, Human
aggcuuggaucuagacaggcc

SEQ ID NO: 107737 - RNA, 22 nt, Human
aggcugucucaccucaggaggg

SEQ ID NO: 107738 - RNA, 22 nt, Human
aggcuguagaucuagacaugua

SEQ ID NO: 107739 - RNA, 22 nt, Human
aggcuuuugcucuggcuccucu

SEQ ID NO: 107740 - RNA, 22 nt, Human
aggcuucaaggacagcagccac

SEQ ID NO: 107741 - RNA, 22 nt, Human
aggcuuaacuacaauuuuugcc

SEQ ID NO: 107742 - RNA, 22 nt, Human
aggggcaagucuggccauuucu

SEQ ID NO: 107743 - RNA, 22 nt, Human
agggcuuaggcacacugugacu

SEQ ID NO: 107744 - RNA, 22 nt, Human
aggucagacagggugucuuucu

SEQ ID NO: 107745 - RNA, 22 nt, Human
aggguaauaacaguauggugau

SEQ ID NO: 107746 - RNA, 22 nt, Human
aggugcagcugguggagucugg

SEQ ID NO: 107747 - RNA, 22 nt, Human
aggugggcuuagaaaucuguau

SEQ ID NO: 107748 - RNA, 22 nt, Human
aggugauauuauguauuucuau

SEQ ID NO: 107749 - RNA, 22 nt, Human
aggugagaaggacuguugcauu

SEQ ID NO: 107750 - RNA, 22 nt, Human
agguggucuuguggaugccgca

SEQ ID NO: 107751 - RNA, 22 nt, Human
aggugucauuauagaccagaua

SEQ ID NO: 107752 - RNA, 22 nt, Human
agguguaauuacucuugcaguu

SEQ ID NO: 107753 - RNA, 22 nt, Human
agguggugacgaugcuccguac

SEQ ID NO: 107754 - RNA, 22 nt, Human
agguuaggaggggagugccaca

SEQ ID NO: 107755 - RNA, 22 nt, Human
agguuagaauauuuuuucaaga

SEQ ID NO: 107756 - RNA, 22 nt, Human
agguuaggaaugggagguaaug

SEQ ID NO: 107757 - RNA, 22 nt, Human
agguuaauaugaacagcagaag

SEQ ID NO: 107758 - RNA, 22 nt, Human
agguuaaacuuccugcagggcu

SEQ ID NO: 107759 - RNA, 22 nt, Human
aggugugcacccggucgcuucc

SEQ ID NO: 107760 - RNA, 22 nt, Human
agguuaaaagagugaguggaua

SEQ ID NO: 107761 - RNA, 22 nt, Human
agguuuaggaaaacugagaguc

SEQ ID NO: 107762 - RNA, 22 nt, Human
agguggcuaugaggaugcaguc

SEQ ID NO: 107763 - RNA, 20 nt, Human
agguugguuuacuagucugu

SEQ ID NO: 107764 - RNA, 18 nt, Human
agguugcaucugugcaga

SEQ ID NO: 107765 - RNA, 22 nt, Human
agguuuuacuuuuuuuggaggu

SEQ ID NO: 107766 - RNA, 22 nt, Human
aguaauaaacaacucauuuugg

SEQ ID NO: 107767 - RNA, 20 nt, Human
aguacugacaauauucugug

SEQ ID NO: 107768 - RNA, 21 nt, Human
aguaccugugugccugugugu

SEQ ID NO: 107769 - RNA, 19 nt, Human
aguaaagugguggcauuuu

SEQ ID NO: 107770 - RNA, 18 nt, Human
aguaaauguuaaauauug

SEQ ID NO: 107771 - RNA, 22 nt, Human
agguuuuagagagccaggaugu

SEQ ID NO: 107772 - RNA, 22 nt, Human
agguuuauggagcaccacaucu

SEQ ID NO: 107773 - RNA, 22 nt, Human
aggaauugucgucauguauaau

SEQ ID NO: 107774 - RNA, 22 nt, Human
aggaauguugagacauggcuaa

SEQ ID NO: 107775 - RNA, 22 nt, Human
aggaauuuuaauaugcuugucu

SEQ ID NO: 107776 - RNA, 22 nt, Human
aggaaauaagggcacuucagau

SEQ ID NO: 107777 - RNA, 22 nt, Human
agcggccucgcugccugcucag

SEQ ID NO: 107778 - RNA, 22 nt, Human
aggaauuugggguuacaugaug

SEQ ID NO: 107779 - RNA, 22 nt, Human
aggacaaaggaccagaucugga

SEQ ID NO: 107780 - RNA, 22 nt, Human
aggaacaacagccuuuauaucc

SEQ ID NO: 107781 - RNA, 22 nt, Human
aggaagaagggacagaauuuug

SEQ ID NO: 107782 - RNA, 22 nt, Human
aggaauuucacugcguuuuuua

SEQ ID NO: 107783 - RNA, 22 nt, Human
aggauuagucaccauuauuauu

SEQ ID NO: 107784 - RNA, 22 nt, Human
aggauuuauuccagaaaugcaa

SEQ ID NO: 107785 - RNA, 22 nt, Human
aggauuuaauugcauuuuucuc

SEQ ID NO: 107786 - RNA, 22 nt, Human
aggauugaaaaaacacauauau

SEQ ID NO: 107787 - RNA, 20 nt, Human
aggauuauguacauggaugc

SEQ ID NO: 107788 - RNA, 22 nt, Human
aggcaacagacaggcuugguuc

SEQ ID NO: 107789 - RNA, 22 nt, Human
aggauuuagcaugaaaugugaa

SEQ ID NO: 107790 - RNA, 22 nt, Human
aggcaauuuuuaggguuguugu

SEQ ID NO: 107791 - RNA, 22 nt, Human
aggcaauuauacuagguuuugg

SEQ ID NO: 107792 - RNA, 22 nt, Human
aggcagaugggagcuggaaguu

SEQ ID NO: 107793 - RNA, 22 nt, Human
aggauugauggcauguuuacug

SEQ ID NO: 107794 - RNA, 23 nt, Human
aggcaagaacggguuguucaccc

SEQ ID NO: 107795 - RNA, 22 nt, Human
aggcaagauuaggaccagaaga

SEQ ID NO: 107796 - RNA, 23 nt, Human
aggcagcaugcaacaggccauuu

SEQ ID NO: 107797 - RNA, 22 nt, Human
aggcaucguguuuuucugcuuu

SEQ ID NO: 107798 - RNA, 22 nt, Human
aggcaggagcugugguggugag

SEQ ID NO: 107799 - RNA, 22 nt, Human
aggcagcagggagggagaaaug

SEQ ID NO: 107800 - RNA, 22 nt, Human
aggcauauaguguuuaaaaaaa

SEQ ID NO: 107801 - RNA, 22 nt, Human
aggccagugcagcuggaacaga

SEQ ID NO: 107802 - RNA, 22 nt, Human
aggcauuuaaagauguaagacu

SEQ ID NO: 107803 - RNA, 22 nt, Human
aggcauuuaucaggaaauguuc

SEQ ID NO: 107804 - RNA, 22 nt, Human
aggcauuuucuuguuauuuuua

SEQ ID NO: 107805 - RNA, 21 nt, Human
aggcauuuucuuggagauucu

SEQ ID NO: 107806 - RNA, 22 nt, Human
aggcuaagugauuagugacaua

SEQ ID NO: 107807 - RNA, 22 nt, Human
agcagcaggugaccucgaugcc

SEQ ID NO: 107808 - RNA, 22 nt, Human
agcagcaggcugggaugagucu

SEQ ID NO: 107809 - RNA, 17 nt, Human
agcagcuggguugaucu

SEQ ID NO: 107810 - RNA, 22 nt, Human
agcauuagguguguuucagagg

SEQ ID NO: 107811 - RNA, 22 nt, Human
agcaggaaggcuagaagcagga

SEQ ID NO: 107812 - RNA, 22 nt, Human
agcaauucugaaauuacuugac

SEQ ID NO: 107813 - RNA, 22 nt, Human
agcaauucagagcauggacuuu

SEQ ID NO: 107814 - RNA, 22 nt, Human
agcagauuguacagugcauuag

SEQ ID NO: 107815 - RNA, 22 nt, Human
agcacucacuagaguuagaacc

SEQ ID NO: 107816 - RNA, 22 nt, Human
agcacuuuagaauuuagaguug

SEQ ID NO: 107817 - RNA, 22 nt, Human
agcagauaaagguugcauuucu

SEQ ID NO: 107818 - RNA, 22 nt, Human
agcagcaaugacaauucaacca

SEQ ID NO: 107819 - RNA, 22 nt, Human
agcaaaauuccaaaaugcuaau

SEQ ID NO: 107820 - RNA, 22 nt, Human
agauuuuacggaguauuagggu

SEQ ID NO: 107821 - RNA, 22 nt, Human
agauuuguauagaugugguuga

SEQ ID NO: 107822 - RNA, 22 nt, Human
agcacauguuucuuuugcaauu

SEQ ID NO: 107823 - RNA, 22 nt, Human
agcaaauaauugucuuugaggg

SEQ ID NO: 107824 - RNA, 22 nt, Human
agcaccuuguucagaucuuaca

SEQ ID NO: 107825 - RNA, 22 nt, Human
agcacagugccugacauauaug

SEQ ID NO: 107826 - RNA, 22 nt, Human
agcagagaacauucauucaugu

SEQ ID NO: 107827 - RNA, 22 nt, Human
agcacguucuucauuacuucac

SEQ ID NO: 107828 - RNA, 22 nt, Human
agcacuugggugauaguacuuu

SEQ ID NO: 107829 - RNA, 22 nt, Human
agcaaaguacugagcucaaagg

SEQ ID NO: 107830 - RNA, 22 nt, Human
agcaacauggaguuugugcgca

SEQ ID NO: 107831 - RNA, 22 nt, Human
agcaauguuggccuauauaccu

SEQ ID NO: 107832 - RNA, 22 nt, Human
agcaaggguugguuuucugaca

SEQ ID NO: 107833 - RNA, 22 nt, Human
agccuauucaucugaucuugaa

SEQ ID NO: 107834 - RNA, 22 nt, Human
agcccuuucuuguuuaacugca

SEQ ID NO: 107835 - RNA, 22 nt, Human
agccuacauuugacuauagucu

SEQ ID NO: 107836 - RNA, 22 nt, Human
agccgcgcagccucauuaagga

SEQ ID NO: 107837 - RNA, 22 nt, Human
agccgcugaauuugaaacaagc

SEQ ID NO: 107838 - RNA, 22 nt, Human
agccuaauuuguaggucugugu

SEQ ID NO: 107839 - RNA, 22 nt, Human
agcgacuugacagacauguccu

SEQ ID NO: 107840 - RNA, 22 nt, Human
agccugaaccaauauagcagcc

SEQ ID NO: 107841 - RNA, 22 nt, Human
agccuuucugcgcacucuuccg

SEQ ID NO: 107842 - RNA, 22 nt, Human
agccagugcagcuggaaauuca

SEQ ID NO: 107843 - RNA, 22 nt, Human
agccaagucucacugagucugu

SEQ ID NO: 107844 - RNA, 22 nt, Human
agccagcauauauauaguugaa

SEQ ID NO: 107845 - RNA, 22 nt, Human
agccaucuggugucaaugauuc

SEQ ID NO: 107846 - RNA, 22 nt, Human
agcauaacaaagggcauaauug

SEQ ID NO: 107847 - RNA, 22 nt, Human
agcauucagacaucugauggau

SEQ ID NO: 107848 - RNA, 22 nt, Human
agcccuauacuuagauuuauuc

SEQ ID NO: 107849 - RNA, 22 nt, Human
agauacuaagccucaagagacg

SEQ ID NO: 107850 - RNA, 22 nt, Human
agauaggccauuaagaaggaua

SEQ ID NO: 107851 - RNA, 22 nt, Human
agauagccagauauaaauaguc

SEQ ID NO: 107852 - RNA, 22 nt, Human
agauauucugccuaacagguuu

SEQ ID NO: 107853 - RNA, 22 nt, Human
agauccuagaugugaauagcua

SEQ ID NO: 107854 - RNA, 22 nt, Human
agaugaugugugucuucagcua

SEQ ID NO: 107855 - RNA, 21 nt, Human
agaugcaguuugcaggugggu

SEQ ID NO: 107856 - RNA, 22 nt, Human
agaugacuaacauaguauugcu

SEQ ID NO: 107857 - RNA, 22 nt, Human
agaugaacuuuuuuaaacugga

SEQ ID NO: 107858 - RNA, 22 nt, Human
agauggcuccaguguccagagg

SEQ ID NO: 107859 - RNA, 23 nt, Human
agaugaugaauaaagagugagga

SEQ ID NO: 107860 - RNA, 22 nt, Human
agauuaagcauuauaauuauaa

SEQ ID NO: 107861 - RNA, 22 nt, Human
agauguugucucuuacguuuga

SEQ ID NO: 107862 - RNA, 22 nt, Human
agauuuggaauggggguucaua

SEQ ID NO: 107863 - RNA, 22 nt, Human
agauugaugugaccauuggaag

SEQ ID NO: 107864 - RNA, 22 nt, Human
agauuucaauggauauugcaag

SEQ ID NO: 107865 - RNA, 22 nt, Human
agauugaacgagcuggcaugga

SEQ ID NO: 107866 - RNA, 19 nt, Human
agauggcaaaaugcaaaga

SEQ ID NO: 107867 - RNA, 22 nt, Human
agauuuucuuuuccaucuuugu

SEQ ID NO: 107868 - RNA, 22 nt, Human
agaugguucagaauuauaaaga

SEQ ID NO: 107869 - RNA, 22 nt, Human
agauuauuuaagacaggaacca

SEQ ID NO: 107870 - RNA, 22 nt, Human
agauguuaauaaccuuagggca

SEQ ID NO: 107871 - RNA, 22 nt, Human
agcaaaacuaaagacacagaca

SEQ ID NO: 107872 - RNA, 22 nt, Human
agauuguaugaggacuccauga

SEQ ID NO: 107873 - RNA, 22 nt, Human
agcaaagccucuuugaaaaaaa

SEQ ID NO: 107874 - RNA, 22 nt, Human
agagcaauggugcuuuaauucu

SEQ ID NO: 107875 - RNA, 22 nt, Human
agagauuuacaacuugggcuuu

SEQ ID NO: 107876 - RNA, 22 nt, Human
agacgacucuuaaggcagaauu

SEQ ID NO: 107877 - RNA, 22 nt, Human
agacuaauaucccauuucugac

SEQ ID NO: 107878 - RNA, 22 nt, Human
agacuauuuugugauaacuaau

SEQ ID NO: 107879 - RNA, 22 nt, Human
agacuagguauagguaauaacu

SEQ ID NO: 107880 - RNA, 22 nt, Human
agagccaugcuugugcauauau

SEQ ID NO: 107881 - RNA, 22 nt, Human
agagcauagggcauuaggaagg

SEQ ID NO: 107882 - RNA, 23 nt, Human
agagggaagagcuuagaugggga

SEQ ID NO: 107883 - RNA, 22 nt, Human
agaggggaaggaugugauguga

SEQ ID NO: 107884 - RNA, 21 nt, Human
agaguuuucuccauuucaggc

SEQ ID NO: 107885 - RNA, 22 nt, Human
agaguucaccccacugaugagu

SEQ ID NO: 107886 - RNA, 22 nt, Human
agauauguuaggcuuguucccu

SEQ ID NO: 107887 - RNA, 22 nt, Human
agauaucuuguuggcauaaaug

SEQ ID NO: 107888 - RNA, 22 nt, Human
agauaaaucauuuauuaagcgg

SEQ ID NO: 107889 - RNA, 22 nt, Human
agauaaacaacucuuagcuguu

SEQ ID NO: 107890 - RNA, 22 nt, Human
agagugagauaugugguuggua

SEQ ID NO: 107891 - RNA, 22 nt, Human
agaguaauguggaguuugugcu

SEQ ID NO: 107892 - RNA, 21 nt, Human
agagugugugcaucauauuug

SEQ ID NO: 107893 - RNA, 19 nt, Human
agaucaggauguauuuuug

SEQ ID NO: 107894 - RNA, 22 nt, Human
agauacaaaagauaagauuuag

SEQ ID NO: 107895 - RNA, 22 nt, Human
agauauuauuuucuauuuauca

SEQ ID NO: 107896 - RNA, 21 nt, Human
acaguaugaucaaaugugcca

SEQ ID NO: 107897 - RNA, 22 nt, Human
acagugguggagggcuguccug

SEQ ID NO: 107898 - RNA, 22 nt, Human
acaucuucuauggagguucgga

SEQ ID NO: 107899 - RNA, 23 nt, Human
acgggaggcggggcagggcugag

SEQ ID NO: 107900 - RNA, 22 nt, Human
acgggugcuuguucccgcugcu

SEQ ID NO: 107901 - RNA, 22 nt, Human
acuauuguccgauuucuuuacu

SEQ ID NO: 107902 - RNA, 22 nt, Human
acuaucuauugucuucuucaug

SEQ ID NO: 107903 - RNA, 22 nt, Human
acucacuguuuugaaauugaac

SEQ ID NO: 107904 - RNA, 22 nt, Human
acuagcacgccuuaccguaaga

SEQ ID NO: 107905 - RNA, 22 nt, Human
acuacuguaauuuauuguuaca

SEQ ID NO: 107906 - RNA, 22 nt, Human
acuaauuuacagaaauuucuua

SEQ ID NO: 107907 - RNA, 22 nt, Human
acguaaacagcaaagacaugau

SEQ ID NO: 107908 - RNA, 22 nt, Human
acguccgcugauucuuuggaag

SEQ ID NO: 107909 - RNA, 22 nt, Human
acgucuacaugcaauucuuaua

SEQ ID NO: 107910 - RNA, 22 nt, Human
acgugcauuacucaaaucucaa

SEQ ID NO: 107911 - RNA, 20 nt, Human
acuagaaagucacugggggg

SEQ ID NO: 107912 - RNA, 22 nt, Human
acuauauaaugcacacaguaua

SEQ ID NO: 107913 - RNA, 22 nt, Human
acuaggaaguaaauaugucauc

SEQ ID NO: 107914 - RNA, 22 nt, Human
acgugguaaaagaucuguaaaa

SEQ ID NO: 107915 - RNA, 22 nt, Human
acucaaacuuuuuguggacauu

SEQ ID NO: 107916 - RNA, 22 nt, Human
acucauuuggauuuuggaguuu

SEQ ID NO: 107917 - RNA, 22 nt, Human
acucaguuuugaucguucuuau

SEQ ID NO: 107918 - RNA, 21 nt, Human
acuccagccacugacugucuc

SEQ ID NO: 107919 - RNA, 22 nt, Human
acucugaaaggcuacaaaugcu

SEQ ID NO: 107920 - RNA, 22 nt, Human
acucuuauuuugaaguaauaau

SEQ ID NO: 107921 - RNA, 22 nt, Human
acugaaauggggacaguccuua

SEQ ID NO: 107922 - RNA, 22 nt, Human
acugaaauuuauauuuugggca

SEQ ID NO: 107923 - RNA, 22 nt, Human
acugacuucugguauuuuuagu

SEQ ID NO: 107924 - RNA, 18 nt, Human
acucuuccuuauguucuu

SEQ ID NO: 107925 - RNA, 22 nt, Human
acugaaaguugaugagucacug

SEQ ID NO: 107926 - RNA, 22 nt, Human
acugaauguucucaaaggggag

SEQ ID NO: 107927 - RNA, 22 nt, Human
acugaaggcuggaccaugcauc

SEQ ID NO: 107928 - RNA, 22 nt, Human
acugaugacaaugugaguguuc

SEQ ID NO: 107929 - RNA, 22 nt, Human
acugcagauccucugagaaacc

SEQ ID NO: 107930 - RNA, 22 nt, Human
acugcaggucccaucaccugcg

SEQ ID NO: 107931 - RNA, 22 nt, Human
acugcugauuauugaaguagag

SEQ ID NO: 107932 - RNA, 22 nt, Human
acugcauuaucaccaagaugua

SEQ ID NO: 107933 - RNA, 22 nt, Human
acugcauuucauaaauuacaau

SEQ ID NO: 107934 - RNA, 22 nt, Human
agaagggcugcuuagaauauac

SEQ ID NO: 107935 - RNA, 22 nt, Human
agaagguagaugcaucaggagg

SEQ ID NO: 107936 - RNA, 22 nt, Human
agaagaucccugugguuacgac

SEQ ID NO: 107937 - RNA, 22 nt, Human
agaagaaugguuugaaagauuu

SEQ ID NO: 107938 - RNA, 22 nt, Human
agaaaauagguaguagacgggc

SEQ ID NO: 107939 - RNA, 22 nt, Human
agaaaaggaagcuuagacugua

SEQ ID NO: 107940 - RNA, 22 nt, Human
agaaccaauacuacagcaagua

SEQ ID NO: 107941 - RNA, 22 nt, Human
agaagaagacccuaaggaaagg

SEQ ID NO: 107942 - RNA, 22 nt, Human
agaaggcaucugcucgcuucca

SEQ ID NO: 107943 - RNA, 22 nt, Human
agaauaagucuaauauauuggu

SEQ ID NO: 107944 - RNA, 22 nt, Human
agaaguuuguuauguaaacaaa

SEQ ID NO: 107945 - RNA, 22 nt, Human
agaagcaauuggaaaguacagg

SEQ ID NO: 107946 - RNA, 22 nt, Human
agaaguagacaguuggauauaa

SEQ ID NO: 107947 - RNA, 21 nt, Human
agaaguuauuccauggguguu

SEQ ID NO: 107948 - RNA, 21 nt, Human
agaagcggucgaaucgcagac

SEQ ID NO: 107949 - RNA, 22 nt, Human
agaaugcaagguauuuggaggg

SEQ ID NO: 107950 - RNA, 22 nt, Human
agaauguaagaaugcaaagauu

SEQ ID NO: 107951 - RNA, 22 nt, Human
agaaucaggaagacagccuggc

SEQ ID NO: 107952 - RNA, 22 nt, Human
agaauccugagggaaauuuggc

SEQ ID NO: 107953 - RNA, 22 nt, Human
agaagguggaguagaacaagcu

SEQ ID NO: 107954 - RNA, 22 nt, Human
agaaguguacuuagagaacaua

SEQ ID NO: 107955 - RNA, 22 nt, Human
agaauauaguaaauauuuucua

SEQ ID NO: 107956 - RNA, 22 nt, Human
agacaaucaacuguugaugccu

SEQ ID NO: 107957 - RNA, 22 nt, Human
agaaugucaagucaagaacaau

SEQ ID NO: 107958 - RNA, 22 nt, Human
agaauuuguaucuacggugugc

SEQ ID NO: 107959 - RNA, 19 nt, Human
agaauuggaaccaugaacc

SEQ ID NO: 107960 - RNA, 22 nt, Human
agacaaggggauuuuugauggu

SEQ ID NO: 107961 - RNA, 22 nt, Human
agaaacaagcccuagaaguccu

SEQ ID NO: 107962 - RNA, 20 nt, Human
agaaaggaguaaagaagaga

SEQ ID NO: 107963 - RNA, 22 nt, Human
agaaauuguaauaaaucugguc

SEQ ID NO: 107964 - RNA, 19 nt, Human
agaaauagccuuccuuguc

SEQ ID NO: 107965 - RNA, 20 nt, Human
acuuucacaugaacauuuaa

SEQ ID NO: 107966 - RNA, 22 nt, Human
agaaaagagacaauguuuuugg

SEQ ID NO: 107967 - RNA, 22 nt, Human
acuuguuuacaagcaguucuga

SEQ ID NO: 107968 - RNA, 22 nt, Human
acuuuauacuagugauaguuug

SEQ ID NO: 107969 - RNA, 22 nt, Human
acuuuaaauaucauuugguagg

SEQ ID NO: 107970 - RNA, 22 nt, Human
acuucauuugaaaugguugaau

SEQ ID NO: 107971 - RNA, 23 nt, Human
acuuugaggagaagaaugucagu

SEQ ID NO: 107972 - RNA, 22 nt, Human
acuuuccuggcuuugcaaggua

SEQ ID NO: 107973 - RNA, 22 nt, Human
acuuugaauuagaauuuugcug

SEQ ID NO: 107974 - RNA, 22 nt, Human
acuugguccacaguaagugcuu

SEQ ID NO: 107975 - RNA, 22 nt, Human
acuuguaaaauagagauaggga

SEQ ID NO: 107976 - RNA, 22 nt, Human
acuugaugcauauggaagagca

SEQ ID NO: 107977 - RNA, 22 nt, Human
acuucaggagcagucucuggaa

SEQ ID NO: 107978 - RNA, 22 nt, Human
acuugauggaguuucacuguau

SEQ ID NO: 107979 - RNA, 22 nt, Human
acuuacuuucuauucuuguagg

SEQ ID NO: 107980 - RNA, 22 nt, Human
acuguugcuuguuuggaauguu

SEQ ID NO: 107981 - RNA, 22 nt, Human
acuguucacccagcacuagcag

SEQ ID NO: 107982 - RNA, 22 nt, Human
acuucuuuugcaugauucuuua

SEQ ID NO: 107983 - RNA, 18 nt, Human
acuugacuuguuucucag

SEQ ID NO: 107984 - RNA, 22 nt, Human
acuggcaugauagaccauaaca

SEQ ID NO: 107985 - RNA, 22 nt, Human
gaaaauaguucaucacaaugau

SEQ ID NO: 107986 - RNA, 21 nt, Human
gaaaaucuaaugugacaaugc

SEQ ID NO: 107987 - RNA, 22 nt, Human
gaaaaguuuaaccuuguacauu

SEQ ID NO: 107988 - RNA, 22 nt, Human
gaaaaucaggauggaugugagg

SEQ ID NO: 107989 - RNA, 22 nt, Human
gaaaaucaugaaaguguguugu

SEQ ID NO: 107990 - RNA, 22 nt, Human
gagccucaggguuuuguugaca

SEQ ID NO: 107991 - RNA, 19 nt, Human
gagccgcucccgcagccgg

SEQ ID NO: 107992 - RNA, 22 nt, Human
gaagcgugcagguccguauacu

SEQ ID NO: 107993 - RNA, 22 nt, Human
gaagcgucaugaaagaaaggcu

SEQ ID NO: 107994 - RNA, 22 nt, Human
gagcuuuagcugagaccugcuu

SEQ ID NO: 107995 - RNA, 22 nt, Human
gagcuuuguuccgugguggcac

SEQ ID NO: 107996 - RNA, 22 nt, Human
gaaggauaauuuugcuggaugu

SEQ ID NO: 107997 - RNA, 22 nt, Human
gaaggcaguaaauggcuguuuu

SEQ ID NO: 107998 - RNA, 22 nt, Human
gaaggcugaauuauuuguuccu

SEQ ID NO: 107999 - RNA, 22 nt, Human
gaaguaaaacaguaacuuuguu

SEQ ID NO: 108000 - RNA, 22 nt, Human
gaaggugcugaaacagaaauuu

SEQ ID NO: 108001 - RNA, 22 nt, Human
gaaggggacuccauggaaugau

SEQ ID NO: 108002 - RNA, 22 nt, Human
gaagguuuuguuugcaaaucau

SEQ ID NO: 108003 - RNA, 22 nt, Human
gaaugcauuuuuuaaaagcaua

SEQ ID NO: 108004 - RNA, 22 nt, Human
gaauggaugcuggucaguuugg

SEQ ID NO: 108005 - RNA, 22 nt, Human
gaggcuaugucuacgcucagcg

SEQ ID NO: 108006 - RNA, 22 nt, Human
gaaugcacacgugugugcaugc

SEQ ID NO: 108007 - RNA, 20 nt, Human
gaaucuggucaaaugucuau

SEQ ID NO: 108008 - RNA, 22 nt, Human
gaauaccauuuacauuugaaaa

SEQ ID NO: 108009 - RNA, 22 nt, Human
gaauacaaauaauaccaaggug

SEQ ID NO: 108010 - RNA, 22 nt, Human
gaauaauuuugaucagaaggga

SEQ ID NO: 108011 - RNA, 22 nt, Human
gaggaugacaaagaaggcagac

SEQ ID NO: 108012 - RNA, 22 nt, Human
gaaguauuucugaguugcccag

SEQ ID NO: 108013 - RNA, 22 nt, Human
gaauaagaauccacuucuggca

SEQ ID NO: 108014 - RNA, 22 nt, Human
gaaguggggaggagaagacuga

SEQ ID NO: 108015 - RNA, 22 nt, Human
gaagucugacucuuuguaagcu

SEQ ID NO: 108016 - RNA, 22 nt, Human
gaaugggaauuauggugggacu

SEQ ID NO: 108017 - RNA, 22 nt, Human
gaaugguuagugaacaaauuug

SEQ ID NO: 108018 - RNA, 22 nt, Human
gaauggcagaaugaagcagugu

SEQ ID NO: 108019 - RNA, 22 nt, Human
gaauuacagaguuguuaaguca

SEQ ID NO: 108020 - RNA, 22 nt, Human
gaggggaagaacaauuuaauuu

SEQ ID NO: 108021 - RNA, 22 nt, Human
gaggggaaggagcgaaggcggg

SEQ ID NO: 108022 - RNA, 22 nt, Human
gaauuagacggcaucacauggg

SEQ ID NO: 108023 - RNA, 22 nt, Human
gaauuagguaauagaacuagua

SEQ ID NO: 108024 - RNA, 22 nt, Human
gaggggaaggguguucaauggg

SEQ ID NO: 108025 - RNA, 19 nt, Human
gaauugcacgagcagaggc

SEQ ID NO: 108026 - RNA, 22 nt, Human
gacaacuucaguaaaguagauu

SEQ ID NO: 108027 - RNA, 22 nt, Human
gacaagaagaacggagguuuca

SEQ ID NO: 108028 - RNA, 22 nt, Human
gagguuauucuucuaucaguau

SEQ ID NO: 108029 - RNA, 22 nt, Human
gagguucgauacagcguauuua

SEQ ID NO: 108030 - RNA, 22 nt, Human
gagguuuaguccauaguauuua

SEQ ID NO: 108031 - RNA, 19 nt, Human
gaguaaaacuagagagaaa

SEQ ID NO: 108032 - RNA, 22 nt, Human
gacaagaugacaucauggcuuc

SEQ ID NO: 108033 - RNA, 22 nt, Human
gacaauuucucaauauagaaac

SEQ ID NO: 108034 - RNA, 22 nt, Human
gacacaacuucccucccacauu

SEQ ID NO: 108035 - RNA, 22 nt, Human
gacaaguagguuauuuuuagca

SEQ ID NO: 108036 - RNA, 22 nt, Human
gaggucauuaaagaaaagaguc

SEQ ID NO: 108037 - RNA, 22 nt, Human
gaguaaacagccuucucccagc

SEQ ID NO: 108038 - RNA, 22 nt, Human
gacauugaauugaauccagauu

SEQ ID NO: 108039 - RNA, 22 nt, Human
gaguauuagaagaguaguuauu

SEQ ID NO: 108040 - RNA, 22 nt, Human
gaguagaacagauagucaagaa

SEQ ID NO: 108041 - RNA, 22 nt, Human
gaguauuacuaaaauucgccua

SEQ ID NO: 108042 - RNA, 22 nt, Human
gagugggugaaugugcucauaa

SEQ ID NO: 108043 - RNA, 22 nt, Human
gagucaauucaccuuggugcuu

SEQ ID NO: 108044 - RNA, 22 nt, Human
gagucaaugugcagugcagccc

SEQ ID NO: 108045 - RNA, 22 nt, Human
gaguauucuauguauauuauug

SEQ ID NO: 108046 - RNA, 22 nt, Human
gacuggaaucucugcuuguuaa

SEQ ID NO: 108047 - RNA, 21 nt, Human
gacuacaauauguaaucuaau

SEQ ID NO: 108048 - RNA, 22 nt, Human
gacuguuggcagauguuugagu

SEQ ID NO: 108049 - RNA, 22 nt, Human
gacuuaaaugcuccccucaggg

SEQ ID NO: 108050 - RNA, 22 nt, Human
gacugucaaauaaaucguuuac

SEQ ID NO: 108051 - RNA, 22 nt, Human
gauaaugcuuuggucagacaug

SEQ ID NO: 108052 - RNA, 22 nt, Human
gauaauuauaggcuaagccacu

SEQ ID NO: 108053 - RNA, 22 nt, Human
gacugacagugguacuguaauu

SEQ ID NO: 108054 - RNA, 22 nt, Human
gacuugcucaaaucagauuuua

SEQ ID NO: 108055 - RNA, 22 nt, Human
gauaccugccaagcugcacuca

SEQ ID NO: 108056 - RNA, 22 nt, Human
gacuucaagaugaaucuuuggg

SEQ ID NO: 108057 - RNA, 22 nt, Human
gagaaaacauacuuaguguccu

SEQ ID NO: 108058 - RNA, 22 nt, Human
gauauuaguuuuggaaggaggg

SEQ ID NO: 108059 - RNA, 22 nt, Human
gauagaaagagaaucagaacuu

SEQ ID NO: 108060 - RNA, 22 nt, Human
gaucacuuugauuagauguccu

SEQ ID NO: 108061 - RNA, 22 nt, Human
gaucauauccagucaccacuau

SEQ ID NO: 108062 - RNA, 22 nt, Human
gagaacagauaugaugacuuca

SEQ ID NO: 108063 - RNA, 22 nt, Human
gagaagugggggucugggauga

SEQ ID NO: 108064 - RNA, 22 nt, Human
gagaagugaauaacgaagcagg

SEQ ID NO: 108065 - RNA, 22 nt, Human
gacagcguguuuugcaugaaca

SEQ ID NO: 108066 - RNA, 18 nt, Human
cuuucugcccccauuagc

SEQ ID NO: 108067 - RNA, 22 nt, Human
cuuugauuucucugguccaauc

SEQ ID NO: 108068 - RNA, 22 nt, Human
gacaggaauuaucuaaaguaga

SEQ ID NO: 108069 - RNA, 22 nt, Human
cuuucugauguaaggaacuagg

SEQ ID NO: 108070 - RNA, 22 nt, Human
cuuucuuucaaguucugcuuua

SEQ ID NO: 108071 - RNA, 22 nt, Human
cuuucucucaaacacacauaca

SEQ ID NO: 108072 - RNA, 22 nt, Human
cuuuccaugucuucuuucucca

SEQ ID NO: 108073 - RNA, 21 nt, Human
cuuuggcaagggagaagucac

SEQ ID NO: 108074 - RNA, 22 nt, Human
cuuuggacaacugagugacguu

SEQ ID NO: 108075 - RNA, 22 nt, Human
cuuuggggcugaggaggagguu

SEQ ID NO: 108076 - RNA, 21 nt, Human
cuuugccuccagcagccgcag

SEQ ID NO: 108077 - RNA, 22 nt, Human
cuuuggauuuuuugcuuuugua

SEQ ID NO: 108078 - RNA, 22 nt, Human
cuuugcaaagagagaaaguggg

SEQ ID NO: 108079 - RNA, 22 nt, Human
gacuugauugguuugucaaguu

SEQ ID NO: 108080 - RNA, 22 nt, Human
gagaaaaauuucuuugcugcac

SEQ ID NO: 108081 - RNA, 22 nt, Human
gacuuguguagcuucagaauuu

SEQ ID NO: 108082 - RNA, 22 nt, Human
gaaaaaccacaauugguauuuu

SEQ ID NO: 108083 - RNA, 22 nt, Human
cuuuuugcccuugggcuuccug

SEQ ID NO: 108084 - RNA, 22 nt, Human
cuuuuucaugggugaugagugg

SEQ ID NO: 108085 - RNA, 22 nt, Human
gacuuaaccacggucacauggu

SEQ ID NO: 108086 - RNA, 16 nt, Human
gacuuucuacgacucu

SEQ ID NO: 108087 - RNA, 22 nt, Human
gagaaagauuguccuucagggg

SEQ ID NO: 108088 - RNA, 22 nt, Human
gagaaggagcagaaaaucuccu

SEQ ID NO: 108089 - RNA, 22 nt, Human
gagaacaaggaagagucggcag

SEQ ID NO: 108090 - RNA, 22 nt, Human
gagaaauagauucaugguagau

SEQ ID NO: 108091 - RNA, 22 nt, Human
gagaccaagcgugggugauaau

SEQ ID NO: 108092 - RNA, 20 nt, Human
gagaauuccagguuucugug

SEQ ID NO: 108093 - RNA, 18 nt, Human
gaagcaacaguucugagu

SEQ ID NO: 108094 - RNA, 22 nt, Human
gaagcaccuggacggugccugg

SEQ ID NO: 108095 - RNA, 22 nt, Human
gaagcaagagggaucaggaucu

SEQ ID NO: 108096 - RNA, 22 nt, Human
gaagaugcugcuuguucacggg

SEQ ID NO: 108097 - RNA, 22 nt, Human
cuguuuuugccugugacaaaaa

SEQ ID NO: 108098 - RNA, 22 nt, Human
gaagguuuacugaagauuuaaa

SEQ ID NO: 108099 - RNA, 21 nt, Human
cuucgcuguuccagcucuugg

SEQ ID NO: 108100 - RNA, 22 nt, Human
cuucuaauucuuauguaagcuu

SEQ ID NO: 108101 - RNA, 22 nt, Human
cuugcaaugaaggcacacuuau

SEQ ID NO: 108102 - RNA, 22 nt, Human
cuugcagagcccauggauguca

SEQ ID NO: 108103 - RNA, 22 nt, Human
cuugcagccuggagcucagccu

SEQ ID NO: 108104 - RNA, 22 nt, Human
gaagugagcauccuaguuaacc

SEQ ID NO: 108105 - RNA, 22 nt, Human
gaaguucuuagucucauuugca

SEQ ID NO: 108106 - RNA, 22 nt, Human
cuucucuuggguguggugucuu

SEQ ID NO: 108107 - RNA, 22 nt, Human
gaagucagaucuuuugacuccc

SEQ ID NO: 108108 - RNA, 22 nt, Human
cuuggggcuugcuguuguagcc

SEQ ID NO: 108109 - RNA, 22 nt, Human
cuuggggauuuuaaagaccucu

SEQ ID NO: 108110 - RNA, 22 nt, Human
gaauguuugagugccaugugac

SEQ ID NO: 108111 - RNA, 22 nt, Human
gaauuacuccaguguguggguu

SEQ ID NO: 108112 - RNA, 22 nt, Human
gaaugguuauaugauguuuaaa

SEQ ID NO: 108113 - RNA, 22 nt, Human
gaauguuaaugcacuucuagcu

SEQ ID NO: 108114 - RNA, 19 nt, Human
gaauggguucuguagggag

SEQ ID NO: 108115 - RNA, 22 nt, Human
cuuuaguaaaacguauuuagga

SEQ ID NO: 108116 - RNA, 22 nt, Human
cuuuauguuggggugucuuagu

SEQ ID NO: 108117 - RNA, 22 nt, Human
cuuguaccuuuguguuuauuuu

SEQ ID NO: 108118 - RNA, 23 nt, Human
cuugugacagcaauuauagcaag

SEQ ID NO: 108119 - RNA, 19 nt, Human
cuuguggcuaugcagauac

SEQ ID NO: 108120 - RNA, 18 nt, Human
cuuuagcugucaucuuug

SEQ ID NO: 108121 - RNA, 22 nt, Human
cuugguuugaaacauacucuac

SEQ ID NO: 108122 - RNA, 22 nt, Human
cuuuuccuccaggaagccaagc

SEQ ID NO: 108123 - RNA, 21 nt, Human
cuuuucuagucccagccccgc

SEQ ID NO: 108124 - RNA, 22 nt, Human
cuuuucauuucauggaauacaa

SEQ ID NO: 108125 - RNA, 22 nt, Human
cuuuucaaacaggacagguccu

SEQ ID NO: 108126 - RNA, 19 nt, Human
cuuuuagagggagaggacu

SEQ ID NO: 108127 - RNA, 22 nt, Human
cuuuugcaauagugacacugau

SEQ ID NO: 108128 - RNA, 22 nt, Human
cugggaaggaagggaaaaacag

SEQ ID NO: 108129 - RNA, 22 nt, Human
cugauggagagugugauuuggg

SEQ ID NO: 108130 - RNA, 22 nt, Human
cugaucuuaaguaacauuauuu

SEQ ID NO: 108131 - RNA, 22 nt, Human
cugaugcucuggauguagucaa

SEQ ID NO: 108132 - RNA, 20 nt, Human
cuuauuuuggagaacuuuuc

SEQ ID NO: 108133 - RNA, 19 nt, Human
cugggacaaugaaagcauc

SEQ ID NO: 108134 - RNA, 22 nt, Human
cugggacacguugugcuuuaac

SEQ ID NO: 108135 - RNA, 22 nt, Human
cugggagaugacucagagcagg

SEQ ID NO: 108136 - RNA, 22 nt, Human
cuuuuuaaaguaaauggcuaga

SEQ ID NO: 108137 - RNA, 22 nt, Human
cuuuuucuugugguuaauaucu

SEQ ID NO: 108138 - RNA, 22 nt, Human
cugggcaugggaacuucaaggc

SEQ ID NO: 108139 - RNA, 22 nt, Human
cuuuuugccuugaagugaccuc

SEQ ID NO: 108140 - RNA, 22 nt, Human
gaaaaagagaaggaguucagua

SEQ ID NO: 108141 - RNA, 22 nt, Human
gaaaaauggguuguuugaagau

SEQ ID NO: 108142 - RNA, 22 nt, Human
cuggguaaauauguauuccuga

SEQ ID NO: 108143 - RNA, 22 nt, Human
cuuuuuuucuccauauuucugg

SEQ ID NO: 108144 - RNA, 22 nt, Human
cugggguaucugccacaacucu

SEQ ID NO: 108145 - RNA, 22 nt, Human
gaaaaugcacacauacacaccc

SEQ ID NO: 108146 - RNA, 22 nt, Human
gaaacauuuguugaguacuugc

SEQ ID NO: 108147 - RNA, 22 nt, Human
gaaaccauggcaaccagguccu

SEQ ID NO: 108148 - RNA, 22 nt, Human
gaaaugaaacacacaugcagcu

SEQ ID NO: 108149 - RNA, 22 nt, Human
gaaagaggcugucagggaaugg

SEQ ID NO: 108150 - RNA, 22 nt, Human
cugugguuuuauuuauuugaag

SEQ ID NO: 108151 - RNA, 22 nt, Human
gaaagagaugucguuugucuuc

SEQ ID NO: 108152 - RNA, 22 nt, Human
gaaaugggggcaugcguuacau

SEQ ID NO: 108153 - RNA, 22 nt, Human
cugugguuucuaugggccuuga

SEQ ID NO: 108154 - RNA, 22 nt, Human
gaacaaggauucccaaagaaga

SEQ ID NO: 108155 - RNA, 22 nt, Human
gaacugggguagggguagcuuu

SEQ ID NO: 108156 - RNA, 22 nt, Human
cuguuguucacuuugcugguga

SEQ ID NO: 108157 - RNA, 22 nt, Human
gaacuugagugugcuauuucuu

SEQ ID NO: 108158 - RNA, 22 nt, Human
gaacuuaauauacaaucaguuc

SEQ ID NO: 108159 - RNA, 22 nt, Human
gaagaaggaagaucaugcuuga

SEQ ID NO: 108160 - RNA, 22 nt, Human
cuguguuguuugaguagcuuga

SEQ ID NO: 108161 - RNA, 22 nt, Human
gaacauuucugcagaugucuga

SEQ ID NO: 108162 - RNA, 22 nt, Human
cuguuaauugugaauuuuacau

SEQ ID NO: 108163 - RNA, 22 nt, Human
gaacugaauguguaauguuggc

SEQ ID NO: 108164 - RNA, 22 nt, Human
gaaaagaaggcaggagcccaag

SEQ ID NO: 108165 - RNA, 22 nt, Human
cuggucuugguauucgcagaag

SEQ ID NO: 108166 - RNA, 22 nt, Human
gaaaagcucuuuagaagagguu

SEQ ID NO: 108167 - RNA, 22 nt, Human
cugguuuauuucauaguuuguu

SEQ ID NO: 108168 - RNA, 22 nt, Human
cuggugcuguagccugauugag

SEQ ID NO: 108169 - RNA, 22 nt, Human
cuguagaugucagguuaaugag

SEQ ID NO: 108170 - RNA, 22 nt, Human
cuguccuguggccugcuccggu

SEQ ID NO: 108171 - RNA, 22 nt, Human
cugucagcaaaucagugucugg

SEQ ID NO: 108172 - RNA, 22 nt, Human
cugguuuuccaauguuuugacu

SEQ ID NO: 108173 - RNA, 22 nt, Human
cuguaaguggugaaauuaguuu

SEQ ID NO: 108174 - RNA, 22 nt, Human
cucaauuuuuauugcuuuuuug

SEQ ID NO: 108175 - RNA, 22 nt, Human
cucaaauggguuuguagaauau

SEQ ID NO: 108176 - RNA, 22 nt, Human
cugcuugaugaggaaaggauug

SEQ ID NO: 108177 - RNA, 22 nt, Human
cucagugacuuccugcucaauu

SEQ ID NO: 108178 - RNA, 22 nt, Human
cucaugaauggcucuuugugcu

SEQ ID NO: 108179 - RNA, 22 nt, Human
cucaucuucuuccuucuuuucc

SEQ ID NO: 108180 - RNA, 22 nt, Human
cucagcugauuaauuucauguu

SEQ ID NO: 108181 - RNA, 22 nt, Human
cucagcaauuaccugugucucu

SEQ ID NO: 108182 - RNA, 22 nt, Human
cuggcuguguguuugugcaucu

SEQ ID NO: 108183 - RNA, 22 nt, Human
cuggcgauugcgagagucgccu

SEQ ID NO: 108184 - RNA, 22 nt, Human
cuggguuuggcugugcuugaau

SEQ ID NO: 108185 - RNA, 22 nt, Human
cugggguaucuggugucuuggu

SEQ ID NO: 108186 - RNA, 22 nt, Human
cuccuuuuuauaucuuucucug

SEQ ID NO: 108187 - RNA, 22 nt, Human
cuggugaagccuucggagaccc

SEQ ID NO: 108188 - RNA, 22 nt, Human
cuguccugauggugccacuggu

SEQ ID NO: 108189 - RNA, 22 nt, Human
cucuuagucugcuuuuuuucca

SEQ ID NO: 108190 - RNA, 22 nt, Human
cucuuucauucuguccuuguuu

SEQ ID NO: 108191 - RNA, 22 nt, Human
cugugcauguucucuagcugau

SEQ ID NO: 108192 - RNA, 22 nt, Human
cucuuuuuuugucuuaagaacc

SEQ ID NO: 108193 - RNA, 21 nt, Human
cugugggaaggccugaggucu

SEQ ID NO: 108194 - RNA, 22 nt, Human
cugaaacucaagauaggaggaa

SEQ ID NO: 108195 - RNA, 19 nt, Human
cugaaacacagagagggcu

SEQ ID NO: 108196 - RNA, 22 nt, Human
cuguucagugcauauguauuga

SEQ ID NO: 108197 - RNA, 22 nt, Human
cuguucuccacuccugacuucu

SEQ ID NO: 108198 - RNA, 22 nt, Human
cugaaagacgaggggaagucgg

SEQ ID NO: 108199 - RNA, 22 nt, Human
cugaagcugggcacuuccuuuu

SEQ ID NO: 108200 - RNA, 22 nt, Human
cugaaagacagccaggcaaagc

SEQ ID NO: 108201 - RNA, 22 nt, Human
cugaagaaagaaaauggccauc

SEQ ID NO: 108202 - RNA, 22 nt, Human
cuguuucucugccugcacacau

SEQ ID NO: 108203 - RNA, 22 nt, Human
cuuacaauuuucuuggacuuuu

SEQ ID NO: 108204 - RNA, 22 nt, Human
cuguuucuuugcugucagagag

SEQ ID NO: 108205 - RNA, 22 nt, Human
cuuauucuucuggacuuggagu

SEQ ID NO: 108206 - RNA, 22 nt, Human
cuuauuagaaagaaaagacaug

SEQ ID NO: 108207 - RNA, 22 nt, Human
cuaauaauuuacugagugcuac

SEQ ID NO: 108208 - RNA, 22 nt, Human
cuaagaaggaggaaaagugcca

SEQ ID NO: 108209 - RNA, 22 nt, Human
cuaacuuugucuugguaauugc

SEQ ID NO: 108210 - RNA, 18 nt, Human
cuacauucauaggaaagg

SEQ ID NO: 108211 - RNA, 22 nt, Human
cuacuucucccuagaucagaaa

SEQ ID NO: 108212 - RNA, 22 nt, Human
cuacuucuguggcucuaagaga

SEQ ID NO: 108213 - RNA, 22 nt, Human
cuacugaugccccgcugugccu

SEQ ID NO: 108214 - RNA, 22 nt, Human
cuacuuucuucuucagaauugu

SEQ ID NO: 108215 - RNA, 22 nt, Human
cuagaaaguaugcuuuuauaau

SEQ ID NO: 108216 - RNA, 22 nt, Human
cuagaaguuuggguccauuaag

SEQ ID NO: 108217 - RNA, 22 nt, Human
cuagaucuuuaaaaaucuggaa

SEQ ID NO: 108218 - RNA, 22 nt, Human
cuagaucuggcaggcacaaggu

SEQ ID NO: 108219 - RNA, 22 nt, Human
cuagagaaaaagcuuagguacg

SEQ ID NO: 108220 - RNA, 21 nt, Human
cugcugaaggaaccccaugga

SEQ ID NO: 108221 - RNA, 22 nt, Human
cuauaucuguggauaguguaug

SEQ ID NO: 108222 - RNA, 22 nt, Human
cuauacuuagaacuccauuuuc

SEQ ID NO: 108223 - RNA, 22 nt, Human
cugcuguuuucugggcuucuua

SEQ ID NO: 108224 - RNA, 22 nt, Human
cuauuaauggccaggagucaug

SEQ ID NO: 108225 - RNA, 22 nt, Human
cuauguuuugcuagugaugggu

SEQ ID NO: 108226 - RNA, 20 nt, Human
cguugccagcccggcccggg

SEQ ID NO: 108227 - RNA, 22 nt, Human
cugaugugcauguggggggaug

SEQ ID NO: 108228 - RNA, 22 nt, Human
cugauguuuaucucaagaguuc

SEQ ID NO: 108229 - RNA, 22 nt, Human
cugauuguagccacugugauga

SEQ ID NO: 108230 - RNA, 22 nt, Human
cuaaagacagcaagacaucauc

SEQ ID NO: 108231 - RNA, 22 nt, Human
cuaaacuucauauguugcuuua

SEQ ID NO: 108232 - RNA, 22 nt, Human
cuaaacacuauucuggaaauag

SEQ ID NO: 108233 - RNA, 22 nt, Human
cugcaguguccgcuugcucagc

SEQ ID NO: 108234 - RNA, 22 nt, Human
cugcagauaaguguuuugaaaa

SEQ ID NO: 108235 - RNA, 22 nt, Human
cugcagauguagcugcuuuccu

SEQ ID NO: 108236 - RNA, 21 nt, Human
cugauguaccucaagccuagu

SEQ ID NO: 108237 - RNA, 22 nt, Human
cgugaaaugcagaaaguugugg

SEQ ID NO: 108238 - RNA, 22 nt, Human
cugaugucaaauuuaucaaagc

SEQ ID NO: 108239 - RNA, 22 nt, Human
cugagggagacagugcggacua

SEQ ID NO: 108240 - RNA, 22 nt, Human
cgcagcuucagggccaggaggg

SEQ ID NO: 108241 - RNA, 22 nt, Human
cuaggcuuucugugugacuaga

SEQ ID NO: 108242 - RNA, 22 nt, Human
cuaguuuuaagcuccuugaggu

SEQ ID NO: 108243 - RNA, 22 nt, Human
cuauguuucagauauauauaua

SEQ ID NO: 108244 - RNA, 22 nt, Human
cuaguagcccauuuuggauacc

SEQ ID NO: 108245 - RNA, 22 nt, Human
cuaguauuaagugugaguaaaa

SEQ ID NO: 108246 - RNA, 22 nt, Human
cucaggugagcgagcuaaauua

SEQ ID NO: 108247 - RNA, 22 nt, Human
cucagcacauuccuaagggaug

SEQ ID NO: 108248 - RNA, 22 nt, Human
cucaaagcagacuuuucccuuu

SEQ ID NO: 108249 - RNA, 22 nt, Human
cucaaaauccauaaaaucaggu

SEQ ID NO: 108250 - RNA, 22 nt, Human
cgcugggugguugauguacagc

SEQ ID NO: 108251 - RNA, 22 nt, Human
cucauugacagagcagcucuac

SEQ ID NO: 108252 - RNA, 20 nt, Human
cucauugcuuucauuuucuu

SEQ ID NO: 108253 - RNA, 22 nt, Human
cuccaaaucugauugcuaccuu

SEQ ID NO: 108254 - RNA, 22 nt, Human
cuccagcagaaagggcgagugg

SEQ ID NO: 108255 - RNA, 22 nt, Human
cucucuuuuuuucccuuguuaa

SEQ ID NO: 108256 - RNA, 22 nt, Human
cucugagcucgugcaguacuuc

SEQ ID NO: 108257 - RNA, 22 nt, Human
cguggccacaguggagcugagc

SEQ ID NO: 108258 - RNA, 16 nt, Human
cuaaaaugucuacuug

SEQ ID NO: 108259 - RNA, 22 nt, Human
cuaaauuuuuuagugaaauagg

SEQ ID NO: 108260 - RNA, 19 nt, Human
cuacaguguuuuucuuucc

SEQ ID NO: 108261 - RNA, 22 nt, Human
cuacugaagcaugcuuauaugu

SEQ ID NO: 108262 - RNA, 22 nt, Human
cgcacuugugagcgacagggcu

SEQ ID NO: 108263 - RNA, 22 nt, Human
cuagaggaacaguuucagguuu

SEQ ID NO: 108264 - RNA, 22 nt, Human
cgggagcagcucuggggcuggg

SEQ ID NO: 108265 - RNA, 22 nt, Human
ccuucuguaccaaggccucaug

SEQ ID NO: 108266 - RNA, 22 nt, Human
ccuugcgaggaugcugugagcu

SEQ ID NO: 108267 - RNA, 22 nt, Human
ccuugguuuagcaauuuuucuu

SEQ ID NO: 108268 - RNA, 22 nt, Human
ccuugggagcgcccuguccggg

SEQ ID NO: 108269 - RNA, 22 nt, Human
ccuuugcccugagaaauguucc

SEQ ID NO: 108270 - RNA, 22 nt, Human
cgucauuuguaaaugaucaaga

SEQ ID NO: 108271 - RNA, 22 nt, Human
ccuugugauugaucuaaguugc

SEQ ID NO: 108272 - RNA, 20 nt, Human
ccuuguggaugucuuuuuug

SEQ ID NO: 108273 - RNA, 23 nt, Human
ccuuguguaucuccagccacucc

SEQ ID NO: 108274 - RNA, 22 nt, Human
ccuuucucuuggauaccgauug

SEQ ID NO: 108275 - RNA, 22 nt, Human
ccuuuuuagaugugcgaauguu

SEQ ID NO: 108276 - RNA, 22 nt, Human
cgugaucuguuauauagugagc

SEQ ID NO: 108277 - RNA, 22 nt, Human
cgugaagaaguaauagguggug

SEQ ID NO: 108278 - RNA, 22 nt, Human
cgaaaaagaagugcaccauguu

SEQ ID NO: 108279 - RNA, 22 nt, Human
ccuauuuucaaaauuguuuauc

SEQ ID NO: 108280 - RNA, 22 nt, Human
ccgugcaguuucucacacacau

SEQ ID NO: 108281 - RNA, 22 nt, Human
ccguaugacuuuuuguuguugu

SEQ ID NO: 108282 - RNA, 22 nt, Human
ccguuugugcugcaggagaucg

SEQ ID NO: 108283 - RNA, 22 nt, Human
ccguccgcuccuccagccgcug

SEQ ID NO: 108284 - RNA, 22 nt, Human
cgaagcuuuuguuggcgugucg

SEQ ID NO: 108285 - RNA, 22 nt, Human
cgaaggaaucacuuaacacuuu

SEQ ID NO: 108286 - RNA, 18 nt, Human
cgauguguaugugauuug

SEQ ID NO: 108287 - RNA, 22 nt, Human
cgagugauuauucuggcugaga

SEQ ID NO: 108288 - RNA, 22 nt, Human
cgcacacaaaugcauacgccag

SEQ ID NO: 108289 - RNA, 22 nt, Human
cgggaaguaaacauuauuucag

SEQ ID NO: 108290 - RNA, 22 nt, Human
cggagcgagaaggggaaagccc

SEQ ID NO: 108291 - RNA, 22 nt, Human
ccuggggcucugcacagagcag

SEQ ID NO: 108292 - RNA, 22 nt, Human
ccugucuuuucugaucauacua

SEQ ID NO: 108293 - RNA, 22 nt, Human
ccuuaauaguguucuaauguuu

SEQ ID NO: 108294 - RNA, 22 nt, Human
ccagagaugcagugggugcagu

SEQ ID NO: 108295 - RNA, 22 nt, Human
ccagagcacaccguuugccuuc

SEQ ID NO: 108296 - RNA, 22 nt, Human
ccuuugcugggccucuccaucu

SEQ ID NO: 108297 - RNA, 22 nt, Human
ccuuuggaugucauucuuggca

SEQ ID NO: 108298 - RNA, 22 nt, Human
ccuuuuaucgcgaagaacucca

SEQ ID NO: 108299 - RNA, 20 nt, Human
ccuuuuguugcuguuuggau

SEQ ID NO: 108300 - RNA, 22 nt, Human
ccggcugcugaggcggccccgg

SEQ ID NO: 108301 - RNA, 22 nt, Human
ccuuucuggucucugagagacu

SEQ ID NO: 108302 - RNA, 22 nt, Human
ccuuuccuggaaaugguaaguu

SEQ ID NO: 108303 - RNA, 17 nt, Human
ccuuucugaucaucuga

SEQ ID NO: 108304 - RNA, 22 nt, Human
ccuuuccucuucaugacuuucu

SEQ ID NO: 108305 - RNA, 22 nt, Human
ccuuagcuggguaacuuugggc

SEQ ID NO: 108306 - RNA, 22 nt, Human
ccuugagacacagccaaagaug

SEQ ID NO: 108307 - RNA, 22 nt, Human
cauugcuguuaauugucucuag

SEQ ID NO: 108308 - RNA, 22 nt, Human
cauugcugccaaggugagcugg

SEQ ID NO: 108309 - RNA, 22 nt, Human
cauugcugugggcauuugcugc

SEQ ID NO: 108310 - RNA, 22 nt, Human
ccagaacgacgggcagaggcgc

SEQ ID NO: 108311 - RNA, 22 nt, Human
ccagaauuugaacccacaaaug

SEQ ID NO: 108312 - RNA, 19 nt, Human
ccagaagggcaagcaaagg

SEQ ID NO: 108313 - RNA, 22 nt, Human
cauugcaaccauuccaaauggc

SEQ ID NO: 108314 - RNA, 22 nt, Human
cauugcaaccccaaaaagaaca

SEQ ID NO: 108315 - RNA, 20 nt, Human
cauuccugaggaauucaugu

SEQ ID NO: 108316 - RNA, 22 nt, Human
cauugucaaguggccgggucuu

SEQ ID NO: 108317 - RNA, 22 nt, Human
cauuuaaccccuugguacugaa

SEQ ID NO: 108318 - RNA, 22 nt, Human
ccagaugggggcugugggaggg

SEQ ID NO: 108319 - RNA, 22 nt, Human
ccagauaaacauuccuuggccu

SEQ ID NO: 108320 - RNA, 22 nt, Human
cauugcaucuuuuauggguaag

SEQ ID NO: 108321 - RNA, 22 nt, Human
cauuggaugagggccucaucga

SEQ ID NO: 108322 - RNA, 22 nt, Human
cauuggcacauguauucugggc

SEQ ID NO: 108323 - RNA, 22 nt, Human
ccagcaggagacuagcaacaua

SEQ ID NO: 108324 - RNA, 22 nt, Human
cauuucaaacaguuacagcugc

SEQ ID NO: 108325 - RNA, 22 nt, Human
cauuuucugcaagucugcucaa

SEQ ID NO: 108326 - RNA, 22 nt, Human
cauuucuugugagccgcauccu

SEQ ID NO: 108327 - RNA, 22 nt, Human
cauuugcuuaucacucuucuuu

SEQ ID NO: 108328 - RNA, 23 nt, Human
cauuugauccucacaauaaaugg

SEQ ID NO: 108329 - RNA, 22 nt, Human
ccaaagaauuuggaaaaucuga

SEQ ID NO: 108330 - RNA, 22 nt, Human
ccaaaauauuagugcuuaagua

SEQ ID NO: 108331 - RNA, 17 nt, Human
ccagcugcucccucaga

SEQ ID NO: 108332 - RNA, 22 nt, Human
ccagggcuggguuugucggugu

SEQ ID NO: 108333 - RNA, 22 nt, Human
ccaagagcuucccauagcuucu

SEQ ID NO: 108334 - RNA, 22 nt, Human
ccaaauuaccuucuuggauuca

SEQ ID NO: 108335 - RNA, 22 nt, Human
ccagucuuggugucuguagcac

SEQ ID NO: 108336 - RNA, 22 nt, Human
ccaaucaacuguguggcuuucu

SEQ ID NO: 108337 - RNA, 22 nt, Human
ccacagcauugaaaucuauaau

SEQ ID NO: 108338 - RNA, 22 nt, Human
ccaccacauuugccuagacuuu

SEQ ID NO: 108339 - RNA, 22 nt, Human
ccaccacugaggcacaggagcc

SEQ ID NO: 108340 - RNA, 22 nt, Human
ccaucuuugcucuuuuauugca

SEQ ID NO: 108341 - RNA, 22 nt, Human
ccauuuuccuguauggacucga

SEQ ID NO: 108342 - RNA, 20 nt, Human
ccagaagagaagaaaaggaa

SEQ ID NO: 108343 - RNA, 18 nt, Human
cccaccugcccagguuca

SEQ ID NO: 108344 - RNA, 22 nt, Human
ccauuucacaucccugacaugu

SEQ ID NO: 108345 - RNA, 22 nt, Human
ccaaacauuucaaauuuagaga

SEQ ID NO: 108346 - RNA, 22 nt, Human
ccaaaguauuaaaucuuagcaa

SEQ ID NO: 108347 - RNA, 22 nt, Human
ccaaauuguuguuguuguuguu

SEQ ID NO: 108348 - RNA, 19 nt, Human
ccaacaguacugaagcacu

SEQ ID NO: 108349 - RNA, 22 nt, Human
ccaaagaagcaaugagaauagu

SEQ ID NO: 108350 - RNA, 22 nt, Human
cauuuuuccucaggcaauuuga

SEQ ID NO: 108351 - RNA, 22 nt, Human
cauuuuuuuuccccuccuggua

SEQ ID NO: 108352 - RNA, 22 nt, Human
caugaugagaguaauaacacag

SEQ ID NO: 108353 - RNA, 22 nt, Human
caugcagauugccaggcucccu

SEQ ID NO: 108354 - RNA, 22 nt, Human
cauuuugguccucauguguagc

SEQ ID NO: 108355 - RNA, 22 nt, Human
caugcagcagaauaaugacuau

SEQ ID NO: 108356 - RNA, 22 nt, Human
caugcgucugcauuggguggug

SEQ ID NO: 108357 - RNA, 22 nt, Human
ccaaggcugcagccgugacgcg

SEQ ID NO: 108358 - RNA, 22 nt, Human
ccaaccaaagggccuaaggucu

SEQ ID NO: 108359 - RNA, 22 nt, Human
caugggaauaaaguuauuucaa

SEQ ID NO: 108360 - RNA, 23 nt, Human
ccacaugugagcccaccgugccc

SEQ ID NO: 108361 - RNA, 22 nt, Human
caugugcaucagccaauuggag

SEQ ID NO: 108362 - RNA, 22 nt, Human
cauguguuucuuaagccaggcc

SEQ ID NO: 108363 - RNA, 22 nt, Human
ccaauuuuggaauuauuaggca

SEQ ID NO: 108364 - RNA, 21 nt, Human
ccacaauucuaguuacauaug

SEQ ID NO: 108365 - RNA, 22 nt, Human
cauguauguuaguggcugcuuu

SEQ ID NO: 108366 - RNA, 22 nt, Human
caugguaaucggggccaucugu

SEQ ID NO: 108367 - RNA, 22 nt, Human
caugguaccuagccucauggau

SEQ ID NO: 108368 - RNA, 21 nt, Human
caugguaaguacaaagaugac

SEQ ID NO: 108369 - RNA, 22 nt, Human
ccaaggcuggagggcuuaugua

SEQ ID NO: 108370 - RNA, 22 nt, Human
ccaaggcuguggggcugugcag

SEQ ID NO: 108371 - RNA, 22 nt, Human
ccaaggugcagcccauggugaa

SEQ ID NO: 108372 - RNA, 22 nt, Human
ccacuacauugagugcuuucuc

SEQ ID NO: 108373 - RNA, 21 nt, Human
ccacuaagccccaguaaugga

SEQ ID NO: 108374 - RNA, 22 nt, Human
cauuccaaguauauacaugaua

SEQ ID NO: 108375 - RNA, 20 nt, Human
cauuccaugcaucuuggucc

SEQ ID NO: 108376 - RNA, 22 nt, Human
cauucauaagacuuugcucuug

SEQ ID NO: 108377 - RNA, 22 nt, Human
cauaucuuaaacaucaucucug

SEQ ID NO: 108378 - RNA, 22 nt, Human
cauuauucaggcuuuggaauuu

SEQ ID NO: 108379 - RNA, 22 nt, Human
cauguguauuauucuuguggaa

SEQ ID NO: 108380 - RNA, 22 nt, Human
cagguuuuuauuacaacuuuga

SEQ ID NO: 108381 - RNA, 22 nt, Human
caucaauagguauuugagagac

SEQ ID NO: 108382 - RNA, 22 nt, Human
caucaacagucuacuuuuugcc

SEQ ID NO: 108383 - RNA, 22 nt, Human
cauuccaagaaguaguucugca

SEQ ID NO: 108384 - RNA, 22 nt, Human
caucaggcugggaacacagauc

SEQ ID NO: 108385 - RNA, 22 nt, Human
cauuuagagaagauuacaagga

SEQ ID NO: 108386 - RNA, 22 nt, Human
caugaugaacugugcuguuagg

SEQ ID NO: 108387 - RNA, 22 nt, Human
caugauaacacuucuguuuaau

SEQ ID NO: 108388 - RNA, 22 nt, Human
cauuuuaucagcacacgucacu

SEQ ID NO: 108389 - RNA, 22 nt, Human
cauuuugguaauguucguuugc

SEQ ID NO: 108390 - RNA, 22 nt, Human
cauuuuccucugcugguguuca

SEQ ID NO: 108391 - RNA, 22 nt, Human
caucugcagccucugcauuccc

SEQ ID NO: 108392 - RNA, 22 nt, Human
caucuaaaauaagccuuauaau

SEQ ID NO: 108393 - RNA, 22 nt, Human
cauugguacaaaauguacuuug

SEQ ID NO: 108394 - RNA, 22 nt, Human
cauuuaucacuugcuaaacaua

SEQ ID NO: 108395 - RNA, 22 nt, Human
cauuuacauaacaguaacgcug

SEQ ID NO: 108396 - RNA, 22 nt, Human
caaaagcaaagaucuuugauug

SEQ ID NO: 108397 - RNA, 22 nt, Human
caagcagauauuuuagucaaga

SEQ ID NO: 108398 - RNA, 22 nt, Human
caagccacugggagcugcacac

SEQ ID NO: 108399 - RNA, 20 nt, Human
caauguuggcaguauagagc

SEQ ID NO: 108400 - RNA, 22 nt, Human
caaaccuagagaggagaggaca

SEQ ID NO: 108401 - RNA, 22 nt, Human
cacucuucucucauuuuccuuu

SEQ ID NO: 108402 - RNA, 22 nt, Human
cacucaaacugaaauccuuuuu

SEQ ID NO: 108403 - RNA, 22 nt, Human
caauuaccaguaauugagguuu

SEQ ID NO: 108404 - RNA, 21 nt, Human
cacuguauagcaggagaaaac

SEQ ID NO: 108405 - RNA, 18 nt, Human
cacagcauccaaguuaug

SEQ ID NO: 108406 - RNA, 22 nt, Human
cacugcugaggcccguguuacu

SEQ ID NO: 108407 - RNA, 22 nt, Human
cacuaaccauguucccaacagc

SEQ ID NO: 108408 - RNA, 22 nt, Human
cacaguuuuaucuuauacugau

SEQ ID NO: 108409 - RNA, 22 nt, Human
cacuuauuuuuccuuugugauu

SEQ ID NO: 108410 - RNA, 20 nt, Human
cacagcugacgaguauccaa

SEQ ID NO: 108411 - RNA, 19 nt, Human
cacagcccucacuuuuagc

SEQ ID NO: 108412 - RNA, 22 nt, Human
cacaucaaacuuacuaagauuu

SEQ ID NO: 108413 - RNA, 22 nt, Human
cagaaaguauguucuaguaguu

SEQ ID NO: 108414 - RNA, 22 nt, Human
cagacagaguuguuucuucucc

SEQ ID NO: 108415 - RNA, 22 nt, Human
cagaaagugauuugcuauucca

SEQ ID NO: 108416 - RNA, 22 nt, Human
cagagaggagcacaaagugaag

SEQ ID NO: 108417 - RNA, 22 nt, Human
cagagacuuuugcuccgauucu

SEQ ID NO: 108418 - RNA, 22 nt, Human
caccacuuggcccugagguccu

SEQ ID NO: 108419 - RNA, 22 nt, Human
caccgaacuuugcaaaugcaau

SEQ ID NO: 108420 - RNA, 18 nt, Human
cacgcaacuguaaaaccc

SEQ ID NO: 108421 - RNA, 22 nt, Human
cagccauucuaacacugccagu

SEQ ID NO: 108422 - RNA, 22 nt, Human
cagaaguugcuugagagagagc

SEQ ID NO: 108423 - RNA, 22 nt, Human
cagaaugugacaucaaaggcuc

SEQ ID NO: 108424 - RNA, 22 nt, Human
cagacaaauccuuaugagacug

SEQ ID NO: 108425 - RNA, 22 nt, Human
cagcccugagagaaccaucuau

SEQ ID NO: 108426 - RNA, 22 nt, Human
cagacgguuaaacgauuuugcu

SEQ ID NO: 108427 - RNA, 21 nt, Human
cagcagaaaugagaggagaaa

SEQ ID NO: 108428 - RNA, 22 nt, Human
cagaaauuggcagagaagaccu

SEQ ID NO: 108429 - RNA, 22 nt, Human
cacuugauugucagaaaaaugg

SEQ ID NO: 108430 - RNA, 22 nt, Human
cagcacaggugugaggccugau

SEQ ID NO: 108431 - RNA, 22 nt, Human
cacuuaaaauucagggcuuaua

SEQ ID NO: 108432 - RNA, 22 nt, Human
cacuuagugcuuuuguguuucu

SEQ ID NO: 108433 - RNA, 22 nt, Human
caggaagucugaauucugagag

SEQ ID NO: 108434 - RNA, 22 nt, Human
cagguuguugacugcauauagg

SEQ ID NO: 108435 - RNA, 22 nt, Human
cagguuuggaagucacgaagcu

SEQ ID NO: 108436 - RNA, 22 nt, Human
cagguuuuccuuuuaaaaggaa

SEQ ID NO: 108437 - RNA, 21 nt, Human
caguuugcuauuuuaguauga

SEQ ID NO: 108438 - RNA, 22 nt, Human
caguugcuauugagagaacaca

SEQ ID NO: 108439 - RNA, 22 nt, Human
caguggaugucucauaguguga

SEQ ID NO: 108440 - RNA, 22 nt, Human
cauauacauauacaugcauaca

SEQ ID NO: 108441 - RNA, 22 nt, Human
cauaggugguagaauggggaga

SEQ ID NO: 108442 - RNA, 22 nt, Human
cauaggaaauugcuguuaugga

SEQ ID NO: 108443 - RNA, 22 nt, Human
cauaaauuuuaccuuguaagug

SEQ ID NO: 108444 - RNA, 22 nt, Human
cauaaucaagggguugugaugu

SEQ ID NO: 108445 - RNA, 22 nt, Human
cagagcagaaaccugggugauu

SEQ ID NO: 108446 - RNA, 22 nt, Human
cagcuauuguucuguauaauga

SEQ ID NO: 108447 - RNA, 22 nt, Human
cagcuauggaauuggcccagau

SEQ ID NO: 108448 - RNA, 22 nt, Human
cagcuucacuuaaaacaugcaa

SEQ ID NO: 108449 - RNA, 22 nt, Human
cagcauugagcacagaaggaaa

SEQ ID NO: 108450 - RNA, 18 nt, Human
cagcauuagcagcuucca

SEQ ID NO: 108451 - RNA, 22 nt, Human
cagcauucuacuuugugaacug

SEQ ID NO: 108452 - RNA, 22 nt, Human
caggaacagcaccaggagcuag

SEQ ID NO: 108453 - RNA, 22 nt, Human
caggagaaauucacauuaguga

SEQ ID NO: 108454 - RNA, 22 nt, Human
caggcgcauggugagcagauga

SEQ ID NO: 108455 - RNA, 22 nt, Human
cagcuacuaccuguagacaaag

SEQ ID NO: 108456 - RNA, 22 nt, Human
caggauuuaauaagauaguguu

SEQ ID NO: 108457 - RNA, 22 nt, Human
cagcuuaccucccacagcucuc

SEQ ID NO: 108458 - RNA, 22 nt, Human
cagcuguauuucucugguuaga

SEQ ID NO: 108459 - RNA, 22 nt, Human
cagcuggggagagacauggcag

SEQ ID NO: 108460 - RNA, 22 nt, Human
cagcuucaaaggcccugauggu

SEQ ID NO: 108461 - RNA, 22 nt, Human
caggugauuuuguuuucaaaug

SEQ ID NO: 108462 - RNA, 22 nt, Human
cagcuugcccugauguggaaga

SEQ ID NO: 108463 - RNA, 22 nt, Human
aucugggaaggggaaaaugcug

SEQ ID NO: 108464 - RNA, 22 nt, Human
auccuugacuguagugauauua

SEQ ID NO: 108465 - RNA, 22 nt, Human
aucuccaguuagcaguacugau

SEQ ID NO: 108466 - RNA, 22 nt, Human
auccuucaaaaggaauagcagg

SEQ ID NO: 108467 - RNA, 19 nt, Human
auacacguguauacauaca

SEQ ID NO: 108468 - RNA, 22 nt, Human
auacacuucauguuuucaucug

SEQ ID NO: 108469 - RNA, 20 nt, Human
aucuuaucuaucuuuuguuc

SEQ ID NO: 108470 - RNA, 22 nt, Human
aucuaaucugccuuccuaaucu

SEQ ID NO: 108471 - RNA, 22 nt, Human
aucuacuuugggaguuucucuu

SEQ ID NO: 108472 - RNA, 22 nt, Human
aucuucaaagcacaucguuugu

SEQ ID NO: 108473 - RNA, 22 nt, Human
aucuuaguuauuuggagaaacc

SEQ ID NO: 108474 - RNA, 22 nt, Human
aucuucaggggcaauggagaua

SEQ ID NO: 108475 - RNA, 22 nt, Human
aucuuagagagucguguuuugu

SEQ ID NO: 108476 - RNA, 22 nt, Human
aucguuaugauagagaaagaga

SEQ ID NO: 108477 - RNA, 22 nt, Human
aucuuuguaaguaaucaaagcu

SEQ ID NO: 108478 - RNA, 19 nt, Human
aucuuucagcagcuccccu

SEQ ID NO: 108479 - RNA, 22 nt, Human
aucuuggccuucuccuggagug

SEQ ID NO: 108480 - RNA, 22 nt, Human
aucucacuucugucauguggca

SEQ ID NO: 108481 - RNA, 21 nt, Human
aucucaguccugggaaugauu

SEQ ID NO: 108482 - RNA, 22 nt, Human
aucucaaagauaugcugguaaa

SEQ ID NO: 108483 - RNA, 22 nt, Human
aucugugguacaugacggcugc

SEQ ID NO: 108484 - RNA, 22 nt, Human
aucuguuccccuaugcucucua

SEQ ID NO: 108485 - RNA, 22 nt, Human
aucuguucuucaaaauauuaca

SEQ ID NO: 108486 - RNA, 22 nt, Human
aucugugauuuuggcaagauuu

SEQ ID NO: 108487 - RNA, 22 nt, Human
augaauuugaacaccagguugg

SEQ ID NO: 108488 - RNA, 20 nt, Human
augaaugcuccccacguuuc

SEQ ID NO: 108489 - RNA, 22 nt, Human
augaaaacggaccagagcuauu

SEQ ID NO: 108490 - RNA, 22 nt, Human
aucuuuuuucacaauuuauuuu

SEQ ID NO: 108491 - RNA, 22 nt, Human
augaacuaagagucauuagugu

SEQ ID NO: 108492 - RNA, 22 nt, Human
augaagugcccugggggccaga

SEQ ID NO: 108493 - RNA, 22 nt, Human
aucuugaaacauauaugcauuu

SEQ ID NO: 108494 - RNA, 22 nt, Human
augacagcucuagcacacagua

SEQ ID NO: 108495 - RNA, 22 nt, Human
augaccuucuuuccuuaaauuu

SEQ ID NO: 108496 - RNA, 22 nt, Human
augaguaaguucugauuagauu

SEQ ID NO: 108497 - RNA, 22 nt, Human
aucuuagcucaacucucaccaa

SEQ ID NO: 108498 - RNA, 22 nt, Human
augaggguggggaaugggccau

SEQ ID NO: 108499 - RNA, 22 nt, Human
augacuauaaauaggagauugu

SEQ ID NO: 108500 - RNA, 22 nt, Human
aucuuguuagaaggcaguaggu

SEQ ID NO: 108501 - RNA, 22 nt, Human
augagugugugguucuaaauga

SEQ ID NO: 108502 - RNA, 22 nt, Human
aucuuugccuuuaugccucuag

SEQ ID NO: 108503 - RNA, 22 nt, Human
aucuuugauuuuggcuuuuagg

SEQ ID NO: 108504 - RNA, 23 nt, Human
augaaaugauacuuuauucacug

SEQ ID NO: 108505 - RNA, 19 nt, Human
augaaauagcauuuucuga

SEQ ID NO: 108506 - RNA, 22 nt, Human
augcaaaaucuuauuuuuucua

SEQ ID NO: 108507 - RNA, 22 nt, Human
augaaggauagggcaaaauuuu

SEQ ID NO: 108508 - RNA, 22 nt, Human
augaacugcaguauaaacuugg

SEQ ID NO: 108509 - RNA, 22 nt, Human
augcaccugucuuuuaaggaua

SEQ ID NO: 108510 - RNA, 19 nt, Human
augcacgugaaaugcauuu

SEQ ID NO: 108511 - RNA, 18 nt, Human
augauaauguuugcauca

SEQ ID NO: 108512 - RNA, 22 nt, Human
augcauaugugugcaagugugu

SEQ ID NO: 108513 - RNA, 22 nt, Human
augcauaucuccuaucuccuca

SEQ ID NO: 108514 - RNA, 22 nt, Human
augccacuguuuaugucacuua

SEQ ID NO: 108515 - RNA, 14 nt, Human
augauuucugggaa

SEQ ID NO: 108516 - RNA, 22 nt, Human
augauuuguuaacagacuuaau

SEQ ID NO: 108517 - RNA, 22 nt, Human
augauuauuugaaugaagagga

SEQ ID NO: 108518 - RNA, 22 nt, Human
augcaugaucccgguaugugaa

SEQ ID NO: 108519 - RNA, 22 nt, Human
augcuuucucuucuauuucuca

SEQ ID NO: 108520 - RNA, 22 nt, Human
auggaacauuaaucuucaaaug

SEQ ID NO: 108521 - RNA, 22 nt, Human
auggaagagacaaugcuaucug

SEQ ID NO: 108522 - RNA, 22 nt, Human
auggaacccgggcgucugcucu

SEQ ID NO: 108523 - RNA, 22 nt, Human
auggacguuuguguauuaugua

SEQ ID NO: 108524 - RNA, 22 nt, Human
auggaauuuaaauuuugguguc

SEQ ID NO: 108525 - RNA, 22 nt, Human
auggagguuugucugguuuugu

SEQ ID NO: 108526 - RNA, 22 nt, Human
auggaggaugugcagcaugggc

SEQ ID NO: 108527 - RNA, 22 nt, Human
auggagcgggaggauggaggag

SEQ ID NO: 108528 - RNA, 22 nt, Human
augggcauggauggccgagucu

SEQ ID NO: 108529 - RNA, 22 nt, Human
auggcaucuucgguuggacugc

SEQ ID NO: 108530 - RNA, 22 nt, Human
auggauuggguugauggcauac

SEQ ID NO: 108531 - RNA, 20 nt, Human
auggaaacacgcagccccaa

SEQ ID NO: 108532 - RNA, 22 nt, Human
augggauuugaaaaguggaaau

SEQ ID NO: 108533 - RNA, 22 nt, Human
augggcauacaaaugcuacccu

SEQ ID NO: 108534 - RNA, 22 nt, Human
augggaauggauugagugggug

SEQ ID NO: 108535 - RNA, 22 nt, Human
augggugggagugaaggggcuc

SEQ ID NO: 108536 - RNA, 19 nt, Human
augguauugcuggguuuuu

SEQ ID NO: 108537 - RNA, 22 nt, Human
auguggaaagcuugucuuagag

SEQ ID NO: 108538 - RNA, 22 nt, Human
auggugugugugugugugugug

SEQ ID NO: 108539 - RNA, 22 nt, Human
auguacugacuguacuuuuaaa

SEQ ID NO: 108540 - RNA, 22 nt, Human
augguguaggugaagagaacau

SEQ ID NO: 108541 - RNA, 22 nt, Human
auguaaugucaaucuucagugg

SEQ ID NO: 108542 - RNA, 22 nt, Human
augguuagauggaugagaugug

SEQ ID NO: 108543 - RNA, 22 nt, Human
auguaacauaugugaucgcauu

SEQ ID NO: 108544 - RNA, 22 nt, Human
auggggaucugcaguguugauc

SEQ ID NO: 108545 - RNA, 22 nt, Human
auggugaugaugaugaugauaa

SEQ ID NO: 108546 - RNA, 22 nt, Human
auggucugcucagucucuugac

SEQ ID NO: 108547 - RNA, 22 nt, Human
auggcagcggagcuggaaauga

SEQ ID NO: 108548 - RNA, 22 nt, Human
augguguaagacuguauuucuu

SEQ ID NO: 108549 - RNA, 22 nt, Human
augugagcuggaugaauuuaua

SEQ ID NO: 108550 - RNA, 22 nt, Human
auguuguuuauggguuaucaag

SEQ ID NO: 108551 - RNA, 22 nt, Human
auguugcugauccuguggcugu

SEQ ID NO: 108552 - RNA, 22 nt, Human
augugcauguauguaucauauu

SEQ ID NO: 108553 - RNA, 22 nt, Human
augugcacuggugugugcguuc

SEQ ID NO: 108554 - RNA, 22 nt, Human
auguguguaugacugaaucuau

SEQ ID NO: 108555 - RNA, 22 nt, Human
auguguguaugugugcauguau

SEQ ID NO: 108556 - RNA, 22 nt, Human
augugugugcgagcgugugugu

SEQ ID NO: 108557 - RNA, 19 nt, Human
auguuuccauuucuggaua

SEQ ID NO: 108558 - RNA, 22 nt, Human
auguuugugauugcugaaaaga

SEQ ID NO: 108559 - RNA, 22 nt, Human
auguuuaaguguuuugccccaa

SEQ ID NO: 108560 - RNA, 22 nt, Human
auguuuuaaaaaacaggcuacc

SEQ ID NO: 108561 - RNA, 20 nt, Human
augugcuaauauuaauaugu

SEQ ID NO: 108562 - RNA, 22 nt, Human
auuaaaaaugagaguagggauu

SEQ ID NO: 108563 - RNA, 22 nt, Human
auuaaaaaaagauaaugaguua

SEQ ID NO: 108564 - RNA, 22 nt, Human
auguuuucuugucuggagaagu

SEQ ID NO: 108565 - RNA, 22 nt, Human
auguuuugaguuuuuuuacacc

SEQ ID NO: 108566 - RNA, 19 nt, Human
auugguuugcucgggaaug

SEQ ID NO: 108567 - RNA, 22 nt, Human
auuguuuugugaaacauaguga

SEQ ID NO: 108568 - RNA, 22 nt, Human
auuguucuagaauuuuuuuucc

SEQ ID NO: 108569 - RNA, 22 nt, Human
auugguuucuuguggguuaucc

SEQ ID NO: 108570 - RNA, 22 nt, Human
auugagaaaauucgagcaaguu

SEQ ID NO: 108571 - RNA, 22 nt, Human
auugagacugaaauuacugaag

SEQ ID NO: 108572 - RNA, 22 nt, Human
auugagaugcuuaaaucuucac

SEQ ID NO: 108573 - RNA, 22 nt, Human
auuuaagugagucuuuaaaaua

SEQ ID NO: 108574 - RNA, 22 nt, Human
auugcaggucguguggaaguga

SEQ ID NO: 108575 - RNA, 22 nt, Human
auugaugaaaauaguuauuuua

SEQ ID NO: 108576 - RNA, 22 nt, Human
auugccauaauagagccaugua

SEQ ID NO: 108577 - RNA, 22 nt, Human
auugcauucaugcuccccuuag

SEQ ID NO: 108578 - RNA, 22 nt, Human
auuucccugcagugcuuaggaa

SEQ ID NO: 108579 - RNA, 22 nt, Human
auuuggucuguaauuacaugga

SEQ ID NO: 108580 - RNA, 22 nt, Human
auuuggucuacauuuuccaaau

SEQ ID NO: 108581 - RNA, 22 nt, Human
auuuaaguuacuucucuuuccu

SEQ ID NO: 108582 - RNA, 22 nt, Human
auuuacugagguaaauaaacug

SEQ ID NO: 108583 - RNA, 22 nt, Human
auuuagacaacaagccuucucc

SEQ ID NO: 108584 - RNA, 22 nt, Human
auuugcuuguucaccaguacuu

SEQ ID NO: 108585 - RNA, 22 nt, Human
auuuauauauuuuguucuggua

SEQ ID NO: 108586 - RNA, 22 nt, Human
auuggcugucagcccggauggg

SEQ ID NO: 108587 - RNA, 22 nt, Human
auuggaagacgcuggaggcacu

SEQ ID NO: 108588 - RNA, 22 nt, Human
auuguauugcguuugcgaaugu

SEQ ID NO: 108589 - RNA, 22 nt, Human
auuugacuugguaagacuuaag

SEQ ID NO: 108590 - RNA, 22 nt, Human
auuugccaguuacucacaccac

SEQ ID NO: 108591 - RNA, 22 nt, Human
auuguuuccccggaauuauuca

SEQ ID NO: 108592 - RNA, 22 nt, Human
auuugaaguauaaguaauugcu

SEQ ID NO: 108593 - RNA, 22 nt, Human
auuuuguugaaacccuuguugu

SEQ ID NO: 108594 - RNA, 19 nt, Human
auuuugguucuuuccauuc

SEQ ID NO: 108595 - RNA, 22 nt, Human
auuuugcaguuuauugccaauc

SEQ ID NO: 108596 - RNA, 22 nt, Human
auuuccugugaacuuuucugau

SEQ ID NO: 108597 - RNA, 22 nt, Human
auuuucgcaccucgcgaguugc

SEQ ID NO: 108598 - RNA, 22 nt, Human
auuuuuauuugccuaugauaua

SEQ ID NO: 108599 - RNA, 21 nt, Human
auuuuucagaaggaugugaua

SEQ ID NO: 108600 - RNA, 22 nt, Human
auuuuaccauuaguuuguaaua

SEQ ID NO: 108601 - RNA, 22 nt, Human
auuuuagagaaacaaacguagg

SEQ ID NO: 108602 - RNA, 22 nt, Human
auuuuauuuugggaucuuuuua

SEQ ID NO: 108603 - RNA, 22 nt, Human
auuuucauauggguuauuugua

SEQ ID NO: 108604 - RNA, 22 nt, Human
auuuuacuaugauaguugagaa

SEQ ID NO: 108605 - RNA, 23 nt, Human
auuuuuccacacacagacucagu

SEQ ID NO: 108606 - RNA, 22 nt, Human
auuuuuucaugugugguugaga

SEQ ID NO: 108607 - RNA, 22 nt, Human
caagagcgugugcagggcaagu

SEQ ID NO: 108608 - RNA, 22 nt, Human
caaaaauacuugccuguaucug

SEQ ID NO: 108609 - RNA, 22 nt, Human
auuuuuuuuccugucucuuuca

SEQ ID NO: 108610 - RNA, 22 nt, Human
caaaaaauccauagaaagaggu

SEQ ID NO: 108611 - RNA, 19 nt, Human
caagagcaaagucuuauga

SEQ ID NO: 108612 - RNA, 22 nt, Human
auuuuugguuucaccugcacgc

SEQ ID NO: 108613 - RNA, 22 nt, Human
auuuuugugucacaucuaggaa

SEQ ID NO: 108614 - RNA, 22 nt, Human
caaauuuuuauuuaccaucugc

SEQ ID NO: 108615 - RNA, 22 nt, Human
caaauguuugguggcauuuugu

SEQ ID NO: 108616 - RNA, 22 nt, Human
auuuuuagagugaaagaauuaa

SEQ ID NO: 108617 - RNA, 22 nt, Human
auuuuuagucuugcugcaauca

SEQ ID NO: 108618 - RNA, 22 nt, Human
caaaauuguugaugcugcuuug

SEQ ID NO: 108619 - RNA, 22 nt, Human
caaaggaaagagaaaaagucuu

SEQ ID NO: 108620 - RNA, 22 nt, Human
caaacauuuguuggaaccccug

SEQ ID NO: 108621 - RNA, 22 nt, Human
caaaggaauuacauguuucgga

SEQ ID NO: 108622 - RNA, 22 nt, Human
caaaugcaguggucgugcugga

SEQ ID NO: 108623 - RNA, 18 nt, Human
auugagcaugacagaccu

SEQ ID NO: 108624 - RNA, 22 nt, Human
auugaguauuguaaauaaaaca

SEQ ID NO: 108625 - RNA, 22 nt, Human
auugaguucaccucuuucagaa

SEQ ID NO: 108626 - RNA, 19 nt, Human
auugcaguguaaaacuauu

SEQ ID NO: 108627 - RNA, 22 nt, Human
auugauuuugugcuuuccuacg

SEQ ID NO: 108628 - RNA, 22 nt, Human
auugaugccugaaaaauaugua

SEQ ID NO: 108629 - RNA, 22 nt, Human
auuggagacauuaagucuaaga

SEQ ID NO: 108630 - RNA, 16 nt, Human
auucuuccaccauuac

SEQ ID NO: 108631 - RNA, 21 nt, Human
auuggcagaucucuggauugu

SEQ ID NO: 108632 - RNA, 22 nt, Human
auucucuguacagaagguaccg

SEQ ID NO: 108633 - RNA, 22 nt, Human
auucucugaugcagguggaaga

SEQ ID NO: 108634 - RNA, 21 nt, Human
auucugaguugucagucuuca

SEQ ID NO: 108635 - RNA, 21 nt, Human
auucugauguuucuauuguuu

SEQ ID NO: 108636 - RNA, 22 nt, Human
auugagcuguugaagucccaca

SEQ ID NO: 108637 - RNA, 22 nt, Human
auucuguuuaauacacgaaagg

SEQ ID NO: 108638 - RNA, 22 nt, Human
auucuguaggcuuuuguuaaaa

SEQ ID NO: 108639 - RNA, 22 nt, Human
auucuguugguuuaauagucaa

SEQ ID NO: 108640 - RNA, 22 nt, Human
auucuaugaaugacuguuagau

SEQ ID NO: 108641 - RNA, 17 nt, Human
auucuaguuggcuuuuu

SEQ ID NO: 108642 - RNA, 22 nt, Human
auucuagaguuucaauccaagg

SEQ ID NO: 108643 - RNA, 20 nt, Human
auucucaccaugugacaugg

SEQ ID NO: 108644 - RNA, 22 nt, Human
auucucauguuaccaaauucua

SEQ ID NO: 108645 - RNA, 22 nt, Human
auucucauguuuuaaaaaaguu

SEQ ID NO: 108646 - RNA, 22 nt, Human
auugaaauuugcuuccucacug

SEQ ID NO: 108647 - RNA, 22 nt, Human
auugacuucccaucaggugagu

SEQ ID NO: 108648 - RNA, 22 nt, Human
auucucuauugguaaauuugac

SEQ ID NO: 108649 - RNA, 22 nt, Human
auugaauuagauguuguagucc

SEQ ID NO: 108650 - RNA, 22 nt, Human
auugacagagguguaguugaga

SEQ ID NO: 108651 - RNA, 22 nt, Human
auugaaguguacguuugaucua

SEQ ID NO: 108652 - RNA, 22 nt, Human
auugaagcauggagaugaggca

SEQ ID NO: 108653 - RNA, 19 nt, Human
auucuucucuuccugcugu

SEQ ID NO: 108654 - RNA, 22 nt, Human
auucuuuagaguccuucaaaua

SEQ ID NO: 108655 - RNA, 22 nt, Human
auucuugauauagauaguuaau

SEQ ID NO: 108656 - RNA, 22 nt, Human
auugaaauuaauuucugcuuuc

SEQ ID NO: 108657 - RNA, 20 nt, Human
auucuuguuccauuucccag

SEQ ID NO: 108658 - RNA, 22 nt, Human
auucuacgcuccgucucuauca

SEQ ID NO: 108659 - RNA, 22 nt, Human
auucuuuucucuaaaugaugaa

SEQ ID NO: 108660 - RNA, 22 nt, Human
auucuuuauuuucuguacuugc

SEQ ID NO: 108661 - RNA, 22 nt, Human
auucuucauguugaagcuguca

SEQ ID NO: 108662 - RNA, 22 nt, Human
auucuaauaagcguuuugucgc

SEQ ID NO: 108663 - RNA, 22 nt, Human
auucgcggcuugaucugcuugc

SEQ ID NO: 108664 - RNA, 23 nt, Human
auuaugaagaagacucgccuguu

SEQ ID NO: 108665 - RNA, 22 nt, Human
auuaucugacugaguagucugu

SEQ ID NO: 108666 - RNA, 22 nt, Human
auucuacucuuuaaauaugaaa

SEQ ID NO: 108667 - RNA, 22 nt, Human
auuauucaaggugaggguaaaa

SEQ ID NO: 108668 - RNA, 22 nt, Human
auuaugaauuguguuacgaaga

SEQ ID NO: 108669 - RNA, 22 nt, Human
auuauggacuuucuuguuuggg

SEQ ID NO: 108670 - RNA, 22 nt, Human
auguuuaauuugaaauuuuauu

SEQ ID NO: 108671 - RNA, 22 nt, Human
auguugaguggaugaacaaaca

SEQ ID NO: 108672 - RNA, 22 nt, Human
auuauaguuuugcccuuaagaa

SEQ ID NO: 108673 - RNA, 22 nt, Human
auuccccagcaggccuuuuguu

SEQ ID NO: 108674 - RNA, 22 nt, Human
auucuacucuccuacaggucua

SEQ ID NO: 108675 - RNA, 22 nt, Human
auguuguugaacucuuugcaug

SEQ ID NO: 108676 - RNA, 22 nt, Human
auuaacaggcucuguucuaguu

SEQ ID NO: 108677 - RNA, 21 nt, Human
auuaagacaauggcaaugggu

SEQ ID NO: 108678 - RNA, 22 nt, Human
auucuguuuuaccauuuucuuu

SEQ ID NO: 108679 - RNA, 17 nt, Human
auucuuauacucuguga

SEQ ID NO: 108680 - RNA, 22 nt, Human
auucauuuuuacaucaccaaua

SEQ ID NO: 108681 - RNA, 22 nt, Human
auucuuauaaaaaguguugacu

SEQ ID NO: 108682 - RNA, 22 nt, Human
auucuuacaaagcagagucugu

SEQ ID NO: 108683 - RNA, 22 nt, Human
auucaaugcacauguuuuggau

SEQ ID NO: 108684 - RNA, 22 nt, Human
auucaucuguacuucaauaucu

SEQ ID NO: 108685 - RNA, 17 nt, Human
auucaugaacauguccu

SEQ ID NO: 108686 - RNA, 18 nt, Human
auucauuugcguuuggcu

SEQ ID NO: 108687 - RNA, 20 nt, Human
auucuguguaaauguccugu

SEQ ID NO: 108688 - RNA, 22 nt, Human
auuauucuuugggaaaguugaa

SEQ ID NO: 108689 - RNA, 22 nt, Human
auuauugcaagcagugaaggga

SEQ ID NO: 108690 - RNA, 22 nt, Human
auucugcaauaaucaguccuua

SEQ ID NO: 108691 - RNA, 22 nt, Human
auucugcauuucuaaccagguc

SEQ ID NO: 108692 - RNA, 22 nt, Human
auucugcugccuaguuuaugaa

SEQ ID NO: 108693 - RNA, 22 nt, Human
auucugaagcagaaaaggcaga

SEQ ID NO: 108694 - RNA, 22 nt, Human
auucaagagcccauguuuccug

SEQ ID NO: 108695 - RNA, 22 nt, Human
uuugggaaacuuaggggucaga

SEQ ID NO: 108696 - RNA, 22 nt, Human
uuuguggaaaagagcccaggag

SEQ ID NO: 108697 - RNA, 22 nt, Human
uuuguggugagcagggaacguc

SEQ ID NO: 108698 - RNA, 22 nt, Human
uuugugguuuugagagaguugc

SEQ ID NO: 108699 - RNA, 22 nt, Human
uuuccugcagacaguuuaagca

SEQ ID NO: 108700 - RNA, 18 nt, Human
uuuccucauuugcagacu

SEQ ID NO: 108701 - RNA, 22 nt, Human
uuuccuguuuugguuuggagag

SEQ ID NO: 108702 - RNA, 22 nt, Human
uuucgcuuguucggagugcuuu

SEQ ID NO: 108703 - RNA, 22 nt, Human
uuucguugcacucauaugguug

SEQ ID NO: 108704 - RNA, 22 nt, Human
uuucuaaaauuacugcagucgg

SEQ ID NO: 108705 - RNA, 22 nt, Human
uuucuaacacccuccuuccaga

SEQ ID NO: 108706 - RNA, 22 nt, Human
uuucuacacuucgugguguuuu

SEQ ID NO: 108707 - RNA, 22 nt, Human
uuucuacauuuguaaccagauu

SEQ ID NO: 108708 - RNA, 22 nt, Human
uuucuauauucaguuucauaaa

SEQ ID NO: 108709 - RNA, 22 nt, Human
uuuccuaggaaaugauugaagu

SEQ ID NO: 108710 - RNA, 21 nt, Human
uuucauaggguuaaaggguua

SEQ ID NO: 108711 - RNA, 22 nt, Human
uuucacagcgucuuucucuugc

SEQ ID NO: 108712 - RNA, 22 nt, Human
uuucagauuauguucauggguu

SEQ ID NO: 108713 - RNA, 22 nt, Human
uuucagcaugacuguuaucuuu

SEQ ID NO: 108714 - RNA, 22 nt, Human
uuucaugauuaacuuagugaau

SEQ ID NO: 108715 - RNA, 22 nt, Human
uuucuugggaaaugucagaagu

SEQ ID NO: 108716 - RNA, 22 nt, Human
uuucuuuuucuacaccuuagcu

SEQ ID NO: 108717 - RNA, 18 nt, Human
uuucuuuuauuccagguc

SEQ ID NO: 108718 - RNA, 22 nt, Human
uuugaaaggagcuuuauccaga

SEQ ID NO: 108719 - RNA, 22 nt, Human
uuugaagaaacagucuuaagag

SEQ ID NO: 108720 - RNA, 22 nt, Human
uuucuguucuguuggauucuuu

SEQ ID NO: 108721 - RNA, 22 nt, Human
uuucuguugugaccugacucuu

SEQ ID NO: 108722 - RNA, 22 nt, Human
uuucuuccuucuugaucauuug

SEQ ID NO: 108723 - RNA, 22 nt, Human
uuucugugguggguaguucaga

SEQ ID NO: 108724 - RNA, 22 nt, Human
uuucuauuuacagugcuaggua

SEQ ID NO: 108725 - RNA, 22 nt, Human
uuucucuccucgaaauucuuau

SEQ ID NO: 108726 - RNA, 22 nt, Human
uuucucuuguauuugaaucacu

SEQ ID NO: 108727 - RNA, 22 nt, Human
uuucugagccacauauaauuug

SEQ ID NO: 108728 - RNA, 22 nt, Human
uuucucuuucaaucugcaguac

SEQ ID NO: 108729 - RNA, 22 nt, Human
uuucuggaaacuguaaagagga

SEQ ID NO: 108730 - RNA, 22 nt, Human
uuugagugccucgaguguggga

SEQ ID NO: 108731 - RNA, 22 nt, Human
uuugaugagaaaugacuuaagu

SEQ ID NO: 108732 - RNA, 22 nt, Human
uuugaguaagauguugauacug

SEQ ID NO: 108733 - RNA, 23 nt, Human
uuugaaucauuguggggcuuuug

SEQ ID NO: 108734 - RNA, 22 nt, Human
uuucuuaguuaaguagguaggc

SEQ ID NO: 108735 - RNA, 22 nt, Human
uuugaagauaaauauggagaaa

SEQ ID NO: 108736 - RNA, 22 nt, Human
uuugaauauacuucaaacaaag

SEQ ID NO: 108737 - RNA, 22 nt, Human
uuugaagaccuuaucucuaaau

SEQ ID NO: 108738 - RNA, 23 nt, Human
uuugccuaaugaagacuauguca

SEQ ID NO: 108739 - RNA, 22 nt, Human
uuugcugggaagccuucacucu

SEQ ID NO: 108740 - RNA, 22 nt, Human
uuugcugaaaaaccacuugagu

SEQ ID NO: 108741 - RNA, 20 nt, Human
uuugauugccccucugacuu

SEQ ID NO: 108742 - RNA, 22 nt, Human
uuugcaaaguccauugaaguua

SEQ ID NO: 108743 - RNA, 23 nt, Human
uuugcaaauuggacacaaccaca

SEQ ID NO: 108744 - RNA, 22 nt, Human
uuugcacuuaaauuuacaacac

SEQ ID NO: 108745 - RNA, 22 nt, Human
uuugcaggaaauguacugaaug

SEQ ID NO: 108746 - RNA, 22 nt, Human
uuugguaccucucgucacaaug

SEQ ID NO: 108747 - RNA, 22 nt, Human
uuuggguauuaguuuagcuaga

SEQ ID NO: 108748 - RNA, 22 nt, Human
uuuggucuggaaucuucagggu

SEQ ID NO: 108749 - RNA, 22 nt, Human
uuuggucaucaaagacaaguaa

SEQ ID NO: 108750 - RNA, 23 nt, Human
uuugucaucccucucacuuucug

SEQ ID NO: 108751 - RNA, 22 nt, Human
uuugucauuuagcccauggugg

SEQ ID NO: 108752 - RNA, 20 nt, Human
uuugucaacugcauccagca

SEQ ID NO: 108753 - RNA, 22 nt, Human
uuugucaggaauugaaaaguuu

SEQ ID NO: 108754 - RNA, 22 nt, Human
uuugcuuugacuuugggaguau

SEQ ID NO: 108755 - RNA, 22 nt, Human
uuuggaggaaugaguuuaauau

SEQ ID NO: 108756 - RNA, 18 nt, Human
uuugggauccucuuuucu

SEQ ID NO: 108757 - RNA, 22 nt, Human
uuuggcugucauuugaaaaugu

SEQ ID NO: 108758 - RNA, 22 nt, Human
uuuggcuccccaggaucugaaa

SEQ ID NO: 108759 - RNA, 22 nt, Human
uuugggcauuuuuaaggaucuu

SEQ ID NO: 108760 - RNA, 22 nt, Human
uuugggaaguaauuaauugcag

SEQ ID NO: 108761 - RNA, 22 nt, Human
uuucacugaguaggagagcacu

SEQ ID NO: 108762 - RNA, 22 nt, Human
uuucacauacaguguauaguag

SEQ ID NO: 108763 - RNA, 22 nt, Human
uuucagaaauggcacugaaauc

SEQ ID NO: 108764 - RNA, 22 nt, Human
uuuauuuuccaugucucuaggu

SEQ ID NO: 108765 - RNA, 19 nt, Human
uuucacaaagagagcguga

SEQ ID NO: 108766 - RNA, 22 nt, Human
uuucaagccucacugcguuuug

SEQ ID NO: 108767 - RNA, 22 nt, Human
uuucaaguagagggaucgcuag

SEQ ID NO: 108768 - RNA, 22 nt, Human
uuuauugcuaugucuugauugu

SEQ ID NO: 108769 - RNA, 22 nt, Human
uuuauugaccugaguaucagca

SEQ ID NO: 108770 - RNA, 22 nt, Human
uuuauuugggauuucucaucug

SEQ ID NO: 108771 - RNA, 22 nt, Human
uuuauuuggugguguuacuguu

SEQ ID NO: 108772 - RNA, 19 nt, Human
uuuauuugagacaugccuu

SEQ ID NO: 108773 - RNA, 22 nt, Human
uuuagugagugugaaucaaaug

SEQ ID NO: 108774 - RNA, 22 nt, Human
uuuauaauuguuauguuaccca

SEQ ID NO: 108775 - RNA, 22 nt, Human
uuuauauauauguaggagcaca

SEQ ID NO: 108776 - RNA, 22 nt, Human
uuuauccacucauccaugccuc

SEQ ID NO: 108777 - RNA, 22 nt, Human
uuuaucaucuucugaauuugga

SEQ ID NO: 108778 - RNA, 22 nt, Human
uuuaugguacaggaaugcuguu

SEQ ID NO: 108779 - RNA, 22 nt, Human
uuguugcuguugaacccugcug

SEQ ID NO: 108780 - RNA, 22 nt, Human
uuguugcaagccuggaaucugg

SEQ ID NO: 108781 - RNA, 22 nt, Human
uuguuguuguuguuauuuaguu

SEQ ID NO: 108782 - RNA, 22 nt, Human
uuuaccucguuguguccuuguu

SEQ ID NO: 108783 - RNA, 22 nt, Human
uuuaccugucuguagaacauaa

SEQ ID NO: 108784 - RNA, 22 nt, Human
uuguuauuauuauuuucguucu

SEQ ID NO: 108785 - RNA, 22 nt, Human
uuguggcaggauggacagcaga

SEQ ID NO: 108786 - RNA, 20 nt, Human
uuguuagguucaguguuucc

SEQ ID NO: 108787 - RNA, 22 nt, Human
uuuaggaagaucugaaggaaga

SEQ ID NO: 108788 - RNA, 22 nt, Human
uuuaggugucugcucauugaag

SEQ ID NO: 108789 - RNA, 22 nt, Human
uuuagguuguguucuggcaugu

SEQ ID NO: 108790 - RNA, 18 nt, Human
uuuacgaacucacuugag

SEQ ID NO: 108791 - RNA, 22 nt, Human
uuuacuaauuaguuuuggaaca

SEQ ID NO: 108792 - RNA, 22 nt, Human
uuuagcaguuuauuuaaggggg

SEQ ID NO: 108793 - RNA, 19 nt, Human
uuuagcuacugugguauua

SEQ ID NO: 108794 - RNA, 22 nt, Human
uuuagauguucccucuacccug

SEQ ID NO: 108795 - RNA, 22 nt, Human
uuggauguggggauggaguggg

SEQ ID NO: 108796 - RNA, 21 nt, Human
uugauuuagcagaucuagcug

SEQ ID NO: 108797 - RNA, 22 nt, Human
uugauucauuuguucccauuuu

SEQ ID NO: 108798 - RNA, 22 nt, Human
uugauuugcagaagguguagag

SEQ ID NO: 108799 - RNA, 22 nt, Human
uugggaacaggcuucccacugg

SEQ ID NO: 108800 - RNA, 20 nt, Human
uugggaagccuacaccauuc

SEQ ID NO: 108801 - RNA, 22 nt, Human
uugggauucugucagugugugu

SEQ ID NO: 108802 - RNA, 22 nt, Human
uugggcauuucuuauguauuuu

SEQ ID NO: 108803 - RNA, 22 nt, Human
uuggggaauuuggggccguccg

SEQ ID NO: 108804 - RNA, 22 nt, Human
uuggcuuuucaguuuuaaguua

SEQ ID NO: 108805 - RNA, 22 nt, Human
uuggccguuucacugggcaguu

SEQ ID NO: 108806 - RNA, 22 nt, Human
uugucagcuagugaugcuguuc

SEQ ID NO: 108807 - RNA, 22 nt, Human
uugucaagauauuuuaggaggc

SEQ ID NO: 108808 - RNA, 22 nt, Human
uugguugaaauguguucaugcu

SEQ ID NO: 108809 - RNA, 22 nt, Human
uugugauuaauaacuuuucucu

SEQ ID NO: 108810 - RNA, 22 nt, Human
uugugaggaugugcuuuuuagu

SEQ ID NO: 108811 - RNA, 22 nt, Human
uugugacuauuuuucauugaag

SEQ ID NO: 108812 - RNA, 22 nt, Human
uugugcacauuucauugaccug

SEQ ID NO: 108813 - RNA, 22 nt, Human
uugugcauuuuguuuuacuuau

SEQ ID NO: 108814 - RNA, 22 nt, Human
uugugcauuugcuaugggccau

SEQ ID NO: 108815 - RNA, 22 nt, Human
uugguuuacucuggggauaucu

SEQ ID NO: 108816 - RNA, 22 nt, Human
uugguugcugaugagcuuugag

SEQ ID NO: 108817 - RNA, 22 nt, Human
uugguuuuuugguguaucuuau

SEQ ID NO: 108818 - RNA, 22 nt, Human
uuguaagacuguagaaugcaaa

SEQ ID NO: 108819 - RNA, 22 nt, Human
uuguaauaguguuuuacguugu

SEQ ID NO: 108820 - RNA, 22 nt, Human
uugguuaccuucagaaaugagu

SEQ ID NO: 108821 - RNA, 22 nt, Human
uugguguuucacuuccuugucg

SEQ ID NO: 108822 - RNA, 22 nt, Human
uuggugauugggaauggauggg

SEQ ID NO: 108823 - RNA, 22 nt, Human
uuuuagaagcauuuaugagauu

SEQ ID NO: 108824 - RNA, 22 nt, Human
uuuuagagacagcauggagaaa

SEQ ID NO: 108825 - RNA, 22 nt, Human
uuuuacauuuuauucguuuauu

SEQ ID NO: 108826 - RNA, 22 nt, Human
uucuagaagggccuaggcauaa

SEQ ID NO: 108827 - RNA, 22 nt, Human
uucgucauuguuguugguuuuc

SEQ ID NO: 108828 - RNA, 22 nt, Human
uuuuaauucaacauuugcuuuu

SEQ ID NO: 108829 - RNA, 22 nt, Human
uucgucauuaugcagccuguga

SEQ ID NO: 108830 - RNA, 22 nt, Human
uuuuccuuagaaauacauugau

SEQ ID NO: 108831 - RNA, 22 nt, Human
uuuucauuguuaguuucuccuu

SEQ ID NO: 108832 - RNA, 23 nt, Human
uuuuccaaaucgacucucuaguu

SEQ ID NO: 108833 - RNA, 22 nt, Human
uuuuaucagagcuugcagugug

SEQ ID NO: 108834 - RNA, 22 nt, Human
uuuuaucuuacauggaaucucc

SEQ ID NO: 108835 - RNA, 22 nt, Human
uuuuauaauacccuugacuaau

SEQ ID NO: 108836 - RNA, 22 nt, Human
uucuagacaauugaaaacuguu

SEQ ID NO: 108837 - RNA, 22 nt, Human
uuuucuugagucacuccaguga

SEQ ID NO: 108838 - RNA, 22 nt, Human
uuuucuucucauucugaccuca

SEQ ID NO: 108839 - RNA, 22 nt, Human
uuuucugauccuucuaacuuga

SEQ ID NO: 108840 - RNA, 22 nt, Human
uuuucucucacuucacauauuu

SEQ ID NO: 108841 - RNA, 22 nt, Human
uuuucucuuugcuucucuaaaa

SEQ ID NO: 108842 - RNA, 22 nt, Human
uuuucggagaauguuaaugugu

SEQ ID NO: 108843 - RNA, 22 nt, Human
uuuucuaggcccuggauuaugu

SEQ ID NO: 108844 - RNA, 22 nt, Human
uuuucucacugagagccuugau

SEQ ID NO: 108845 - RNA, 22 nt, Human
uuuugguuugaguauuuuuuuu

SEQ ID NO: 108846 - RNA, 22 nt, Human
uucuuaaugcauccuguguuca

SEQ ID NO: 108847 - RNA, 22 nt, Human
uuuugguauaauuuaaaauuaa

SEQ ID NO: 108848 - RNA, 22 nt, Human
uucuguuuuuauucuaucucug

SEQ ID NO: 108849 - RNA, 22 nt, Human
uuuugcuucuaguauauuuuuu

SEQ ID NO: 108850 - RNA, 22 nt, Human
uuuuggaaaaaccaguauggaa

SEQ ID NO: 108851 - RNA, 22 nt, Human
uucugugacuccucagagauuu

SEQ ID NO: 108852 - RNA, 22 nt, Human
uucugugcugagaaauagagag

SEQ ID NO: 108853 - RNA, 22 nt, Human
uucugugacgcaaagcugggaa

SEQ ID NO: 108854 - RNA, 22 nt, Human
uuuugagucuggcaguuuuguu

SEQ ID NO: 108855 - RNA, 22 nt, Human
uuuugauacaaguuguaaaaaa

SEQ ID NO: 108856 - RNA, 22 nt, Human
uuuucuuggaguggcuguccuu

SEQ ID NO: 108857 - RNA, 22 nt, Human
uuuuuggacccaucuucuuuuu

SEQ ID NO: 108858 - RNA, 22 nt, Human
uuuuugcuuuuuugucaucuaa

SEQ ID NO: 108859 - RNA, 22 nt, Human
uucuuuuaauuucugucugcag

SEQ ID NO: 108860 - RNA, 22 nt, Human
uucuuuuuagcugguuguaaga

SEQ ID NO: 108861 - RNA, 22 nt, Human
uugaaaaaaucugaggaggacc

SEQ ID NO: 108862 - RNA, 21 nt, Human
uucuuugcugcuguuuuugua

SEQ ID NO: 108863 - RNA, 22 nt, Human
uuuuugaauaagugcaucauca

SEQ ID NO: 108864 - RNA, 22 nt, Human
uucuugcuuccggugcuccagg

SEQ ID NO: 108865 - RNA, 22 nt, Human
uucuuggcacagaugagauucu

SEQ ID NO: 108866 - RNA, 21 nt, Human
uucuuugaagacccauuugag

SEQ ID NO: 108867 - RNA, 22 nt, Human
uucuugugugaauauaauuaca

SEQ ID NO: 108868 - RNA, 22 nt, Human
uuuuuaaaauuaggacggcacg

SEQ ID NO: 108869 - RNA, 22 nt, Human
uuuugucuguggaaagcugcua

SEQ ID NO: 108870 - RNA, 22 nt, Human
uucuucuguuggcagagcauac

SEQ ID NO: 108871 - RNA, 22 nt, Human
uucuucgacuguauaaaaguau

SEQ ID NO: 108872 - RNA, 22 nt, Human
uugaacauuagaauaaguaauu

SEQ ID NO: 108873 - RNA, 22 nt, Human
uuuuugggccaaauauauuuac

SEQ ID NO: 108874 - RNA, 22 nt, Human
uuuuuguauaugcuucgaggau

SEQ ID NO: 108875 - RNA, 22 nt, Human
uugaauuuagguuuaugugaaa

SEQ ID NO: 108876 - RNA, 22 nt, Human
uuuuuuccugguuacagauugu

SEQ ID NO: 108877 - RNA, 20 nt, Human
uugagccucauggauugucu

SEQ ID NO: 108878 - RNA, 21 nt, Human
uugagcuuuuaguacagacag

SEQ ID NO: 108879 - RNA, 22 nt, Human
uugaugagucacuuucuguaaa

SEQ ID NO: 108880 - RNA, 22 nt, Human
uugaccagaaaaguuaguaauu

SEQ ID NO: 108881 - RNA, 22 nt, Human
uuuuuugucuugaagaaauggu

SEQ ID NO: 108882 - RNA, 22 nt, Human
uugagauuuggagguaauuccc

SEQ ID NO: 108883 - RNA, 22 nt, Human
uuuuuuguggcuggaagaaaaa

SEQ ID NO: 108884 - RNA, 20 nt, Human
uuaguuacuuagugagaguc

SEQ ID NO: 108885 - RNA, 21 nt, Human
uucaaccagcaauuggcagaa

SEQ ID NO: 108886 - RNA, 22 nt, Human
uucaaccuucagcuugaguugg

SEQ ID NO: 108887 - RNA, 21 nt, Human
uucaaguucacacucaaaggu

SEQ ID NO: 108888 - RNA, 22 nt, Human
uucaauuacaucagaaucuaaa

SEQ ID NO: 108889 - RNA, 22 nt, Human
uuuauucacuuaucaggaacga

SEQ ID NO: 108890 - RNA, 22 nt, Human
uuuauguugagcaaaauaccac

SEQ ID NO: 108891 - RNA, 22 nt, Human
uuaguuaauaaauauugagugu

SEQ ID NO: 108892 - RNA, 22 nt, Human
uuaguuaccacugcagaucuuu

SEQ ID NO: 108893 - RNA, 22 nt, Human
uuagugaagaagcaucuuuagu

SEQ ID NO: 108894 - RNA, 22 nt, Human
uucagaauguacugauagaaca

SEQ ID NO: 108895 - RNA, 22 nt, Human
uucagaauuaucauaauuuuga

SEQ ID NO: 108896 - RNA, 22 nt, Human
uuugccaucagaugugguaggu

SEQ ID NO: 108897 - RNA, 22 nt, Human
uucagaacugucuguccuuuuc

SEQ ID NO: 108898 - RNA, 22 nt, Human
uuugauuuuuugagcaguguau

SEQ ID NO: 108899 - RNA, 22 nt, Human
uucacccaaaucaagcuggccu

SEQ ID NO: 108900 - RNA, 22 nt, Human
uucacguuguugaagaaaauac

SEQ ID NO: 108901 - RNA, 22 nt, Human
uucaauggaauucuuagguuuc

SEQ ID NO: 108902 - RNA, 22 nt, Human
uucagauuuguuuuuguuucug

SEQ ID NO: 108903 - RNA, 22 nt, Human
uucagcauggcuguuuucccuu

SEQ ID NO: 108904 - RNA, 19 nt, Human
uuugccugugguucagaag

SEQ ID NO: 108905 - RNA, 22 nt, Human
uucagcugcuugccugaaguca

SEQ ID NO: 108906 - RNA, 22 nt, Human
uuugcuguccaauauucagggu

SEQ ID NO: 108907 - RNA, 22 nt, Human
uuugcuguaaugcaugucagag

SEQ ID NO: 108908 - RNA, 22 nt, Human
uuuggaugcugucauaugcugc

SEQ ID NO: 108909 - RNA, 22 nt, Human
uucaggaaacaaauuugcaguu

SEQ ID NO: 108910 - RNA, 22 nt, Human
uuuggcgucucucaggagcuca

SEQ ID NO: 108911 - RNA, 22 nt, Human
uuuggcuuugauccuaggauuc

SEQ ID NO: 108912 - RNA, 22 nt, Human
uuuggcuacucuucauugguga

SEQ ID NO: 108913 - RNA, 22 nt, Human
uucaggacacauuauuuaugaa

SEQ ID NO: 108914 - RNA, 22 nt, Human
uuuggcuaccugggagggaaag

SEQ ID NO: 108915 - RNA, 22 nt, Human
uucauagaagggaguuuuuccu

SEQ ID NO: 108916 - RNA, 22 nt, Human
uucauaugaauuggguuuuuuu

SEQ ID NO: 108917 - RNA, 22 nt, Human
uucaucauuuuccauuccucuu

SEQ ID NO: 108918 - RNA, 23 nt, Human
uuuguugguuuaagaguagcaga

SEQ ID NO: 108919 - RNA, 19 nt, Human
uuuguuguaucagagcuuu

SEQ ID NO: 108920 - RNA, 22 nt, Human
uuccccuucuaauacucaauuu

SEQ ID NO: 108921 - RNA, 22 nt, Human
uuccauuacuaaugccugcaau

SEQ ID NO: 108922 - RNA, 22 nt, Human
uucauuagcguaggauguguac

SEQ ID NO: 108923 - RNA, 22 nt, Human
uucaugucuuugauucugauaa

SEQ ID NO: 108924 - RNA, 23 nt, Human
uuugggaaauagccuauaggcac

SEQ ID NO: 108925 - RNA, 22 nt, Human
uucaugcaagagugugaggucc

SEQ ID NO: 108926 - RNA, 22 nt, Human
uuccacaugaucauuguaauaa

SEQ ID NO: 108927 - RNA, 22 nt, Human
uuuggguuuuuccuuagggacu

SEQ ID NO: 108928 - RNA, 22 nt, Human
uuccagaacaauguggacguau

SEQ ID NO: 108929 - RNA, 22 nt, Human
uuuguuugcuaguauuuuguuu

SEQ ID NO: 108930 - RNA, 22 nt, Human
uuuguuuauuuacuuugggccu

SEQ ID NO: 108931 - RNA, 22 nt, Human
uuccucauuuggcacaucugag

SEQ ID NO: 108932 - RNA, 22 nt, Human
uuccugacacuggcaggcuucu

SEQ ID NO: 108933 - RNA, 21 nt, Human
uuccuccucuggagaagaaga

SEQ ID NO: 108934 - RNA, 22 nt, Human
uuccucauuuuguuaauuuuac

SEQ ID NO: 108935 - RNA, 22 nt, Human
uuccuuaagauuucccaaguca

SEQ ID NO: 108936 - RNA, 22 nt, Human
uuccuuuaaccaagagcaguac

SEQ ID NO: 108937 - RNA, 22 nt, Human
uuccuuuucuucuaccacaugu

SEQ ID NO: 108938 - RNA, 22 nt, Human
uuuuaaaguaauugaagcuugu

SEQ ID NO: 108939 - RNA, 23 nt, Human
uuuuaauaguaugacaugagcug

SEQ ID NO: 108940 - RNA, 22 nt, Human
uuuuaauaguauaucuagacac

SEQ ID NO: 108941 - RNA, 21 nt, Human
uucgaaugggucguugcugcc

SEQ ID NO: 108942 - RNA, 22 nt, Human
uuuuaaauggcuuuuacuuuuc

SEQ ID NO: 108943 - RNA, 22 nt, Human
uuuuaacuuuggguucucuuua

SEQ ID NO: 108944 - RNA, 22 nt, Human
uuuuaacuuuaccauuucuuca

SEQ ID NO: 108945 - RNA, 22 nt, Human
uguguguguguguaugugcgug

SEQ ID NO: 108946 - RNA, 22 nt, Human
uguguguguccucauuugcaga

SEQ ID NO: 108947 - RNA, 22 nt, Human
ugugugcacguacauacuguau

SEQ ID NO: 108948 - RNA, 17 nt, Human
uguguauucuccaggug

SEQ ID NO: 108949 - RNA, 22 nt, Human
uguguguguuguaugaaauuuu

SEQ ID NO: 108950 - RNA, 22 nt, Human
uuggauugugaaaguauucucu

SEQ ID NO: 108951 - RNA, 22 nt, Human
uguguuacaauaauggcaagua

SEQ ID NO: 108952 - RNA, 22 nt, Human
ugugugugugugugugugugug

SEQ ID NO: 108953 - RNA, 22 nt, Human
uugcggauguccacgucacacu

SEQ ID NO: 108954 - RNA, 22 nt, Human
uuggcaaaagauuggguacuua

SEQ ID NO: 108955 - RNA, 22 nt, Human
uuggcaaagagaugcauaagga

SEQ ID NO: 108956 - RNA, 22 nt, Human
uuggcacagagcugcagccugg

SEQ ID NO: 108957 - RNA, 22 nt, Human
uuggcagagaacagaaugauuu

SEQ ID NO: 108958 - RNA, 22 nt, Human
uguguuagguuuugggauggcu

SEQ ID NO: 108959 - RNA, 22 nt, Human
uguguuguuggggauguuuuca

SEQ ID NO: 108960 - RNA, 21 nt, Human
uguguuuauauguguuuauau

SEQ ID NO: 108961 - RNA, 22 nt, Human
uguguuuaaacuauaugccugc

SEQ ID NO: 108962 - RNA, 22 nt, Human
uguguuuuucauuuuaaguccu

SEQ ID NO: 108963 - RNA, 22 nt, Human
uuggcauuccagaugcuuuucu

SEQ ID NO: 108964 - RNA, 22 nt, Human
uguucugauggauuacaugucu

SEQ ID NO: 108965 - RNA, 19 nt, Human
uguucuacuugcuaguauu

SEQ ID NO: 108966 - RNA, 22 nt, Human
uuggcuguguugaaaacgugga

SEQ ID NO: 108967 - RNA, 22 nt, Human
uuggcguuuccuguucugggug

SEQ ID NO: 108968 - RNA, 22 nt, Human
uuggccaaggaccuuuuuggag

SEQ ID NO: 108969 - RNA, 22 nt, Human
uuguauuaauacacuccuuuuc

SEQ ID NO: 108970 - RNA, 22 nt, Human
uuguauuguuugcgucuguguu

SEQ ID NO: 108971 - RNA, 22 nt, Human
uugucaggaacuaugauuaugc

SEQ ID NO: 108972 - RNA, 22 nt, Human
uguuuguaugauggcacaucca

SEQ ID NO: 108973 - RNA, 22 nt, Human
uguuuaaauagaacauacugca

SEQ ID NO: 108974 - RNA, 22 nt, Human
uguuuaagugguuaaaggauuc

SEQ ID NO: 108975 - RNA, 22 nt, Human
uguuuagcucugacuaugugau

SEQ ID NO: 108976 - RNA, 22 nt, Human
uugguauuuguuuaaauuacac

SEQ ID NO: 108977 - RNA, 22 nt, Human
uuggucaagacugauaucaaga

SEQ ID NO: 108978 - RNA, 19 nt, Human
uugguuuguugcuuaggug

SEQ ID NO: 108979 - RNA, 22 nt, Human
uugguuuuauucguauuuguau

SEQ ID NO: 108980 - RNA, 22 nt, Human
uugucaugauccuucuguuagg

SEQ ID NO: 108981 - RNA, 22 nt, Human
uugucauuuucuuaauguuccu

SEQ ID NO: 108982 - RNA, 22 nt, Human
uguuuuguuuagguuuguuuuu

SEQ ID NO: 108983 - RNA, 22 nt, Human
uguuuucuuuccccuucuuuuc

SEQ ID NO: 108984 - RNA, 22 nt, Human
uguuuucaucucucacccagaa

SEQ ID NO: 108985 - RNA, 19 nt, Human
uugucuuagcugcauaaga

SEQ ID NO: 108986 - RNA, 22 nt, Human
uugugacaauacagcauggaga

SEQ ID NO: 108987 - RNA, 22 nt, Human
uugucuuggcauaccguuauau

SEQ ID NO: 108988 - RNA, 22 nt, Human
uugucuuucguauggaacacua

SEQ ID NO: 108989 - RNA, 22 nt, Human
uuaaaagaauccuguuauccuc

SEQ ID NO: 108990 - RNA, 23 nt, Human
uugugguuauauuugcccauuuu

SEQ ID NO: 108991 - RNA, 22 nt, Human
uguuuuuucccccccuucuaaa

SEQ ID NO: 108992 - RNA, 22 nt, Human
uguuuuuuagagugauacuuuu

SEQ ID NO: 108993 - RNA, 15 nt, Human
uugugauauuuaccg

SEQ ID NO: 108994 - RNA, 23 nt, Human
uugugcggugcuuuggguuuaca

SEQ ID NO: 108995 - RNA, 22 nt, Human
uuuagaaugaaugcaagagaau

SEQ ID NO: 108996 - RNA, 22 nt, Human
uuuacuauuaguauuucauuuu

SEQ ID NO: 108997 - RNA, 22 nt, Human
uuacuuaucugaugugauuuuu

SEQ ID NO: 108998 - RNA, 22 nt, Human
uuacuguguguaaaauaucuuu

SEQ ID NO: 108999 - RNA, 22 nt, Human
uuuaauuauaucugggcaguua

SEQ ID NO: 109000 - RNA, 22 nt, Human
uuaccuuuucuuguuuacaagu

SEQ ID NO: 109001 - RNA, 22 nt, Human
uuuaccuuauguaaauaagagu

SEQ ID NO: 109002 - RNA, 22 nt, Human
uuuaauauuacacuuaccuugu

SEQ ID NO: 109003 - RNA, 22 nt, Human
uuuaauauucucuuugaaggaa

SEQ ID NO: 109004 - RNA, 22 nt, Human
uuaauugggugcuuuguaaaua

SEQ ID NO: 109005 - RNA, 22 nt, Human
uuuaaucaauaaccuccugggu

SEQ ID NO: 109006 - RNA, 20 nt, Human
uuuaacuggccuucuggcuc

SEQ ID NO: 109007 - RNA, 22 nt, Human
uuuaacccaaauaaccacagga

SEQ ID NO: 109008 - RNA, 22 nt, Human
uuuaacauaugaaagaauauuu

SEQ ID NO: 109009 - RNA, 22 nt, Human
uuuaaguuaguauggguuaggu

SEQ ID NO: 109010 - RNA, 21 nt, Human
uuuaaggccagcaggagguga

SEQ ID NO: 109011 - RNA, 18 nt, Human
uuuaauaagccuguuaug

SEQ ID NO: 109012 - RNA, 22 nt, Human
uuacaacgcacacagauuucac

SEQ ID NO: 109013 - RNA, 22 nt, Human
uuaauuguuagauagauuauag

SEQ ID NO: 109014 - RNA, 22 nt, Human
uuacaguuuacauaagaauugu

SEQ ID NO: 109015 - RNA, 19 nt, Human
uuacaugacauaugaagga

SEQ ID NO: 109016 - RNA, 22 nt, Human
uuuaaugaugucuaugccuguu

SEQ ID NO: 109017 - RNA, 22 nt, Human
uuuagacuacuaugcugccaga

SEQ ID NO: 109018 - RNA, 22 nt, Human
uuuagagguacaguaggcauga

SEQ ID NO: 109019 - RNA, 22 nt, Human
uuuagaugcuguauguuauuuc

SEQ ID NO: 109020 - RNA, 22 nt, Human
uuuagcaaaaaagcucugcgua

SEQ ID NO: 109021 - RNA, 22 nt, Human
uuacuuuuuucccccuuagaug

SEQ ID NO: 109022 - RNA, 22 nt, Human
uuagaugaaaaucggaacaugu

SEQ ID NO: 109023 - RNA, 20 nt, Human
uuuagucauuuccuaggaaa

SEQ ID NO: 109024 - RNA, 22 nt, Human
uuuaguauaguaugugcucaaa

SEQ ID NO: 109025 - RNA, 22 nt, Human
uuagaugugaucagcuggcuua

SEQ ID NO: 109026 - RNA, 22 nt, Human
uuuaguugcuuuaguugagcug

SEQ ID NO: 109027 - RNA, 22 nt, Human
uuuauaaacacaagaugggcuc

SEQ ID NO: 109028 - RNA, 22 nt, Human
uuuagugaagcuuugcauuuca

SEQ ID NO: 109029 - RNA, 22 nt, Human
uuuaugucaaaaguaaaaugaa

SEQ ID NO: 109030 - RNA, 22 nt, Human
uuuauguuuguuuuugaaauaa

SEQ ID NO: 109031 - RNA, 22 nt, Human
uuaguccuaaauuuagauuuuc

SEQ ID NO: 109032 - RNA, 22 nt, Human
uuaguauuuuuugaaugaugaa

SEQ ID NO: 109033 - RNA, 22 nt, Human
uuaguauuuucaccauaugagg

SEQ ID NO: 109034 - RNA, 22 nt, Human
uuagguuuaugaggucugcauu

SEQ ID NO: 109035 - RNA, 22 nt, Human
uuguguuuaaucuguuccacua

SEQ ID NO: 109036 - RNA, 22 nt, Human
uugugugugcccaccuguggcc

SEQ ID NO: 109037 - RNA, 22 nt, Human
uuguuauaggaucagugucacu

SEQ ID NO: 109038 - RNA, 22 nt, Human
uuaaagaguuuauuacuuguaa

SEQ ID NO: 109039 - RNA, 22 nt, Human
uuaaaauuguuaacuuugguga

SEQ ID NO: 109040 - RNA, 22 nt, Human
uuaaacauuuccacuugccagu

SEQ ID NO: 109041 - RNA, 22 nt, Human
uuaacauuguccuuagcagauu

SEQ ID NO: 109042 - RNA, 22 nt, Human
uuaagggauugagauggaauga

SEQ ID NO: 109043 - RNA, 22 nt, Human
uuaagagaagaguaucuagaac

SEQ ID NO: 109044 - RNA, 22 nt, Human
uuguuuaaagaacuucugacuu

SEQ ID NO: 109045 - RNA, 22 nt, Human
uuguuuacuugagcugcacucu

SEQ ID NO: 109046 - RNA, 22 nt, Human
uuguuucagcuuccuccuccau

SEQ ID NO: 109047 - RNA, 22 nt, Human
uuguuuggcaaaugugugugug

SEQ ID NO: 109048 - RNA, 22 nt, Human
uuguuugcacuuuagagacugu

SEQ ID NO: 109049 - RNA, 22 nt, Human
uuguuccagaaacccaggggaa

SEQ ID NO: 109050 - RNA, 22 nt, Human
uuguuccuuucuucuguagucg

SEQ ID NO: 109051 - RNA, 22 nt, Human
uuaauaaauugugguaccagag

SEQ ID NO: 109052 - RNA, 22 nt, Human
uuaaguccuugguaauuuucuu

SEQ ID NO: 109053 - RNA, 22 nt, Human
uuaauaaggaccugugacaugc

SEQ ID NO: 109054 - RNA, 22 nt, Human
uuaaucagacauucucaaguuu

SEQ ID NO: 109055 - RNA, 22 nt, Human
uuaauauuaagauauugagugg

SEQ ID NO: 109056 - RNA, 22 nt, Human
uuguuuuaguagaaguuacaug

SEQ ID NO: 109057 - RNA, 22 nt, Human
uuaaugauuaauguggacccaa

SEQ ID NO: 109058 - RNA, 22 nt, Human
uuguuuucuugaugaaauuauu

SEQ ID NO: 109059 - RNA, 22 nt, Human
uuuaaaccuuggaagccacaua

SEQ ID NO: 109060 - RNA, 21 nt, Human
uuaaugcuaugcagaaaaucu

SEQ ID NO: 109061 - RNA, 22 nt, Human
uuaauguggaagaguuuggcua

SEQ ID NO: 109062 - RNA, 22 nt, Human
uuaaugcauguaaaugugcaaa

SEQ ID NO: 109063 - RNA, 22 nt, Human
uuuaaacuaacaguacacguug

SEQ ID NO: 109064 - RNA, 22 nt, Human
uuuaaagucaggcuguaguggu

SEQ ID NO: 109065 - RNA, 22 nt, Human
uuuaaauuucugaaucuugagg

SEQ ID NO: 109066 - RNA, 23 nt, Human
uuuaaacaauguggucguggugg

SEQ ID NO: 109067 - RNA, 22 nt, Human
uuuaaaccuaucuaagaaauag

SEQ ID NO: 109068 - RNA, 22 nt, Human
ugucacagagcgugcaacagaa

SEQ ID NO: 109069 - RNA, 21 nt, Human
uugaaguggguagcuggcggg

SEQ ID NO: 109070 - RNA, 22 nt, Human
uugaauaaggcauaaagauacu

SEQ ID NO: 109071 - RNA, 22 nt, Human
uguaguguuuagucuagugucg

SEQ ID NO: 109072 - RNA, 22 nt, Human
uugaauaguuuuggauagcaua

SEQ ID NO: 109073 - RNA, 22 nt, Human
uugaaucauauguaauugacuu

SEQ ID NO: 109074 - RNA, 22 nt, Human
uguaguuuuaggagggguaaau

SEQ ID NO: 109075 - RNA, 22 nt, Human
ugucauuuauucucuuauucua

SEQ ID NO: 109076 - RNA, 20 nt, Human
uugauucacaaaaagcuuag

SEQ ID NO: 109077 - RNA, 22 nt, Human
uugaugacuaaagaaagcugcu

SEQ ID NO: 109078 - RNA, 22 nt, Human
uugaugacauuuagcauaauug

SEQ ID NO: 109079 - RNA, 22 nt, Human
uugauagauuuuagaggcaggc

SEQ ID NO: 109080 - RNA, 22 nt, Human
ugucugaauuguaauguugcgu

SEQ ID NO: 109081 - RNA, 22 nt, Human
ugucccuaucagucccaaguca

SEQ ID NO: 109082 - RNA, 22 nt, Human
uugauuggguauaaugacagga

SEQ ID NO: 109083 - RNA, 22 nt, Human
uugauuccagcguuccaucagc

SEQ ID NO: 109084 - RNA, 22 nt, Human
uugauuuggcguuuuccuccug

SEQ ID NO: 109085 - RNA, 22 nt, Human
uugcaucagcaggcauaauugg

SEQ ID NO: 109086 - RNA, 22 nt, Human
ugugauugucuucugaaaguca

SEQ ID NO: 109087 - RNA, 22 nt, Human
uguauaaaauggaaugucagaa

SEQ ID NO: 109088 - RNA, 22 nt, Human
uguagugaaauuaaaccaaagc

SEQ ID NO: 109089 - RNA, 22 nt, Human
uguagcuccuaaagcccagcug

SEQ ID NO: 109090 - RNA, 22 nt, Human
uugaaagucuaagaauagguau

SEQ ID NO: 109091 - RNA, 23 nt, Human
uguacugucuuucagguucuuau

SEQ ID NO: 109092 - RNA, 22 nt, Human
uguacuuguaauaucagugaaa

SEQ ID NO: 109093 - RNA, 22 nt, Human
ugguugagguugacucuauaua

SEQ ID NO: 109094 - RNA, 22 nt, Human
ugguuuuuuguaggauaaacau

SEQ ID NO: 109095 - RNA, 22 nt, Human
ugguugggguaacaaaaaggaa

SEQ ID NO: 109096 - RNA, 22 nt, Human
uugaaaaaauguguuuaaggag

SEQ ID NO: 109097 - RNA, 22 nt, Human
uguaaucaugguagaggcaaag

SEQ ID NO: 109098 - RNA, 22 nt, Human
uucuuuuaauagagauccugug

SEQ ID NO: 109099 - RNA, 22 nt, Human
uucuuuguccuagcauucuaca

SEQ ID NO: 109100 - RNA, 22 nt, Human
uucuuuucuucccuguuuauua

SEQ ID NO: 109101 - RNA, 19 nt, Human
uggugcgcuguuccugagc

SEQ ID NO: 109102 - RNA, 20 nt, Human
uucuguggcccguuuaagug

SEQ ID NO: 109103 - RNA, 22 nt, Human
uggucucaaagcaaggaaggaa

SEQ ID NO: 109104 - RNA, 22 nt, Human
uggucugggaagaucacaauua

SEQ ID NO: 109105 - RNA, 22 nt, Human
uggugaggacccagauuuuccu

SEQ ID NO: 109106 - RNA, 22 nt, Human
ugguuauauaaggauuaaauac

SEQ ID NO: 109107 - RNA, 22 nt, Human
ugguucacaagaauccagguag

SEQ ID NO: 109108 - RNA, 22 nt, Human
ugguucggcuguaaguauaucu

SEQ ID NO: 109109 - RNA, 22 nt, Human
ugguuauggaacuggcuauggc

SEQ ID NO: 109110 - RNA, 19 nt, Human
ugguggaggugcaccugac

SEQ ID NO: 109111 - RNA, 22 nt, Human
uucuugcgaaagaaugagcuga

SEQ ID NO: 109112 - RNA, 22 nt, Human
uucuucuucuuccucauccuca

SEQ ID NO: 109113 - RNA, 22 nt, Human
uucuucuuuccuauaauuaauu

SEQ ID NO: 109114 - RNA, 22 nt, Human
uggggcuggccaggaggagucu

SEQ ID NO: 109115 - RNA, 21 nt, Human
uucuauauugagaauuggcua

SEQ ID NO: 109116 - RNA, 22 nt, Human
uucuauaagagaugaauacagu

SEQ ID NO: 109117 - RNA, 22 nt, Human
uucuaguuacagaagccuugcu

SEQ ID NO: 109118 - RNA, 22 nt, Human
uucuaguuacucuuaaaugcug

SEQ ID NO: 109119 - RNA, 22 nt, Human
uggguuugcuuguucagguucu

SEQ ID NO: 109120 - RNA, 22 nt, Human
uggguuuaccaguguuucuucc

SEQ ID NO: 109121 - RNA, 22 nt, Human
uggguuaaaguuugucacugac

SEQ ID NO: 109122 - RNA, 22 nt, Human
ugggugggcagagucuaagaua

SEQ ID NO: 109123 - RNA, 22 nt, Human
uucugcuagugguauauguuga

SEQ ID NO: 109124 - RNA, 17 nt, Human
uucugcucaggaacaga

SEQ ID NO: 109125 - RNA, 22 nt, Human
ugguagcaggugcuaaaggccu

SEQ ID NO: 109126 - RNA, 22 nt, Human
ugguauaaaaauuugugaaugu

SEQ ID NO: 109127 - RNA, 22 nt, Human
ugguaauuuaacaaaauuguca

SEQ ID NO: 109128 - RNA, 22 nt, Human
ugguauauuugaccauaugugu

SEQ ID NO: 109129 - RNA, 22 nt, Human
uucuguacuagaucuuaucagu

SEQ ID NO: 109130 - RNA, 22 nt, Human
uggucaagcaaugaauuuauuu

SEQ ID NO: 109131 - RNA, 22 nt, Human
uggagcuggcuuguggaaguug

SEQ ID NO: 109132 - RNA, 22 nt, Human
uuaucuuuuaaaaacacuugug

SEQ ID NO: 109133 - RNA, 22 nt, Human
uuaugucauuugaauuaauuuu

SEQ ID NO: 109134 - RNA, 22 nt, Human
uuauggauuagaguuugauucu

SEQ ID NO: 109135 - RNA, 22 nt, Human
uuaugccuguuaggcagcaucu

SEQ ID NO: 109136 - RNA, 22 nt, Human
uuaugcaaaggggccucuuccu

SEQ ID NO: 109137 - RNA, 22 nt, Human
uuccaacaugugcuuguguuga

SEQ ID NO: 109138 - RNA, 22 nt, Human
uuccaaggcugcuauuuguuuc

SEQ ID NO: 109139 - RNA, 22 nt, Human
uuccaaggagagcucgaccuca

SEQ ID NO: 109140 - RNA, 22 nt, Human
uuccacauucggaauuuucuga

SEQ ID NO: 109141 - RNA, 22 nt, Human
uggcugagcugcagcguggcuu

SEQ ID NO: 109142 - RNA, 22 nt, Human
uuccaaaugacaaugggcugua

SEQ ID NO: 109143 - RNA, 22 nt, Human
uggcugaggcuuuucuuaaaga

SEQ ID NO: 109144 - RNA, 22 nt, Human
uuaugguuuaauauccagcaca

SEQ ID NO: 109145 - RNA, 22 nt, Human
uuaugugcuacacauaauuugu

SEQ ID NO: 109146 - RNA, 22 nt, Human
ugggaagcugagccucgaugug

SEQ ID NO: 109147 - RNA, 22 nt, Human
ugggaauuuaugagaaaauaua

SEQ ID NO: 109148 - RNA, 22 nt, Human
ugggaaaauagcuauuuugaaa

SEQ ID NO: 109149 - RNA, 22 nt, Human
uggcugagugaacauguccauu

SEQ ID NO: 109150 - RNA, 22 nt, Human
uggcuguuggagcuggaagaug

SEQ ID NO: 109151 - RNA, 22 nt, Human
uggcuuuuuucuccccuuggau

SEQ ID NO: 109152 - RNA, 22 nt, Human
uggcuuuuuauuccuaugugau

SEQ ID NO: 109153 - RNA, 22 nt, Human
uuccugcuggucaaaguugccu

SEQ ID NO: 109154 - RNA, 22 nt, Human
ugggagagaaauuuaaguuuuu

SEQ ID NO: 109155 - RNA, 21 nt, Human
uuccuaaaaugcuuuugugcc

SEQ ID NO: 109156 - RNA, 22 nt, Human
uuccuaauugccaugaaguuau

SEQ ID NO: 109157 - RNA, 22 nt, Human
uuccuaauguccaccuaguccu

SEQ ID NO: 109158 - RNA, 20 nt, Human
uuccuuaucuguaaagugga

SEQ ID NO: 109159 - RNA, 22 nt, Human
ugggauucugaaaauggauuac

SEQ ID NO: 109160 - RNA, 20 nt, Human
uuccuuucuuucuuuuuuuu

SEQ ID NO: 109161 - RNA, 22 nt, Human
uggggcgcaggcccagcgggcu

SEQ ID NO: 109162 - RNA, 22 nt, Human
uucgucaauaugcagccuguga

SEQ ID NO: 109163 - RNA, 22 nt, Human
ugcucuguucaguguaucuugu

SEQ ID NO: 109164 - RNA, 17 nt, Human
uguuguguggauuuucc

SEQ ID NO: 109165 - RNA, 22 nt, Human
uguuguuguuguuguuguuguu

SEQ ID NO: 109166 - RNA, 19 nt, Human
uguugugggccacuaacua

SEQ ID NO: 109167 - RNA, 22 nt, Human
ugccuggugcggagugaguggc

SEQ ID NO: 109168 - RNA, 22 nt, Human
ugccugucuaucuuugucaucu

SEQ ID NO: 109169 - RNA, 22 nt, Human
uguguguguauacauguauaua

SEQ ID NO: 109170 - RNA, 22 nt, Human
uguguguguguguguaauauau

SEQ ID NO: 109171 - RNA, 18 nt, Human
uguugguguucacucacu

SEQ ID NO: 109172 - RNA, 22 nt, Human
uguuggauuuugugaaauauga

SEQ ID NO: 109173 - RNA, 22 nt, Human
ugcucuuuguagcugcuuugcu

SEQ ID NO: 109174 - RNA, 22 nt, Human
ugcugacuauacauuuagcauu

SEQ ID NO: 109175 - RNA, 22 nt, Human
uguuuaucaguagacucaaguu

SEQ ID NO: 109176 - RNA, 22 nt, Human
uguuuaguuuugcaccaauaaa

SEQ ID NO: 109177 - RNA, 22 nt, Human
uguuugaugugcacgugugugu

SEQ ID NO: 109178 - RNA, 22 nt, Human
uguuugaggugacucuggaaug

SEQ ID NO: 109179 - RNA, 22 nt, Human
uguuuucuauuaccugagauug

SEQ ID NO: 109180 - RNA, 22 nt, Human
uguuuguuuuguauuuuuaauu

SEQ ID NO: 109181 - RNA, 21 nt, Human
uguuuuguaauagauacuaug

SEQ ID NO: 109182 - RNA, 22 nt, Human
uguuuuuagcuguuuuuuggau

SEQ ID NO: 109183 - RNA, 22 nt, Human
uguuuuuauucuuaauguuuca

SEQ ID NO: 109184 - RNA, 22 nt, Human
uguuuuucaagcauuuauuaau

SEQ ID NO: 109185 - RNA, 23 nt, Human
ugcugcuggaguaucuacaaugc

SEQ ID NO: 109186 - RNA, 22 nt, Human
uuaaaucaggcaucauuucagu

SEQ ID NO: 109187 - RNA, 22 nt, Human
ugcuggaaggguaguauuaacu

SEQ ID NO: 109188 - RNA, 22 nt, Human
uuaacgaauugugcauaauucc

SEQ ID NO: 109189 - RNA, 23 nt, Human
uuaagacuggcugaacuuaguag

SEQ ID NO: 109190 - RNA, 22 nt, Human
ugcuggugauuaaauccugaag

SEQ ID NO: 109191 - RNA, 23 nt, Human
uuaaggugccguguaauucaugc

SEQ ID NO: 109192 - RNA, 22 nt, Human
ugcuugaggcuugucaucuaac

SEQ ID NO: 109193 - RNA, 22 nt, Human
ugcuugacucagcaucggcaau

SEQ ID NO: 109194 - RNA, 21 nt, Human
uuaauugagggauggggguga

SEQ ID NO: 109195 - RNA, 22 nt, Human
uuaauguugacacacuagcaca

SEQ ID NO: 109196 - RNA, 22 nt, Human
uuaauucuugagcugucuuucc

SEQ ID NO: 109197 - RNA, 22 nt, Human
ugcuucuuugggggugaagaga

SEQ ID NO: 109198 - RNA, 22 nt, Human
uuaauguuuuagaaugagagug

SEQ ID NO: 109199 - RNA, 22 nt, Human
ugcuuaucuccuuaguuuuugc

SEQ ID NO: 109200 - RNA, 22 nt, Human
uuaaugcagguacuguuacaau

SEQ ID NO: 109201 - RNA, 22 nt, Human
uuaaucuauuucauauaaggga

SEQ ID NO: 109202 - RNA, 20 nt, Human
ugcuguggguaagcuuuaua

SEQ ID NO: 109203 - RNA, 22 nt, Human
uuaaguauauccauuugacugg

SEQ ID NO: 109204 - RNA, 22 nt, Human
uuaagguggcauacaacacagc

SEQ ID NO: 109205 - RNA, 22 nt, Human
uuaauauuuauugguaaucacu

SEQ ID NO: 109206 - RNA, 22 nt, Human
uuaauacugugucuuuuuuaau

SEQ ID NO: 109207 - RNA, 22 nt, Human
uuaggcuuuauugaaaacaaua

SEQ ID NO: 109208 - RNA, 22 nt, Human
uuaggcuaauagagauggaaug

SEQ ID NO: 109209 - RNA, 22 nt, Human
uuaggcugcuuuggaaaacugu

SEQ ID NO: 109210 - RNA, 22 nt, Human
uggaagaucugguguagcuccu

SEQ ID NO: 109211 - RNA, 22 nt, Human
uuagucauucccucuugauauu

SEQ ID NO: 109212 - RNA, 19 nt, Human
uggaagugauaguauagua

SEQ ID NO: 109213 - RNA, 21 nt, Human
uggaagggaagucuugguugu

SEQ ID NO: 109214 - RNA, 22 nt, Human
uggaaggaaauguguaucauaa

SEQ ID NO: 109215 - RNA, 20 nt, Human
uggaaggaaagguguaucuu

SEQ ID NO: 109216 - RNA, 22 nt, Human
uuaguggguuccauuucuaugg

SEQ ID NO: 109217 - RNA, 22 nt, Human
uuauaaaccgcuaacagcacuu

SEQ ID NO: 109218 - RNA, 22 nt, Human
uuaguuauaggugaaucagaga

SEQ ID NO: 109219 - RNA, 22 nt, Human
uggaagugucagcaggcugguu

SEQ ID NO: 109220 - RNA, 22 nt, Human
uggaauuaucugaagugauuug

SEQ ID NO: 109221 - RNA, 21 nt, Human
uggaauuggaaaccauucuau

SEQ ID NO: 109222 - RNA, 22 nt, Human
uuauaagugccucuuuauuuuc

SEQ ID NO: 109223 - RNA, 22 nt, Human
uuauaucagaaggugagauuga

SEQ ID NO: 109224 - RNA, 22 nt, Human
uuauaguggcuuggggaaaaaa

SEQ ID NO: 109225 - RNA, 22 nt, Human
uuauaguuuucaaggauuggag

SEQ ID NO: 109226 - RNA, 18 nt, Human
uuauacaauuuuuuuuca

SEQ ID NO: 109227 - RNA, 22 nt, Human
uuaucuguuuuaaugaauaauu

SEQ ID NO: 109228 - RNA, 19 nt, Human
uuauccggacuuaauuuau

SEQ ID NO: 109229 - RNA, 22 nt, Human
uggagcaagaagggaggcagaa

SEQ ID NO: 109230 - RNA, 22 nt, Human
uggagauauucuauauuuuaua

SEQ ID NO: 109231 - RNA, 22 nt, Human
uuauauuuuauuuaauuaaaua

SEQ ID NO: 109232 - RNA, 22 nt, Human
uuaucaaaaaauaguacuuuga

SEQ ID NO: 109233 - RNA, 22 nt, Human
uggaaaguuggaagucucagga

SEQ ID NO: 109234 - RNA, 22 nt, Human
uggaaaggcccauaaaaggaua

SEQ ID NO: 109235 - RNA, 22 nt, Human
uuagaauggaaucauuugcauu

SEQ ID NO: 109236 - RNA, 22 nt, Human
uuagacaucaagaagccaaugu

SEQ ID NO: 109237 - RNA, 22 nt, Human
uuacuuacagggggucaggcug

SEQ ID NO: 109238 - RNA, 22 nt, Human
uuagaaaaaggcuguggucuua

SEQ ID NO: 109239 - RNA, 22 nt, Human
uuacuuucugggauaucaaaug

SEQ ID NO: 109240 - RNA, 22 nt, Human
uuagaaauguccuacuaauaug

SEQ ID NO: 109241 - RNA, 22 nt, Human
uggaaagaagacugugguugag

SEQ ID NO: 109242 - RNA, 22 nt, Human
uuagagauuuuauguuaaugua

SEQ ID NO: 109243 - RNA, 22 nt, Human
uuagaguacaggauuguuuuaa

SEQ ID NO: 109244 - RNA, 22 nt, Human
uggaaaugcuuagaggugaucu

SEQ ID NO: 109245 - RNA, 22 nt, Human
uggaagaaaacuuggaaggcau

SEQ ID NO: 109246 - RNA, 22 nt, Human
uuagaguucaagcuuuaggaaa

SEQ ID NO: 109247 - RNA, 22 nt, Human
uuagauaguaaauagcacuaag

SEQ ID NO: 109248 - RNA, 22 nt, Human
uuagauaaaucagcccugagua

SEQ ID NO: 109249 - RNA, 22 nt, Human
uuagaugcugugauuuuucaaa

SEQ ID NO: 109250 - RNA, 22 nt, Human
uuagcagacagauggagagaga

SEQ ID NO: 109251 - RNA, 22 nt, Human
uuaacccagccauuuucaauuu

SEQ ID NO: 109252 - RNA, 22 nt, Human
uuagcacugucugguuaucuug

SEQ ID NO: 109253 - RNA, 22 nt, Human
uuacaagaucuuugaaggcaag

SEQ ID NO: 109254 - RNA, 22 nt, Human
uuacaucacuuuacuuaauaau

SEQ ID NO: 109255 - RNA, 22 nt, Human
ugcuuguuuguuuucuuccauu

SEQ ID NO: 109256 - RNA, 22 nt, Human
uuaccauaguacuaucaguuua

SEQ ID NO: 109257 - RNA, 22 nt, Human
uuacccuugaauuugugacaaa

SEQ ID NO: 109258 - RNA, 22 nt, Human
ugcuuucagauaucuguuucaa

SEQ ID NO: 109259 - RNA, 22 nt, Human
ugcuuuauucgacaucugguag

SEQ ID NO: 109260 - RNA, 22 nt, Human
ugcuuuuggcagcaguguuuau

SEQ ID NO: 109261 - RNA, 22 nt, Human
ugcuuuggcccaacauugaugc

SEQ ID NO: 109262 - RNA, 22 nt, Human
ugcuuuuguaucagaguauuca

SEQ ID NO: 109263 - RNA, 20 nt, Human
uuacugagguauuuuuauca

SEQ ID NO: 109264 - RNA, 22 nt, Human
ucuuuugaacauccaggauguc

SEQ ID NO: 109265 - RNA, 22 nt, Human
ugaaaaauauuuuuagaaauaa

SEQ ID NO: 109266 - RNA, 22 nt, Human
ugaccuuaguuuuuucaaugag

SEQ ID NO: 109267 - RNA, 22 nt, Human
uggguauauauguugcuacaga

SEQ ID NO: 109268 - RNA, 22 nt, Human
ugggugugcaccuacgaucucu

SEQ ID NO: 109269 - RNA, 22 nt, Human
ugggugaugagguccccagccc

SEQ ID NO: 109270 - RNA, 22 nt, Human
uggguuaaaaguugaaugaauu

SEQ ID NO: 109271 - RNA, 22 nt, Human
uggguguuccuggggugcaagg

SEQ ID NO: 109272 - RNA, 22 nt, Human
ugagaaaacaguuuguaauaau

SEQ ID NO: 109273 - RNA, 22 nt, Human
ugagaaauauacaccagacaca

SEQ ID NO: 109274 - RNA, 22 nt, Human
ugagaacacuuuucucuuugcu

SEQ ID NO: 109275 - RNA, 22 nt, Human
uggguucugaucccaggacugc

SEQ ID NO: 109276 - RNA, 22 nt, Human
ugguaaaguguacugaauauga

SEQ ID NO: 109277 - RNA, 22 nt, Human
ugagaagucagucuauugugaa

SEQ ID NO: 109278 - RNA, 22 nt, Human
ugguaaaugucuaacaaucacu

SEQ ID NO: 109279 - RNA, 22 nt, Human
ugguacaaaaaagauuuuggac

SEQ ID NO: 109280 - RNA, 22 nt, Human
ugguauaaaaaaaugaguauaa

SEQ ID NO: 109281 - RNA, 22 nt, Human
ugagagaauuacuaaagggcuu

SEQ ID NO: 109282 - RNA, 22 nt, Human
uggucacacugcauaacacgca

SEQ ID NO: 109283 - RNA, 22 nt, Human
uggucacgucgggguauugcca

SEQ ID NO: 109284 - RNA, 22 nt, Human
uggucacagauuuacaggaaug

SEQ ID NO: 109285 - RNA, 22 nt, Human
uggucaaauccuagauccuuug

SEQ ID NO: 109286 - RNA, 22 nt, Human
ugguuagucaugguacugcagc

SEQ ID NO: 109287 - RNA, 20 nt, Human
ugguuaaagugggugagcgg

SEQ ID NO: 109288 - RNA, 22 nt, Human
ugguuacagaugaagaucggcc

SEQ ID NO: 109289 - RNA, 22 nt, Human
ugguucuagaugagaugaugag

SEQ ID NO: 109290 - RNA, 19 nt, Human
ugagauuguaugaggagau

SEQ ID NO: 109291 - RNA, 22 nt, Human
ugagcagccagucauucaaaaa

SEQ ID NO: 109292 - RNA, 22 nt, Human
uggugcuuuuguggaugcuaac

SEQ ID NO: 109293 - RNA, 22 nt, Human
ugguuuguauauguuugugaga

SEQ ID NO: 109294 - RNA, 22 nt, Human
ugguuuccugauggacacuugg

SEQ ID NO: 109295 - RNA, 22 nt, Human
ugauaccugagucuuccccguu

SEQ ID NO: 109296 - RNA, 22 nt, Human
ugguuuucuuaauuagcaguca

SEQ ID NO: 109297 - RNA, 23 nt, Human
ugguuuucagaagaccuuguuag

SEQ ID NO: 109298 - RNA, 22 nt, Human
uguagaaguuaauugaugagua

SEQ ID NO: 109299 - RNA, 22 nt, Human
ugaugaaguuggaaggaaaguu

SEQ ID NO: 109300 - RNA, 22 nt, Human
uguaauguuagaaacaauugcu

SEQ ID NO: 109301 - RNA, 22 nt, Human
ugaucaacagggcuggaaagag

SEQ ID NO: 109302 - RNA, 22 nt, Human
ugauauaaaagauucuuauuga

SEQ ID NO: 109303 - RNA, 20 nt, Human
ugauaggcauugacauaagg

SEQ ID NO: 109304 - RNA, 20 nt, Human
ugauaugcgguacagagagg

SEQ ID NO: 109305 - RNA, 22 nt, Human
ugauuugauuuguuuaugccug

SEQ ID NO: 109306 - RNA, 22 nt, Human
ugauuuggcaucaguguauccu

SEQ ID NO: 109307 - RNA, 22 nt, Human
ugauuugguauccaggauuuaa

SEQ ID NO: 109308 - RNA, 22 nt, Human
ugauuuguuuaaauugcucguu

SEQ ID NO: 109309 - RNA, 22 nt, Human
ugauuuagguauuuucuuuugu

SEQ ID NO: 109310 - RNA, 22 nt, Human
ugauugguauguauguuuguca

SEQ ID NO: 109311 - RNA, 22 nt, Human
ugauugggacauuuuguuuucu

SEQ ID NO: 109312 - RNA, 22 nt, Human
ugaugaugccaaaauuuggcau

SEQ ID NO: 109313 - RNA, 22 nt, Human
ugaugccauaguaaaauuugcu

SEQ ID NO: 109314 - RNA, 21 nt, Human
ugucagaaagccugugacuuu

SEQ ID NO: 109315 - RNA, 22 nt, Human
ugcaaauuuuuuuauuuuuccu

SEQ ID NO: 109316 - RNA, 22 nt, Human
ugucagccacggugugaccggc

SEQ ID NO: 109317 - RNA, 21 nt, Human
uguccucggaucaguccacaa

SEQ ID NO: 109318 - RNA, 22 nt, Human
ugcaaugagcuucuuugauaaa

SEQ ID NO: 109319 - RNA, 22 nt, Human
ugcaagugccauggauucaggu

SEQ ID NO: 109320 - RNA, 22 nt, Human
ugucucuagggcagauagagug

SEQ ID NO: 109321 - RNA, 21 nt, Human
ugcaaugcauugacagcagca

SEQ ID NO: 109322 - RNA, 23 nt, Human
ugcaaugcagcuagauguaaaau

SEQ ID NO: 109323 - RNA, 22 nt, Human
ugcagaacacaguagacagaac

SEQ ID NO: 109324 - RNA, 22 nt, Human
ugcagaauauucuggugacaau

SEQ ID NO: 109325 - RNA, 22 nt, Human
ugcagaggagcuggaaggcugg

SEQ ID NO: 109326 - RNA, 22 nt, Human
ugcagacuguuucuugacugaa

SEQ ID NO: 109327 - RNA, 22 nt, Human
ugucuuucuuucucuugacaga

SEQ ID NO: 109328 - RNA, 22 nt, Human
ugugaagugaugggugaccgag

SEQ ID NO: 109329 - RNA, 23 nt, Human
ugugaauggccuucuuuagaggu

SEQ ID NO: 109330 - RNA, 22 nt, Human
ugucuuuuaaaaauguguaaaa

SEQ ID NO: 109331 - RNA, 22 nt, Human
ugugaagaauuaaugugaauca

SEQ ID NO: 109332 - RNA, 22 nt, Human
ugugagcugccacuucuaaucu

SEQ ID NO: 109333 - RNA, 22 nt, Human
ugucuuguaaacaagaggggcu

SEQ ID NO: 109334 - RNA, 22 nt, Human
ugugauaaaggcccgcagaucc

SEQ ID NO: 109335 - RNA, 22 nt, Human
ugcagcaucuccuugugccaug

SEQ ID NO: 109336 - RNA, 22 nt, Human
ugcagcagaauauggcugcagg

SEQ ID NO: 109337 - RNA, 19 nt, Human
ugcagcacuaaaaacuuuc

SEQ ID NO: 109338 - RNA, 22 nt, Human
ugcauguuuuaagugaagcuga

SEQ ID NO: 109339 - RNA, 22 nt, Human
ugcauguuucuguauguuaaug

SEQ ID NO: 109340 - RNA, 22 nt, Human
ugcauguuauuguggcaagaau

SEQ ID NO: 109341 - RNA, 22 nt, Human
ugugucgccaacaauugugucu

SEQ ID NO: 109342 - RNA, 22 nt, Human
uguggugcagcgggaacagcuu

SEQ ID NO: 109343 - RNA, 19 nt, Human
ugccccuucuucauccauc

SEQ ID NO: 109344 - RNA, 22 nt, Human
ugccgcaggaggggcgauuucu

SEQ ID NO: 109345 - RNA, 22 nt, Human
ugcccuuucuccagugaccauu

SEQ ID NO: 109346 - RNA, 22 nt, Human
ugcagugaugcuucuggcucag

SEQ ID NO: 109347 - RNA, 22 nt, Human
uguggauauauuuuaaaaggaa

SEQ ID NO: 109348 - RNA, 22 nt, Human
ugugcuugucuguuuugauugu

SEQ ID NO: 109349 - RNA, 17 nt, Human
ugcaugcgucugugaua

SEQ ID NO: 109350 - RNA, 22 nt, Human
ugcaugaucucacuuacaggug

SEQ ID NO: 109351 - RNA, 22 nt, Human
ugcaucccaaacaugguuuccu

SEQ ID NO: 109352 - RNA, 18 nt, Human
ugcagcuuugugauuggc

SEQ ID NO: 109353 - RNA, 22 nt, Human
ugugcagaaaacacuuaagaac

SEQ ID NO: 109354 - RNA, 22 nt, Human
ugcaggaacucgaaaacuauag

SEQ ID NO: 109355 - RNA, 22 nt, Human
ugugcuauuuuugcauaugugu

SEQ ID NO: 109356 - RNA, 22 nt, Human
ugugaugagaugaacuguagac

SEQ ID NO: 109357 - RNA, 22 nt, Human
ugugauaauauuauuagagcuc

SEQ ID NO: 109358 - RNA, 22 nt, Human
ugugauugcauugcagauuacu

SEQ ID NO: 109359 - RNA, 20 nt, Human
ugcagcucccccgcaguuuc

SEQ ID NO: 109360 - RNA, 23 nt, Human
uggaagaaaaugguuuggcugug

SEQ ID NO: 109361 - RNA, 22 nt, Human
ucugcuuaguuuucuugaacag

SEQ ID NO: 109362 - RNA, 22 nt, Human
uggaagaaaugguugagccaug

SEQ ID NO: 109363 - RNA, 22 nt, Human
uggaagugggcaucaccaucca

SEQ ID NO: 109364 - RNA, 22 nt, Human
ucugguuccugcauucauucaa

SEQ ID NO: 109365 - RNA, 22 nt, Human
ucugugcuccuuccuugucauc

SEQ ID NO: 109366 - RNA, 19 nt, Human
ucuguggccuucccugaug

SEQ ID NO: 109367 - RNA, 19 nt, Human
ucuguggagcucagaguag

SEQ ID NO: 109368 - RNA, 22 nt, Human
ucuguaauccacacagguggau

SEQ ID NO: 109369 - RNA, 22 nt, Human
uggagaaauaacauuuggauuc

SEQ ID NO: 109370 - RNA, 22 nt, Human
ucuguauuuuuuacacacaugc

SEQ ID NO: 109371 - RNA, 22 nt, Human
ucuguuauaaaucacacugcau

SEQ ID NO: 109372 - RNA, 22 nt, Human
ucuguguguguggcuaaacaag

SEQ ID NO: 109373 - RNA, 22 nt, Human
ucuguguuccuggcaccaaacu

SEQ ID NO: 109374 - RNA, 21 nt, Human
uggauauugaguaguuucuga

SEQ ID NO: 109375 - RNA, 22 nt, Human
ucuguuuuccaggaaucucaua

SEQ ID NO: 109376 - RNA, 22 nt, Human
uggcaucacagacaaggcagca

SEQ ID NO: 109377 - RNA, 22 nt, Human
ucuucuuauuuuaugaucgcuu

SEQ ID NO: 109378 - RNA, 21 nt, Human
uggcauacugcuaaaaagugu

SEQ ID NO: 109379 - RNA, 22 nt, Human
uggcauuuuguagcuguguauc

SEQ ID NO: 109380 - RNA, 22 nt, Human
uggccaaucagcugugaccugc

SEQ ID NO: 109381 - RNA, 22 nt, Human
ucuuuaaggggccuuuguguca

SEQ ID NO: 109382 - RNA, 22 nt, Human
ucuuuaagugugugccuccagg

SEQ ID NO: 109383 - RNA, 22 nt, Human
ucuuuaucugugagcagucucc

SEQ ID NO: 109384 - RNA, 22 nt, Human
uggcgugaagcuggaaggcgga

SEQ ID NO: 109385 - RNA, 22 nt, Human
ucuucauuucuggggaauuggc

SEQ ID NO: 109386 - RNA, 22 nt, Human
ucuuccaaacaaaaaucugugu

SEQ ID NO: 109387 - RNA, 22 nt, Human
ucuucaucucuaaaaugggaac

SEQ ID NO: 109388 - RNA, 22 nt, Human
ucuucaugaaauugauugcuua

SEQ ID NO: 109389 - RNA, 22 nt, Human
uggcagugggaagcuggaaguc

SEQ ID NO: 109390 - RNA, 22 nt, Human
ucuucuguguguagugguugug

SEQ ID NO: 109391 - RNA, 22 nt, Human
ucuuccuuguaagggcuuuaga

SEQ ID NO: 109392 - RNA, 20 nt, Human
uggaugacuucaggcagccu

SEQ ID NO: 109393 - RNA, 22 nt, Human
uggauuuuggaauguuucagua

SEQ ID NO: 109394 - RNA, 22 nt, Human
uggcaacucaauuucuacaaga

SEQ ID NO: 109395 - RNA, 22 nt, Human
uggcaaacacaauauggguaca

SEQ ID NO: 109396 - RNA, 22 nt, Human
uggcaaaaccugcaauuacuuu

SEQ ID NO: 109397 - RNA, 23 nt, Human
uggcaaacgggaauaaaggaauu

SEQ ID NO: 109398 - RNA, 20 nt, Human
ucuucagcuccaagucuggc

SEQ ID NO: 109399 - RNA, 22 nt, Human
ucuucacugaagcuuugcaucu

SEQ ID NO: 109400 - RNA, 22 nt, Human
ucuuauuucuuucuuuuccugu

SEQ ID NO: 109401 - RNA, 22 nt, Human
ugcuucuuuaggauguaguuau

SEQ ID NO: 109402 - RNA, 22 nt, Human
ucuccuuugaaaguuaggacug

SEQ ID NO: 109403 - RNA, 20 nt, Human
ucucuaacaugaaugcuauc

SEQ ID NO: 109404 - RNA, 22 nt, Human
ugcuugaacccaggaaguggag

SEQ ID NO: 109405 - RNA, 22 nt, Human
ugcuugcuaucuaaguguuuca

SEQ ID NO: 109406 - RNA, 22 nt, Human
ugcuuggagaaucagucccagc

SEQ ID NO: 109407 - RNA, 22 nt, Human
ugcuuguuuuguggcuucagcu

SEQ ID NO: 109408 - RNA, 22 nt, Human
ugcuugugcacacacauguuau

SEQ ID NO: 109409 - RNA, 22 nt, Human
ugcuuggauuuccaaaugguuu

SEQ ID NO: 109410 - RNA, 22 nt, Human
ugcuuuaccuuccauuuaagga

SEQ ID NO: 109411 - RNA, 22 nt, Human
ugcuuucaaaacucagaggaau

SEQ ID NO: 109412 - RNA, 22 nt, Human
ugcuuucaaugaauuguauacu

SEQ ID NO: 109413 - RNA, 22 nt, Human
ucugaagagaacucuuaguguu

SEQ ID NO: 109414 - RNA, 22 nt, Human
ucugaaauuuuaguuauagaaa

SEQ ID NO: 109415 - RNA, 18 nt, Human
ucugaaggaaugauucca

SEQ ID NO: 109416 - RNA, 22 nt, Human
ucugaauauguuuaucaucucu

SEQ ID NO: 109417 - RNA, 21 nt, Human
ugcuuucugugcuuuuucugc

SEQ ID NO: 109418 - RNA, 22 nt, Human
ucucuuuuuuuaaaacucuaug

SEQ ID NO: 109419 - RNA, 22 nt, Human
ucugacugucccguagaggaac

SEQ ID NO: 109420 - RNA, 22 nt, Human
ucugaguagaaucauucauaaa

SEQ ID NO: 109421 - RNA, 22 nt, Human
ucugagugacguccugacagga

SEQ ID NO: 109422 - RNA, 22 nt, Human
ucugaccaggcucuuguagccu

SEQ ID NO: 109423 - RNA, 21 nt, Human
ugcuuuuguugucagcugcug

SEQ ID NO: 109424 - RNA, 22 nt, Human
uggaaaauuuagaaagauuuau

SEQ ID NO: 109425 - RNA, 22 nt, Human
uggaaaacgcaguuuaauuuuu

SEQ ID NO: 109426 - RNA, 22 nt, Human
uggaaaagaugucuuccugaau

SEQ ID NO: 109427 - RNA, 20 nt, Human
ugcugggccaucuugcaugc

SEQ ID NO: 109428 - RNA, 22 nt, Human
ugcuggagccauguuuucucua

SEQ ID NO: 109429 - RNA, 20 nt, Human
ugcugugugucuacuguggg

SEQ ID NO: 109430 - RNA, 22 nt, Human
ugcuuaaagcauuucucuuuaa

SEQ ID NO: 109431 - RNA, 22 nt, Human
ugcugugagaccauuuguugag

SEQ ID NO: 109432 - RNA, 22 nt, Human
ugcuguugacuuuguuguucuu

SEQ ID NO: 109433 - RNA, 22 nt, Human
ugcugcuguuuccuacaucuca

SEQ ID NO: 109434 - RNA, 22 nt, Human
ucucagaagaaacaucugcugg

SEQ ID NO: 109435 - RNA, 21 nt, Human
ucucaagguaacauuuaagau

SEQ ID NO: 109436 - RNA, 22 nt, Human
ucuauuguuauccuuuccauuu

SEQ ID NO: 109437 - RNA, 22 nt, Human
ugcggaaggcagcgcagggugg

SEQ ID NO: 109438 - RNA, 22 nt, Human
ucgcuauuauuuuagguucuca

SEQ ID NO: 109439 - RNA, 20 nt, Human
ucgcugcaagggaaauggag

SEQ ID NO: 109440 - RNA, 22 nt, Human
ucuaugaagucuuccuuuccuc

SEQ ID NO: 109441 - RNA, 22 nt, Human
ucuagagaauuuggaaauuaag

SEQ ID NO: 109442 - RNA, 22 nt, Human
uccuggcuguuagagaggcaag

SEQ ID NO: 109443 - RNA, 22 nt, Human
uccuggaagggaugguugagga

SEQ ID NO: 109444 - RNA, 22 nt, Human
uccuugaauugcguccacaaga

SEQ ID NO: 109445 - RNA, 22 nt, Human
ugccuaguuuaaaucauuuucu

SEQ ID NO: 109446 - RNA, 22 nt, Human
uccuuucaaauuuauuugacau

SEQ ID NO: 109447 - RNA, 22 nt, Human
uccuuuauuuaugggcagugua

SEQ ID NO: 109448 - RNA, 22 nt, Human
uccuuguuggaauauccuuacc

SEQ ID NO: 109449 - RNA, 22 nt, Human
ugccuuuggcuguucugugacc

SEQ ID NO: 109450 - RNA, 22 nt, Human
ugccaacaggcuugccugaugu

SEQ ID NO: 109451 - RNA, 22 nt, Human
uccuccauguugugcacuugaa

SEQ ID NO: 109452 - RNA, 22 nt, Human
ugccaguaauuguccuguagcu

SEQ ID NO: 109453 - RNA, 22 nt, Human
ugcaucauuaagguacaguugg

SEQ ID NO: 109454 - RNA, 22 nt, Human
ugcaucuaaguggcuaacaacc

SEQ ID NO: 109455 - RNA, 22 nt, Human
ugcauuuucuaccacacccacu

SEQ ID NO: 109456 - RNA, 22 nt, Human
ugcauuuugaaggaaaaaaaug

SEQ ID NO: 109457 - RNA, 22 nt, Human
ugcaggagcccaggaauacuau

SEQ ID NO: 109458 - RNA, 22 nt, Human
ugcaggguuucaauacacagga

SEQ ID NO: 109459 - RNA, 18 nt, Human
uccggaggucagaguaaa

SEQ ID NO: 109460 - RNA, 22 nt, Human
ugcagguuuucagauguguguu

SEQ ID NO: 109461 - RNA, 22 nt, Human
ugcauaaauauuguugggagua

SEQ ID NO: 109462 - RNA, 22 nt, Human
ugcacacaguucucaggaaaga

SEQ ID NO: 109463 - RNA, 22 nt, Human
ugcaauggauaucugaacgugg

SEQ ID NO: 109464 - RNA, 22 nt, Human
uccccucucugcgcucccaggu

SEQ ID NO: 109465 - RNA, 22 nt, Human
ucccucacacagcugggagaac

SEQ ID NO: 109466 - RNA, 22 nt, Human
ugauuguauuuauccucuguuc

SEQ ID NO: 109467 - RNA, 22 nt, Human
ugauuucauaugacagcuuuuu

SEQ ID NO: 109468 - RNA, 22 nt, Human
ugauuugaaaccuuuggcaaga

SEQ ID NO: 109469 - RNA, 22 nt, Human
ucagucauguuuaccagacgua

SEQ ID NO: 109470 - RNA, 22 nt, Human
ucagguuuuuaaggagcuagga

SEQ ID NO: 109471 - RNA, 22 nt, Human
ucagucacugugaaaugaauuu

SEQ ID NO: 109472 - RNA, 22 nt, Human
ucuucaggaaaaccaaaguugu

SEQ ID NO: 109473 - RNA, 22 nt, Human
ugagaauuuaacuugauuagga

SEQ ID NO: 109474 - RNA, 22 nt, Human
ucagguagugguuaaguucugu

SEQ ID NO: 109475 - RNA, 22 nt, Human
ucagguuuaagcuacuggaauc

SEQ ID NO: 109476 - RNA, 22 nt, Human
ugagcuauuucaccauauagau

SEQ ID NO: 109477 - RNA, 20 nt, Human
ucaguggcauaguugcuaag

SEQ ID NO: 109478 - RNA, 22 nt, Human
ugagauuuagaacuggauuuca

SEQ ID NO: 109479 - RNA, 22 nt, Human
ugagcaaacacagauaggcuua

SEQ ID NO: 109480 - RNA, 22 nt, Human
ugagauucuguucagaaaaaug

SEQ ID NO: 109481 - RNA, 22 nt, Human
ucagucuucaggacuaugaaaa

SEQ ID NO: 109482 - RNA, 22 nt, Human
ucaguuuaauuggaucuuuuuc

SEQ ID NO: 109483 - RNA, 22 nt, Human
ucaguugauggcaguuaauguc

SEQ ID NO: 109484 - RNA, 22 nt, Human
ucaguguccuucguucuuguug

SEQ ID NO: 109485 - RNA, 22 nt, Human
ugagccauguucaugagguuca

SEQ ID NO: 109486 - RNA, 20 nt, Human
ucagugggaaagugagagug

SEQ ID NO: 109487 - RNA, 22 nt, Human
ugaggaacaugggagaaauguc

SEQ ID NO: 109488 - RNA, 22 nt, Human
ugaggaugagaaggaagagaag

SEQ ID NO: 109489 - RNA, 22 nt, Human
ugaggaugaggaagaagaagaa

SEQ ID NO: 109490 - RNA, 21 nt, Human
ucauaauaauuacaugggggg

SEQ ID NO: 109491 - RNA, 22 nt, Human
ucauaagucucauauaugucca

SEQ ID NO: 109492 - RNA, 22 nt, Human
ucauaaguuguugacuagcaaa

SEQ ID NO: 109493 - RNA, 22 nt, Human
ucauaaaggugccacucaguuu

SEQ ID NO: 109494 - RNA, 22 nt, Human
ucaucauccuuuuuugaagagu

SEQ ID NO: 109495 - RNA, 22 nt, Human
ucauccgcaaccacuuuagccu

SEQ ID NO: 109496 - RNA, 22 nt, Human
ucaugcagauaagaauaaguaa

SEQ ID NO: 109497 - RNA, 22 nt, Human
ucaucuuucuuuauggaaauac

SEQ ID NO: 109498 - RNA, 20 nt, Human
ucaucuuucaaauuugugac

SEQ ID NO: 109499 - RNA, 22 nt, Human
ucaucuauaaguagcaucuggg

SEQ ID NO: 109500 - RNA, 22 nt, Human
ugauggaucuguuggcggguuu

SEQ ID NO: 109501 - RNA, 22 nt, Human
ugauguaaaauaggaaguucua

SEQ ID NO: 109502 - RNA, 22 nt, Human
ucauuuuaucaggaauggaauc

SEQ ID NO: 109503 - RNA, 22 nt, Human
ugaugaugaagaaauauuauca

SEQ ID NO: 109504 - RNA, 22 nt, Human
ugaucauugaacaucgaguuaa

SEQ ID NO: 109505 - RNA, 22 nt, Human
ugaucauguucuccaaaagcgu

SEQ ID NO: 109506 - RNA, 22 nt, Human
ugauaugguaauaagauauucu

SEQ ID NO: 109507 - RNA, 22 nt, Human
ugauuagauacuucagaugaca

SEQ ID NO: 109508 - RNA, 22 nt, Human
uccaaggcuggaucuuuucuuu

SEQ ID NO: 109509 - RNA, 20 nt, Human
ugauuauuccaacaagaaug

SEQ ID NO: 109510 - RNA, 22 nt, Human
ugauucacagacuucacaaggc

SEQ ID NO: 109511 - RNA, 22 nt, Human
ugauguuucugaagggguuacu

SEQ ID NO: 109512 - RNA, 22 nt, Human
ugaugugugaauucuuaaaugu

SEQ ID NO: 109513 - RNA, 22 nt, Human
ugauugaauaauguuaugugaa

SEQ ID NO: 109514 - RNA, 22 nt, Human
ugauugcucgacacucugcuug

SEQ ID NO: 109515 - RNA, 22 nt, Human
ucucaaagguuuuccucuuuuu

SEQ ID NO: 109516 - RNA, 22 nt, Human
ucucacucuuccccaugucaga

SEQ ID NO: 109517 - RNA, 22 nt, Human
ucuauauucuauguucuucuuu

SEQ ID NO: 109518 - RNA, 22 nt, Human
uaguuggguagacaguucuaca

SEQ ID NO: 109519 - RNA, 22 nt, Human
uaguucugaauagcauugaaga

SEQ ID NO: 109520 - RNA, 22 nt, Human
uaguugaauuuaucaguagcau

SEQ ID NO: 109521 - RNA, 22 nt, Human
ucuauuauauuuacacgagagu

SEQ ID NO: 109522 - RNA, 22 nt, Human
uaggauaacaauuuguaguuuc

SEQ ID NO: 109523 - RNA, 18 nt, Human
uaguggguccaagcacau

SEQ ID NO: 109524 - RNA, 22 nt, Human
uaguuauuucugcacuuaauga

SEQ ID NO: 109525 - RNA, 22 nt, Human
uaguguuauuucuuaugugcua

SEQ ID NO: 109526 - RNA, 20 nt, Human
uagcuucaccuagagauagc

SEQ ID NO: 109527 - RNA, 19 nt, Human
uagcuguucuugaguguga

SEQ ID NO: 109528 - RNA, 22 nt, Human
uaggaaugcagaugcauaauaa

SEQ ID NO: 109529 - RNA, 22 nt, Human
ucgauccaggaaggcugguuua

SEQ ID NO: 109530 - RNA, 22 nt, Human
uauaagaaaagucauuaucaaa

SEQ ID NO: 109531 - RNA, 22 nt, Human
uauaaucuugcccauaguauuu

SEQ ID NO: 109532 - RNA, 22 nt, Human
uauagccuuacaagauauuaua

SEQ ID NO: 109533 - RNA, 22 nt, Human
uauacucaauaaauauuuggag

SEQ ID NO: 109534 - RNA, 22 nt, Human
ucucauugugcuuuuuguacug

SEQ ID NO: 109535 - RNA, 22 nt, Human
ucucccaaaucuuucuagcaca

SEQ ID NO: 109536 - RNA, 20 nt, Human
ucucauuuugauuucgcauu

SEQ ID NO: 109537 - RNA, 22 nt, Human
ucucauaauuguuucccagcua

SEQ ID NO: 109538 - RNA, 22 nt, Human
uaguugguggagcgauuugucu

SEQ ID NO: 109539 - RNA, 22 nt, Human
uaguuuuaagcugacauuguuc

SEQ ID NO: 109540 - RNA, 22 nt, Human
uaguuuucuuuuguguuauucu

SEQ ID NO: 109541 - RNA, 22 nt, Human
uauaugaggauauuuuaaagcu

SEQ ID NO: 109542 - RNA, 22 nt, Human
uauaugcagauuuucaucaucg

SEQ ID NO: 109543 - RNA, 22 nt, Human
uauauuaaagugcuuugcagug

SEQ ID NO: 109544 - RNA, 22 nt, Human
uauauuuguccuagcuccuagc

SEQ ID NO: 109545 - RNA, 22 nt, Human
uaucaguagaacaauggacauu

SEQ ID NO: 109546 - RNA, 22 nt, Human
uaucauuuuacugugacauuuu

SEQ ID NO: 109547 - RNA, 22 nt, Human
uaucacauaaaugaggaauauu

SEQ ID NO: 109548 - RNA, 22 nt, Human
uaucauuaggagugcugcucgg

SEQ ID NO: 109549 - RNA, 22 nt, Human
ucucugaggaagcgaucuuuag

SEQ ID NO: 109550 - RNA, 22 nt, Human
uauaggguggguaaggaaaaaa

SEQ ID NO: 109551 - RNA, 22 nt, Human
uauauaauacacaaauauguac

SEQ ID NO: 109552 - RNA, 22 nt, Human
uauauacuugaaaauugcugag

SEQ ID NO: 109553 - RNA, 22 nt, Human
uauauacacgcacauauacaua

SEQ ID NO: 109554 - RNA, 20 nt, Human
ucucuuuuucuucuuuucuc

SEQ ID NO: 109555 - RNA, 22 nt, Human
ucucuucacuuguaugcuauca

SEQ ID NO: 109556 - RNA, 21 nt, Human
uaucauuuuuuccccugagau

SEQ ID NO: 109557 - RNA, 22 nt, Human
uauccaucuucuuugagaaugg

SEQ ID NO: 109558 - RNA, 22 nt, Human
ucugacuucuuuuauuaucauu

SEQ ID NO: 109559 - RNA, 22 nt, Human
uaucuguagucucaugguuccu

SEQ ID NO: 109560 - RNA, 22 nt, Human
uaucuguauuguagaacuguug

SEQ ID NO: 109561 - RNA, 22 nt, Human
uaucuuugccuuggguuuuguu

SEQ ID NO: 109562 - RNA, 22 nt, Human
ucugagcaggaaagagcagaga

SEQ ID NO: 109563 - RNA, 22 nt, Human
ucugagagcuguagaagccuau

SEQ ID NO: 109564 - RNA, 22 nt, Human
uaucuuagaagaaaugggucca

SEQ ID NO: 109565 - RNA, 22 nt, Human
uauguuaauuaccagcacugau

SEQ ID NO: 109566 - RNA, 17 nt, Human
ucuggguuucugauuua

SEQ ID NO: 109567 - RNA, 22 nt, Human
ucuguaaaugcaaguuuuccuc

SEQ ID NO: 109568 - RNA, 22 nt, Human
ucugguuucccaguuccuccgu

SEQ ID NO: 109569 - RNA, 22 nt, Human
ucugugcuggacugauuucaua

SEQ ID NO: 109570 - RNA, 22 nt, Human
ucugucuaaccauauuuuccua

SEQ ID NO: 109571 - RNA, 19 nt, Human
uauuagccucaucccagcc

SEQ ID NO: 109572 - RNA, 22 nt, Human
uauuacugccacaucauuaggu

SEQ ID NO: 109573 - RNA, 22 nt, Human
uauuaauugugguuauuguauu

SEQ ID NO: 109574 - RNA, 21 nt, Human
ucuuauacagcaauagaucug

SEQ ID NO: 109575 - RNA, 22 nt, Human
ucuguuuuucagaccuuuuugg

SEQ ID NO: 109576 - RNA, 22 nt, Human
ucuuaaucauucuucacuuccu

SEQ ID NO: 109577 - RNA, 22 nt, Human
ucuguuuuuaucuauucuguua

SEQ ID NO: 109578 - RNA, 22 nt, Human
ucuuaaauaugaaaaggauuau

SEQ ID NO: 109579 - RNA, 22 nt, Human
ucuguuuugugcuuuguuuucu

SEQ ID NO: 109580 - RNA, 22 nt, Human
ucuuauugugaugaugaagaac

SEQ ID NO: 109581 - RNA, 22 nt, Human
ucuuauugguaaugauggcauu

SEQ ID NO: 109582 - RNA, 22 nt, Human
ucuuauucuuuuaaacaacgca

SEQ ID NO: 109583 - RNA, 22 nt, Human
ucuucaaauacagucauauuga

SEQ ID NO: 109584 - RNA, 22 nt, Human
ucuucacagaugcauauacuuc

SEQ ID NO: 109585 - RNA, 22 nt, Human
ucuguuuacaugucagcagcaa

SEQ ID NO: 109586 - RNA, 22 nt, Human
ucuguuguauggcugucuaauu

SEQ ID NO: 109587 - RNA, 22 nt, Human
ucuguucacaauuacacacacu

SEQ ID NO: 109588 - RNA, 22 nt, Human
ucuguucagaagaggugaaagu

SEQ ID NO: 109589 - RNA, 22 nt, Human
ucuguucucuuguucugacggu

SEQ ID NO: 109590 - RNA, 21 nt, Human
uauucgcauuucugucuuuac

SEQ ID NO: 109591 - RNA, 22 nt, Human
ucugugugugugcauaugcaug

SEQ ID NO: 109592 - RNA, 22 nt, Human
uauuauggguuuuuguguaaau

SEQ ID NO: 109593 - RNA, 22 nt, Human
uauggcuaguguguuuguaaca

SEQ ID NO: 109594 - RNA, 22 nt, Human
uauggcuucucagucaugaaaa

SEQ ID NO: 109595 - RNA, 22 nt, Human
ucugcuguugaucaugacuagc

SEQ ID NO: 109596 - RNA, 22 nt, Human
ucuggaaauggaaguaacuaug

SEQ ID NO: 109597 - RNA, 22 nt, Human
uaugguuucuccugcagauuug

SEQ ID NO: 109598 - RNA, 22 nt, Human
uauguauauaaaugugugugug

SEQ ID NO: 109599 - RNA, 22 nt, Human
ucuggcaguugccgcuucaguc

SEQ ID NO: 109600 - RNA, 22 nt, Human
uauguauauccagguaagggcu

SEQ ID NO: 109601 - RNA, 22 nt, Human
uauguauaacuugauaggauga

SEQ ID NO: 109602 - RNA, 22 nt, Human
ucuggcuucaguaggguucacu

SEQ ID NO: 109603 - RNA, 20 nt, Human
uaugugcaguuugguuuauc

SEQ ID NO: 109604 - RNA, 22 nt, Human
uaugugugaguauauaugcaca

SEQ ID NO: 109605 - RNA, 18 nt, Human
uaugugucuguuacaacu

SEQ ID NO: 109606 - RNA, 22 nt, Human
uaugugugugcguguguuuugc

SEQ ID NO: 109607 - RNA, 22 nt, Human
uaugaguauagugcaccauggu

SEQ ID NO: 109608 - RNA, 22 nt, Human
ucugauaaggaaggauuaaaag

SEQ ID NO: 109609 - RNA, 22 nt, Human
ucugaucuuucauccuaaaugg

SEQ ID NO: 109610 - RNA, 22 nt, Human
ucugaucagaagacaaaugagg

SEQ ID NO: 109611 - RNA, 22 nt, Human
ucugaugaccacaugugggacu

SEQ ID NO: 109612 - RNA, 22 nt, Human
uaugaauauaccacaauuuagg

SEQ ID NO: 109613 - RNA, 22 nt, Human
uaugaccuuaggaagcaagaag

SEQ ID NO: 109614 - RNA, 19 nt, Human
uaugacaaguacuaguucu

SEQ ID NO: 109615 - RNA, 22 nt, Human
ucugccuucaggagcagacucu

SEQ ID NO: 109616 - RNA, 22 nt, Human
uaugcgguccaucaggggcacu

SEQ ID NO: 109617 - RNA, 22 nt, Human
uaugcuagauggaaaaauauug

SEQ ID NO: 109618 - RNA, 22 nt, Human
uaugcauaauuggauaaguaga

SEQ ID NO: 109619 - RNA, 22 nt, Human
uaugcaucaguaugguuggaaa

SEQ ID NO: 109620 - RNA, 22 nt, Human
uaugccaaaaauaaguuuuaug

SEQ ID NO: 109621 - RNA, 22 nt, Human
uaugccaccagucuggaacucu

SEQ ID NO: 109622 - RNA, 22 nt, Human
uaugcacacguguccaugugca

SEQ ID NO: 109623 - RNA, 22 nt, Human
uaugcagauaguuugccauuca

SEQ ID NO: 109624 - RNA, 22 nt, Human
uaugaucuuaggauggaacuuc

SEQ ID NO: 109625 - RNA, 22 nt, Human
uaugauuuucaugguagaguua

SEQ ID NO: 109626 - RNA, 22 nt, Human
uccaaggcagacacauuuuuug

SEQ ID NO: 109627 - RNA, 23 nt, Human
uccaagagagauuuuaaauuucu

SEQ ID NO: 109628 - RNA, 22 nt, Human
uccaaggacuaaauucuagauu

SEQ ID NO: 109629 - RNA, 22 nt, Human
uacagcgaaaauuuagcuugau

SEQ ID NO: 109630 - RNA, 22 nt, Human
uccagcuucugccugcugcugc

SEQ ID NO: 109631 - RNA, 22 nt, Human
uacaguauuuuuuaagaaaaaa

SEQ ID NO: 109632 - RNA, 22 nt, Human
uacagcuuccucuaugguggcc

SEQ ID NO: 109633 - RNA, 22 nt, Human
uccaucuacgagauuuuccaga

SEQ ID NO: 109634 - RNA, 22 nt, Human
uccauguauugcuaacaaauag

SEQ ID NO: 109635 - RNA, 22 nt, Human
uccagguaaggguaaguaggcu

SEQ ID NO: 109636 - RNA, 22 nt, Human
uacuaaacugcauuucuaucua

SEQ ID NO: 109637 - RNA, 22 nt, Human
uacuaaagaaugaguuaaguuu

SEQ ID NO: 109638 - RNA, 22 nt, Human
uaccuuuuuauucuuaaggccg

SEQ ID NO: 109639 - RNA, 22 nt, Human
uacguuuuauaucuuuuggaau

SEQ ID NO: 109640 - RNA, 22 nt, Human
uccauguugauaaucuugugaa

SEQ ID NO: 109641 - RNA, 22 nt, Human
uacugaauuacugcugguaaau

SEQ ID NO: 109642 - RNA, 22 nt, Human
uacugaagaugccaucacaagc

SEQ ID NO: 109643 - RNA, 22 nt, Human
uacugccauuauccugcugaaa

SEQ ID NO: 109644 - RNA, 22 nt, Human
uacugauggagauaggcuauca

SEQ ID NO: 109645 - RNA, 22 nt, Human
uacuuuaauugcaaaaauaaau

SEQ ID NO: 109646 - RNA, 22 nt, Human
uacuugucuuuauuuuaaugcu

SEQ ID NO: 109647 - RNA, 22 nt, Human
uacuuuggugaaauuggaaaua

SEQ ID NO: 109648 - RNA, 22 nt, Human
uagaggcuagugguuaugaccu

SEQ ID NO: 109649 - RNA, 22 nt, Human
uagagugcugucaaagacuugu

SEQ ID NO: 109650 - RNA, 21 nt, Human
uagaccagcugugcuccucgg

SEQ ID NO: 109651 - RNA, 22 nt, Human
uccguccacacuuagagaguuu

SEQ ID NO: 109652 - RNA, 22 nt, Human
uacuuuuuucacuucuagcccc

SEQ ID NO: 109653 - RNA, 22 nt, Human
uagaaauaaacacugcuaccuu

SEQ ID NO: 109654 - RNA, 20 nt, Human
uccgaaucaugacuuugcac

SEQ ID NO: 109655 - RNA, 22 nt, Human
uagaagagcaugucaaacuaua

SEQ ID NO: 109656 - RNA, 22 nt, Human
uagaugguguccagaaagagaa

SEQ ID NO: 109657 - RNA, 22 nt, Human
uagaugaacagaaagccacugu

SEQ ID NO: 109658 - RNA, 22 nt, Human
uagaucucugccuuguucagag

SEQ ID NO: 109659 - RNA, 22 nt, Human
uagcacauaguaggcacaggcu

SEQ ID NO: 109660 - RNA, 22 nt, Human
uagcagaacaauagucaaugau

SEQ ID NO: 109661 - RNA, 22 nt, Human
uagcaggagagaaguuuuaagu

SEQ ID NO: 109662 - RNA, 20 nt, Human
uccugaaauuacgugauuca

SEQ ID NO: 109663 - RNA, 22 nt, Human
uccuucuguuguuuauuuuaaa

SEQ ID NO: 109664 - RNA, 22 nt, Human
uagcuggaggggcaggaugcug

SEQ ID NO: 109665 - RNA, 22 nt, Human
ucauauugguagagauguguaa

SEQ ID NO: 109666 - RNA, 21 nt, Human
uaagcuaaacauucaguuaac

SEQ ID NO: 109667 - RNA, 22 nt, Human
ucaucggcugucaucuucacgu

SEQ ID NO: 109668 - RNA, 22 nt, Human
ucaguuccccaaagccuccuag

SEQ ID NO: 109669 - RNA, 22 nt, Human
ucaguugagguggucuauugcg

SEQ ID NO: 109670 - RNA, 17 nt, Human
ucaguugugcgagcagc

SEQ ID NO: 109671 - RNA, 22 nt, Human
ucaguuguuggaaguagaugua

SEQ ID NO: 109672 - RNA, 22 nt, Human
uaagagauuuauugaggacuuc

SEQ ID NO: 109673 - RNA, 22 nt, Human
ucauaaaaucaguguccauugu

SEQ ID NO: 109674 - RNA, 22 nt, Human
ucaugucagugucugugugugg

SEQ ID NO: 109675 - RNA, 22 nt, Human
uaaggaaaugcaaauuuaagaa

SEQ ID NO: 109676 - RNA, 22 nt, Human
uaaggagagaauuuagagguuu

SEQ ID NO: 109677 - RNA, 22 nt, Human
ucaugcagaguagaaagggcaa

SEQ ID NO: 109678 - RNA, 22 nt, Human
uaauauauuuuuuaagggaugu

SEQ ID NO: 109679 - RNA, 22 nt, Human
uaauaucuuuacacauuuucaa

SEQ ID NO: 109680 - RNA, 22 nt, Human
uaauuuugucacagugacaugc

SEQ ID NO: 109681 - RNA, 22 nt, Human
ucauuguuuacugucuuuuuuc

SEQ ID NO: 109682 - RNA, 22 nt, Human
ucauugugugugcuucuugggc

SEQ ID NO: 109683 - RNA, 22 nt, Human
ucauuguuucugcuuuucauga

SEQ ID NO: 109684 - RNA, 17 nt, Human
ucauuuauccucuuugg

SEQ ID NO: 109685 - RNA, 22 nt, Human
ucauuuguauucuacaaagcac

SEQ ID NO: 109686 - RNA, 17 nt, Human
ucauuucaguaaaucca

SEQ ID NO: 109687 - RNA, 22 nt, Human
uccaaauagcuggaugauggug

SEQ ID NO: 109688 - RNA, 18 nt, Human
uccaaaccuuuuacuucc

SEQ ID NO: 109689 - RNA, 19 nt, Human
uccaaaauacuuguuacug

SEQ ID NO: 109690 - RNA, 18 nt, Human
uacagauguaugucuaca

SEQ ID NO: 109691 - RNA, 23 nt, Human
uacagccaugucgcugauuuaac

SEQ ID NO: 109692 - RNA, 22 nt, Human
uaaagugaaguucagaauggcu

SEQ ID NO: 109693 - RNA, 22 nt, Human
uaaaugagcaccucuaguuuug

SEQ ID NO: 109694 - RNA, 22 nt, Human
ucagguuuaagugacuggaauc

SEQ ID NO: 109695 - RNA, 22 nt, Human
ucagguuugcaaccucgggcaa

SEQ ID NO: 109696 - RNA, 22 nt, Human
uaaaugauaguauugaagguag

SEQ ID NO: 109697 - RNA, 22 nt, Human
ucaguauuagugcauuaucagg

SEQ ID NO: 109698 - RNA, 22 nt, Human
uaaagcauguuucaguaagguu

SEQ ID NO: 109699 - RNA, 21 nt, Human
ucaagcggcagagcaguuauu

SEQ ID NO: 109700 - RNA, 18 nt, Human
ucagggaaacuuugccug

SEQ ID NO: 109701 - RNA, 22 nt, Human
ucaggucacugauaaaguggaa

SEQ ID NO: 109702 - RNA, 23 nt, Human
ucagugaaggaacaacuaaauag

SEQ ID NO: 109703 - RNA, 22 nt, Human
uaacaacuuucugguguaacuu

SEQ ID NO: 109704 - RNA, 22 nt, Human
ucagugauccagauauuugagc

SEQ ID NO: 109705 - RNA, 22 nt, Human
uaaauuccuagucacaaacuuc

SEQ ID NO: 109706 - RNA, 22 nt, Human
uaaauguugcuugugcugcuca

SEQ ID NO: 109707 - RNA, 22 nt, Human
uaaauguacugaggcaacagga

SEQ ID NO: 109708 - RNA, 22 nt, Human
ucagugguuaaguucuguccac

SEQ ID NO: 109709 - RNA, 22 nt, Human
uaacgcaucuggaaacaggaca

SEQ ID NO: 109710 - RNA, 22 nt, Human
uaacuguuuugaauauuguggu

SEQ ID NO: 109711 - RNA, 22 nt, Human
uaacuugaauacauucuuuuca

SEQ ID NO: 109712 - RNA, 22 nt, Human
uaacauuagcuuugcucaugca

SEQ ID NO: 109713 - RNA, 22 nt, Human
uaacaguggucugugguaucug

SEQ ID NO: 109714 - RNA, 22 nt, Human
uaacagugcuacaguuacuuuc

SEQ ID NO: 109715 - RNA, 22 nt, Human
uaacacauagauauuuuaacuu

SEQ ID NO: 109716 - RNA, 22 nt, Human
uagcucuuaccagugaaguuug

SEQ ID NO: 109717 - RNA, 22 nt, Human
uagcugacagcagaagaguauu

SEQ ID NO: 109718 - RNA, 22 nt, Human
uagcguucuugcaugcuaaccu

SEQ ID NO: 109719 - RNA, 22 nt, Human
uaggaagagauuuucacauggc

SEQ ID NO: 109720 - RNA, 21 nt, Human
uagcuugaucauuuuauuucc

SEQ ID NO: 109721 - RNA, 22 nt, Human
uagcuucacuuuuguugaugcg

SEQ ID NO: 109722 - RNA, 22 nt, Human
gugcucuagaaauugucagugg

SEQ ID NO: 109723 - RNA, 17 nt, Human
uagccagcuugugauuu

SEQ ID NO: 109724 - RNA, 22 nt, Human
uagccaaguuuucuuugaaagu

SEQ ID NO: 109725 - RNA, 22 nt, Human
uagaacaaacagcauguuugau

SEQ ID NO: 109726 - RNA, 21 nt, Human
uagaagagggaauuugucuuu

SEQ ID NO: 109727 - RNA, 22 nt, Human
uagaagaacaugucaaacuaua

SEQ ID NO: 109728 - RNA, 22 nt, Human
gugcuuuaccuuauuggucucg

SEQ ID NO: 109729 - RNA, 22 nt, Human
gugcuguuagcgguuuauaaca

SEQ ID NO: 109730 - RNA, 22 nt, Human
guggaaauaugggcaacaaaga

SEQ ID NO: 109731 - RNA, 22 nt, Human
gugcuuugcuaggaccgauugu

SEQ ID NO: 109732 - RNA, 22 nt, Human
uaggcagauuccauauuuuggc

SEQ ID NO: 109733 - RNA, 22 nt, Human
guggauaaguuguuugaccuac

SEQ ID NO: 109734 - RNA, 22 nt, Human
guggagauauuugugauagggg

SEQ ID NO: 109735 - RNA, 22 nt, Human
uagugauuuaagaaaggugacu

SEQ ID NO: 109736 - RNA, 22 nt, Human
uagugcuuaaaacagaauuuuc

SEQ ID NO: 109737 - RNA, 23 nt, Human
uaguguuauuaauuaguaaggau

SEQ ID NO: 109738 - RNA, 22 nt, Human
uagugggauuuugaacaaaacc

SEQ ID NO: 109739 - RNA, 22 nt, Human
uagugcuucauucuauugguuu

SEQ ID NO: 109740 - RNA, 20 nt, Human
uaguggaccuugaaggccuc

SEQ ID NO: 109741 - RNA, 22 nt, Human
uaguggaaccuucuaaaugacg

SEQ ID NO: 109742 - RNA, 22 nt, Human
gugggggugaggaauguucuau

SEQ ID NO: 109743 - RNA, 22 nt, Human
gugggaaacagccuugcuucua

SEQ ID NO: 109744 - RNA, 22 nt, Human
gugggauaaccugagauaacau

SEQ ID NO: 109745 - RNA, 22 nt, Human
guggcuuauguccagcagauau

SEQ ID NO: 109746 - RNA, 22 nt, Human
guggcuuuguuuccaaaugaaa

SEQ ID NO: 109747 - RNA, 22 nt, Human
guggcuggguggaacugagucu

SEQ ID NO: 109748 - RNA, 22 nt, Human
uaguagcuguuguuuuuuaaac

SEQ ID NO: 109749 - RNA, 22 nt, Human
uaguacuugauuuuaaauguua

SEQ ID NO: 109750 - RNA, 22 nt, Human
uaguaauagcuguaaagugugu

SEQ ID NO: 109751 - RNA, 22 nt, Human
uagguggaaccauaugaaauuu

SEQ ID NO: 109752 - RNA, 22 nt, Human
uaggcaauauuagacuuugucu

SEQ ID NO: 109753 - RNA, 22 nt, Human
uaggcaguagcuuuggauguca

SEQ ID NO: 109754 - RNA, 22 nt, Human
uagguaauacuuagaccugauu

SEQ ID NO: 109755 - RNA, 22 nt, Human
uaggggaagcauagguuuagaa

SEQ ID NO: 109756 - RNA, 22 nt, Human
guggcagagagcaagugucuga

SEQ ID NO: 109757 - RNA, 22 nt, Human
guggcagguguacagcucagcu

SEQ ID NO: 109758 - RNA, 22 nt, Human
uauccauaccuucaaguuugcu

SEQ ID NO: 109759 - RNA, 22 nt, Human
uaucuucaauagcccagaugug

SEQ ID NO: 109760 - RNA, 22 nt, Human
uaugaaggauacaccucugauu

SEQ ID NO: 109761 - RNA, 22 nt, Human
uaugaaagguuuuuucuugaaa

SEQ ID NO: 109762 - RNA, 19 nt, Human
uaugaaguugauaaaaguu

SEQ ID NO: 109763 - RNA, 22 nt, Human
guguaucagaggcuguguuaua

SEQ ID NO: 109764 - RNA, 20 nt, Human
uaugcgaagccuuucuggac

SEQ ID NO: 109765 - RNA, 22 nt, Human
gugguaaagugugccugugguc

SEQ ID NO: 109766 - RNA, 22 nt, Human
guggugaacauuugcaucugcu

SEQ ID NO: 109767 - RNA, 22 nt, Human
gugguggggaguuggauggaag

SEQ ID NO: 109768 - RNA, 22 nt, Human
uauccaaaggaacaaucacagc

SEQ ID NO: 109769 - RNA, 22 nt, Human
uauguugucuuguucagccaua

SEQ ID NO: 109770 - RNA, 22 nt, Human
guuaaaugcagauucugacuca

SEQ ID NO: 109771 - RNA, 22 nt, Human
guuaauaugcaaaacggaugcg

SEQ ID NO: 109772 - RNA, 22 nt, Human
guuaucauccucagaggcaguu

SEQ ID NO: 109773 - RNA, 22 nt, Human
guuaggcagugugguauagcag

SEQ ID NO: 109774 - RNA, 22 nt, Human
uauguuugcaguucuaggucuu

SEQ ID NO: 109775 - RNA, 22 nt, Human
uauguuuugcaaauaucaaaca

SEQ ID NO: 109776 - RNA, 22 nt, Human
uauguggcaggugggagaucag

SEQ ID NO: 109777 - RNA, 22 nt, Human
uaugugguuugucauuuaauau

SEQ ID NO: 109778 - RNA, 22 nt, Human
guuaaaaugauuugugauuuau

SEQ ID NO: 109779 - RNA, 22 nt, Human
uaugucuauugacuuaggauuu

SEQ ID NO: 109780 - RNA, 22 nt, Human
uaugugaaauggaauauagaaa

SEQ ID NO: 109781 - RNA, 21 nt, Human
guguugugagguugguguuag

SEQ ID NO: 109782 - RNA, 22 nt, Human
guguuguaguguguguuucuuu

SEQ ID NO: 109783 - RNA, 22 nt, Human
guguugugauuggucagucacu

SEQ ID NO: 109784 - RNA, 23 nt, Human
guguuguugauuuucgaaucuuu

SEQ ID NO: 109785 - RNA, 22 nt, Human
guguuuguauccuccauauaac

SEQ ID NO: 109786 - RNA, 22 nt, Human
guguuuauguuuuugcuaggga

SEQ ID NO: 109787 - RNA, 22 nt, Human
guguuugagagguacaagggaa

SEQ ID NO: 109788 - RNA, 22 nt, Human
uauguauguauguauguauaug

SEQ ID NO: 109789 - RNA, 19 nt, Human
guguucuguuauacaguug

SEQ ID NO: 109790 - RNA, 22 nt, Human
guguugaaaaguagcacugcuu

SEQ ID NO: 109791 - RNA, 22 nt, Human
guguugaugugucuguauucua

SEQ ID NO: 109792 - RNA, 22 nt, Human
guucaaucucucaugcauuuuc

SEQ ID NO: 109793 - RNA, 22 nt, Human
guuccugugcccuguucuuucc

SEQ ID NO: 109794 - RNA, 22 nt, Human
uauucagugcugguucuuuuuc

SEQ ID NO: 109795 - RNA, 22 nt, Human
uauucauuuuuauuugugacug

SEQ ID NO: 109796 - RNA, 22 nt, Human
uauuaugguuguagguuaacaa

SEQ ID NO: 109797 - RNA, 22 nt, Human
guucuuagcacuucugcccauu

SEQ ID NO: 109798 - RNA, 22 nt, Human
uauuuuaaaagcauuaauucuu

SEQ ID NO: 109799 - RNA, 21 nt, Human
guucuuaguuauauucucaau

SEQ ID NO: 109800 - RNA, 22 nt, Human
guucucauugugaugcuuaguu

SEQ ID NO: 109801 - RNA, 22 nt, Human
guucuguucuucacagguuugu

SEQ ID NO: 109802 - RNA, 22 nt, Human
guugcggaguguagcgaugcuu

SEQ ID NO: 109803 - RNA, 22 nt, Human
guuggaaauaucagucacguga

SEQ ID NO: 109804 - RNA, 22 nt, Human
uauuuucucugccacacuucca

SEQ ID NO: 109805 - RNA, 22 nt, Human
uauuuuucacagauuggugcuu

SEQ ID NO: 109806 - RNA, 23 nt, Human
guugccuuugcaucuucauccau

SEQ ID NO: 109807 - RNA, 22 nt, Human
uauuuuuguuuaccaguuaaca

SEQ ID NO: 109808 - RNA, 22 nt, Human
ucaagaagauaaugucuagggu

SEQ ID NO: 109809 - RNA, 22 nt, Human
guuggggccuggagucucuugg

SEQ ID NO: 109810 - RNA, 22 nt, Human
guuggugagaguuagggauuua

SEQ ID NO: 109811 - RNA, 22 nt, Human
ucaaaggcuugugguucuggga

SEQ ID NO: 109812 - RNA, 22 nt, Human
ucaaagaucuuugcuuuugggg

SEQ ID NO: 109813 - RNA, 20 nt, Human
guugggagaagugucagcug

SEQ ID NO: 109814 - RNA, 22 nt, Human
uaagggagcagaagcugugaaa

SEQ ID NO: 109815 - RNA, 22 nt, Human
uaaguaauugugguuuuugcca

SEQ ID NO: 109816 - RNA, 19 nt, Human
uaaguagaugacugaugcu

SEQ ID NO: 109817 - RNA, 22 nt, Human
uaagcacuuuauaugcuuuauc

SEQ ID NO: 109818 - RNA, 22 nt, Human
guauuggcaguauacauagcac

SEQ ID NO: 109819 - RNA, 22 nt, Human
uaaguauguuagaaaaucaagu

SEQ ID NO: 109820 - RNA, 22 nt, Human
uaagucaagagcuagaaaaagc

SEQ ID NO: 109821 - RNA, 22 nt, Human
guagagcagaaacauggagaaa

SEQ ID NO: 109822 - RNA, 22 nt, Human
guagaucaugaaaauucacugc

SEQ ID NO: 109823 - RNA, 22 nt, Human
guaugaguggauagauguaucu

SEQ ID NO: 109824 - RNA, 22 nt, Human
guagaauggggcucucaaagca

SEQ ID NO: 109825 - RNA, 22 nt, Human
uaagaauguuuguugaguaaau

SEQ ID NO: 109826 - RNA, 22 nt, Human
uaagaaaggggaaguuccucuu

SEQ ID NO: 109827 - RNA, 22 nt, Human
uaagacuuuaccaggcucaaau

SEQ ID NO: 109828 - RNA, 22 nt, Human
guauucugugugaucaagugau

SEQ ID NO: 109829 - RNA, 22 nt, Human
uaauuuagugcauuuccuagua

SEQ ID NO: 109830 - RNA, 22 nt, Human
uaauugaacguucauuuuuaau

SEQ ID NO: 109831 - RNA, 22 nt, Human
uaauuauuaauuuuagguugcu

SEQ ID NO: 109832 - RNA, 22 nt, Human
guccugaaaaaaaucccugagu

SEQ ID NO: 109833 - RNA, 22 nt, Human
guccuaugggaagggauccugg

SEQ ID NO: 109834 - RNA, 22 nt, Human
uaauauaacugccaguuaaggu

SEQ ID NO: 109835 - RNA, 22 nt, Human
uaaugaugaacacuuggaagaa

SEQ ID NO: 109836 - RNA, 22 nt, Human
uaauccaaaacugaaucugugg

SEQ ID NO: 109837 - RNA, 22 nt, Human
uaauauccaguuauuucccuca

SEQ ID NO: 109838 - RNA, 22 nt, Human
guccacauaggaacccagcuuc

SEQ ID NO: 109839 - RNA, 19 nt, Human
guccaugguaaagaaggau

SEQ ID NO: 109840 - RNA, 20 nt, Human
gucguguauauagcuggggc

SEQ ID NO: 109841 - RNA, 22 nt, Human
gucguucugcuauucuaugagg

SEQ ID NO: 109842 - RNA, 22 nt, Human
uaauuucauuuugcaaugaucu

SEQ ID NO: 109843 - RNA, 22 nt, Human
gucgagaacauucauuaugcaa

SEQ ID NO: 109844 - RNA, 22 nt, Human
gucugcuuuuaucacaugucau

SEQ ID NO: 109845 - RNA, 22 nt, Human
gucugguggaguuguauauacu

SEQ ID NO: 109846 - RNA, 22 nt, Human
uacaaaauucaaauaauguuug

SEQ ID NO: 109847 - RNA, 22 nt, Human
uacaaagugauuuuggaauuga

SEQ ID NO: 109848 - RNA, 22 nt, Human
uaauuugauuucucccuggaaa

SEQ ID NO: 109849 - RNA, 22 nt, Human
gugaaaaauggccaucaggaca

SEQ ID NO: 109850 - RNA, 22 nt, Human
uacauuugauuuuugcuucuuu

SEQ ID NO: 109851 - RNA, 22 nt, Human
gucuugugaagacggcagaaag

SEQ ID NO: 109852 - RNA, 22 nt, Human
uacauguggagauaacugaagc

SEQ ID NO: 109853 - RNA, 22 nt, Human
uacuucuuuuguaaaguauuga

SEQ ID NO: 109854 - RNA, 22 nt, Human
uacuggguguucugagaaaaua

SEQ ID NO: 109855 - RNA, 22 nt, Human
uacugggugagcugggcuggga

SEQ ID NO: 109856 - RNA, 22 nt, Human
uacguaauagcuuuauuuuggg

SEQ ID NO: 109857 - RNA, 22 nt, Human
gugaagguccugauuugugacc

SEQ ID NO: 109858 - RNA, 20 nt, Human
gugaaguuuucugaagacag

SEQ ID NO: 109859 - RNA, 22 nt, Human
uacuugaaaugggcaucaagag

SEQ ID NO: 109860 - RNA, 22 nt, Human
gugacugagcuggcaaaguaug

SEQ ID NO: 109861 - RNA, 22 nt, Human
uacuugaacaucacuaagagaa

SEQ ID NO: 109862 - RNA, 22 nt, Human
uacuugcaaggcucuuggaaua

SEQ ID NO: 109863 - RNA, 22 nt, Human
ggugcaaagauggcaguugcaa

SEQ ID NO: 109864 - RNA, 22 nt, Human
ggugcaauaaaguuguagaacc

SEQ ID NO: 109865 - RNA, 22 nt, Human
guuuguguauauguguauuuuu

SEQ ID NO: 109866 - RNA, 22 nt, Human
gguguagagaaaauaguuguau

SEQ ID NO: 109867 - RNA, 22 nt, Human
gguguacuucacucuuaccuag

SEQ ID NO: 109868 - RNA, 22 nt, Human
gguguagggaaacuugacuaau

SEQ ID NO: 109869 - RNA, 22 nt, Human
ggugucuuugauguugggcuga

SEQ ID NO: 109870 - RNA, 22 nt, Human
ggugugaauagagccuggagca

SEQ ID NO: 109871 - RNA, 22 nt, Human
uaaaaauuagauauguauuuag

SEQ ID NO: 109872 - RNA, 22 nt, Human
guaccuuucuaucuagaaggua

SEQ ID NO: 109873 - RNA, 22 nt, Human
guacaaagucaaggugaaaaua

SEQ ID NO: 109874 - RNA, 22 nt, Human
uaaauuagauucccagcgcuau

SEQ ID NO: 109875 - RNA, 22 nt, Human
uaaauuggaauaaugagaagug

SEQ ID NO: 109876 - RNA, 22 nt, Human
guaaccacuaugguuauugauu

SEQ ID NO: 109877 - RNA, 22 nt, Human
gguuuucuuguucauuuuuuaa

SEQ ID NO: 109878 - RNA, 22 nt, Human
uaaaugaaaggguuuaauuuau

SEQ ID NO: 109879 - RNA, 22 nt, Human
uaaauaugcaugugguauucau

SEQ ID NO: 109880 - RNA, 22 nt, Human
uaaaccuuauuugaauaccaac

SEQ ID NO: 109881 - RNA, 22 nt, Human
uaaaaugcucagauaaauauau

SEQ ID NO: 109882 - RNA, 22 nt, Human
uaaaaucaugacagauugacau

SEQ ID NO: 109883 - RNA, 22 nt, Human
uaaaggaguguauaauuguagu

SEQ ID NO: 109884 - RNA, 22 nt, Human
uaaaguauucaaguagcuuucu

SEQ ID NO: 109885 - RNA, 22 nt, Human
uaaacgaagcuucaugcuugaa

SEQ ID NO: 109886 - RNA, 22 nt, Human
gguugauuuuuaugaagccaug

SEQ ID NO: 109887 - RNA, 22 nt, Human
uaaaggcaaacucuccaaggau

SEQ ID NO: 109888 - RNA, 22 nt, Human
gguuuuuggcucaauauuuugg

SEQ ID NO: 109889 - RNA, 22 nt, Human
gugcugggaggcccaggaugga

SEQ ID NO: 109890 - RNA, 22 nt, Human
gugcucuauguugauuccuuga

SEQ ID NO: 109891 - RNA, 22 nt, Human
gugcuugaguaaaaauagucuu

SEQ ID NO: 109892 - RNA, 22 nt, Human
guuggcgaaggaccuggaggag

SEQ ID NO: 109893 - RNA, 22 nt, Human
guugggaauucggagagaaaua

SEQ ID NO: 109894 - RNA, 22 nt, Human
guugggcugaagugugugcuua

SEQ ID NO: 109895 - RNA, 22 nt, Human
guugggugccagaggcuucacg

SEQ ID NO: 109896 - RNA, 22 nt, Human
guuggguaauuaagcacagaaa

SEQ ID NO: 109897 - RNA, 19 nt, Human
guuguguuugguucuuuug

SEQ ID NO: 109898 - RNA, 22 nt, Human
guuguuagccucacauuuagga

SEQ ID NO: 109899 - RNA, 22 nt, Human
guuguuaagugcugguuguuag

SEQ ID NO: 109900 - RNA, 22 nt, Human
guugugcaaaacaggaaggucu

SEQ ID NO: 109901 - RNA, 22 nt, Human
ggugagagaaaagaaacacugu

SEQ ID NO: 109902 - RNA, 22 nt, Human
ggugaaggaucccucuuggccu

SEQ ID NO: 109903 - RNA, 22 nt, Human
guuuccaagucucucaacaccc

SEQ ID NO: 109904 - RNA, 22 nt, Human
ggugaguagaaguaguuggcuu

SEQ ID NO: 109905 - RNA, 22 nt, Human
guuucuguguugauugugcccu

SEQ ID NO: 109906 - RNA, 22 nt, Human
guuucuguggacucugcuuagg

SEQ ID NO: 109907 - RNA, 22 nt, Human
guuuccaggcuuugguaugguu

SEQ ID NO: 109908 - RNA, 22 nt, Human
guuugaacagaaggguugauca

SEQ ID NO: 109909 - RNA, 22 nt, Human
guuuaaguuaaaauuuaccugc

SEQ ID NO: 109910 - RNA, 22 nt, Human
guuuacaacaucuuguccuuca

SEQ ID NO: 109911 - RNA, 22 nt, Human
guuuaucagagagcagaggugg

SEQ ID NO: 109912 - RNA, 22 nt, Human
guuuagauguagauucucuggu

SEQ ID NO: 109913 - RNA, 22 nt, Human
guuuauucuuuuauuugugaga

SEQ ID NO: 109914 - RNA, 22 nt, Human
guuguugucauuagcuguuuaa

SEQ ID NO: 109915 - RNA, 22 nt, Human
guuguuuuuguuaaaacaguga

SEQ ID NO: 109916 - RNA, 22 nt, Human
guuuaaaagcaaccaacaggcu

SEQ ID NO: 109917 - RNA, 22 nt, Human
ggcgauuggccgggaggaggca

SEQ ID NO: 109918 - RNA, 22 nt, Human
guaucuuuauuuuaauuaagau

SEQ ID NO: 109919 - RNA, 22 nt, Human
guaugugucuuagaacuuggga

SEQ ID NO: 109920 - RNA, 22 nt, Human
guauaaauaucuauauuguuac

SEQ ID NO: 109921 - RNA, 22 nt, Human
gguuugccagugcuggaaugca

SEQ ID NO: 109922 - RNA, 22 nt, Human
gguuugauauguuugugauucu

SEQ ID NO: 109923 - RNA, 22 nt, Human
gguuuguggagcuggaaacacu

SEQ ID NO: 109924 - RNA, 22 nt, Human
gguuuauucccacaaaggaagu

SEQ ID NO: 109925 - RNA, 22 nt, Human
gguuuaucuuuacaaaugaaau

SEQ ID NO: 109926 - RNA, 22 nt, Human
gguuucuuuccucucugugccu

SEQ ID NO: 109927 - RNA, 22 nt, Human
guaugugugcauacauguacga

SEQ ID NO: 109928 - RNA, 22 nt, Human
guauuauauaaccauugguucu

SEQ ID NO: 109929 - RNA, 22 nt, Human
guauugauuguuuuaaaagauu

SEQ ID NO: 109930 - RNA, 22 nt, Human
guauuugcaaucacaaacaaaa

SEQ ID NO: 109931 - RNA, 22 nt, Human
guauuugacaccagugaauggu

SEQ ID NO: 109932 - RNA, 22 nt, Human
gucacaaaugauuuagcaauca

SEQ ID NO: 109933 - RNA, 22 nt, Human
gucacuuugcuugcgaugcucc

SEQ ID NO: 109934 - RNA, 22 nt, Human
guauggggugacaaaaauuagu

SEQ ID NO: 109935 - RNA, 22 nt, Human
gucagugaaccuucaccaaacc

SEQ ID NO: 109936 - RNA, 22 nt, Human
gucagaagauagaggaaguuug

SEQ ID NO: 109937 - RNA, 22 nt, Human
gucacuuuuaagggccuuuucu

SEQ ID NO: 109938 - RNA, 22 nt, Human
ggcucacuguaccugccgccgc

SEQ ID NO: 109939 - RNA, 22 nt, Human
ggcuauuguuuuaaaaaaugag

SEQ ID NO: 109940 - RNA, 22 nt, Human
ggcugaugacgccugagucuga

SEQ ID NO: 109941 - RNA, 22 nt, Human
ggcugcaagacguuauuagcgu

SEQ ID NO: 109942 - RNA, 22 nt, Human
ggcugcagugcaacucuuucua

SEQ ID NO: 109943 - RNA, 22 nt, Human
ggcugcuugggcuguuucuuuu

SEQ ID NO: 109944 - RNA, 22 nt, Human
gucguagaaccuuuuccaaaca

SEQ ID NO: 109945 - RNA, 22 nt, Human
guccuuuauuugaacaugacau

SEQ ID NO: 109946 - RNA, 22 nt, Human
guccuuaaauacgaugaacaug

SEQ ID NO: 109947 - RNA, 22 nt, Human
gucgcuuuccugaggggucuca

SEQ ID NO: 109948 - RNA, 22 nt, Human
gucugcagcacugugcacgguc

SEQ ID NO: 109949 - RNA, 22 nt, Human
gugaugugugaaggucugcagg

SEQ ID NO: 109950 - RNA, 22 nt, Human
gugaugaaggccugcaccuggu

SEQ ID NO: 109951 - RNA, 22 nt, Human
gugaugaagguggagaaucaga

SEQ ID NO: 109952 - RNA, 22 nt, Human
gugauaguucuuacuccaaagu

SEQ ID NO: 109953 - RNA, 22 nt, Human
gugauucaucuggggccuuauu

SEQ ID NO: 109954 - RNA, 22 nt, Human
gggagaaccagccagugcaagg

SEQ ID NO: 109955 - RNA, 19 nt, Human
gggagaaaaucuuuauccu

SEQ ID NO: 109956 - RNA, 22 nt, Human
gugcagcugguggagucugggg

SEQ ID NO: 109957 - RNA, 21 nt, Human
gggagaguagcgguagggagg

SEQ ID NO: 109958 - RNA, 22 nt, Human
gugcauauguguguauacaaac

SEQ ID NO: 109959 - RNA, 22 nt, Human
gugauuucagguuuuucauacu

SEQ ID NO: 109960 - RNA, 21 nt, Human
gggagccucauuuucuucauc

SEQ ID NO: 109961 - RNA, 22 nt, Human
gugccaaauagcuugauuaaga

SEQ ID NO: 109962 - RNA, 20 nt, Human
gggaucgaguaccuccgggu

SEQ ID NO: 109963 - RNA, 22 nt, Human
gugccuuuuucccaguucauug

SEQ ID NO: 109964 - RNA, 22 nt, Human
gugccuggaaucuuuucuucac

SEQ ID NO: 109965 - RNA, 21 nt, Human
gggagugaguaaugauggggg

SEQ ID NO: 109966 - RNA, 22 nt, Human
gugcgaaagaagcgacuccagu

SEQ ID NO: 109967 - RNA, 22 nt, Human
gugcugcaugagcaucacguag

SEQ ID NO: 109968 - RNA, 22 nt, Human
gggcaagaagcuggaagcauuc

SEQ ID NO: 109969 - RNA, 22 nt, Human
gggcaagagaggaagagauggc

SEQ ID NO: 109970 - RNA, 22 nt, Human
gggauuaaaaaucaccaaagua

SEQ ID NO: 109971 - RNA, 22 nt, Human
gggauuuaaugggaaaaauaug

SEQ ID NO: 109972 - RNA, 23 nt, Human
gggaaaucaaaagauauuucuuc

SEQ ID NO: 109973 - RNA, 22 nt, Human
gggaaaauguuucugagacaaa

SEQ ID NO: 109974 - RNA, 22 nt, Human
ggcuuuuucccuaggguaagag

SEQ ID NO: 109975 - RNA, 22 nt, Human
gggaagugagcuggaaucaagg

SEQ ID NO: 109976 - RNA, 22 nt, Human
gugauauaacaauuuagggaau

SEQ ID NO: 109977 - RNA, 22 nt, Human
gugagaggaggcagcuuuuaca

SEQ ID NO: 109978 - RNA, 22 nt, Human
gggaagaaccucugcuaccaau

SEQ ID NO: 109979 - RNA, 22 nt, Human
ggcuuuuguuauaaucaggccu

SEQ ID NO: 109980 - RNA, 22 nt, Human
gugaagcaagggucaccugugg

SEQ ID NO: 109981 - RNA, 22 nt, Human
ggcuucuuaacauuuggacacc

SEQ ID NO: 109982 - RNA, 22 nt, Human
gugaagaugccucaggugaccc

SEQ ID NO: 109983 - RNA, 20 nt, Human
gugaacuggagaacugaugu

SEQ ID NO: 109984 - RNA, 22 nt, Human
gugaaaugaagugacuggauau

SEQ ID NO: 109985 - RNA, 23 nt, Human
gugaacaaugcuccaggagauac

SEQ ID NO: 109986 - RNA, 22 nt, Human
gugaaauuguacacucaguacc

SEQ ID NO: 109987 - RNA, 22 nt, Human
ggcuucaaaacacaugucaaga

SEQ ID NO: 109988 - RNA, 22 nt, Human
ggcuuaugaucugacccaucga

SEQ ID NO: 109989 - RNA, 22 nt, Human
ggcuuauauguauucccagaga

SEQ ID NO: 109990 - RNA, 22 nt, Human
gugaaacuggaugugaaaacaa

SEQ ID NO: 109991 - RNA, 19 nt, Human
gucuuauggauagcuccuc

SEQ ID NO: 109992 - RNA, 22 nt, Human
gucuucuauuuggcaugacaga

SEQ ID NO: 109993 - RNA, 22 nt, Human
gucuuucuuuuacauauuugug

SEQ ID NO: 109994 - RNA, 22 nt, Human
ggcuggggccuguugaagaugc

SEQ ID NO: 109995 - RNA, 22 nt, Human
ggcugguggcgggcagcacaga

SEQ ID NO: 109996 - RNA, 22 nt, Human
gucuuuguaguuuuaauuugag

SEQ ID NO: 109997 - RNA, 22 nt, Human
gugaaaauaguaaccuggcuag

SEQ ID NO: 109998 - RNA, 22 nt, Human
ggccacauuccagagggcugaa

SEQ ID NO: 109999 - RNA, 20 nt, Human
ggcauuuuuuaguugagcuu

SEQ ID NO: 110000 - RNA, 22 nt, Human
ggccaaagagcacaaugaauag

SEQ ID NO: 110001 - RNA, 22 nt, Human
gcuguugagucagacaaguuuu

SEQ ID NO: 110002 - RNA, 22 nt, Human
ggcuuugggaggaugaggcggu

SEQ ID NO: 110003 - RNA, 22 nt, Human
gggaaaaaggaaccuuauuacu

SEQ ID NO: 110004 - RNA, 22 nt, Human
gcuuacuguuccuguuggugcu

SEQ ID NO: 110005 - RNA, 22 nt, Human
gggaaaugugucuuggcauucu

SEQ ID NO: 110006 - RNA, 22 nt, Human
gcuguugcaaucaaggccaugg

SEQ ID NO: 110007 - RNA, 22 nt, Human
gggaaaaaggaguuagagauaa

SEQ ID NO: 110008 - RNA, 22 nt, Human
gcuguugugaggaucagcauau

SEQ ID NO: 110009 - RNA, 22 nt, Human
gcuguuuaaguggaauuuguuu

SEQ ID NO: 110010 - RNA, 22 nt, Human
gcuguuguugcacggaaggugg

SEQ ID NO: 110011 - RNA, 22 nt, Human
gggaagaagaaaagagguggga

SEQ ID NO: 110012 - RNA, 22 nt, Human
gggaagaacugauuucacacca

SEQ ID NO: 110013 - RNA, 18 nt, Human
gggaagaugccacaguga

SEQ ID NO: 110014 - RNA, 22 nt, Human
gcuucucauguuuauuuuuaca

SEQ ID NO: 110015 - RNA, 22 nt, Human
gcuucugugagugcagaugcug

SEQ ID NO: 110016 - RNA, 22 nt, Human
gcuuauugcuuauagauaggaa

SEQ ID NO: 110017 - RNA, 22 nt, Human
gggaacgacuguuaguacuugg

SEQ ID NO: 110018 - RNA, 22 nt, Human
gcuuaugauguuuacauaaaag

SEQ ID NO: 110019 - RNA, 22 nt, Human
gcuucuguuaggauguggcuua

SEQ ID NO: 110020 - RNA, 22 nt, Human
gcuugcuuuguaaauaucugug

SEQ ID NO: 110021 - RNA, 22 nt, Human
gcuugcugaacaggaaccuggc

SEQ ID NO: 110022 - RNA, 22 nt, Human
gcuuguuuagcauaggucacug

SEQ ID NO: 110023 - RNA, 22 nt, Human
gcuuguauguguauauauacau

SEQ ID NO: 110024 - RNA, 22 nt, Human
gggaccaaaugcuaccauucua

SEQ ID NO: 110025 - RNA, 22 nt, Human
gggaauguuaaccuuucuauuu

SEQ ID NO: 110026 - RNA, 22 nt, Human
gggaauuuuaggaugacuccua

SEQ ID NO: 110027 - RNA, 22 nt, Human
gcuuguuagcaaugcagaaucu

SEQ ID NO: 110028 - RNA, 22 nt, Human
gcuuucauuauguuguguuuuu

SEQ ID NO: 110029 - RNA, 22 nt, Human
gcuuuccuggcccugucccugc

SEQ ID NO: 110030 - RNA, 22 nt, Human
gggagcugagcuggaagagaau

SEQ ID NO: 110031 - RNA, 22 nt, Human
gggaugaaugccuggcuccccc

SEQ ID NO: 110032 - RNA, 22 nt, Human
ggaaaaauggguggugauauga

SEQ ID NO: 110033 - RNA, 22 nt, Human
ggaagaagagggagcuguggga

SEQ ID NO: 110034 - RNA, 22 nt, Human
ggaagauagaaguucaaaaguu

SEQ ID NO: 110035 - RNA, 22 nt, Human
gggagccucccacugggggaag

SEQ ID NO: 110036 - RNA, 22 nt, Human
ggaauaauauuacagauacagu

SEQ ID NO: 110037 - RNA, 22 nt, Human
ggaauauaaaucagaugcuccg

SEQ ID NO: 110038 - RNA, 22 nt, Human
ggaaucuucagccaugccaaga

SEQ ID NO: 110039 - RNA, 22 nt, Human
ggaagcugucugcccggcgcuc

SEQ ID NO: 110040 - RNA, 22 nt, Human
ggacuucuggggacuguagauu

SEQ ID NO: 110041 - RNA, 22 nt, Human
gggcuuaaccuggguaugaggg

SEQ ID NO: 110042 - RNA, 22 nt, Human
ggaauuaagaggcuggacaggg

SEQ ID NO: 110043 - RNA, 22 nt, Human
ggaaugcagugagcauuagaua

SEQ ID NO: 110044 - RNA, 22 nt, Human
ggucgagcagcacccguucggc

SEQ ID NO: 110045 - RNA, 22 nt, Human
ggucaucacugagagcagaucc

SEQ ID NO: 110046 - RNA, 22 nt, Human
ggaugauuuucaguuguguggg

SEQ ID NO: 110047 - RNA, 22 nt, Human
gguaaucuccucauugacguua

SEQ ID NO: 110048 - RNA, 22 nt, Human
ggcaauuacguauuagucaugu

SEQ ID NO: 110049 - RNA, 22 nt, Human
ggcaauauuauaagggcauuua

SEQ ID NO: 110050 - RNA, 20 nt, Human
ggcagagcuaugucuguugc

SEQ ID NO: 110051 - RNA, 20 nt, Human
ggcagcaaccauaugcuaca

SEQ ID NO: 110052 - RNA, 22 nt, Human
ggccaauuuccuagacauuagu

SEQ ID NO: 110053 - RNA, 22 nt, Human
ggcauggugggggaggacuugg

SEQ ID NO: 110054 - RNA, 20 nt, Human
ggcaucugacaacuaguugc

SEQ ID NO: 110055 - RNA, 22 nt, Human
ggugauaaaaagcauuuaaauu

SEQ ID NO: 110056 - RNA, 22 nt, Human
ggcagcagaaccaacuguggcu

SEQ ID NO: 110057 - RNA, 22 nt, Human
gguggcagaggaggcgggagag

SEQ ID NO: 110058 - RNA, 22 nt, Human
gguggcauguaccucacagacu

SEQ ID NO: 110059 - RNA, 22 nt, Human
ggugcuuuucacaagcauggga

SEQ ID NO: 110060 - RNA, 22 nt, Human
gguggagacucagauuuguugc

SEQ ID NO: 110061 - RNA, 22 nt, Human
ggaucuaaagccagaauauaug

SEQ ID NO: 110062 - RNA, 22 nt, Human
ggaugauacuuggagaaauauu

SEQ ID NO: 110063 - RNA, 22 nt, Human
ggguuuugugauugccucugaa

SEQ ID NO: 110064 - RNA, 22 nt, Human
gguaagcacuucauguacauga

SEQ ID NO: 110065 - RNA, 22 nt, Human
ggguggugagagaacuuugcag

SEQ ID NO: 110066 - RNA, 22 nt, Human
gggugcuuaagcuuguuuguaa

SEQ ID NO: 110067 - RNA, 22 nt, Human
ggagugaagacagagugaacuu

SEQ ID NO: 110068 - RNA, 22 nt, Human
ggagugauuugucuugucuggu

SEQ ID NO: 110069 - RNA, 22 nt, Human
ggaggaaauccuuaguaaggca

SEQ ID NO: 110070 - RNA, 22 nt, Human
ggggcuuggguagagcagaaac

SEQ ID NO: 110071 - RNA, 22 nt, Human
gggggacagugugccuggugug

SEQ ID NO: 110072 - RNA, 22 nt, Human
ggaauuauuuuaaauagacauu

SEQ ID NO: 110073 - RNA, 22 nt, Human
ggacuuuggauuuuauucuaaa

SEQ ID NO: 110074 - RNA, 22 nt, Human
ggacuugaaguaguuauggccu

SEQ ID NO: 110075 - RNA, 22 nt, Human
ggacauggaaagugugugauuu

SEQ ID NO: 110076 - RNA, 22 nt, Human
ggacauaguugcuauggagagu

SEQ ID NO: 110077 - RNA, 22 nt, Human
ggagagagggaucuuuguggag

SEQ ID NO: 110078 - RNA, 22 nt, Human
ggagagaacguaaucuaguauu

SEQ ID NO: 110079 - RNA, 22 nt, Human
ggagcuaagagaauggacaagg

SEQ ID NO: 110080 - RNA, 22 nt, Human
ggagcugaacccuuaacuggcu

SEQ ID NO: 110081 - RNA, 22 nt, Human
gcgugcauguguguaugcgugu

SEQ ID NO: 110082 - RNA, 22 nt, Human
ggcagaaaacaauaaccauuuc

SEQ ID NO: 110083 - RNA, 22 nt, Human
gcuagaaggaagccccugcuga

SEQ ID NO: 110084 - RNA, 22 nt, Human
ggcagcagaacuggcccuguau

SEQ ID NO: 110085 - RNA, 22 nt, Human
ggcagguccugaguccugaggc

SEQ ID NO: 110086 - RNA, 17 nt, Human
gcuaguuguuuccagua

SEQ ID NO: 110087 - RNA, 22 nt, Human
gcuagauugucacuugaguguc

SEQ ID NO: 110088 - RNA, 22 nt, Human
gcucaaggucacacagggguga

SEQ ID NO: 110089 - RNA, 22 nt, Human
ggcauuccgggguccccuucuc

SEQ ID NO: 110090 - RNA, 22 nt, Human
ggcauuccucucuguucaugga

SEQ ID NO: 110091 - RNA, 22 nt, Human
ggcauugauggggucuugggga

SEQ ID NO: 110092 - RNA, 22 nt, Human
gcugacuuauuagaaaaggaca

SEQ ID NO: 110093 - RNA, 23 nt, Human
gcucugauaccagcuacaucuag

SEQ ID NO: 110094 - RNA, 22 nt, Human
gcugagcagaacaauuagaaau

SEQ ID NO: 110095 - RNA, 22 nt, Human
gcaugguuagacaucaauguga

SEQ ID NO: 110096 - RNA, 22 nt, Human
gcauucuugucaguggggucag

SEQ ID NO: 110097 - RNA, 22 nt, Human
gcauuuaaauuugaacuucaga

SEQ ID NO: 110098 - RNA, 22 nt, Human
gcccuguuuucuggguuccuug

SEQ ID NO: 110099 - RNA, 22 nt, Human
gcugugacaagaggcugcuucu

SEQ ID NO: 110100 - RNA, 22 nt, Human
gcuguguucauccugcccaggu

SEQ ID NO: 110101 - RNA, 22 nt, Human
gcuguuggaggaguucagugcu

SEQ ID NO: 110102 - RNA, 22 nt, Human
gcuguuucuuuggcaaacugau

SEQ ID NO: 110103 - RNA, 22 nt, Human
gcuuagaugcugucauucacca

SEQ ID NO: 110104 - RNA, 22 nt, Human
gcuuauuagguuauuucaagga

SEQ ID NO: 110105 - RNA, 22 nt, Human
gccugcaaagacuuccuucucu

SEQ ID NO: 110106 - RNA, 22 nt, Human
ggaacuaagcacauuaucugau

SEQ ID NO: 110107 - RNA, 22 nt, Human
gccugaaaugaaccagaggacu

SEQ ID NO: 110108 - RNA, 22 nt, Human
ggaaauguguguaagaaaguau

SEQ ID NO: 110109 - RNA, 22 nt, Human
ggaaauauaagcaguuugugug

SEQ ID NO: 110110 - RNA, 22 nt, Human
ggaaaggaagggaaggagaugc

SEQ ID NO: 110111 - RNA, 22 nt, Human
ggaaagagaaacaugaacuaga

SEQ ID NO: 110112 - RNA, 22 nt, Human
ggaaagaggacaucuuacuucu

SEQ ID NO: 110113 - RNA, 22 nt, Human
ggaaaaugcugaagcaucugaa

SEQ ID NO: 110114 - RNA, 22 nt, Human
gccguuccuacucucucugugu

SEQ ID NO: 110115 - RNA, 22 nt, Human
gcuuucagggucacugucaaca

SEQ ID NO: 110116 - RNA, 20 nt, Human
gcuugaauuugauggccaga

SEQ ID NO: 110117 - RNA, 22 nt, Human
gcuuuugcaaagcuggagaauu

SEQ ID NO: 110118 - RNA, 22 nt, Human
gcuuuugagaaaguguuuuccc

SEQ ID NO: 110119 - RNA, 22 nt, Human
gcuuuuuaauuugcuucccugg

SEQ ID NO: 110120 - RNA, 22 nt, Human
ggaaaaucaaaccauuuacagu

SEQ ID NO: 110121 - RNA, 22 nt, Human
ggaaaagaauuguuaguuagug

SEQ ID NO: 110122 - RNA, 22 nt, Human
gcuuuucaaguuacaauuagcu

SEQ ID NO: 110123 - RNA, 22 nt, Human
gcuuuugaauacuacaggaguu

SEQ ID NO: 110124 - RNA, 22 nt, Human
gcuuuucucccugcuuucuucc

SEQ ID NO: 110125 - RNA, 22 nt, Human
gcuuuggcuucuccuggcagga

SEQ ID NO: 110126 - RNA, 22 nt, Human
gcuuuuaaauuaucugacaaug

SEQ ID NO: 110127 - RNA, 22 nt, Human
gcagggcucuggagucaggcug

SEQ ID NO: 110128 - RNA, 20 nt, Human
gagaaugucauuccuuuuuu

SEQ ID NO: 110129 - RNA, 22 nt, Human
gauccucagacccuccucuggu

SEQ ID NO: 110130 - RNA, 22 nt, Human
gagaauuauacaugagcuauuu

SEQ ID NO: 110131 - RNA, 22 nt, Human
gaugaaguaguccacuggaagg

SEQ ID NO: 110132 - RNA, 21 nt, Human
gaucgcaaugugggaaucaug

SEQ ID NO: 110133 - RNA, 22 nt, Human
gcagguggaagcagcagacuca

SEQ ID NO: 110134 - RNA, 22 nt, Human
gcaguauuguguguggucaugg

SEQ ID NO: 110135 - RNA, 22 nt, Human
gcaguaaggaggggaaggguuu

SEQ ID NO: 110136 - RNA, 22 nt, Human
gcagucauggguagaacucaag

SEQ ID NO: 110137 - RNA, 22 nt, Human
gaguagcaguucauccacaagc

SEQ ID NO: 110138 - RNA, 22 nt, Human
gaguagccucagucugcaagug

SEQ ID NO: 110139 - RNA, 22 nt, Human
gaguaaaagaugaggcaguaga

SEQ ID NO: 110140 - RNA, 22 nt, Human
gaguaauuuucuuaaaacauca

SEQ ID NO: 110141 - RNA, 22 nt, Human
gaguauuuaccacuaaaugguu

SEQ ID NO: 110142 - RNA, 22 nt, Human
gcaguuguagcuguuucuacuc

SEQ ID NO: 110143 - RNA, 22 nt, Human
gcaguuaccuauuuuguagaaa

SEQ ID NO: 110144 - RNA, 22 nt, Human
gagugaucuguaggcagcaugg

SEQ ID NO: 110145 - RNA, 22 nt, Human
gaguggcaaagagaacaaagau

SEQ ID NO: 110146 - RNA, 22 nt, Human
gaguuaaauagcuuaggauuca

SEQ ID NO: 110147 - RNA, 22 nt, Human
gcauagauauguaaugcaucau

SEQ ID NO: 110148 - RNA, 22 nt, Human
gcauaaaggacuauaaggauca

SEQ ID NO: 110149 - RNA, 22 nt, Human
gcaucacacgcacauacacaca

SEQ ID NO: 110150 - RNA, 22 nt, Human
gcauauuuuaaaguguaaccug

SEQ ID NO: 110151 - RNA, 22 nt, Human
gcauaguuuucauagguguuuu

SEQ ID NO: 110152 - RNA, 22 nt, Human
gcaucuccugagucagauuuug

SEQ ID NO: 110153 - RNA, 22 nt, Human
gaguuauuuuuccuguuuuuua

SEQ ID NO: 110154 - RNA, 22 nt, Human
gccacucaguuuaggggcaagc

SEQ ID NO: 110155 - RNA, 20 nt, Human
gccaaggaggagaaacaggc

SEQ ID NO: 110156 - RNA, 22 nt, Human
gaguugauggccauugaguuga

SEQ ID NO: 110157 - RNA, 22 nt, Human
gaugaagaaacucaaccaagaa

SEQ ID NO: 110158 - RNA, 22 nt, Human
gaucuuacucacuucagcuggc

SEQ ID NO: 110159 - RNA, 22 nt, Human
gaugggaggaugaauuggaccu

SEQ ID NO: 110160 - RNA, 22 nt, Human
gauggggaaaaaauggaucuuu

SEQ ID NO: 110161 - RNA, 22 nt, Human
gauggugauggcccuaagcuga

SEQ ID NO: 110162 - RNA, 22 nt, Human
gccaguuuguuuacugaugguu

SEQ ID NO: 110163 - RNA, 22 nt, Human
gccauauucaugcaggugcuaa

SEQ ID NO: 110164 - RNA, 22 nt, Human
gaugucauguuggcagacaguu

SEQ ID NO: 110165 - RNA, 20 nt, Human
gagugucacacacaaccccu

SEQ ID NO: 110166 - RNA, 22 nt, Human
gauguuggugcauucacuucug

SEQ ID NO: 110167 - RNA, 22 nt, Human
gauuaucaccaaauggccuccu

SEQ ID NO: 110168 - RNA, 22 nt, Human
gauuaaaggucuugauuauaag

SEQ ID NO: 110169 - RNA, 22 nt, Human
gauuuugcuuuagugaaggaag

SEQ ID NO: 110170 - RNA, 22 nt, Human
gcacauauuuagaucuugaugu

SEQ ID NO: 110171 - RNA, 22 nt, Human
gcacaaaagguacuucauguag

SEQ ID NO: 110172 - RNA, 22 nt, Human
gcaauagccuacaugcgucaga

SEQ ID NO: 110173 - RNA, 19 nt, Human
gcaaguuaucugucuccau

SEQ ID NO: 110174 - RNA, 22 nt, Human
gcaauuguauugucaagacaug

SEQ ID NO: 110175 - RNA, 22 nt, Human
gcagaaguauuguacgguggga

SEQ ID NO: 110176 - RNA, 22 nt, Human
gcagaugagagugugaucuggg

SEQ ID NO: 110177 - RNA, 22 nt, Human
gcagauaaaauuuuugauggga

SEQ ID NO: 110178 - RNA, 22 nt, Human
gcgcagugagguuaagaaugca

SEQ ID NO: 110179 - RNA, 22 nt, Human
gcagauccaaauauaguucuug

SEQ ID NO: 110180 - RNA, 22 nt, Human
gcagcaaucuucacagugucau

SEQ ID NO: 110181 - RNA, 22 nt, Human
gcaggcagauccagaagcacua

SEQ ID NO: 110182 - RNA, 22 nt, Human
gcagggcucagccgcucccacc

SEQ ID NO: 110183 - RNA, 22 nt, Human
gcaggaagauugcagaaggcug

SEQ ID NO: 110184 - RNA, 22 nt, Human
gcaguccuugcuguguaauaaa

SEQ ID NO: 110185 - RNA, 22 nt, Human
gcaguagauccagcagccugca

SEQ ID NO: 110186 - RNA, 22 nt, Human
gcagguuguuuaaauuaggauu

SEQ ID NO: 110187 - RNA, 22 nt, Human
gcaguaaauugagagucauguu

SEQ ID NO: 110188 - RNA, 22 nt, Human
gcuagaaacuguuuaaucucuu

SEQ ID NO: 110189 - RNA, 22 nt, Human
gcuccagcuccauaaacauaag

SEQ ID NO: 110190 - RNA, 22 nt, Human
gcucuagcuggcgcugaccugg

SEQ ID NO: 110191 - RNA, 22 nt, Human
gcauggaaaagggaugcuaacu

SEQ ID NO: 110192 - RNA, 22 nt, Human
ggcagggagagcgccgccaugc

SEQ ID NO: 110193 - RNA, 22 nt, Human
cacuaggauccuucuucuucuu

SEQ ID NO: 110194 - RNA, 22 nt, Human
gagcaggcuggcagggccaggg

SEQ ID NO: 110195 - RNA, 22 nt, Human
aggcgagcgcggccggugcccc

SEQ ID NO: 110196 - RNA, 22 nt, Human
caaaaauacuugccuguaucug

SEQ ID NO: 110197 - RNA, 22 nt, Human
uuagaaauguccuacuaauaug

SEQ ID NO: 110198 - RNA, 22 nt, Human
gccaggccuggguggagcgcuc

SEQ ID NO: 110199 - RNA, 22 nt, Human
auggaggaugugcagcaugggc

SEQ ID NO: 110200 - RNA, 22 nt, Human
agaguucuauccagacucaugu

SEQ ID NO: 110201 - RNA, 22 nt, Human
uacaaauugccugacggcaggu

SEQ ID NO: 110202 - RNA, 21 nt, Human
uuucauuaguacaucaauuug

SEQ ID NO: 110203 - RNA, 22 nt, Human
uuauaucagaaggugagauuga

SEQ ID NO: 110204 - RNA, 22 nt, Human
cccagaccagagugccuggacg

SEQ ID NO: 110205 - RNA, 22 nt, Human
aucuucuuucaucagccccuca

SEQ ID NO: 110206 - RNA, 22 nt, Human
uuuugaauaauucagaaacagc

SEQ ID NO: 110207 - RNA, 22 nt, Human
gaggcaggcggggcccaggugg

SEQ ID NO: 110208 - RNA, 22 nt, Human
uguacauacauagauauacaca

SEQ ID NO: 110209 - RNA, 22 nt, Human
aauauuuaaauagaauuacauc

SEQ ID NO: 110210 - RNA, 22 nt, Human
uuuuaaauaaacuacacugauu

SEQ ID NO: 110211 - RNA, 22 nt, Human
uggaaaauuuagaaagauuuau

SEQ ID NO: 110212 - RNA, 17 nt, Human
ucuuuuacuuucucucc

SEQ ID NO: 110213 - RNA, 22 nt, Human
gagcuggacauacaggaaacca

SEQ ID NO: 110214 - RNA, 22 nt, Human
ggaggcggaaguccaagcaggu

SEQ ID NO: 110215 - RNA, 20 nt, Human
ucugugugccaucaccuaac

SEQ ID NO: 110216 - RNA, 22 nt, Human
auuaauaucaauauauuauaug

SEQ ID NO: 110217 - RNA, 22 nt, Human
uccacaaagucuaugagaguug

SEQ ID NO: 110218 - RNA, 22 nt, Human
ggagccuuccgagucccagguu

SEQ ID NO: 110219 - RNA, 19 nt, Human
acuggggcaggcugggcuu

SEQ ID NO: 110220 - RNA, 22 nt, Human
ucgagcgcucccugugcucucg

SEQ ID NO: 110221 - RNA, 22 nt, Human
gccugggguuugcggggcugca

SEQ ID NO: 110222 - RNA, 22 nt, Human
acucacuguuuugaaauugaac

SEQ ID NO: 110223 - RNA, 22 nt, Human
ccauuucacaucccugacaugu

SEQ ID NO: 110224 - RNA, 22 nt, Human
uucccagggaucucuaguauuu

SEQ ID NO: 110225 - RNA, 22 nt, Human
ccagcugggucccugcuggggc

SEQ ID NO: 110226 - RNA, 22 nt, Human
uuauuuucgugugugugugugu

SEQ ID NO: 110227 - RNA, 22 nt, Human
cuuuuuuucuccauauuucugg

SEQ ID NO: 110228 - RNA, 22 nt, Human
aggcaguguguagcuggaagag

SEQ ID NO: 110229 - RNA, 22 nt, Human
uaagggagcagaagcugugaaa

SEQ ID NO: 110230 - RNA, 22 nt, Human
agggaguuccgaucugugcacc

SEQ ID NO: 110231 - RNA, 22 nt, Human
agagggagagaccuccgugccu

SEQ ID NO: 110232 - RNA, 22 nt, Human
uuuuucuccucucucuuucauu

SEQ ID NO: 110233 - RNA, 22 nt, Human
uggucuuuccuucauuguccag

SEQ ID NO: 110234 - RNA, 22 nt, Human
uuuuuaagguuuguuuauauau

SEQ ID NO: 110235 - RNA, 22 nt, Human
gcaggccgauuuguuagaaguc

SEQ ID NO: 110236 - RNA, 22 nt, Human
uuuuccuucuuccugccuugcc

SEQ ID NO: 110237 - RNA, 22 nt, Human
uacagaccaguaguucucagcg

SEQ ID NO: 110238 - RNA, 20 nt, Human
aaaaacaguaaugcugaaga

SEQ ID NO: 110239 - RNA, 22 nt, Human
auuucacucuuaauugcuuccu

SEQ ID NO: 110240 - RNA, 22 nt, Human
uugaaaauuaauagguguacaa

SEQ ID NO: 110241 - RNA, 22 nt, Human
cuucuuuuggggaugaaaaugg

SEQ ID NO: 110242 - RNA, 22 nt, Human
cagacagaaggcuccuugaggu

SEQ ID NO: 110243 - RNA, 20 nt, Human
uucacagaucucuaacugag

SEQ ID NO: 110244 - RNA, 22 nt, Human
ggagaggaaguuuaaagaauug

SEQ ID NO: 110245 - RNA, 22 nt, Human
gagcgcacagaaggaagcagcc

SEQ ID NO: 110246 - RNA, 22 nt, Human
uuuaaauuucugaaucuugagg

SEQ ID NO: 110247 - RNA, 22 nt, Human
uuucuauauucaguuucauaaa

SEQ ID NO: 110248 - RNA, 22 nt, Human
aaauauauauaauauauauauu

SEQ ID NO: 110249 - RNA, 22 nt, Human
caaaaaauccauagaaagaggu

SEQ ID NO: 110250 - RNA, 22 nt, Human
ugcagcuuuugguuucuagaug

SEQ ID NO: 110251 - RNA, 22 nt, Human
uauuuucucugccacacuucca

SEQ ID NO: 110252 - RNA, 22 nt, Human
cauggcaggugcagauucugug

SEQ ID NO: 110253 - RNA, 22 nt, Human
uauuuuaaaagcauuaauucuu

SEQ ID NO: 110254 - RNA, 22 nt, Human
agauuuucuuuuccaucuuugu

SEQ ID NO: 110255 - RNA, 22 nt, Human
gguuuucacgauccucccuuuu

SEQ ID NO: 110256 - RNA, 22 nt, Human
uuuuaaauggcuuuuacuuuuc

SEQ ID NO: 110257 - RNA, 22 nt, Human
auagaugacaguuaggaagcug

SEQ ID NO: 110258 - RNA, 22 nt, Human
auacauauaugcacauuaauau

SEQ ID NO: 110259 - RNA, 22 nt, Human
gagcagcucgagaaggaagcag

SEQ ID NO: 110260 - RNA, 22 nt, Human
gcuuauuagguuauuucaagga

SEQ ID NO: 110261 - RNA, 22 nt, Human
cacugguugccucuuucuguuc

SEQ ID NO: 110262 - RNA, 22 nt, Human
gggggagcuacaggucccuugg

SEQ ID NO: 110263 - RNA, 22 nt, Human
gcgcgccugccucccgcggugc

SEQ ID NO: 110264 - RNA, 22 nt, Human
ggcuagggaucuagaccaggac

SEQ ID NO: 110265 - RNA, 22 nt, Human
ucuuuuaucuguuguguaacaa

SEQ ID NO: 110266 - RNA, 22 nt, Human
cccuguccuucccuccaucuga

SEQ ID NO: 110267 - RNA, 22 nt, Human
aaaacauuuaggguuuuuuuua

SEQ ID NO: 110268 - RNA, 22 nt, Human
cccagcgccugcccuccgccgc

SEQ ID NO: 110269 - RNA, 22 nt, Human
gcacaaaagguacuucauguag

SEQ ID NO: 110270 - RNA, 20 nt, Human
cuggaguguagcaguggcug

SEQ ID NO: 110271 - RNA, 22 nt, Human
ucuucuuugugguugcccaagg

SEQ ID NO: 110272 - RNA, 22 nt, Human
ucucaaagagcuacuggucuau

SEQ ID NO: 110273 - RNA, 22 nt, Human
cagcaugguggagcugcucuuu

SEQ ID NO: 110274 - RNA, 22 nt, Human
ugcggaaggcagcgcagggugg

SEQ ID NO: 110275 - RNA, 22 nt, Human
agggcaguuuuacugaaaggug

SEQ ID NO: 110276 - RNA, 22 nt, Human
aggccgagaugacagagccacu

SEQ ID NO: 110277 - RNA, 22 nt, Human
uuuuuaaaagaugauuuaauga

SEQ ID NO: 110278 - RNA, 22 nt, Human
ccagucuuggugucuguagcac

SEQ ID NO: 110279 - RNA, 22 nt, Human
ucucccaaaucuuucuagcaca

SEQ ID NO: 110280 - RNA, 22 nt, Human
ugcuggagucucuugacccugg

SEQ ID NO: 110281 - RNA, 22 nt, Human
cuacuucucccuagaucagaaa

SEQ ID NO: 110282 - RNA, 22 nt, Human
auaaaguaaugcauauaaugug

SEQ ID NO: 110283 - RNA, 22 nt, Human
ucuucacagaugcauauacuuc

SEQ ID NO: 110284 - RNA, 22 nt, Human
gucuuuguaguuuuaauuugag

SEQ ID NO: 110285 - RNA, 22 nt, Human
ucacucuuuaucuuuuaugucu

SEQ ID NO: 110286 - RNA, 20 nt, Human
agugauuuguuaguacauug

SEQ ID NO: 110287 - RNA, 22 nt, Human
guuuucuuguuaauuuugaacg

SEQ ID NO: 110288 - RNA, 22 nt, Human
ggugucuuugauguugggcuga

SEQ ID NO: 110289 - RNA, 22 nt, Human
cagacagagcucacaagucuuu

SEQ ID NO: 110290 - RNA, 22 nt, Human
caugccucuguuuuaguuguug

SEQ ID NO: 110291 - RNA, 22 nt, Human
uuucucuuguauuugaaucacu

SEQ ID NO: 110292 - RNA, 22 nt, Human
agauggaguccugaagccagaa

SEQ ID NO: 110293 - RNA, 22 nt, Human
augaaaacggaccagagcuauu

SEQ ID NO: 110294 - RNA, 22 nt, Human
cuaaauucuauauccuugcuuc

SEQ ID NO: 110295 - RNA, 22 nt, Human
ggcagagguagcuggaaccagg

SEQ ID NO: 110296 - RNA, 20 nt, Human
uuguacuuaugugagaagga

SEQ ID NO: 110297 - RNA, 22 nt, Human
gaggugggaggcgggccugcau

SEQ ID NO: 110298 - RNA, 22 nt, Human
gcgggcgcuguggccccggccu

SEQ ID NO: 110299 - RNA, 22 nt, Human
uguuccucuuagucuuaugugu

SEQ ID NO: 110300 - RNA, 22 nt, Human
aaacaaauccaauaauaaaauu

SEQ ID NO: 110301 - RNA, 22 nt, Human
ggagccucuaaacaguuaucaa

SEQ ID NO: 110302 - RNA, 20 nt, Human
aauaaauauaacccauaauu

SEQ ID NO: 110303 - RNA, 21 nt, Human
aucagaggacaucucagggcc

SEQ ID NO: 110304 - RNA, 22 nt, Human
uugaaaaaaucugaggaggacc

SEQ ID NO: 110305 - RNA, 22 nt, Human
cagacagaguuguuucuucucc

SEQ ID NO: 110306 - RNA, 20 nt, Human
ugauuauuccaacaagaaug

SEQ ID NO: 110307 - RNA, 18 nt, Human
guucaagcauuuugcucu

SEQ ID NO: 110308 - RNA, 22 nt, Human
aacccugaacuuaguucuagga

SEQ ID NO: 110309 - RNA, 22 nt, Human
aggauggaaguaacuggauaau

SEQ ID NO: 110310 - RNA, 22 nt, Human
ggggaggugugcaggacaccuc

SEQ ID NO: 110311 - RNA, 19 nt, Human
agcggccgccgcgggcgcc

SEQ ID NO: 110312 - RNA, 22 nt, Human
gaauucuaguucuguaucucug

SEQ ID NO: 110313 - RNA, 22 nt, Human
gggcgcgccaggagcugcgcgg

SEQ ID NO: 110314 - RNA, 22 nt, Human
auucuucauguugaagcuguca

SEQ ID NO: 110315 - RNA, 20 nt, Human
ugccagagagcucauacccu

SEQ ID NO: 110316 - RNA, 22 nt, Human
aggaaauaggaccagacaaagc

SEQ ID NO: 110317 - RNA, 22 nt, Human
augcagauguagauucugaaau

SEQ ID NO: 110318 - RNA, 22 nt, Human
uacaaaugaucaucucuuugaa

SEQ ID NO: 110319 - RNA, 22 nt, Human
aauuuaauugguuuuuacuugu

SEQ ID NO: 110320 - RNA, 20 nt, Human
acuagaaagucacugggggg

SEQ ID NO: 110321 - RNA, 22 nt, Human
aggcucagcaucugauucauau

SEQ ID NO: 110322 - RNA, 22 nt, Human
gagggcugccacguugggcgag

SEQ ID NO: 110323 - RNA, 22 nt, Human
uaugugaaauggaauauagaaa

SEQ ID NO: 110324 - RNA, 23 nt, Human
ucucacucauucuccucugucca

SEQ ID NO: 110325 - RNA, 23 nt, Human
ccagcugugccuggcccaggagc

SEQ ID NO: 110326 - RNA, 22 nt, Human
gcauaauauugagaaauuauua

SEQ ID NO: 110327 - RNA, 22 nt, Human
ggcucccgugggaugguggagc

SEQ ID NO: 110328 - RNA, 23 nt, Human
uccuccccaccuuuguccccucc

SEQ ID NO: 110329 - RNA, 22 nt, Human
uauacauauacaaaugcacaua

SEQ ID NO: 110330 - RNA, 22 nt, Human
ccagcaggagacuagcaacaua

SEQ ID NO: 110331 - RNA, 23 nt, Human
aagaaugcuucugaagagcugcc

SEQ ID NO: 110332 - RNA, 22 nt, Human
cguuuugaguagauagccauau

SEQ ID NO: 110333 - RNA, 22 nt, Human
cuucuuucuuuucuucuucucu

SEQ ID NO: 110334 - RNA, 22 nt, Human
aagaggcuacagcccugugucu

SEQ ID NO: 110335 - RNA, 17 nt, Human
ucuguguccgcucaguc

SEQ ID NO: 110336 - RNA, 22 nt, Human
cuucuucaucuuuuggaggaac

SEQ ID NO: 110337 - RNA, 22 nt, Human
uggcucuucucaagcauuggcu

SEQ ID NO: 110338 - RNA, 22 nt, Human
gggcugcuccgcccgcugcgcc

SEQ ID NO: 110339 - RNA, 22 nt, Human
cauuucaaacaguuacagcugc

SEQ ID NO: 110340 - RNA, 22 nt, Human
uucauuuccauuuuauagauaa

SEQ ID NO: 110341 - RNA, 22 nt, Human
gcccagccucagggcaucagcu

SEQ ID NO: 110342 - RNA, 22 nt, Human
gcucuucuaaguuuacccuucc

SEQ ID NO: 110343 - RNA, 21 nt, Human
aggugaaggcgagggggacag

SEQ ID NO: 110344 - RNA, 22 nt, Human
ggggaagugguggggcuccgag

SEQ ID NO: 110345 - RNA, 22 nt, Human
gaauaagaauccacuucuggca

SEQ ID NO: 110346 - RNA, 20 nt, Human
gacaugagggagcaaagagc

SEQ ID NO: 110347 - RNA, 22 nt, Human
acuucuuuugcaugauucuuua

SEQ ID NO: 110348 - RNA, 22 nt, Human
ucccaaguguuuggcgaggaga

SEQ ID NO: 110349 - RNA, 22 nt, Human
auuauaauucauuaggcuuagu

SEQ ID NO: 110350 - RNA, 22 nt, Human
cuguuaauugugaauuuuacau

SEQ ID NO: 110351 - RNA, 22 nt, Human
cuccaugagccaggagggcuac

SEQ ID NO: 110352 - RNA, 22 nt, Human
aaauucuuccaggaggaaauac

SEQ ID NO: 110353 - RNA, 22 nt, Human
ucuugugguggaucccucauuu

SEQ ID NO: 110354 - RNA, 22 nt, Human
uuggugauguagcagcaauugu

SEQ ID NO: 110355 - RNA, 22 nt, Human
uuucacuucgaucagaguuuuu

SEQ ID NO: 110356 - RNA, 22 nt, Human
uucucugcgcuccggcccaguu

SEQ ID NO: 110357 - RNA, 22 nt, Human
gaggcuccgccggggcgggccg

SEQ ID NO: 110358 - RNA, 22 nt, Human
gccagggcucgagcaggccagc

SEQ ID NO: 110359 - RNA, 22 nt, Human
ugugaagaauuaaugugaauca

SEQ ID NO: 110360 - RNA, 22 nt, Human
ugccagcuccgaggagcugcag

SEQ ID NO: 110361 - RNA, 22 nt, Human
agaucugucaccauccuggagc

SEQ ID NO: 110362 - RNA, 22 nt, Human
aggggcagaggaugauggaaga

SEQ ID NO: 110363 - RNA, 22 nt, Human
augcugugccuggaaagcggcu

SEQ ID NO: 110364 - RNA, 22 nt, Human
auuuuucuuucacauuuucuua

SEQ ID NO: 110365 - RNA, 22 nt, Human
aggggaggggaguaucaggauu

SEQ ID NO: 110366 - RNA, 22 nt, Human
caaaucuguuaauuucaaguug

SEQ ID NO: 110367 - RNA, 23 nt, Human
auuuccuaaaagauaaucauuac

SEQ ID NO: 110368 - RNA, 22 nt, Human
gggggacagugugccuggugug

SEQ ID NO: 110369 - RNA, 22 nt, Human
uuuuuggacccaucuucuuuuu

SEQ ID NO: 110370 - RNA, 22 nt, Human
uggcucaguaaucgagucuccu

SEQ ID NO: 110371 - RNA, 19 nt, Human
acugggaugggcagugcca

SEQ ID NO: 110372 - RNA, 23 nt, Human
aaguggugacugugcuacugaga

SEQ ID NO: 110373 - RNA, 22 nt, Human
auggagugggaggacaugaagg

SEQ ID NO: 110374 - RNA, 22 nt, Human
agugccaucuuuaacuguccca

SEQ ID NO: 110375 - RNA, 22 nt, Human
cuguggcuaggaagcuguggga

SEQ ID NO: 110376 - RNA, 22 nt, Human
aauaucuugaguuauaaauuca

SEQ ID NO: 110377 - RNA, 22 nt, Human
uucuagcucauggugacagauc

SEQ ID NO: 110378 - RNA, 22 nt, Human
uauguuuugcaaauaucaaaca

SEQ ID NO: 110379 - RNA, 22 nt, Human
uuggaggcagagucuugcugag

SEQ ID NO: 110380 - RNA, 22 nt, Human
gagcuggagaaacacauaagaa

SEQ ID NO: 110381 - RNA, 23 nt, Human
uggaaguugagagucugcuuugu

SEQ ID NO: 110382 - RNA, 22 nt, Human
aaggucuucgaaccuuauguua

SEQ ID NO: 110383 - RNA, 22 nt, Human
uguguuguuggggauguuuuca

SEQ ID NO: 110384 - RNA, 22 nt, Human
auauauguauauaugugugugu

SEQ ID NO: 110385 - RNA, 22 nt, Human
agaaccaauacuacagcaagua

SEQ ID NO: 110386 - RNA, 22 nt, Human
gaggagggagcuggaagcucuu

SEQ ID NO: 110387 - RNA, 22 nt, Human
ggccugcuaccagcugugaccu

SEQ ID NO: 110388 - RNA, 22 nt, Human
augcaaaaucuuauuuuuucua

SEQ ID NO: 110389 - RNA, 22 nt, Human
cccuguccugcuaggcccuggu

SEQ ID NO: 110390 - RNA, 22 nt, Human
ugcuuucagauaucuguuucaa

SEQ ID NO: 110391 - RNA, 22 nt, Human
uauaaagaccuuauccuucaua

SEQ ID NO: 110392 - RNA, 22 nt, Human
uuuguuaugguuggaagcagga

SEQ ID NO: 110393 - RNA, 22 nt, Human
agagcuccaggguuuuguagug

SEQ ID NO: 110394 - RNA, 22 nt, Human
aaagggagauaaaguaauuuua

SEQ ID NO: 110395 - RNA, 22 nt, Human
caagggcagaggcagggccccg

SEQ ID NO: 110396 - RNA, 22 nt, Human
ggaaguggauucagggcugcua

SEQ ID NO: 110397 - RNA, 21 nt, Human
uggcaggcagcuggaagcuug

SEQ ID NO: 110398 - RNA, 22 nt, Human
gaggcucagagggacuuucaag

SEQ ID NO: 110399 - RNA, 22 nt, Human
gagaacagauaugaugacuuca

SEQ ID NO: 110400 - RNA, 22 nt, Human
ugacuaauacagaaacuacaag

SEQ ID NO: 110401 - RNA, 20 nt, Human
uuuuuuaaauagagcuguug

SEQ ID NO: 110402 - RNA, 22 nt, Human
gcuguguaugaugcaggcaccu

SEQ ID NO: 110403 - RNA, 18 nt, Human
uuuaauaagccuguuaug

SEQ ID NO: 110404 - RNA, 22 nt, Human
ugcccacuucaaaaucuucauu

SEQ ID NO: 110405 - RNA, 22 nt, Human
uccuuuauuuaugggcagugua

SEQ ID NO: 110406 - RNA, 22 nt, Human
acuggguuguuugucucaugag

SEQ ID NO: 110407 - RNA, 22 nt, Human
uucauagaagggaguuuuuccu

SEQ ID NO: 110408 - RNA, 22 nt, Human
aaauguaaacuguauuuauaaa

SEQ ID NO: 110409 - RNA, 22 nt, Human
augggagggugaggaggcagcu

SEQ ID NO: 110410 - RNA, 22 nt, Human
uuguuuucuaguguuuugaaua

SEQ ID NO: 110411 - RNA, 22 nt, Human
augcuuucucuucuauuucuca

SEQ ID NO: 110412 - RNA, 22 nt, Human
ggcaaggaagaaagcagaaguu

SEQ ID NO: 110413 - RNA, 22 nt, Human
guacauauccuuuacguuuugu

SEQ ID NO: 110414 - RNA, 22 nt, Human
acucugcaguaaggaauuguuu

SEQ ID NO: 110415 - RNA, 22 nt, Human
uaauuccacacucccgcaagcg

SEQ ID NO: 110416 - RNA, 22 nt, Human
gcuggaaauaacuuguguagaa

SEQ ID NO: 110417 - RNA, 22 nt, Human
uguugaaacagcuauugacuuu

SEQ ID NO: 110418 - RNA, 22 nt, Human
aggugagaacguggaggggcgg

SEQ ID NO: 110419 - RNA, 23 nt, Human
uuucugaguuuuuuaaaagucca

SEQ ID NO: 110420 - RNA, 22 nt, Human
cagcuuguucugaccugugauu

SEQ ID NO: 110421 - RNA, 18 nt, Human
ccuccccuguggaggucc

SEQ ID NO: 110422 - RNA, 22 nt, Human
uuuacaaggcaguuauuuuccu

SEQ ID NO: 110423 - RNA, 22 nt, Human
ucuuggucccugagcucuuuca

SEQ ID NO: 110424 - RNA, 20 nt, Human
gcucuucuccgggucugccu

SEQ ID NO: 110425 - RNA, 21 nt, Human
acugggcuagccugacuucug

SEQ ID NO: 110426 - RNA, 22 nt, Human
uguauuuuuucccugaaauaaa

SEQ ID NO: 110427 - RNA, 22 nt, Human
uacagcuuccucuaugguggcc

SEQ ID NO: 110428 - RNA, 22 nt, Human
gggcaagaagcuggaagcauuc

SEQ ID NO: 110429 - RNA, 22 nt, Human
cuccccuuauuccucaacauga

SEQ ID NO: 110430 - RNA, 22 nt, Human
uucugcuuuaaagcucauguuu

SEQ ID NO: 110431 - RNA, 22 nt, Human
guuuccaggcuuugguaugguu

SEQ ID NO: 110432 - RNA, 20 nt, Human
uucacagaggacucagguca

SEQ ID NO: 110433 - RNA, 22 nt, Human
ucaccauguuuucauaggaaca

SEQ ID NO: 110434 - RNA, 22 nt, Human
gcagggcucuggagucaggcug

SEQ ID NO: 110435 - RNA, 22 nt, Human
gauuuuaaaagauguauaaggu

SEQ ID NO: 110436 - RNA, 22 nt, Human
uucuaauauuaugauuucuaag

SEQ ID NO: 110437 - RNA, 21 nt, Human
uccccugugccuggcauacag

SEQ ID NO: 110438 - RNA, 22 nt, Human
cuggaagcgucggaggaagggc

SEQ ID NO: 110439 - RNA, 22 nt, Human
ccaggcucaccuggagccccug

SEQ ID NO: 110440 - RNA, 18 nt, Human
ggccucagccuggccgga

SEQ ID NO: 110441 - RNA, 22 nt, Human
uuucuggacuaaagggagagau

SEQ ID NO: 110442 - RNA, 22 nt, Human
uggagccuugugagaccacaau

SEQ ID NO: 110443 - RNA, 22 nt, Human
ugggcagggagcuggaaccaca

SEQ ID NO: 110444 - RNA, 22 nt, Human
uauauaauacacaaauauguac

SEQ ID NO: 110445 - RNA, 22 nt, Human
gcucagagaaaacuggggcuug

SEQ ID NO: 110446 - RNA, 22 nt, Human
gaggcuugccacuguccauggc

SEQ ID NO: 110447 - RNA, 22 nt, Human
cggcugcagcggagcaggcugg

SEQ ID NO: 110448 - RNA, 22 nt, Human
uugucuuucguauggaacacua

SEQ ID NO: 110449 - RNA, 22 nt, Human
guucuucagcccucagguccua

SEQ ID NO: 110450 - RNA, 22 nt, Human
gggggcagguuccaggccagcu

SEQ ID NO: 110451 - RNA, 22 nt, Human
cagagagcguccauccggugcc

SEQ ID NO: 110452 - RNA, 22 nt, Human
auauuuuacagcucucguugaa

SEQ ID NO: 110453 - RNA, 22 nt, Human
gagguagaggaaaagauuauca

SEQ ID NO: 110454 - RNA, 22 nt, Human
ggggcucauuugcaggggggag

SEQ ID NO: 110455 - RNA, 22 nt, Human
uuuuaaaguaauugaagcuugu

SEQ ID NO: 110456 - RNA, 22 nt, Human
ggcucacuguaccugccgccgc

SEQ ID NO: 110457 - RNA, 22 nt, Human
ucccuugacauuacuugggagg

SEQ ID NO: 110458 - RNA, 21 nt, Human
agccgggacaacguggacccc

SEQ ID NO: 110459 - RNA, 20 nt, Human
ucucuuuuucuucuuuucuc

SEQ ID NO: 110460 - RNA, 22 nt, Human
uuuguauuguuuauuucauuuu

SEQ ID NO: 110461 - RNA, 22 nt, Human
ccaggcuccccaggaggcccuu

SEQ ID NO: 110462 - RNA, 22 nt, Human
gcagagcugucuaagucacuuc

SEQ ID NO: 110463 - RNA, 22 nt, Human
aaauguauuagccuaugugaga

SEQ ID NO: 110464 - RNA, 22 nt, Human
guccccugcguguucauccugg

SEQ ID NO: 110465 - RNA, 22 nt, Human
aagagaggcccaaguggcuggc

SEQ ID NO: 110466 - RNA, 20 nt, Human
cuccuccccucggccccacc

SEQ ID NO: 110467 - RNA, 22 nt, Human
uucacuuuuucucugcuugaga

SEQ ID NO: 110468 - RNA, 22 nt, Human
cccgccggccacaccggccgcc

SEQ ID NO: 110469 - RNA, 22 nt, Human
uucacuguucuuagagaagacc

SEQ ID NO: 110470 - RNA, 22 nt, Human
gcuguugugaggaucagcauau

SEQ ID NO: 110471 - RNA, 22 nt, Human
aaugaauaaauuuuaaagacag

SEQ ID NO: 110472 - RNA, 22 nt, Human
aggggaggcugggcuggggggc

SEQ ID NO: 110473 - RNA, 22 nt, Human
gcucagcuggagagggacgggu

SEQ ID NO: 110474 - RNA, 22 nt, Human
ggcagcagaacuggcccuguau

SEQ ID NO: 110475 - RNA, 22 nt, Human
aguuuccacuggagacacugug

SEQ ID NO: 110476 - RNA, 22 nt, Human
agcgcucauuuuccuccugcuc

SEQ ID NO: 110477 - RNA, 22 nt, Human
cuggggccccagcucggccccu

SEQ ID NO: 110478 - RNA, 22 nt, Human
cacauuuuccagaagaaucaga

SEQ ID NO: 110479 - RNA, 18 nt, Human
auucauuugcguuuggcu

SEQ ID NO: 110480 - RNA, 22 nt, Human
uacauuugauuuuugcuucuuu

SEQ ID NO: 110481 - RNA, 22 nt, Human
uuuuagaagcauuuaugagauu

SEQ ID NO: 110482 - RNA, 22 nt, Human
ucagucucuggggcuucuguuu

SEQ ID NO: 110483 - RNA, 22 nt, Human
ucuucaaauacagucauauuga

SEQ ID NO: 110484 - RNA, 22 nt, Human
gaggggaacaggcauucuuaag

SEQ ID NO: 110485 - RNA, 22 nt, Human
aggcauauaguguuuaaaaaaa

SEQ ID NO: 110486 - RNA, 22 nt, Human
ucaccaugcccuucucugcucu

SEQ ID NO: 110487 - RNA, 22 nt, Human
agccuggagcaggcucugcucu

SEQ ID NO: 110488 - RNA, 23 nt, Human
aggcugcagaagaauagggucau

SEQ ID NO: 110489 - RNA, 22 nt, Human
agccggccucggacagagggag

SEQ ID NO: 110490 - RNA, 19 nt, Human
augaaauagcauuuucuga

SEQ ID NO: 110491 - RNA, 22 nt, Human
guccuguguaaguacuugcuca

SEQ ID NO: 110492 - RNA, 22 nt, Human
ucgagcucagcagggaggugcg

SEQ ID NO: 110493 - RNA, 19 nt, Human
uucuuuccccaccccuacc

SEQ ID NO: 110494 - RNA, 22 nt, Human
ugugucuuuggcgaugucugga

SEQ ID NO: 110495 - RNA, 18 nt, Human
uucucucuggauaguagu

SEQ ID NO: 110496 - RNA, 22 nt, Human
ugcuggaguggcacuguguggc

SEQ ID NO: 110497 - RNA, 22 nt, Human
aggcagagaggucuuccuggaa

SEQ ID NO: 110498 - RNA, 22 nt, Human
aaaucauagccaugaacauuug

SEQ ID NO: 110499 - RNA, 22 nt, Human
agcucuucugacucuaggcuca

SEQ ID NO: 110500 - RNA, 22 nt, Human
auguuccaugacuaugcaugaa

SEQ ID NO: 110501 - RNA, 22 nt, Human
gcaggggguaaggggcagggcu

SEQ ID NO: 110502 - RNA, 22 nt, Human
ucccugcugggcgaucuucucu

SEQ ID NO: 110503 - RNA, 22 nt, Human
uuaaacauuuccacuugccagu

SEQ ID NO: 110504 - RNA, 22 nt, Human
guugagaaucucuagcuuagga

SEQ ID NO: 110505 - RNA, 22 nt, Human
gaggugauuccucccauguaau

SEQ ID NO: 110506 - RNA, 22 nt, Human
ggcagcgcuuggcugcucgaca

SEQ ID NO: 110507 - RNA, 22 nt, Human
uggaagugggcaucaccaucca

SEQ ID NO: 110508 - RNA, 22 nt, Human
uucuucuucuuccucauccuca

SEQ ID NO: 110509 - RNA, 22 nt, Human
ucuuucugaugggaagggucaa

SEQ ID NO: 110510 - RNA, 22 nt, Human
uuuuguuuacauuaaauuuuga

SEQ ID NO: 110511 - RNA, 22 nt, Human
agggggaauccugcuuauggau

SEQ ID NO: 110512 - RNA, 22 nt, Human
gggggcugugugcccgcucccc

SEQ ID NO: 110513 - RNA, 22 nt, Human
uuaggggcuuaggcagaguuug

SEQ ID NO: 110514 - RNA, 22 nt, Human
cagcuggggagagacauggcag

SEQ ID NO: 110515 - RNA, 22 nt, Human
gcuuucacugcaauagaugaau

SEQ ID NO: 110516 - RNA, 21 nt, Human
caguucuaagugucaucuuuu

SEQ ID NO: 110517 - RNA, 22 nt, Human
cugguuuauuucauaguuuguu

SEQ ID NO: 110518 - RNA, 22 nt, Human
auacaucuuaacgcgcucuugg

SEQ ID NO: 110519 - RNA, 22 nt, Human
agccuggacagcuacggagaac

SEQ ID NO: 110520 - RNA, 22 nt, Human
cagcccuguugcgcuuccggcg

SEQ ID NO: 110521 - RNA, 22 nt, Human
ugagggaguguggauacaguag

SEQ ID NO: 110522 - RNA, 22 nt, Human
ugcuuggauuuccaaaugguuu

SEQ ID NO: 110523 - RNA, 22 nt, Human
aaacuuuaucaaguacucuuca

SEQ ID NO: 110524 - RNA, 22 nt, Human
uuuucauuguuaguuucuccuu

SEQ ID NO: 110525 - RNA, 22 nt, Human
ggcuggagcaggcugcacagug

SEQ ID NO: 110526 - RNA, 22 nt, Human
uggggcugguaccguaauauau

SEQ ID NO: 110527 - RNA, 22 nt, Human
uaauaaaaauuuaauucacauu

SEQ ID NO: 110528 - RNA, 22 nt, Human
uaauauaacugccaguuaaggu

SEQ ID NO: 110529 - RNA, 21 nt, Human
aggcuuggaucuagacaggcc

SEQ ID NO: 110530 - RNA, 22 nt, Human
ugcuuucaaaacucagaggaau

SEQ ID NO: 110531 - RNA, 22 nt, Human
uggagucuugcuuugggagugc

SEQ ID NO: 110532 - RNA, 22 nt, Human
agcggcgcgucuccgagcugga

SEQ ID NO: 110533 - RNA, 22 nt, Human
uuuucucuuugcuucucuaaaa

SEQ ID NO: 110534 - RNA, 22 nt, Human
auaaaucaagggcaguauuucc

SEQ ID NO: 110535 - RNA, 22 nt, Human
uuauuuuuguuuguuaagccua

SEQ ID NO: 110536 - RNA, 22 nt, Human
gcucucucuucugcaggccuua

SEQ ID NO: 110537 - RNA, 19 nt, Human
agcgccucuacugcaugga

SEQ ID NO: 110538 - RNA, 22 nt, Human
uuucaugauuaacuuagugaau

SEQ ID NO: 110539 - RNA, 22 nt, Human
gggcagagagcuggaacuccuu

SEQ ID NO: 110540 - RNA, 17 nt, Human
auucaugaacauguccu

SEQ ID NO: 110541 - RNA, 22 nt, Human
auguaugagagauucuuuuauu

SEQ ID NO: 110542 - RNA, 22 nt, Human
aaagcgagccggcuuggaggga

SEQ ID NO: 110543 - RNA, 22 nt, Human
uuauuuuuaggaauguagaggu

SEQ ID NO: 110544 - RNA, 22 nt, Human
gaauauuuaucucagcugcaga

SEQ ID NO: 110545 - RNA, 22 nt, Human
ugguccucacccuacccagcug

SEQ ID NO: 110546 - RNA, 21 nt, Human
ugccccucuuuucuuuccuuc

SEQ ID NO: 110547 - RNA, 22 nt, Human
cacagcuggggaagcugaggcc

SEQ ID NO: 110548 - RNA, 22 nt, Human
guuuucuccugcuauacagugc

SEQ ID NO: 110549 - RNA, 22 nt, Human
aaauauagugacacuuauaguc

SEQ ID NO: 110550 - RNA, 22 nt, Human
uuuguuuccagccuuuugucuu

SEQ ID NO: 110551 - RNA, 22 nt, Human
ucuggaggucucagggcgggaa

SEQ ID NO: 110552 - RNA, 22 nt, Human
gucuuucuuuuacauauuugug

SEQ ID NO: 110553 - RNA, 22 nt, Human
aguaaaugaaagcaauuuuaga

SEQ ID NO: 110554 - RNA, 20 nt, Human
ccugggcuccaggagccccg

SEQ ID NO: 110555 - RNA, 22 nt, Human
aagaaggaaggcaagagauggg

SEQ ID NO: 110556 - RNA, 22 nt, Human
uuuuucuuugcuuuccacuggc

SEQ ID NO: 110557 - RNA, 22 nt, Human
aaauauuugaaugguguaagau

SEQ ID NO: 110558 - RNA, 22 nt, Human
guucuucagauuccauuucagu

SEQ ID NO: 110559 - RNA, 22 nt, Human
uggcagcucauuuggaaaugga

SEQ ID NO: 110560 - RNA, 22 nt, Human
ccucaggaauuuauucuucugu

SEQ ID NO: 110561 - RNA, 22 nt, Human
acauuuuaaaaacaguaccugg

SEQ ID NO: 110562 - RNA, 22 nt, Human
uuuuaaaagguugcuguuauaa

SEQ ID NO: 110563 - RNA, 22 nt, Human
uuuugcuucuaguauauuuuuu

SEQ ID NO: 110564 - RNA, 22 nt, Human
uucuuuuaauagagauccugug

SEQ ID NO: 110565 - RNA, 23 nt, Human
aaggugaagccaccaggugagga

SEQ ID NO: 110566 - RNA, 22 nt, Human
uggggagacauggaguaaaaga

SEQ ID NO: 110567 - RNA, 22 nt, Human
auauuugucuguuuuaguggca

SEQ ID NO: 110568 - RNA, 19 nt, Human
caggucuucuuggaggacu

SEQ ID NO: 110569 - RNA, 22 nt, Human
ggagagcuagugagcuggaggu

SEQ ID NO: 110570 - RNA, 22 nt, Human
ugggcagggauuuggggaaacu

SEQ ID NO: 110571 - RNA, 22 nt, Human
gggaugaaugccuggcuccccc

SEQ ID NO: 110572 - RNA, 22 nt, Human
cggcgccccgcgcgggcggcuc

SEQ ID NO: 110573 - RNA, 22 nt, Human
ggcugggagguggcgaggaggc

SEQ ID NO: 110574 - RNA, 22 nt, Human
caggggcuccaggugagccugg

SEQ ID NO: 110575 - RNA, 22 nt, Human
uugggauucugucagugugugu

SEQ ID NO: 110576 - RNA, 22 nt, Human
gauaaauaguguuuggggacau

SEQ ID NO: 110577 - RNA, 22 nt, Human
gaggaagucuuaucuggaugca

SEQ ID NO: 110578 - RNA, 22 nt, Human
aguggagguuacagcuguacau

SEQ ID NO: 110579 - RNA, 22 nt, Human
uucuugugugaauauaauuaca

SEQ ID NO: 110580 - RNA, 22 nt, Human
agcaaaauuccaaaaugcuaau

SEQ ID NO: 110581 - RNA, 22 nt, Human
gcuguggacacagcucucuuca

SEQ ID NO: 110582 - RNA, 22 nt, Human
gcuggccugcgagggcaggcug

SEQ ID NO: 110583 - RNA, 22 nt, Human
gcagggcucagccgcucccacc

SEQ ID NO: 110584 - RNA, 22 nt, Human
ucuucuuuccuuuugugcauuu

SEQ ID NO: 110585 - RNA, 22 nt, Human
agggcaggguuggugcuggugc

SEQ ID NO: 110586 - RNA, 22 nt, Human
cagcuucaugacaaacaguuuu

SEQ ID NO: 110587 - RNA, 22 nt, Human
uuauuuaaguauuuauugaagu

SEQ ID NO: 110588 - RNA, 22 nt, Human
cgccgccgccugcccgcgcccc

SEQ ID NO: 110589 - RNA, 22 nt, Human
cagagaggagcacaaagugaag

SEQ ID NO: 110590 - RNA, 22 nt, Human
uaguuucuucaacugucccagc

SEQ ID NO: 110591 - RNA, 22 nt, Human
caggccccagggacugggcgcu

SEQ ID NO: 110592 - RNA, 22 nt, Human
cgguggcccauuguacgcagcu

SEQ ID NO: 110593 - RNA, 22 nt, Human
accuccauggcccacaucuagu

SEQ ID NO: 110594 - RNA, 22 nt, Human
ugguccaccgccucauucucug

SEQ ID NO: 110595 - RNA, 22 nt, Human
ggcugugaaguacguugaaggu

SEQ ID NO: 110596 - RNA, 22 nt, Human
auuugccaguuacucacaccac

SEQ ID NO: 110597 - RNA, 22 nt, Human
aagccuccgugcugcuggaucu

SEQ ID NO: 110598 - RNA, 22 nt, Human
cuucucuuggguguggugucuu

SEQ ID NO: 110599 - RNA, 22 nt, Human
uauuuuuaccuaauuuaugaga

SEQ ID NO: 110600 - RNA, 22 nt, Human
cucucugcugucuuucgggaaa

SEQ ID NO: 110601 - RNA, 22 nt, Human
cucacugucagcugcagggcuu

SEQ ID NO: 110602 - RNA, 22 nt, Human
augggagggagcagugaguguu

SEQ ID NO: 110603 - RNA, 22 nt, Human
uagaccugugggggcagcgggc

SEQ ID NO: 110604 - RNA, 22 nt, Human
ccagccugagcuugcugcccuc

SEQ ID NO: 110605 - RNA, 22 nt, Human
cagcucugcugggaggaugcag

SEQ ID NO: 110606 - RNA, 22 nt, Human
acagagcucccagccaucuccu

SEQ ID NO: 110607 - RNA, 22 nt, Human
uucaaacaguguagaauauaug

SEQ ID NO: 110608 - RNA, 22 nt, Human
aaauuuauaacuuaaagugaau

SEQ ID NO: 110609 - RNA, 22 nt, Human
acuggagcccguggaggcgcag

SEQ ID NO: 110610 - RNA, 22 nt, Human
ggcuguggcagcuggaaguggu

SEQ ID NO: 110611 - RNA, 22 nt, Human
gaauuagacggcaucacauggg

SEQ ID NO: 110612 - RNA, 22 nt, Human
ccugccagaaaagagggaguuc

SEQ ID NO: 110613 - RNA, 22 nt, Human
ccuggggcucugcacagagcag

SEQ ID NO: 110614 - RNA, 20 nt, Human
agaaggagagaugaggcaaa

SEQ ID NO: 110615 - RNA, 22 nt, Human
gugauggucgagcgcuuguugu

SEQ ID NO: 110616 - RNA, 22 nt, Human
uggcgcgcucgcucucgcugag

SEQ ID NO: 110617 - RNA, 22 nt, Human
agcggccucgcugccugcucag

SEQ ID NO: 110618 - RNA, 22 nt, Human
cagcuguggagauggggugcau

SEQ ID NO: 110619 - RNA, 22 nt, Human
augaaaacgugugugugugugu

SEQ ID NO: 110620 - RNA, 22 nt, Human
uuauuuaaaauguagguuggga

SEQ ID NO: 110621 - RNA, 22 nt, Human
uuucauguuggauacuguuuca

SEQ ID NO: 110622 - RNA, 22 nt, Human
uccauuuacuauucucauaucg

SEQ ID NO: 110623 - RNA, 22 nt, Human
ggcugggaggcggaggcugaga

SEQ ID NO: 110624 - RNA, 22 nt, Human
cagcagccuccccggccgaccu

SEQ ID NO: 110625 - RNA, 22 nt, Human
gcugucccccaaagaugcuccu

SEQ ID NO: 110626 - RNA, 22 nt, Human
uucaaaaugcagaauaguuugg

SEQ ID NO: 110627 - RNA, 22 nt, Human
uggggcuccuccuggcaggagg

SEQ ID NO: 110628 - RNA, 22 nt, Human
uuauuuuuguaacacuguauag

SEQ ID NO: 110629 - RNA, 22 nt, Human
uuuaaaauguuuuauuuauuua

SEQ ID NO: 110630 - RNA, 22 nt, Human
aaacagcugcaguacacggccu

SEQ ID NO: 110631 - RNA, 20 nt, Human
cagagacaagagggaaggga

SEQ ID NO: 110632 - RNA, 22 nt, Human
uggccccauuuuucuggagccu

SEQ ID NO: 110633 - RNA, 22 nt, Human
uuccccaccagagacagagcug

SEQ ID NO: 110634 - RNA, 22 nt, Human
cccaggccguguaaucagcagc

SEQ ID NO: 110635 - RNA, 22 nt, Human
cgggagcagcucuggggcuggg

SEQ ID NO: 110636 - RNA, 22 nt, Human
gagaacaaggaagagucggcag

SEQ ID NO: 110637 - RNA, 22 nt, Human
uuauuguuuggguauaauuuga

SEQ ID NO: 110638 - RNA, 18 nt, Human
aggcuggggaucacaggg

SEQ ID NO: 110639 - RNA, 22 nt, Human
gggcgcgcggagccucgccggg

SEQ ID NO: 110640 - RNA, 22 nt, Human
ccagggcuggaggaggucagga

SEQ ID NO: 110641 - RNA, 22 nt, Human
ggaggccgugcugugcugccag

SEQ ID NO: 110642 - RNA, 22 nt, Human
cugggaccugugugccugggcc

SEQ ID NO: 110643 - RNA, 22 nt, Human
uguuuuuauucuuaauguuuca

SEQ ID NO: 110644 - RNA, 22 nt, Human
cuccuugguuccggcguuggag

SEQ ID NO: 110645 - RNA, 22 nt, Human
uuuucauagccagaaacugaaa

SEQ ID NO: 110646 - RNA, 22 nt, Human
agagacuguaaugagagguaca

SEQ ID NO: 110647 - RNA, 22 nt, Human
gcggcccggguccccagcagca

SEQ ID NO: 110648 - RNA, 22 nt, Human
agggagucuggccgucggcugg

SEQ ID NO: 110649 - RNA, 22 nt, Human
uuaauguugacacacuagcaca

SEQ ID NO: 110650 - RNA, 22 nt, Human
cuggcaguguccagcucgugau

SEQ ID NO: 110651 - RNA, 22 nt, Human
guggguauauauaugugugcug

SEQ ID NO: 110652 - RNA, 22 nt, Human
acagcucaggcccaucaacccc

SEQ ID NO: 110653 - RNA, 22 nt, Human
uacugcaguuccugcugucucc

SEQ ID NO: 110654 - RNA, 22 nt, Human
ugagagguagaacuuguagugu

SEQ ID NO: 110655 - RNA, 22 nt, Human
gugggagggaguccugggagca

SEQ ID NO: 110656 - RNA, 22 nt, Human
uauuuuauuuagguuuaguugu

SEQ ID NO: 110657 - RNA, 22 nt, Human
ugguucuagaugagaugaugag

SEQ ID NO: 110658 - RNA, 22 nt, Human
aauguaaauaauuguaaaauuu

SEQ ID NO: 110659 - RNA, 22 nt, Human
ucauuguuuacugucuuuuuuc

SEQ ID NO: 110660 - RNA, 22 nt, Human
ucuuuuucccugguuccuuuuu

SEQ ID NO: 110661 - RNA, 22 nt, Human
cuguuucucugccugcacacau

SEQ ID NO: 110662 - RNA, 20 nt, Human
uggguucaguuguuucuggc

SEQ ID NO: 110663 - RNA, 22 nt, Human
agugagaguauuaaugugaacu

SEQ ID NO: 110664 - RNA, 22 nt, Human
uuucuugugauuuugaugaacu

SEQ ID NO: 110665 - RNA, 22 nt, Human
gccagccggugaguggaagcgg

SEQ ID NO: 110666 - RNA, 22 nt, Human
ugagauguaauguaguacuuug

SEQ ID NO: 110667 - RNA, 22 nt, Human
uugucaggaacuaugauuaugc

SEQ ID NO: 110668 - RNA, 22 nt, Human
ggcuggggccuguugaagaugc

SEQ ID NO: 110669 - RNA, 22 nt, Human
ccuaggauuaaaauaauaauua

SEQ ID NO: 110670 - RNA, 22 nt, Human
uucacugugauguuuaagagaa

SEQ ID NO: 110671 - RNA, 22 nt, Human
uuuuccuuagaaauacauugau

SEQ ID NO: 110672 - RNA, 22 nt, Human
cucuuucauucuguccuuguuu

SEQ ID NO: 110673 - RNA, 22 nt, Human
ucacuguuucaccgucugaagg

SEQ ID NO: 110674 - RNA, 22 nt, Human
auuuuuauuugccuaugauaua

SEQ ID NO: 110675 - RNA, 22 nt, Human
uggguucaaauccugguuccac

SEQ ID NO: 110676 - RNA, 22 nt, Human
gggagccucccacugggggaag

SEQ ID NO: 110677 - RNA, 22 nt, Human
uauuuaaagucagcaacuuuuc

SEQ ID NO: 110678 - RNA, 17 nt, Human
ugucuuuuuccuccucc

SEQ ID NO: 110679 - RNA, 22 nt, Human
auagaagugaaaagggaugacu

SEQ ID NO: 110680 - RNA, 22 nt, Human
caggccgccacugcagcagcug

SEQ ID NO: 110681 - RNA, 22 nt, Human
agauggggccugaggacacugu

SEQ ID NO: 110682 - RNA, 22 nt, Human
aucuugaaacauauaugcauuu

SEQ ID NO: 110683 - RNA, 22 nt, Human
cucggcccuggucuuacgggac

SEQ ID NO: 110684 - RNA, 22 nt, Human
auguacugacuguacuuuuaaa

SEQ ID NO: 110685 - RNA, 22 nt, Human
uggcaaggccacaggugcaguu

SEQ ID NO: 110686 - RNA, 20 nt, Human
cuuauuuuggagaacuuuuc

SEQ ID NO: 110687 - RNA, 22 nt, Human
aacacuaaaggucaguuagaag

SEQ ID NO: 110688 - RNA, 22 nt, Human
gggucagggaggccccaccaug

SEQ ID NO: 110689 - RNA, 22 nt, Human
gaagaaggaagaucaugcuuga

SEQ ID NO: 110690 - RNA, 19 nt, Human
uuacaugacauaugaagga

SEQ ID NO: 110691 - RNA, 22 nt, Human
caauggagccaagaggaggaaa

SEQ ID NO: 110692 - RNA, 22 nt, Human
ggaggccagagaagagccaggc

SEQ ID NO: 110693 - RNA, 22 nt, Human
uuaauaaauugugguaccagag

SEQ ID NO: 110694 - RNA, 22 nt, Human
uccgggagcccccggaggagga

SEQ ID NO: 110695 - RNA, 22 nt, Human
ucugagugacguccugacagga

SEQ ID NO: 110696 - RNA, 22 nt, Human
cggaggcugcuuucuguugcua

SEQ ID NO: 110697 - RNA, 22 nt, Human
uggcgcgcagccugcuggugcu

SEQ ID NO: 110698 - RNA, 21 nt, Human
uuccuggaggcagaaacguga

SEQ ID NO: 110699 - RNA, 22 nt, Human
aagagugaguagcuugguuggu

SEQ ID NO: 110700 - RNA, 22 nt, Human
uuuacuguuuacagcuaaugca

SEQ ID NO: 110701 - RNA, 22 nt, Human
uggacacugguggauauggaau

SEQ ID NO: 110702 - RNA, 22 nt, Human
ugacuagggauauuuucuuucc

SEQ ID NO: 110703 - RNA, 22 nt, Human
cccgugggaugagaggcccugg

SEQ ID NO: 110704 - RNA, 22 nt, Human
uuuuuuuuacuccggacagcuc

SEQ ID NO: 110705 - RNA, 22 nt, Human
caggccagcuggaggggcagcu

SEQ ID NO: 110706 - RNA, 22 nt, Human
aagggagagggagaagguggga

SEQ ID NO: 110707 - RNA, 22 nt, Human
cagcacaggugugaggccugau

SEQ ID NO: 110708 - RNA, 22 nt, Human
auuuuagagaaacaaacguagg

SEQ ID NO: 110709 - RNA, 22 nt, Human
uaugggcaagagauaggugguc

SEQ ID NO: 110710 - RNA, 22 nt, Human
gugcugggaggcccaggaugga

SEQ ID NO: 110711 - RNA, 22 nt, Human
uccagcugugcuccaggaggug

SEQ ID NO: 110712 - RNA, 20 nt, Human
accccuccccacuccucgcc

SEQ ID NO: 110713 - RNA, 22 nt, Human
uucauggauuugugaaauuuag

SEQ ID NO: 110714 - RNA, 22 nt, Human
cugccucucaugccugcuugcu

SEQ ID NO: 110715 - RNA, 22 nt, Human
uauauuaaagugcuuugcagug

SEQ ID NO: 110716 - RNA, 23 nt, Human
aggcagaguccuggggcacagcc

SEQ ID NO: 110717 - RNA, 22 nt, Human
uguuggaaucuucuagucuucc

SEQ ID NO: 110718 - RNA, 22 nt, Human
ucagcucacaauguugagaaag

SEQ ID NO: 110719 - RNA, 19 nt, Human
uccaccgcgugcaccucua

SEQ ID NO: 110720 - RNA, 21 nt, Human
augcgcgguggagugagcgaa

SEQ ID NO: 110721 - RNA, 22 nt, Human
augcggcugugggggaauggga

SEQ ID NO: 110722 - RNA, 22 nt, Human
ucucugaccuccaccccaggag

SEQ ID NO: 110723 - RNA, 22 nt, Human
cauuuugguaauguucguuugc

SEQ ID NO: 110724 - RNA, 22 nt, Human
cauaaauuuuaccuuguaagug

SEQ ID NO: 110725 - RNA, 22 nt, Human
gacuggggcauuagaguagcuu

SEQ ID NO: 110726 - RNA, 22 nt, Human
gaucccagaggcggggauagga

SEQ ID NO: 110727 - RNA, 22 nt, Human
gugucacuuucaggagcucuaa

SEQ ID NO: 110728 - RNA, 22 nt, Human
gaggaggcuggagaggccagga

SEQ ID NO: 110729 - RNA, 22 nt, Human
cagggggacuuguuagguuuua

SEQ ID NO: 110730 - RNA, 22 nt, Human
ugaagacaguuuuacucaugag

SEQ ID NO: 110731 - RNA, 22 nt, Human
cuuggggauuuuaaagaccucu

SEQ ID NO: 110732 - RNA, 22 nt, Human
cggagggcccucaggacugggu

SEQ ID NO: 110733 - RNA, 22 nt, Human
ggagaggaggugagaggaagua

SEQ ID NO: 110734 - RNA, 22 nt, Human
uccucccugcacucagugaagu

SEQ ID NO: 110735 - RNA, 22 nt, Human
ggggaggguuuggaugagaguc

SEQ ID NO: 110736 - RNA, 22 nt, Human
acugucuuguuguaugugagcu

SEQ ID NO: 110737 - RNA, 22 nt, Human
cagagguagaaguagauguuug

SEQ ID NO: 110738 - RNA, 20 nt, Human
ggcagagcuaugucuguugc

SEQ ID NO: 110739 - RNA, 22 nt, Human
aucacuagaguuacauugccag

SEQ ID NO: 110740 - RNA, 22 nt, Human
uggaaggugauucucugguuaa

SEQ ID NO: 110741 - RNA, 22 nt, Human
uuggugaugcccaccuuuucau

SEQ ID NO: 110742 - RNA, 22 nt, Human
uuucuaaaaccagaguuuauaa

SEQ ID NO: 110743 - RNA, 22 nt, Human
uuuauaauuacguaaaauauuu

SEQ ID NO: 110744 - RNA, 22 nt, Human
gcuuucagggucacugucaaca

SEQ ID NO: 110745 - RNA, 22 nt, Human
uagacugagcuccuugaggaca

SEQ ID NO: 110746 - RNA, 22 nt, Human
aauaaugguuugauucucacau

SEQ ID NO: 110747 - RNA, 22 nt, Human
uuguuauaggaucagugucacu

SEQ ID NO: 110748 - RNA, 22 nt, Human
ggaaggggagcuggaaagggua

SEQ ID NO: 110749 - RNA, 22 nt, Human
acucauuuggauuuuggaguuu

SEQ ID NO: 110750 - RNA, 22 nt, Human
gugugucucaguugcuccgaag

SEQ ID NO: 110751 - RNA, 22 nt, Human
uauuucuagggcaugaaaauaa

SEQ ID NO: 110752 - RNA, 22 nt, Human
cugcaucacagcaggaggcaca

SEQ ID NO: 110753 - RNA, 22 nt, Human
ucugcaugccucaggaggccug

SEQ ID NO: 110754 - RNA, 22 nt, Human
ugcggagggagcagucggcugu

SEQ ID NO: 110755 - RNA, 22 nt, Human
gaaagggggcuuggacacuggc

SEQ ID NO: 110756 - RNA, 22 nt, Human
gucucacuucauuuucuuagcc

SEQ ID NO: 110757 - RNA, 22 nt, Human
uauauauaugcaccacaugugu

SEQ ID NO: 110758 - RNA, 22 nt, Human
guuaaaaugauuugugauuuau

SEQ ID NO: 110759 - RNA, 22 nt, Human
uaaaauaccacauauggugcuc

SEQ ID NO: 110760 - RNA, 22 nt, Human
ugagguauuuggauuuauauuu

SEQ ID NO: 110761 - RNA, 19 nt, Human
ggaacgcugggcuccccuc

SEQ ID NO: 110762 - RNA, 22 nt, Human
aagugaggagaccucuucuuca

SEQ ID NO: 110763 - RNA, 22 nt, Human
gcugguggcagagcuccgcggc

SEQ ID NO: 110764 - RNA, 22 nt, Human
aagagaggaaagggugugaggu

SEQ ID NO: 110765 - RNA, 22 nt, Human
cagcugcgcagcgccgggccug

SEQ ID NO: 110766 - RNA, 22 nt, Human
auuuauuugaagagccauugca

SEQ ID NO: 110767 - RNA, 22 nt, Human
gcgcggcgcggguccucggccu

SEQ ID NO: 110768 - RNA, 22 nt, Human
uuuuaaaacaugucaaaaugug

SEQ ID NO: 110769 - RNA, 22 nt, Human
ugaggaugagaaggaagagaag

SEQ ID NO: 110770 - RNA, 22 nt, Human
uuguuauuauuauuuucguucu

SEQ ID NO: 110771 - RNA, 22 nt, Human
aaaauaaccuucauuugcauug

SEQ ID NO: 110772 - RNA, 22 nt, Human
ugcgccccgcgggccuucgggc

SEQ ID NO: 110773 - RNA, 23 nt, Human
ugcugcgggacccgagcgcgcgc

SEQ ID NO: 110774 - RNA, 22 nt, Human
ugaaguuuagaaaaagugccuu

SEQ ID NO: 110775 - RNA, 22 nt, Human
uuuuauaauacccuugacuaau

SEQ ID NO: 110776 - RNA, 22 nt, Human
cgcuggagagcaagugcgugca

SEQ ID NO: 110777 - RNA, 22 nt, Human
uuaucuuuuaaaaacacuugug

SEQ ID NO: 110778 - RNA, 22 nt, Human
ugagguuacauuaggaauaacc

SEQ ID NO: 110779 - RNA, 22 nt, Human
ccagccugccaagcccagcccu

SEQ ID NO: 110780 - RNA, 22 nt, Human
aguaggaauucaaagagacaaa

SEQ ID NO: 110781 - RNA, 22 nt, Human
auuuuguugaaacccuuguugu

SEQ ID NO: 110782 - RNA, 22 nt, Human
aggcgaagggaccagacgguag

SEQ ID NO: 110783 - RNA, 22 nt, Human
ucagcugggagaaaguuuuagg

SEQ ID NO: 110784 - RNA, 22 nt, Human
gcucucuggccugggaggagga

SEQ ID NO: 110785 - RNA, 22 nt, Human
gggcuguggggccugcagaagg

SEQ ID NO: 110786 - RNA, 18 nt, Human
uucaggcucuugcaugaa

SEQ ID NO: 110787 - RNA, 22 nt, Human
cguggcaguagagcuggaacuu

SEQ ID NO: 110788 - RNA, 22 nt, Human
uucuugucuuuguuauguagga

SEQ ID NO: 110789 - RNA, 22 nt, Human
ggcuccucaggcugggguaagg

SEQ ID NO: 110790 - RNA, 23 nt, Human
agagggaagagcuuagaugggga

SEQ ID NO: 110791 - RNA, 22 nt, Human
uugugugugcccaccuguggcc

SEQ ID NO: 110792 - RNA, 22 nt, Human
auauucaaugaggucauauaag

SEQ ID NO: 110793 - RNA, 22 nt, Human
cuucuuaaaguugucacagcug

SEQ ID NO: 110794 - RNA, 22 nt, Human
cuccugcuuuuucuucuuccga

SEQ ID NO: 110795 - RNA, 22 nt, Human
cuggguuuggcugugcuugaau

SEQ ID NO: 110796 - RNA, 22 nt, Human
gcuguggaaaaugggucuccaa

SEQ ID NO: 110797 - RNA, 22 nt, Human
aaauauugaauuugaggaugua

SEQ ID NO: 110798 - RNA, 22 nt, Human
cuuggcuccuucacagggagau

SEQ ID NO: 110799 - RNA, 21 nt, Human
uaagaacauuaucuucuuccu

SEQ ID NO: 110800 - RNA, 22 nt, Human
uguccuuuauauguuuuuuagu

SEQ ID NO: 110801 - RNA, 22 nt, Human
agcagccgccgccgccgcgcac

SEQ ID NO: 110802 - RNA, 22 nt, Human
aggauggauagcaaggaagccg

SEQ ID NO: 110803 - RNA, 22 nt, Human
uauuguuuuaagguguauuaau

SEQ ID NO: 110804 - RNA, 22 nt, Human
uucccggccgccccccgcucgg

SEQ ID NO: 110805 - RNA, 22 nt, Human
uauuuuuacuguuugaugauuc

SEQ ID NO: 110806 - RNA, 22 nt, Human
gagguagcgugcagggcccgaa

SEQ ID NO: 110807 - RNA, 22 nt, Human
auuuucuucauuuugauuguau

SEQ ID NO: 110808 - RNA, 22 nt, Human
agggcaguuaugaaugucucca

SEQ ID NO: 110809 - RNA, 22 nt, Human
aagcucuuuccacuaaaccacu

SEQ ID NO: 110810 - RNA, 22 nt, Human
cucugcuuguaucacauuugcu

SEQ ID NO: 110811 - RNA, 22 nt, Human
guuguuuucagcccagcauuag

SEQ ID NO: 110812 - RNA, 22 nt, Human
ccuucugcuggucaucccagug

SEQ ID NO: 110813 - RNA, 22 nt, Human
ggcagucuuucccuugagcucu

SEQ ID NO: 110814 - RNA, 21 nt, Human
agaugaggauacugaggccua

SEQ ID NO: 110815 - RNA, 22 nt, Human
aaugugcauaacuuuauaaauu

SEQ ID NO: 110816 - RNA, 22 nt, Human
ugaauuagagugaaggaaagcu

SEQ ID NO: 110817 - RNA, 22 nt, Human
cugcugugcagacagacucucu

SEQ ID NO: 110818 - RNA, 22 nt, Human
cagcuucacuuaaaacaugcaa

SEQ ID NO: 110819 - RNA, 22 nt, Human
ggacggggagcuggaaagggga

SEQ ID NO: 110820 - RNA, 23 nt, Human
auaaugauaaugcuauuuuuugu

SEQ ID NO: 110821 - RNA, 22 nt, Human
gggaagaaccucugcuaccaau

SEQ ID NO: 110822 - RNA, 22 nt, Human
uugauagauuuuagaggcaggc

SEQ ID NO: 110823 - RNA, 22 nt, Human
ucccuguggauuaaggagaugu

SEQ ID NO: 110824 - RNA, 22 nt, Human
cuguggcugcgcccugggggag

SEQ ID NO: 110825 - RNA, 22 nt, Human
ucgcccagguuggagugcagug

SEQ ID NO: 110826 - RNA, 22 nt, Human
ugggggaggaggagacagacug

SEQ ID NO: 110827 - RNA, 22 nt, Human
augaagguggacagauuuuuuu

SEQ ID NO: 110828 - RNA, 22 nt, Human
ggagacagauggcgucucaguu

SEQ ID NO: 110829 - RNA, 22 nt, Human
aacugcauaagcuucgggaccu

SEQ ID NO: 110830 - RNA, 22 nt, Human
uacuauuuugacaugaaauuga

SEQ ID NO: 110831 - RNA, 19 nt, Human
agcucaggcccaucguccc

SEQ ID NO: 110832 - RNA, 22 nt, Human
aggcaguguggagggcuguugc

SEQ ID NO: 110833 - RNA, 22 nt, Human
cccagaggcugaguugggagca

SEQ ID NO: 110834 - RNA, 22 nt, Human
ggcagagcugugcgcccaccca

SEQ ID NO: 110835 - RNA, 22 nt, Human
aaaauacuaggaaaauaaauca

SEQ ID NO: 110836 - RNA, 22 nt, Human
guagaacucuuuccugcguggg

SEQ ID NO: 110837 - RNA, 22 nt, Human
cuuuaaaaauguauuuuugugg

SEQ ID NO: 110838 - RNA, 22 nt, Human
acuuauaaauuuaguacacugu

SEQ ID NO: 110839 - RNA, 22 nt, Human
ugacagaggagcuggaaugauu

SEQ ID NO: 110840 - RNA, 22 nt, Human
aguggcuguuccaggugaggac

SEQ ID NO: 110841 - RNA, 22 nt, Human
agucaccuacagcucaugcuuc

SEQ ID NO: 110842 - RNA, 22 nt, Human
ggcagaggagcuggaaacaugg

SEQ ID NO: 110843 - RNA, 22 nt, Human
ggagcucacuacgaaauaagcu

SEQ ID NO: 110844 - RNA, 22 nt, Human
ggugaguagaaguaguuggcuu

SEQ ID NO: 110845 - RNA, 22 nt, Human
gaggggacugucuggcuccgag

SEQ ID NO: 110846 - RNA, 22 nt, Human
augcaccugucuuuuaaggaua

SEQ ID NO: 110847 - RNA, 22 nt, Human
ucagccuugguuuugguguugg

SEQ ID NO: 110848 - RNA, 22 nt, Human
gugaucagaagaaccugccgaa

SEQ ID NO: 110849 - RNA, 22 nt, Human
aguggcugugaaauacauggga

SEQ ID NO: 110850 - RNA, 22 nt, Human
aaucaaauuucuugugguuguu

SEQ ID NO: 110851 - RNA, 22 nt, Human
uuuaugucaaaaguaaaaugaa

SEQ ID NO: 110852 - RNA, 22 nt, Human
ggagugaguauguucugaugca

SEQ ID NO: 110853 - RNA, 22 nt, Human
ucuucaugaaauugauugcuua

SEQ ID NO: 110854 - RNA, 22 nt, Human
cggccgcgggauggcgggcagc

SEQ ID NO: 110855 - RNA, 22 nt, Human
uaaaaauuagauauguauuuag

SEQ ID NO: 110856 - RNA, 22 nt, Human
uggcucaggccuacgacgccuu

SEQ ID NO: 110857 - RNA, 22 nt, Human
ucuccucucugaucuugcuccg

SEQ ID NO: 110858 - RNA, 21 nt, Human
gccgugcgccuccaggcgcgc

SEQ ID NO: 110859 - RNA, 19 nt, Human
agugaacuccauaucaggu

SEQ ID NO: 110860 - RNA, 22 nt, Human
uuauuuaagaucuuaauauaua

SEQ ID NO: 110861 - RNA, 22 nt, Human
aaaauauuuaucuagcucuuaa

SEQ ID NO: 110862 - RNA, 22 nt, Human
cuguccauuuucgugccuccuu

SEQ ID NO: 110863 - RNA, 22 nt, Human
uauauguagcucaaaaauuccc

SEQ ID NO: 110864 - RNA, 22 nt, Human
gcuucucacccuuacuaucucu

SEQ ID NO: 110865 - RNA, 22 nt, Human
gugucccaaagauuagaaauca

SEQ ID NO: 110866 - RNA, 22 nt, Human
aggaggcucucagguccucccc

SEQ ID NO: 110867 - RNA, 22 nt, Human
gagggagugggcccgugggcac

SEQ ID NO: 110868 - RNA, 22 nt, Human
gggagggaggagccccggccau

SEQ ID NO: 110869 - RNA, 22 nt, Human
agggaggagggacagaaagagg

SEQ ID NO: 110870 - RNA, 22 nt, Human
gauuuucauuauagcuaguuuc

SEQ ID NO: 110871 - RNA, 22 nt, Human
ggcagguggcacugcugcuccc

SEQ ID NO: 110872 - RNA, 22 nt, Human
ugcuccguucuucugcuucuug

SEQ ID NO: 110873 - RNA, 22 nt, Human
uucucuugccuucucuuuuauc

SEQ ID NO: 110874 - RNA, 22 nt, Human
uuauuugcccauguuuagcaga

SEQ ID NO: 110875 - RNA, 22 nt, Human
auuuuugguuucaccugcacgc

SEQ ID NO: 110876 - RNA, 22 nt, Human
augugugugcgagcgugugugu

SEQ ID NO: 110877 - RNA, 22 nt, Human
ggcucagaggagcuggaacggu

SEQ ID NO: 110878 - RNA, 22 nt, Human
auuuuuuuuccugucucuuuca

SEQ ID NO: 110879 - RNA, 22 nt, Human
aaaacuuucagggauacagaaa

SEQ ID NO: 110880 - RNA, 22 nt, Human
uguguuguuuggggauguccau

SEQ ID NO: 110881 - RNA, 22 nt, Human
uuuuuuaaucaaguaggaaaca

SEQ ID NO: 110882 - RNA, 22 nt, Human
agagauacugcaggccauaaau

SEQ ID NO: 110883 - RNA, 22 nt, Human
cucagcgagggaaagaggccgc

SEQ ID NO: 110884 - RNA, 22 nt, Human
ugaguucugacugagcaugggg

SEQ ID NO: 110885 - RNA, 22 nt, Human
auauaguacauguauauauaua

SEQ ID NO: 110886 - RNA, 22 nt, Human
ugcauucugaacguaaauguga

SEQ ID NO: 110887 - RNA, 22 nt, Human
ucauuauuuugauguauuuccu

SEQ ID NO: 110888 - RNA, 22 nt, Human
guggaaggaauuaacagacuag

SEQ ID NO: 110889 - RNA, 22 nt, Human
gaggagcugggucagggagaca

SEQ ID NO: 110890 - RNA, 22 nt, Human
cuuuuuaaaguaaauggcuaga

SEQ ID NO: 110891 - RNA, 19 nt, Human
aacaaaauaguucuaguua

SEQ ID NO: 110892 - RNA, 22 nt, Human
gcccugucagcucucauggaca

SEQ ID NO: 110893 - RNA, 22 nt, Human
uaagcgagccaguggaaaaagc

SEQ ID NO: 110894 - RNA, 22 nt, Human
cagcagaggagguggcagcacc

SEQ ID NO: 110895 - RNA, 23 nt, Human
gcccagaggccccuggccugagc

SEQ ID NO: 110896 - RNA, 22 nt, Human
gggaaaauguuucugagacaaa

SEQ ID NO: 110897 - RNA, 22 nt, Human
aagcgggcagcggccugcgcca

SEQ ID NO: 110898 - RNA, 22 nt, Human
uuuauuuuccaugucucuaggu

SEQ ID NO: 110899 - RNA, 22 nt, Human
agccugggucgagagacgagaa

SEQ ID NO: 110900 - RNA, 22 nt, Human
auagaaauagacaaugcaaaga

SEQ ID NO: 110901 - RNA, 21 nt, Human
aagagcgccgggcagggcuga

SEQ ID NO: 110902 - RNA, 22 nt, Human
aggcaguggagcuggaauaggc

SEQ ID NO: 110903 - RNA, 22 nt, Human
ugaauaaauaaacuuuuacuac

SEQ ID NO: 110904 - RNA, 21 nt, Human
auauuguugggguuuucuuuu

SEQ ID NO: 110905 - RNA, 22 nt, Human
uuucagaaauggcacugaaauc

SEQ ID NO: 110906 - RNA, 22 nt, Human
uuuuuaaaauuaggacggcacg

SEQ ID NO: 110907 - RNA, 22 nt, Human
uugcuuucuuuguagguuuucc

SEQ ID NO: 110908 - RNA, 22 nt, Human
cugggggacagagagaggcggu

SEQ ID NO: 110909 - RNA, 22 nt, Human
agcacagugccugacauauaug

SEQ ID NO: 110910 - RNA, 22 nt, Human
ggcuccaggguaccccuggaug

SEQ ID NO: 110911 - RNA, 22 nt, Human
ucauuguuucugcuuuucauga

SEQ ID NO: 110912 - RNA, 22 nt, Human
uucuuuucuucccuguuuauua

SEQ ID NO: 110913 - RNA, 20 nt, Human
cugauagauucuuccccaga

SEQ ID NO: 110914 - RNA, 22 nt, Human
ccucccuucccggcauggcucu

SEQ ID NO: 110915 - RNA, 22 nt, Human
caagaaaaaacaugaugagugu

SEQ ID NO: 110916 - RNA, 20 nt, Human
uugauucacaaaaagcuuag

SEQ ID NO: 110917 - RNA, 22 nt, Human
agggcugcugcuccgggcccag

SEQ ID NO: 110918 - RNA, 22 nt, Human
uuuauguuuguuuuugaaauaa

SEQ ID NO: 110919 - RNA, 22 nt, Human
cuccggggacgcagucgccgcc

SEQ ID NO: 110920 - RNA, 22 nt, Human
uagcugucauuggaucagaagg

SEQ ID NO: 110921 - RNA, 22 nt, Human
uguuuagcucugacuaugugau

SEQ ID NO: 110922 - RNA, 22 nt, Human
cauggcggcgcucucccugccu

SEQ ID NO: 110923 - RNA, 22 nt, Human
ggcagugguaggagcccaggag

SEQ ID NO: 110924 - RNA, 22 nt, Human
gaauuagguaauagaacuagua

SEQ ID NO: 110925 - RNA, 22 nt, Human
auaugcacauguacauguauau

SEQ ID NO: 110926 - RNA, 22 nt, Human
auucuuuauuuucuguacuugc

SEQ ID NO: 110927 - RNA, 22 nt, Human
uuggaggccacagucaucuuua

SEQ ID NO: 110928 - RNA, 22 nt, Human
agguggucccaauggcugggca

SEQ ID NO: 110929 - RNA, 22 nt, Human
gaggguggggaauagacugcua

SEQ ID NO: 110930 - RNA, 22 nt, Human
cauaggcucuucagagaacuga

SEQ ID NO: 110931 - RNA, 22 nt, Human
acagcugguugaaggggaccaa

SEQ ID NO: 110932 - RNA, 22 nt, Human
ucauacuuuuuugacccuugug

SEQ ID NO: 110933 - RNA, 22 nt, Human
auagagcuggggaagaagcugg

SEQ ID NO: 110934 - RNA, 22 nt, Human
cacuguugagcaauguacagug

SEQ ID NO: 110935 - RNA, 22 nt, Human
aaugauuuucugcaaacaguga

SEQ ID NO: 110936 - RNA, 22 nt, Human
uuuuuuuaaguuuugauuuuag

SEQ ID NO: 110937 - RNA, 22 nt, Human
uuaacauuguccuuagcagauu

SEQ ID NO: 110938 - RNA, 22 nt, Human
auuaaauagcagaagaaagaug

SEQ ID NO: 110939 - RNA, 22 nt, Human
aaggugggacugagaggggaca

SEQ ID NO: 110940 - RNA, 22 nt, Human
gagggaggugacaaggacauag

SEQ ID NO: 110941 - RNA, 22 nt, Human
gcuggggaucgaaggcagagcc

SEQ ID NO: 110942 - RNA, 22 nt, Human
uggcucagcgcggccuggucuu

SEQ ID NO: 110943 - RNA, 22 nt, Human
gaacauuucugcagaugucuga

SEQ ID NO: 110944 - RNA, 22 nt, Human
uuaucaaaaaauaguacuuuga

SEQ ID NO: 110945 - RNA, 22 nt, Human
uugaauaaggcauaaagauacu

SEQ ID NO: 110946 - RNA, 22 nt, Human
ggggcaucguugauugcauggu

SEQ ID NO: 110947 - RNA, 20 nt, Human
acccagaguccuccccgcgc

SEQ ID NO: 110948 - RNA, 22 nt, Human
uaaaaucaugacagauugacau

SEQ ID NO: 110949 - RNA, 22 nt, Human
ggauaauguauuuuaaaauggg

SEQ ID NO: 110950 - RNA, 22 nt, Human
auggauggaagcagccugaacu

SEQ ID NO: 110951 - RNA, 22 nt, Human
uggaagcccagaaggaagcaga

SEQ ID NO: 110952 - RNA, 22 nt, Human
acauaaaccccccuuccccagg

SEQ ID NO: 110953 - RNA, 19 nt, Human
uuccucaggugugaguuag

SEQ ID NO: 110954 - RNA, 22 nt, Human
uguaaauucuauacacuuaaaa

SEQ ID NO: 110955 - RNA, 22 nt, Human
agccgcgcuguuccugcugcug

SEQ ID NO: 110956 - RNA, 22 nt, Human
ugucuuugaccuuaagaaguuu

SEQ ID NO: 110957 - RNA, 22 nt, Human
ucccuucccaccccugccuuuu

SEQ ID NO: 110958 - RNA, 22 nt, Human
guuuauuucuuaucaucacuau

SEQ ID NO: 110959 - RNA, 22 nt, Human
gagccucaggguuuuguugaca

SEQ ID NO: 110960 - RNA, 22 nt, Human
ugcucacugcuuguguucaguu

SEQ ID NO: 110961 - RNA, 22 nt, Human
ucaaauaugggccagaggaaau

SEQ ID NO: 110962 - RNA, 22 nt, Human
gugugugucuacuuucaucucu

SEQ ID NO: 110963 - RNA, 21 nt, Human
gggagugaguaaugauggggg

SEQ ID NO: 110964 - RNA, 19 nt, Human
acccaugcucuguggacuu

SEQ ID NO: 110965 - RNA, 22 nt, Human
cuucuuuucuacuggccuagaa

SEQ ID NO: 110966 - RNA, 22 nt, Human
gguagacugagcuccuugagga

SEQ ID NO: 110967 - RNA, 22 nt, Human
uuuaaugaugucuaugccuguu

SEQ ID NO: 110968 - RNA, 22 nt, Human
acuuuuccuggguagcuccugg

SEQ ID NO: 110969 - RNA, 22 nt, Human
gagaaaaauuucuuugcugcac

SEQ ID NO: 110970 - RNA, 22 nt, Human
gugggugauacugccgugggag

SEQ ID NO: 110971 - RNA, 22 nt, Human
guguucuuuguagaggaucuug

SEQ ID NO: 110972 - RNA, 22 nt, Human
uuaaugauuaauguggacccaa

SEQ ID NO: 110973 - RNA, 22 nt, Human
cccagagggcugaggauaugaa

SEQ ID NO: 110974 - RNA, 22 nt, Human
ugaaauuuuuuggagauaauuu

SEQ ID NO: 110975 - RNA, 22 nt, Human
uuucucuuucaaucugcaguac

SEQ ID NO: 110976 - RNA, 22 nt, Human
ugugugcuaguuuugucaguau

SEQ ID NO: 110977 - RNA, 22 nt, Human
cggcccggccucgcggcgcaug

SEQ ID NO: 110978 - RNA, 22 nt, Human
cuguguguauaauguuugauaa

SEQ ID NO: 110979 - RNA, 22 nt, Human
caauccccaggucccagaacag

SEQ ID NO: 110980 - RNA, 22 nt, Human
auguguguaugacugaaucuau

SEQ ID NO: 110981 - RNA, 22 nt, Human
uggggggacagauggagaggac

SEQ ID NO: 110982 - RNA, 21 nt, Human
ccgaggagugcggggagcccc

SEQ ID NO: 110983 - RNA, 22 nt, Human
uuccgcuuucaauggcuuggcu

SEQ ID NO: 110984 - RNA, 22 nt, Human
ugucuuuuaaaaauguguaaaa

SEQ ID NO: 110985 - RNA, 22 nt, Human
gcugcgcgcagccggcgccgag

SEQ ID NO: 110986 - RNA, 22 nt, Human
aaugaaaaucugucaguucaag

SEQ ID NO: 110987 - RNA, 22 nt, Human
cgaccccugaaaauggcagcca

SEQ ID NO: 110988 - RNA, 22 nt, Human
cuccacagccccuccaguggca

SEQ ID NO: 110989 - RNA, 22 nt, Human
guguggcgacucagagcugccu

SEQ ID NO: 110990 - RNA, 22 nt, Human
guuauuuugucuuguucaugaa

SEQ ID NO: 110991 - RNA, 22 nt, Human
auuuucauauggguuauuugua

SEQ ID NO: 110992 - RNA, 22 nt, Human
guuuggguggcuagagaaagaa

SEQ ID NO: 110993 - RNA, 20 nt, Human
ucagugggaaagugagagug

SEQ ID NO: 110994 - RNA, 22 nt, Human
auuguuuugugaaacauaguga

SEQ ID NO: 110995 - RNA, 22 nt, Human
auccuagacuccuaugccccaa

SEQ ID NO: 110996 - RNA, 22 nt, Human
uauauacacgcacauauacaua

SEQ ID NO: 110997 - RNA, 22 nt, Human
gagaggugaagcuaauuaauuu

SEQ ID NO: 110998 - RNA, 22 nt, Human
ggccugagaagcaaggacacaa

SEQ ID NO: 110999 - RNA, 22 nt, Human
uagacugugagcuccuugaggg

SEQ ID NO: 111000 - RNA, 17 nt, Human
agcagcuggguugaucu

SEQ ID NO: 111001 - RNA, 22 nt, Human
ugugguuuguaagcaaagcaaa

SEQ ID NO: 111002 - RNA, 22 nt, Human
aucguuaugauagagaaagaga

SEQ ID NO: 111003 - RNA, 21 nt, Human
agcgcugcauccaccauggcu

SEQ ID NO: 111004 - RNA, 22 nt, Human
gcgcgcucugcgaggacacgcu

SEQ ID NO: 111005 - RNA, 20 nt, Human
gccggggcauaggggccguc

SEQ ID NO: 111006 - RNA, 22 nt, Human
aaaauauaaaggauguggguuu

SEQ ID NO: 111007 - RNA, 22 nt, Human
cuaaaccaauauauuuucuucc

SEQ ID NO: 111008 - RNA, 22 nt, Human
uauuuuagccaacagaaugaug

SEQ ID NO: 111009 - RNA, 22 nt, Human
ugauauaaaagauucuuauuga

SEQ ID NO: 111010 - RNA, 22 nt, Human
uucuccaccugcuccucccacc

SEQ ID NO: 111011 - RNA, 22 nt, Human
aauuauguugaaauaugagaac

SEQ ID NO: 111012 - RNA, 22 nt, Human
uuuaucaggccaucuuaugucu

SEQ ID NO: 111013 - RNA, 22 nt, Human
uuuaaucaguugguaauauuga

SEQ ID NO: 111014 - RNA, 22 nt, Human
cucuugugucaccauggauaaa

SEQ ID NO: 111015 - RNA, 22 nt, Human
agguuaggaggggagugccaca

SEQ ID NO: 111016 - RNA, 22 nt, Human
gugaaauuguacacucaguacc

SEQ ID NO: 111017 - RNA, 22 nt, Human
uuauuucaggcauuuguaaaug

SEQ ID NO: 111018 - RNA, 19 nt, Human
gauauugagcugagaauuc

SEQ ID NO: 111019 - RNA, 22 nt, Human
aauguugaaccuuuuuggccug

SEQ ID NO: 111020 - RNA, 22 nt, Human
gaggcgcgcugcgagggcgcgg

SEQ ID NO: 111021 - RNA, 22 nt, Human
aauucuguugguuagaguugga

SEQ ID NO: 111022 - RNA, 22 nt, Human
uugccaggggacaucuggagcc

SEQ ID NO: 111023 - RNA, 22 nt, Human
ucggccggagggggcgggcgca

SEQ ID NO: 111024 - RNA, 22 nt, Human
aucauguauauuuuugcuauua

SEQ ID NO: 111025 - RNA, 22 nt, Human
guguugaugugucuguauucua

SEQ ID NO: 111026 - RNA, 22 nt, Human
ggaggaugaggguggugguguu

SEQ ID NO: 111027 - RNA, 22 nt, Human
ugaauucaaacuuuuuaacaag

SEQ ID NO: 111028 - RNA, 22 nt, Human
uuuauuuagguaaacaugaguu

SEQ ID NO: 111029 - RNA, 22 nt, Human
aggggaggcugcgggcugccgu

SEQ ID NO: 111030 - RNA, 22 nt, Human
guaaauaucucacgaaugauuc

SEQ ID NO: 111031 - RNA, 22 nt, Human
cagcuccagcccaggcagcucc

SEQ ID NO: 111032 - RNA, 22 nt, Human
gaggccagcacccagaugcaug

SEQ ID NO: 111033 - RNA, 22 nt, Human
ggccgggcaugcgagcugagcg

SEQ ID NO: 111034 - RNA, 22 nt, Human
gaaacauuuguugaguacuugc

SEQ ID NO: 111035 - RNA, 22 nt, Human
uuuuuauaagagcagcagaguu

SEQ ID NO: 111036 - RNA, 22 nt, Human
gggcggcguccucagucgggug

SEQ ID NO: 111037 - RNA, 22 nt, Human
guuauuguuauugcguugucga

SEQ ID NO: 111038 - RNA, 22 nt, Human
agggcucacuacaacccuggga

SEQ ID NO: 111039 - RNA, 22 nt, Human
agcacgcccaccuccugcggcg

SEQ ID NO: 111040 - RNA, 22 nt, Human
agcggaggaggcggagcaggga

SEQ ID NO: 111041 - RNA, 23 nt, Human
uuuuccaaaucgacucucuaguu

SEQ ID NO: 111042 - RNA, 22 nt, Human
gagcagcugagcuggaaugaga

SEQ ID NO: 111043 - RNA, 22 nt, Human
uuauuucauguaaaauuuaugu

SEQ ID NO: 111044 - RNA, 22 nt, Human
cugucucugauaagcucgaggg

SEQ ID NO: 111045 - RNA, 22 nt, Human
uccuuucaaauuuauuugacau

SEQ ID NO: 111046 - RNA, 22 nt, Human
agucccugauggacuggaugag

SEQ ID NO: 111047 - RNA, 19 nt, Human
uagaggagaauggcaaaga

SEQ ID NO: 111048 - RNA, 22 nt, Human
agccccaauuacagcugugcug

SEQ ID NO: 111049 - RNA, 22 nt, Human
ucugaauauguuuaucaucucu

SEQ ID NO: 111050 - RNA, 22 nt, Human
aauaugcaaagcguguuaucug

SEQ ID NO: 111051 - RNA, 22 nt, Human
aaaauauguugagauacugaaa

SEQ ID NO: 111052 - RNA, 22 nt, Human
agauucucccuccuggcgcugu

SEQ ID NO: 111053 - RNA, 23 nt, Human
cagagaaaauagaauaugcugug

SEQ ID NO: 111054 - RNA, 22 nt, Human
uuugcaggaaauguacugaaug

SEQ ID NO: 111055 - RNA, 22 nt, Human
ccggcggguggagcaugcgcgg

SEQ ID NO: 111056 - RNA, 22 nt, Human
cagaccagaaggaagccgacaa

SEQ ID NO: 111057 - RNA, 22 nt, Human
aucuaaaacuacgaauacuacc

SEQ ID NO: 111058 - RNA, 22 nt, Human
uuauauuuuauuuaauuaaaua

SEQ ID NO: 111059 - RNA, 22 nt, Human
gcccuagaguugagagcaccca

SEQ ID NO: 111060 - RNA, 22 nt, Human
cagggcagaguuaagaugcugg

SEQ ID NO: 111061 - RNA, 19 nt, Human
ucaggaggucgaccuggca

SEQ ID NO: 111062 - RNA, 19 nt, Human
ggaggguguccucaguguc

SEQ ID NO: 111063 - RNA, 22 nt, Human
auuaaaaaugagaguagggauu

SEQ ID NO: 111064 - RNA, 22 nt, Human
aauagagacaguuuaacaauau

SEQ ID NO: 111065 - RNA, 22 nt, Human
cuagcacagugcuuggcacaca

SEQ ID NO: 111066 - RNA, 22 nt, Human
cacugcacuccagccugggcaa

SEQ ID NO: 111067 - RNA, 22 nt, Human
agaguacagaagcauuucagau

SEQ ID NO: 111068 - RNA, 22 nt, Human
ugggggagggagaguugauggg

SEQ ID NO: 111069 - RNA, 17 nt, Human
uuagagcuacauguuga

SEQ ID NO: 111070 - RNA, 22 nt, Human
ggcuagggagacagagggcaug

SEQ ID NO: 111071 - RNA, 22 nt, Human
gcagaggcugccgugggcagga

SEQ ID NO: 111072 - RNA, 22 nt, Human
cacugcaaccuccaccucccgg

SEQ ID NO: 111073 - RNA, 21 nt, Human
gggagaguagcgguagggagg

SEQ ID NO: 111074 - RNA, 22 nt, Human
uccaugaguuuuuuaguuucac

SEQ ID NO: 111075 - RNA, 22 nt, Human
aaauguuugguggauaaaagga

SEQ ID NO: 111076 - RNA, 22 nt, Human
ccuaggcuggcugucuucaggu

SEQ ID NO: 111077 - RNA, 22 nt, Human
agggcugggcuuggcaggcugg

SEQ ID NO: 111078 - RNA, 22 nt, Human
cugguacuggaggaguucagag

SEQ ID NO: 111079 - RNA, 22 nt, Human
gccggagagccaacaccacgga

SEQ ID NO: 111080 - RNA, 22 nt, Human
agcaaggguugguuuucugaca

SEQ ID NO: 111081 - RNA, 22 nt, Human
uacaggaggaugugcagccagg

SEQ ID NO: 111082 - RNA, 22 nt, Human
gagggugguggcggccggcacc

SEQ ID NO: 111083 - RNA, 22 nt, Human
uggggcauacgugaaauaauuu

SEQ ID NO: 111084 - RNA, 22 nt, Human
agacuccuucuaagaccucauu

SEQ ID NO: 111085 - RNA, 22 nt, Human
cuucuuuccauguguuuugguu

SEQ ID NO: 111086 - RNA, 22 nt, Human
gggagggucugagagcugcacc

SEQ ID NO: 111087 - RNA, 22 nt, Human
uagcuggaggggcaggaugcug

SEQ ID NO: 111088 - RNA, 22 nt, Human
cuuucuuucaaguucugcuuua

SEQ ID NO: 111089 - RNA, 22 nt, Human
acaggcugcccgcuccccaccu

SEQ ID NO: 111090 - RNA, 22 nt, Human
agcagcugagccccagcuguga

SEQ ID NO: 111091 - RNA, 22 nt, Human
uucccaggugugagugagguga

SEQ ID NO: 111092 - RNA, 22 nt, Human
gcaggcagauccagaagcacua

SEQ ID NO: 111093 - RNA, 22 nt, Human
aggauagacuucagaaggcaua

SEQ ID NO: 111094 - RNA, 19 nt, Human
agagucuccacuccacuug

SEQ ID NO: 111095 - RNA, 22 nt, Human
uggagccugauggauaggaacg

SEQ ID NO: 111096 - RNA, 22 nt, Human
cagguggauggcgagcccugca

SEQ ID NO: 111097 - RNA, 22 nt, Human
ugcggugcgcccgggcgagugc

SEQ ID NO: 111098 - RNA, 22 nt, Human
guuuauucuuuuauuugugaga

SEQ ID NO: 111099 - RNA, 22 nt, Human
gcuguggagaagcugccuaugg

SEQ ID NO: 111100 - RNA, 22 nt, Human
cucuguguguuugugugugugu

SEQ ID NO: 111101 - RNA, 22 nt, Human
ggagacuaagaaaauagagucc

SEQ ID NO: 111102 - RNA, 22 nt, Human
ccuccuuuccuguuuuccugag

SEQ ID NO: 111103 - RNA, 22 nt, Human
acauauaugugcauacaacuau

SEQ ID NO: 111104 - RNA, 22 nt, Human
uuauuuuauaaagagaagacuu

SEQ ID NO: 111105 - RNA, 22 nt, Human
gggcugagagcuggaaucugag

SEQ ID NO: 111106 - RNA, 22 nt, Human
uucacccuucucuggcuuucag

SEQ ID NO: 111107 - RNA, 22 nt, Human
agcgcgcggggcugcggcaggg

SEQ ID NO: 111108 - RNA, 19 nt, Human
cagagacuguaacacuuuu

SEQ ID NO: 111109 - RNA, 22 nt, Human
aagagggguggucugugaggau

SEQ ID NO: 111110 - RNA, 22 nt, Human
aggcaggggagcuggaagggua

SEQ ID NO: 111111 - RNA, 22 nt, Human
guuuacaacaucuuguccuuca

SEQ ID NO: 111112 - RNA, 22 nt, Human
aagugugugugcgcaugugcau

SEQ ID NO: 111113 - RNA, 22 nt, Human
gcagccagggaccuuugacuau

SEQ ID NO: 111114 - RNA, 22 nt, Human
uguuuucuuuccccuucuuuuc

SEQ ID NO: 111115 - RNA, 22 nt, Human
gggaggaagaguaggaauuuga

SEQ ID NO: 111116 - RNA, 22 nt, Human
gguggcagaggaggcgggagag

SEQ ID NO: 111117 - RNA, 22 nt, Human
ggggcgaguguggaccgcagcc

SEQ ID NO: 111118 - RNA, 22 nt, Human
ugagggaggggaaugugugcag

SEQ ID NO: 111119 - RNA, 22 nt, Human
uauaagaaaagucauuaucaaa

SEQ ID NO: 111120 - RNA, 22 nt, Human
aaauuuuguugaaaaauauuuu

SEQ ID NO: 111121 - RNA, 22 nt, Human
acuuuauacuagugauaguuug

SEQ ID NO: 111122 - RNA, 22 nt, Human
acuguugagggaagcagaugaa

SEQ ID NO: 111123 - RNA, 22 nt, Human
auuuuacuaugauaguugagaa

SEQ ID NO: 111124 - RNA, 22 nt, Human
ggacauaguugcuauggagagu

SEQ ID NO: 111125 - RNA, 22 nt, Human
auccugugggguauugcugcau

SEQ ID NO: 111126 - RNA, 22 nt, Human
gaacuuuaauuagcuuuugucu

SEQ ID NO: 111127 - RNA, 22 nt, Human
gcuucuguuaggauguggcuua

SEQ ID NO: 111128 - RNA, 22 nt, Human
ugcuuggagaaucagucccagc

SEQ ID NO: 111129 - RNA, 22 nt, Human
uauuuuuuuaacauuuauugua

SEQ ID NO: 111130 - RNA, 22 nt, Human
uugguuuacucuggggauaucu

SEQ ID NO: 111131 - RNA, 22 nt, Human
guuuuucuuugauuuagaacca

SEQ ID NO: 111132 - RNA, 22 nt, Human
agagacaggguuuugucguguu

SEQ ID NO: 111133 - RNA, 22 nt, Human
aauuagaagcuguuagcaaaau

SEQ ID NO: 111134 - RNA, 22 nt, Human
cacagugugguauauuucccaa

SEQ ID NO: 111135 - RNA, 22 nt, Human
uuuuccuuccugucucuuuauu

SEQ ID NO: 111136 - RNA, 22 nt, Human
ugccgccgugggucccgacgcg

SEQ ID NO: 111137 - RNA, 22 nt, Human
aaaaaauugcuggcagagcugu

SEQ ID NO: 111138 - RNA, 22 nt, Human
uuuucucaguuuuuuucaaaag

SEQ ID NO: 111139 - RNA, 20 nt, Human
aggggcuguaguuagaugac

SEQ ID NO: 111140 - RNA, 22 nt, Human
uauuuguauugucuuaucacuu

SEQ ID NO: 111141 - RNA, 22 nt, Human
aaggcuguuugagcacuggagc

SEQ ID NO: 111142 - RNA, 22 nt, Human
ugcuggagccauguuuucucua

SEQ ID NO: 111143 - RNA, 21 nt, Human
ugagcccaaagcuguauuggu

SEQ ID NO: 111144 - RNA, 23 nt, Human
cuuauauaaucauuagaaaccau

SEQ ID NO: 111145 - RNA, 22 nt, Human
aucuguuccccuaugcucucua

SEQ ID NO: 111146 - RNA, 22 nt, Human
auggaguguggccaggcaguaa

SEQ ID NO: 111147 - RNA, 22 nt, Human
ggcugcagggaacaggaugggu

SEQ ID NO: 111148 - RNA, 22 nt, Human
cgaggagguccaggagcaguag

SEQ ID NO: 111149 - RNA, 22 nt, Human
gaggcaggaagggaggguugug

SEQ ID NO: 111150 - RNA, 22 nt, Human
gggagguaaugggggugcaggg

SEQ ID NO: 111151 - RNA, 22 nt, Human
uucacugugauugggguggauu

SEQ ID NO: 111152 - RNA, 23 nt, Human
caggggacaggugaccugggcuc

SEQ ID NO: 111153 - RNA, 20 nt, Human
aggaacuggaagggaggaaa

SEQ ID NO: 111154 - RNA, 22 nt, Human
agcugaggccccgcagcagggu

SEQ ID NO: 111155 - RNA, 22 nt, Human
gaggagcuucagaggaaucuua

SEQ ID NO: 111156 - RNA, 22 nt, Human
aaaauauucuauaucaaagaua

SEQ ID NO: 111157 - RNA, 22 nt, Human
agucugugguccucuguaucuc

SEQ ID NO: 111158 - RNA, 22 nt, Human
uggcagccugcgugaaggagcu

SEQ ID NO: 111159 - RNA, 22 nt, Human
gcucccaauuccuuuuacaauu

SEQ ID NO: 111160 - RNA, 22 nt, Human
aggggcagccucacaauccucu

SEQ ID NO: 111161 - RNA, 22 nt, Human
gaccaggagauuugagcuaggc

SEQ ID NO: 111162 - RNA, 22 nt, Human
auuuuuuuggucauaugagaua

SEQ ID NO: 111163 - RNA, 22 nt, Human
ggaagcucaauacuuuccucuu

SEQ ID NO: 111164 - RNA, 22 nt, Human
uauauauacauauagaauaugu

SEQ ID NO: 111165 - RNA, 22 nt, Human
uauaagaaacaaggcaaauuuu

SEQ ID NO: 111166 - RNA, 22 nt, Human
auuuccagcagcauauuugucu

SEQ ID NO: 111167 - RNA, 22 nt, Human
ucucucucucuuccagcauguu

SEQ ID NO: 111168 - RNA, 22 nt, Human
aaugcuuuuugcgaaaugugca

SEQ ID NO: 111169 - RNA, 22 nt, Human
uucacauucauuucuuauguuu

SEQ ID NO: 111170 - RNA, 22 nt, Human
caacuucugcuuucuuccuugc

SEQ ID NO: 111171 - RNA, 18 nt, Human
cccagaggaaugccugga

SEQ ID NO: 111172 - RNA, 22 nt, Human
gggcucuuaauuuuuuucucua

SEQ ID NO: 111173 - RNA, 22 nt, Human
ccggcugcugaggcggccccgg

SEQ ID NO: 111174 - RNA, 22 nt, Human
guugcggaguguagcgaugcuu

SEQ ID NO: 111175 - RNA, 22 nt, Human
gucccagaggacagggucacau

SEQ ID NO: 111176 - RNA, 22 nt, Human
uggaugccuugggggaggagga

SEQ ID NO: 111177 - RNA, 21 nt, Human
cuauaaaaaugguucuuugcg

SEQ ID NO: 111178 - RNA, 22 nt, Human
gaaggagaggauugugaggcug

SEQ ID NO: 111179 - RNA, 22 nt, Human
ugcuuucaaugaauuguauacu

SEQ ID NO: 111180 - RNA, 22 nt, Human
aguggugccuaagcgcggaggc

SEQ ID NO: 111181 - RNA, 22 nt, Human
guucuacaugacacucaacauu

SEQ ID NO: 111182 - RNA, 22 nt, Human
uggaagugucagcaggcugguu

SEQ ID NO: 111183 - RNA, 22 nt, Human
ggcucccccauggcugacagac

SEQ ID NO: 111184 - RNA, 22 nt, Human
acaguuuucugagaaucacagg

SEQ ID NO: 111185 - RNA, 22 nt, Human
uuuuacaaugcaaauucuugcu

SEQ ID NO: 111186 - RNA, 22 nt, Human
aagccucaugccagauccaggu

SEQ ID NO: 111187 - RNA, 22 nt, Human
auuuaaaaacugguacaacagg

SEQ ID NO: 111188 - RNA, 22 nt, Human
cggcugcgguucaccuagggca

SEQ ID NO: 111189 - RNA, 22 nt, Human
gcucagccuuuuguucuauuca

SEQ ID NO: 111190 - RNA, 22 nt, Human
uuuguuugcugagugaauucaa

SEQ ID NO: 111191 - RNA, 22 nt, Human
cugauagagcauuagugugaga

SEQ ID NO: 111192 - RNA, 22 nt, Human
acuuugccuucuuacuguguug

SEQ ID NO: 111193 - RNA, 22 nt, Human
uuguuuuaguagaaguuacaug

SEQ ID NO: 111194 - RNA, 22 nt, Human
gccggguguuccugggaagaug

SEQ ID NO: 111195 - RNA, 22 nt, Human
auaaaacagaucaggagaauga

SEQ ID NO: 111196 - RNA, 22 nt, Human
cccggcucggcuucuuccccac

SEQ ID NO: 111197 - RNA, 22 nt, Human
aaugagauggaggacucuuaau

SEQ ID NO: 111198 - RNA, 22 nt, Human
gucuugugaagacggcagaaag

SEQ ID NO: 111199 - RNA, 20 nt, Human
auggaaacacgcagccccaa

SEQ ID NO: 111200 - RNA, 17 nt, Human
auuguuuuuaauuugca

SEQ ID NO: 111201 - RNA, 22 nt, Human
ggcccgcgcugcuggcgcgcca

SEQ ID NO: 111202 - RNA, 22 nt, Human
uuuaacauaugaaagaauauuu

SEQ ID NO: 111203 - RNA, 22 nt, Human
cagagcugucauuugccaguga

SEQ ID NO: 111204 - RNA, 22 nt, Human
uggguauauauguugcuacaga

SEQ ID NO: 111205 - RNA, 22 nt, Human
ucacugaacucucauagagaaa

SEQ ID NO: 111206 - RNA, 22 nt, Human
ugagagggagacagcucuagca

SEQ ID NO: 111207 - RNA, 20 nt, Human
uaguggaccuugaaggccuc

SEQ ID NO: 111208 - RNA, 22 nt, Human
uagcacauaguaggcacaggcu

SEQ ID NO: 111209 - RNA, 22 nt, Human
ugucccaucacagaggagacua

SEQ ID NO: 111210 - RNA, 22 nt, Human
cccggagcagucgggcuccggg

SEQ ID NO: 111211 - RNA, 22 nt, Human
uaggauugguguauguagguuu

SEQ ID NO: 111212 - RNA, 22 nt, Human
agcggcaggaagcgcgcaagcg

SEQ ID NO: 111213 - RNA, 20 nt, Human
ucuugucuggcagccuggag

SEQ ID NO: 111214 - RNA, 22 nt, Human
ggcugugguggacgcgggaaac

SEQ ID NO: 111215 - RNA, 22 nt, Human
uacuuuaauugcaaaaauaaau

SEQ ID NO: 111216 - RNA, 22 nt, Human
ucaguggaacacacagaguggg

SEQ ID NO: 111217 - RNA, 23 nt, Human
ucagaccaaccucuugcuggaac

SEQ ID NO: 111218 - RNA, 22 nt, Human
augaggaacagcaagaauauuu

SEQ ID NO: 111219 - RNA, 22 nt, Human
ccagaugggggcugugggaggg

SEQ ID NO: 111220 - RNA, 22 nt, Human
aggggcugugucauuuguccua

SEQ ID NO: 111221 - RNA, 16 nt, Human
gaauuccauugcucug

SEQ ID NO: 111222 - RNA, 22 nt, Human
uuucacugaguaggagagcacu

SEQ ID NO: 111223 - RNA, 22 nt, Human
guuuuguagucuggagacuguc

SEQ ID NO: 111224 - RNA, 22 nt, Human
cgcccggcugagacgcucgccc

SEQ ID NO: 111225 - RNA, 22 nt, Human
ucugaggacagugcugugccug

SEQ ID NO: 111226 - RNA, 22 nt, Human
cagcuggaggagcagcuuccag

SEQ ID NO: 111227 - RNA, 22 nt, Human
gggauggggagcuggaaagggg

SEQ ID NO: 111228 - RNA, 22 nt, Human
uuuguacuuucuaauguauuua

SEQ ID NO: 111229 - RNA, 22 nt, Human
aaaauaauauuauaccacugcu

SEQ ID NO: 111230 - RNA, 22 nt, Human
caguagcuuuuugcagacaaga

SEQ ID NO: 111231 - RNA, 22 nt, Human
cucugugucugauucugggaag

SEQ ID NO: 111232 - RNA, 22 nt, Human
cggggcuggcguuagggaggca

SEQ ID NO: 111233 - RNA, 22 nt, Human
acagcuggaggucugugagcac

SEQ ID NO: 111234 - RNA, 22 nt, Human
aaucacuucuuugucuucuuca

SEQ ID NO: 111235 - RNA, 23 nt, Human
ggacuaggcaacagaugggacag

SEQ ID NO: 111236 - RNA, 22 nt, Human
uuuuuuccuguuugucuuuggg

SEQ ID NO: 111237 - RNA, 22 nt, Human
ugaaaaauauuuuuagaaauaa

SEQ ID NO: 111238 - RNA, 22 nt, Human
uuuccuaggaaaugauugaagu

SEQ ID NO: 111239 - RNA, 22 nt, Human
aggcuccucugggggccccgga

SEQ ID NO: 111240 - RNA, 22 nt, Human
gucagacucuggggccccaggc

SEQ ID NO: 111241 - RNA, 22 nt, Human
gccugggccgggcgcggccccc

SEQ ID NO: 111242 - RNA, 22 nt, Human
agcgcggccuuacacccagggg

SEQ ID NO: 111243 - RNA, 22 nt, Human
ucgcucgcuggcuccugcccgc

SEQ ID NO: 111244 - RNA, 22 nt, Human
agcuagugcaguucucaaaugg

SEQ ID NO: 111245 - RNA, 22 nt, Human
ccauuuggccauucaguuguuc

SEQ ID NO: 111246 - RNA, 22 nt, Human
aaacuuuaggcacauggaucua

SEQ ID NO: 111247 - RNA, 22 nt, Human
cagagacuuuugcuccgauucu

SEQ ID NO: 111248 - RNA, 22 nt, Human
aaagacaauaauucucucuagc

SEQ ID NO: 111249 - RNA, 22 nt, Human
cugcagagaccuaggucagguu

SEQ ID NO: 111250 - RNA, 23 nt, Human
uucuuuccuuaucccauuuacuu

SEQ ID NO: 111251 - RNA, 22 nt, Human
ggccgggugggaggcagcggag

SEQ ID NO: 111252 - RNA, 22 nt, Human
cugggaguugacgaggcuugua

SEQ ID NO: 111253 - RNA, 22 nt, Human
caucuuuguuuuggauauaauc

SEQ ID NO: 111254 - RNA, 22 nt, Human
ugaauaaucuuggguauuaaua

SEQ ID NO: 111255 - RNA, 22 nt, Human
gcagguggaagcagcagacuca

SEQ ID NO: 111256 - RNA, 22 nt, Human
gugguuuagccuucauuaaccu

SEQ ID NO: 111257 - RNA, 22 nt, Human
uugcaagcccugaagggcugga

SEQ ID NO: 111258 - RNA, 22 nt, Human
guuguuuuuguuaaaacaguga

SEQ ID NO: 111259 - RNA, 22 nt, Human
gagcgcgcaaucucuccagcug

SEQ ID NO: 111260 - RNA, 17 nt, Human
ccacuagauagguugug

SEQ ID NO: 111261 - RNA, 22 nt, Human
uucccugugcaguauguuccaa

SEQ ID NO: 111262 - RNA, 22 nt, Human
ggaggcccagaaggaagcccag

SEQ ID NO: 111263 - RNA, 22 nt, Human
ggcuccagauguccccuggcaa

SEQ ID NO: 111264 - RNA, 22 nt, Human
augcacaagguagauuauuauu

SEQ ID NO: 111265 - RNA, 22 nt, Human
uuuucaauuuucauuugcaaga

SEQ ID NO: 111266 - RNA, 22 nt, Human
auuagugguguauuuggcacua

SEQ ID NO: 111267 - RNA, 22 nt, Human
caguggagaccugccugcugga

SEQ ID NO: 111268 - RNA, 22 nt, Human
aaaugcuuuaauugaguucaug

SEQ ID NO: 111269 - RNA, 22 nt, Human
cucaugcugcaaauggcuguuu

SEQ ID NO: 111270 - RNA, 22 nt, Human
aaauuaaaguuuuauuuagagc

SEQ ID NO: 111271 - RNA, 22 nt, Human
uuuucacugacuuggucuggaa

SEQ ID NO: 111272 - RNA, 22 nt, Human
ggaggaagagaccagggggcuu

SEQ ID NO: 111273 - RNA, 22 nt, Human
agcaagggucucucauggcuug

SEQ ID NO: 111274 - RNA, 22 nt, Human
uucauuagcacauuuccuuggu

SEQ ID NO: 111275 - RNA, 22 nt, Human
gucugcagcacugugcacgguc

SEQ ID NO: 111276 - RNA, 22 nt, Human
uucauaugaauuggguuuuuuu

SEQ ID NO: 111277 - RNA, 22 nt, Human
ccagggaggucauagugcuggu

SEQ ID NO: 111278 - RNA, 22 nt, Human
cuggagaacucugugcuucacu

SEQ ID NO: 111279 - RNA, 22 nt, Human
auuugcuuguucaccaguacuu

SEQ ID NO: 111280 - RNA, 22 nt, Human
uaguauuuguaauuaucaaagc

SEQ ID NO: 111281 - RNA, 22 nt, Human
ggcaggaaguaaggaugcuaca

SEQ ID NO: 111282 - RNA, 21 nt, Human
ugcuuucugugcuuuuucugc

SEQ ID NO: 111283 - RNA, 20 nt, Human
ccuuguggaugucuuuuuug

SEQ ID NO: 111284 - RNA, 22 nt, Human
cagaccuggaaaacaggcuugc

SEQ ID NO: 111285 - RNA, 22 nt, Human
ccaaggcuguggggcugugcag

SEQ ID NO: 111286 - RNA, 22 nt, Human
aagcucagcugguggugauugc

SEQ ID NO: 111287 - RNA, 22 nt, Human
uacaagcucuuguagggggaaa

SEQ ID NO: 111288 - RNA, 22 nt, Human
agggcgugguggugcuggagca

SEQ ID NO: 111289 - RNA, 22 nt, Human
ucacaucugugugauugucauu

SEQ ID NO: 111290 - RNA, 22 nt, Human
ugugggcguggguuggggaggg

SEQ ID NO: 111291 - RNA, 22 nt, Human
aauuuauccuuuugcuaaagca

SEQ ID NO: 111292 - RNA, 22 nt, Human
ccacuuugagaagcugaugaaa

SEQ ID NO: 111293 - RNA, 22 nt, Human
aaucauaacaaaagcaauuaua

SEQ ID NO: 111294 - RNA, 22 nt, Human
acauuccugaagguaaugagaa

SEQ ID NO: 111295 - RNA, 22 nt, Human
cuccucccagcccaggcgccac

SEQ ID NO: 111296 - RNA, 22 nt, Human
auuuauuuucccucaaguaccu

SEQ ID NO: 111297 - RNA, 22 nt, Human
gccaguggucagugggagggug

SEQ ID NO: 111298 - RNA, 19 nt, Human
ugcagcuguaugagcuuaa

SEQ ID NO: 111299 - RNA, 22 nt, Human
ugauucacagacuucacaaggc

SEQ ID NO: 111300 - RNA, 20 nt, Human
gaacauaaauaacucuuuac

SEQ ID NO: 111301 - RNA, 20 nt, Human
uccccuccacuuuccuccua

SEQ ID NO: 111302 - RNA, 17 nt, Human
ucuccuggcucuaucag

SEQ ID NO: 111303 - RNA, 21 nt, Human
guucuuaguuauauucucaau

SEQ ID NO: 111304 - RNA, 22 nt, Human
aguaggauguuuagcccuucuu

SEQ ID NO: 111305 - RNA, 22 nt, Human
uugccaggagacaucuggagcc

SEQ ID NO: 111306 - RNA, 22 nt, Human
uaaaugauaguauugaagguag

SEQ ID NO: 111307 - RNA, 22 nt, Human
guuuuaucuauguaauuauaaa

SEQ ID NO: 111308 - RNA, 18 nt, Human
uuuccucauuugcagacu

SEQ ID NO: 111309 - RNA, 18 nt, Human
acaaaaauagugcuuugg

SEQ ID NO: 111310 - RNA, 22 nt, Human
ggaagcugucugcccggcgcuc

SEQ ID NO: 111311 - RNA, 22 nt, Human
aggguggaggacaggccaguga

SEQ ID NO: 111312 - RNA, 22 nt, Human
uuuaaaacagcauuuaaaaggu

SEQ ID NO: 111313 - RNA, 22 nt, Human
uugaccagaaaaguuaguaauu

SEQ ID NO: 111314 - RNA, 22 nt, Human
uuuuuguaaaugaaguuuuauu

SEQ ID NO: 111315 - RNA, 19 nt, Human
ccaguuuuuuaauauucaa

SEQ ID NO: 111316 - RNA, 19 nt, Human
agcaucuccacagaaaaag

SEQ ID NO: 111317 - RNA, 22 nt, Human
ccccauggaaaacccaccuagg

SEQ ID NO: 111318 - RNA, 22 nt, Human
ccuuuuaucgcgaagaacucca

SEQ ID NO: 111319 - RNA, 22 nt, Human
agcuuucuauauaugaguugcu

SEQ ID NO: 111320 - RNA, 22 nt, Human
ucagcucucucuuggugaucuc

SEQ ID NO: 111321 - RNA, 22 nt, Human
uuuauguugagcaaaauaccac

SEQ ID NO: 111322 - RNA, 22 nt, Human
auauuuuugcagaauuuuucgu

SEQ ID NO: 111323 - RNA, 22 nt, Human
uggaggcccagcugggggccgg

SEQ ID NO: 111324 - RNA, 22 nt, Human
uguuuuuuagagugauacuuuu

SEQ ID NO: 111325 - RNA, 22 nt, Human
cagcuccaucuugcuuauacca

SEQ ID NO: 111326 - RNA, 22 nt, Human
agcgcccguugagucgcgcggu

SEQ ID NO: 111327 - RNA, 19 nt, Human
gcugggauaggauguauuu

SEQ ID NO: 111328 - RNA, 22 nt, Human
auauguuaugccauuuucaagg

SEQ ID NO: 111329 - RNA, 22 nt, Human
agcucuuccuccauucuggcca

SEQ ID NO: 111330 - RNA, 22 nt, Human
ugguugauuaauuuugccaagc

SEQ ID NO: 111331 - RNA, 23 nt, Human
gcgggcggagccgggaggcgggg

SEQ ID NO: 111332 - RNA, 22 nt, Human
gagggggaaaagggcagcagag

SEQ ID NO: 111333 - RNA, 22 nt, Human
gcugcaggaggugguagggucu

SEQ ID NO: 111334 - RNA, 23 nt, Human
ucugccuccuaauuguugguguc

SEQ ID NO: 111335 - RNA, 22 nt, Human
uggaaguggcaggggagacgua

SEQ ID NO: 111336 - RNA, 22 nt, Human
auugaaauuaauuucugcuuuc

SEQ ID NO: 111337 - RNA, 19 nt, Human
uccuacaugagacagagag

SEQ ID NO: 111338 - RNA, 23 nt, Human
uggguuucagugccaaugcugcc

SEQ ID NO: 111339 - RNA, 20 nt, Human
ugcugugugucuacuguggg

SEQ ID NO: 111340 - RNA, 22 nt, Human
caaauguuugguggcauuuugu

SEQ ID NO: 111341 - RNA, 20 nt, Human
ucacuguaauugccuacauu

SEQ ID NO: 111342 - RNA, 22 nt, Human
caauaccucuuggugauugggc

SEQ ID NO: 111343 - RNA, 22 nt, Human
uucaugucuuugauucugauaa

SEQ ID NO: 111344 - RNA, 22 nt, Human
auuuucuugucucuguuguagg

SEQ ID NO: 111345 - RNA, 22 nt, Human
aggccccacaaacucgccuuug

SEQ ID NO: 111346 - RNA, 22 nt, Human
acuuguaaaauagagauaggga

SEQ ID NO: 111347 - RNA, 22 nt, Human
auuaaaaaaagauaaugaguua

SEQ ID NO: 111348 - RNA, 21 nt, Human
auacaguucagcuuuuacuau

SEQ ID NO: 111349 - RNA, 22 nt, Human
gccucucuggcaaagcggugau

SEQ ID NO: 111350 - RNA, 21 nt, Human
gcgcgcucgugcucgacgcgc

SEQ ID NO: 111351 - RNA, 22 nt, Human
uucuucuuuccuauaauuaauu

SEQ ID NO: 111352 - RNA, 22 nt, Human
ucuucaucucuaaaaugggaac

SEQ ID NO: 111353 - RNA, 20 nt, Human
uucucugcagcaggcggccc

SEQ ID NO: 111354 - RNA, 22 nt, Human
ugaaaaaugcuuuaaugcaugu

SEQ ID NO: 111355 - RNA, 22 nt, Human
aagugauuuucccaccaucuac

SEQ ID NO: 111356 - RNA, 22 nt, Human
caguggacacuuccucuacaau

SEQ ID NO: 111357 - RNA, 22 nt, Human
gaaccauuuaauggagaugcuc

SEQ ID NO: 111358 - RNA, 22 nt, Human
uagggaggguuugggguggagg

SEQ ID NO: 111359 - RNA, 22 nt, Human
aguuauuuuucacuauuaggcu

SEQ ID NO: 111360 - RNA, 22 nt, Human
ggggaaggaaggggagggcacg

SEQ ID NO: 111361 - RNA, 22 nt, Human
uaguggaaccuucuaaaugacg

SEQ ID NO: 111362 - RNA, 22 nt, Human
ucggcuccucccuggaaagggg

SEQ ID NO: 111363 - RNA, 22 nt, Human
gcgccgacccucccugccggac

SEQ ID NO: 111364 - RNA, 22 nt, Human
uauuaaaagagaaaaagccacc

SEQ ID NO: 111365 - RNA, 22 nt, Human
acgugugugugcacguguguau

SEQ ID NO: 111366 - RNA, 22 nt, Human
aacuagugucuguaugauaagg

SEQ ID NO: 111367 - RNA, 22 nt, Human
ucacuuccuugcagcuguagaa

SEQ ID NO: 111368 - RNA, 22 nt, Human
ggagccaguuuagaccucaguu

SEQ ID NO: 111369 - RNA, 22 nt, Human
ugaggaagugguuguaugguuu

SEQ ID NO: 111370 - RNA, 22 nt, Human
uaugaauauaccacaauuuagg

SEQ ID NO: 111371 - RNA, 22 nt, Human
cagggccaggccucaggggcgc

SEQ ID NO: 111372 - RNA, 22 nt, Human
aaauguuucauucuauuuuuag

SEQ ID NO: 111373 - RNA, 22 nt, Human
auucuuuucucuaaaugaugaa

SEQ ID NO: 111374 - RNA, 22 nt, Human
cuaggaugcuguaauggugucu

SEQ ID NO: 111375 - RNA, 22 nt, Human
uuacuuuuuucccccuuagaug

SEQ ID NO: 111376 - RNA, 22 nt, Human
gcagccugaguuuagcucgucg

SEQ ID NO: 111377 - RNA, 22 nt, Human
uuuuauuuguauguugaaugua

SEQ ID NO: 111378 - RNA, 22 nt, Human
aucucacuucugucauguggca

SEQ ID NO: 111379 - RNA, 22 nt, Human
uggggcuggccaggaggagucu

SEQ ID NO: 111380 - RNA, 22 nt, Human
uaccuggauaaauguacaaccg

SEQ ID NO: 111381 - RNA, 22 nt, Human
agcagggagacagugcagcauu

SEQ ID NO: 111382 - RNA, 22 nt, Human
auaaaaauguuuuuguguggua

SEQ ID NO: 111383 - RNA, 22 nt, Human
uacuuacacugaagcaaagaua

SEQ ID NO: 111384 - RNA, 22 nt, Human
agaguguagugaaaagagauua

SEQ ID NO: 111385 - RNA, 22 nt, Human
cuccuuugagcaaaucuuugau

SEQ ID NO: 111386 - RNA, 22 nt, Human
aagccagccaguuccagcagcu

SEQ ID NO: 111387 - RNA, 22 nt, Human
auggugaugaugaugaugauaa

SEQ ID NO: 111388 - RNA, 22 nt, Human
uccauguauugcuaacaaauag

SEQ ID NO: 111389 - RNA, 20 nt, Human
cauuccaugcaucuuggucc

SEQ ID NO: 111390 - RNA, 22 nt, Human
uggaguuuuaaucuguacagaa

SEQ ID NO: 111391 - RNA, 22 nt, Human
aauauuuugggacugaggaauu

SEQ ID NO: 111392 - RNA, 22 nt, Human
gaguucuagauguauuauuaau

SEQ ID NO: 111393 - RNA, 22 nt, Human
aggcaacagacaggcuugguuc

SEQ ID NO: 111394 - RNA, 22 nt, Human
uucuuuuaauuucugucugcag

SEQ ID NO: 111395 - RNA, 22 nt, Human
guucaaucucucaugcauuuuc

SEQ ID NO: 111396 - RNA, 22 nt, Human
gaauuccaggugagagaaggua

SEQ ID NO: 111397 - RNA, 22 nt, Human
ucaccauguacaugaagggcgg

SEQ ID NO: 111398 - RNA, 22 nt, Human
auagggaggcggagggagcugg

SEQ ID NO: 111399 - RNA, 22 nt, Human
agagggagagauuggcaaucag

SEQ ID NO: 111400 - RNA, 22 nt, Human
aggcugggaaguguguccugag

SEQ ID NO: 111401 - RNA, 21 nt, Human
gcagcucaggauauagacuug

SEQ ID NO: 111402 - RNA, 22 nt, Human
auuuuauuuugggaucuuuuua

SEQ ID NO: 111403 - RNA, 23 nt, Human
aaugugaaauugaguuuuuguua

SEQ ID NO: 111404 - RNA, 22 nt, Human
aacgagcugggggggccggggg

SEQ ID NO: 111405 - RNA, 22 nt, Human
uguugaagcaccucugucuuuc

SEQ ID NO: 111406 - RNA, 22 nt, Human
gaggucagugugggggcaaggg

SEQ ID NO: 111407 - RNA, 22 nt, Human
agacuagguauagguaauaacu

SEQ ID NO: 111408 - RNA, 22 nt, Human
agugaggggagaaugaggugga

SEQ ID NO: 111409 - RNA, 22 nt, Human
uccucagcaagacgcuggcagc

SEQ ID NO: 111410 - RNA, 22 nt, Human
auucaaugcacauguuuuggau

SEQ ID NO: 111411 - RNA, 19 nt, Human
ccucggggucugaagucag

SEQ ID NO: 111412 - RNA, 22 nt, Human
ccgcucuuugagacucucccga

SEQ ID NO: 111413 - RNA, 22 nt, Human
aauggaaaaagaacuguuuaaa

SEQ ID NO: 111414 - RNA, 22 nt, Human
uaaaacuaugcaaccuacuacc

SEQ ID NO: 111415 - RNA, 20 nt, Human
uuggagaucacguguccagg

SEQ ID NO: 111416 - RNA, 22 nt, Human
auucauucugaccucaagagaa

SEQ ID NO: 111417 - RNA, 22 nt, Human
guuuaaaagcaaccaacaggcu

SEQ ID NO: 111418 - RNA, 22 nt, Human
gucacuuugcuugcgaugcucc

SEQ ID NO: 111419 - RNA, 22 nt, Human
uuaaaagaauccuguuauccuc

SEQ ID NO: 111420 - RNA, 22 nt, Human
agauggaggaaagcaguuagaa

SEQ ID NO: 111421 - RNA, 22 nt, Human
cuauguuucagauauauauaua

SEQ ID NO: 111422 - RNA, 22 nt, Human
acauuuccaaagaugccaguca

SEQ ID NO: 111423 - RNA, 22 nt, Human
aggggcugagaguuugaugugg

SEQ ID NO: 111424 - RNA, 22 nt, Human
agucacuguucugucaugucaa

SEQ ID NO: 111425 - RNA, 23 nt, Human
uugcuuuugccccaaaagaguua

SEQ ID NO: 111426 - RNA, 22 nt, Human
ucagucacugugaaaugaauuu

SEQ ID NO: 111427 - RNA, 22 nt, Human
uauuucaugagugaauaucuag

SEQ ID NO: 111428 - RNA, 22 nt, Human
cagcgguggcaaggugacugug

SEQ ID NO: 111429 - RNA, 22 nt, Human
gcuggaagggccagcuuucagg

SEQ ID NO: 111430 - RNA, 22 nt, Human
gcgggccggcaggggaggaguu

SEQ ID NO: 111431 - RNA, 22 nt, Human
ucucucugcuguccagcguuau

SEQ ID NO: 111432 - RNA, 22 nt, Human
uaaaguauucaaguagcuuucu

SEQ ID NO: 111433 - RNA, 22 nt, Human
gcuuucccaaccuucuugguau

SEQ ID NO: 111434 - RNA, 22 nt, Human
uuuuuuuccaguuauucauuuu

SEQ ID NO: 111435 - RNA, 22 nt, Human
uuuuuuuguagguguaugaaaa

SEQ ID NO: 111436 - RNA, 22 nt, Human
uuuuucuuugguaacucuuccu

SEQ ID NO: 111437 - RNA, 22 nt, Human
uuuuugaauaagugcaucauca

SEQ ID NO: 111438 - RNA, 19 nt, Human
uuuuucccccucuccucag

SEQ ID NO: 111439 - RNA, 22 nt, Human
uuuuucuuugcuuuccacuggc

SEQ ID NO: 111440 - RNA, 22 nt, Human
uuuuucuccucucucuuucauu

SEQ ID NO: 111441 - RNA, 22 nt, Human
uuuuugcccuaaagaagucauu

SEQ ID NO: 111442 - RNA, 21 nt, Human
uuuuuggagggguggggagga

SEQ ID NO: 111443 - RNA, 22 nt, Human
uuuuuggacccaucuucuuuuu

SEQ ID NO: 111444 - RNA, 22 nt, Human
uuuuuguauaugcuucgaggau

SEQ ID NO: 111445 - RNA, 22 nt, Human
uuuuugggaagaauucugauau

SEQ ID NO: 111446 - RNA, 20 nt, Human
uuuuuuaaauagagcuguug

SEQ ID NO: 111447 - RNA, 22 nt, Human
uuuuuguggggggcggugugaa

SEQ ID NO: 111448 - RNA, 22 nt, Human
uuuuuuccagcuucuagaggcc

SEQ ID NO: 111449 - RNA, 22 nt, Human
uuuuuucuucucuaucuuaaua

SEQ ID NO: 111450 - RNA, 22 nt, Human
uuuuuuccugguuacagauugu

SEQ ID NO: 111451 - RNA, 18 nt, Human
uuuuuuguucuguuuugu

SEQ ID NO: 111452 - RNA, 22 nt, Human
uuuuuuuagaaagaucauaguu

SEQ ID NO: 111453 - RNA, 22 nt, Human
uuuuuugguuuggggauuauuu

SEQ ID NO: 111454 - RNA, 22 nt, Human
uuuuaaguauuuucuuuuuuua

SEQ ID NO: 111455 - RNA, 22 nt, Human
uuuuaaauggcuuuuacuuuuc

SEQ ID NO: 111456 - RNA, 22 nt, Human
uuuuaauucaacauuugcuuuu

SEQ ID NO: 111457 - RNA, 22 nt, Human
uuuuagagacagcauggagaaa

SEQ ID NO: 111458 - RNA, 22 nt, Human
uuuuauaaaaccuguuugaccu

SEQ ID NO: 111459 - RNA, 22 nt, Human
uuuuaguaauacuuuggccuuu

SEQ ID NO: 111460 - RNA, 22 nt, Human
uuuucaauuuucauuugcaaga

SEQ ID NO: 111461 - RNA, 22 nt, Human
uuuucaaucaaguuuauuuaua

SEQ ID NO: 111462 - RNA, 22 nt, Human
uuuucacugacuuggucuggaa

SEQ ID NO: 111463 - RNA, 22 nt, Human
uuuucaguuccaucucugcucu

SEQ ID NO: 111464 - RNA, 22 nt, Human
uuuuaucuuacauggaaucucc

SEQ ID NO: 111465 - RNA, 22 nt, Human
uuuucaacuuuauuuuccccca

SEQ ID NO: 111466 - RNA, 22 nt, Human
uuuguuaggguuucagcuagcc

SEQ ID NO: 111467 - RNA, 22 nt, Human
uuuguuaugguuggaagcagga

SEQ ID NO: 111468 - RNA, 22 nt, Human
uuuguguuuucaggcacauggc

SEQ ID NO: 111469 - RNA, 22 nt, Human
uuuagagauaaaugcucuccca

SEQ ID NO: 111470 - RNA, 22 nt, Human
uuuagaaugaaugcaagagaau

SEQ ID NO: 111471 - RNA, 22 nt, Human
uuuaaugucuuggaaaaagacu

SEQ ID NO: 111472 - RNA, 22 nt, Human
uuuaaugucuuuggccuuuaau

SEQ ID NO: 111473 - RNA, 22 nt, Human
uuuacuuuugguaaggucauuu

SEQ ID NO: 111474 - RNA, 22 nt, Human
uuuacuuguuuugcucuuuucc

SEQ ID NO: 111475 - RNA, 22 nt, Human
uuuacuguuuacagcuaaugca

SEQ ID NO: 111476 - RNA, 22 nt, Human
uuuguugaauggcaggauuuua

SEQ ID NO: 111477 - RNA, 19 nt, Human
uuuguuguaucagagcuuu

SEQ ID NO: 111478 - RNA, 21 nt, Human
uuuguucaggggcaaaguuaa

SEQ ID NO: 111479 - RNA, 22 nt, Human
uuuguucaccuagcaaacuuuu

SEQ ID NO: 111480 - RNA, 22 nt, Human
uuuguugucuucauaauacuuu

SEQ ID NO: 111481 - RNA, 22 nt, Human
uuuguuuccagccuuuugucuu

SEQ ID NO: 111482 - RNA, 17 nt, Human
uuuguuucauacuucau

SEQ ID NO: 111483 - RNA, 22 nt, Human
uuuuaaaacaugucaaaaugug

SEQ ID NO: 111484 - RNA, 22 nt, Human
uuuguuuuggugucaugcguga

SEQ ID NO: 111485 - RNA, 22 nt, Human
uuuguuugcugagugaauucaa

SEQ ID NO: 111486 - RNA, 22 nt, Human
uuuuccuucuuccugccuugcc

SEQ ID NO: 111487 - RNA, 22 nt, Human
uuuucggagaauguuaaugugu

SEQ ID NO: 111488 - RNA, 22 nt, Human
uuuucucaguuuuuuucaaaag

SEQ ID NO: 111489 - RNA, 22 nt, Human
uuuucucacugagagccuugau

SEQ ID NO: 111490 - RNA, 22 nt, Human
uuuucuacaaucacucuggaag

SEQ ID NO: 111491 - RNA, 22 nt, Human
uuuuccuucugauacuccauuu

SEQ ID NO: 111492 - RNA, 22 nt, Human
uuuuccuuaacagagggagaaa

SEQ ID NO: 111493 - RNA, 23 nt, Human
uuuuccaaaucgacucucuaguu

SEQ ID NO: 111494 - RNA, 22 nt, Human
uuuucauuguuaguuucuccuu

SEQ ID NO: 111495 - RNA, 22 nt, Human
uuuucuguuuaugaaauugugu

SEQ ID NO: 111496 - RNA, 22 nt, Human
uuuucucuuugcuucucuaaaa

SEQ ID NO: 111497 - RNA, 22 nt, Human
uuuucuucggugcuggguugau

SEQ ID NO: 111498 - RNA, 22 nt, Human
uuuucugauccuucuaacuuga

SEQ ID NO: 111499 - RNA, 22 nt, Human
uuuugaugaccauucuucuuuu

SEQ ID NO: 111500 - RNA, 22 nt, Human
uuuugauacaaguuguaaaaaa

SEQ ID NO: 111501 - RNA, 22 nt, Human
uuuugagucuggcaguuuuguu

SEQ ID NO: 111502 - RNA, 22 nt, Human
uuuugucagggcaggaggaaga

SEQ ID NO: 111503 - RNA, 21 nt, Human
uuuuguguugcgcacuuugag

SEQ ID NO: 111504 - RNA, 22 nt, Human
uuuugguaguccagaguuuagu

SEQ ID NO: 111505 - RNA, 22 nt, Human
uuuugguauaauuuaaaauuaa

SEQ ID NO: 111506 - RNA, 22 nt, Human
uuuugggugcaaauuguuuguu

SEQ ID NO: 111507 - RNA, 22 nt, Human
uuuuggauugcuaacucagggu

SEQ ID NO: 111508 - RNA, 22 nt, Human
uuuuggaaaaaccaguauggaa

SEQ ID NO: 111509 - RNA, 22 nt, Human
uuuuuaagguuuguuuauauau

SEQ ID NO: 111510 - RNA, 22 nt, Human
uuuuuagcauaugucaaaucag

SEQ ID NO: 111511 - RNA, 22 nt, Human
uuuuuaaaagaugauuuaauga

SEQ ID NO: 111512 - RNA, 22 nt, Human
uuuuguuuacauuaaauuuuga

SEQ ID NO: 111513 - RNA, 22 nt, Human
uuuuuagcuguuauuguggaag

SEQ ID NO: 111514 - RNA, 22 nt, Human
uuuuuagggauuaguguuugag

SEQ ID NO: 111515 - RNA, 22 nt, Human
uuuuuauaagagcagcagaguu

SEQ ID NO: 111516 - RNA, 22 nt, Human
uuuuuauaagauuuaaaaugua

SEQ ID NO: 111517 - RNA, 22 nt, Human
uuuuucacacuccuuuccaguu

SEQ ID NO: 111518 - RNA, 22 nt, Human
gagaccuuaagagaugucagcu

SEQ ID NO: 111519 - RNA, 22 nt, Human
gaugauuccuuuguucauugug

SEQ ID NO: 111520 - RNA, 22 nt, Human
gaugauuuuguaacuggggaca

SEQ ID NO: 111521 - RNA, 22 nt, Human
gagacucagccccugcucucaa

SEQ ID NO: 111522 - RNA, 22 nt, Human
gauggauuuuuuauuaaaucag

SEQ ID NO: 111523 - RNA, 22 nt, Human
gagagucuuaaguuacagaacu

SEQ ID NO: 111524 - RNA, 22 nt, Human
gagauuaauuaaaaccuuuaug

SEQ ID NO: 111525 - RNA, 22 nt, Human
gagauuucauuugugaggcuca

SEQ ID NO: 111526 - RNA, 22 nt, Human
gagauuuccauauuuuguaaca

SEQ ID NO: 111527 - RNA, 22 nt, Human
gauggugauggcccuaagcuga

SEQ ID NO: 111528 - RNA, 22 nt, Human
gagcacuucagcauaaaucaca

SEQ ID NO: 111529 - RNA, 22 nt, Human
gagcagacugcacaguucuugc

SEQ ID NO: 111530 - RNA, 22 nt, Human
gaugguuuuacauuuuaauguu

SEQ ID NO: 111531 - RNA, 22 nt, Human
gauguaucugagcugcuuaggu

SEQ ID NO: 111532 - RNA, 22 nt, Human
gcaaagaauugauucauuuugc

SEQ ID NO: 111533 - RNA, 22 nt, Human
gagcuuuguuccgugguggcac

SEQ ID NO: 111534 - RNA, 22 nt, Human
gauuucauaaaacgagaaacuc

SEQ ID NO: 111535 - RNA, 22 nt, Human
gauuuuaaaagauguauaaggu

SEQ ID NO: 111536 - RNA, 21 nt, Human
gauuuuagggcagccaaacac

SEQ ID NO: 111537 - RNA, 22 nt, Human
gauuccuuucgccugccgagcu

SEQ ID NO: 111538 - RNA, 22 nt, Human
gauuguagacauauuagacugc

SEQ ID NO: 111539 - RNA, 20 nt, Human
gauuuaacgcugcgucuguc

SEQ ID NO: 111540 - RNA, 22 nt, Human
gagcccgugugugugugugugu

SEQ ID NO: 111541 - RNA, 22 nt, Human
gauucagagcugcaacaaagaa

SEQ ID NO: 111542 - RNA, 22 nt, Human
gauucuaucauucuguauauua

SEQ ID NO: 111543 - RNA, 22 nt, Human
gauucugaaauuaacagacugg

SEQ ID NO: 111544 - RNA, 22 nt, Human
gauuaagugaauuggagaaaag

SEQ ID NO: 111545 - RNA, 22 nt, Human
gauuaucaccaaauggccuccu

SEQ ID NO: 111546 - RNA, 22 nt, Human
gauguuuugaaagaagaauaca

SEQ ID NO: 111547 - RNA, 22 nt, Human
gcaauuggaaugaauucuauuu

SEQ ID NO: 111548 - RNA, 22 nt, Human
gcaaggaggguaaccacauuuc

SEQ ID NO: 111549 - RNA, 19 nt, Human
gcaaguuaucugucuccau

SEQ ID NO: 111550 - RNA, 22 nt, Human
gcaauuguauugucaagacaug

SEQ ID NO: 111551 - RNA, 22 nt, Human
gaggagaaacagccgugauagu

SEQ ID NO: 111552 - RNA, 22 nt, Human
gaggaaagcugguuuaaaguau

SEQ ID NO: 111553 - RNA, 22 nt, Human
gcacaaaagguacuucauguag

SEQ ID NO: 111554 - RNA, 22 nt, Human
gaggagcugggucagggagaca

SEQ ID NO: 111555 - RNA, 22 nt, Human
gagggaaaggggccaugauugg

SEQ ID NO: 111556 - RNA, 22 nt, Human
gcacucuguggagacaagauag

SEQ ID NO: 111557 - RNA, 22 nt, Human
gaggcucagagggacuuucaag

SEQ ID NO: 111558 - RNA, 22 nt, Human
gaggaugacaaagaaggcagac

SEQ ID NO: 111559 - RNA, 22 nt, Human
gcaggcaggauucagagauaca

SEQ ID NO: 111560 - RNA, 22 nt, Human
gaggguuucagugggacggguu

SEQ ID NO: 111561 - RNA, 22 nt, Human
gcagagaaugucagauuuuguu

SEQ ID NO: 111562 - RNA, 22 nt, Human
gagggcucaacuacuacuaggc

SEQ ID NO: 111563 - RNA, 22 nt, Human
gaggggaauguuccugagcugg

SEQ ID NO: 111564 - RNA, 22 nt, Human
gaggggcugggguugacuccaa

SEQ ID NO: 111565 - RNA, 22 nt, Human
gauauucauaggcagguauuua

SEQ ID NO: 111566 - RNA, 22 nt, Human
gaucacuuugauuagauguccu

SEQ ID NO: 111567 - RNA, 22 nt, Human
gaugauaacagcauuucaacug

SEQ ID NO: 111568 - RNA, 22 nt, Human
gauggcaaugcuagaaauuuag

SEQ ID NO: 111569 - RNA, 22 nt, Human
gcauuagacuaguacacggcag

SEQ ID NO: 111570 - RNA, 22 nt, Human
gauaggaggaugggaccuguga

SEQ ID NO: 111571 - RNA, 22 nt, Human
gcauucuugucaguggggucag

SEQ ID NO: 111572 - RNA, 22 nt, Human
gcauuggaaacugcuuuaugcu

SEQ ID NO: 111573 - RNA, 22 nt, Human
gauuugucuauauucaaauaug

SEQ ID NO: 111574 - RNA, 22 nt, Human
gcaaaaacaguguagucuucug

SEQ ID NO: 111575 - RNA, 22 nt, Human
gagguucacgcagggaggggac

SEQ ID NO: 111576 - RNA, 22 nt, Human
gauuucuucauuuaaaaauauu

SEQ ID NO: 111577 - RNA, 22 nt, Human
gauugcugccagcguguccgug

SEQ ID NO: 111578 - RNA, 22 nt, Human
gauugcauaugcauucugauac

SEQ ID NO: 111579 - RNA, 22 nt, Human
gauugcaucaauauuuagagua

SEQ ID NO: 111580 - RNA, 22 nt, Human
gauugauuuaauaugagaggau

SEQ ID NO: 111581 - RNA, 22 nt, Human
gauugauguaggugauaaaucu

SEQ ID NO: 111582 - RNA, 22 nt, Human
gcugcuggcuuccugcuguuuu

SEQ ID NO: 111583 - RNA, 22 nt, Human
gcauuucuguuuuuuuaaauga

SEQ ID NO: 111584 - RNA, 22 nt, Human
gcauuuuaauuggggcaguuag

SEQ ID NO: 111585 - RNA, 22 nt, Human
gcugauucuucugcuuuuucuc

SEQ ID NO: 111586 - RNA, 22 nt, Human
gcucucucuucugcaggccuua

SEQ ID NO: 111587 - RNA, 22 nt, Human
gcucugaacugucaugaauugg

SEQ ID NO: 111588 - RNA, 22 nt, Human
gcuccuuaugguccugacccua

SEQ ID NO: 111589 - RNA, 22 nt, Human
gcuaagcuuugagucuggacag

SEQ ID NO: 111590 - RNA, 22 nt, Human
gcuaagucaaaaaauucaaaau

SEQ ID NO: 111591 - RNA, 22 nt, Human
gcuacaaaaccagggcaaagga

SEQ ID NO: 111592 - RNA, 22 nt, Human
gccuuuuaaggcagagggagau

SEQ ID NO: 111593 - RNA, 22 nt, Human
ggaguuucugucaucccguccc

SEQ ID NO: 111594 - RNA, 22 nt, Human
gggugguuccuggaucugacug

SEQ ID NO: 111595 - RNA, 22 nt, Human
ggguauuugacaaacugacacu

SEQ ID NO: 111596 - RNA, 22 nt, Human
ggagagagggaucuuuguggag

SEQ ID NO: 111597 - RNA, 22 nt, Human
ggagauaugugaaaaagacagc

SEQ ID NO: 111598 - RNA, 22 nt, Human
ggggauuucccaaugcgaagca

SEQ ID NO: 111599 - RNA, 22 nt, Human
ggagaagaggagcuggaagccu

SEQ ID NO: 111600 - RNA, 22 nt, Human
ggggaaauauuucugaccugug

SEQ ID NO: 111601 - RNA, 22 nt, Human
gggcuggggcucuggggcuagg

SEQ ID NO: 111602 - RNA, 23 nt, Human
ggacaugucucuggguauuuuga

SEQ ID NO: 111603 - RNA, 23 nt, Human
ggaauuucagaugugaaauaaaa

SEQ ID NO: 111604 - RNA, 20 nt, Human
gggcucugcauccaucagcc

SEQ ID NO: 111605 - RNA, 22 nt, Human
ggacauaguugcuauggagagu

SEQ ID NO: 111606 - RNA, 20 nt, Human
ggaaguauccacaaauuccu

SEQ ID NO: 111607 - RNA, 17 nt, Human
ggaagaaaaggaucauc

SEQ ID NO: 111608 - RNA, 22 nt, Human
ggaaagagaaacaugaacuaga

SEQ ID NO: 111609 - RNA, 22 nt, Human
gggauguuuugcaggcaaagaa

SEQ ID NO: 111610 - RNA, 22 nt, Human
ggaaaagaauuguuaguuagug

SEQ ID NO: 111611 - RNA, 22 nt, Human
gggcaagagaggaagagauggc

SEQ ID NO: 111612 - RNA, 22 nt, Human
ggaaagaggacaucuuacuucu

SEQ ID NO: 111613 - RNA, 22 nt, Human
ggaaaaugcugaagcaucugaa

SEQ ID NO: 111614 - RNA, 22 nt, Human
gcuuuuaaauuaucugacaaug

SEQ ID NO: 111615 - RNA, 22 nt, Human
gcuguggguuccuccccugucc

SEQ ID NO: 111616 - RNA, 22 nt, Human
gggaggaagaguaggaauuuga

SEQ ID NO: 111617 - RNA, 22 nt, Human
gcuguggagaagcugccuaugg

SEQ ID NO: 111618 - RNA, 22 nt, Human
guaagaauauacccaggaguca

SEQ ID NO: 111619 - RNA, 22 nt, Human
guaacuuuuuccucauuggcua

SEQ ID NO: 111620 - RNA, 22 nt, Human
guaaaucuuggcaucugcuuuc

SEQ ID NO: 111621 - RNA, 22 nt, Human
gguuuuuggcucaauauuuugg

SEQ ID NO: 111622 - RNA, 22 nt, Human
gguuuucuuguucauuuuuuaa

SEQ ID NO: 111623 - RNA, 22 nt, Human
guaccuuucuaucuagaaggua

SEQ ID NO: 111624 - RNA, 22 nt, Human
guaauucugugugaaucuauua

SEQ ID NO: 111625 - RNA, 22 nt, Human
guaagguuggaugcaaucaacu

SEQ ID NO: 111626 - RNA, 22 nt, Human
gguguagggaaacuugacuaau

SEQ ID NO: 111627 - RNA, 22 nt, Human
guagauaauuuuggaaagcugg

SEQ ID NO: 111628 - RNA, 22 nt, Human
guagaauggggcucucaaagca

SEQ ID NO: 111629 - RNA, 22 nt, Human
guacuugauucauuauugcauu

SEQ ID NO: 111630 - RNA, 22 nt, Human
guagaaaauagauugucucuug

SEQ ID NO: 111631 - RNA, 22 nt, Human
guagucuuaggaaugauuuugu

SEQ ID NO: 111632 - RNA, 22 nt, Human
guaguuuucaugguuagaaaua

SEQ ID NO: 111633 - RNA, 22 nt, Human
guaguucuccaggggcuguuca

SEQ ID NO: 111634 - RNA, 22 nt, Human
guaguuuuucuugcaagaguag

SEQ ID NO: 111635 - RNA, 22 nt, Human
ggcagcagaacuggcccuguau

SEQ ID NO: 111636 - RNA, 22 nt, Human
ggcaggaaguaaggaugcuaca

SEQ ID NO: 111637 - RNA, 22 nt, Human
ggucgguuggagagaucaugaa

SEQ ID NO: 111638 - RNA, 22 nt, Human
ggauaauugaugauuuauaaga

SEQ ID NO: 111639 - RNA, 22 nt, Human
gguagagagugaggaggggcuc

SEQ ID NO: 111640 - RNA, 22 nt, Human
ggauugaagggaaccucagaau

SEQ ID NO: 111641 - RNA, 22 nt, Human
ggcuucaaaacacaugucaaga

SEQ ID NO: 111642 - RNA, 22 nt, Human
ggcuuauauguauucccagaga

SEQ ID NO: 111643 - RNA, 22 nt, Human
gcuggauuuaggguucccuccu

SEQ ID NO: 111644 - RNA, 22 nt, Human
ggcucuggcgagcuuuaguaca

SEQ ID NO: 111645 - RNA, 22 nt, Human
ggcugcuugauagauaugagua

SEQ ID NO: 111646 - RNA, 18 nt, Human
gcugaaauucuaaacaaa

SEQ ID NO: 111647 - RNA, 22 nt, Human
gcuauuuagaaaggcuuggaga

SEQ ID NO: 111648 - RNA, 22 nt, Human
gcuacaaauaaaaugggugacu

SEQ ID NO: 111649 - RNA, 22 nt, Human
gcuacaacugugucuguggggc

SEQ ID NO: 111650 - RNA, 22 nt, Human
gcuauuggcuaauuguugcaac

SEQ ID NO: 111651 - RNA, 22 nt, Human
gcucaugggcccagagcagccc

SEQ ID NO: 111652 - RNA, 22 nt, Human
ggauuugaugagacuaucuacu

SEQ ID NO: 111653 - RNA, 22 nt, Human
ggauuucuucucauaacugaga

SEQ ID NO: 111654 - RNA, 20 nt, Human
ggauugaacuauuucucagc

SEQ ID NO: 111655 - RNA, 22 nt, Human
ggagcaucuaccauuucuagau

SEQ ID NO: 111656 - RNA, 22 nt, Human
ggaucgauuccaaauguagauc

SEQ ID NO: 111657 - RNA, 22 nt, Human
ggauccuuccuggugaagacug

SEQ ID NO: 111658 - RNA, 22 nt, Human
ggaucguauuucaguuuuuugg

SEQ ID NO: 111659 - RNA, 19 nt, Human
ggagcagauaaacauacuu

SEQ ID NO: 111660 - RNA, 22 nt, Human
ggagaaacuaguuagauccaau

SEQ ID NO: 111661 - RNA, 22 nt, Human
ggagaggaaguuuaaagaauug

SEQ ID NO: 111662 - RNA, 21 nt, Human
gcgcgcucgugcucgacgcgc

SEQ ID NO: 111663 - RNA, 22 nt, Human
ggacggcuagcagcagaauuca

SEQ ID NO: 111664 - RNA, 23 nt, Human
ggacgugaggcgcccuuuuuccc

SEQ ID NO: 111665 - RNA, 22 nt, Human
gccuuuauauuacauuuggaag

SEQ ID NO: 111666 - RNA, 22 nt, Human
ggacaauuguacucgauuucaa

SEQ ID NO: 111667 - RNA, 22 nt, Human
ggaagauagaaguucaaaaguu

SEQ ID NO: 111668 - RNA, 22 nt, Human
gugcuuugcuaggaccgauugu

SEQ ID NO: 111669 - RNA, 22 nt, Human
guggaaauuuuaggaucaucuu

SEQ ID NO: 111670 - RNA, 22 nt, Human
guggaaauaugggcaacaaaga

SEQ ID NO: 111671 - RNA, 22 nt, Human
guaguuagaguugugcuggaga

SEQ ID NO: 111672 - RNA, 22 nt, Human
guggaggaagaucuuugaugau

SEQ ID NO: 111673 - RNA, 22 nt, Human
gugggcuuuuuugaaaccugaa

SEQ ID NO: 111674 - RNA, 22 nt, Human
guggggguaggggguuuucugg

SEQ ID NO: 111675 - RNA, 22 nt, Human
guggggguaggggguuuccugg

SEQ ID NO: 111676 - RNA, 22 nt, Human
gggccuuggaggagaaggacuu

SEQ ID NO: 111677 - RNA, 22 nt, Human
gugguuuagccuucauuaaccu

SEQ ID NO: 111678 - RNA, 22 nt, Human
guguauuucuagaagaaaugaa

SEQ ID NO: 111679 - RNA, 22 nt, Human
gugguaagugcuccuauuggcg

SEQ ID NO: 111680 - RNA, 22 nt, Human
guggucaagaccgggaauagga

SEQ ID NO: 111681 - RNA, 22 nt, Human
ggggaagaaauagaacauuuug

SEQ ID NO: 111682 - RNA, 19 nt, Human
guguucuguuauacaguug

SEQ ID NO: 111683 - RNA, 22 nt, Human
guguucuucacuguuagaaggu

SEQ ID NO: 111684 - RNA, 22 nt, Human
guguucuuuguagaggaucuug

SEQ ID NO: 111685 - RNA, 22 nt, Human
guguucuuuaugguuguagugu

SEQ ID NO: 111686 - RNA, 22 nt, Human
guguugaaaaguagcacugcuu

SEQ ID NO: 111687 - RNA, 22 nt, Human
gugucccaaagauuagaaauca

SEQ ID NO: 111688 - RNA, 22 nt, Human
gggcuguaggagcuggaauggg

SEQ ID NO: 111689 - RNA, 22 nt, Human
ggguuuuaccagauguguggug

SEQ ID NO: 111690 - RNA, 22 nt, Human
ggguuuuggggaggaagugagc

SEQ ID NO: 111691 - RNA, 22 nt, Human
ggguuuugugauugccucugaa

SEQ ID NO: 111692 - RNA, 22 nt, Human
guucuucagcccucagguccua

SEQ ID NO: 111693 - RNA, 23 nt, Human
guugccuuugcaucuucauccau

SEQ ID NO: 111694 - RNA, 22 nt, Human
guugauaauuaauagcuuuuga

SEQ ID NO: 111695 - RNA, 22 nt, Human
guugauuuaggguuuugguuuu

SEQ ID NO: 111696 - RNA, 22 nt, Human
guugagacguguauuggaaucu

SEQ ID NO: 111697 - RNA, 22 nt, Human
gguaagguugggugucagaggg

SEQ ID NO: 111698 - RNA, 22 nt, Human
gguaauguucugaugaauuugu

SEQ ID NO: 111699 - RNA, 22 nt, Human
guucuacaacuucgcuugcaga

SEQ ID NO: 111700 - RNA, 22 nt, Human
guucgucuguggugugaggugc

SEQ ID NO: 111701 - RNA, 22 nt, Human
guucuacaugacacucaacauu

SEQ ID NO: 111702 - RNA, 22 nt, Human
guucauuucaagucuaauccau

SEQ ID NO: 111703 - RNA, 22 nt, Human
guuccucugaaggauuuucaga

SEQ ID NO: 111704 - RNA, 22 nt, Human
guuccuauauagccuuaaggau

SEQ ID NO: 111705 - RNA, 22 nt, Human
guuccucucacaggcuggagcu

SEQ ID NO: 111706 - RNA, 22 nt, Human
guuccucugugguggaggaagg

SEQ ID NO: 111707 - RNA, 22 nt, Human
guucuguucuucacagguuugu

SEQ ID NO: 111708 - RNA, 22 nt, Human
guucuucagauuccauuucagu

SEQ ID NO: 111709 - RNA, 22 nt, Human
guucuguauauauccuagcaaa

SEQ ID NO: 111710 - RNA, 22 nt, Human
guucucuuaauccuaguuggua

SEQ ID NO: 111711 - RNA, 22 nt, Human
gggggaaaguggagguucguga

SEQ ID NO: 111712 - RNA, 22 nt, Human
gggguugauaauuagagaaaug

SEQ ID NO: 111713 - RNA, 18 nt, Human
guucaagcauuuugcucu

SEQ ID NO: 111714 - RNA, 22 nt, Human
guucaaggagcagcuugcuaca

SEQ ID NO: 111715 - RNA, 22 nt, Human
guucacauccuugugaggauuu

SEQ ID NO: 111716 - RNA, 22 nt, Human
guucaaccaugauuaggaacug

SEQ ID NO: 111717 - RNA, 22 nt, Human
guuauuaaauauuuuggugauu

SEQ ID NO: 111718 - RNA, 22 nt, Human
guguugugauuggucagucacu

SEQ ID NO: 111719 - RNA, 22 nt, Human
guguuucccuggcacaagaacc

SEQ ID NO: 111720 - RNA, 22 nt, Human
guguuuguauccuccauauaac

SEQ ID NO: 111721 - RNA, 22 nt, Human
ggggaggaagcuggaacacggg

SEQ ID NO: 111722 - RNA, 22 nt, Human
guuagaauggacaaagcugaaa

SEQ ID NO: 111723 - RNA, 23 nt, Human
guuaccgaccugauucggcagcc

SEQ ID NO: 111724 - RNA, 22 nt, Human
ggggauuuuucuuacucuuagg

SEQ ID NO: 111725 - RNA, 22 nt, Human
uaaccuuuuuuaaaguuuccug

SEQ ID NO: 111726 - RNA, 22 nt, Human
guaggaaaugaauaagguaccu

SEQ ID NO: 111727 - RNA, 22 nt, Human
uaaccaggaaaaagauaugcau

SEQ ID NO: 111728 - RNA, 22 nt, Human
uaacauuuaguuuuaagauggu

SEQ ID NO: 111729 - RNA, 22 nt, Human
uaacaacuuucugguguaacuu

SEQ ID NO: 111730 - RNA, 22 nt, Human
guaguucuuucucaauguucaa

SEQ ID NO: 111731 - RNA, 22 nt, Human
guaguuuuugagcuguaaucuu

SEQ ID NO: 111732 - RNA, 22 nt, Human
guauaaagaugccauacuuacu

SEQ ID NO: 111733 - RNA, 22 nt, Human
guauauccaauaggugaugaaa

SEQ ID NO: 111734 - RNA, 22 nt, Human
guaucaggugugagcauuuuaa

SEQ ID NO: 111735 - RNA, 22 nt, Human
guaucuuuauuuuaauuaagau

SEQ ID NO: 111736 - RNA, 22 nt, Human
guauuaugaaugccgaggcggc

SEQ ID NO: 111737 - RNA, 22 nt, Human
guauuauauaaccauugguucu

SEQ ID NO: 111738 - RNA, 22 nt, Human
uaagagauuuauugaggacuuc

SEQ ID NO: 111739 - RNA, 22 nt, Human
gucacaaaugauuuagcaauca

SEQ ID NO: 111740 - RNA, 22 nt, Human
gucagauucuuucauuugcuga

SEQ ID NO: 111741 - RNA, 22 nt, Human
gucagaagauagaggaaguuug

SEQ ID NO: 111742 - RNA, 22 nt, Human
gucacuuuuaagggccuuuucu

SEQ ID NO: 111743 - RNA, 22 nt, Human
uaaggaaaugcaaauuuaagaa

SEQ ID NO: 111744 - RNA, 22 nt, Human
gguuauuucugauuauaugaua

SEQ ID NO: 111745 - RNA, 22 nt, Human
gguucuggaaaagaaagcaaag

SEQ ID NO: 111746 - RNA, 22 nt, Human
uaaagaagaaaaggcuucaggc

SEQ ID NO: 111747 - RNA, 22 nt, Human
guaaauaucucacgaaugauuc

SEQ ID NO: 111748 - RNA, 22 nt, Human
guaaauacuaugagauaaugaa

SEQ ID NO: 111749 - RNA, 22 nt, Human
uaaaugauaguauugaagguag

SEQ ID NO: 111750 - RNA, 22 nt, Human
gguuuaucuuuacaaaugaaau

SEQ ID NO: 111751 - RNA, 23 nt, Human
uaaagauaguuuaaaggugaguu

SEQ ID NO: 111752 - RNA, 22 nt, Human
uaaagacaauuucgagcuguag

SEQ ID NO: 111753 - RNA, 22 nt, Human
guuuugauggaguguguuaaau

SEQ ID NO: 111754 - RNA, 22 nt, Human
guuuucuuguuaauuuugaacg

SEQ ID NO: 111755 - RNA, 22 nt, Human
guuuuguagucuggagacuguc

SEQ ID NO: 111756 - RNA, 22 nt, Human
ggugggaauccaggccuucauc

SEQ ID NO: 111757 - RNA, 22 nt, Human
guuuuauguuuuauagacacaa

SEQ ID NO: 111758 - RNA, 22 nt, Human
guuuucuccugcuauacagugc

SEQ ID NO: 111759 - RNA, 22 nt, Human
guuuuaucuauguaauuauaaa

SEQ ID NO: 111760 - RNA, 22 nt, Human
guugcuaugaaauuaaaauuua

SEQ ID NO: 111761 - RNA, 22 nt, Human
uacaaauuguuuugccacaaag

SEQ ID NO: 111762 - RNA, 22 nt, Human
uaauaacuacacucagaggacc

SEQ ID NO: 111763 - RNA, 22 nt, Human
uaauaauuaacagugauggguc

SEQ ID NO: 111764 - RNA, 22 nt, Human
uaauaaaaauuuaauucacauu

SEQ ID NO: 111765 - RNA, 22 nt, Human
uacaaucacccaaagagccaga

SEQ ID NO: 111766 - RNA, 22 nt, Human
gucucuuuugauuuuucacuca

SEQ ID NO: 111767 - RNA, 20 nt, Human
uacaauauucccacuuugcu

SEQ ID NO: 111768 - RNA, 20 nt, Human
uacaaggauguucaucagag

SEQ ID NO: 111769 - RNA, 22 nt, Human
uacaacuuacuugaauggcuuu

SEQ ID NO: 111770 - RNA, 22 nt, Human
uacuuaaaacacauuuagcauu

SEQ ID NO: 111771 - RNA, 22 nt, Human
uacuuaauuuuaaaagcuagau

SEQ ID NO: 111772 - RNA, 22 nt, Human
uacucgaaaucagagagaauaa

SEQ ID NO: 111773 - RNA, 22 nt, Human
uacuaucauuuuuuguugccaa

SEQ ID NO: 111774 - RNA, 22 nt, Human
uacuauuuugacaugaaauuga

SEQ ID NO: 111775 - RNA, 19 nt, Human
uacccggauagccagguag

SEQ ID NO: 111776 - RNA, 22 nt, Human
uaccgaagcugcuuuugcaugu

SEQ ID NO: 111777 - RNA, 22 nt, Human
uagaguguaagcuccuugaggg

SEQ ID NO: 111778 - RNA, 22 nt, Human
uagaucucugccuuguucagag

SEQ ID NO: 111779 - RNA, 22 nt, Human
uagauuccaaaauaguuugguu

SEQ ID NO: 111780 - RNA, 22 nt, Human
gugccaaauagcuugauuaaga

SEQ ID NO: 111781 - RNA, 22 nt, Human
uagcaggaggcaguuccucgcu

SEQ ID NO: 111782 - RNA, 22 nt, Human
uagcaaucugugaugugugugu

SEQ ID NO: 111783 - RNA, 22 nt, Human
uagacauuuacuuugaaaaaau

SEQ ID NO: 111784 - RNA, 22 nt, Human
uagaaugggaggggaaucaucc

SEQ ID NO: 111785 - RNA, 22 nt, Human
uagacugugagcuccuugaggg

SEQ ID NO: 111786 - RNA, 22 nt, Human
uagaaguuaaaggaauacagaa

SEQ ID NO: 111787 - RNA, 22 nt, Human
gugaguuuucgugacacuauuu

SEQ ID NO: 111788 - RNA, 22 nt, Human
gugauaguucuuacuccaaagu

SEQ ID NO: 111789 - RNA, 22 nt, Human
uacuuaucuuagggaugcuugc

SEQ ID NO: 111790 - RNA, 22 nt, Human
uagagcccucuggccacguugc

SEQ ID NO: 111791 - RNA, 19 nt, Human
uagagcagcuucagauucc

SEQ ID NO: 111792 - RNA, 22 nt, Human
uagagaaauuacagcuuucuuu

SEQ ID NO: 111793 - RNA, 22 nt, Human
uagagaaauauuuguagugcug

SEQ ID NO: 111794 - RNA, 22 nt, Human
uagaccuccagcggaggagauu

SEQ ID NO: 111795 - RNA, 22 nt, Human
uagagagaaaccaggguuuggg

SEQ ID NO: 111796 - RNA, 22 nt, Human
uccucacaugcaaaaugguauu

SEQ ID NO: 111797 - RNA, 22 nt, Human
uccucuucaaaauagcucugaa

SEQ ID NO: 111798 - RNA, 19 nt, Human
uagaggagaauggcaaaga

SEQ ID NO: 111799 - RNA, 20 nt, Human
uccuacauugacccucuucc

SEQ ID NO: 111800 - RNA, 22 nt, Human
uccuaagaaacagacugaaaag

SEQ ID NO: 111801 - RNA, 17 nt, Human
uccuacaggugugcuga

SEQ ID NO: 111802 - RNA, 22 nt, Human
uacuuacacugaagcaaagaua

SEQ ID NO: 111803 - RNA, 22 nt, Human
uacuucauucaaguucgcuaua

SEQ ID NO: 111804 - RNA, 22 nt, Human
ucccauauuauggggaaaaacu

SEQ ID NO: 111805 - RNA, 22 nt, Human
uagcauuuagaacaccuugaga

SEQ ID NO: 111806 - RNA, 22 nt, Human
uagcauuuauugggcuagcaaa

SEQ ID NO: 111807 - RNA, 22 nt, Human
uagauuuaaaaagggugggaug

SEQ ID NO: 111808 - RNA, 22 nt, Human
uagauuguaagcuccuugaggg

SEQ ID NO: 111809 - RNA, 23 nt, Human
uccugcagauaagcugguugaca

SEQ ID NO: 111810 - RNA, 22 nt, Human
uccugaaugguguaauagguuu

SEQ ID NO: 111811 - RNA, 21 nt, Human
uagcuugaucauuuuauuucc

SEQ ID NO: 111812 - RNA, 22 nt, Human
uccuuguuggaauauccuuacc

SEQ ID NO: 111813 - RNA, 22 nt, Human
uccuuucaaauuuauuugacau

SEQ ID NO: 111814 - RNA, 22 nt, Human
uccuuuauuuaugggcagugua

SEQ ID NO: 111815 - RNA, 22 nt, Human
ucgugaagaaauguggacuuca

SEQ ID NO: 111816 - RNA, 22 nt, Human
ucguguuggaacugcuuuguaa

SEQ ID NO: 111817 - RNA, 22 nt, Human
uaguaugaaaauuagcgggagg

SEQ ID NO: 111818 - RNA, 22 nt, Human
uagucuuuguggucuuuagcua

SEQ ID NO: 111819 - RNA, 22 nt, Human
ucuaaagcuccuuccacuaaaa

SEQ ID NO: 111820 - RNA, 22 nt, Human
uaguaauauuccuacauuaugu

SEQ ID NO: 111821 - RNA, 22 nt, Human
ucguccaauaaccugccagcgc

SEQ ID NO: 111822 - RNA, 22 nt, Human
uagguaguuuccuguuguuggg

SEQ ID NO: 111823 - RNA, 22 nt, Human
uaguaauagcuguaaagugugu

SEQ ID NO: 111824 - RNA, 22 nt, Human
ucgcuuuaauggucuucacagc

SEQ ID NO: 111825 - RNA, 22 nt, Human
ucgcuucugaguuggugacccc

SEQ ID NO: 111826 - RNA, 22 nt, Human
uaggguuucaugcugguuucca

SEQ ID NO: 111827 - RNA, 22 nt, Human
uaggguagugggaaacuggacg

SEQ ID NO: 111828 - RNA, 22 nt, Human
uaggauugguguauguagguuu

SEQ ID NO: 111829 - RNA, 22 nt, Human
uacucauuggagaauuacgagg

SEQ ID NO: 111830 - RNA, 20 nt, Human
uccaguuuuggagacauucu

SEQ ID NO: 111831 - RNA, 23 nt, Human
ucccaacuuugaaauauuccaca

SEQ ID NO: 111832 - RNA, 22 nt, Human
uacugaaagagugguggacucu

SEQ ID NO: 111833 - RNA, 22 nt, Human
uacucuggaguugagaugcgag

SEQ ID NO: 111834 - RNA, 22 nt, Human
uccauugucaauaguauugauu

SEQ ID NO: 111835 - RNA, 22 nt, Human
ucccaaaacuugaagcaagccu

SEQ ID NO: 111836 - RNA, 22 nt, Human
uacugguguauuucuucuuauu

SEQ ID NO: 111837 - RNA, 22 nt, Human
uacuggaugcaacaaagcccag

SEQ ID NO: 111838 - RNA, 22 nt, Human
uccagaaagccguugacuuauu

SEQ ID NO: 111839 - RNA, 22 nt, Human
uccagaaaucucuguugauugu

SEQ ID NO: 111840 - RNA, 22 nt, Human
uaccauaaagcaggcaaaugag

SEQ ID NO: 111841 - RNA, 22 nt, Human
uacauuguguuaaaacagaaga

SEQ ID NO: 111842 - RNA, 22 nt, Human
uacauuugauuuuugcuucuuu

SEQ ID NO: 111843 - RNA, 22 nt, Human
uacauaauucauuagcuccucu

SEQ ID NO: 111844 - RNA, 22 nt, Human
uacagauaaaaaugcuguucuu

SEQ ID NO: 111845 - RNA, 22 nt, Human
uacagaccaguaguucucagcg

SEQ ID NO: 111846 - RNA, 22 nt, Human
uccaccuaagucuccgggagcu

SEQ ID NO: 111847 - RNA, 22 nt, Human
uccacgcucuuucuacuuuuca

SEQ ID NO: 111848 - RNA, 22 nt, Human
uaagcacuuuauaugcuuuauc

SEQ ID NO: 111849 - RNA, 22 nt, Human
uaagggaagucuucaggagaca

SEQ ID NO: 111850 - RNA, 22 nt, Human
uaaguaauugugguuuuugcca

SEQ ID NO: 111851 - RNA, 22 nt, Human
ucaugacaacuugcacaguuuu

SEQ ID NO: 111852 - RNA, 22 nt, Human
ucaucuuucuuuauggaaauac

SEQ ID NO: 111853 - RNA, 22 nt, Human
uaacuuuuuauccuguuaaaug

SEQ ID NO: 111854 - RNA, 22 nt, Human
uaagaaacauuuuuaugacagu

SEQ ID NO: 111855 - RNA, 22 nt, Human
uaagauauugagugguaauuug

SEQ ID NO: 111856 - RNA, 20 nt, Human
ucaguuucccuauuagguug

SEQ ID NO: 111857 - RNA, 21 nt, Human
uaauaauugggggcagggugg

SEQ ID NO: 111858 - RNA, 22 nt, Human
uaauaagugcuggcuguacauc

SEQ ID NO: 111859 - RNA, 20 nt, Human
ucaucuuucaaauuugugac

SEQ ID NO: 111860 - RNA, 22 nt, Human
uaaugaugaacacuuggaagaa

SEQ ID NO: 111861 - RNA, 22 nt, Human
ucauugguugcguaauuugauu

SEQ ID NO: 111862 - RNA, 22 nt, Human
ucauugguugcauaauuugauc

SEQ ID NO: 111863 - RNA, 22 nt, Human
ucauuggagcauaugaugguua

SEQ ID NO: 111864 - RNA, 22 nt, Human
uccaacuuaauugggaagauua

SEQ ID NO: 111865 - RNA, 22 nt, Human
uacaaucaggcucuagcuucuc

SEQ ID NO: 111866 - RNA, 22 nt, Human
uaauucuagauugacauuuuga

SEQ ID NO: 111867 - RNA, 22 nt, Human
uaauucuucaauccaguguuca

SEQ ID NO: 111868 - RNA, 22 nt, Human
uacaaauugccugacggcaggu

SEQ ID NO: 111869 - RNA, 22 nt, Human
uaauuauuaauuuuagguugcu

SEQ ID NO: 111870 - RNA, 22 nt, Human
uaauucuacagggaacucugga

SEQ ID NO: 111871 - RNA, 22 nt, Human
uaauuccacacucccgcaagcg

SEQ ID NO: 111872 - RNA, 22 nt, Human
uaaaaguuagcuaggacaaagu

SEQ ID NO: 111873 - RNA, 22 nt, Human
uaaaaugcucagauaaauauau

SEQ ID NO: 111874 - RNA, 22 nt, Human
uaaacgaagcuucaugcuugaa

SEQ ID NO: 111875 - RNA, 22 nt, Human
uaaaaucaugacagauugacau

SEQ ID NO: 111876 - RNA, 23 nt, Human
guuuuugcugcagcugaagaagg

SEQ ID NO: 111877 - RNA, 22 nt, Human
guuuuucuuugauuuagaacca

SEQ ID NO: 111878 - RNA, 22 nt, Human
uaaaacuaugcaaccuacuacc

SEQ ID NO: 111879 - RNA, 19 nt, Human
ucagcagauuuugcaaaca

SEQ ID NO: 111880 - RNA, 22 nt, Human
ucagauagcaagggauaccugu

SEQ ID NO: 111881 - RNA, 22 nt, Human
ucagaacuaacuuugcugaacc

SEQ ID NO: 111882 - RNA, 22 nt, Human
guuuuauaacuauagugagaau

SEQ ID NO: 111883 - RNA, 22 nt, Human
ucagaacucuagucucagccug

SEQ ID NO: 111884 - RNA, 22 nt, Human
ucagaacugcggggaagguggg

SEQ ID NO: 111885 - RNA, 22 nt, Human
guuuuaaucuccuuauuccuaa

SEQ ID NO: 111886 - RNA, 22 nt, Human
guuuuagugauaagaacaccaa

SEQ ID NO: 111887 - RNA, 22 nt, Human
guuugguucucauuguuuuucu

SEQ ID NO: 111888 - RNA, 22 nt, Human
guuugggauucuagacaaaaau

SEQ ID NO: 111889 - RNA, 22 nt, Human
guuuguguauauguguauuuuu

SEQ ID NO: 111890 - RNA, 22 nt, Human
guuuucuaaaacacauauaagu

SEQ ID NO: 111891 - RNA, 20 nt, Human
ucagaaugugacccccaugg

SEQ ID NO: 111892 - RNA, 22 nt, Human
guuuuuacuuccaaugcuauga

SEQ ID NO: 111893 - RNA, 22 nt, Human
guuuuguucaugaacauugggu

SEQ ID NO: 111894 - RNA, 22 nt, Human
guuuugugugugugcccacacg

SEQ ID NO: 111895 - RNA, 22 nt, Human
guuuuggagauguccauuuucc

SEQ ID NO: 111896 - RNA, 22 nt, Human
guuuugaugugauuucucaugu

SEQ ID NO: 111897 - RNA, 22 nt, Human
guuuugaagagaagcaagucug

SEQ ID NO: 111898 - RNA, 22 nt, Human
guuuuuaguuuaaguuuuugca

SEQ ID NO: 111899 - RNA, 22 nt, Human
guuuuucuagaaaucuccuccu

SEQ ID NO: 111900 - RNA, 21 nt, Human
ucagaccaacucuuguauccu

SEQ ID NO: 111901 - RNA, 22 nt, Human
ucagauaauccaauagagagga

SEQ ID NO: 111902 - RNA, 22 nt, Human
ucacucuuuaucuuuuaugucu

SEQ ID NO: 111903 - RNA, 22 nt, Human
ucaccuuuugaauugcuguugu

SEQ ID NO: 111904 - RNA, 22 nt, Human
ucagaaacuaaauguggauuug

SEQ ID NO: 111905 - RNA, 22 nt, Human
ucacugaacucucauagagaaa

SEQ ID NO: 111906 - RNA, 22 nt, Human
guuuccaggcuuugguaugguu

SEQ ID NO: 111907 - RNA, 22 nt, Human
guuugaacagaaggguugauca

SEQ ID NO: 111908 - RNA, 22 nt, Human
guuucucuuugguggguugaga

SEQ ID NO: 111909 - RNA, 22 nt, Human
ucacagauguuauccugaggau

SEQ ID NO: 111910 - RNA, 22 nt, Human
ucaauuggcuacaaauaaugua

SEQ ID NO: 111911 - RNA, 22 nt, Human
ucacauugcauuuucucauuug

SEQ ID NO: 111912 - RNA, 22 nt, Human
guuuaaaagcaaccaacaggcu

SEQ ID NO: 111913 - RNA, 22 nt, Human
guuuagauguagauucucuggu

SEQ ID NO: 111914 - RNA, 22 nt, Human
uauuuuuacuguuugaugauuc

SEQ ID NO: 111915 - RNA, 22 nt, Human
guugcaaaugggaagaugguua

SEQ ID NO: 111916 - RNA, 22 nt, Human
uauuuuggcuccugagcucuga

SEQ ID NO: 111917 - RNA, 19 nt, Human
guuguguuugguucuuuug

SEQ ID NO: 111918 - RNA, 22 nt, Human
ucaagucaauagguuaguaggu

SEQ ID NO: 111919 - RNA, 22 nt, Human
guuguuuucagcccagcauuag

SEQ ID NO: 111920 - RNA, 22 nt, Human
uauucuucaacuuuucuccucu

SEQ ID NO: 111921 - RNA, 21 nt, Human
uauucgcauuucugucuuuac

SEQ ID NO: 111922 - RNA, 22 nt, Human
uauucccacuccucagcaauuu

SEQ ID NO: 111923 - RNA, 18 nt, Human
uauuccucuuccucuauc

SEQ ID NO: 111924 - RNA, 22 nt, Human
guucccuugccuuuaguuugau

SEQ ID NO: 111925 - RNA, 22 nt, Human
guucagauucuuucucuuucac

SEQ ID NO: 111926 - RNA, 22 nt, Human
uauuaaaagagaaaaagccacc

SEQ ID NO: 111927 - RNA, 22 nt, Human
guuauuuugucuuguucaugaa

SEQ ID NO: 111928 - RNA, 18 nt, Human
uaugugucuguuacaacu

SEQ ID NO: 111929 - RNA, 22 nt, Human
uauguaacaccauuuacaaagu

SEQ ID NO: 111930 - RNA, 22 nt, Human
guguuaaucauuuuugauuuug

SEQ ID NO: 111931 - RNA, 22 nt, Human
gugugugucuacuuucaucucu

SEQ ID NO: 111932 - RNA, 22 nt, Human
uauggcucacaaauaauaaauu

SEQ ID NO: 111933 - RNA, 22 nt, Human
uauugugaaggccaugugcuaa

SEQ ID NO: 111934 - RNA, 22 nt, Human
guuccuaaauuugaaggacuuu

SEQ ID NO: 111935 - RNA, 22 nt, Human
uauuguauuagcucuuggagau

SEQ ID NO: 111936 - RNA, 22 nt, Human
uauucuucagcauaaaaauucu

SEQ ID NO: 111937 - RNA, 22 nt, Human
uauuucaguuaagaugagguca

SEQ ID NO: 111938 - RNA, 20 nt, Human
uauuucaaugugccaaguuu

SEQ ID NO: 111939 - RNA, 22 nt, Human
uauuuguauugucuuaucacuu

SEQ ID NO: 111940 - RNA, 22 nt, Human
uauuugauggaacucuugcuuu

SEQ ID NO: 111941 - RNA, 22 nt, Human
guucuuuacuucgcaucugcua

SEQ ID NO: 111942 - RNA, 22 nt, Human
uauuucaugagugaauaucuag

SEQ ID NO: 111943 - RNA, 22 nt, Human
uauuucaucugaacuucccaac

SEQ ID NO: 111944 - RNA, 22 nt, Human
guugauuuaaccucaccuuuga

SEQ ID NO: 111945 - RNA, 22 nt, Human
guugagaagaccauuuuguuca

SEQ ID NO: 111946 - RNA, 22 nt, Human
uauuuuggaugcauugagaugc

SEQ ID NO: 111947 - RNA, 22 nt, Human
uauccuaagguaguuuuaguuu

SEQ ID NO: 111948 - RNA, 22 nt, Human
uauaguucuuagcuggcaccag

SEQ ID NO: 111949 - RNA, 22 nt, Human
uauauuaaagugcuuugcagug

SEQ ID NO: 111950 - RNA, 22 nt, Human
uauauguagcucaaaaauuccc

SEQ ID NO: 111951 - RNA, 22 nt, Human
uauaugcagauuuucaucaucg

SEQ ID NO: 111952 - RNA, 22 nt, Human
uaugcagauaguuugccauuca

SEQ ID NO: 111953 - RNA, 22 nt, Human
uauaggguggguaaggaaaaaa

SEQ ID NO: 111954 - RNA, 22 nt, Human
uaugauuuucaugguagaguua

SEQ ID NO: 111955 - RNA, 19 nt, Human
uaugacaaguacuaguucu

SEQ ID NO: 111956 - RNA, 22 nt, Human
uaugaauauaccacaauuuagg

SEQ ID NO: 111957 - RNA, 22 nt, Human
gugugaguggcuaagugugccu

SEQ ID NO: 111958 - RNA, 22 nt, Human
uauagcaagagaaccauuacca

SEQ ID NO: 111959 - RNA, 22 nt, Human
uauauauaauguguacagguga

SEQ ID NO: 111960 - RNA, 22 nt, Human
uauauacacugauuaggauuuu

SEQ ID NO: 111961 - RNA, 22 nt, Human
uauaagaaacaaggcaaauuuu

SEQ ID NO: 111962 - RNA, 18 nt, Human
uauaaacacacuuagguu

SEQ ID NO: 111963 - RNA, 22 nt, Human
uauaaugucuuuguugaaaucu

SEQ ID NO: 111964 - RNA, 22 nt, Human
gugcucaagacauuaggaauau

SEQ ID NO: 111965 - RNA, 22 nt, Human
uaguuacuuuugcucuucauua

SEQ ID NO: 111966 - RNA, 22 nt, Human
uaguuauuucugcacuuaauga

SEQ ID NO: 111967 - RNA, 22 nt, Human
uagcauuucacugaucuucacu

SEQ ID NO: 111968 - RNA, 22 nt, Human
uaguuucuucaacugucccagc

SEQ ID NO: 111969 - RNA, 22 nt, Human
uaguuuucuuuuguguuauucu

SEQ ID NO: 111970 - RNA, 22 nt, Human
uaguuagaucuccaguuugguu

SEQ ID NO: 111971 - RNA, 22 nt, Human
ucagcguuaguuuuucaucuaa

SEQ ID NO: 111972 - RNA, 22 nt, Human
ugacauuugagagagauauaca

SEQ ID NO: 111973 - RNA, 18 nt, Human
ucagaaugauuuggugga

SEQ ID NO: 111974 - RNA, 22 nt, Human
ucagaaugaaauuucuuucaga

SEQ ID NO: 111975 - RNA, 22 nt, Human
ugacaucagacugugagaagag

SEQ ID NO: 111976 - RNA, 22 nt, Human
ugacagugugcccggagguuag

SEQ ID NO: 111977 - RNA, 22 nt, Human
ucagaagguacugaagacaugg

SEQ ID NO: 111978 - RNA, 22 nt, Human
ugaauuuuggcaauuuucugug

SEQ ID NO: 111979 - RNA, 22 nt, Human
ugaauuucuuuuuaaaauauua

SEQ ID NO: 111980 - RNA, 22 nt, Human
ugaauuuuaacauucugcugga

SEQ ID NO: 111981 - RNA, 22 nt, Human
ugacacacagggggauggaguu

SEQ ID NO: 111982 - RNA, 22 nt, Human
ucacuuuacaucuguaaaagga

SEQ ID NO: 111983 - RNA, 22 nt, Human
ugaauguguacacgauuguuug

SEQ ID NO: 111984 - RNA, 22 nt, Human
ugaauguggucaggaaauuguu

SEQ ID NO: 111985 - RNA, 22 nt, Human
ugaaugcuacccugcuggcucu

SEQ ID NO: 111986 - RNA, 22 nt, Human
ugaauuagagugaaggaaagcu

SEQ ID NO: 111987 - RNA, 22 nt, Human
ucacaguucaacuaguucagau

SEQ ID NO: 111988 - RNA, 22 nt, Human
ugaauucaaacuuuuuaacaag

SEQ ID NO: 111989 - RNA, 22 nt, Human
ucacuggauucauguuucuuua

SEQ ID NO: 111990 - RNA, 22 nt, Human
ucacuggaaaacaaauguuuua

SEQ ID NO: 111991 - RNA, 22 nt, Human
ucaauuuauguggcuauucauu

SEQ ID NO: 111992 - RNA, 22 nt, Human
ucacaagaagaaauuaaacugu

SEQ ID NO: 111993 - RNA, 22 nt, Human
ugaauagcaccuugaguaauga

SEQ ID NO: 111994 - RNA, 22 nt, Human
ugaaucaaugaauugcacuuca

SEQ ID NO: 111995 - RNA, 22 nt, Human
ugaaucugagccugcgcaaagu

SEQ ID NO: 111996 - RNA, 22 nt, Human
ugaaugaagcacuguaauucuc

SEQ ID NO: 111997 - RNA, 22 nt, Human
ugaaugaacugaugaacuuaac

SEQ ID NO: 111998 - RNA, 22 nt, Human
ucaaggaagggguaggaauaau

SEQ ID NO: 111999 - RNA, 22 nt, Human
ugaaguuuagaaaaagugccuu

SEQ ID NO: 112000 - RNA, 22 nt, Human
ugaauaaauaaacuuuuacuac

SEQ ID NO: 112001 - RNA, 22 nt, Human
ucaacagaagugauagcuauua

SEQ ID NO: 112002 - RNA, 22 nt, Human
ucaaauaugggccagaggaaau

SEQ ID NO: 112003 - RNA, 22 nt, Human
ucaaaucugauaggcgacaccu

SEQ ID NO: 112004 - RNA, 22 nt, Human
ucaaaaauaagauauucuggac

SEQ ID NO: 112005 - RNA, 22 nt, Human
uauuuuuuuaacauuuauugua

SEQ ID NO: 112006 - RNA, 22 nt, Human
ugaacuaauguuguguccuaau

SEQ ID NO: 112007 - RNA, 22 nt, Human
ugaaccugagggcaaagggaca

SEQ ID NO: 112008 - RNA, 22 nt, Human
ugaacauuuuugcuugcagcuu

SEQ ID NO: 112009 - RNA, 22 nt, Human
uauuuuuaccuaauuuaugaga

SEQ ID NO: 112010 - RNA, 22 nt, Human
ugaacuuacauugaggaauucu

SEQ ID NO: 112011 - RNA, 22 nt, Human
ugaaauguggagaugguaagua

SEQ ID NO: 112012 - RNA, 22 nt, Human
ugaaauugaguaccucuuuaua

SEQ ID NO: 112013 - RNA, 22 nt, Human
ugaaaaauauuuuuagaaauaa

SEQ ID NO: 112014 - RNA, 23 nt, Human
uauuuuccccuguaauauguauu

SEQ ID NO: 112015 - RNA, 22 nt, Human
uauuuuagaagauuuggagaaa

SEQ ID NO: 112016 - RNA, 22 nt, Human
uauuuuagccaacagaaugaug

SEQ ID NO: 112017 - RNA, 22 nt, Human
uauuucuagggcaugaaaauaa

SEQ ID NO: 112018 - RNA, 22 nt, Human
uauuuucucugccacacuucca

SEQ ID NO: 112019 - RNA, 22 nt, Human
uauuuugaggugaaagaguuug

SEQ ID NO: 112020 - RNA, 22 nt, Human
uauuuuaaaagcauuaauucuu

SEQ ID NO: 112021 - RNA, 22 nt, Human
uauuuguuucuaguggcagcaa

SEQ ID NO: 112022 - RNA, 18 nt, Human
uauuugugugugugugug

SEQ ID NO: 112023 - RNA, 22 nt, Human
ucuuuugugauuuucugaagca

SEQ ID NO: 112024 - RNA, 22 nt, Human
ucuuuuaucuguuguguaacaa

SEQ ID NO: 112025 - RNA, 22 nt, Human
uauuuacuuugaggaaguuguu

SEQ ID NO: 112026 - RNA, 22 nt, Human
uauuguuuuaagguguauuaau

SEQ ID NO: 112027 - RNA, 22 nt, Human
uauuuaaagucagcaacuuuuc

SEQ ID NO: 112028 - RNA, 22 nt, Human
uauuuacgcaaacaauugugca

SEQ ID NO: 112029 - RNA, 22 nt, Human
uauuuacuguguucaucccucu

SEQ ID NO: 112030 - RNA, 18 nt, Human
uauuuacuguguguuacc

SEQ ID NO: 112031 - RNA, 22 nt, Human
ucuuugcagaauuuaacuuugc

SEQ ID NO: 112032 - RNA, 22 nt, Human
uauuuaugcaucacuuuuuucc

SEQ ID NO: 112033 - RNA, 22 nt, Human
uauuuaggcagaaagugauauu

SEQ ID NO: 112034 - RNA, 22 nt, Human
ucuuugcugacacuuacacugu

SEQ ID NO: 112035 - RNA, 22 nt, Human
ucuuucucuccagccuggaccu

SEQ ID NO: 112036 - RNA, 22 nt, Human
ucuuucucauccaaacuaguug

SEQ ID NO: 112037 - RNA, 22 nt, Human
ucuuuaaauucuuaugagugaa

SEQ ID NO: 112038 - RNA, 22 nt, Human
uauugauuuuguugcuaccugg

SEQ ID NO: 112039 - RNA, 22 nt, Human
ucuucuuaggaaagucaggagg

SEQ ID NO: 112040 - RNA, 22 nt, Human
ucuugauggugauguuguguca

SEQ ID NO: 112041 - RNA, 22 nt, Human
ucuucuuuccuuuugugcauuu

SEQ ID NO: 112042 - RNA, 22 nt, Human
uaguggaaccuucuaaaugacg

SEQ ID NO: 112043 - RNA, 20 nt, Human
ucuaaugaagugagcuuagc

SEQ ID NO: 112044 - RNA, 22 nt, Human
ucuaccuucagaaugugggguu

SEQ ID NO: 112045 - RNA, 22 nt, Human
ucuacugagugcugagauuuug

SEQ ID NO: 112046 - RNA, 19 nt, Human
ucuuccaucuauccuccuc

SEQ ID NO: 112047 - RNA, 22 nt, Human
ugcagcaucuccuugugccaug

SEQ ID NO: 112048 - RNA, 22 nt, Human
ugcagcagaauauggcugcagg

SEQ ID NO: 112049 - RNA, 17 nt, Human
ucccacuucauuuucca

SEQ ID NO: 112050 - RNA, 19 nt, Human
ugcagcacuaaaaacuuuc

SEQ ID NO: 112051 - RNA, 22 nt, Human
ugcagaacacaguagacagaac

SEQ ID NO: 112052 - RNA, 22 nt, Human
ugcaacuacccccaggauuuua

SEQ ID NO: 112053 - RNA, 22 nt, Human
uccauguauugcuaacaaauag

SEQ ID NO: 112054 - RNA, 22 nt, Human
uccauuuacuauucucauaucg

SEQ ID NO: 112055 - RNA, 21 nt, Human
uccauucuuggugguucugca

SEQ ID NO: 112056 - RNA, 22 nt, Human
ugcaaaaguuuuauacacagau

SEQ ID NO: 112057 - RNA, 23 nt, Human
ugcaaaauuugcagaguucgaug

SEQ ID NO: 112058 - RNA, 22 nt, Human
ugcaaauuuuuuuauuuuuccu

SEQ ID NO: 112059 - RNA, 22 nt, Human
ugcaaauucuuuacucugugau

SEQ ID NO: 112060 - RNA, 22 nt, Human
uccauaugaucuguuguauggu

SEQ ID NO: 112061 - RNA, 22 nt, Human
ugauuuguuuaaauugcucguu

SEQ ID NO: 112062 - RNA, 22 nt, Human
ucauuuaauuuggaacucagag

SEQ ID NO: 112063 - RNA, 22 nt, Human
uccaaauucccaugacagaagu

SEQ ID NO: 112064 - RNA, 22 nt, Human
uccacaaagucuaugagaguug

SEQ ID NO: 112065 - RNA, 22 nt, Human
uccaaugugccuuauuuugagc

SEQ ID NO: 112066 - RNA, 22 nt, Human
ucauuguuucugcuuuucauga

SEQ ID NO: 112067 - RNA, 22 nt, Human
ugauauaaaagauucuuauuga

SEQ ID NO: 112068 - RNA, 22 nt, Human
ugaguuuuggaagauguuacag

SEQ ID NO: 112069 - RNA, 22 nt, Human
ugaguugcagucaauauugcaa

SEQ ID NO: 112070 - RNA, 22 nt, Human
ucauaggaguagcagugagagg

SEQ ID NO: 112071 - RNA, 22 nt, Human
ugagguuacauuaggaauaacc

SEQ ID NO: 112072 - RNA, 22 nt, Human
ugagguauuuggauuuauauuu

SEQ ID NO: 112073 - RNA, 23 nt, Human
ugaggucuuggaaguucuguuug

SEQ ID NO: 112074 - RNA, 22 nt, Human
ugacuagggauauuuucuuucc

SEQ ID NO: 112075 - RNA, 22 nt, Human
ugacuuuucuccucugaaguuu

SEQ ID NO: 112076 - RNA, 22 nt, Human
ugagaaaacaguuuguaauaau

SEQ ID NO: 112077 - RNA, 22 nt, Human
uccuuacuccuggagauucuga

SEQ ID NO: 112078 - RNA, 22 nt, Human
uccuuuuuagguuauuguacau

SEQ ID NO: 112079 - RNA, 22 nt, Human
uccuuuggaaacuggaugucuu

SEQ ID NO: 112080 - RNA, 22 nt, Human
uccuuuucuuugaggaaggugu

SEQ ID NO: 112081 - RNA, 22 nt, Human
uccucuucucuagagccggaau

SEQ ID NO: 112082 - RNA, 20 nt, Human
uccugaaauuacgugauuca

SEQ ID NO: 112083 - RNA, 22 nt, Human
ucccuuucuucuugguccaccu

SEQ ID NO: 112084 - RNA, 22 nt, Human
uccuaaauuuguacuagcauuu

SEQ ID NO: 112085 - RNA, 22 nt, Human
ucuaaucuacaaaaggaaauuc

SEQ ID NO: 112086 - RNA, 22 nt, Human
ucgugagugcugucaccugcug

SEQ ID NO: 112087 - RNA, 22 nt, Human
ucuaaaaauuagaaauuagguc

SEQ ID NO: 112088 - RNA, 22 nt, Human
ugcucugguccucccucggcgc

SEQ ID NO: 112089 - RNA, 22 nt, Human
ucguauucagugcaagucaacg

SEQ ID NO: 112090 - RNA, 22 nt, Human
ugcugacuauacauuuagcauu

SEQ ID NO: 112091 - RNA, 22 nt, Human
ucugggguucuuaauuuggaag

SEQ ID NO: 112092 - RNA, 21 nt, Human
uggaauuggaaaccauucuau

SEQ ID NO: 112093 - RNA, 22 nt, Human
uggagaaauaacauuuggauuc

SEQ ID NO: 112094 - RNA, 22 nt, Human
uggaagaagcuacaagcgguga

SEQ ID NO: 112095 - RNA, 22 nt, Human
uggaagaaaugguugagccaug

SEQ ID NO: 112096 - RNA, 22 nt, Human
ucuggcacuugccaguuucuau

SEQ ID NO: 112097 - RNA, 22 nt, Human
uggaacugguuugcuucagacu

SEQ ID NO: 112098 - RNA, 22 nt, Human
ucugcuuuucuuaaggggauca

SEQ ID NO: 112099 - RNA, 22 nt, Human
ucuuuauuucccuaacuugcua

SEQ ID NO: 112100 - RNA, 22 nt, Human
ucuuggcaguucuugugcuuuu

SEQ ID NO: 112101 - RNA, 22 nt, Human
ucuugugagcugagauaaagcc

SEQ ID NO: 112102 - RNA, 22 nt, Human
ucuucuuugugguugcccaagg

SEQ ID NO: 112103 - RNA, 20 nt, Human
uggcaugcucucuuuuuagg

SEQ ID NO: 112104 - RNA, 21 nt, Human
ucuuauacagcaauagaucug

SEQ ID NO: 112105 - RNA, 22 nt, Human
ucuuauugugaugaugaagaac

SEQ ID NO: 112106 - RNA, 22 nt, Human
ucuuaaauaugaaaaggauuau

SEQ ID NO: 112107 - RNA, 22 nt, Human
uggaguuuuaaucuguacagaa

SEQ ID NO: 112108 - RNA, 22 nt, Human
ucuguucaugucuuuuuaagug

SEQ ID NO: 112109 - RNA, 22 nt, Human
uggagucuugcuuugggagugc

SEQ ID NO: 112110 - RNA, 22 nt, Human
ugaauuuguaggaauucuccau

SEQ ID NO: 112111 - RNA, 22 nt, Human
ugaauuauaugguauugaacau

SEQ ID NO: 112112 - RNA, 22 nt, Human
ugacaagagaccccuccgcagg

SEQ ID NO: 112113 - RNA, 22 nt, Human
ugaaucuuguuuacugauuccu

SEQ ID NO: 112114 - RNA, 22 nt, Human
ugaauaaucuuggguauuaaua

SEQ ID NO: 112115 - RNA, 22 nt, Human
ugaaucagaccuucauugggua

SEQ ID NO: 112116 - RNA, 22 nt, Human
uggggacucacugacuaucuug

SEQ ID NO: 112117 - RNA, 22 nt, Human
ugggauucugaaaauggauuac

SEQ ID NO: 112118 - RNA, 21 nt, Human
ugaagggugagauauaaguga

SEQ ID NO: 112119 - RNA, 22 nt, Human
ugggauauagaauuggcagagu

SEQ ID NO: 112120 - RNA, 22 nt, Human
ugaagaauuccauggcuuccau

SEQ ID NO: 112121 - RNA, 22 nt, Human
ugggaaacucuaaacuugagua

SEQ ID NO: 112122 - RNA, 22 nt, Human
ugggaacuggaaaaaaugaagu

SEQ ID NO: 112123 - RNA, 22 nt, Human
ugaaccaugaauuacaggagca

SEQ ID NO: 112124 - RNA, 22 nt, Human
ucuuuguuagucagaauugauc

SEQ ID NO: 112125 - RNA, 19 nt, Human
ucuuugcuuuucuaagagg

SEQ ID NO: 112126 - RNA, 17 nt, Human
ucuuuuacuuucucucc

SEQ ID NO: 112127 - RNA, 22 nt, Human
ucuuuucagccagcugguagga

SEQ ID NO: 112128 - RNA, 22 nt, Human
uggcugaugucuguucuguuau

SEQ ID NO: 112129 - RNA, 22 nt, Human
uggcuguuggagcuggaagaug

SEQ ID NO: 112130 - RNA, 22 nt, Human
uggcuugacaucaauacuuauu

SEQ ID NO: 112131 - RNA, 22 nt, Human
uggcuucugguuuauccuuaua

SEQ ID NO: 112132 - RNA, 22 nt, Human
ugaaaggaauuuaaauguuguu

SEQ ID NO: 112133 - RNA, 22 nt, Human
ugaacagacuauucucccaugu

SEQ ID NO: 112134 - RNA, 22 nt, Human
ugaaaugccucuuugguucuaa

SEQ ID NO: 112135 - RNA, 22 nt, Human
ugaaauuuuuuggagauaauuu

SEQ ID NO: 112136 - RNA, 22 nt, Human
ugauugaauaauguuaugugaa

SEQ ID NO: 112137 - RNA, 19 nt, Human
uguauuuauauuucugugc

SEQ ID NO: 112138 - RNA, 22 nt, Human
uguauuuauuuuucaacuacca

SEQ ID NO: 112139 - RNA, 22 nt, Human
ugucaaguuguuaaguucuggg

SEQ ID NO: 112140 - RNA, 22 nt, Human
uguauuuuuucccugaaauaaa

SEQ ID NO: 112141 - RNA, 22 nt, Human
uguauuugaagaaagagcuucu

SEQ ID NO: 112142 - RNA, 22 nt, Human
ugcaaaaagagcgaggagcccu

SEQ ID NO: 112143 - RNA, 20 nt, Human
ugauuauuccaacaagaaug

SEQ ID NO: 112144 - RNA, 22 nt, Human
ugaugugugaauucuuaaaugu

SEQ ID NO: 112145 - RNA, 22 nt, Human
ugauguuucugaagggguuacu

SEQ ID NO: 112146 - RNA, 22 nt, Human
uguauauuuucuguauaaaaua

SEQ ID NO: 112147 - RNA, 22 nt, Human
ugauucacagacuucacaaggc

SEQ ID NO: 112148 - RNA, 22 nt, Human
uguauauuccagggguagggcc

SEQ ID NO: 112149 - RNA, 22 nt, Human
uguaucuguguguauguguuua

SEQ ID NO: 112150 - RNA, 22 nt, Human
uguauggguaggaaacagcugg

SEQ ID NO: 112151 - RNA, 22 nt, Human
uguauugugggugucagagugc

SEQ ID NO: 112152 - RNA, 22 nt, Human
uguauugaggauucauuuuugu

SEQ ID NO: 112153 - RNA, 22 nt, Human
uguagaccaaaccuucuaaacu

SEQ ID NO: 112154 - RNA, 22 nt, Human
uguaguguauagaauuccagca

SEQ ID NO: 112155 - RNA, 22 nt, Human
uguagggaucugccucuuccuc

SEQ ID NO: 112156 - RNA, 22 nt, Human
ugauguaggacauuauuauuuc

SEQ ID NO: 112157 - RNA, 22 nt, Human
uguauaaaauggaaugucagaa

SEQ ID NO: 112158 - RNA, 22 nt, Human
uguaauuugguuagauuucuuu

SEQ ID NO: 112159 - RNA, 22 nt, Human
ugaguugucacaacgucacaag

SEQ ID NO: 112160 - RNA, 22 nt, Human
ugaguuucuuacucaggagcug

SEQ ID NO: 112161 - RNA, 22 nt, Human
ugguugguuaaugugcccauuu

SEQ ID NO: 112162 - RNA, 22 nt, Human
ugaguuagcucuauucuuuugg

SEQ ID NO: 112163 - RNA, 22 nt, Human
ugaguguuguaaccauaugauu

SEQ ID NO: 112164 - RNA, 22 nt, Human
ugaguucugacugagcaugggg

SEQ ID NO: 112165 - RNA, 22 nt, Human
ugaggggaggggagaaaauggu

SEQ ID NO: 112166 - RNA, 22 nt, Human
ugaggucaggcagggguuuggc

SEQ ID NO: 112167 - RNA, 22 nt, Human
ugaggaagugguuguaugguuu

SEQ ID NO: 112168 - RNA, 22 nt, Human
ugaggaacaugggagaaauguc

SEQ ID NO: 112169 - RNA, 22 nt, Human
ugaggcuuucacuuggcaaaga

SEQ ID NO: 112170 - RNA, 22 nt, Human
ucuugugguggaucccucauuu

SEQ ID NO: 112171 - RNA, 22 nt, Human
uggggucuggcauaugguagau

SEQ ID NO: 112172 - RNA, 22 nt, Human
uguuccuuuuguuguuuuguuu

SEQ ID NO: 112173 - RNA, 22 nt, Human
uguucuuaacuuuuguguauau

SEQ ID NO: 112174 - RNA, 22 nt, Human
uguucugaggaggguuucaagg

SEQ ID NO: 112175 - RNA, 22 nt, Human
uguugaaacagcuauugacuuu

SEQ ID NO: 112176 - RNA, 22 nt, Human
uguugagaacaucucggggaca

SEQ ID NO: 112177 - RNA, 22 nt, Human
uguugaugaccacaauuuaugc

SEQ ID NO: 112178 - RNA, 23 nt, Human
ugcuaaaggcagaauauucaccu

SEQ ID NO: 112179 - RNA, 22 nt, Human
uguucuuacuaaguaccugaaa

SEQ ID NO: 112180 - RNA, 19 nt, Human
uguguguguuuuguuugaa

SEQ ID NO: 112181 - RNA, 22 nt, Human
uguuaacugccaggacagaucg

SEQ ID NO: 112182 - RNA, 22 nt, Human
uguguuuuucauuuuaaguccu

SEQ ID NO: 112183 - RNA, 22 nt, Human
uguuauugccucaugagacucc

SEQ ID NO: 112184 - RNA, 22 nt, Human
uguucaguuugcuaucauaauc

SEQ ID NO: 112185 - RNA, 22 nt, Human
uguuaguauuggcaaauuuguu

SEQ ID NO: 112186 - RNA, 22 nt, Human
ugcauucugaacguaaauguga

SEQ ID NO: 112187 - RNA, 22 nt, Human
ugcauuuucuaccacacccacu

SEQ ID NO: 112188 - RNA, 22 nt, Human
uguggguggucagcgugugaug

SEQ ID NO: 112189 - RNA, 22 nt, Human
uguguguauauauuuuuauaug

SEQ ID NO: 112190 - RNA, 22 nt, Human
uguguguaugagcauuuguaug

SEQ ID NO: 112191 - RNA, 17 nt, Human
uguguaaguugcauaga

SEQ ID NO: 112192 - RNA, 22 nt, Human
ugucuuaugcugcauagacuau

SEQ ID NO: 112193 - RNA, 22 nt, Human
ugcaggagcccaggaauacuau

SEQ ID NO: 112194 - RNA, 22 nt, Human
ugcauaagguuaaauuagcaga

SEQ ID NO: 112195 - RNA, 22 nt, Human
ugcauuccagcucccuucuggc

SEQ ID NO: 112196 - RNA, 22 nt, Human
uguggcuuaggugagcauguga

SEQ ID NO: 112197 - RNA, 22 nt, Human
ugcagggucuccuguacuuggg

SEQ ID NO: 112198 - RNA, 22 nt, Human
ugggguguuacacaacauugag

SEQ ID NO: 112199 - RNA, 22 nt, Human
uggggugccccccucgguuugc

SEQ ID NO: 112200 - RNA, 22 nt, Human
ugggucagauacaguguuuggu

SEQ ID NO: 112201 - RNA, 22 nt, Human
ugggucaguagccuugcagaac

SEQ ID NO: 112202 - RNA, 22 nt, Human
uucucucaguuaaacuuuguga

SEQ ID NO: 112203 - RNA, 21 nt, Human
uggguccuuggucuaguuuuc

SEQ ID NO: 112204 - RNA, 22 nt, Human
uucucaauggcaacuuguugcu

SEQ ID NO: 112205 - RNA, 18 nt, Human
uucucucuggauaguagu

SEQ ID NO: 112206 - RNA, 22 nt, Human
uucucuugccuucucuuuuauc

SEQ ID NO: 112207 - RNA, 22 nt, Human
uucuaagaaauggaaaacgauu

SEQ ID NO: 112208 - RNA, 22 nt, Human
uucguugaagcaacgacuuugg

SEQ ID NO: 112209 - RNA, 18 nt, Human
uucuaaauucuguuuuua

SEQ ID NO: 112210 - RNA, 22 nt, Human
uucuaauauuaugauuucuaag

SEQ ID NO: 112211 - RNA, 22 nt, Human
uucuacauugugaaguucuuua

SEQ ID NO: 112212 - RNA, 22 nt, Human
uucgucauuguuguugguuuuc

SEQ ID NO: 112213 - RNA, 22 nt, Human
ugggcaaaugcuuuuuagucaa

SEQ ID NO: 112214 - RNA, 22 nt, Human
uggcuucuggccaggcacagga

SEQ ID NO: 112215 - RNA, 18 nt, Human
uuccauuuuucagucuuc

SEQ ID NO: 112216 - RNA, 22 nt, Human
uggcuugagcugggcccaccug

SEQ ID NO: 112217 - RNA, 22 nt, Human
uucaguuugaauucuguagaac

SEQ ID NO: 112218 - RNA, 22 nt, Human
uucauagaagggaguuuuuccu

SEQ ID NO: 112219 - RNA, 22 nt, Human
uucagugggggcuuuccuucug

SEQ ID NO: 112220 - RNA, 22 nt, Human
uucagguuauugaagagcuuuc

SEQ ID NO: 112221 - RNA, 22 nt, Human
uucaugcaagagugugaggucc

SEQ ID NO: 112222 - RNA, 19 nt, Human
uuccacugcuuagcauugc

SEQ ID NO: 112223 - RNA, 22 nt, Human
uuccagauguuuaaguucugcu

SEQ ID NO: 112224 - RNA, 22 nt, Human
uucauuauuaauaauagcagcu

SEQ ID NO: 112225 - RNA, 22 nt, Human
uucauggauuugugaaauuuag

SEQ ID NO: 112226 - RNA, 22 nt, Human
uucauuuccauuuuauagauaa

SEQ ID NO: 112227 - RNA, 22 nt, Human
uucauugauuuccuuggaauaa

SEQ ID NO: 112228 - RNA, 22 nt, Human
uucagaagguaggaaugucccu

SEQ ID NO: 112229 - RNA, 22 nt, Human
uucagaacugucuguccuuuuc

SEQ ID NO: 112230 - RNA, 22 nt, Human
uucagauuuguuuuuguuucug

SEQ ID NO: 112231 - RNA, 22 nt, Human
uucagaaagugaaucuuguuau

SEQ ID NO: 112232 - RNA, 20 nt, Human
uucacggaggccgcgccccc

SEQ ID NO: 112233 - RNA, 23 nt, Human
uggcaaacgggaauaaaggaauu

SEQ ID NO: 112234 - RNA, 22 nt, Human
uggcaaaaccugcaauuacuuu

SEQ ID NO: 112235 - RNA, 22 nt, Human
uggauuuuggaauguuucagua

SEQ ID NO: 112236 - RNA, 22 nt, Human
uggauuguauugauugguuggc

SEQ ID NO: 112237 - RNA, 22 nt, Human
uggauucucuguagccugguuc

SEQ ID NO: 112238 - RNA, 22 nt, Human
uucaaaccuaucuaagaaauag

SEQ ID NO: 112239 - RNA, 22 nt, Human
uucaaaaugcagaauaguuugg

SEQ ID NO: 112240 - RNA, 22 nt, Human
uggaguuuauuugaauucuugg

SEQ ID NO: 112241 - RNA, 22 nt, Human
uucaaacacugugcaauugggu

SEQ ID NO: 112242 - RNA, 22 nt, Human
uuauuuuuguuuguuaagccua

SEQ ID NO: 112243 - RNA, 22 nt, Human
uuauuuuuaggaauguagaggu

SEQ ID NO: 112244 - RNA, 22 nt, Human
uggaucuugaugcuccaagagu

SEQ ID NO: 112245 - RNA, 22 nt, Human
uggauauuuuguaugugcguuu

SEQ ID NO: 112246 - RNA, 22 nt, Human
uucaaguucccucagggagccc

SEQ ID NO: 112247 - RNA, 23 nt, Human
uucaccaaugcuguccaaguacc

SEQ ID NO: 112248 - RNA, 20 nt, Human
uucacagaucucuaacugag

SEQ ID NO: 112249 - RNA, 22 nt, Human
uucacaauuuuaaaaaguggaa

SEQ ID NO: 112250 - RNA, 22 nt, Human
uucaauggaauucuuagguuuc

SEQ ID NO: 112251 - RNA, 22 nt, Human
uuauuuuauaaagagaagacuu

SEQ ID NO: 112252 - RNA, 22 nt, Human
uuauuuuguagcucugaucuuu

SEQ ID NO: 112253 - RNA, 22 nt, Human
uuauuuucgugugugugugugu

SEQ ID NO: 112254 - RNA, 22 nt, Human
uuauuucauguaaaauuuaugu

SEQ ID NO: 112255 - RNA, 22 nt, Human
uuauuucaggcauuuguaaaug

SEQ ID NO: 112256 - RNA, 22 nt, Human
uuauuuaagaucuuaauauaua

SEQ ID NO: 112257 - RNA, 22 nt, Human
uggaggauaacacaagaaguga

SEQ ID NO: 112258 - RNA, 22 nt, Human
ugcuauuaagagaaagugaaca

SEQ ID NO: 112259 - RNA, 22 nt, Human
uuauuccauagaagucaaggaa

SEQ ID NO: 112260 - RNA, 22 nt, Human
uucugaaacauugcuauuuucc

SEQ ID NO: 112261 - RNA, 22 nt, Human
uucucuuguaaaauuccuuuuu

SEQ ID NO: 112262 - RNA, 22 nt, Human
uucugaaccauugagcacugcc

SEQ ID NO: 112263 - RNA, 23 nt, Human
uucugaggucacgguggaccugg

SEQ ID NO: 112264 - RNA, 22 nt, Human
uucuguuuauaauuugcaguug

SEQ ID NO: 112265 - RNA, 22 nt, Human
uucuguuuaaccuggaaagugu

SEQ ID NO: 112266 - RNA, 22 nt, Human
uucuuagauuuuauuucuucug

SEQ ID NO: 112267 - RNA, 22 nt, Human
uucuuacuaaguagaguacuca

SEQ ID NO: 112268 - RNA, 22 nt, Human
uucuucauucccuuacuuccga

SEQ ID NO: 112269 - RNA, 22 nt, Human
uucuuccagugaaacgugcauc

SEQ ID NO: 112270 - RNA, 22 nt, Human
uucuucgacuguauaaaaguau

SEQ ID NO: 112271 - RNA, 22 nt, Human
uguagcaauauaucagugcaca

SEQ ID NO: 112272 - RNA, 22 nt, Human
uugaagaagucaaaagcugcag

SEQ ID NO: 112273 - RNA, 22 nt, Human
uguauaugucugugagcuauua

SEQ ID NO: 112274 - RNA, 22 nt, Human
uguagacaugcuuuucugauga

SEQ ID NO: 112275 - RNA, 22 nt, Human
uugaaagaacaauucugugaug

SEQ ID NO: 112276 - RNA, 22 nt, Human
uugaaaauuaauagguguacaa

SEQ ID NO: 112277 - RNA, 22 nt, Human
uguaaacuuuugcauacugcuu

SEQ ID NO: 112278 - RNA, 22 nt, Human
uguaaagugguauuuaauuuua

SEQ ID NO: 112279 - RNA, 22 nt, Human
uucuuucgaacaagagaaguuc

SEQ ID NO: 112280 - RNA, 23 nt, Human
uguaaaacaccguuauugcaccu

SEQ ID NO: 112281 - RNA, 22 nt, Human
uugaaaaaaucugaggaggacc

SEQ ID NO: 112282 - RNA, 21 nt, Human
ugguuuuaucuugguggcugc

SEQ ID NO: 112283 - RNA, 22 nt, Human
ugucuaaggaaaaagucuauuu

SEQ ID NO: 112284 - RNA, 22 nt, Human
uugcaagauaguguauuuuuca

SEQ ID NO: 112285 - RNA, 22 nt, Human
ugucuuugaccuuaagaaguuu

SEQ ID NO: 112286 - RNA, 22 nt, Human
ugucuuucuuucucuugacaga

SEQ ID NO: 112287 - RNA, 17 nt, Human
ugucuuuuuccuccucc

SEQ ID NO: 112288 - RNA, 22 nt, Human
ugucuuuuaaaaauguguaaaa

SEQ ID NO: 112289 - RNA, 22 nt, Human
ugugaagaauuaaugugaauca

SEQ ID NO: 112290 - RNA, 22 nt, Human
ugugaaugacuguguucuuugc

SEQ ID NO: 112291 - RNA, 22 nt, Human
ugugauuucaaagggugucuuu

SEQ ID NO: 112292 - RNA, 22 nt, Human
ugugauugcauugcagauuacu

SEQ ID NO: 112293 - RNA, 20 nt, Human
uguagacuagcggggaaaua

SEQ ID NO: 112294 - RNA, 21 nt, Human
ugucaucucuaaaaagauugu

SEQ ID NO: 112295 - RNA, 21 nt, Human
ugucagaaagccugugacuuu

SEQ ID NO: 112296 - RNA, 22 nt, Human
uugguguaauacaagcaauuug

SEQ ID NO: 112297 - RNA, 21 nt, Human
uguugguugugggaaggagga

SEQ ID NO: 112298 - RNA, 22 nt, Human
uuguacaaauaggaaccucuga

SEQ ID NO: 112299 - RNA, 22 nt, Human
uuggugauguagcagcaauugu

SEQ ID NO: 112300 - RNA, 22 nt, Human
uuggugaugcuaggaauguagu

SEQ ID NO: 112301 - RNA, 19 nt, Human
uguugcagcuugaucggua

SEQ ID NO: 112302 - RNA, 22 nt, Human
uguuggaauaagugcuugaagg

SEQ ID NO: 112303 - RNA, 22 nt, Human
uguugauuaauuuucccaaaca

SEQ ID NO: 112304 - RNA, 22 nt, Human
uguugaagcaccucugucuuuc

SEQ ID NO: 112305 - RNA, 22 nt, Human
uugggauuggugggguggguuu

SEQ ID NO: 112306 - RNA, 22 nt, Human
uugggauucugucagugugugu

SEQ ID NO: 112307 - RNA, 22 nt, Human
uugggagagaaaccuaaugccu

SEQ ID NO: 112308 - RNA, 22 nt, Human
uguuaaaaagucccuguuuugu

SEQ ID NO: 112309 - RNA, 22 nt, Human
uuggcuuuucaguuuuaaguua

SEQ ID NO: 112310 - RNA, 22 nt, Human
uuggcuucuugcuaggaagcug

SEQ ID NO: 112311 - RNA, 22 nt, Human
uugggaacaggcuucccacugg

SEQ ID NO: 112312 - RNA, 22 nt, Human
uugcuuuuugggguuuacuggg

SEQ ID NO: 112313 - RNA, 22 nt, Human
uugcuuugcuucuuuaugguca

SEQ ID NO: 112314 - RNA, 22 nt, Human
uugcuuucuuuguagguuuucc

SEQ ID NO: 112315 - RNA, 22 nt, Human
uuggaaaagaaauacucauaua

SEQ ID NO: 112316 - RNA, 22 nt, Human
uuggaaaugcauuuguuauuau

SEQ ID NO: 112317 - RNA, 22 nt, Human
uuggaguucuucaugcucugua

SEQ ID NO: 112318 - RNA, 22 nt, Human
ugugugguaaugagagauccaa

SEQ ID NO: 112319 - RNA, 20 nt, Human
uuggagaucacguguccagg

SEQ ID NO: 112320 - RNA, 19 nt, Human
uuggagcaucccaaaggcu

SEQ ID NO: 112321 - RNA, 22 nt, Human
ugugcuaauguuaggauugaau

SEQ ID NO: 112322 - RNA, 22 nt, Human
uugcuuaaaucgcuuaaacugg

SEQ ID NO: 112323 - RNA, 22 nt, Human
ugugggaucguaaauuugggac

SEQ ID NO: 112324 - RNA, 22 nt, Human
ugugggaucauggaucagggcc

SEQ ID NO: 112325 - RNA, 22 nt, Human
uuucuaaaaccagaguuuauaa

SEQ ID NO: 112326 - RNA, 22 nt, Human
uuucuaacacccuccuuccaga

SEQ ID NO: 112327 - RNA, 22 nt, Human
uuauuguuuggguauaauuuga

SEQ ID NO: 112328 - RNA, 22 nt, Human
uuuccuuuguuuugguauaugu

SEQ ID NO: 112329 - RNA, 22 nt, Human
uuuccuuacuuauaaaaugggg

SEQ ID NO: 112330 - RNA, 22 nt, Human
uuuccuucccuccugggccuuc

SEQ ID NO: 112331 - RNA, 22 nt, Human
uuucucagcauauugccuuuga

SEQ ID NO: 112332 - RNA, 22 nt, Human
uuucuaguauauaacuagaucu

SEQ ID NO: 112333 - RNA, 22 nt, Human
uuucuacauuuguaaccagauu

SEQ ID NO: 112334 - RNA, 22 nt, Human
uuucuacacuucgugguguuuu

SEQ ID NO: 112335 - RNA, 22 nt, Human
uuaugguuuaauauccagcaca

SEQ ID NO: 112336 - RNA, 22 nt, Human
uuaugucauuugaauuaauuuu

SEQ ID NO: 112337 - RNA, 22 nt, Human
uuuccaguaaguggcaaggagc

SEQ ID NO: 112338 - RNA, 22 nt, Human
uuaugugcuacacauaauuugu

SEQ ID NO: 112339 - RNA, 22 nt, Human
uuuccuuaauuguaaaauggag

SEQ ID NO: 112340 - RNA, 22 nt, Human
uuauucuuagccucgguauuuc

SEQ ID NO: 112341 - RNA, 22 nt, Human
uuauguugauaggaaucugauu

SEQ ID NO: 112342 - RNA, 22 nt, Human
uuucaugauuaacuuagugaau

SEQ ID NO: 112343 - RNA, 21 nt, Human
uuucauaggguuaaaggguua

SEQ ID NO: 112344 - RNA, 22 nt, Human
uuucagacugcccauguuugcc

SEQ ID NO: 112345 - RNA, 22 nt, Human
uuucagaaauggcacugaaauc

SEQ ID NO: 112346 - RNA, 22 nt, Human
uuucagauuauguucauggguu

SEQ ID NO: 112347 - RNA, 22 nt, Human
uuauaucagaaggugagauuga

SEQ ID NO: 112348 - RNA, 22 nt, Human
uuauauuuuauuuaauuaaaua

SEQ ID NO: 112349 - RNA, 22 nt, Human
uuaucaaaaaauaguacuuuga

SEQ ID NO: 112350 - RNA, 22 nt, Human
uuauggauuagaguuugauucu

SEQ ID NO: 112351 - RNA, 22 nt, Human
uuaucuuuuaaaaacacuugug

SEQ ID NO: 112352 - RNA, 22 nt, Human
uuuaggaauuugcugggcauga

SEQ ID NO: 112353 - RNA, 22 nt, Human
uuacuguaggugggugaauuug

SEQ ID NO: 112354 - RNA, 22 nt, Human
uuagaauggaaucauuugcauu

SEQ ID NO: 112355 - RNA, 22 nt, Human
uuacucucugaggcacucaaaa

SEQ ID NO: 112356 - RNA, 20 nt, Human
uuacucaaccaggcuucuac

SEQ ID NO: 112357 - RNA, 22 nt, Human
uuacuggaauauaaagauaaga

SEQ ID NO: 112358 - RNA, 22 nt, Human
uuuacaagucuguugaucccaa

SEQ ID NO: 112359 - RNA, 22 nt, Human
uuaccauaguacuaucaguuua

SEQ ID NO: 112360 - RNA, 22 nt, Human
uuuaggugucugcucauugaag

SEQ ID NO: 112361 - RNA, 22 nt, Human
uuagagagguuggagugguaga

SEQ ID NO: 112362 - RNA, 22 nt, Human
uuagagauuuuauguuaaugua

SEQ ID NO: 112363 - RNA, 22 nt, Human
uuagcagacagauggagagaga

SEQ ID NO: 112364 - RNA, 22 nt, Human
uuaggaauugcuucauguuugg

SEQ ID NO: 112365 - RNA, 22 nt, Human
uuuaucaggccaucuuaugucu

SEQ ID NO: 112366 - RNA, 22 nt, Human
uuuaucaucuucugaauuugga

SEQ ID NO: 112367 - RNA, 22 nt, Human
uuuauaauuacguaaaauauuu

SEQ ID NO: 112368 - RNA, 22 nt, Human
uuuauauauauguaggagcaca

SEQ ID NO: 112369 - RNA, 22 nt, Human
uuuauuugugguaguguaaucu

SEQ ID NO: 112370 - RNA, 22 nt, Human
uuucaagccucacugcguuuug

SEQ ID NO: 112371 - RNA, 22 nt, Human
uuucacugaguaggagagcacu

SEQ ID NO: 112372 - RNA, 19 nt, Human
uuucacaaagagagcguga

SEQ ID NO: 112373 - RNA, 22 nt, Human
uuuauuuagguaaacaugaguu

SEQ ID NO: 112374 - RNA, 22 nt, Human
uuuauugcuaugucuugauugu

SEQ ID NO: 112375 - RNA, 22 nt, Human
uuuauugaccugaguaucagca

SEQ ID NO: 112376 - RNA, 22 nt, Human
uuucuuaaaagcuuuuaaaguu

SEQ ID NO: 112377 - RNA, 22 nt, Human
uuucugugguggguaguucaga

SEQ ID NO: 112378 - RNA, 22 nt, Human
uuucuuccaucuggcuuuauuu

SEQ ID NO: 112379 - RNA, 22 nt, Human
uuucuugggaaaugucagaagu

SEQ ID NO: 112380 - RNA, 22 nt, Human
uuauuugcccauguuuagcaga

SEQ ID NO: 112381 - RNA, 22 nt, Human
uuucucuuucaaucugcaguac

SEQ ID NO: 112382 - RNA, 22 nt, Human
uuucugagccacauauaauuug

SEQ ID NO: 112383 - RNA, 23 nt, Human
uuucugaguuuuuuaaaagucca

SEQ ID NO: 112384 - RNA, 22 nt, Human
uuucucuuuuugggguggggug

SEQ ID NO: 112385 - RNA, 22 nt, Human
uuauuuaaaauguagguuggga

SEQ ID NO: 112386 - RNA, 22 nt, Human
uuauuucuucucgaagcuuggg

SEQ ID NO: 112387 - RNA, 22 nt, Human
uuauuuaaguauuuauugaagu

SEQ ID NO: 112388 - RNA, 22 nt, Human
uucaaacaguguagaauauaug

SEQ ID NO: 112389 - RNA, 22 nt, Human
uuugaagauaaauauggagaaa

SEQ ID NO: 112390 - RNA, 22 nt, Human
uuucuuugggcccuggcagucu

SEQ ID NO: 112391 - RNA, 22 nt, Human
uuauuuuuguaacacuguauag

SEQ ID NO: 112392 - RNA, 22 nt, Human
uuucuuuuucuacaccuuagcu

SEQ ID NO: 112393 - RNA, 22 nt, Human
uuugaauauuaugucccacuuu

SEQ ID NO: 112394 - RNA, 22 nt, Human
uuugagaagauaggggaauacu

SEQ ID NO: 112395 - RNA, 22 nt, Human
uucaacacaaguugugcaguaa

SEQ ID NO: 112396 - RNA, 22 nt, Human
uucaacaacuugguucaaaugg

SEQ ID NO: 112397 - RNA, 22 nt, Human
uuugaugauuuucuagagugua

SEQ ID NO: 112398 - RNA, 22 nt, Human
uuugaguaagauguugauacug

SEQ ID NO: 112399 - RNA, 22 nt, Human
uuugaguacagcugccuuuuug

SEQ ID NO: 112400 - RNA, 22 nt, Human
uucaggaucuaggaguauuuuu

SEQ ID NO: 112401 - RNA, 22 nt, Human
uuuggcaagcagaugaagguag

SEQ ID NO: 112402 - RNA, 22 nt, Human
uucagacugcccauguuugcca

SEQ ID NO: 112403 - RNA, 22 nt, Human
uuugcauuaguuuagauuucaa

SEQ ID NO: 112404 - RNA, 22 nt, Human
uuugcaaaguccauugaaguua

SEQ ID NO: 112405 - RNA, 22 nt, Human
uuugguaccucucgucacaaug

SEQ ID NO: 112406 - RNA, 22 nt, Human
uuuggguuaguuuuccaaucuu

SEQ ID NO: 112407 - RNA, 22 nt, Human
uucaguuuugcuuuuaaucaug

SEQ ID NO: 112408 - RNA, 22 nt, Human
uucauacuguuuaaguucuguu

SEQ ID NO: 112409 - RNA, 22 nt, Human
uucaguaugcugaaugauuuuu

SEQ ID NO: 112410 - RNA, 22 nt, Human
uuccccaccagagacagagcug

SEQ ID NO: 112411 - RNA, 22 nt, Human
uucccugggggggccgcuuucc

SEQ ID NO: 112412 - RNA, 22 nt, Human
uuugugguuuugagagaguugc

SEQ ID NO: 112413 - RNA, 22 nt, Human
uuuguggugagcagggaacguc

SEQ ID NO: 112414 - RNA, 22 nt, Human
uuugugauaaguggauucaagg

SEQ ID NO: 112415 - RNA, 22 nt, Human
uuuguauuucaaggcacucuca

SEQ ID NO: 112416 - RNA, 22 nt, Human
uuccaacaugugcuuguguuga

SEQ ID NO: 112417 - RNA, 23 nt, Human
uuugucaucccucucacuuucug

SEQ ID NO: 112418 - RNA, 22 nt, Human
uucauuuuauauuagagcuguu

SEQ ID NO: 112419 - RNA, 22 nt, Human
uuuguaguuguggaugcugaag

SEQ ID NO: 112420 - RNA, 22 nt, Human
uuugguguuuucaggaauauac

SEQ ID NO: 112421 - RNA, 22 nt, Human
uuuguacuuucuaauguauuua

SEQ ID NO: 112422 - RNA, 22 nt, Human
uucauugcuacuuaaaauacca

SEQ ID NO: 112423 - RNA, 22 nt, Human
uugccuacaaacgaaucuaucu

SEQ ID NO: 112424 - RNA, 22 nt, Human
uugcuaagguuuaacuauugga

SEQ ID NO: 112425 - RNA, 22 nt, Human
uugaguuuacauuguauuagcc

SEQ ID NO: 112426 - RNA, 22 nt, Human
uugauuuggaauuuuuagagcu

SEQ ID NO: 112427 - RNA, 22 nt, Human
uuggaaauguagaaaagcagau

SEQ ID NO: 112428 - RNA, 23 nt, Human
uugcuuuugccccaaaagaguua

SEQ ID NO: 112429 - RNA, 22 nt, Human
uugcuuuuuuggguuuacuggg

SEQ ID NO: 112430 - RNA, 22 nt, Human
uuggaauuugagaccaagaaaa

SEQ ID NO: 112431 - RNA, 19 nt, Human
uuggacuaugaaaaaucag

SEQ ID NO: 112432 - RNA, 22 nt, Human
uuggaaguggcaaaggcuaaag

SEQ ID NO: 112433 - RNA, 22 nt, Human
uugcuggaguagaaaacuuaac

SEQ ID NO: 112434 - RNA, 21 nt, Human
uugcuggagcaauguaaauca

SEQ ID NO: 112435 - RNA, 22 nt, Human
uugcugagcugaaccagccacc

SEQ ID NO: 112436 - RNA, 22 nt, Human
uugguauucaguuggauuugga

SEQ ID NO: 112437 - RNA, 22 nt, Human
uugguauuuguuuaaauuacac

SEQ ID NO: 112438 - RNA, 22 nt, Human
uuggcaaagagaugcauaagga

SEQ ID NO: 112439 - RNA, 22 nt, Human
uuggugaugcccaccuuuucau

SEQ ID NO: 112440 - RNA, 22 nt, Human
uuguacuuaaauaugcaaauag

SEQ ID NO: 112441 - RNA, 22 nt, Human
uuguacuuguucuguuuccuug

SEQ ID NO: 112442 - RNA, 20 nt, Human
uuguacuuaugugagaagga

SEQ ID NO: 112443 - RNA, 22 nt, Human
uuguauaaagauggcuagaucc

SEQ ID NO: 112444 - RNA, 19 nt, Human
uugucuuagcugcauaaga

SEQ ID NO: 112445 - RNA, 22 nt, Human
uuuaaugguuuauggucuaaga

SEQ ID NO: 112446 - RNA, 22 nt, Human
uuuaaugaugucuaugccuguu

SEQ ID NO: 112447 - RNA, 18 nt, Human
uuuaauaagccuguuaug

SEQ ID NO: 112448 - RNA, 22 nt, Human
uuuaaguuaguauggguuaggu

SEQ ID NO: 112449 - RNA, 22 nt, Human
uuuaaauaguugguuuuuuugc

SEQ ID NO: 112450 - RNA, 22 nt, Human
uuuaaaccuuggaagccacaua

SEQ ID NO: 112451 - RNA, 22 nt, Human
uuuaaauuucugaaucuugagg

SEQ ID NO: 112452 - RNA, 22 nt, Human
uuguuuacuugagcugcacucu

SEQ ID NO: 112453 - RNA, 22 nt, Human
uuguuucauggggacgacuggc

SEQ ID NO: 112454 - RNA, 22 nt, Human
uuguuuguaaggcucuuagaau

SEQ ID NO: 112455 - RNA, 22 nt, Human
uuguuucagcuuccuccuccau

SEQ ID NO: 112456 - RNA, 22 nt, Human
uuguuuggcaaaugugugugug

SEQ ID NO: 112457 - RNA, 22 nt, Human
uuuaaaauguuuuauuuauuua

SEQ ID NO: 112458 - RNA, 22 nt, Human
uuuaaaacagcauuuaaaaggu

SEQ ID NO: 112459 - RNA, 22 nt, Human
uuguuuuucucuagggaaggcu

SEQ ID NO: 112460 - RNA, 22 nt, Human
uuguuuucuugaugaaauuauu

SEQ ID NO: 112461 - RNA, 22 nt, Human
uuguuuuaaaaagaauaacuac

SEQ ID NO: 112462 - RNA, 22 nt, Human
uuuuguuacugauuauuaaaau

SEQ ID NO: 112463 - RNA, 18 nt, Human
uuuuguguuuauucugca

SEQ ID NO: 112464 - RNA, 22 nt, Human
uucuuauuuuucguaaauccug

SEQ ID NO: 112465 - RNA, 22 nt, Human
uucuuaggauuauuuaaaauuc

SEQ ID NO: 112466 - RNA, 22 nt, Human
uuuuguagauagggaaacagag

SEQ ID NO: 112467 - RNA, 22 nt, Human
uuuuguagauuggaaaaucugg

SEQ ID NO: 112468 - RNA, 22 nt, Human
uuuuuaauuuuaagcuauuugu

SEQ ID NO: 112469 - RNA, 22 nt, Human
uucuucuuuccuauaauuaauu

SEQ ID NO: 112470 - RNA, 22 nt, Human
uuuuucagacuaauagggcaua

SEQ ID NO: 112471 - RNA, 22 nt, Human
uuuuuauguaaaauauuaaaag

SEQ ID NO: 112472 - RNA, 22 nt, Human
uuuuuguuauuuagguguagag

SEQ ID NO: 112473 - RNA, 22 nt, Human
uuuuucugacugcuaacaaaaa

SEQ ID NO: 112474 - RNA, 22 nt, Human
uugaaaacugucaccuuuauuc

SEQ ID NO: 112475 - RNA, 22 nt, Human
uugaaaaguuuguuacucacau

SEQ ID NO: 112476 - RNA, 22 nt, Human
uuuuuuccuguuugucuuuggg

SEQ ID NO: 112477 - RNA, 22 nt, Human
uuuuuucuggaguuugggguuu

SEQ ID NO: 112478 - RNA, 22 nt, Human
uugaaagucuaagaauagguau

SEQ ID NO: 112479 - RNA, 22 nt, Human
uuuuuuuaaguuuugauuuuag

SEQ ID NO: 112480 - RNA, 22 nt, Human
uuuuuuguuccuugguuuuugu

SEQ ID NO: 112481 - RNA, 20 nt, Human
uugaggagauauugaauacu

SEQ ID NO: 112482 - RNA, 22 nt, Human
uugacucuuucauuuauuauuu

SEQ ID NO: 112483 - RNA, 22 nt, Human
uuuuuuuuacuccggacagcuc

SEQ ID NO: 112484 - RNA, 22 nt, Human
uucuggugauuugccucuuuag

SEQ ID NO: 112485 - RNA, 22 nt, Human
uucugaugccuggguugcuucu

SEQ ID NO: 112486 - RNA, 22 nt, Human
uuuuaggauuugaguugcugga

SEQ ID NO: 112487 - RNA, 20 nt, Human
uucguuucaguguuggauca

SEQ ID NO: 112488 - RNA, 22 nt, Human
uuuuacgucuuugcugccucgu

SEQ ID NO: 112489 - RNA, 22 nt, Human
uuuguucuucucaugcacacaa

SEQ ID NO: 112490 - RNA, 22 nt, Human
uuuguucuagauaacugguaau

SEQ ID NO: 112491 - RNA, 22 nt, Human
uuccuaauguccaccuaguccu

SEQ ID NO: 112492 - RNA, 21 nt, Human
uuccuaaaaugcuuuugugcc

SEQ ID NO: 112493 - RNA, 22 nt, Human
uuuuauuuguauguugaaugua

SEQ ID NO: 112494 - RNA, 19 nt, Human
uuuucaacguccgguucau

SEQ ID NO: 112495 - RNA, 22 nt, Human
uucuagauagucugauauuccu

SEQ ID NO: 112496 - RNA, 22 nt, Human
uucuagccauagaaauuagauu

SEQ ID NO: 112497 - RNA, 18 nt, Human
uucuagaggucucaucca

SEQ ID NO: 112498 - RNA, 22 nt, Human
uucuaggagucugguuccugcc

SEQ ID NO: 112499 - RNA, 22 nt, Human
uucucaagccuuccuuucccaa

SEQ ID NO: 112500 - RNA, 22 nt, Human
uucucagagaaagcuccucaug

SEQ ID NO: 112501 - RNA, 22 nt, Human
uucucuauuugcugcaccucuc

SEQ ID NO: 112502 - RNA, 22 nt, Human
uucucucacucuuagaucccgc

SEQ ID NO: 112503 - RNA, 22 nt, Human
auaucuaggcugaauguaaaau

SEQ ID NO: 112504 - RNA, 22 nt, Human
auauguuaugccauuuucaagg

SEQ ID NO: 112505 - RNA, 22 nt, Human
auauguuuuaguagaaucccaa

SEQ ID NO: 112506 - RNA, 22 nt, Human
auauauacuuugacacauucug

SEQ ID NO: 112507 - RNA, 22 nt, Human
auauuuguuuggcagaguucag

SEQ ID NO: 112508 - RNA, 22 nt, Human
auauuuguacagcuugugaguu

SEQ ID NO: 112509 - RNA, 22 nt, Human
auauuucuacaggcugauuuua

SEQ ID NO: 112510 - RNA, 21 nt, Human
auauggauauuauuuuguguc

SEQ ID NO: 112511 - RNA, 21 nt, Human
auauuguugggguuuucuuuu

SEQ ID NO: 112512 - RNA, 22 nt, Human
auaucuuguuuuugauuucuug

SEQ ID NO: 112513 - RNA, 22 nt, Human
auaguuaagguguacugaagau

SEQ ID NO: 112514 - RNA, 22 nt, Human
auaguaaauguuaacagcaaca

SEQ ID NO: 112515 - RNA, 22 nt, Human
auaugaagaaugaucugaagua

SEQ ID NO: 112516 - RNA, 22 nt, Human
auauaaugugugcuuuauugaa

SEQ ID NO: 112517 - RNA, 22 nt, Human
auauccugguucuaucaaaagg

SEQ ID NO: 112518 - RNA, 22 nt, Human
auauauguauauacacauauau

SEQ ID NO: 112519 - RNA, 19 nt, Human
auagcagaagucauuuuca

SEQ ID NO: 112520 - RNA, 22 nt, Human
auagauguauucauuguuuggc

SEQ ID NO: 112521 - RNA, 22 nt, Human
auauaguuggguuucauucuac

SEQ ID NO: 112522 - RNA, 22 nt, Human
auauaguacauguauauauaua

SEQ ID NO: 112523 - RNA, 23 nt, Human
auagucuuaaaccagacuucacc

SEQ ID NO: 112524 - RNA, 22 nt, Human
auaguuuuagauacugagaaaa

SEQ ID NO: 112525 - RNA, 22 nt, Human
auauaagauaauaacuuuuuua

SEQ ID NO: 112526 - RNA, 22 nt, Human
auauaaugcaguaggugauuaa

SEQ ID NO: 112527 - RNA, 22 nt, Human
auauaagucacauuaaggaggu

SEQ ID NO: 112528 - RNA, 22 nt, Human
auagaguucucuuuggaggagu

SEQ ID NO: 112529 - RNA, 22 nt, Human
auagaagugaaaagggaugacu

SEQ ID NO: 112530 - RNA, 23 nt, Human
auacuuuuuuucuacguuaucuc

SEQ ID NO: 112531 - RNA, 22 nt, Human
auacuucaccuaacccaguuuc

SEQ ID NO: 112532 - RNA, 22 nt, Human
auacugagauguuaauagggug

SEQ ID NO: 112533 - RNA, 22 nt, Human
auaggaguauaaggcaguaacu

SEQ ID NO: 112534 - RNA, 22 nt, Human
auacaugugugugcauacaugu

SEQ ID NO: 112535 - RNA, 22 nt, Human
auagauuuuaucagauuuuauc

SEQ ID NO: 112536 - RNA, 22 nt, Human
auagauugcucauauauuacuu

SEQ ID NO: 112537 - RNA, 21 nt, Human
auacaguucagcuuuuacuau

SEQ ID NO: 112538 - RNA, 22 nt, Human
auacauauaugcacauuaauau

SEQ ID NO: 112539 - RNA, 22 nt, Human
auagagaggaacagcaagaacu

SEQ ID NO: 112540 - RNA, 22 nt, Human
auagacuagccaaagacuucug

SEQ ID NO: 112541 - RNA, 20 nt, Human
auagaguggugugucacauu

SEQ ID NO: 112542 - RNA, 22 nt, Human
auagacuuccuguccuagacuu

SEQ ID NO: 112543 - RNA, 22 nt, Human
auagaaauagacaaugcaaaga

SEQ ID NO: 112544 - RNA, 22 nt, Human
auagacacagcuaugauuugag

SEQ ID NO: 112545 - RNA, 22 nt, Human
auagaauggcaccagcaucuac

SEQ ID NO: 112546 - RNA, 22 nt, Human
agugaaaacugaaucaccuucc

SEQ ID NO: 112547 - RNA, 22 nt, Human
agugaaagaaaacuguuagaac

SEQ ID NO: 112548 - RNA, 22 nt, Human
agugaauuagccuauuuguaaa

SEQ ID NO: 112549 - RNA, 22 nt, Human
agugagcuuuuaaaauuuacca

SEQ ID NO: 112550 - RNA, 22 nt, Human
aucauugaaaauuuaugcauuu

SEQ ID NO: 112551 - RNA, 22 nt, Human
aucauuuuuauuagcugggguu

SEQ ID NO: 112552 - RNA, 22 nt, Human
aucauugcuaguaaggaucuug

SEQ ID NO: 112553 - RNA, 22 nt, Human
auccagaaguauuuuggguacu

SEQ ID NO: 112554 - RNA, 22 nt, Human
aucauguauaugcagcguuugu

SEQ ID NO: 112555 - RNA, 22 nt, Human
aucauguauauuuuugcuauua

SEQ ID NO: 112556 - RNA, 22 nt, Human
aucccacaccccuacaacauau

SEQ ID NO: 112557 - RNA, 22 nt, Human
auccuccuuugcccugagauca

SEQ ID NO: 112558 - RNA, 22 nt, Human
auccuaagacgugugguuugag

SEQ ID NO: 112559 - RNA, 22 nt, Human
aucauuaacagugcagggguag

SEQ ID NO: 112560 - RNA, 22 nt, Human
aucauuugaacagaauuuguuu

SEQ ID NO: 112561 - RNA, 22 nt, Human
auccucaaggaauuaaauaggg

SEQ ID NO: 112562 - RNA, 22 nt, Human
aucuacuuugggaguuucucuu

SEQ ID NO: 112563 - RNA, 22 nt, Human
aucuaauguggcaaguugcuga

SEQ ID NO: 112564 - RNA, 22 nt, Human
aucuaaaacuacgaauacuacc

SEQ ID NO: 112565 - RNA, 22 nt, Human
aucggucuccuauaauucaaac

SEQ ID NO: 112566 - RNA, 22 nt, Human
aucauguuauguacaaauauga

SEQ ID NO: 112567 - RNA, 22 nt, Human
aucauuuggaaauuuggccuaa

SEQ ID NO: 112568 - RNA, 22 nt, Human
aucaugcugacacaguuuaucu

SEQ ID NO: 112569 - RNA, 21 nt, Human
aucagaaucucuagauuugga

SEQ ID NO: 112570 - RNA, 22 nt, Human
aucaaaauuuucagauacuaca

SEQ ID NO: 112571 - RNA, 22 nt, Human
aucaauaaccauagugguuaca

SEQ ID NO: 112572 - RNA, 22 nt, Human
aucauccuagaaggaagcuagg

SEQ ID NO: 112573 - RNA, 22 nt, Human
auauuugucuguuuuaguggca

SEQ ID NO: 112574 - RNA, 22 nt, Human
auauuuguuagcugcuuuggag

SEQ ID NO: 112575 - RNA, 22 nt, Human
auauuuuacagcucucguugaa

SEQ ID NO: 112576 - RNA, 22 nt, Human
aucacaaauggaaucaccuccc

SEQ ID NO: 112577 - RNA, 22 nt, Human
aucagaagaaauggaugugacu

SEQ ID NO: 112578 - RNA, 22 nt, Human
aucaaaauguguagucuugauc

SEQ ID NO: 112579 - RNA, 22 nt, Human
auauuuuugcagaauuuuucgu

SEQ ID NO: 112580 - RNA, 22 nt, Human
aucaaacuaugguccaugggca

SEQ ID NO: 112581 - RNA, 22 nt, Human
aucaaguuauuaaguagcuuuc

SEQ ID NO: 112582 - RNA, 22 nt, Human
aucaacacuguuggcggggacc

SEQ ID NO: 112583 - RNA, 22 nt, Human
auauuauuaaaauagauggaua

SEQ ID NO: 112584 - RNA, 22 nt, Human
auauucaaugaggucauauaag

SEQ ID NO: 112585 - RNA, 22 nt, Human
auauuguagcaucacugucuug

SEQ ID NO: 112586 - RNA, 22 nt, Human
augaauuugaacaccagguugg

SEQ ID NO: 112587 - RNA, 22 nt, Human
augaauuaucugguguuggaaa

SEQ ID NO: 112588 - RNA, 22 nt, Human
augauuaagguacgucauuucu

SEQ ID NO: 112589 - RNA, 22 nt, Human
augauuacagcaugauguuuca

SEQ ID NO: 112590 - RNA, 22 nt, Human
augaagugcccugggggccaga

SEQ ID NO: 112591 - RNA, 22 nt, Human
augcacuacuagaugcaaaagu

SEQ ID NO: 112592 - RNA, 22 nt, Human
augaggaacagcaagaauauuu

SEQ ID NO: 112593 - RNA, 22 nt, Human
augcagaaucucuuuccugagg

SEQ ID NO: 112594 - RNA, 22 nt, Human
augagaaauaauuguguacuga

SEQ ID NO: 112595 - RNA, 22 nt, Human
augauucuaccaaugccaucuu

SEQ ID NO: 112596 - RNA, 22 nt, Human
augauuauuugaaugaagagga

SEQ ID NO: 112597 - RNA, 22 nt, Human
augacuguuaugaggugggugg

SEQ ID NO: 112598 - RNA, 22 nt, Human
augagcucuaaguacaugccca

SEQ ID NO: 112599 - RNA, 22 nt, Human
aucuucaaggacgccaagaucc

SEQ ID NO: 112600 - RNA, 20 nt, Human
aucuuaucuaucuuuuguuc

SEQ ID NO: 112601 - RNA, 22 nt, Human
aucuucaaagcacaucguuugu

SEQ ID NO: 112602 - RNA, 22 nt, Human
aucuagucccugcccuugaaga

SEQ ID NO: 112603 - RNA, 22 nt, Human
augaaacucuagcuuucagcac

SEQ ID NO: 112604 - RNA, 22 nt, Human
aucucaaagauaugcugguaaa

SEQ ID NO: 112605 - RNA, 22 nt, Human
augaaaacgugugugugugugu

SEQ ID NO: 112606 - RNA, 22 nt, Human
aucuggaacuucucugcauuga

SEQ ID NO: 112607 - RNA, 22 nt, Human
augcuugcccauguuucugaag

SEQ ID NO: 112608 - RNA, 22 nt, Human
augcugcuuguccauuuauuug

SEQ ID NO: 112609 - RNA, 22 nt, Human
augcuucuguugcuuaggaggu

SEQ ID NO: 112610 - RNA, 22 nt, Human
augcagauguagauucugaaau

SEQ ID NO: 112611 - RNA, 22 nt, Human
augcagcggucagaggaacuca

SEQ ID NO: 112612 - RNA, 22 nt, Human
augcuagaaaauuucauauuau

SEQ ID NO: 112613 - RNA, 22 nt, Human
augcucuuaauugcuagauaag

SEQ ID NO: 112614 - RNA, 22 nt, Human
augaucaagaauuuuguauucc

SEQ ID NO: 112615 - RNA, 22 nt, Human
augaugauuauucauuuucugu

SEQ ID NO: 112616 - RNA, 22 nt, Human
auuauaguuuugcccuuaagaa

SEQ ID NO: 112617 - RNA, 22 nt, Human
auuaugaauuguguuacgaaga

SEQ ID NO: 112618 - RNA, 21 nt, Human
auuauagugacuaaauugaua

SEQ ID NO: 112619 - RNA, 22 nt, Human
auuaaaaaaagauaaugaguua

SEQ ID NO: 112620 - RNA, 22 nt, Human
auuauacauuaggagauugauu

SEQ ID NO: 112621 - RNA, 22 nt, Human
auuagguaguauaaucuuuguu

SEQ ID NO: 112622 - RNA, 22 nt, Human
auuauaauucauuaggcuuagu

SEQ ID NO: 112623 - RNA, 22 nt, Human
auguucucagguuguauuuauu

SEQ ID NO: 112624 - RNA, 22 nt, Human
auguuccuuuaaaauauagauu

SEQ ID NO: 112625 - RNA, 22 nt, Human
auuacagaagauaugcucaaca

SEQ ID NO: 112626 - RNA, 22 nt, Human
auuaaguuauuaagcuaaauau

SEQ ID NO: 112627 - RNA, 22 nt, Human
auuaauaucaauauauuauaug

SEQ ID NO: 112628 - RNA, 22 nt, Human
auuacugaggcaaaguaguuuu

SEQ ID NO: 112629 - RNA, 22 nt, Human
auuacagauuauaaauuugagc

SEQ ID NO: 112630 - RNA, 22 nt, Human
auuagaagagcuuuuuacucuu

SEQ ID NO: 112631 - RNA, 23 nt, Human
auuauuucaggguuuugacuugc

SEQ ID NO: 112632 - RNA, 22 nt, Human
auuauucaaggugaggguaaaa

SEQ ID NO: 112633 - RNA, 22 nt, Human
auuaacaggcucuguucuaguu

SEQ ID NO: 112634 - RNA, 22 nt, Human
auuaagacugcccauguuuuua

SEQ ID NO: 112635 - RNA, 22 nt, Human
auuaaaaaugagaguagggauu

SEQ ID NO: 112636 - RNA, 19 nt, Human
auucaagugcuuagagauc

SEQ ID NO: 112637 - RNA, 22 nt, Human
auucaagagcccauguuuccug

SEQ ID NO: 112638 - RNA, 22 nt, Human
auucaagauaagggucugggag

SEQ ID NO: 112639 - RNA, 22 nt, Human
auucauauagcgcuuacagccu

SEQ ID NO: 112640 - RNA, 17 nt, Human
auucaugaacauguccu

SEQ ID NO: 112641 - RNA, 22 nt, Human
auucauuuuuacaucaccaaua

SEQ ID NO: 112642 - RNA, 22 nt, Human
auguauuuauguauguguuaua

SEQ ID NO: 112643 - RNA, 22 nt, Human
auguaaauauuuauauaugcau

SEQ ID NO: 112644 - RNA, 22 nt, Human
augugauacuccuucuagugga

SEQ ID NO: 112645 - RNA, 22 nt, Human
augguuuugugaaaaugcuuug

SEQ ID NO: 112646 - RNA, 22 nt, Human
augugaaauuugggcucuggga

SEQ ID NO: 112647 - RNA, 22 nt, Human
auguguuuugaccccugcuaaa

SEQ ID NO: 112648 - RNA, 22 nt, Human
auguguguaugugugcauguau

SEQ ID NO: 112649 - RNA, 22 nt, Human
auggcuucugucuuggaaauuu

SEQ ID NO: 112650 - RNA, 18 nt, Human
auggcuccagugucuucc

SEQ ID NO: 112651 - RNA, 22 nt, Human
augguuuuguccucuuugguuc

SEQ ID NO: 112652 - RNA, 22 nt, Human
auguacugacuguacuuuuaaa

SEQ ID NO: 112653 - RNA, 22 nt, Human
augugaaagagguguucagugg

SEQ ID NO: 112654 - RNA, 22 nt, Human
caaguaugagaaagcuauuacc

SEQ ID NO: 112655 - RNA, 22 nt, Human
caaaguaggcuaagaccuucca

SEQ ID NO: 112656 - RNA, 22 nt, Human
caaaggaaagagaaaaagucuu

SEQ ID NO: 112657 - RNA, 22 nt, Human
caaagcuucaucuguuguuuug

SEQ ID NO: 112658 - RNA, 22 nt, Human
caaaacccaagugcuauugcaa

SEQ ID NO: 112659 - RNA, 22 nt, Human
caaaacauucagagagcucacu

SEQ ID NO: 112660 - RNA, 22 nt, Human
caagaaaaaacaugaugagugu

SEQ ID NO: 112661 - RNA, 22 nt, Human
caagaaccuagcgaucagguaa

SEQ ID NO: 112662 - RNA, 22 nt, Human
caaggaaaugucagaaaggcaa

SEQ ID NO: 112663 - RNA, 22 nt, Human
caaggaaaacagaugaucaaca

SEQ ID NO: 112664 - RNA, 22 nt, Human
caagcgcgccgcuuccuuccgc

SEQ ID NO: 112665 - RNA, 22 nt, Human
caaagaugccaaaaggaagaca

SEQ ID NO: 112666 - RNA, 22 nt, Human
caaccucuaucggucaggaagc

SEQ ID NO: 112667 - RNA, 22 nt, Human
caacauuucaaggucuuuagga

SEQ ID NO: 112668 - RNA, 22 nt, Human
caauuuggaaagcaugcccccc

SEQ ID NO: 112669 - RNA, 22 nt, Human
caacaaguugauuucacgcugc

SEQ ID NO: 112670 - RNA, 22 nt, Human
cacaauuuccauugagcagcag

SEQ ID NO: 112671 - RNA, 22 nt, Human
cacaacaaaaaauaaguaugag

SEQ ID NO: 112672 - RNA, 22 nt, Human
caaaguauuuagcugacucgcu

SEQ ID NO: 112673 - RNA, 22 nt, Human
caaucuucucuagaguauucua

SEQ ID NO: 112674 - RNA, 22 nt, Human
caauguuuuuccuuccuuaaua

SEQ ID NO: 112675 - RNA, 22 nt, Human
caaauuuuuauuuaccaucugc

SEQ ID NO: 112676 - RNA, 22 nt, Human
caauaguaaucaaugcaguuag

SEQ ID NO: 112677 - RNA, 22 nt, Human
caauaauugcuuuccagaguua

SEQ ID NO: 112678 - RNA, 22 nt, Human
caagguauugaggccagugucc

SEQ ID NO: 112679 - RNA, 22 nt, Human
caagguuucgaguucccaacca

SEQ ID NO: 112680 - RNA, 22 nt, Human
caccacauguccgaaauucagc

SEQ ID NO: 112681 - RNA, 22 nt, Human
caaggaagguugguugaaggua

SEQ ID NO: 112682 - RNA, 22 nt, Human
caagauauguccuguuacuaag

SEQ ID NO: 112683 - RNA, 22 nt, Human
caacuucugcuuucuuccuugc

SEQ ID NO: 112684 - RNA, 22 nt, Human
caacuucuauucagucugcagu

SEQ ID NO: 112685 - RNA, 22 nt, Human
caacacaucaguucagucuuga

SEQ ID NO: 112686 - RNA, 22 nt, Human
auuuuucacauuuugggggaca

SEQ ID NO: 112687 - RNA, 21 nt, Human
auuuuucagaaggaugugaua

SEQ ID NO: 112688 - RNA, 22 nt, Human
auuuuucucucaugugcaacua

SEQ ID NO: 112689 - RNA, 22 nt, Human
auuuuucuuucacauuuucuua

SEQ ID NO: 112690 - RNA, 22 nt, Human
caacaagcgcucagagcaaagc

SEQ ID NO: 112691 - RNA, 22 nt, Human
auuuuuuuggucauaugagaua

SEQ ID NO: 112692 - RNA, 22 nt, Human
auuuuuuuuccugucucuuuca

SEQ ID NO: 112693 - RNA, 22 nt, Human
caaaaauacuugccuguaucug

SEQ ID NO: 112694 - RNA, 22 nt, Human
auuuucuugucucuguuguagg

SEQ ID NO: 112695 - RNA, 19 nt, Human
auuuugguucuuuccauuc

SEQ ID NO: 112696 - RNA, 22 nt, Human
caaagaagagauuuacagagcu

SEQ ID NO: 112697 - RNA, 22 nt, Human
caaagagaugcaccauauuucu

SEQ ID NO: 112698 - RNA, 22 nt, Human
auuuggaaacaugcugaccaug

SEQ ID NO: 112699 - RNA, 18 nt, Human
auuuguggggguuauaga

SEQ ID NO: 112700 - RNA, 22 nt, Human
auuuucuucauuuugauuguau

SEQ ID NO: 112701 - RNA, 22 nt, Human
auuuuugugcuuuauuggggua

SEQ ID NO: 112702 - RNA, 22 nt, Human
auuugcauguuuauuucuuaga

SEQ ID NO: 112703 - RNA, 22 nt, Human
auuugcaucagugagcgaugug

SEQ ID NO: 112704 - RNA, 22 nt, Human
auuugacuugguaagacuuaag

SEQ ID NO: 112705 - RNA, 22 nt, Human
auuuuuaucuaaaauccacuuu

SEQ ID NO: 112706 - RNA, 22 nt, Human
auuuccagcagcauauuugucu

SEQ ID NO: 112707 - RNA, 22 nt, Human
auuuaagacuguggugcaguuu

SEQ ID NO: 112708 - RNA, 21 nt, Human
auuuguggugcaauuguggua

SEQ ID NO: 112709 - RNA, 22 nt, Human
auuuuaccauuaguuuguaaua

SEQ ID NO: 112710 - RNA, 22 nt, Human
auuguagucuggacuuuuggga

SEQ ID NO: 112711 - RNA, 22 nt, Human
auuguuacuggguuaauuugga

SEQ ID NO: 112712 - RNA, 22 nt, Human
auugugaaugccugucagucuu

SEQ ID NO: 112713 - RNA, 22 nt, Human
auuaguagcacacagagaucag

SEQ ID NO: 112714 - RNA, 22 nt, Human
auuagaaaugacaugugggaau

SEQ ID NO: 112715 - RNA, 22 nt, Human
auuaauguguaugauauaaauu

SEQ ID NO: 112716 - RNA, 20 nt, Human
auuaauuuuuagggcucacc

SEQ ID NO: 112717 - RNA, 22 nt, Human
auuuagagaaguagcaaggucc

SEQ ID NO: 112718 - RNA, 22 nt, Human
auuuacugagguaaauaaacug

SEQ ID NO: 112719 - RNA, 22 nt, Human
auuuaaaggaagugggugauaa

SEQ ID NO: 112720 - RNA, 22 nt, Human
auuuaggacagugucugaauug

SEQ ID NO: 112721 - RNA, 22 nt, Human
auuuauccuugggguagagcca

SEQ ID NO: 112722 - RNA, 22 nt, Human
auugaguauuguaaauaaaaca

SEQ ID NO: 112723 - RNA, 22 nt, Human
auuuaaagaguaauacaaucca

SEQ ID NO: 112724 - RNA, 22 nt, Human
auucuuuucucuaaaugaugaa

SEQ ID NO: 112725 - RNA, 17 nt, Human
auuguuuuuaauuugca

SEQ ID NO: 112726 - RNA, 22 nt, Human
auugaaauuugcuuccucacug

SEQ ID NO: 112727 - RNA, 22 nt, Human
auuucagaguagaucguuauuu

SEQ ID NO: 112728 - RNA, 22 nt, Human
auuucagaaugaaaggaaaaau

SEQ ID NO: 112729 - RNA, 22 nt, Human
auuucagcagcccauguuugga

SEQ ID NO: 112730 - RNA, 22 nt, Human
auuuauuuucccucaaguaccu

SEQ ID NO: 112731 - RNA, 22 nt, Human
auuuccacaaauuaagauugca

SEQ ID NO: 112732 - RNA, 22 nt, Human
auuucauuuuagaaauaagugu

SEQ ID NO: 112733 - RNA, 22 nt, Human
auuucauaaaaacuuuaccuga

SEQ ID NO: 112734 - RNA, 22 nt, Human
auuucaguuugcaguuucucuc

SEQ ID NO: 112735 - RNA, 22 nt, Human
auuguuuugugaaacauaguga

SEQ ID NO: 112736 - RNA, 17 nt, Human
auuuccgaguuucuuuc

SEQ ID NO: 112737 - RNA, 22 nt, Human
auuucacucuuaauugcuuccu

SEQ ID NO: 112738 - RNA, 22 nt, Human
auuucaacagaguuugaaggca

SEQ ID NO: 112739 - RNA, 22 nt, Human
auuuauuugaagagccauugca

SEQ ID NO: 112740 - RNA, 22 nt, Human
auuugaaaaucuaugaugugca

SEQ ID NO: 112741 - RNA, 22 nt, Human
auuuggaaggcguuucucugua

SEQ ID NO: 112742 - RNA, 22 nt, Human
auuuaaaaacugguacaacagg

SEQ ID NO: 112743 - RNA, 22 nt, Human
caguaguucucauaacucauga

SEQ ID NO: 112744 - RNA, 22 nt, Human
caguuuuggaagaaacaaggaa

SEQ ID NO: 112745 - RNA, 22 nt, Human
caucgagaauuggcagcuaaag

SEQ ID NO: 112746 - RNA, 23 nt, Human
cauauucagaaacaccuaguggu

SEQ ID NO: 112747 - RNA, 22 nt, Human
cagguaguuagaaugaccagga

SEQ ID NO: 112748 - RNA, 22 nt, Human
cauaauuggugcuuauuaaaug

SEQ ID NO: 112749 - RNA, 22 nt, Human
caugguacugccacagaagagu

SEQ ID NO: 112750 - RNA, 22 nt, Human
caugguaccuagccucauggau

SEQ ID NO: 112751 - RNA, 22 nt, Human
cauaaucaagggguugugaugu

SEQ ID NO: 112752 - RNA, 22 nt, Human
caguuuuauacacugcagcucc

SEQ ID NO: 112753 - RNA, 22 nt, Human
caguuuuucaaaauuacaugau

SEQ ID NO: 112754 - RNA, 21 nt, Human
caguucuaagugucaucuuuu

SEQ ID NO: 112755 - RNA, 22 nt, Human
caugauaacacuucuguuuaau

SEQ ID NO: 112756 - RNA, 22 nt, Human
caguggggcuuccagacgcuga

SEQ ID NO: 112757 - RNA, 22 nt, Human
caugaacucucggguuuggaau

SEQ ID NO: 112758 - RNA, 22 nt, Human
cauccuauuacugaggcucccc

SEQ ID NO: 112759 - RNA, 22 nt, Human
caucuaaaauaagccuuauaau

SEQ ID NO: 112760 - RNA, 22 nt, Human
cagggcuuuuuccuccucuuug

SEQ ID NO: 112761 - RNA, 22 nt, Human
cagggcuugaaucaaggaaguc

SEQ ID NO: 112762 - RNA, 19 nt, Human
cagcaaacacuguaaaugg

SEQ ID NO: 112763 - RNA, 22 nt, Human
cagauuuagcacugauaggacu

SEQ ID NO: 112764 - RNA, 22 nt, Human
cagaaagaaguggggauagagg

SEQ ID NO: 112765 - RNA, 22 nt, Human
cagagggagcuaaccagcagcc

SEQ ID NO: 112766 - RNA, 22 nt, Human
cagauaagcuauaaguaguacc

SEQ ID NO: 112767 - RNA, 22 nt, Human
cagauggaguuaguuucuaaca

SEQ ID NO: 112768 - RNA, 22 nt, Human
cagauggagaaagagugaaugg

SEQ ID NO: 112769 - RNA, 20 nt, Human
cagaucuuauguuuuucugu

SEQ ID NO: 112770 - RNA, 22 nt, Human
cagauuuaauaaaaaaugcauc

SEQ ID NO: 112771 - RNA, 22 nt, Human
cagaaaaaaaugcagacuagca

SEQ ID NO: 112772 - RNA, 22 nt, Human
caaugaaaauuuaaguugcagc

SEQ ID NO: 112773 - RNA, 22 nt, Human
cacaagacuaaguggcagagca

SEQ ID NO: 112774 - RNA, 22 nt, Human
cacucaaacugaaauccuuuuu

SEQ ID NO: 112775 - RNA, 22 nt, Human
cuggagaacucugugcuucacu

SEQ ID NO: 112776 - RNA, 22 nt, Human
cugagaucaugggucagguggu

SEQ ID NO: 112777 - RNA, 22 nt, Human
cucauguucuaagcuuucuuca

SEQ ID NO: 112778 - RNA, 22 nt, Human
cuccuuuacaauugugggaaaa

SEQ ID NO: 112779 - RNA, 22 nt, Human
cucucacucccuccuucccucu

SEQ ID NO: 112780 - RNA, 22 nt, Human
cuccuuuuuuuaaagauggauu

SEQ ID NO: 112781 - RNA, 22 nt, Human
cucuaaauguggucugcagaua

SEQ ID NO: 112782 - RNA, 21 nt, Human
cugggaacccgaccaaggccu

SEQ ID NO: 112783 - RNA, 19 nt, Human
cugggacaaugaaagcauc

SEQ ID NO: 112784 - RNA, 22 nt, Human
cugacacagccauuguccuugu

SEQ ID NO: 112785 - RNA, 22 nt, Human
cuguuuggaugccauggucaag

SEQ ID NO: 112786 - RNA, 22 nt, Human
cugaguuuuucaaaucugaauu

SEQ ID NO: 112787 - RNA, 22 nt, Human
cugauaauaaccauuuuaaaau

SEQ ID NO: 112788 - RNA, 22 nt, Human
cuucaacuucuguuuuaaggaa

SEQ ID NO: 112789 - RNA, 20 nt, Human
cuuaugcaaaauguuaggga

SEQ ID NO: 112790 - RNA, 22 nt, Human
cugagaaauacccaagucuggu

SEQ ID NO: 112791 - RNA, 22 nt, Human
cugacugauuuugcuuuuuaau

SEQ ID NO: 112792 - RNA, 22 nt, Human
cugucucugucucuguuuaucc

SEQ ID NO: 112793 - RNA, 22 nt, Human
cucuucauguuggugcagaagc

SEQ ID NO: 112794 - RNA, 19 nt, Human
cucuucauuggaggguuga

SEQ ID NO: 112795 - RNA, 22 nt, Human
cucuucauuauucacgcccugu

SEQ ID NO: 112796 - RNA, 22 nt, Human
cucuuuuuccuaugaaaucuau

SEQ ID NO: 112797 - RNA, 22 nt, Human
cucuuuucaaaccuguuuaugg

SEQ ID NO: 112798 - RNA, 22 nt, Human
cucugauuuuucuaauacuuca

SEQ ID NO: 112799 - RNA, 22 nt, Human
cuugcuuuaucugguuucucau

SEQ ID NO: 112800 - RNA, 22 nt, Human
cuugggacucccuguagcagug

SEQ ID NO: 112801 - RNA, 22 nt, Human
cuugggguuugggggcuugacc

SEQ ID NO: 112802 - RNA, 22 nt, Human
cugcuugaugaggaaaggauug

SEQ ID NO: 112803 - RNA, 22 nt, Human
cuuucuuucaaguucugcuuua

SEQ ID NO: 112804 - RNA, 22 nt, Human
cuuucugauguaaggaacuagg

SEQ ID NO: 112805 - RNA, 22 nt, Human
cuuucucucaaacacacauaca

SEQ ID NO: 112806 - RNA, 22 nt, Human
cuuuaaaaauguauuuuugugg

SEQ ID NO: 112807 - RNA, 22 nt, Human
cuuuacauuaauuucuacugau

SEQ ID NO: 112808 - RNA, 22 nt, Human
cuuuauguuggggugucuuagu

SEQ ID NO: 112809 - RNA, 22 nt, Human
cuuuaguaaaacguauuuagga

SEQ ID NO: 112810 - RNA, 22 nt, Human
cuuguuaacaauugguaucuuu

SEQ ID NO: 112811 - RNA, 22 nt, Human
cuggacucuuuguuuaguucug

SEQ ID NO: 112812 - RNA, 22 nt, Human
cuggaagcgucggaggaagggc

SEQ ID NO: 112813 - RNA, 22 nt, Human
cuggaaaaauggauccugucuu

SEQ ID NO: 112814 - RNA, 22 nt, Human
cuggaaauggcagaguugcauu

SEQ ID NO: 112815 - RNA, 22 nt, Human
cuugugggaucuggagacaccg

SEQ ID NO: 112816 - RNA, 22 nt, Human
cuugugagaagaccuuccgcau

SEQ ID NO: 112817 - RNA, 22 nt, Human
cuuguuaaaagugacccuaaug

SEQ ID NO: 112818 - RNA, 22 nt, Human
cuggaaagauuuacacggggaa

SEQ ID NO: 112819 - RNA, 22 nt, Human
cuugauucauuuaagguuggag

SEQ ID NO: 112820 - RNA, 20 nt, Human
cuugaguucagagcugucau

SEQ ID NO: 112821 - RNA, 22 nt, Human
cuucuuuucuacuggccuagaa

SEQ ID NO: 112822 - RNA, 22 nt, Human
cuucuuugacucacugguacgc

SEQ ID NO: 112823 - RNA, 22 nt, Human
cuucuuuuggggaugaaaaugg

SEQ ID NO: 112824 - RNA, 22 nt, Human
cuucuuagugauuuaacaugua

SEQ ID NO: 112825 - RNA, 22 nt, Human
cuucuuaaaguugucacagcug

SEQ ID NO: 112826 - RNA, 22 nt, Human
cuucucuugugauguuagcgga

SEQ ID NO: 112827 - RNA, 22 nt, Human
cuucuggaggcugcagaaaaga

SEQ ID NO: 112828 - RNA, 22 nt, Human
cuucugaugugugcucuuaguu

SEQ ID NO: 112829 - RNA, 22 nt, Human
cuucucuuccuucucauccuca

SEQ ID NO: 112830 - RNA, 22 nt, Human
cuucucuuggguguggugucuu

SEQ ID NO: 112831 - RNA, 22 nt, Human
cuucauccguaccacggccaca

SEQ ID NO: 112832 - RNA, 22 nt, Human
cuucaguuaguuucaugugagc

SEQ ID NO: 112833 - RNA, 22 nt, Human
cuucauuucaggcugaagaaua

SEQ ID NO: 112834 - RNA, 22 nt, Human
cuuccagugcauagguagauca

SEQ ID NO: 112835 - RNA, 22 nt, Human
gaagaugacaucggaucugucu

SEQ ID NO: 112836 - RNA, 22 nt, Human
gaagaaggaagaucaugcuuga

SEQ ID NO: 112837 - RNA, 22 nt, Human
gagcaguuagggaccgcaggcu

SEQ ID NO: 112838 - RNA, 22 nt, Human
gagcacauguggagagucuggg

SEQ ID NO: 112839 - RNA, 22 nt, Human
gagcagcacagaccaaacagaa

SEQ ID NO: 112840 - RNA, 22 nt, Human
gaacucuugguggucauuagau

SEQ ID NO: 112841 - RNA, 22 nt, Human
gagcagcaggccagguugcagg

SEQ ID NO: 112842 - RNA, 22 nt, Human
gaacugaauguguaauguuggc

SEQ ID NO: 112843 - RNA, 20 nt, Human
gaacauaaauaacucuuuac

SEQ ID NO: 112844 - RNA, 22 nt, Human
gaacauauuuagcaccuaauau

SEQ ID NO: 112845 - RNA, 22 nt, Human
gagauuugaguuccuacugagu

SEQ ID NO: 112846 - RNA, 22 nt, Human
gaacaguuucccuguagaaaau

SEQ ID NO: 112847 - RNA, 22 nt, Human
gaacaaggauucccaaagaaga

SEQ ID NO: 112848 - RNA, 22 nt, Human
gaacagauucaucuaguggcua

SEQ ID NO: 112849 - RNA, 22 nt, Human
gagauuguggcagcagcuguuu

SEQ ID NO: 112850 - RNA, 22 nt, Human
gagaguuggaggguauguuagu

SEQ ID NO: 112851 - RNA, 22 nt, Human
gagauggauuuuuuugccaguc

SEQ ID NO: 112852 - RNA, 22 nt, Human
gaaaugucaagauauguuugga

SEQ ID NO: 112853 - RNA, 22 nt, Human
gaaauuucuuuguuaucuuggu

SEQ ID NO: 112854 - RNA, 22 nt, Human
gaaaugaaacacacaugcagcu

SEQ ID NO: 112855 - RNA, 22 nt, Human
gagagguuaucugcuaagguag

SEQ ID NO: 112856 - RNA, 20 nt, Human
gagaggguuaggauauuugc

SEQ ID NO: 112857 - RNA, 20 nt, Human
gagaaugucauuccuuuuuu

SEQ ID NO: 112858 - RNA, 22 nt, Human
gaaaaguauuaugugaggguuc

SEQ ID NO: 112859 - RNA, 22 nt, Human
gagaagucaggaguggagaaca

SEQ ID NO: 112860 - RNA, 22 nt, Human
gagaagugggggucugggauga

SEQ ID NO: 112861 - RNA, 22 nt, Human
gaaacguuguggaaaauccucu

SEQ ID NO: 112862 - RNA, 22 nt, Human
gaaagagaugucguuugucuuc

SEQ ID NO: 112863 - RNA, 22 nt, Human
gaaaaggaggggaggcagaugg

SEQ ID NO: 112864 - RNA, 22 nt, Human
gaaaagcucuuuagaagagguu

SEQ ID NO: 112865 - RNA, 22 nt, Human
gaaaagaaggcaggagcccaag

SEQ ID NO: 112866 - RNA, 20 nt, Human
gacuucaauuucuaucuuuu

SEQ ID NO: 112867 - RNA, 22 nt, Human
gaaaaagucuuaaaguaaggca

SEQ ID NO: 112868 - RNA, 23 nt, Human
gacuucacacucucaaccacugc

SEQ ID NO: 112869 - RNA, 22 nt, Human
gaaaaacucagugggggucuuu

SEQ ID NO: 112870 - RNA, 22 nt, Human
gaaaaaccacaauugguauuuu

SEQ ID NO: 112871 - RNA, 22 nt, Human
cuuguuuuaaacuguuguggcu

SEQ ID NO: 112872 - RNA, 20 nt, Human
cuuguuaaauaugcagguag

SEQ ID NO: 112873 - RNA, 18 nt, Human
gacaaaaguacagacaga

SEQ ID NO: 112874 - RNA, 22 nt, Human
cuuuuucuuaucuuuuucuaug

SEQ ID NO: 112875 - RNA, 22 nt, Human
cuuuuucuugugguuaauaucu

SEQ ID NO: 112876 - RNA, 22 nt, Human
cuuuucuuuucuucucuuccca

SEQ ID NO: 112877 - RNA, 22 nt, Human
cuuuuaaucuaauuuuuauauu

SEQ ID NO: 112878 - RNA, 22 nt, Human
cuuuuaccuuaauuucgacaca

SEQ ID NO: 112879 - RNA, 22 nt, Human
cuuuucaaacaggacagguccu

SEQ ID NO: 112880 - RNA, 19 nt, Human
cuuuuagagggagaggacu

SEQ ID NO: 112881 - RNA, 22 nt, Human
gaaugcauuuuuuaaaagcaua

SEQ ID NO: 112882 - RNA, 22 nt, Human
gaauggaugcuggucaguuugg

SEQ ID NO: 112883 - RNA, 22 nt, Human
gaauucuaguucuguaucucug

SEQ ID NO: 112884 - RNA, 22 nt, Human
gaaugacuugcucauucugugu

SEQ ID NO: 112885 - RNA, 22 nt, Human
cuucuuuccauguguuuugguu

SEQ ID NO: 112886 - RNA, 22 nt, Human
gaauaauuuugaucagaaggga

SEQ ID NO: 112887 - RNA, 22 nt, Human
cuucuugggaggggcggagcuc

SEQ ID NO: 112888 - RNA, 22 nt, Human
cuucuugucagugauuucuucc

SEQ ID NO: 112889 - RNA, 22 nt, Human
cuucuuucuuuucuucuucucu

SEQ ID NO: 112890 - RNA, 22 nt, Human
gaauagauuagaaagaguaugu

SEQ ID NO: 112891 - RNA, 22 nt, Human
cuucauaagauuguugugagga

SEQ ID NO: 112892 - RNA, 22 nt, Human
cuuccauucugauggcuaauua

SEQ ID NO: 112893 - RNA, 22 nt, Human
gaaggaagcugucuggaugugu

SEQ ID NO: 112894 - RNA, 22 nt, Human
gaaggagaggauugugaggcug

SEQ ID NO: 112895 - RNA, 22 nt, Human
cuucuggaggcucuagaggaga

SEQ ID NO: 112896 - RNA, 22 nt, Human
cuucuucaucuuuuggaggaac

SEQ ID NO: 112897 - RNA, 22 nt, Human
cuucacaaaauauuucauuaua

SEQ ID NO: 112898 - RNA, 22 nt, Human
cuuauuugcccauguuucuuua

SEQ ID NO: 112899 - RNA, 22 nt, Human
cuuaggaaauccuguacucccc

SEQ ID NO: 112900 - RNA, 23 nt, Human
cuuauauaaucauuagaaaccau

SEQ ID NO: 112901 - RNA, 22 nt, Human
cuuauucuucuggacuuggagu

SEQ ID NO: 112902 - RNA, 22 nt, Human
cuuauaucaacuggaaaaauua

SEQ ID NO: 112903 - RNA, 22 nt, Human
cuguuucuuugcugucagagag

SEQ ID NO: 112904 - RNA, 22 nt, Human
gaacaugaguuuuaugguauuu

SEQ ID NO: 112905 - RNA, 22 nt, Human
cuguuucucugccugcacacau

SEQ ID NO: 112906 - RNA, 22 nt, Human
cuguucagugcauauguauuga

SEQ ID NO: 112907 - RNA, 22 nt, Human
gaacaaaagauagcccaaacau

SEQ ID NO: 112908 - RNA, 22 nt, Human
cuguggaaugcaguugcgagca

SEQ ID NO: 112909 - RNA, 22 nt, Human
gaaaggagacugcacuggagcc

SEQ ID NO: 112910 - RNA, 22 nt, Human
gaaauaggcccuuacauggaaa

SEQ ID NO: 112911 - RNA, 22 nt, Human
gaaauagagacaguaagugucu

SEQ ID NO: 112912 - RNA, 22 nt, Human
gaaagugaauguaacauguuau

SEQ ID NO: 112913 - RNA, 19 nt, Human
cuuugugguuuucagaacu

SEQ ID NO: 112914 - RNA, 22 nt, Human
gaaagcuuggaaacgacuuuau

SEQ ID NO: 112915 - RNA, 22 nt, Human
gaaagcauucuggaggggcaga

SEQ ID NO: 112916 - RNA, 22 nt, Human
cugaauucuuguugucggagca

SEQ ID NO: 112917 - RNA, 22 nt, Human
cugaaggacacgugaggagcca

SEQ ID NO: 112918 - RNA, 22 nt, Human
cggcuucucgggucggauuccg

SEQ ID NO: 112919 - RNA, 22 nt, Human
cugaagaaagaaaauggccauc

SEQ ID NO: 112920 - RNA, 22 nt, Human
cucuuucauucuuagguugccg

SEQ ID NO: 112921 - RNA, 22 nt, Human
cucuuuguauucuagaagcucu

SEQ ID NO: 112922 - RNA, 22 nt, Human
cucuuucauucuguccuuguuu

SEQ ID NO: 112923 - RNA, 22 nt, Human
cugaaacuauggggaggggagc

SEQ ID NO: 112924 - RNA, 22 nt, Human
cucugugggcauauuuguaaaa

SEQ ID NO: 112925 - RNA, 22 nt, Human
cucuuagucugcuuuuuuucca

SEQ ID NO: 112926 - RNA, 22 nt, Human
cggccuuugcccgucauucugg

SEQ ID NO: 112927 - RNA, 22 nt, Human
cucuauuuuuucaucuuucagg

SEQ ID NO: 112928 - RNA, 22 nt, Human
cuccuuugagcaaaucuuugau

SEQ ID NO: 112929 - RNA, 22 nt, Human
cuccuugagaaugaacaaagga

SEQ ID NO: 112930 - RNA, 22 nt, Human
cuccuuccuccgcccuuccucg

SEQ ID NO: 112931 - RNA, 22 nt, Human
cuccuuuuugggaccgugcagc

SEQ ID NO: 112932 - RNA, 22 nt, Human
cggaagcacuagacacugacac

SEQ ID NO: 112933 - RNA, 22 nt, Human
cucaugcugcaaauggcuguuu

SEQ ID NO: 112934 - RNA, 22 nt, Human
cucagaugaugucuucagggaa

SEQ ID NO: 112935 - RNA, 22 nt, Human
cucagaauugucaccucaaaaa

SEQ ID NO: 112936 - RNA, 22 nt, Human
cuaugaaucaauuucugcaguu

SEQ ID NO: 112937 - RNA, 22 nt, Human
cuauauucuggaauguccauuu

SEQ ID NO: 112938 - RNA, 22 nt, Human
cuauguuuugcuagugaugggu

SEQ ID NO: 112939 - RNA, 22 nt, Human
ccuuuggaugucauucuuggca

SEQ ID NO: 112940 - RNA, 21 nt, Human
ccuuuggagacugcagcaaug

SEQ ID NO: 112941 - RNA, 22 nt, Human
cgguuuuuaaaagucucuucua

SEQ ID NO: 112942 - RNA, 22 nt, Human
cguauauaaauguauauacaca

SEQ ID NO: 112943 - RNA, 19 nt, Human
ccugugaguuaagcuaugu

SEQ ID NO: 112944 - RNA, 22 nt, Human
ccuguuuguucauguacuguga

SEQ ID NO: 112945 - RNA, 18 nt, Human
ccuucaucucugcuucuu

SEQ ID NO: 112946 - RNA, 22 nt, Human
ccucucacucccucauggguuc

SEQ ID NO: 112947 - RNA, 22 nt, Human
ccgauuuauucugacaguuuau

SEQ ID NO: 112948 - RNA, 22 nt, Human
ccucaauucgugccucacauug

SEQ ID NO: 112949 - RNA, 22 nt, Human
ccucacaaagaaugucuagaca

SEQ ID NO: 112950 - RNA, 22 nt, Human
cgacagauuauuuugugacugc

SEQ ID NO: 112951 - RNA, 22 nt, Human
cccuuuuuuauggaguuggcca

SEQ ID NO: 112952 - RNA, 22 nt, Human
ccugauauggugucauuuaaac

SEQ ID NO: 112953 - RNA, 22 nt, Human
cccuucauguagcugugugucc

SEQ ID NO: 112954 - RNA, 22 nt, Human
ccugaauuuaucugaauggugg

SEQ ID NO: 112955 - RNA, 22 nt, Human
ccucuuuugaaccaguucuuca

SEQ ID NO: 112956 - RNA, 22 nt, Human
ccugaaaugaguucugcucacu

SEQ ID NO: 112957 - RNA, 22 nt, Human
ccucuuugcccucuuuccuucc

SEQ ID NO: 112958 - RNA, 22 nt, Human
ccccuuucucccgcgucuggcc

SEQ ID NO: 112959 - RNA, 22 nt, Human
ccguaugacuuuuuguuguugu

SEQ ID NO: 112960 - RNA, 22 nt, Human
ccccacaugaauacaguguagu

SEQ ID NO: 112961 - RNA, 22 nt, Human
cccauuuuuuggauguguggau

SEQ ID NO: 112962 - RNA, 22 nt, Human
ccccccaaauguuacagugacc

SEQ ID NO: 112963 - RNA, 22 nt, Human
ccuaggauuaaaauaauaauua

SEQ ID NO: 112964 - RNA, 22 nt, Human
ccuauauaaaugacauauagga

SEQ ID NO: 112965 - RNA, 22 nt, Human
ccuauuuucaaaauuguuuauc

SEQ ID NO: 112966 - RNA, 22 nt, Human
ccauuuuccuguauggacucga

SEQ ID NO: 112967 - RNA, 22 nt, Human
ccgauuuaugucucugacuuga

SEQ ID NO: 112968 - RNA, 22 nt, Human
ccauggaugcucagauguuagc

SEQ ID NO: 112969 - RNA, 22 nt, Human
ccauggauacuaagguauguga

SEQ ID NO: 112970 - RNA, 22 nt, Human
cccuuuuuugccauuccuuccu

SEQ ID NO: 112971 - RNA, 22 nt, Human
ccaucuuugcucuuuuauugca

SEQ ID NO: 112972 - RNA, 22 nt, Human
ccauaaaguaggaaacacuaca

SEQ ID NO: 112973 - RNA, 22 nt, Human
ccauaaaagagaaucuaaauga

SEQ ID NO: 112974 - RNA, 22 nt, Human
ccgaaaaacagaaucuuggaac

SEQ ID NO: 112975 - RNA, 22 nt, Human
cauauuaugcauguuguucuuu

SEQ ID NO: 112976 - RNA, 22 nt, Human
acauuugauauggaguugugua

SEQ ID NO: 112977 - RNA, 22 nt, Human
acauuuuaaaaacaguaccugg

SEQ ID NO: 112978 - RNA, 22 nt, Human
acauuuugggagaaaguuguua

SEQ ID NO: 112979 - RNA, 22 nt, Human
acauuucuccuacuuguuauuu

SEQ ID NO: 112980 - RNA, 22 nt, Human
acauuuccaaagaugccaguca

SEQ ID NO: 112981 - RNA, 22 nt, Human
accaaucuccuauuuuguuuca

SEQ ID NO: 112982 - RNA, 22 nt, Human
accaaucugguauauuccagaa

SEQ ID NO: 112983 - RNA, 22 nt, Human
acauuccugaagguaaugagaa

SEQ ID NO: 112984 - RNA, 23 nt, Human
acauuacacgcaguaauugcccc

SEQ ID NO: 112985 - RNA, 22 nt, Human
acauuuuuggguugaugucuga

SEQ ID NO: 112986 - RNA, 22 nt, Human
accaauguuuuauagaaaugcc

SEQ ID NO: 112987 - RNA, 22 nt, Human
accauuuaucagaagagacacc

SEQ ID NO: 112988 - RNA, 22 nt, Human
acauuuuguuuauggaaaagau

SEQ ID NO: 112989 - RNA, 22 nt, Human
acauuguuuuugugacuucuau

SEQ ID NO: 112990 - RNA, 22 nt, Human
acauuuuaccaucuguggauga

SEQ ID NO: 112991 - RNA, 22 nt, Human
acauuuguuucucuagaguagg

SEQ ID NO: 112992 - RNA, 22 nt, Human
acauucucuuuuagaaagcugu

SEQ ID NO: 112993 - RNA, 20 nt, Human
acauggagaagcgagguagg

SEQ ID NO: 112994 - RNA, 22 nt, Human
acauggaauuucagaagagcau

SEQ ID NO: 112995 - RNA, 22 nt, Human
acauaaaccccccuuccccagg

SEQ ID NO: 112996 - RNA, 22 nt, Human
acaguuuucugagaaucacagg

SEQ ID NO: 112997 - RNA, 21 nt, Human
aauucccagaaacagcacaag

SEQ ID NO: 112998 - RNA, 22 nt, Human
aauucuaaugaguucuuaucua

SEQ ID NO: 112999 - RNA, 22 nt, Human
aauucugaggccauuuauuucc

SEQ ID NO: 113000 - RNA, 22 nt, Human
aauugcauucauuuguauauuu

SEQ ID NO: 113001 - RNA, 22 nt, Human
acaugaggaacucaggagucac

SEQ ID NO: 113002 - RNA, 22 nt, Human
aauugauauuagauuugucuca

SEQ ID NO: 113003 - RNA, 22 nt, Human
aauucuuuguuccucugccaag

SEQ ID NO: 113004 - RNA, 22 nt, Human
acgcugagcucauggagaugca

SEQ ID NO: 113005 - RNA, 22 nt, Human
accuuagugauuuaaaaucaga

SEQ ID NO: 113006 - RNA, 22 nt, Human
acgaaugacaugugauuugaaa

SEQ ID NO: 113007 - RNA, 22 nt, Human
acguuuuagccauguaguuucu

SEQ ID NO: 113008 - RNA, 22 nt, Human
acgguuuggggaggaggauccc

SEQ ID NO: 113009 - RNA, 22 nt, Human
acguuauagaugcuucaugaaa

SEQ ID NO: 113010 - RNA, 22 nt, Human
acuaaacauaucacugcuuuac

SEQ ID NO: 113011 - RNA, 22 nt, Human
acgauuugguucagugaagaca

SEQ ID NO: 113012 - RNA, 22 nt, Human
accuugauggagugaugaauga

SEQ ID NO: 113013 - RNA, 20 nt, Human
accuucuuugguagacggaa

SEQ ID NO: 113014 - RNA, 22 nt, Human
accuuaagugauuaugacauau

SEQ ID NO: 113015 - RNA, 22 nt, Human
accuuagcuguuaaaacuaagu

SEQ ID NO: 113016 - RNA, 22 nt, Human
acgauaacaauaguagcaugua

SEQ ID NO: 113017 - RNA, 22 nt, Human
acgauacaaucauauaguaccu

SEQ ID NO: 113018 - RNA, 22 nt, Human
accuuuuauuuucaugcuugcu

SEQ ID NO: 113019 - RNA, 22 nt, Human
acgaaauaaaauuaaagcccua

SEQ ID NO: 113020 - RNA, 22 nt, Human
acccuuucgagauuucugccuu

SEQ ID NO: 113021 - RNA, 22 nt, Human
acccuauuaacuacuacguugg

SEQ ID NO: 113022 - RNA, 22 nt, Human
accuauuuauacaacugcacca

SEQ ID NO: 113023 - RNA, 22 nt, Human
accuaucugcuggauuuguugu

SEQ ID NO: 113024 - RNA, 22 nt, Human
accgguucccaucuggagaguu

SEQ ID NO: 113025 - RNA, 22 nt, Human
accauuauagaggacauuaugu

SEQ ID NO: 113026 - RNA, 22 nt, Human
accgauuucaaauggugcuaga

SEQ ID NO: 113027 - RNA, 22 nt, Human
agauaacauguugcagauucug

SEQ ID NO: 113028 - RNA, 22 nt, Human
agauaaucacaaucuagacuuu

SEQ ID NO: 113029 - RNA, 22 nt, Human
agaguacagaagcauuucagau

SEQ ID NO: 113030 - RNA, 22 nt, Human
agaguagucuuuacucuuccaa

SEQ ID NO: 113031 - RNA, 22 nt, Human
agaguguagugaaaagagauua

SEQ ID NO: 113032 - RNA, 22 nt, Human
agaguaauguggaguuugugcu

SEQ ID NO: 113033 - RNA, 22 nt, Human
agagggagcuccaagaucaagg

SEQ ID NO: 113034 - RNA, 22 nt, Human
agagggcugugcuaaauuucag

SEQ ID NO: 113035 - RNA, 23 nt, Human
agagggaagagcuuagaugggga

SEQ ID NO: 113036 - RNA, 22 nt, Human
agagcuuuggaguaaguuuuga

SEQ ID NO: 113037 - RNA, 22 nt, Human
agagcuauuucuuaaaagcugu

SEQ ID NO: 113038 - RNA, 22 nt, Human
agaggaauuauugaguuagauu

SEQ ID NO: 113039 - RNA, 22 nt, Human
agaggagaauguaaauuuguca

SEQ ID NO: 113040 - RNA, 22 nt, Human
agagcagcaaucuuugaaauua

SEQ ID NO: 113041 - RNA, 22 nt, Human
agagaaauguacuagucuaacu

SEQ ID NO: 113042 - RNA, 21 nt, Human
agacuucuacuaucuuaugac

SEQ ID NO: 113043 - RNA, 19 nt, Human
agagauuuucuguuuuagu

SEQ ID NO: 113044 - RNA, 22 nt, Human
agagcaauggugcuuuaauucu

SEQ ID NO: 113045 - RNA, 22 nt, Human
agagauggugaugaggaaaaau

SEQ ID NO: 113046 - RNA, 22 nt, Human
agagauugagcucagaagaccu

SEQ ID NO: 113047 - RNA, 22 nt, Human
agagauuagagaagaugauaaa

SEQ ID NO: 113048 - RNA, 22 nt, Human
agagaauuugggaauauaaauc

SEQ ID NO: 113049 - RNA, 22 nt, Human
agagacauagcacaguuuuucg

SEQ ID NO: 113050 - RNA, 22 nt, Human
agagcagauggagcuggaagag

SEQ ID NO: 113051 - RNA, 21 nt, Human
agacugaugggaagacucugu

SEQ ID NO: 113052 - RNA, 22 nt, Human
agacuauuuugugauaacuaau

SEQ ID NO: 113053 - RNA, 22 nt, Human
agagaacauuuucaggguuuca

SEQ ID NO: 113054 - RNA, 20 nt, Human
agagaacaguuuggucacag

SEQ ID NO: 113055 - RNA, 22 nt, Human
agagaagaauccccugguggag

SEQ ID NO: 113056 - RNA, 22 nt, Human
agagaaacauuaauugaugagg

SEQ ID NO: 113057 - RNA, 22 nt, Human
agacuucucuuggcuauauuau

SEQ ID NO: 113058 - RNA, 22 nt, Human
agacugugagaagauggcugcg

SEQ ID NO: 113059 - RNA, 22 nt, Human
agacauuuggugugaagggagg

SEQ ID NO: 113060 - RNA, 22 nt, Human
agaaucugcauuuuaacaagau

SEQ ID NO: 113061 - RNA, 21 nt, Human
agaaugaagaagaggucuuug

SEQ ID NO: 113062 - RNA, 22 nt, Human
agacauauuggcuugcuuuaau

SEQ ID NO: 113063 - RNA, 22 nt, Human
agaacauaucuguuuucuaacu

SEQ ID NO: 113064 - RNA, 22 nt, Human
agaaauuguaauaaaucugguc

SEQ ID NO: 113065 - RNA, 22 nt, Human
agaaucagagcagaaucuucau

SEQ ID NO: 113066 - RNA, 22 nt, Human
agaauccugagggaaauuuggc

SEQ ID NO: 113067 - RNA, 19 nt, Human
agaaacaacauucuggaga

SEQ ID NO: 113068 - RNA, 22 nt, Human
agaagaaugguuugaaagauuu

SEQ ID NO: 113069 - RNA, 22 nt, Human
agaagaagacccuaaggaaagg

SEQ ID NO: 113070 - RNA, 22 nt, Human
agaagcaauuggaaaguacagg

SEQ ID NO: 113071 - RNA, 21 nt, Human
agaagcggucgaaucgcagac

SEQ ID NO: 113072 - RNA, 22 nt, Human
agaaauggggugaagcaaaugg

SEQ ID NO: 113073 - RNA, 22 nt, Human
acuuugagaauuuuacuugugu

SEQ ID NO: 113074 - RNA, 22 nt, Human
acuuuugaguuacauaccugaa

SEQ ID NO: 113075 - RNA, 22 nt, Human
acuuuuuugccaucccuccagc

SEQ ID NO: 113076 - RNA, 22 nt, Human
agaaaagagacaauguuuuugg

SEQ ID NO: 113077 - RNA, 22 nt, Human
acuuuuagccuucccacaacag

SEQ ID NO: 113078 - RNA, 22 nt, Human
acuuuuccuggguagcuccugg

SEQ ID NO: 113079 - RNA, 22 nt, Human
acuuuuaaggggccuugauuua

SEQ ID NO: 113080 - RNA, 22 nt, Human
acuuugugaauagaacuggaug

SEQ ID NO: 113081 - RNA, 22 nt, Human
acuuggcuaggguuuuuaucuu

SEQ ID NO: 113082 - RNA, 22 nt, Human
acuugauggaguuucacuguau

SEQ ID NO: 113083 - RNA, 22 nt, Human
acuuuaaaucuguugcuuagcu

SEQ ID NO: 113084 - RNA, 18 nt, Human
acuugacuuguuucucag

SEQ ID NO: 113085 - RNA, 22 nt, Human
acuucuuuugcaugauucuuua

SEQ ID NO: 113086 - RNA, 22 nt, Human
acugugaagagcauucuggcug

SEQ ID NO: 113087 - RNA, 22 nt, Human
acuuauaaauuuaguacacugu

SEQ ID NO: 113088 - RNA, 22 nt, Human
acuguugugaauaaugaaaugc

SEQ ID NO: 113089 - RNA, 22 nt, Human
acuguugagggaagcagaugaa

SEQ ID NO: 113090 - RNA, 22 nt, Human
acugucauuaaugaauguaaua

SEQ ID NO: 113091 - RNA, 19 nt, Human
acuggggcaggcugggcuu

SEQ ID NO: 113092 - RNA, 22 nt, Human
acuggggauugguucuucaaca

SEQ ID NO: 113093 - RNA, 22 nt, Human
acuggauuuugugguguaucuu

SEQ ID NO: 113094 - RNA, 22 nt, Human
acuggauucucuuacacagaug

SEQ ID NO: 113095 - RNA, 20 nt, Human
acugcaagagacagaugaaa

SEQ ID NO: 113096 - RNA, 22 nt, Human
acugcagauccucugagaaacc

SEQ ID NO: 113097 - RNA, 22 nt, Human
acugauuuuauauauuaccccg

SEQ ID NO: 113098 - RNA, 22 nt, Human
acuaauuuacagaaauuucuua

SEQ ID NO: 113099 - RNA, 22 nt, Human
aggaaaaagaagaaaagaauca

SEQ ID NO: 113100 - RNA, 22 nt, Human
aggaaaaugaaggaagugggaa

SEQ ID NO: 113101 - RNA, 20 nt, Human
aggaagauccuuucuuuuaa

SEQ ID NO: 113102 - RNA, 22 nt, Human
agcuuucuauauaugaguugcu

SEQ ID NO: 113103 - RNA, 20 nt, Human
agcuuucaccaguacuucca

SEQ ID NO: 113104 - RNA, 22 nt, Human
aggaacaacagccuuuauaucc

SEQ ID NO: 113105 - RNA, 22 nt, Human
agcuggaaucucggcaaagcgu

SEQ ID NO: 113106 - RNA, 22 nt, Human
aggaaauaggaccagacaaagc

SEQ ID NO: 113107 - RNA, 22 nt, Human
aggaaauaagggcacuucagau

SEQ ID NO: 113108 - RNA, 22 nt, Human
aggaaaguugagcugucuguag

SEQ ID NO: 113109 - RNA, 22 nt, Human
aggaaaauggaccagaguuguu

SEQ ID NO: 113110 - RNA, 20 nt, Human
aggaaggagaaucugagcaa

SEQ ID NO: 113111 - RNA, 22 nt, Human
aggaagagcuggaccagaggac

SEQ ID NO: 113112 - RNA, 22 nt, Human
aggacauuugcuuuuuuucuuu

SEQ ID NO: 113113 - RNA, 22 nt, Human
aggauaaaggucauuauuccca

SEQ ID NO: 113114 - RNA, 22 nt, Human
aggaguuugaaaacuuaacuaa

SEQ ID NO: 113115 - RNA, 22 nt, Human
aggauaaaugggucauuaggca

SEQ ID NO: 113116 - RNA, 22 nt, Human
aggaagucucucaaaacuggaa

SEQ ID NO: 113117 - RNA, 19 nt, Human
aggagacuacuucuugcug

SEQ ID NO: 113118 - RNA, 22 nt, Human
aggagaaagaccagccugccga

SEQ ID NO: 113119 - RNA, 22 nt, Human
aggaaagacgcauuucuguagg

SEQ ID NO: 113120 - RNA, 22 nt, Human
agcugcuuuacuggucggcugg

SEQ ID NO: 113121 - RNA, 22 nt, Human
agcugcauucguaucauauugu

SEQ ID NO: 113122 - RNA, 22 nt, Human
agcugauugucuuuuuaaaagu

SEQ ID NO: 113123 - RNA, 22 nt, Human
agcucccaauugacuugaacua

SEQ ID NO: 113124 - RNA, 20 nt, Human
agcugaauaguuuugugaaa

SEQ ID NO: 113125 - RNA, 22 nt, Human
agcucuucugacucuaggcuca

SEQ ID NO: 113126 - RNA, 22 nt, Human
agcuaaaaugagguuuuuggau

SEQ ID NO: 113127 - RNA, 22 nt, Human
agcauuagguguguuucagagg

SEQ ID NO: 113128 - RNA, 22 nt, Human
agcauucuguggucuucuaugg

SEQ ID NO: 113129 - RNA, 22 nt, Human
agcauugguggcauuugcagcu

SEQ ID NO: 113130 - RNA, 22 nt, Human
agcauuugcuguucuagaaagu

SEQ ID NO: 113131 - RNA, 22 nt, Human
agcaguuuauccucauaaugga

SEQ ID NO: 113132 - RNA, 22 nt, Human
agcaguugcuuuguauauuaaa

SEQ ID NO: 113133 - RNA, 22 nt, Human
agcaguucucugucuagcuaga

SEQ ID NO: 113134 - RNA, 22 nt, Human
agcauuuuaaaacuaguuacca

SEQ ID NO: 113135 - RNA, 22 nt, Human
agcagauuguacagugcauuag

SEQ ID NO: 113136 - RNA, 22 nt, Human
agcagcaggcugggaugagucu

SEQ ID NO: 113137 - RNA, 22 nt, Human
agcagcaggugaccucgaugcc

SEQ ID NO: 113138 - RNA, 22 nt, Human
agcaggaaggcuagaagcagga

SEQ ID NO: 113139 - RNA, 20 nt, Human
aggcuccuccaggaugugug

SEQ ID NO: 113140 - RNA, 22 nt, Human
aggcauuuaaagauguaagacu

SEQ ID NO: 113141 - RNA, 22 nt, Human
agggaaauaggagaagaaagga

SEQ ID NO: 113142 - RNA, 22 nt, Human
agggaugcaguaaaaacuguag

SEQ ID NO: 113143 - RNA, 22 nt, Human
aggcgaagggaccagacgguag

SEQ ID NO: 113144 - RNA, 22 nt, Human
agggaagagaaacaaagauuca

SEQ ID NO: 113145 - RNA, 22 nt, Human
agggaaauuaaugugagcaaug

SEQ ID NO: 113146 - RNA, 22 nt, Human
aggguuugugaagacuuggcca

SEQ ID NO: 113147 - RNA, 22 nt, Human
agguaguacuuuuuagagugca

SEQ ID NO: 113148 - RNA, 22 nt, Human
aggguuuucauauauuauuagu

SEQ ID NO: 113149 - RNA, 22 nt, Human
aggguuugaauccucuuucuua

SEQ ID NO: 113150 - RNA, 22 nt, Human
agguagaaggaccagaauuuau

SEQ ID NO: 113151 - RNA, 22 nt, Human
aggucagacagggugucuuucu

SEQ ID NO: 113152 - RNA, 22 nt, Human
agguauuuuaugucgugugaug

SEQ ID NO: 113153 - RNA, 20 nt, Human
agucuuaucugcauuuagaa

SEQ ID NO: 113154 - RNA, 22 nt, Human
agucugaaccagauggcaaggu

SEQ ID NO: 113155 - RNA, 18 nt, Human
agucugagugaaauguag

SEQ ID NO: 113156 - RNA, 22 nt, Human
agucucccauaggcuaaguauu

SEQ ID NO: 113157 - RNA, 22 nt, Human
agucauuguguucaguaaaauc

SEQ ID NO: 113158 - RNA, 22 nt, Human
agucauuugaggcaugauuaug

SEQ ID NO: 113159 - RNA, 22 nt, Human
agucauuugucauuuuuuugag

SEQ ID NO: 113160 - RNA, 22 nt, Human
agucaacauuugagaugcaaug

SEQ ID NO: 113161 - RNA, 22 nt, Human
agucagaaggugucagaucuug

SEQ ID NO: 113162 - RNA, 22 nt, Human
aguauuuaguauucuauauuag

SEQ ID NO: 113163 - RNA, 22 nt, Human
aguauuuucuuuaguuuguuag

SEQ ID NO: 113164 - RNA, 23 nt, Human
aguauuguucaucuucaagacag

SEQ ID NO: 113165 - RNA, 22 nt, Human
agucaaaaaaccuagaaacacc

SEQ ID NO: 113166 - RNA, 21 nt, Human
agucaagcugccugcuuggca

SEQ ID NO: 113167 - RNA, 22 nt, Human
aguauuuuaaaauacauuaucc

SEQ ID NO: 113168 - RNA, 22 nt, Human
agguuuuugucauuuucuggua

SEQ ID NO: 113169 - RNA, 22 nt, Human
agguuuuagagagccaggaugu

SEQ ID NO: 113170 - RNA, 22 nt, Human
agguuuuagaagcugaagccaa

SEQ ID NO: 113171 - RNA, 22 nt, Human
agguuuuacuuuuuuuggaggu

SEQ ID NO: 113172 - RNA, 22 nt, Human
aguaaaugaaagcaauuuuaga

SEQ ID NO: 113173 - RNA, 22 nt, Human
aggugguauuuaaaauuauuug

SEQ ID NO: 113174 - RNA, 22 nt, Human
aggucuuuaguggcagagucua

SEQ ID NO: 113175 - RNA, 22 nt, Human
aggugcucaguaauugauuguu

SEQ ID NO: 113176 - RNA, 22 nt, Human
aguaauuucuuacggagaccuu

SEQ ID NO: 113177 - RNA, 22 nt, Human
aguaagaaagaaugauaggccu

SEQ ID NO: 113178 - RNA, 22 nt, Human
aguaggagcucaauuaaauguu

SEQ ID NO: 113179 - RNA, 22 nt, Human
aguaggaauucaaagagacaaa

SEQ ID NO: 113180 - RNA, 22 nt, Human
aguacuuugacuagaggcagcu

SEQ ID NO: 113181 - RNA, 22 nt, Human
aguagaauuacagguuuucucu

SEQ ID NO: 113182 - RNA, 22 nt, Human
aguacuuuuuguucaauugugc

SEQ ID NO: 113183 - RNA, 22 nt, Human
aguaucuauaucaaaaauggcu

SEQ ID NO: 113184 - RNA, 22 nt, Human
aguauccauccugcuguuucua

SEQ ID NO: 113185 - RNA, 22 nt, Human
aguaucugccagaaucucaguu

SEQ ID NO: 113186 - RNA, 22 nt, Human
aguaugcuggcaccuuugagug

SEQ ID NO: 113187 - RNA, 22 nt, Human
aaaugguguucuuuagaugaaa

SEQ ID NO: 113188 - RNA, 22 nt, Human
aaauguaaacuguauuuauaaa

SEQ ID NO: 113189 - RNA, 22 nt, Human
aaauggauaaucaagauaauca

SEQ ID NO: 113190 - RNA, 22 nt, Human
aaagaucaguuaacgccaucaa

SEQ ID NO: 113191 - RNA, 22 nt, Human
aaauggaaguuuguucucagcc

SEQ ID NO: 113192 - RNA, 22 nt, Human
aaauguuucauucuauuuuuag

SEQ ID NO: 113193 - RNA, 22 nt, Human
aaauguguagaggggagagccg

SEQ ID NO: 113194 - RNA, 20 nt, Human
aaauucgacuaaaaccagaa

SEQ ID NO: 113195 - RNA, 22 nt, Human
aaauguuugguggauaaaagga

SEQ ID NO: 113196 - RNA, 22 nt, Human
aaauucagauggcuuucuuuuc

SEQ ID NO: 113197 - RNA, 22 nt, Human
aaauucuuccaggaggaaauac

SEQ ID NO: 113198 - RNA, 22 nt, Human
aaauucagcagguuucaaaagc

SEQ ID NO: 113199 - RNA, 22 nt, Human
aacagaaaucauuuagggcucu

SEQ ID NO: 113200 - RNA, 22 nt, Human
aaauuugggagaaaugggucau

SEQ ID NO: 113201 - RNA, 22 nt, Human
aacaucaaaggaagaaugauau

SEQ ID NO: 113202 - RNA, 22 nt, Human
aacaaguagaauagguuuuuuu

SEQ ID NO: 113203 - RNA, 22 nt, Human
aaauuuuguugaaaaauauuuu

SEQ ID NO: 113204 - RNA, 22 nt, Human
aaauucggggaguuuugaggau

SEQ ID NO: 113205 - RNA, 22 nt, Human
aacacaguuucucuaugagagu

SEQ ID NO: 113206 - RNA, 20 nt, Human
aaauugaacaagccaggcug

SEQ ID NO: 113207 - RNA, 22 nt, Human
aacacuaaaggucaguuagaag

SEQ ID NO: 113208 - RNA, 22 nt, Human
aaauugucuuuaaucaggucau

SEQ ID NO: 113209 - RNA, 22 nt, Human
aaauuuauaacuuaaagugaau

SEQ ID NO: 113210 - RNA, 21 nt, Human
aacaaaagggaagaacagcug

SEQ ID NO: 113211 - RNA, 21 nt, Human
aaauuucauauggccaaccua

SEQ ID NO: 113212 - RNA, 21 nt, Human
aacuauuaauaccauuagcaa

SEQ ID NO: 113213 - RNA, 21 nt, Human
aacuaaugacugcagcaggaa

SEQ ID NO: 113214 - RNA, 22 nt, Human
aaccuuucucccugcacacugg

SEQ ID NO: 113215 - RNA, 22 nt, Human
aacgaugauaaauuguucucug

SEQ ID NO: 113216 - RNA, 22 nt, Human
aacgauuugaguuaguuuuuag

SEQ ID NO: 113217 - RNA, 22 nt, Human
aaccucuuuaaaagggauauug

SEQ ID NO: 113218 - RNA, 22 nt, Human
aacccguagaucaguucuaggu

SEQ ID NO: 113219 - RNA, 22 nt, Human
aacccugaacuuaguucuagga

SEQ ID NO: 113220 - RNA, 22 nt, Human
aacaguaugugagauuuacaca

SEQ ID NO: 113221 - RNA, 22 nt, Human
aacaguguaggagcugguuuau

SEQ ID NO: 113222 - RNA, 20 nt, Human
aaccuauuguaauauucuaa

SEQ ID NO: 113223 - RNA, 22 nt, Human
aaccagaagucaucagagcuga

SEQ ID NO: 113224 - RNA, 22 nt, Human
aaccaaaguugguauuuaauaa

SEQ ID NO: 113225 - RNA, 22 nt, Human
aacauuuccggccuuuuguucu

SEQ ID NO: 113226 - RNA, 22 nt, Human
aaccugaggguagacaaguuca

SEQ ID NO: 113227 - RNA, 22 nt, Human
aagauucaguugguuuuggaaa

SEQ ID NO: 113228 - RNA, 22 nt, Human
aagcagaaaaacugagcuccaa

SEQ ID NO: 113229 - RNA, 21 nt, Human
aagcagcugcagaauuucagu

SEQ ID NO: 113230 - RNA, 22 nt, Human
aagcagaacuguuuuguuuucu

SEQ ID NO: 113231 - RNA, 22 nt, Human
aagaggaauaauaaaaauugca

SEQ ID NO: 113232 - RNA, 22 nt, Human
aagauuuaccacuuuauucaag

SEQ ID NO: 113233 - RNA, 22 nt, Human
aagagugaguagcuugguuggu

SEQ ID NO: 113234 - RNA, 22 nt, Human
aagauguuguagauuagugaga

SEQ ID NO: 113235 - RNA, 22 nt, Human
aagagaaaugcuuuaacuuuau

SEQ ID NO: 113236 - RNA, 22 nt, Human
aagaagguugaaugacuacuuu

SEQ ID NO: 113237 - RNA, 22 nt, Human
aagaaaagaaacauggguaugc

SEQ ID NO: 113238 - RNA, 23 nt, Human
aagaaugcuucugaagagcugcc

SEQ ID NO: 113239 - RNA, 22 nt, Human
aagaacuagauagugguguaaa

SEQ ID NO: 113240 - RNA, 22 nt, Human
aagaaugaaaugaaagaacuaa

SEQ ID NO: 113241 - RNA, 22 nt, Human
aacuucuggaaacuuccaugug

SEQ ID NO: 113242 - RNA, 22 nt, Human
aagaaaggagauauucuuuuag

SEQ ID NO: 113243 - RNA, 22 nt, Human
aagaaauagauagaggaauacu

SEQ ID NO: 113244 - RNA, 21 nt, Human
aacuuucccaauccagauuug

SEQ ID NO: 113245 - RNA, 22 nt, Human
aacuuucuuugcaucuaaguuu

SEQ ID NO: 113246 - RNA, 22 nt, Human
aacuuucugaaaagcuugauca

SEQ ID NO: 113247 - RNA, 20 nt, Human
aacuuugagugcaugacuuu

SEQ ID NO: 113248 - RNA, 22 nt, Human
aacuuuuaugaaggaaaucaua

SEQ ID NO: 113249 - RNA, 22 nt, Human
aacuuuuucuuaggggaaagca

SEQ ID NO: 113250 - RNA, 22 nt, Human
aacucugacgcugucaaauaca

SEQ ID NO: 113251 - RNA, 22 nt, Human
aacuuucagaauccuaugcauu

SEQ ID NO: 113252 - RNA, 22 nt, Human
aacugagugcuacauugugauu

SEQ ID NO: 113253 - RNA, 22 nt, Human
aacuguugucacgaauguggcu

SEQ ID NO: 113254 - RNA, 22 nt, Human
aacuuaaacaagcucccaaguu

SEQ ID NO: 113255 - RNA, 22 nt, Human
aacuuaacucugcaauccagcu

SEQ ID NO: 113256 - RNA, 22 nt, Human
aacuuagagcucuccuaaauga

SEQ ID NO: 113257 - RNA, 22 nt, Human
aacuuauacccagggcagaaau

SEQ ID NO: 113258 - RNA, 22 nt, Human
aacucaggagagaguaacaggg

SEQ ID NO: 113259 - RNA, 22 nt, Human
aacuagugucuguaugauaagg

SEQ ID NO: 113260 - RNA, 19 nt, Human
aacuacagcgcacuguccu

SEQ ID NO: 113261 - RNA, 22 nt, Human
aacuuuacagacuagagcuuuc

SEQ ID NO: 113262 - RNA, 22 nt, Human
aacuuguaaugaaaggcaauag

SEQ ID NO: 113263 - RNA, 22 nt, Human
aacucugagaaacuugcaguug

SEQ ID NO: 113264 - RNA, 22 nt, Human
aacugaaguuuucagauuuugc

SEQ ID NO: 113265 - RNA, 22 nt, Human
aacgggcacuuuauuuaaaaaa

SEQ ID NO: 113266 - RNA, 23 nt, Human
aacucuggcuagcauagaauaga

SEQ ID NO: 113267 - RNA, 22 nt, Human
aacucgaugcaauucacuuugu

SEQ ID NO: 113268 - RNA, 22 nt, Human
aaugagaauguaagugaagaga

SEQ ID NO: 113269 - RNA, 23 nt, Human
aaugaguugggcagcauacaggc

SEQ ID NO: 113270 - RNA, 22 nt, Human
aaugaguucaucugaauucugg

SEQ ID NO: 113271 - RNA, 22 nt, Human
aaugagauaagaaaaccuuugc

SEQ ID NO: 113272 - RNA, 22 nt, Human
aaugcauaaugguuugugacaa

SEQ ID NO: 113273 - RNA, 22 nt, Human
aaugaguuuguucuauuauuug

SEQ ID NO: 113274 - RNA, 22 nt, Human
aaugauuuucugcaaacaguga

SEQ ID NO: 113275 - RNA, 22 nt, Human
aaugcagaugugucuuuaauuu

SEQ ID NO: 113276 - RNA, 22 nt, Human
aaugagauggaggacucuuaau

SEQ ID NO: 113277 - RNA, 22 nt, Human
aaugaaugaaugaaugauuaug

SEQ ID NO: 113278 - RNA, 22 nt, Human
aaucuuguucaacauuaucugu

SEQ ID NO: 113279 - RNA, 22 nt, Human
aaugaaaaucugucaguucaag

SEQ ID NO: 113280 - RNA, 22 nt, Human
aaucucuugggaagagugagug

SEQ ID NO: 113281 - RNA, 22 nt, Human
aaucucguuaugaagaugguug

SEQ ID NO: 113282 - RNA, 22 nt, Human
aaucuguugucaggaauccaca

SEQ ID NO: 113283 - RNA, 22 nt, Human
aaucuuuuugaaggaggagaga

SEQ ID NO: 113284 - RNA, 22 nt, Human
aaugaauaaauuuuaaagacag

SEQ ID NO: 113285 - RNA, 22 nt, Human
aaugaacuuucaguucagagag

SEQ ID NO: 113286 - RNA, 22 nt, Human
aaugaaacuaguagaaucuuug

SEQ ID NO: 113287 - RNA, 22 nt, Human
aaucaaagccugcaaguugacu

SEQ ID NO: 113288 - RNA, 23 nt, Human
aaucacuggauuugagcaugagg

SEQ ID NO: 113289 - RNA, 22 nt, Human
aaucaugguacaaguaagcacg

SEQ ID NO: 113290 - RNA, 22 nt, Human
aaucccaguugacagaacuguu

SEQ ID NO: 113291 - RNA, 22 nt, Human
aauccaaacaggauuaccuauc

SEQ ID NO: 113292 - RNA, 22 nt, Human
aaucgguugaacccaggaagug

SEQ ID NO: 113293 - RNA, 22 nt, Human
aaucuacaaugaaaaaauguuu

SEQ ID NO: 113294 - RNA, 22 nt, Human
aauguuuaagcuuuuauuuaca

SEQ ID NO: 113295 - RNA, 22 nt, Human
aauguuuaguuuuauuuuagua

SEQ ID NO: 113296 - RNA, 22 nt, Human
aauguuugaacuuugcauauuu

SEQ ID NO: 113297 - RNA, 22 nt, Human
aauguuguaaauauucuuugag

SEQ ID NO: 113298 - RNA, 23 nt, Human
aauguugaggguggguuuuuaac

SEQ ID NO: 113299 - RNA, 22 nt, Human
aauguauuuuuaggcagaauau

SEQ ID NO: 113300 - RNA, 22 nt, Human
aauguucucuaaucuuucucuu

SEQ ID NO: 113301 - RNA, 22 nt, Human
aauuauguugaaauaugagaac

SEQ ID NO: 113302 - RNA, 22 nt, Human
aauuagaagcuguuagcaaaau

SEQ ID NO: 113303 - RNA, 22 nt, Human
aauuacuuuaggaaaacuccuc

SEQ ID NO: 113304 - RNA, 22 nt, Human
aauuauucuugccuagguuuaa

SEQ ID NO: 113305 - RNA, 21 nt, Human
aauuauuugcauuuuucuugu

SEQ ID NO: 113306 - RNA, 22 nt, Human
aauucaacagucaguuaucuca

SEQ ID NO: 113307 - RNA, 22 nt, Human
aauggaaaggagccugacuaua

SEQ ID NO: 113308 - RNA, 22 nt, Human
aauggcaauagugcauuaugua

SEQ ID NO: 113309 - RNA, 22 nt, Human
aaugggauuaagaaagaucuug

SEQ ID NO: 113310 - RNA, 22 nt, Human
aauguacucgaaugauguuaag

SEQ ID NO: 113311 - RNA, 22 nt, Human
aauguaaauaauuguaaaauuu

SEQ ID NO: 113312 - RNA, 22 nt, Human
aauguaguuuacugugagugca

SEQ ID NO: 113313 - RNA, 22 nt, Human
aauacagauggcaugugaagau

SEQ ID NO: 113314 - RNA, 22 nt, Human
aauacaaucagauuaugguagu

SEQ ID NO: 113315 - RNA, 22 nt, Human
aauaauuuuuuugugauuaugu

SEQ ID NO: 113316 - RNA, 22 nt, Human
aauaauacaugugaugagaauu

SEQ ID NO: 113317 - RNA, 22 nt, Human
aaguuuaagguagugaugauga

SEQ ID NO: 113318 - RNA, 22 nt, Human
aaguugaaugucuugcugaaug

SEQ ID NO: 113319 - RNA, 22 nt, Human
aauaacaguuuauuugagggcu

SEQ ID NO: 113320 - RNA, 22 nt, Human
aauaagagaauaaaaucuguua

SEQ ID NO: 113321 - RNA, 22 nt, Human
aauaguggcuuggacuaaauau

SEQ ID NO: 113322 - RNA, 22 nt, Human
aauaggaaggaaauguuuaccu

SEQ ID NO: 113323 - RNA, 22 nt, Human
aauagagacaguuuaacaauau

SEQ ID NO: 113324 - RNA, 22 nt, Human
aauauauaugggugcaugucug

SEQ ID NO: 113325 - RNA, 22 nt, Human
aauaucuagccuuuagcagcuu

SEQ ID NO: 113326 - RNA, 22 nt, Human
aauauagagcagaucuggcucu

SEQ ID NO: 113327 - RNA, 22 nt, Human
aaguagaaaaccgcacuggacu

SEQ ID NO: 113328 - RNA, 19 nt, Human
aaguauagucagccuucua

SEQ ID NO: 113329 - RNA, 21 nt, Human
aaguccaauaccuaaggcucc

SEQ ID NO: 113330 - RNA, 22 nt, Human
aaguguucucuguuuuaucuac

SEQ ID NO: 113331 - RNA, 22 nt, Human
aaguucaccugcauuuacuaaa

SEQ ID NO: 113332 - RNA, 22 nt, Human
aaguuaauugcuucuaguuaau

SEQ ID NO: 113333 - RNA, 22 nt, Human
aagugugugagaaggggucgca

SEQ ID NO: 113334 - RNA, 22 nt, Human
aaguuaaaaaagcuggguaaaa

SEQ ID NO: 113335 - RNA, 22 nt, Human
aaguguggguaagcauuucuug

SEQ ID NO: 113336 - RNA, 22 nt, Human
aagugugugugcgcaugugcau

SEQ ID NO: 113337 - RNA, 22 nt, Human
aaggucuucgaaccuuauguua

SEQ ID NO: 113338 - RNA, 22 nt, Human
aaguaaaucuuaugucagggag

SEQ ID NO: 113339 - RNA, 22 nt, Human
aagguuuuguuuucgguuuuuu

SEQ ID NO: 113340 - RNA, 21 nt, Human
aaguaaauuuuuacuuaggcc

SEQ ID NO: 113341 - RNA, 22 nt, Human
aagguuuuguaugaaaucucug

SEQ ID NO: 113342 - RNA, 22 nt, Human
aaguaauuugugaaggcauguu

SEQ ID NO: 113343 - RNA, 22 nt, Human
aagggaaaagcugaaugagaug

SEQ ID NO: 113344 - RNA, 22 nt, Human
aagggagaguauccagaaacag

SEQ ID NO: 113345 - RNA, 22 nt, Human
aagggaaguuugacacuuuuua

SEQ ID NO: 113346 - RNA, 22 nt, Human
aagggaauagagcagcaaaaau

SEQ ID NO: 113347 - RNA, 22 nt, Human
aagguauaaauaacucgggagg

SEQ ID NO: 113348 - RNA, 22 nt, Human
aaggcuguuugagcacuggagc

SEQ ID NO: 113349 - RNA, 22 nt, Human
aaggcuuugugcugaguugucg

SEQ ID NO: 113350 - RNA, 22 nt, Human
aaggauuuccaggccugcgccu

SEQ ID NO: 113351 - RNA, 22 nt, Human
aaggaucuuucuuuuuaccauu

SEQ ID NO: 113352 - RNA, 18 nt, Human
aaggaggaaugaauagca

SEQ ID NO: 113353 - RNA, 22 nt, Human
aagcauaucaaguuuuaugugc

SEQ ID NO: 113354 - RNA, 22 nt, Human
aaagacagccuguuggcuuucu

SEQ ID NO: 113355 - RNA, 22 nt, Human
aaagacuaaccaguugucaaaa

SEQ ID NO: 113356 - RNA, 22 nt, Human
aaagagacaacaacaacuucua

SEQ ID NO: 113357 - RNA, 22 nt, Human
aaacuugaggcaaugaaggugu

SEQ ID NO: 113358 - RNA, 22 nt, Human
aaacugugcagucacauaagga

SEQ ID NO: 113359 - RNA, 22 nt, Human
aaacuuuaucaaguacucuuca

SEQ ID NO: 113360 - RNA, 22 nt, Human
aaagaacguuucugggaaucag

SEQ ID NO: 113361 - RNA, 20 nt, Human
aaacucucugaucuuacagu

SEQ ID NO: 113362 - RNA, 22 nt, Human
aaacucaugccagagaacuuaa

SEQ ID NO: 113363 - RNA, 22 nt, Human
aaacugcuuucucugccuuucc

SEQ ID NO: 113364 - RNA, 21 nt, Human
aaagaaguuaguucagugguu

SEQ ID NO: 113365 - RNA, 22 nt, Human
aaacuuuaggcacauggaucua

SEQ ID NO: 113366 - RNA, 22 nt, Human
aaacucaucaguuuagaaaccu

SEQ ID NO: 113367 - RNA, 20 nt, Human
aaacucuuuucuuacauuuu

SEQ ID NO: 113368 - RNA, 22 nt, Human
aaacucuaagacuaaaauugaa

SEQ ID NO: 113369 - RNA, 22 nt, Human
aaaaggaagaguuuucagagac

SEQ ID NO: 113370 - RNA, 22 nt, Human
aaaagcgaagagaacugaaguu

SEQ ID NO: 113371 - RNA, 22 nt, Human
aaaaggaacaauaugguauuuu

SEQ ID NO: 113372 - RNA, 22 nt, Human
aaaauaauauuauaccacugcu

SEQ ID NO: 113373 - RNA, 22 nt, Human
aaaauacuaggaaaauaaauca

SEQ ID NO: 113374 - RNA, 22 nt, Human
aaaauauaaaggauguggguuu

SEQ ID NO: 113375 - RNA, 22 nt, Human
aaacauaugccuucuuuuguaa

SEQ ID NO: 113376 - RNA, 22 nt, Human
aaaccagaguucauaguauuca

SEQ ID NO: 113377 - RNA, 22 nt, Human
aaaauauguugagauacugaaa

SEQ ID NO: 113378 - RNA, 21 nt, Human
aaacaugcagccugccaauuc

SEQ ID NO: 113379 - RNA, 22 nt, Human
aaaagauguaaacauauauuaa

SEQ ID NO: 113380 - RNA, 22 nt, Human
aaaagacaaggaucuggaguga

SEQ ID NO: 113381 - RNA, 22 nt, Human
aaaacuuucagggauacagaaa

SEQ ID NO: 113382 - RNA, 22 nt, Human
aaaacauuuuacugccaucuca

SEQ ID NO: 113383 - RNA, 22 nt, Human
aaaaaaacuaauuuuaaaugug

SEQ ID NO: 113384 - RNA, 20 nt, Human
aaaaacaguaaugcugaaga

SEQ ID NO: 113385 - RNA, 22 nt, Human
aaaacauuuaggguuuuuuuua

SEQ ID NO: 113386 - RNA, 20 nt, Human
aaaaauguguuuauggagau

SEQ ID NO: 113387 - RNA, 22 nt, Human
aaaaauuucuggugaaaugccu

SEQ ID NO: 113388 - RNA, 22 nt, Human
aaaaacuuaccccagggcaagg

SEQ ID NO: 113389 - RNA, 22 nt, Human
aaaaaguaccacuuggacacuu

SEQ ID NO: 113390 - RNA, 22 nt, Human
aaaaaggagaaagagagggaga

SEQ ID NO: 113391 - RNA, 22 nt, Human
aaaaaauugcuggcagagcugu

SEQ ID NO: 113392 - RNA, 17 nt, Human
uuugugauggcagaugc

SEQ ID NO: 113393 - RNA, 23 nt, Human
gcucauguugcuucuguucuguc

SEQ ID NO: 113394 - RNA, 22 nt, Human
gcuagaaacuguuuaaucucuu

SEQ ID NO: 113395 - RNA, 22 nt, Human
gcuacauuagcuucaauggcua

SEQ ID NO: 113396 - RNA, 22 nt, Human
gcuagauugucacuugaguguc

SEQ ID NO: 113397 - RNA, 22 nt, Human
gcggacaauggaagaugucauu

SEQ ID NO: 113398 - RNA, 22 nt, Human
gcagcuuuggagguggaacucu

SEQ ID NO: 113399 - RNA, 22 nt, Human
gcagauuggguacauaaacagu

SEQ ID NO: 113400 - RNA, 20 nt, Human
gcagcagacagacaggggac

SEQ ID NO: 113401 - RNA, 22 nt, Human
gcagcauuaccaagacauggca

SEQ ID NO: 113402 - RNA, 22 nt, Human
gcagauccaaauauaguucuug

SEQ ID NO: 113403 - RNA, 21 nt, Human
gcagaaagugauuugcuauuc

SEQ ID NO: 113404 - RNA, 22 nt, Human
gauuuuuaaaaguaguuuugaa

SEQ ID NO: 113405 - RNA, 22 nt, Human
gcaaggaagcagaguugcuauc

SEQ ID NO: 113406 - RNA, 22 nt, Human
gauuuucauuauagcuaguuuc

SEQ ID NO: 113407 - RNA, 22 nt, Human
gauuuugaaccuuauuuggaaa

SEQ ID NO: 113408 - RNA, 22 nt, Human
gauuaaaggucuugauuauaag

SEQ ID NO: 113409 - RNA, 22 nt, Human
gauuaagaaagauagaugugga

SEQ ID NO: 113410 - RNA, 22 nt, Human
gauuaagauuacauauuuaagu

SEQ ID NO: 113411 - RNA, 22 nt, Human
gaugugugugcccugggccugc

SEQ ID NO: 113412 - RNA, 22 nt, Human
gauggguuugagauguuugggu

SEQ ID NO: 113413 - RNA, 22 nt, Human
gaugggaaggugguaaaguuua

SEQ ID NO: 113414 - RNA, 21 nt, Human
gaucgcaaugugggaaucaug

SEQ ID NO: 113415 - RNA, 22 nt, Human
gauauuaguuuuggaaggaggg

SEQ ID NO: 113416 - RNA, 16 nt, Human
gccagauugaacuuug

SEQ ID NO: 113417 - RNA, 22 nt, Human
gaguuauuuuuccuguuuuuua

SEQ ID NO: 113418 - RNA, 22 nt, Human
gaguucuagauguauuauuaau

SEQ ID NO: 113419 - RNA, 22 nt, Human
gcauauuuuaaaguguaaccug

SEQ ID NO: 113420 - RNA, 22 nt, Human
gcauaaaggacuauaaggauca

SEQ ID NO: 113421 - RNA, 22 nt, Human
gcauaauauugagaaauuauua

SEQ ID NO: 113422 - RNA, 22 nt, Human
gaguuaaauagcuuaggauuca

SEQ ID NO: 113423 - RNA, 22 nt, Human
gaguguuugcuguauaauugga

SEQ ID NO: 113424 - RNA, 22 nt, Human
gagugguaaaguguacugaaua

SEQ ID NO: 113425 - RNA, 22 nt, Human
gcauccaaggagcagaagugau

SEQ ID NO: 113426 - RNA, 22 nt, Human
gaguggugagaauacaacggaa

SEQ ID NO: 113427 - RNA, 22 nt, Human
gaguauuagaagaguaguuauu

SEQ ID NO: 113428 - RNA, 19 nt, Human
gcaguuccucuuaagagaa

SEQ ID NO: 113429 - RNA, 22 nt, Human
gaguaaaagaugaggcaguaga

SEQ ID NO: 113430 - RNA, 22 nt, Human
gcagguccgagagggucgggua

SEQ ID NO: 113431 - RNA, 22 nt, Human
gaguagcaguucauccacaagc

SEQ ID NO: 113432 - RNA, 19 nt, Human
gaguacuuuacaaguuuuc

SEQ ID NO: 113433 - RNA, 22 nt, Human
gaguaaacagccuucucccagc

SEQ ID NO: 113434 - RNA, 22 nt, Human
gaucugguuccaggacauugca

SEQ ID NO: 113435 - RNA, 22 nt, Human
gaugaaguaguccacuggaagg

SEQ ID NO: 113436 - RNA, 22 nt, Human
gagaauuauacaugagcuauuu

SEQ ID NO: 113437 - RNA, 22 nt, Human
gcaggucacagcugauuggcca

SEQ ID NO: 113438 - RNA, 22 nt, Human
gcuuuguugauggugagucugu

SEQ ID NO: 113439 - RNA, 22 nt, Human
gcuuuguucauuuaguuuuuuu

SEQ ID NO: 113440 - RNA, 22 nt, Human
gcuuuucucccugcuuucuucc

SEQ ID NO: 113441 - RNA, 23 nt, Human
gcuuugaaaaugcuuucuuccag

SEQ ID NO: 113442 - RNA, 22 nt, Human
ggaaaaucaaaccauuuacagu

SEQ ID NO: 113443 - RNA, 22 nt, Human
gcuuuuuaauuugcuucccugg

SEQ ID NO: 113444 - RNA, 22 nt, Human
gcuuuugagaaaguguuuuccc

SEQ ID NO: 113445 - RNA, 22 nt, Human
gcuuucagggucacugucaaca

SEQ ID NO: 113446 - RNA, 22 nt, Human
gcuuucacugcaauagaugaau

SEQ ID NO: 113447 - RNA, 22 nt, Human
gccuaagguucuucagcuauaa

SEQ ID NO: 113448 - RNA, 22 nt, Human
ggaaaggaagggaaggagaugc

SEQ ID NO: 113449 - RNA, 22 nt, Human
ggaacuaagcacauuaucugau

SEQ ID NO: 113450 - RNA, 21 nt, Human
gcuucaauucauccaccucuc

SEQ ID NO: 113451 - RNA, 22 nt, Human
gcuucucauguuuauuuuuaca

SEQ ID NO: 113452 - RNA, 22 nt, Human
gcuuacuguuccuguuggugcu

SEQ ID NO: 113453 - RNA, 22 nt, Human
gcuguugagucagacaaguuuu

SEQ ID NO: 113454 - RNA, 22 nt, Human
gcccugaagagguagagaauuu

SEQ ID NO: 113455 - RNA, 22 nt, Human
gcauuuaaauuugaacuucaga

SEQ ID NO: 113456 - RNA, 22 nt, Human
gcucuugcuuuuucuagaaaga

SEQ ID NO: 113457 - RNA, 22 nt, Human
ggcauugauggggucuugggga

SEQ ID NO: 113458 - RNA, 22 nt, Human
gcucgauugucaguguuaggga

SEQ ID NO: 113459 - RNA, 22 nt, Human
ggcagcagaaccaacuguggcu

SEQ ID NO: 113460 - RNA, 22 nt, Human
ggcagaaaacaauaaccauuuc

SEQ ID NO: 113461 - RNA, 22 nt, Human
gcgucucugggcugacccaggu

SEQ ID NO: 113462 - RNA, 22 nt, Human
ggaguguuagacuaaauuggga

SEQ ID NO: 113463 - RNA, 22 nt, Human
ggaguucaaaucuuuuggaucu

SEQ ID NO: 113464 - RNA, 22 nt, Human
ggaguguaagugacucaccugg

SEQ ID NO: 113465 - RNA, 22 nt, Human
ggagagaacguaaucuaguauu

SEQ ID NO: 113466 - RNA, 22 nt, Human
ggagagcguggaugggcuucca

SEQ ID NO: 113467 - RNA, 22 nt, Human
ggagacuaagaaaauagagucc

SEQ ID NO: 113468 - RNA, 22 nt, Human
ggagcucacuacgaaauaagcu

SEQ ID NO: 113469 - RNA, 22 nt, Human
ggagcucaggaguugauuauuu

SEQ ID NO: 113470 - RNA, 22 nt, Human
ggaauugagcaagggguggggc

SEQ ID NO: 113471 - RNA, 22 nt, Human
ggacauagaucuagacuuuaaa

SEQ ID NO: 113472 - RNA, 22 nt, Human
ggacauuguuguuggauccuug

SEQ ID NO: 113473 - RNA, 22 nt, Human
ggaauuaagaggcuggacaggg

SEQ ID NO: 113474 - RNA, 22 nt, Human
ggaauccugguguuuucugccu

SEQ ID NO: 113475 - RNA, 22 nt, Human
ggaagaggaagaugaggcagca

SEQ ID NO: 113476 - RNA, 22 nt, Human
ggggcuuggguagagcagaaac

SEQ ID NO: 113477 - RNA, 22 nt, Human
ggggcuuggguaagaaugcaaa

SEQ ID NO: 113478 - RNA, 22 nt, Human
gggguuggaugccuuggaaauu

SEQ ID NO: 113479 - RNA, 21 nt, Human
gggguuuuguucuuauaaugu

SEQ ID NO: 113480 - RNA, 22 nt, Human
ggagcuaaggauuuuuauaugu

SEQ ID NO: 113481 - RNA, 22 nt, Human
ggagggcuggacguacuagggc

SEQ ID NO: 113482 - RNA, 22 nt, Human
ggguuccuuggaacacuguuug

SEQ ID NO: 113483 - RNA, 22 nt, Human
ggaugaguuguauauaggauuc

SEQ ID NO: 113484 - RNA, 22 nt, Human
gguggagacucagauuuguugc

SEQ ID NO: 113485 - RNA, 22 nt, Human
ggugaguaguggaaaugaauga

SEQ ID NO: 113486 - RNA, 22 nt, Human
ggugagagaaaagaaacacugu

SEQ ID NO: 113487 - RNA, 22 nt, Human
gguguuaaccagcuaaaguuug

SEQ ID NO: 113488 - RNA, 22 nt, Human
gguaaucuccucauugacguua

SEQ ID NO: 113489 - RNA, 22 nt, Human
ggaauuauuuuaaauagacauu

SEQ ID NO: 113490 - RNA, 21 nt, Human
ggacccuuagauuuuaucuga

SEQ ID NO: 113491 - RNA, 22 nt, Human
ggaaucuucagccaugccaaga

SEQ ID NO: 113492 - RNA, 22 nt, Human
ggaauauaaaucagaugcuccg

SEQ ID NO: 113493 - RNA, 22 nt, Human
ggaauaauauuacagauacagu

SEQ ID NO: 113494 - RNA, 22 nt, Human
ggaauaaaaggagguggcgaga

SEQ ID NO: 113495 - RNA, 22 nt, Human
ggaaguuugagcaucuguuucc

SEQ ID NO: 113496 - RNA, 22 nt, Human
ggaagaagagggagcuguggga

SEQ ID NO: 113497 - RNA, 22 nt, Human
ggaaaaauggguggugauauga

SEQ ID NO: 113498 - RNA, 22 nt, Human
ggaaauguguguaagaaaguau

SEQ ID NO: 113499 - RNA, 22 nt, Human
ggaaauauaagcaguuugugug

SEQ ID NO: 113500 - RNA, 22 nt, Human
gggauacuuuguuucccugcca

SEQ ID NO: 113501 - RNA, 22 nt, Human
gggaauguuaaccuuucuauuu

SEQ ID NO: 113502 - RNA, 22 nt, Human
gggaacgacuguuaguacuugg

SEQ ID NO: 113503 - RNA, 22 nt, Human
gggaacuuggcaggaaaauuau

SEQ ID NO: 113504 - RNA, 22 nt, Human
gggaagaagaaaagagguggga

SEQ ID NO: 113505 - RNA, 22 nt, Human
gggaagaaccucugcuaccaau

SEQ ID NO: 113506 - RNA, 22 nt, Human
gggaaaaaggaguuagagauaa

SEQ ID NO: 113507 - RNA, 22 nt, Human
gcuuagaaucagaccuggguca

SEQ ID NO: 113508 - RNA, 22 nt, Human
gggaaaauguuucugagacaaa

SEQ ID NO: 113509 - RNA, 22 nt, Human
gucuuugagccucaguuuccuc

SEQ ID NO: 113510 - RNA, 22 nt, Human
gucuucuauuuggcaugacaga

SEQ ID NO: 113511 - RNA, 22 nt, Human
gugaaacuggaugugaaaacaa

SEQ ID NO: 113512 - RNA, 22 nt, Human
gugaaauuguacacucaguacc

SEQ ID NO: 113513 - RNA, 22 nt, Human
gggaagaacugauuucacacca

SEQ ID NO: 113514 - RNA, 19 nt, Human
gugauauuuauuauuuauu

SEQ ID NO: 113515 - RNA, 22 nt, Human
ggcuuuuucccuaggguaagag

SEQ ID NO: 113516 - RNA, 22 nt, Human
gggaaaaaggaaccuuauuacu

SEQ ID NO: 113517 - RNA, 22 nt, Human
gggauuuaaugggaaaaauaug

SEQ ID NO: 113518 - RNA, 22 nt, Human
gugcgaaagaagcgacuccagu

SEQ ID NO: 113519 - RNA, 22 nt, Human
gggauggggagcuggaaagggg

SEQ ID NO: 113520 - RNA, 22 nt, Human
gggagggcuuggacccagaugu

SEQ ID NO: 113521 - RNA, 22 nt, Human
gugauuucaaauauagagugag

SEQ ID NO: 113522 - RNA, 19 nt, Human
gggagaaaaucuuuauccu

SEQ ID NO: 113523 - RNA, 22 nt, Human
gggaauuuuaggaugacuccua

SEQ ID NO: 113524 - RNA, 22 nt, Human
gucugaaauaucuuuugucuug

SEQ ID NO: 113525 - RNA, 22 nt, Human
gucuauuuauagacagauccua

SEQ ID NO: 113526 - RNA, 22 nt, Human
gucuauaaccuuuccaauuacc

SEQ ID NO: 113527 - RNA, 23 nt, Human
gucucacaaccaccugagaaaau

SEQ ID NO: 113528 - RNA, 22 nt, Human
gucuccuucauuuacuguuucc

SEQ ID NO: 113529 - RNA, 22 nt, Human
guccuuuuuuuauacccaggcc

SEQ ID NO: 113530 - RNA, 22 nt, Human
gucguagaaccuuuuccaaaca

SEQ ID NO: 113531 - RNA, 22 nt, Human
ggcugcuugggcuguuucuuuu

SEQ ID NO: 113532 - RNA, 22 nt, Human
gucuauucaucauucaucaaac

SEQ ID NO: 113533 - RNA, 22 nt, Human
ggcuccuuguaugauauuuugu

SEQ ID NO: 113534 - RNA, 22 nt, Human
guccccugcguguucauccugg

SEQ ID NO: 113535 - RNA, 22 nt, Human
ggcuauuguuuuaaaaaaugag

SEQ ID NO: 113536 - RNA, 22 nt, Human
gucacuuugcuugcgaugcucc

SEQ ID NO: 113537 - RNA, 22 nt, Human
gucacucuuuuucagcuagcuc

SEQ ID NO: 113538 - RNA, 22 nt, Human
gucaaugcuuaguuugccugaa

SEQ ID NO: 113539 - RNA, 22 nt, Human
guauugauuguuuuaaaagauu

SEQ ID NO: 113540 - RNA, 22 nt, Human
gguuucuuuccucucugugccu

SEQ ID NO: 113541 - RNA, 22 nt, Human
gguuuauucccacaaaggaagu

SEQ ID NO: 113542 - RNA, 22 nt, Human
gguuuguggagcuggaaacacu

SEQ ID NO: 113543 - RNA, 22 nt, Human
guauaaauaucuauauuguuac

SEQ ID NO: 113544 - RNA, 22 nt, Human
gguuuucagaaugcaguccugu

SEQ ID NO: 113545 - RNA, 21 nt, Human
guaucuuucuuuuaaaauauc

SEQ ID NO: 113546 - RNA, 22 nt, Human
guaucugaaaaagaauucugac

SEQ ID NO: 113547 - RNA, 22 nt, Human
guauauuuaugagcauuagccu

SEQ ID NO: 113548 - RNA, 22 nt, Human
guuguuuuuguuaaaacaguga

SEQ ID NO: 113549 - RNA, 22 nt, Human
ggucugcaaugauuugaaaaac

SEQ ID NO: 113550 - RNA, 22 nt, Human
guuuauucuuuuauuugugaga

SEQ ID NO: 113551 - RNA, 22 nt, Human
guuuauuucuuaucaucacuau

SEQ ID NO: 113552 - RNA, 22 nt, Human
guuuaucagagagcagaggugg

SEQ ID NO: 113553 - RNA, 22 nt, Human
guuuacaacaucuuguccuuca

SEQ ID NO: 113554 - RNA, 22 nt, Human
guuuaaguuaaaauuuaccugc

SEQ ID NO: 113555 - RNA, 22 nt, Human
guuuccuuuugugguuuuucua

SEQ ID NO: 113556 - RNA, 22 nt, Human
guuuccaagucucucaacaccc

SEQ ID NO: 113557 - RNA, 22 nt, Human
guuggugagaguuagggauuua

SEQ ID NO: 113558 - RNA, 22 nt, Human
guuguuaagugcugguuguuag

SEQ ID NO: 113559 - RNA, 22 nt, Human
guugggugccagaggcuucacg

SEQ ID NO: 113560 - RNA, 22 nt, Human
guuggcgaaggaccuggaggag

SEQ ID NO: 113561 - RNA, 22 nt, Human
guuggaggaaggacaggaacag

SEQ ID NO: 113562 - RNA, 22 nt, Human
gguuuucacgauccucccuuuu

SEQ ID NO: 113563 - RNA, 22 nt, Human
gguuuuccaguagaucagaaga

SEQ ID NO: 113564 - RNA, 22 nt, Human
gguuugggaagaacuauucccu

SEQ ID NO: 113565 - RNA, 22 nt, Human
uaaaguauucaaguagcuuucu

SEQ ID NO: 113566 - RNA, 22 nt, Human
uaaaggaguguauaauuguagu

SEQ ID NO: 113567 - RNA, 22 nt, Human
uaaaauaccacauauggugcuc

SEQ ID NO: 113568 - RNA, 22 nt, Human
uaaaccuuauuugaauaccaac

SEQ ID NO: 113569 - RNA, 22 nt, Human
uaaaguguacaagucauaagua

SEQ ID NO: 113570 - RNA, 22 nt, Human
uaaaugaaaggguuuaauuuau

SEQ ID NO: 113571 - RNA, 22 nt, Human
guaaaucccucucuuuguagau

SEQ ID NO: 113572 - RNA, 22 nt, Human
guaaauuaugucugggucaguu

SEQ ID NO: 113573 - RNA, 22 nt, Human
guacaaagucaaggugaaaaua

SEQ ID NO: 113574 - RNA, 22 nt, Human
guacuaguuaaaaauagaauua

SEQ ID NO: 113575 - RNA, 22 nt, Human
uaaaaauuagauauguauuuag

SEQ ID NO: 113576 - RNA, 22 nt, Human
uaaaaaccuuguauuuaacucu

SEQ ID NO: 113577 - RNA, 21 nt, Human
uaaaagaugacaagacagcuc

SEQ ID NO: 113578 - RNA, 22 nt, Human
uaaaaccauucauugaccuaug

SEQ ID NO: 113579 - RNA, 22 nt, Human
gguguguaggugaaggccaaga

SEQ ID NO: 113580 - RNA, 22 nt, Human
gguguaaggaagauggaagaug

SEQ ID NO: 113581 - RNA, 22 nt, Human
guuuguuugccagcuuaguaaa

SEQ ID NO: 113582 - RNA, 22 nt, Human
gguggggugagggggcgaggcc

SEQ ID NO: 113583 - RNA, 22 nt, Human
uacuuuaauugcaaaaauaaau

SEQ ID NO: 113584 - RNA, 22 nt, Human
uacuuuuuucacuucuagcccc

SEQ ID NO: 113585 - RNA, 22 nt, Human
uacuuugucauucuaaccuucc

SEQ ID NO: 113586 - RNA, 23 nt, Human
uacuuuggcuagaguugucucuu

SEQ ID NO: 113587 - RNA, 20 nt, Human
gugaaguuuucugaagacag

SEQ ID NO: 113588 - RNA, 22 nt, Human
uacuaaacugcauuucuaucua

SEQ ID NO: 113589 - RNA, 22 nt, Human
uacuucuuuuguaaaguauuga

SEQ ID NO: 113590 - RNA, 22 nt, Human
uaccaauuaaauagccaaucua

SEQ ID NO: 113591 - RNA, 22 nt, Human
uacauggauguuauccuuacug

SEQ ID NO: 113592 - RNA, 22 nt, Human
gucuuucuuuuacauauuugug

SEQ ID NO: 113593 - RNA, 22 nt, Human
gugaaaaauggccaucaggaca

SEQ ID NO: 113594 - RNA, 22 nt, Human
gugaaaauaguaaccuggcuag

SEQ ID NO: 113595 - RNA, 22 nt, Human
uacaaagugauuuuggaauuga

SEQ ID NO: 113596 - RNA, 22 nt, Human
uacaaaauucaaauaauguuug

SEQ ID NO: 113597 - RNA, 22 nt, Human
gucguucugcuauucuaugagg

SEQ ID NO: 113598 - RNA, 22 nt, Human
uaauaucuuuacacauuuucaa

SEQ ID NO: 113599 - RNA, 22 nt, Human
uaauccaaaacugaaucugugg

SEQ ID NO: 113600 - RNA, 22 nt, Human
uaauauaacugccaguuaaggu

SEQ ID NO: 113601 - RNA, 22 nt, Human
guccuguaagauacaaguuuaa

SEQ ID NO: 113602 - RNA, 22 nt, Human
guccugauggccauuuuucacu

SEQ ID NO: 113603 - RNA, 22 nt, Human
uaauugaacguucauuuuuaau

SEQ ID NO: 113604 - RNA, 22 nt, Human
uaauuuagugcauuuccuagua

SEQ ID NO: 113605 - RNA, 22 nt, Human
uaagacuuuaccaggcucaaau

SEQ ID NO: 113606 - RNA, 19 nt, Human
uaagaaucaccaggggugu

SEQ ID NO: 113607 - RNA, 22 nt, Human
uaagaccuuuuugaaaucacug

SEQ ID NO: 113608 - RNA, 22 nt, Human
uaagaaaggggaaguuccucuu

SEQ ID NO: 113609 - RNA, 22 nt, Human
uaacacauagauauuuuaacuu

SEQ ID NO: 113610 - RNA, 22 nt, Human
uaagaauguuuguugaguaaau

SEQ ID NO: 113611 - RNA, 21 nt, Human
uaagaacauuaucuucuuccu

SEQ ID NO: 113612 - RNA, 22 nt, Human
guagaacucuuuccugcguggg

SEQ ID NO: 113613 - RNA, 22 nt, Human
guacuuccauccacauauaugu

SEQ ID NO: 113614 - RNA, 22 nt, Human
guaugaguggauagauguaucu

SEQ ID NO: 113615 - RNA, 22 nt, Human
guagaucaugaaaauucacugc

SEQ ID NO: 113616 - RNA, 22 nt, Human
guagagagugucuuccagaaau

SEQ ID NO: 113617 - RNA, 22 nt, Human
uaagucaagagcuagaaaaagc

SEQ ID NO: 113618 - RNA, 22 nt, Human
uaagauuuuuacaaauagagug

SEQ ID NO: 113619 - RNA, 22 nt, Human
uaaggagagaauuuagagguuu

SEQ ID NO: 113620 - RNA, 22 nt, Human
guauuugacaccagugaauggu

SEQ ID NO: 113621 - RNA, 22 nt, Human
ucaacauguuuuuuaaaagaaa

SEQ ID NO: 113622 - RNA, 22 nt, Human
ucaaaucuuuuuuccuucccug

SEQ ID NO: 113623 - RNA, 22 nt, Human
ucaaagaucuuugcuuuugggg

SEQ ID NO: 113624 - RNA, 22 nt, Human
guugggguuucaguggcaguca

SEQ ID NO: 113625 - RNA, 22 nt, Human
ucaagaagauaaugucuagggu

SEQ ID NO: 113626 - RNA, 22 nt, Human
uauuuuuguuuaccaguuaaca

SEQ ID NO: 113627 - RNA, 22 nt, Human
uauuuuucacagauuggugcuu

SEQ ID NO: 113628 - RNA, 22 nt, Human
uauuuuauuuagguuuaguugu

SEQ ID NO: 113629 - RNA, 22 nt, Human
guuggaaauaucagucacguga

SEQ ID NO: 113630 - RNA, 22 nt, Human
guugggaauucggagagaaaua

SEQ ID NO: 113631 - RNA, 22 nt, Human
uauuuccugcguuucugugagc

SEQ ID NO: 113632 - RNA, 22 nt, Human
guucuccaggggcuguucaucu

SEQ ID NO: 113633 - RNA, 22 nt, Human
uauuuguuuuuaaugcugggug

SEQ ID NO: 113634 - RNA, 22 nt, Human
guucuuagguacucauauuuaa

SEQ ID NO: 113635 - RNA, 22 nt, Human
guucuucucuuguaauggaauc

SEQ ID NO: 113636 - RNA, 22 nt, Human
guucggcuuccuaugucaugag

SEQ ID NO: 113637 - RNA, 22 nt, Human
guucaaucucucaugcauuuuc

SEQ ID NO: 113638 - RNA, 17 nt, Human
guucucaaacugacuga

SEQ ID NO: 113639 - RNA, 23 nt, Human
guguuguugauuuucgaaucuuu

SEQ ID NO: 113640 - RNA, 22 nt, Human
guuaaaaugauuugugauuuau

SEQ ID NO: 113641 - RNA, 22 nt, Human
guguuuugagaggaugguuuua

SEQ ID NO: 113642 - RNA, 22 nt, Human
uauguggcaggugggagaucag

SEQ ID NO: 113643 - RNA, 22 nt, Human
guuaguucccaccccuguaaga

SEQ ID NO: 113644 - RNA, 22 nt, Human
guuaauaugcaaaacggaugcg

SEQ ID NO: 113645 - RNA, 22 nt, Human
guuacagagcugcuaugugugc

SEQ ID NO: 113646 - RNA, 22 nt, Human
gugguuugcugguguacguuua

SEQ ID NO: 113647 - RNA, 22 nt, Human
guggugggcgugguguaugccu

SEQ ID NO: 113648 - RNA, 22 nt, Human
guggguuggguuuuugaaggga

SEQ ID NO: 113649 - RNA, 22 nt, Human
uaggcuuuguuacuuucccuuu

SEQ ID NO: 113650 - RNA, 22 nt, Human
uagguuuugugucagaguagaa

SEQ ID NO: 113651 - RNA, 22 nt, Human
uaguacuugauuuuaaauguua

SEQ ID NO: 113652 - RNA, 22 nt, Human
uaguagcuguuguuuuuuaaac

SEQ ID NO: 113653 - RNA, 22 nt, Human
gugggauaaccugagauaacau

SEQ ID NO: 113654 - RNA, 22 nt, Human
gugggaguggagcucagcaugu

SEQ ID NO: 113655 - RNA, 22 nt, Human
gugggcacguccuacugucacu

SEQ ID NO: 113656 - RNA, 22 nt, Human
uagugggauuuugaacaaaacc

SEQ ID NO: 113657 - RNA, 22 nt, Human
uaguauuuguaauuaucaaagc

SEQ ID NO: 113658 - RNA, 22 nt, Human
guggagauauuugugauagggg

SEQ ID NO: 113659 - RNA, 22 nt, Human
guggauuguaccacgaaaagug

SEQ ID NO: 113660 - RNA, 22 nt, Human
guggauuucaggcuccccucag

SEQ ID NO: 113661 - RNA, 22 nt, Human
gugcuguuagcgguuuauaaca

SEQ ID NO: 113662 - RNA, 21 nt, Human
uagaagagggaauuugucuuu

SEQ ID NO: 113663 - RNA, 22 nt, Human
uagaagaugccuuaaaguugaa

SEQ ID NO: 113664 - RNA, 22 nt, Human
uagaacaaacagcauguuugau

SEQ ID NO: 113665 - RNA, 22 nt, Human
uagaacugcucucauacuugcu

SEQ ID NO: 113666 - RNA, 22 nt, Human
uagaacuguaaauuaucucucc

SEQ ID NO: 113667 - RNA, 22 nt, Human
uagcucuuaccagugaaguuug

SEQ ID NO: 113668 - RNA, 22 nt, Human
uaacauuagcuuugcucaugca

SEQ ID NO: 113669 - RNA, 22 nt, Human
uaacauuucggugacaguggga

SEQ ID NO: 113670 - RNA, 22 nt, Human
uaacuugaauacauucuuuuca

SEQ ID NO: 113671 - RNA, 22 nt, Human
uaacgcaucuggaaacaggaca

SEQ ID NO: 113672 - RNA, 22 nt, Human
ucagugguuaaguucuguccac

SEQ ID NO: 113673 - RNA, 22 nt, Human
uaacuuuucuguucaauuuucc

SEQ ID NO: 113674 - RNA, 22 nt, Human
uaaauguacugaggcaacagga

SEQ ID NO: 113675 - RNA, 22 nt, Human
uaaaugcucuuuaaaagugcuu

SEQ ID NO: 113676 - RNA, 22 nt, Human
uaaauguugcuugugcugcuca

SEQ ID NO: 113677 - RNA, 22 nt, Human
uaaauuagauucccagcgcuau

SEQ ID NO: 113678 - RNA, 22 nt, Human
uaaauuccuagucacaaacuuc

SEQ ID NO: 113679 - RNA, 22 nt, Human
uaaauuugugaauuagcuauca

SEQ ID NO: 113680 - RNA, 22 nt, Human
ucagucauguuuaccagacgua

SEQ ID NO: 113681 - RNA, 23 nt, Human
uaaauuuuauucugauaacacag

SEQ ID NO: 113682 - RNA, 22 nt, Human
ucagucugcuauagguauuugu

SEQ ID NO: 113683 - RNA, 22 nt, Human
uaaaggaccuguacuagguuua

SEQ ID NO: 113684 - RNA, 22 nt, Human
ucaagcuggaaaugaagaaucu

SEQ ID NO: 113685 - RNA, 22 nt, Human
uaaaugagcaccucuaguuuug

SEQ ID NO: 113686 - RNA, 22 nt, Human
uaaaugaaaugaagugaaagcu

SEQ ID NO: 113687 - RNA, 22 nt, Human
uaaauaugcaugugguauucau

SEQ ID NO: 113688 - RNA, 19 nt, Human
uccaaaauacuuguuacug

SEQ ID NO: 113689 - RNA, 22 nt, Human
uccaaauagcuggaugauggug

SEQ ID NO: 113690 - RNA, 21 nt, Human
uccaaaggagacugagugugu

SEQ ID NO: 113691 - RNA, 17 nt, Human
ucauuucaguaaaucca

SEQ ID NO: 113692 - RNA, 22 nt, Human
ucauuuguauucuacaaagcac

SEQ ID NO: 113693 - RNA, 22 nt, Human
ucauuuuaucaggaauggaauc

SEQ ID NO: 113694 - RNA, 17 nt, Human
ucauuuauccucuuugg

SEQ ID NO: 113695 - RNA, 22 nt, Human
ucauuuaucgcugccuuuuaaa

SEQ ID NO: 113696 - RNA, 22 nt, Human
ucauuguuuacugucuuuuuuc

SEQ ID NO: 113697 - RNA, 22 nt, Human
uaauuuugucacagugacaugc

SEQ ID NO: 113698 - RNA, 22 nt, Human
uaauuugauuucucccuggaaa

SEQ ID NO: 113699 - RNA, 22 nt, Human
uaauuucauuuugcaaugaucu

SEQ ID NO: 113700 - RNA, 22 nt, Human
uaauauccaguuauuucccuca

SEQ ID NO: 113701 - RNA, 22 nt, Human
ucauuauuuugauguauuuccu

SEQ ID NO: 113702 - RNA, 22 nt, Human
uaauauauuuuuuaagggaugu

SEQ ID NO: 113703 - RNA, 22 nt, Human
uaauaguugaaggucaucacua

SEQ ID NO: 113704 - RNA, 21 nt, Human
uaaggaagagcauuuuagguc

SEQ ID NO: 113705 - RNA, 22 nt, Human
ucauuagauuccugugguggau

SEQ ID NO: 113706 - RNA, 22 nt, Human
uaaguauguuagaaaaucaagu

SEQ ID NO: 113707 - RNA, 22 nt, Human
ucauaaaaucaguguccauugu

SEQ ID NO: 113708 - RNA, 22 nt, Human
ucaguuuaucuagcugggggaa

SEQ ID NO: 113709 - RNA, 22 nt, Human
ucaucuauaaguagcaucuggg

SEQ ID NO: 113710 - RNA, 22 nt, Human
ucauacuuuuuugacccuugug

SEQ ID NO: 113711 - RNA, 22 nt, Human
uccuucuguuguuuauuuuaaa

SEQ ID NO: 113712 - RNA, 22 nt, Human
uccuucuuuucgccggaguuga

SEQ ID NO: 113713 - RNA, 22 nt, Human
uccugguaaagaguaucagauu

SEQ ID NO: 113714 - RNA, 22 nt, Human
uagcaggagagaaguuuuaagu

SEQ ID NO: 113715 - RNA, 22 nt, Human
uagcagaacaauagucaaugau

SEQ ID NO: 113716 - RNA, 22 nt, Human
uagauccaagguuggauugggg

SEQ ID NO: 113717 - RNA, 19 nt, Human
uagauuagagcauaggguu

SEQ ID NO: 113718 - RNA, 22 nt, Human
uccuccauguugugcacuugaa

SEQ ID NO: 113719 - RNA, 22 nt, Human
uagaagagcaugucaaacuaua

SEQ ID NO: 113720 - RNA, 22 nt, Human
ucccuuuuuccugaucugugaa

SEQ ID NO: 113721 - RNA, 22 nt, Human
ucccuuuuuaauugugucccug

SEQ ID NO: 113722 - RNA, 22 nt, Human
uagaaauaaacacugcuaccuu

SEQ ID NO: 113723 - RNA, 22 nt, Human
uagaagaacaugucaaacuaua

SEQ ID NO: 113724 - RNA, 22 nt, Human
ucccuucccaccccugccuuuu

SEQ ID NO: 113725 - RNA, 23 nt, Human
ucccuguuucagggccagaacug

SEQ ID NO: 113726 - RNA, 21 nt, Human
uccuaaaggaaauacucaauu

SEQ ID NO: 113727 - RNA, 22 nt, Human
uagaguauuuguuuacuaaguu

SEQ ID NO: 113728 - RNA, 22 nt, Human
uacuuuggugaaauuggaaaua

SEQ ID NO: 113729 - RNA, 22 nt, Human
ucccugagcucacauggcagga

SEQ ID NO: 113730 - RNA, 22 nt, Human
uacugaguuucacugucugugc

SEQ ID NO: 113731 - RNA, 22 nt, Human
uacugaauuacugcugguaaau

SEQ ID NO: 113732 - RNA, 22 nt, Human
uccauguugauaaucuugugaa

SEQ ID NO: 113733 - RNA, 22 nt, Human
uacuugaaaugggcaucaagag

SEQ ID NO: 113734 - RNA, 22 nt, Human
uacuugaacaucacuaagagaa

SEQ ID NO: 113735 - RNA, 22 nt, Human
uacuugcaaggcucuuggaaua

SEQ ID NO: 113736 - RNA, 22 nt, Human
uacuuccuucugcccccucuga

SEQ ID NO: 113737 - RNA, 22 nt, Human
ucccccuugucguuugagguuu

SEQ ID NO: 113738 - RNA, 22 nt, Human
uacguuuuauaucuuuuggaau

SEQ ID NO: 113739 - RNA, 22 nt, Human
uacuaaagaaugaguuaaguuu

SEQ ID NO: 113740 - RNA, 22 nt, Human
uccaucuacgagauuuuccaga

SEQ ID NO: 113741 - RNA, 22 nt, Human
uccaugaguuuuuuaguuucac

SEQ ID NO: 113742 - RNA, 22 nt, Human
uacaguauuuuuuaagaaaaaa

SEQ ID NO: 113743 - RNA, 22 nt, Human
uaugaucuuaggauggaacuuc

SEQ ID NO: 113744 - RNA, 22 nt, Human
uaugccuaccuccaaaauauau

SEQ ID NO: 113745 - RNA, 22 nt, Human
uaugccaaaaauaaguuuuaug

SEQ ID NO: 113746 - RNA, 22 nt, Human
uaugcaucaguaugguuggaaa

SEQ ID NO: 113747 - RNA, 19 nt, Human
uaugaaguugauaaaaguu

SEQ ID NO: 113748 - RNA, 22 nt, Human
ucugaugaccacaugugggacu

SEQ ID NO: 113749 - RNA, 22 nt, Human
uaugaguauagugcaccauggu

SEQ ID NO: 113750 - RNA, 22 nt, Human
ucugaguuaaaauuccagaggu

SEQ ID NO: 113751 - RNA, 22 nt, Human
uauguauaacuugauaggauga

SEQ ID NO: 113752 - RNA, 22 nt, Human
uaugugaaauggaauauagaaa

SEQ ID NO: 113753 - RNA, 22 nt, Human
uauguauguauguauguauaug

SEQ ID NO: 113754 - RNA, 22 nt, Human
uauguauauaaaugugugugug

SEQ ID NO: 113755 - RNA, 22 nt, Human
uaugguuucuccugcagauuug

SEQ ID NO: 113756 - RNA, 22 nt, Human
ucuggaaauggaaguaacuaug

SEQ ID NO: 113757 - RNA, 22 nt, Human
uauuauggguuuuuguguaaau

SEQ ID NO: 113758 - RNA, 22 nt, Human
uauucagugcugguucuuuuuc

SEQ ID NO: 113759 - RNA, 22 nt, Human
uauucauuuuuauuugugacug

SEQ ID NO: 113760 - RNA, 22 nt, Human
ucuguuuuccaggaaucucaua

SEQ ID NO: 113761 - RNA, 22 nt, Human
ucuucacugaagcuuugcaucu

SEQ ID NO: 113762 - RNA, 22 nt, Human
ucuucagacuguuguucuuuug

SEQ ID NO: 113763 - RNA, 22 nt, Human
ucuuauucuuuuaaacaacgca

SEQ ID NO: 113764 - RNA, 22 nt, Human
ucuuauugguaaugauggcauu

SEQ ID NO: 113765 - RNA, 22 nt, Human
ucuuauuucuuucuuuuccugu

SEQ ID NO: 113766 - RNA, 22 nt, Human
ucuguuucaggggucuggaaug

SEQ ID NO: 113767 - RNA, 22 nt, Human
ucuguuuuuaucuauucuguua

SEQ ID NO: 113768 - RNA, 22 nt, Human
ucuguuuuucagaccuuuuugg

SEQ ID NO: 113769 - RNA, 22 nt, Human
ucuuagacagagaagacuauug

SEQ ID NO: 113770 - RNA, 22 nt, Human
uauuaauugugguuauuguauu

SEQ ID NO: 113771 - RNA, 22 nt, Human
uauguuuugcaaauaucaaaca

SEQ ID NO: 113772 - RNA, 22 nt, Human
ucuguaaaugcaaguuuuccuc

SEQ ID NO: 113773 - RNA, 22 nt, Human
ucuggguuuccuucacaagcac

SEQ ID NO: 113774 - RNA, 22 nt, Human
ucuggucugccgagauccauuu

SEQ ID NO: 113775 - RNA, 22 nt, Human
uauguuaaauguuugauguuua

SEQ ID NO: 113776 - RNA, 22 nt, Human
uaugaaagguuuuuucuugaaa

SEQ ID NO: 113777 - RNA, 22 nt, Human
ucugaguagaaucauucauaaa

SEQ ID NO: 113778 - RNA, 22 nt, Human
uaucuuugccuuggguuuuguu

SEQ ID NO: 113779 - RNA, 22 nt, Human
uaucuguauuguagaacuguug

SEQ ID NO: 113780 - RNA, 22 nt, Human
uauccaucuucuuugagaaugg

SEQ ID NO: 113781 - RNA, 22 nt, Human
uauccauaccuucaaguuugcu

SEQ ID NO: 113782 - RNA, 22 nt, Human
uaucuagguacacaucuccucu

SEQ ID NO: 113783 - RNA, 22 nt, Human
ucugaaauuuuaguuauagaaa

SEQ ID NO: 113784 - RNA, 22 nt, Human
ucugaauauguuuaucaucucu

SEQ ID NO: 113785 - RNA, 22 nt, Human
uauauacacgcacauauacaua

SEQ ID NO: 113786 - RNA, 22 nt, Human
uauauacuugaaaauugcugag

SEQ ID NO: 113787 - RNA, 22 nt, Human
uauauaauacacaaauauguac

SEQ ID NO: 113788 - RNA, 22 nt, Human
ucuccuuuacuggcuccuuuug

SEQ ID NO: 113789 - RNA, 22 nt, Human
uauaggugagugaagcucagga

SEQ ID NO: 113790 - RNA, 22 nt, Human
uauauauacauauagaauaugu

SEQ ID NO: 113791 - RNA, 22 nt, Human
uauauauaugcaccacaugugu

SEQ ID NO: 113792 - RNA, 22 nt, Human
ucucucguuuuuugcagauaaa

SEQ ID NO: 113793 - RNA, 22 nt, Human
ucucucucucuuccagcauguu

SEQ ID NO: 113794 - RNA, 20 nt, Human
ucucucacccuugcugugca

SEQ ID NO: 113795 - RNA, 22 nt, Human
uauagucuuaaguaguagacuc

SEQ ID NO: 113796 - RNA, 22 nt, Human
uaucauuuuacugugacauuuu

SEQ ID NO: 113797 - RNA, 22 nt, Human
uauccaaaggaacaaucacagc

SEQ ID NO: 113798 - RNA, 22 nt, Human
uauauuuguccuagcuccuagc

SEQ ID NO: 113799 - RNA, 22 nt, Human
uaguuuuaagcugacauuguuc

SEQ ID NO: 113800 - RNA, 22 nt, Human
uaguuuucaagugaguuggaag

SEQ ID NO: 113801 - RNA, 22 nt, Human
ucucauaauuguuucccagcua

SEQ ID NO: 113802 - RNA, 23 nt, Human
uaguuucaucuccacccugcccu

SEQ ID NO: 113803 - RNA, 22 nt, Human
uaguuucuaauguugaaauuau

SEQ ID NO: 113804 - RNA, 21 nt, Human
ucucauuuuaacacagaguug

SEQ ID NO: 113805 - RNA, 22 nt, Human
uauaaagaccuuauccuucaua

SEQ ID NO: 113806 - RNA, 22 nt, Human
uauacauauacaaaugcacaua

SEQ ID NO: 113807 - RNA, 22 nt, Human
uauaaucuugcccauaguauuu

SEQ ID NO: 113808 - RNA, 22 nt, Human
uauaagaaaagucauuaucaaa

SEQ ID NO: 113809 - RNA, 22 nt, Human
ucgauccaggaaggcugguuua

SEQ ID NO: 113810 - RNA, 22 nt, Human
uaggaaugcagaugcauaauaa

SEQ ID NO: 113811 - RNA, 21 nt, Human
uaggaacuguucugagugguc

SEQ ID NO: 113812 - RNA, 22 nt, Human
uaguguguggucucucccuugu

SEQ ID NO: 113813 - RNA, 22 nt, Human
uaggauaacaauuuguaguuuc

SEQ ID NO: 113814 - RNA, 22 nt, Human
uaggauauuuuagaaugguaca

SEQ ID NO: 113815 - RNA, 20 nt, Human
ucuaggacaggcaaaguaca

SEQ ID NO: 113816 - RNA, 22 nt, Human
ucuauuguuauccuuuccauuu

SEQ ID NO: 113817 - RNA, 22 nt, Human
uaguucugaauagcauugaaga

SEQ ID NO: 113818 - RNA, 22 nt, Human
uaguuccucuucucagggccau

SEQ ID NO: 113819 - RNA, 22 nt, Human
ucucaaagagcuacuggucuau

SEQ ID NO: 113820 - RNA, 22 nt, Human
ugauugauaaugaagacaguca

SEQ ID NO: 113821 - RNA, 22 nt, Human
ugauuccugugcuuauuccagu

SEQ ID NO: 113822 - RNA, 22 nt, Human
ugauucuuugaccaaaaaauug

SEQ ID NO: 113823 - RNA, 22 nt, Human
ugauucaguacuuucucuaacu

SEQ ID NO: 113824 - RNA, 22 nt, Human
ugauucacgcuucucuuuaaac

SEQ ID NO: 113825 - RNA, 22 nt, Human
uccaaggcuggaucuuuucuuu

SEQ ID NO: 113826 - RNA, 22 nt, Human
ugauuagauacuucagaugaca

SEQ ID NO: 113827 - RNA, 22 nt, Human
ugauaugguaauaagauauucu

SEQ ID NO: 113828 - RNA, 22 nt, Human
ugaucaguacuguaugagggau

SEQ ID NO: 113829 - RNA, 22 nt, Human
ugaugaugaagaaauauuauca

SEQ ID NO: 113830 - RNA, 22 nt, Human
ucauuugggauuuuuuauaauu

SEQ ID NO: 113831 - RNA, 22 nt, Human
ugauguaaaauaggaaguucua

SEQ ID NO: 113832 - RNA, 22 nt, Human
ucaugcagauaagaauaaguaa

SEQ ID NO: 113833 - RNA, 22 nt, Human
ucaucccuuccugcacuauuag

SEQ ID NO: 113834 - RNA, 22 nt, Human
ucauaaaggugccacucaguuu

SEQ ID NO: 113835 - RNA, 22 nt, Human
ucauaaguuguugacuagcaaa

SEQ ID NO: 113836 - RNA, 22 nt, Human
ucauaagucucauauaugucca

SEQ ID NO: 113837 - RNA, 22 nt, Human
ugaggaaugugacaaaaccaag

SEQ ID NO: 113838 - RNA, 22 nt, Human
ucaguugagguggucuauugcg

SEQ ID NO: 113839 - RNA, 22 nt, Human
ucaguuuaauuggaucuuuuuc

SEQ ID NO: 113840 - RNA, 22 nt, Human
ugagauucuguucagaaaaaug

SEQ ID NO: 113841 - RNA, 21 nt, Human
ugagagucuguguauuuuuag

SEQ ID NO: 113842 - RNA, 22 nt, Human
ugagcaaacacagauaggcuua

SEQ ID NO: 113843 - RNA, 22 nt, Human
ucagguagugguuaaguucugu

SEQ ID NO: 113844 - RNA, 20 nt, Human
ucaggguuucccauucuugg

SEQ ID NO: 113845 - RNA, 22 nt, Human
ugagaauuuaacuugauuagga

SEQ ID NO: 113846 - RNA, 22 nt, Human
ugagaacacuuuucucuuugcu

SEQ ID NO: 113847 - RNA, 22 nt, Human
ucuucauuucuggggaauuggc

SEQ ID NO: 113848 - RNA, 22 nt, Human
ucuuccaaacaaaaaucugugu

SEQ ID NO: 113849 - RNA, 22 nt, Human
ucaguauuagugcauuaucagg

SEQ ID NO: 113850 - RNA, 22 nt, Human
ucaguaagauugauauuucccc

SEQ ID NO: 113851 - RNA, 22 nt, Human
ugagaccuaaaccgucuguccu

SEQ ID NO: 113852 - RNA, 22 nt, Human
ugagacagaccuuggaccaugu

SEQ ID NO: 113853 - RNA, 22 nt, Human
ugagaagucagucuauugugaa

SEQ ID NO: 113854 - RNA, 22 nt, Human
ugagagaggugaaaugacuuuc

SEQ ID NO: 113855 - RNA, 22 nt, Human
ugauuuagguauuuucuuuugu

SEQ ID NO: 113856 - RNA, 22 nt, Human
ucccaauuuacuagaugaauga

SEQ ID NO: 113857 - RNA, 23 nt, Human
ucccacauuucacagcacuuucc

SEQ ID NO: 113858 - RNA, 22 nt, Human
ugcacacaguucucaggaaaga

SEQ ID NO: 113859 - RNA, 22 nt, Human
ugcaggagaaaguacggagcgu

SEQ ID NO: 113860 - RNA, 22 nt, Human
uccgacacacgugcucgcagcg

SEQ ID NO: 113861 - RNA, 22 nt, Human
ugcaggaacucgaaaacuauag

SEQ ID NO: 113862 - RNA, 22 nt, Human
ucccugagagacuucuuuggcu

SEQ ID NO: 113863 - RNA, 22 nt, Human
ugcauuuugaaggaaaaaaaug

SEQ ID NO: 113864 - RNA, 22 nt, Human
ugcauuuuuaauuuggaaaaaa

SEQ ID NO: 113865 - RNA, 22 nt, Human
ugcaucuaaguggcuaacaacc

SEQ ID NO: 113866 - RNA, 19 nt, Human
uccuacaugagacagagag

SEQ ID NO: 113867 - RNA, 22 nt, Human
ucuagagaauuuggaaauuaag

SEQ ID NO: 113868 - RNA, 21 nt, Human
ucuauccuggcuuuccacuug

SEQ ID NO: 113869 - RNA, 22 nt, Human
ucuauauucuauguucuucuuu

SEQ ID NO: 113870 - RNA, 22 nt, Human
ucgcuauuauuuuagguucuca

SEQ ID NO: 113871 - RNA, 22 nt, Human
ugcggaaggcagcgcagggugg

SEQ ID NO: 113872 - RNA, 22 nt, Human
ucuauuauauuuacacgagagu

SEQ ID NO: 113873 - RNA, 22 nt, Human
ucucaaacuauauaugggguuc

SEQ ID NO: 113874 - RNA, 22 nt, Human
ucucaaagguuuuccucuuuuu

SEQ ID NO: 113875 - RNA, 22 nt, Human
ucucagaagaaacaucugcugg

SEQ ID NO: 113876 - RNA, 22 nt, Human
ugcugcggauauacaggaucug

SEQ ID NO: 113877 - RNA, 22 nt, Human
ugcuuaaagcauuucucuuuaa

SEQ ID NO: 113878 - RNA, 22 nt, Human
ucuccaggggcagggucuggag

SEQ ID NO: 113879 - RNA, 20 nt, Human
ucucauuuugauuucgcauu

SEQ ID NO: 113880 - RNA, 21 nt, Human
ucucauacauaguaggaacca

SEQ ID NO: 113881 - RNA, 22 nt, Human
ucucagaaaugacaggagguac

SEQ ID NO: 113882 - RNA, 22 nt, Human
ucucauacguuuccagguguca

SEQ ID NO: 113883 - RNA, 22 nt, Human
uggaaaacgcaguuuaauuuuu

SEQ ID NO: 113884 - RNA, 22 nt, Human
ucugagucgcucccuggaucca

SEQ ID NO: 113885 - RNA, 22 nt, Human
ucugacuucuuuuauuaucauu

SEQ ID NO: 113886 - RNA, 22 nt, Human
ucucuuuuuuuaaaacucuaug

SEQ ID NO: 113887 - RNA, 22 nt, Human
ugcuuuggcccaacauugaugc

SEQ ID NO: 113888 - RNA, 18 nt, Human
ucugaaggaaugauucca

SEQ ID NO: 113889 - RNA, 22 nt, Human
ucugaagagaacucuuaguguu

SEQ ID NO: 113890 - RNA, 20 nt, Human
ucucuuuuucuucuuuucuc

SEQ ID NO: 113891 - RNA, 22 nt, Human
ucucuucacuuguaugcuauca

SEQ ID NO: 113892 - RNA, 22 nt, Human
ucucucugcuguccagcguuau

SEQ ID NO: 113893 - RNA, 22 nt, Human
ucuccuuugaaaguuaggacug

SEQ ID NO: 113894 - RNA, 22 nt, Human
ucucuacuuggcuuguguucac

SEQ ID NO: 113895 - RNA, 22 nt, Human
ucucuagcuuccuuaggaacac

SEQ ID NO: 113896 - RNA, 22 nt, Human
ugcuucuuugggggugaagaga

SEQ ID NO: 113897 - RNA, 22 nt, Human
ucuucacagaugcauauacuuc

SEQ ID NO: 113898 - RNA, 22 nt, Human
ucuucaaauacagucauauuga

SEQ ID NO: 113899 - RNA, 22 nt, Human
uggcaacucaauuucuacaaga

SEQ ID NO: 113900 - RNA, 22 nt, Human
ucuuccauuccccuccuacgcc

SEQ ID NO: 113901 - RNA, 22 nt, Human
ucuucuauaucuacauaugcaa

SEQ ID NO: 113902 - RNA, 22 nt, Human
ucuucuuacauuaaguugaaac

SEQ ID NO: 113903 - RNA, 22 nt, Human
uggcuacguacaauggaacuuu

SEQ ID NO: 113904 - RNA, 22 nt, Human
uggcauuugagcuggaaggaug

SEQ ID NO: 113905 - RNA, 20 nt, Human
uggccgacccugaggaguug

SEQ ID NO: 113906 - RNA, 22 nt, Human
uggcaguugcaguaacuuguau

SEQ ID NO: 113907 - RNA, 22 nt, Human
ucuugcucuguucuaaaggauu

SEQ ID NO: 113908 - RNA, 22 nt, Human
ucuguuuugugcuuuguuuucu

SEQ ID NO: 113909 - RNA, 22 nt, Human
ucuguuuacaugucagcagcaa

SEQ ID NO: 113910 - RNA, 21 nt, Human
uggauauugaguaguuucuga

SEQ ID NO: 113911 - RNA, 22 nt, Human
ucuguguuccuggcaccaaacu

SEQ ID NO: 113912 - RNA, 22 nt, Human
ucuguauuuuuuacacacaugc

SEQ ID NO: 113913 - RNA, 22 nt, Human
ucugucuaaccauauuuuccua

SEQ ID NO: 113914 - RNA, 22 nt, Human
ucugucaguguccucguguggu

SEQ ID NO: 113915 - RNA, 22 nt, Human
ucuguaauccacacagguggau

SEQ ID NO: 113916 - RNA, 22 nt, Human
ucuguaccuuauguucagagug

SEQ ID NO: 113917 - RNA, 19 nt, Human
ucuguggagcucagaguag

SEQ ID NO: 113918 - RNA, 22 nt, Human
ucugcuguugaucaugacuagc

SEQ ID NO: 113919 - RNA, 21 nt, Human
ucugaggagaaacucuuggug

SEQ ID NO: 113920 - RNA, 22 nt, Human
ucugaucagaagacaaaugagg

SEQ ID NO: 113921 - RNA, 22 nt, Human
ucugauaaggaaggauuaaaag

SEQ ID NO: 113922 - RNA, 22 nt, Human
ucugauucauucugguaaaugg

SEQ ID NO: 113923 - RNA, 22 nt, Human
ugugauaauauuauuagagcuc

SEQ ID NO: 113924 - RNA, 22 nt, Human
ugugaugagaugaacuguagac

SEQ ID NO: 113925 - RNA, 22 nt, Human
ugugcuugucuguuuugauugu

SEQ ID NO: 113926 - RNA, 22 nt, Human
ugcauguuauuguggcaagaau

SEQ ID NO: 113927 - RNA, 22 nt, Human
ugcauuacuuugauaagcgucu

SEQ ID NO: 113928 - RNA, 22 nt, Human
ugccaauuaccuauuucugaga

SEQ ID NO: 113929 - RNA, 22 nt, Human
ugugagcugccacuucuaaucu

SEQ ID NO: 113930 - RNA, 23 nt, Human
ugugaauggccuucuuuagaggu

SEQ ID NO: 113931 - RNA, 22 nt, Human
ugugaaugacuuuguucuuugc

SEQ ID NO: 113932 - RNA, 22 nt, Human
ugucuuuagagugaacagaaga

SEQ ID NO: 113933 - RNA, 22 nt, Human
ugcagaauauucuggugacaau

SEQ ID NO: 113934 - RNA, 22 nt, Human
ugcaaugagcuucuuugauaaa

SEQ ID NO: 113935 - RNA, 22 nt, Human
ugucauuuauucucuuauucua

SEQ ID NO: 113936 - RNA, 22 nt, Human
uguccuauuugugauaggugac

SEQ ID NO: 113937 - RNA, 22 nt, Human
ugucacuuaagguuggugucuc

SEQ ID NO: 113938 - RNA, 22 nt, Human
ugaugccauaguaaaauuugcu

SEQ ID NO: 113939 - RNA, 22 nt, Human
ugauugggacauuuuguuuucu

SEQ ID NO: 113940 - RNA, 22 nt, Human
uguaauucuaauccagagcugg

SEQ ID NO: 113941 - RNA, 22 nt, Human
ugauuucauaugacagcuuuuu

SEQ ID NO: 113942 - RNA, 22 nt, Human
ugauuugguauccaggauuuaa

SEQ ID NO: 113943 - RNA, 22 nt, Human
ugauuugauuuguuuaugccug

SEQ ID NO: 113944 - RNA, 22 nt, Human
ugauuugaaaccuuuggcaaga

SEQ ID NO: 113945 - RNA, 22 nt, Human
ugauaguaucugauuauuucac

SEQ ID NO: 113946 - RNA, 22 nt, Human
ugaucaacagggcuggaaagag

SEQ ID NO: 113947 - RNA, 22 nt, Human
uguaauguuagaaacaauugcu

SEQ ID NO: 113948 - RNA, 22 nt, Human
ugaugaaguuggaaggaaaguu

SEQ ID NO: 113949 - RNA, 22 nt, Human
ugaucuuugcuuuuggcuuagu

SEQ ID NO: 113950 - RNA, 20 nt, Human
ugauccacucucauugcucu

SEQ ID NO: 113951 - RNA, 22 nt, Human
ugguuuuuuguaggauaaacau

SEQ ID NO: 113952 - RNA, 22 nt, Human
ugguuuguauauguuugugaga

SEQ ID NO: 113953 - RNA, 22 nt, Human
ugagucuguugcuagggggaau

SEQ ID NO: 113954 - RNA, 22 nt, Human
ugagucugaagagagaauaagg

SEQ ID NO: 113955 - RNA, 21 nt, Human
ugagucuuagagaacuucagg

SEQ ID NO: 113956 - RNA, 22 nt, Human
ugguccuuuccauuggagacac

SEQ ID NO: 113957 - RNA, 22 nt, Human
ugagauuuagaacuggauuuca

SEQ ID NO: 113958 - RNA, 22 nt, Human
ugagauguaauguaguacuuug

SEQ ID NO: 113959 - RNA, 22 nt, Human
ugagggaagguugauaauguuc

SEQ ID NO: 113960 - RNA, 22 nt, Human
uggugguaggggugguuucuga

SEQ ID NO: 113961 - RNA, 22 nt, Human
uggucaagcaaugaauuuauuu

SEQ ID NO: 113962 - RNA, 21 nt, Human
ugguccaaggacucauaccug

SEQ ID NO: 113963 - RNA, 22 nt, Human
ugguaauuuaacaaaauuguca

SEQ ID NO: 113964 - RNA, 22 nt, Human
ugguaaaugucuaacaaucacu

SEQ ID NO: 113965 - RNA, 22 nt, Human
ugagacaaaguuguuggauguu

SEQ ID NO: 113966 - RNA, 22 nt, Human
uggguuuauuguauuucccuua

SEQ ID NO: 113967 - RNA, 22 nt, Human
ugagaagaggucuuuugggaug

SEQ ID NO: 113968 - RNA, 22 nt, Human
ugacguuugcgccgcgcacgac

SEQ ID NO: 113969 - RNA, 22 nt, Human
ugacugagacugcaaugaccga

SEQ ID NO: 113970 - RNA, 22 nt, Human
ugacuaauacagaaacuacaag

SEQ ID NO: 113971 - RNA, 22 nt, Human
ucuuuuucccugguuccuuuuu

SEQ ID NO: 113972 - RNA, 22 nt, Human
ugaaaaaugcuuuaaugcaugu

SEQ ID NO: 113973 - RNA, 22 nt, Human
ucuuuuuaugucaaaaucgaug

SEQ ID NO: 113974 - RNA, 20 nt, Human
uuacugagguauuuuuauca

SEQ ID NO: 113975 - RNA, 22 nt, Human
uggaaaagaugucuuccugaau

SEQ ID NO: 113976 - RNA, 22 nt, Human
uuacuguguguaaaauaucuuu

SEQ ID NO: 113977 - RNA, 22 nt, Human
ugcuuuuguaucagaguauuca

SEQ ID NO: 113978 - RNA, 22 nt, Human
uuaccuuuucuuguuuacaagu

SEQ ID NO: 113979 - RNA, 22 nt, Human
ugcuuucaaugaauuguauacu

SEQ ID NO: 113980 - RNA, 22 nt, Human
ugcuuucagauaucuguuucaa

SEQ ID NO: 113981 - RNA, 21 nt, Human
ugcuuucugugcuuuuucugc

SEQ ID NO: 113982 - RNA, 19 nt, Human
uuacaugacauaugaagga

SEQ ID NO: 113983 - RNA, 22 nt, Human
uuacaagaucuuugaaggcaag

SEQ ID NO: 113984 - RNA, 22 nt, Human
uuagaugaaaaucggaacaugu

SEQ ID NO: 113985 - RNA, 22 nt, Human
uuagauaaaucagcccugagua

SEQ ID NO: 113986 - RNA, 22 nt, Human
uuagauaguaaauagcacuaag

SEQ ID NO: 113987 - RNA, 22 nt, Human
uuagaguucaagcuuuaggaaa

SEQ ID NO: 113988 - RNA, 22 nt, Human
uggaagaaaacuuggaaggcau

SEQ ID NO: 113989 - RNA, 22 nt, Human
uggaacuagugucugagauggg

SEQ ID NO: 113990 - RNA, 22 nt, Human
uggaaauaguugugagucaggc

SEQ ID NO: 113991 - RNA, 17 nt, Human
uuagagcuacauguuga

SEQ ID NO: 113992 - RNA, 22 nt, Human
uggaaaauuuagaaagauuuau

SEQ ID NO: 113993 - RNA, 22 nt, Human
uggaaagauuuaaaauaacgag

SEQ ID NO: 113994 - RNA, 22 nt, Human
uuacuuucugggauaucaaaug

SEQ ID NO: 113995 - RNA, 22 nt, Human
uuagaaaaaggcuguggucuua

SEQ ID NO: 113996 - RNA, 22 nt, Human
uuacuuaucugaugugauuuuu

SEQ ID NO: 113997 - RNA, 22 nt, Human
uuagagagaggagagagagaga

SEQ ID NO: 113998 - RNA, 22 nt, Human
uggaaauagauguaggaaauug

SEQ ID NO: 113999 - RNA, 22 nt, Human
uggaaaggcccauaaaaggaua

SEQ ID NO: 114000 - RNA, 22 nt, Human
uggaaaggaguucuguuuauuu

SEQ ID NO: 114001 - RNA, 22 nt, Human
uggaaaguuggaagucucagga

SEQ ID NO: 114002 - RNA, 22 nt, Human
uggaaauacaagaaguauguca

SEQ ID NO: 114003 - RNA, 22 nt, Human
uuagaaauguccuacuaauaug

SEQ ID NO: 114004 - RNA, 22 nt, Human
uggagagaaguucuauaaauca

SEQ ID NO: 114005 - RNA, 22 nt, Human
uggagauauucuauauuuuaua

SEQ ID NO: 114006 - RNA, 19 nt, Human
uuauccggacuuaauuuau

SEQ ID NO: 114007 - RNA, 22 nt, Human
uuaucuguuuuaaugaauaauu

SEQ ID NO: 114008 - RNA, 22 nt, Human
uuaucugugcuuuacugacaga

SEQ ID NO: 114009 - RNA, 18 nt, Human
uuauacaauuuuuuuuca

SEQ ID NO: 114010 - RNA, 22 nt, Human
uuauaggugauuaauuuuaacc

SEQ ID NO: 114011 - RNA, 22 nt, Human
uuauacuucugccagaggacaa

SEQ ID NO: 114012 - RNA, 22 nt, Human
uuauauuaaaaaucgcuaacag

SEQ ID NO: 114013 - RNA, 22 nt, Human
uuauaagugccucuuuauuuuc

SEQ ID NO: 114014 - RNA, 22 nt, Human
uggaauuaucugaagugauuug

SEQ ID NO: 114015 - RNA, 22 nt, Human
uggaagugggcaucaccaucca

SEQ ID NO: 114016 - RNA, 22 nt, Human
uggaaugaaagaaaaauuguag

SEQ ID NO: 114017 - RNA, 22 nt, Human
uuaguuauaggugaaucagaga

SEQ ID NO: 114018 - RNA, 22 nt, Human
uuauaaaccgcuaacagcacuu

SEQ ID NO: 114019 - RNA, 22 nt, Human
uuaguuacuugacucaagaccc

SEQ ID NO: 114020 - RNA, 22 nt, Human
uuaguuaauaaauauugagugu

SEQ ID NO: 114021 - RNA, 22 nt, Human
uuagugaagaagcaucuuuagu

SEQ ID NO: 114022 - RNA, 22 nt, Human
uggaagaucugguguagcuccu

SEQ ID NO: 114023 - RNA, 23 nt, Human
uggaagaaaaugguuuggcugug

SEQ ID NO: 114024 - RNA, 22 nt, Human
uuaguauuuuuugaaugaugaa

SEQ ID NO: 114025 - RNA, 22 nt, Human
uuaguauuuucaccauaugagg

SEQ ID NO: 114026 - RNA, 21 nt, Human
uuagcaguuguugauuuccag

SEQ ID NO: 114027 - RNA, 22 nt, Human
uuaauauuuauugguaaucacu

SEQ ID NO: 114028 - RNA, 22 nt, Human
uuaauaaggaccugugacaugc

SEQ ID NO: 114029 - RNA, 22 nt, Human
uuaaguauauccauuugacugg

SEQ ID NO: 114030 - RNA, 22 nt, Human
ugcuguugacuuuguuguucuu

SEQ ID NO: 114031 - RNA, 22 nt, Human
uuaaugcagguacuguuacaau

SEQ ID NO: 114032 - RNA, 22 nt, Human
uuaauucuugagcugucuuucc

SEQ ID NO: 114033 - RNA, 22 nt, Human
uuaauguugacacacuagcaca

SEQ ID NO: 114034 - RNA, 22 nt, Human
ugcuucuuuaggauguaguuau

SEQ ID NO: 114035 - RNA, 22 nt, Human
uuacaacgcacacagauuucac

SEQ ID NO: 114036 - RNA, 22 nt, Human
ugcuugacucagcaucggcaau

SEQ ID NO: 114037 - RNA, 22 nt, Human
ugcuugaggcuugucaucuaac

SEQ ID NO: 114038 - RNA, 23 nt, Human
uuaaggugccguguaauucaugc

SEQ ID NO: 114039 - RNA, 22 nt, Human
uuaagagaagaguaucuagaac

SEQ ID NO: 114040 - RNA, 23 nt, Human
uuaagacuggcugaacuuaguag

SEQ ID NO: 114041 - RNA, 22 nt, Human
uuaacgaauugugcauaauucc

SEQ ID NO: 114042 - RNA, 22 nt, Human
ugcuggaaggguaguauuaacu

SEQ ID NO: 114043 - RNA, 22 nt, Human
uuaaaucaggcaucauuucagu

SEQ ID NO: 114044 - RNA, 22 nt, Human
uuaaacauuuccacuugccagu

SEQ ID NO: 114045 - RNA, 22 nt, Human
uuaaagaguuuauuacuuguaa

SEQ ID NO: 114046 - RNA, 22 nt, Human
uuaaaagaauccuguuauccuc

SEQ ID NO: 114047 - RNA, 22 nt, Human
uguuuuucaagcauuuauuaau

SEQ ID NO: 114048 - RNA, 22 nt, Human
uguuuuuuagagugauacuuuu

SEQ ID NO: 114049 - RNA, 22 nt, Human
uguuuuuauucuuaauguuuca

SEQ ID NO: 114050 - RNA, 23 nt, Human
uguuugggcuaucuuuuguucuc

SEQ ID NO: 114051 - RNA, 22 nt, Human
uguuuucuauuaccugagauug

SEQ ID NO: 114052 - RNA, 22 nt, Human
uguuuguaugauggcacaucca

SEQ ID NO: 114053 - RNA, 22 nt, Human
uguuuccuaagugucucugaag

SEQ ID NO: 114054 - RNA, 22 nt, Human
ugcucuuuguagcugcuuugcu

SEQ ID NO: 114055 - RNA, 22 nt, Human
uguuucguugguggagagcuac

SEQ ID NO: 114056 - RNA, 22 nt, Human
uguuugagaauuugcugauguu

SEQ ID NO: 114057 - RNA, 22 nt, Human
uguuggauuuugugaaauauga

SEQ ID NO: 114058 - RNA, 22 nt, Human
uguuggaaucuucuagucuucc

SEQ ID NO: 114059 - RNA, 18 nt, Human
uguugguguucacucacu

SEQ ID NO: 114060 - RNA, 22 nt, Human
ugugugugugugugugugugug

SEQ ID NO: 114061 - RNA, 22 nt, Human
uguguguguguguaugugcgug

SEQ ID NO: 114062 - RNA, 19 nt, Human
uguugugggccacuaacua

SEQ ID NO: 114063 - RNA, 22 nt, Human
uguuuaaauagaacauacugca

SEQ ID NO: 114064 - RNA, 17 nt, Human
uguuguguggauuuucc

SEQ ID NO: 114065 - RNA, 22 nt, Human
ugcucuuguauccaaaagugau

SEQ ID NO: 114066 - RNA, 22 nt, Human
ugcucgauuauuucauuuugca

SEQ ID NO: 114067 - RNA, 22 nt, Human
uuccuucccccuucuuugccuu

SEQ ID NO: 114068 - RNA, 22 nt, Human
uuccuuuaaccaagagcaguac

SEQ ID NO: 114069 - RNA, 21 nt, Human
uuccuggaggcagaaacguga

SEQ ID NO: 114070 - RNA, 22 nt, Human
uuccuaauugccaugaaguuau

SEQ ID NO: 114071 - RNA, 20 nt, Human
uuauccccauucuuguucuc

SEQ ID NO: 114072 - RNA, 22 nt, Human
uucccuacuagccuuaauguuu

SEQ ID NO: 114073 - RNA, 22 nt, Human
ugggagagaaauuuaaguuuuu

SEQ ID NO: 114074 - RNA, 22 nt, Human
uuccucauuuggcacaucugag

SEQ ID NO: 114075 - RNA, 22 nt, Human
uuccucauuuauaggaaagaga

SEQ ID NO: 114076 - RNA, 22 nt, Human
uuccucuugaaucugucugacu

SEQ ID NO: 114077 - RNA, 22 nt, Human
uggcuuuuuauuccuaugugau

SEQ ID NO: 114078 - RNA, 22 nt, Human
ugggaaaauagcuauuuugaaa

SEQ ID NO: 114079 - RNA, 22 nt, Human
ugggaaaauugugauucuuucu

SEQ ID NO: 114080 - RNA, 22 nt, Human
ugggaauuuaugagaaaauaua

SEQ ID NO: 114081 - RNA, 22 nt, Human
ugggaaggggagcuggaaagga

SEQ ID NO: 114082 - RNA, 22 nt, Human
ugggaagccaguaucagacuaa

SEQ ID NO: 114083 - RNA, 22 nt, Human
uggcugaggcuuuucuuaaaga

SEQ ID NO: 114084 - RNA, 22 nt, Human
uuccacauucggaauuuucuga

SEQ ID NO: 114085 - RNA, 22 nt, Human
uuccacaugaucauuguaauaa

SEQ ID NO: 114086 - RNA, 22 nt, Human
uuaugcaaaggggccucuuccu

SEQ ID NO: 114087 - RNA, 22 nt, Human
uucuguacuagaucuuaucagu

SEQ ID NO: 114088 - RNA, 22 nt, Human
ugguacaaaaaagauuuuggac

SEQ ID NO: 114089 - RNA, 21 nt, Human
ugguaaggggauccuguuacu

SEQ ID NO: 114090 - RNA, 22 nt, Human
ugguaaaguguacugaauauga

SEQ ID NO: 114091 - RNA, 18 nt, Human
uucugcggugacagauau

SEQ ID NO: 114092 - RNA, 22 nt, Human
uggguuuaccaguguuucuucc

SEQ ID NO: 114093 - RNA, 22 nt, Human
uggguuugcuuguucagguucu

SEQ ID NO: 114094 - RNA, 23 nt, Human
uggguuucagugccaaugcugcc

SEQ ID NO: 114095 - RNA, 22 nt, Human
uucuauaagagaugaauacagu

SEQ ID NO: 114096 - RNA, 21 nt, Human
uucuauauugagaauuggcua

SEQ ID NO: 114097 - RNA, 22 nt, Human
uucuccugacuggccauucagu

SEQ ID NO: 114098 - RNA, 22 nt, Human
ugggguuuuagagcaggcagag

SEQ ID NO: 114099 - RNA, 22 nt, Human
uucuuugcucaccugccgcucc

SEQ ID NO: 114100 - RNA, 22 nt, Human
ugguuauauaaggauuaaauac

SEQ ID NO: 114101 - RNA, 23 nt, Human
uggugugaggaaggaagacuuua

SEQ ID NO: 114102 - RNA, 22 nt, Human
uggugaggacccagauuuuccu

SEQ ID NO: 114103 - RNA, 22 nt, Human
uucugugacuccucagagauuu

SEQ ID NO: 114104 - RNA, 22 nt, Human
uucuguguauggaagaaugucc

SEQ ID NO: 114105 - RNA, 22 nt, Human
uucuuaaugcauccuguguuca

SEQ ID NO: 114106 - RNA, 22 nt, Human
uucuuuucuucccuguuuauua

SEQ ID NO: 114107 - RNA, 22 nt, Human
uucuuuuaauuucugucugcag

SEQ ID NO: 114108 - RNA, 22 nt, Human
uguaagaagaaaaccguaugga

SEQ ID NO: 114109 - RNA, 22 nt, Human
uugaaaaaauguguuuaaggag

SEQ ID NO: 114110 - RNA, 23 nt, Human
ugguuuucagaagaccuuguuag

SEQ ID NO: 114111 - RNA, 20 nt, Human
uugaaagucagggcuccagu

SEQ ID NO: 114112 - RNA, 22 nt, Human
uguaaaguuuccuauugcccua

SEQ ID NO: 114113 - RNA, 22 nt, Human
uguacauuuacaaaagcuuuau

SEQ ID NO: 114114 - RNA, 22 nt, Human
uguaaauucuauacacuuaaaa

SEQ ID NO: 114115 - RNA, 22 nt, Human
uugaaaaaugcccagcagacaa

SEQ ID NO: 114116 - RNA, 22 nt, Human
uguagucucagggagcugcuuc

SEQ ID NO: 114117 - RNA, 22 nt, Human
ugugauugucuucugaaaguca

SEQ ID NO: 114118 - RNA, 22 nt, Human
uugcaugauuuaagaauaucug

SEQ ID NO: 114119 - RNA, 22 nt, Human
uugcaugugugaaaugcacaga

SEQ ID NO: 114120 - RNA, 22 nt, Human
uugccauacuugaaaggagaaa

SEQ ID NO: 114121 - RNA, 22 nt, Human
uugcccuaccccaggccuuuuu

SEQ ID NO: 114122 - RNA, 22 nt, Human
uugauuuggcguuuuccuccug

SEQ ID NO: 114123 - RNA, 20 nt, Human
uugcaaagugaauagcaauu

SEQ ID NO: 114124 - RNA, 21 nt, Human
uugauuuagcagaucuagcug

SEQ ID NO: 114125 - RNA, 22 nt, Human
ugucugaauuguaauguugcgu

SEQ ID NO: 114126 - RNA, 22 nt, Human
uugaguaaugcaagccuuugua

SEQ ID NO: 114127 - RNA, 20 nt, Human
uugauucacaaaaagcuuag

SEQ ID NO: 114128 - RNA, 22 nt, Human
uguaguuuuaggagggguaaau

SEQ ID NO: 114129 - RNA, 22 nt, Human
uugaauggaauuggaaucuuau

SEQ ID NO: 114130 - RNA, 22 nt, Human
uugaaucauauguaauugacuu

SEQ ID NO: 114131 - RNA, 22 nt, Human
uugaauuuagguuuaugugaaa

SEQ ID NO: 114132 - RNA, 22 nt, Human
uugagauggccuuuuuuauacu

SEQ ID NO: 114133 - RNA, 22 nt, Human
uugagauuuggagguaauuccc

SEQ ID NO: 114134 - RNA, 22 nt, Human
uugacacauggcuucaauugca

SEQ ID NO: 114135 - RNA, 22 nt, Human
uugacuauacucuggcggaaaa

SEQ ID NO: 114136 - RNA, 22 nt, Human
uuuaaaccuaucuaagaaauag

SEQ ID NO: 114137 - RNA, 23 nt, Human
uuuaaacaauguggucguggugg

SEQ ID NO: 114138 - RNA, 22 nt, Human
uuuaaaacaguacguuuucuua

SEQ ID NO: 114139 - RNA, 22 nt, Human
uuuaaagucaggcuguaguggu

SEQ ID NO: 114140 - RNA, 22 nt, Human
uuuaaacuaacaguacacguug

SEQ ID NO: 114141 - RNA, 22 nt, Human
uuaaugcauguaaaugugcaaa

SEQ ID NO: 114142 - RNA, 21 nt, Human
uuaaugcuaugcagaaaaucu

SEQ ID NO: 114143 - RNA, 22 nt, Human
uuaauguuuuagaaugagagug

SEQ ID NO: 114144 - RNA, 22 nt, Human
uuguuuucuaguguuuugaaua

SEQ ID NO: 114145 - RNA, 22 nt, Human
uuguuugguugacugauuuacc

SEQ ID NO: 114146 - RNA, 22 nt, Human
uuaaucuauuucauauaaggga

SEQ ID NO: 114147 - RNA, 22 nt, Human
uuguuuuaguagaaguuacaug

SEQ ID NO: 114148 - RNA, 22 nt, Human
uuaauauuaagauauugagugg

SEQ ID NO: 114149 - RNA, 22 nt, Human
uuaaucagacauucucaaguuu

SEQ ID NO: 114150 - RNA, 22 nt, Human
uuaauacugugucuuuuuuaau

SEQ ID NO: 114151 - RNA, 22 nt, Human
uuaauaaauugugguaccagag

SEQ ID NO: 114152 - RNA, 22 nt, Human
uuguuccuucuuuuuguaucag

SEQ ID NO: 114153 - RNA, 22 nt, Human
uuguuccuaguuguccaucaca

SEQ ID NO: 114154 - RNA, 22 nt, Human
uuguuuaaagaacuucugacuu

SEQ ID NO: 114155 - RNA, 22 nt, Human
uuaacauuguccuuagcagauu

SEQ ID NO: 114156 - RNA, 22 nt, Human
uuaaaauuguuaacuuugguga

SEQ ID NO: 114157 - RNA, 22 nt, Human
uuguuauaggaucagugucacu

SEQ ID NO: 114158 - RNA, 22 nt, Human
uuguuauuauuauuuucguucu

SEQ ID NO: 114159 - RNA, 22 nt, Human
uuuaugguacaggaaugcuguu

SEQ ID NO: 114160 - RNA, 20 nt, Human
uuuagucauuuccuaggaaa

SEQ ID NO: 114161 - RNA, 22 nt, Human
uuagaugcugugauuuuucaaa

SEQ ID NO: 114162 - RNA, 22 nt, Human
uuuagaguucuaaggacggguu

SEQ ID NO: 114163 - RNA, 22 nt, Human
uuagagguuuuuuuccucauuc

SEQ ID NO: 114164 - RNA, 22 nt, Human
uuagaguacaggauuguuuuaa

SEQ ID NO: 114165 - RNA, 22 nt, Human
uuacuuuuuucccccuuagaug

SEQ ID NO: 114166 - RNA, 22 nt, Human
uuuagaugcuguauguuauuuc

SEQ ID NO: 114167 - RNA, 22 nt, Human
uuuagagguacaguaggcauga

SEQ ID NO: 114168 - RNA, 22 nt, Human
uuuaaucaguugguaauauuga

SEQ ID NO: 114169 - RNA, 22 nt, Human
uuacaucacuuuacuuaauaau

SEQ ID NO: 114170 - RNA, 22 nt, Human
uuacaguuuacauaagaauugu

SEQ ID NO: 114171 - RNA, 22 nt, Human
uuaauuguuagauagauuauag

SEQ ID NO: 114172 - RNA, 22 nt, Human
uuuaacauaugaaagaauauuu

SEQ ID NO: 114173 - RNA, 20 nt, Human
uuuaacuggccuucuggcuc

SEQ ID NO: 114174 - RNA, 22 nt, Human
uuuaaucaauaaccuccugggu

SEQ ID NO: 114175 - RNA, 21 nt, Human
uuaauugagggauggggguga

SEQ ID NO: 114176 - RNA, 22 nt, Human
uuaauugggugcuuuguaaaua

SEQ ID NO: 114177 - RNA, 22 nt, Human
uuuaauauucucuuugaaggaa

SEQ ID NO: 114178 - RNA, 22 nt, Human
uuuaauauuacacuuaccuugu

SEQ ID NO: 114179 - RNA, 22 nt, Human
uuuaauuauaucugggcaguua

SEQ ID NO: 114180 - RNA, 19 nt, Human
uuuacuuaggccacagaau

SEQ ID NO: 114181 - RNA, 22 nt, Human
uguuuuuagcuguuuuuuggau

SEQ ID NO: 114182 - RNA, 22 nt, Human
uugugauuaauaacuuuucucu

SEQ ID NO: 114183 - RNA, 22 nt, Human
uugugcauuuuguuuuacuuau

SEQ ID NO: 114184 - RNA, 22 nt, Human
uguuuuuucccccccuucuaaa

SEQ ID NO: 114185 - RNA, 22 nt, Human
uuguggagaggaagcaaggagg

SEQ ID NO: 114186 - RNA, 22 nt, Human
uugucuuucguauggaacacua

SEQ ID NO: 114187 - RNA, 21 nt, Human
uugugaaaguccaggaacaac

SEQ ID NO: 114188 - RNA, 22 nt, Human
uugucuuggcauaccguuauau

SEQ ID NO: 114189 - RNA, 22 nt, Human
uugugaggaugugcuuuuuagu

SEQ ID NO: 114190 - RNA, 22 nt, Human
uugucaguggccugaggacaga

SEQ ID NO: 114191 - RNA, 22 nt, Human
uugucucuacagagaguaguag

SEQ ID NO: 114192 - RNA, 22 nt, Human
uguuuguuuuguauuuuuaauu

SEQ ID NO: 114193 - RNA, 22 nt, Human
uguuuucuuuccccuucuuuuc

SEQ ID NO: 114194 - RNA, 22 nt, Human
uguuuuguuuagguuuguuuuu

SEQ ID NO: 114195 - RNA, 21 nt, Human
uguuuuguaauagauacuaug

SEQ ID NO: 114196 - RNA, 22 nt, Human
uugucauuuucuuaauguuccu

SEQ ID NO: 114197 - RNA, 22 nt, Human
uuggucaagacugauaucaaga

SEQ ID NO: 114198 - RNA, 22 nt, Human
uugggucagcuuucagguagua

SEQ ID NO: 114199 - RNA, 22 nt, Human
uguuuaucaguagacucaaguu

SEQ ID NO: 114200 - RNA, 22 nt, Human
uugguuuuuugguguaucuuau

SEQ ID NO: 114201 - RNA, 22 nt, Human
uguuuaagugguuaaaggauuc

SEQ ID NO: 114202 - RNA, 22 nt, Human
uguuguuguuguuguuguuguu

SEQ ID NO: 114203 - RNA, 22 nt, Human
uuguaagacuguagaaugcaaa

SEQ ID NO: 114204 - RNA, 22 nt, Human
uuguaauaguguuuuacguugu

SEQ ID NO: 114205 - RNA, 23 nt, Human
uguuaucacauguuccuuuaaau

SEQ ID NO: 114206 - RNA, 22 nt, Human
uguuccaacuacugaauuggca

SEQ ID NO: 114207 - RNA, 22 nt, Human
uguucugauggauuacaugucu

SEQ ID NO: 114208 - RNA, 22 nt, Human
uuggcauuccagaugcuuuucu

SEQ ID NO: 114209 - RNA, 21 nt, Human
uguguuuauauguguuuauau

SEQ ID NO: 114210 - RNA, 22 nt, Human
uguguuucggauagcagauucu

SEQ ID NO: 114211 - RNA, 22 nt, Human
uguguuguuggggauguuuuca

SEQ ID NO: 114212 - RNA, 22 nt, Human
uguguuguuuggggauguccau

SEQ ID NO: 114213 - RNA, 22 nt, Human
uguguuagguuuugggauggcu

SEQ ID NO: 114214 - RNA, 22 nt, Human
uguguucuuugcuuaauuaaag

SEQ ID NO: 114215 - RNA, 22 nt, Human
uugcguaauuugagauuguaaa

SEQ ID NO: 114216 - RNA, 22 nt, Human
uuggacuucauuuaccucucuc

SEQ ID NO: 114217 - RNA, 22 nt, Human
uuggauugugaaaguauucucu

SEQ ID NO: 114218 - RNA, 22 nt, Human
uguguguguguguguguuugug

SEQ ID NO: 114219 - RNA, 23 nt, Human
ugugugugugugugugugugugu

SEQ ID NO: 114220 - RNA, 22 nt, Human
ugugucuuuggcgaugucugga

SEQ ID NO: 114221 - RNA, 22 nt, Human
uguguguguccucauuugcaga

SEQ ID NO: 114222 - RNA, 22 nt, Human
uguguguguauacauguauaua

SEQ ID NO: 114223 - RNA, 22 nt, Human
uuuuaacuuuaccauuucuuca

SEQ ID NO: 114224 - RNA, 22 nt, Human
uuuuaacuuuggguucucuuua

SEQ ID NO: 114225 - RNA, 22 nt, Human
uuuuaaauaaacuacacugauu

SEQ ID NO: 114226 - RNA, 22 nt, Human
uuuuaauaguauaucuagacac

SEQ ID NO: 114227 - RNA, 23 nt, Human
uuuuaauaguaugacaugagcug

SEQ ID NO: 114228 - RNA, 22 nt, Human
uuuuaaaguaauugaagcuugu

SEQ ID NO: 114229 - RNA, 22 nt, Human
uuccuuuuuaauuaaucuaauu

SEQ ID NO: 114230 - RNA, 22 nt, Human
uuccuuuucuucuaccacaugu

SEQ ID NO: 114231 - RNA, 20 nt, Human
uuccuuucuuucuuuuuuuu

SEQ ID NO: 114232 - RNA, 22 nt, Human
uuccucauuuuguuaauuuuac

SEQ ID NO: 114233 - RNA, 22 nt, Human
uuccugaucuuuucccagaguu

SEQ ID NO: 114234 - RNA, 22 nt, Human
uuuguuugcuaguauuuuguuu

SEQ ID NO: 114235 - RNA, 22 nt, Human
uuuguuuauuuacuuugggccu

SEQ ID NO: 114236 - RNA, 22 nt, Human
uuuuaaaagguugcuguuauaa

SEQ ID NO: 114237 - RNA, 22 nt, Human
uuuguccuguuggcaugaaaau

SEQ ID NO: 114238 - RNA, 22 nt, Human
uuuggguuuuuccuuagggacu

SEQ ID NO: 114239 - RNA, 20 nt, Human
uuugugaggccagagaacag

SEQ ID NO: 114240 - RNA, 22 nt, Human
uucauuagcguaggauguguac

SEQ ID NO: 114241 - RNA, 21 nt, Human
uucauucauggcauaauauag

SEQ ID NO: 114242 - RNA, 22 nt, Human
uuuguguuacaguccuagaacu

SEQ ID NO: 114243 - RNA, 22 nt, Human
uuuguguuggaagaaaugcuac

SEQ ID NO: 114244 - RNA, 22 nt, Human
uucccgcugcuggaguuggggc

SEQ ID NO: 114245 - RNA, 22 nt, Human
uucccuagagagauuuuuauuc

SEQ ID NO: 114246 - RNA, 22 nt, Human
uuuguucaguuuguugugggug

SEQ ID NO: 114247 - RNA, 23 nt, Human
uuuguugguuuaagaguagcaga

SEQ ID NO: 114248 - RNA, 22 nt, Human
uucaucauuuuccauuccucuu

SEQ ID NO: 114249 - RNA, 22 nt, Human
uucauccucuaguacugaagug

SEQ ID NO: 114250 - RNA, 22 nt, Human
uucauauuguggucuugcauuc

SEQ ID NO: 114251 - RNA, 22 nt, Human
uucagguuuuaugguaaugcuu

SEQ ID NO: 114252 - RNA, 22 nt, Human
uuuggcuacucuucauugguga

SEQ ID NO: 114253 - RNA, 22 nt, Human
uucaggaaacaaauuugcaguu

SEQ ID NO: 114254 - RNA, 22 nt, Human
uuugcugaaaaaccacuugagu

SEQ ID NO: 114255 - RNA, 22 nt, Human
uuugcuuugacuuugggaguau

SEQ ID NO: 114256 - RNA, 22 nt, Human
uucagcaagugucucuacuguc

SEQ ID NO: 114257 - RNA, 22 nt, Human
uucacucagagcaggacagccc

SEQ ID NO: 114258 - RNA, 22 nt, Human
uucacguuguugaagaaaauac

SEQ ID NO: 114259 - RNA, 22 nt, Human
uuugaauauacuucaaacaaag

SEQ ID NO: 114260 - RNA, 22 nt, Human
uucacauucauuucuuauguuu

SEQ ID NO: 114261 - RNA, 22 nt, Human
uucacuuuuucucugcuugaga

SEQ ID NO: 114262 - RNA, 22 nt, Human
uucacuuuuuccugguccauuu

SEQ ID NO: 114263 - RNA, 22 nt, Human
uucagaauuaucauaauuuuga

SEQ ID NO: 114264 - RNA, 22 nt, Human
uucagaauguacugauagaaca

SEQ ID NO: 114265 - RNA, 22 nt, Human
uuaguuaccacugcagaucuuu

SEQ ID NO: 114266 - RNA, 22 nt, Human
uuuauucacuuaucaggaacga

SEQ ID NO: 114267 - RNA, 22 nt, Human
uuuauuuggugguguuacuguu

SEQ ID NO: 114268 - RNA, 22 nt, Human
uuuauuugggauuucucaucug

SEQ ID NO: 114269 - RNA, 22 nt, Human
uucaauuacaucagaaucuaaa

SEQ ID NO: 114270 - RNA, 22 nt, Human
uucaaugcaagggaggucugaa

SEQ ID NO: 114271 - RNA, 21 nt, Human
uucaaguucacacucaaaggu

SEQ ID NO: 114272 - RNA, 22 nt, Human
uucaaccuucagcuugaguugg

SEQ ID NO: 114273 - RNA, 22 nt, Human
uuuuuuguggcuggaagaaaaa

SEQ ID NO: 114274 - RNA, 22 nt, Human
uugagaugacuuaaaucacugu

SEQ ID NO: 114275 - RNA, 22 nt, Human
uuuuuugucuugaagaaauggu

SEQ ID NO: 114276 - RNA, 22 nt, Human
uugacacauuagagcuuguaaa

SEQ ID NO: 114277 - RNA, 22 nt, Human
uugacguccucgauggggaacu

SEQ ID NO: 114278 - RNA, 22 nt, Human
uugaugagucacuuucuguaaa

SEQ ID NO: 114279 - RNA, 22 nt, Human
uugaugacauuuagcauaauug

SEQ ID NO: 114280 - RNA, 22 nt, Human
uugaauaaggcauaaagauacu

SEQ ID NO: 114281 - RNA, 22 nt, Human
uugaauaguuuuggauagcaua

SEQ ID NO: 114282 - RNA, 22 nt, Human
uuuuuuaaucaaguaggaaaca

SEQ ID NO: 114283 - RNA, 22 nt, Human
uuuuuguaaaugaaguuuuauu

SEQ ID NO: 114284 - RNA, 22 nt, Human
uuuuugggccaaauauauuuac

SEQ ID NO: 114285 - RNA, 22 nt, Human
uugaaaucuucccuccugucug

SEQ ID NO: 114286 - RNA, 22 nt, Human
uucuucuucuuccucauccuca

SEQ ID NO: 114287 - RNA, 22 nt, Human
uuuuguggacugauccgaggac

SEQ ID NO: 114288 - RNA, 22 nt, Human
uuuuuaaaauuaggacggcacg

SEQ ID NO: 114289 - RNA, 21 nt, Human
uucuuugaagacccauuugag

SEQ ID NO: 114290 - RNA, 23 nt, Human
uucuuuccuuaucccauuuacuu

SEQ ID NO: 114291 - RNA, 22 nt, Human
uucuuguccacagaagagcuca

SEQ ID NO: 114292 - RNA, 22 nt, Human
uuuuguggacugugagggugca

SEQ ID NO: 114293 - RNA, 22 nt, Human
uucuugcuuccggugcuccagg

SEQ ID NO: 114294 - RNA, 21 nt, Human
uucuuugcugcuguuuuugua

SEQ ID NO: 114295 - RNA, 22 nt, Human
uucuuuguccuagcauucuaca

SEQ ID NO: 114296 - RNA, 22 nt, Human
uucuuugcccauguuuccuaag

SEQ ID NO: 114297 - RNA, 22 nt, Human
uucuuuuuagcugguuguaaga

SEQ ID NO: 114298 - RNA, 22 nt, Human
uuuuucugccucucucccacau

SEQ ID NO: 114299 - RNA, 22 nt, Human
uucuuuuaauagagauccugug

SEQ ID NO: 114300 - RNA, 22 nt, Human
uuuugaauaauucagaaacagc

SEQ ID NO: 114301 - RNA, 22 nt, Human
uucugugacgcaaagcugggaa

SEQ ID NO: 114302 - RNA, 22 nt, Human
uuuugcuagaaaucaccaauac

SEQ ID NO: 114303 - RNA, 22 nt, Human
uuuugccuauuguaucaucgua

SEQ ID NO: 114304 - RNA, 22 nt, Human
uuuugcaaauuacuaaauuucu

SEQ ID NO: 114305 - RNA, 22 nt, Human
uuuugcuucuaguauauuuuuu

SEQ ID NO: 114306 - RNA, 22 nt, Human
uucuguuuuuauucuaucucug

SEQ ID NO: 114307 - RNA, 22 nt, Human
uuuugguuugaguauuuuuuuu

SEQ ID NO: 114308 - RNA, 22 nt, Human
uuuugguauggcuugauagagu

SEQ ID NO: 114309 - RNA, 22 nt, Human
uuuucuaggcccuggauuaugu

SEQ ID NO: 114310 - RNA, 22 nt, Human
uucugagguagccacucacugg

SEQ ID NO: 114311 - RNA, 22 nt, Human
uuuucuacaaaucuggacuuuu

SEQ ID NO: 114312 - RNA, 22 nt, Human
uuuuccuugagucggggcacag

SEQ ID NO: 114313 - RNA, 22 nt, Human
uuuucucucacuucacauauuu

SEQ ID NO: 114314 - RNA, 22 nt, Human
uuuucuucucauucugaccuca

SEQ ID NO: 114315 - RNA, 22 nt, Human
uucuagacaauugaaaacuguu

SEQ ID NO: 114316 - RNA, 22 nt, Human
uuuuauaauacccuugacuaau

SEQ ID NO: 114317 - RNA, 22 nt, Human
uuuuaucagagcuugcagugug

SEQ ID NO: 114318 - RNA, 22 nt, Human
uuuuauguuccugaagcuaucu

SEQ ID NO: 114319 - RNA, 22 nt, Human
uuuuccgaccuuaggaaggaac

SEQ ID NO: 114320 - RNA, 22 nt, Human
uuuucauagccagaaacugaaa

SEQ ID NO: 114321 - RNA, 22 nt, Human
uuuuccuuagaaauacauugau

SEQ ID NO: 114322 - RNA, 22 nt, Human
uuuuccuuccugucucuuuauu

SEQ ID NO: 114323 - RNA, 22 nt, Human
uuuuccaaaaguggagaggaau

SEQ ID NO: 114324 - RNA, 22 nt, Human
uuuuaaucagguauuugaguau

SEQ ID NO: 114325 - RNA, 22 nt, Human
uuuuaauccucuugguaucuua

SEQ ID NO: 114326 - RNA, 22 nt, Human
uucuagaagggccuaggcauaa

SEQ ID NO: 114327 - RNA, 22 nt, Human
uucuacuagugguugauggccu

SEQ ID NO: 114328 - RNA, 22 nt, Human
uuuuacauuuuauucguuuauu

SEQ ID NO: 114329 - RNA, 23 nt, Human
uuuuacaagagugcauuugucuc

SEQ ID NO: 114330 - RNA, 22 nt, Human
uuuuacaaugcaaauucuugcu

SEQ ID NO: 114331 - RNA, 22 nt, Human
uuuuagccagaguuuaucacag

SEQ ID NO: 114332 - RNA, 22 nt, Human
uuuuagaagcauuuaugagauu

SEQ ID NO: 114333 - RNA, 22 nt, Human
uuuuacuuuucccacuuacagc

SEQ ID NO: 114334 - RNA, 22 nt, Human
uuggugauugggaauggauggg

SEQ ID NO: 114335 - RNA, 22 nt, Human
uugguguuucacuuccuugucg

SEQ ID NO: 114336 - RNA, 22 nt, Human
uugguuccauuuuaccagcucu

SEQ ID NO: 114337 - RNA, 22 nt, Human
uuguaaguuuuagguguuucaa

SEQ ID NO: 114338 - RNA, 22 nt, Human
uugguuuacucuggggauaucu

SEQ ID NO: 114339 - RNA, 22 nt, Human
uugguuuuauucguauuuguau

SEQ ID NO: 114340 - RNA, 22 nt, Human
uugugacuauuuuucauugaag

SEQ ID NO: 114341 - RNA, 22 nt, Human
uugguugaaauguguucaugcu

SEQ ID NO: 114342 - RNA, 22 nt, Human
uuguauuaauacacuccuuuuc

SEQ ID NO: 114343 - RNA, 22 nt, Human
uugucagcuagugaugcuguuc

SEQ ID NO: 114344 - RNA, 22 nt, Human
uugggaguaauacugaagagag

SEQ ID NO: 114345 - RNA, 22 nt, Human
uugggagaaaguuaacuuucua

SEQ ID NO: 114346 - RNA, 22 nt, Human
uugauuugcagaagguguagag

SEQ ID NO: 114347 - RNA, 22 nt, Human
uugauuuccauuguccagcauu

SEQ ID NO: 114348 - RNA, 22 nt, Human
uugauuggguauaaugacagga

SEQ ID NO: 114349 - RNA, 22 nt, Human
uugauggaggaaaaguuggaau

SEQ ID NO: 114350 - RNA, 22 nt, Human
uugauuaauugaugaaccucuc

SEQ ID NO: 114351 - RNA, 22 nt, Human
uuggauagaauuuaaauugucu

SEQ ID NO: 114352 - RNA, 22 nt, Human
uuggaggaagcucaugggggau

SEQ ID NO: 114353 - RNA, 22 nt, Human
uuuacuauuaguauuucauuuu

SEQ ID NO: 114354 - RNA, 22 nt, Human
uuuagcaaggagaaauaauccu

SEQ ID NO: 114355 - RNA, 22 nt, Human
uuuacuaauuaguuuuggaaca

SEQ ID NO: 114356 - RNA, 18 nt, Human
uuuacgaacucacuugag

SEQ ID NO: 114357 - RNA, 22 nt, Human
uuuaccuuauguaaauaagagu

SEQ ID NO: 114358 - RNA, 22 nt, Human
uuuaguauaguaugugcucaaa

SEQ ID NO: 114359 - RNA, 22 nt, Human
uuuagugaagcuuugcauuuca

SEQ ID NO: 114360 - RNA, 22 nt, Human
uuuaggaagaucugaaggaaga

SEQ ID NO: 114361 - RNA, 22 nt, Human
uuuagcugugugugucgcucca

SEQ ID NO: 114362 - RNA, 22 nt, Human
uuuagguccguguugcaguugg

SEQ ID NO: 114363 - RNA, 22 nt, Human
uuuaggauaacuccaguuuucc

SEQ ID NO: 114364 - RNA, 22 nt, Human
uuuacaaggcaguuauuuuccu

SEQ ID NO: 114365 - RNA, 22 nt, Human
uuguuguuguuguuauuuaguu

SEQ ID NO: 114366 - RNA, 22 nt, Human
uuuauguugagcaaaauaccac

SEQ ID NO: 114367 - RNA, 22 nt, Human
uuuauguuuguuuuugaaauaa

SEQ ID NO: 114368 - RNA, 22 nt, Human
uuuaucucugcauagaagugau

SEQ ID NO: 114369 - RNA, 22 nt, Human
uuuauaauuguuauguuaccca

SEQ ID NO: 114370 - RNA, 22 nt, Human
uuuagugagugugaaucaaaug

SEQ ID NO: 114371 - RNA, 22 nt, Human
uuuauaaacacaagaugggcuc

SEQ ID NO: 114372 - RNA, 22 nt, Human
uuuauucuuugcuagguuccau

SEQ ID NO: 114373 - RNA, 22 nt, Human
uuuauuuacuuucgguucugcu

SEQ ID NO: 114374 - RNA, 22 nt, Human
uuucaaguagagggaucgcuag

SEQ ID NO: 114375 - RNA, 22 nt, Human
uuuauuuuccaugucucuaggu

SEQ ID NO: 114376 - RNA, 22 nt, Human
uuucacuucgaucagaguuuuu

SEQ ID NO: 114377 - RNA, 22 nt, Human
uuucacauacaguguauaguag

SEQ ID NO: 114378 - RNA, 22 nt, Human
uuugggaaguaauuaauugcag

SEQ ID NO: 114379 - RNA, 22 nt, Human
uuugggguuuuuuggugaaauc

SEQ ID NO: 114380 - RNA, 22 nt, Human
uuuggggcucauuugcuuuugu

SEQ ID NO: 114381 - RNA, 18 nt, Human
uuugggauccucuuuucu

SEQ ID NO: 114382 - RNA, 23 nt, Human
uuugggaaauagccuauaggcac

SEQ ID NO: 114383 - RNA, 22 nt, Human
uuuggcuuugauccuaggauuc

SEQ ID NO: 114384 - RNA, 22 nt, Human
uuuggaugcugucauaugcugc

SEQ ID NO: 114385 - RNA, 22 nt, Human
uuuguauuguuuauuucauuuu

SEQ ID NO: 114386 - RNA, 22 nt, Human
uuugucaucuuccauauuugca

SEQ ID NO: 114387 - RNA, 22 nt, Human
uuuggucuggaaucuucagggu

SEQ ID NO: 114388 - RNA, 22 nt, Human
uuuguaaguuuguucuccuggg

SEQ ID NO: 114389 - RNA, 22 nt, Human
uuuggugauuuuuaaucccccu

SEQ ID NO: 114390 - RNA, 19 nt, Human
uuugguaggcuugagggaa

SEQ ID NO: 114391 - RNA, 22 nt, Human
uuugcaggaaauguacugaaug

SEQ ID NO: 114392 - RNA, 23 nt, Human
uuugcaaauuggacacaaccaca

SEQ ID NO: 114393 - RNA, 22 nt, Human
uuugauuuuuugagcaguguau

SEQ ID NO: 114394 - RNA, 22 nt, Human
uuugauuuuguuuauagugccg

SEQ ID NO: 114395 - RNA, 22 nt, Human
uuugcuccucuucauuuguauc

SEQ ID NO: 114396 - RNA, 22 nt, Human
uuugcuguaaugcaugucagag

SEQ ID NO: 114397 - RNA, 23 nt, Human
uuugccuaaugaagacuauguca

SEQ ID NO: 114398 - RNA, 22 nt, Human
uuugccaucagaugugguaggu

SEQ ID NO: 114399 - RNA, 22 nt, Human
uuugaagaccuuaucucuaaau

SEQ ID NO: 114400 - RNA, 22 nt, Human
uuucuuaguuaaguagguaggc

SEQ ID NO: 114401 - RNA, 22 nt, Human
uuugacaccaggagagaaaaca

SEQ ID NO: 114402 - RNA, 21 nt, Human
uuugacagaccagguauaguu

SEQ ID NO: 114403 - RNA, 23 nt, Human
uuugaaucauuguggggcuuuug

SEQ ID NO: 114404 - RNA, 22 nt, Human
uuugagguuuagcucacuauuu

SEQ ID NO: 114405 - RNA, 22 nt, Human
uuugagaaugucaaucacaaga

SEQ ID NO: 114406 - RNA, 22 nt, Human
uuugaugagaaaugacuuaagu

SEQ ID NO: 114407 - RNA, 22 nt, Human
uuugagugccucgaguguggga

SEQ ID NO: 114408 - RNA, 22 nt, Human
uuucuggaaacuguaaagagga

SEQ ID NO: 114409 - RNA, 22 nt, Human
uuucuggacuaaagggagagau

SEQ ID NO: 114410 - RNA, 22 nt, Human
uuucugaugaaguagaaagacc

SEQ ID NO: 114411 - RNA, 17 nt, Human
uuucugcaugauuggac

SEQ ID NO: 114412 - RNA, 22 nt, Human
uuucugcauuuguauuggaaaa

SEQ ID NO: 114413 - RNA, 22 nt, Human
uuucucuuguauuugaaucacu

SEQ ID NO: 114414 - RNA, 22 nt, Human
uuucuauuuacagugcuaggua

SEQ ID NO: 114415 - RNA, 22 nt, Human
uuucuccauuuuguguguucug

SEQ ID NO: 114416 - RNA, 22 nt, Human
uuucucagccuccuugcuggag

SEQ ID NO: 114417 - RNA, 22 nt, Human
uuucuuccuucuugaucauuug

SEQ ID NO: 114418 - RNA, 22 nt, Human
uuucuguugugaccugacucuu

SEQ ID NO: 114419 - RNA, 22 nt, Human
uuucuguucuguuggauucuuu

SEQ ID NO: 114420 - RNA, 22 nt, Human
uuugaagaaacagucuuaagag

SEQ ID NO: 114421 - RNA, 22 nt, Human
uuugaaaggagcuuuauccaga

SEQ ID NO: 114422 - RNA, 18 nt, Human
uuucuuuuauuccagguc

SEQ ID NO: 114423 - RNA, 22 nt, Human
uuucuugugauuuugaugaacu

SEQ ID NO: 114424 - RNA, 22 nt, Human
uuucuuugcugguuggcucucc

SEQ ID NO: 114425 - RNA, 22 nt, Human
uuucaucccugucagugaaggc

SEQ ID NO: 114426 - RNA, 22 nt, Human
uuucagcaugacuguuaucuuu

SEQ ID NO: 114427 - RNA, 22 nt, Human
uuuccagacaugguuuuucaaa

SEQ ID NO: 114428 - RNA, 22 nt, Human
uuuccaguuguucuagaaagcu

SEQ ID NO: 114429 - RNA, 21 nt, Human
uuucauuaguacaucaauuug

SEQ ID NO: 114430 - RNA, 22 nt, Human
uuucauguuggauacuguuuca

SEQ ID NO: 114431 - RNA, 22 nt, Human
uuucuauauucaguuucauaaa

SEQ ID NO: 114432 - RNA, 22 nt, Human
uuucuaaaauuacugcagucgg

SEQ ID NO: 114433 - RNA, 22 nt, Human
uuucuaaguuugaggcgaagca

SEQ ID NO: 114434 - RNA, 22 nt, Human
uuucgcuuguucggagugcuuu

SEQ ID NO: 114435 - RNA, 22 nt, Human
uuucgggauuucaaagagcaaa

SEQ ID NO: 114436 - RNA, 22 nt, Human
auucugagaucucuucuaggcc

SEQ ID NO: 114437 - RNA, 21 nt, Human
auucugauguuucuauuguuu

SEQ ID NO: 114438 - RNA, 22 nt, Human
auucugcugccuaguuuaugaa

SEQ ID NO: 114439 - RNA, 22 nt, Human
auuauucuuugggaaaguugaa

SEQ ID NO: 114440 - RNA, 20 nt, Human
auuauuucuucugcccaaag

SEQ ID NO: 114441 - RNA, 22 nt, Human
auucaagauagaaggauuuuca

SEQ ID NO: 114442 - RNA, 22 nt, Human
auuauuugcuuaagcuggucuc

SEQ ID NO: 114443 - RNA, 21 nt, Human
auucaaagaagaggaaggccc

SEQ ID NO: 114444 - RNA, 18 nt, Human
auucauuugcguuuggcu

SEQ ID NO: 114445 - RNA, 22 nt, Human
auucauucugaccucaagagaa

SEQ ID NO: 114446 - RNA, 22 nt, Human
auucaucuguacuucaauaucu

SEQ ID NO: 114447 - RNA, 22 nt, Human
auucaguucuaaggucagugcc

SEQ ID NO: 114448 - RNA, 22 nt, Human
auucaggacucuuccuugaaga

SEQ ID NO: 114449 - RNA, 17 nt, Human
auucuuauacucuguga

SEQ ID NO: 114450 - RNA, 22 nt, Human
auucuguuuuaccauuuucuuu

SEQ ID NO: 114451 - RNA, 22 nt, Human
auucuguugguuuaauagucaa

SEQ ID NO: 114452 - RNA, 22 nt, Human
auuaaauagcagaagaaagaug

SEQ ID NO: 114453 - RNA, 22 nt, Human
auguuguuuauggguuaucaag

SEQ ID NO: 114454 - RNA, 22 nt, Human
auucuacucuccuacaggucua

SEQ ID NO: 114455 - RNA, 22 nt, Human
auucgcggcuugaucugcuugc

SEQ ID NO: 114456 - RNA, 22 nt, Human
auucgaucacugccgaggaccu

SEQ ID NO: 114457 - RNA, 22 nt, Human
auguugaguggaugaacaaaca

SEQ ID NO: 114458 - RNA, 22 nt, Human
auguuuaaguguuuugccccaa

SEQ ID NO: 114459 - RNA, 22 nt, Human
auguuuaauuugaaauuuuauu

SEQ ID NO: 114460 - RNA, 22 nt, Human
auuccguuuuaaaaccuuaagc

SEQ ID NO: 114461 - RNA, 22 nt, Human
auucuacucuuuaaauaugaaa

SEQ ID NO: 114462 - RNA, 22 nt, Human
auuaucuauccgccaacaguaa

SEQ ID NO: 114463 - RNA, 22 nt, Human
auucucauguuaccaaauucua

SEQ ID NO: 114464 - RNA, 22 nt, Human
auucuccucaaaacaucugcug

SEQ ID NO: 114465 - RNA, 22 nt, Human
auucucauguuuuaaaaaaguu

SEQ ID NO: 114466 - RNA, 22 nt, Human
auuccuguggcuggguaaagua

SEQ ID NO: 114467 - RNA, 22 nt, Human
auucuaauaagcguuuugucgc

SEQ ID NO: 114468 - RNA, 22 nt, Human
auucuucauguugaagcuguca

SEQ ID NO: 114469 - RNA, 22 nt, Human
auucuuuauuuucuguacuugc

SEQ ID NO: 114470 - RNA, 22 nt, Human
auugaaauuaauuucugcuuuc

SEQ ID NO: 114471 - RNA, 19 nt, Human
auucuucucuuccugcugu

SEQ ID NO: 114472 - RNA, 22 nt, Human
auugaaguguacguuugaucua

SEQ ID NO: 114473 - RNA, 22 nt, Human
auugacagagguguaguugaga

SEQ ID NO: 114474 - RNA, 22 nt, Human
auucucuauugguaaauuugac

SEQ ID NO: 114475 - RNA, 22 nt, Human
auugacuucccaucaggugagu

SEQ ID NO: 114476 - RNA, 22 nt, Human
auugacuuucccuucuccucau

SEQ ID NO: 114477 - RNA, 22 nt, Human
auucuagaguuucaauccaagg

SEQ ID NO: 114478 - RNA, 22 nt, Human
auucuaugaaugacuguuagau

SEQ ID NO: 114479 - RNA, 22 nt, Human
auucuguaggcuuuuguuaaaa

SEQ ID NO: 114480 - RNA, 22 nt, Human
auucuguuuaauacacgaaagg

SEQ ID NO: 114481 - RNA, 22 nt, Human
auugagaugcuuaaaucuucac

SEQ ID NO: 114482 - RNA, 22 nt, Human
auucuuauaaaaaguguugacu

SEQ ID NO: 114483 - RNA, 22 nt, Human
auucuuacaaagcagagucugu

SEQ ID NO: 114484 - RNA, 21 nt, Human
auucugaguugucagucuuca

SEQ ID NO: 114485 - RNA, 22 nt, Human
auucugaagcagaaaaggcaga

SEQ ID NO: 114486 - RNA, 22 nt, Human
auugcaggucguguggaaguga

SEQ ID NO: 114487 - RNA, 22 nt, Human
auugaguucaccucuuucagaa

SEQ ID NO: 114488 - RNA, 18 nt, Human
auugagcaugacagaccu

SEQ ID NO: 114489 - RNA, 22 nt, Human
auuuuuauuugccuaugauaua

SEQ ID NO: 114490 - RNA, 22 nt, Human
caaaggauguguagugcaacca

SEQ ID NO: 114491 - RNA, 22 nt, Human
caaaggaauuacauguuucgga

SEQ ID NO: 114492 - RNA, 22 nt, Human
caaacauuuguuggaaccccug

SEQ ID NO: 114493 - RNA, 22 nt, Human
caaaauuguugaugcugcuuug

SEQ ID NO: 114494 - RNA, 22 nt, Human
caaauguuugguggcauuuugu

SEQ ID NO: 114495 - RNA, 22 nt, Human
caaaucuguuaauuucaaguug

SEQ ID NO: 114496 - RNA, 22 nt, Human
auuuuugguuauaaaauaguuu

SEQ ID NO: 114497 - RNA, 22 nt, Human
auuuuugugucacaucuaggaa

SEQ ID NO: 114498 - RNA, 22 nt, Human
auuuuugguuucaccugcacgc

SEQ ID NO: 114499 - RNA, 22 nt, Human
caaaaaauccauagaaagaggu

SEQ ID NO: 114500 - RNA, 22 nt, Human
auuuuuucaugugugguugaga

SEQ ID NO: 114501 - RNA, 23 nt, Human
auuuuuccacacacagacucagu

SEQ ID NO: 114502 - RNA, 22 nt, Human
auuuuacuaugauaguugagaa

SEQ ID NO: 114503 - RNA, 22 nt, Human
auuuuuuuaggcugucagccgc

SEQ ID NO: 114504 - RNA, 22 nt, Human
auuuucauauggguuauuugua

SEQ ID NO: 114505 - RNA, 22 nt, Human
auuuuauuuugggaucuuuuua

SEQ ID NO: 114506 - RNA, 22 nt, Human
auuuuagagaaacaaacguagg

SEQ ID NO: 114507 - RNA, 22 nt, Human
auuuuuagucuugcugcaauca

SEQ ID NO: 114508 - RNA, 23 nt, Human
auuuccuaaaagauaaucauuac

SEQ ID NO: 114509 - RNA, 22 nt, Human
auuuugcaguuuauugccaauc

SEQ ID NO: 114510 - RNA, 22 nt, Human
auuuuggguguuaacaaugaaa

SEQ ID NO: 114511 - RNA, 22 nt, Human
auuuuguugaaacccuuguugu

SEQ ID NO: 114512 - RNA, 22 nt, Human
auuuuuagagugaaagaauuaa

SEQ ID NO: 114513 - RNA, 22 nt, Human
auuugaaguauaaguaauugcu

SEQ ID NO: 114514 - RNA, 22 nt, Human
auuguauugcguuugcgaaugu

SEQ ID NO: 114515 - RNA, 22 nt, Human
auugguuucuuguggguuaucc

SEQ ID NO: 114516 - RNA, 22 nt, Human
auuggagacauuaagucuaaga

SEQ ID NO: 114517 - RNA, 22 nt, Human
auuuaucugcucuucgcguuga

SEQ ID NO: 114518 - RNA, 22 nt, Human
auuuauauauuuuguucuggua

SEQ ID NO: 114519 - RNA, 22 nt, Human
auuuggucuacauuuuccaaau

SEQ ID NO: 114520 - RNA, 22 nt, Human
auuuggucuguaauuacaugga

SEQ ID NO: 114521 - RNA, 22 nt, Human
auuucauccauuaagaguacuc

SEQ ID NO: 114522 - RNA, 19 nt, Human
auugcaguguaaaacuauu

SEQ ID NO: 114523 - RNA, 22 nt, Human
auugaugaaaauaguuauuuua

SEQ ID NO: 114524 - RNA, 22 nt, Human
auugauuuugugcuuuccuacg

SEQ ID NO: 114525 - RNA, 22 nt, Human
auuuaagugagucuuuaaaaua

SEQ ID NO: 114526 - RNA, 22 nt, Human
auugagaaaauucgagcaaguu

SEQ ID NO: 114527 - RNA, 22 nt, Human
auucuuuagaguccuucaaaua

SEQ ID NO: 114528 - RNA, 20 nt, Human
auucuuguuccauuucccag

SEQ ID NO: 114529 - RNA, 22 nt, Human
auuguucuagaauuuuuuuucc

SEQ ID NO: 114530 - RNA, 22 nt, Human
auucuugauauagauaguuaau

SEQ ID NO: 114531 - RNA, 22 nt, Human
auuguuuccccggaauuauuca

SEQ ID NO: 114532 - RNA, 19 nt, Human
auugguuugcucgggaaug

SEQ ID NO: 114533 - RNA, 22 nt, Human
auugaagcauggagaugaggca

SEQ ID NO: 114534 - RNA, 22 nt, Human
auugaauuagauguuguagucc

SEQ ID NO: 114535 - RNA, 22 nt, Human
auguuuugaguuuuuuuacacc

SEQ ID NO: 114536 - RNA, 22 nt, Human
auguuuucuugucuggagaagu

SEQ ID NO: 114537 - RNA, 22 nt, Human
auguuuuuugaaaauguauuuu

SEQ ID NO: 114538 - RNA, 22 nt, Human
auguugagaaucucucuucuaa

SEQ ID NO: 114539 - RNA, 22 nt, Human
auuaaacuaaauuaugaauugg

SEQ ID NO: 114540 - RNA, 22 nt, Human
auuaaagcaugaauaauaugua

SEQ ID NO: 114541 - RNA, 22 nt, Human
auguuuuaaaaaacaggcuacc

SEQ ID NO: 114542 - RNA, 22 nt, Human
auguuuucauuuagaagcuaau

SEQ ID NO: 114543 - RNA, 22 nt, Human
auguuuuauacacauguaucac

SEQ ID NO: 114544 - RNA, 22 nt, Human
auguuugugauugcugaaaaga

SEQ ID NO: 114545 - RNA, 19 nt, Human
auguuuccauuucuggaua

SEQ ID NO: 114546 - RNA, 23 nt, Human
auguagcugcucccgaugcccuc

SEQ ID NO: 114547 - RNA, 22 nt, Human
auguauauauacauguauugua

SEQ ID NO: 114548 - RNA, 22 nt, Human
auguguguaugacugaaucuau

SEQ ID NO: 114549 - RNA, 22 nt, Human
auguugcugauccuguggcugu

SEQ ID NO: 114550 - RNA, 22 nt, Human
auguuguugaacucuuugcaug

SEQ ID NO: 114551 - RNA, 22 nt, Human
auguaugagagauucuuuuauu

SEQ ID NO: 114552 - RNA, 22 nt, Human
auggucugcucagucucuugac

SEQ ID NO: 114553 - RNA, 22 nt, Human
auggggaauugaccguggaucu

SEQ ID NO: 114554 - RNA, 22 nt, Human
augggauuugaaaaguggaaau

SEQ ID NO: 114555 - RNA, 22 nt, Human
augggaggguagagugaacaga

SEQ ID NO: 114556 - RNA, 22 nt, Human
auguaccgccuuggagaaaugc

SEQ ID NO: 114557 - RNA, 22 nt, Human
augguaaguuuuuaaaaagcgu

SEQ ID NO: 114558 - RNA, 22 nt, Human
augguguaagacuguauuucuu

SEQ ID NO: 114559 - RNA, 22 nt, Human
auggugaugaugaugaugauaa

SEQ ID NO: 114560 - RNA, 19 nt, Human
augguauugcuggguuuuu

SEQ ID NO: 114561 - RNA, 22 nt, Human
auggaggaugugcagcaugggc

SEQ ID NO: 114562 - RNA, 22 nt, Human
auggauuggguugauggcauac

SEQ ID NO: 114563 - RNA, 22 nt, Human
auggacguuuguguauuaugua

SEQ ID NO: 114564 - RNA, 22 nt, Human
auggaauuuaaauuuugguguc

SEQ ID NO: 114565 - RNA, 22 nt, Human
auggaggagcagaggguuucca

SEQ ID NO: 114566 - RNA, 22 nt, Human
auggaacccgggcgucugcucu

SEQ ID NO: 114567 - RNA, 22 nt, Human
auggaagagacaaugcuaucug

SEQ ID NO: 114568 - RNA, 22 nt, Human
auggaacauuaaucuucaaaug

SEQ ID NO: 114569 - RNA, 22 nt, Human
augcuuucucuucuauuucuca

SEQ ID NO: 114570 - RNA, 22 nt, Human
augcaugaucccgguaugugaa

SEQ ID NO: 114571 - RNA, 22 nt, Human
augauuuguuaacagacuuaau

SEQ ID NO: 114572 - RNA, 22 nt, Human
augcaaaaucuuauuuuuucua

SEQ ID NO: 114573 - RNA, 22 nt, Human
augcugcuccuuuucaggcauu

SEQ ID NO: 114574 - RNA, 22 nt, Human
augcauaugugugcaagugugu

SEQ ID NO: 114575 - RNA, 22 nt, Human
augauguuggaauuuuaacuua

SEQ ID NO: 114576 - RNA, 22 nt, Human
augaguuaaguagcccuucaug

SEQ ID NO: 114577 - RNA, 19 nt, Human
augaaauagcauuuucuga

SEQ ID NO: 114578 - RNA, 23 nt, Human
augaaaugauacuuuauucacug

SEQ ID NO: 114579 - RNA, 23 nt, Human
augaacgcacugagaucauaauu

SEQ ID NO: 114580 - RNA, 22 nt, Human
augaaacuggagcgccuggagg

SEQ ID NO: 114581 - RNA, 22 nt, Human
aucuuuuuucacaauuuauuuu

SEQ ID NO: 114582 - RNA, 22 nt, Human
aucuuuguaaguaaucaaagcu

SEQ ID NO: 114583 - RNA, 22 nt, Human
aucuuugauuuuggcuuuuagg

SEQ ID NO: 114584 - RNA, 22 nt, Human
augaguaaguucugauuagauu

SEQ ID NO: 114585 - RNA, 22 nt, Human
aucuugaaacauauaugcauuu

SEQ ID NO: 114586 - RNA, 22 nt, Human
augaacuaagagucauuagugu

SEQ ID NO: 114587 - RNA, 22 nt, Human
augaagguggacagauuuuuuu

SEQ ID NO: 114588 - RNA, 22 nt, Human
augaaggauagggcaaaauuuu

SEQ ID NO: 114589 - RNA, 22 nt, Human
augaaaacggaccagagcuauu

SEQ ID NO: 114590 - RNA, 22 nt, Human
aucugugauuuuggcaagauuu

SEQ ID NO: 114591 - RNA, 22 nt, Human
aucuguggguaaggauaagcau

SEQ ID NO: 114592 - RNA, 22 nt, Human
aucuucuuucaucagccccuca

SEQ ID NO: 114593 - RNA, 22 nt, Human
aucuauguaucucagaagcuag

SEQ ID NO: 114594 - RNA, 19 nt, Human
aucuuucagcagcuccccu

SEQ ID NO: 114595 - RNA, 22 nt, Human
aucuuugccuuuaugccucuag

SEQ ID NO: 114596 - RNA, 22 nt, Human
aucguuaugauagagaaagaga

SEQ ID NO: 114597 - RNA, 22 nt, Human
aucggggaaugaccuuuucauu

SEQ ID NO: 114598 - RNA, 22 nt, Human
aucuuagagagucguguuuugu

SEQ ID NO: 114599 - RNA, 22 nt, Human
aucuguucuucaaaauauuaca

SEQ ID NO: 114600 - RNA, 22 nt, Human
aucuucaggggcaauggagaua

SEQ ID NO: 114601 - RNA, 22 nt, Human
aucuuaguuauuuggagaaacc

SEQ ID NO: 114602 - RNA, 22 nt, Human
aucuaaucugccuuccuaaucu

SEQ ID NO: 114603 - RNA, 22 nt, Human
auacacuucauguuuucaucug

SEQ ID NO: 114604 - RNA, 22 nt, Human
auacaauugcaauggaagauga

SEQ ID NO: 114605 - RNA, 22 nt, Human
auacuaagcucauuacauuuug

SEQ ID NO: 114606 - RNA, 20 nt, Human
auccuggucuuuggaagcuu

SEQ ID NO: 114607 - RNA, 22 nt, Human
aucgcagaguggaaauugauga

SEQ ID NO: 114608 - RNA, 18 nt, Human
auccuuugaucaucuguc

SEQ ID NO: 114609 - RNA, 22 nt, Human
aucugcauguggcagguggauu

SEQ ID NO: 114610 - RNA, 22 nt, Human
aucucuguaaaccauaaauuga

SEQ ID NO: 114611 - RNA, 20 nt, Human
aucugugaugagaacgguuu

SEQ ID NO: 114612 - RNA, 22 nt, Human
cagcuguauuucucugguuaga

SEQ ID NO: 114613 - RNA, 22 nt, Human
caggguuuuauuuggcuuuaaa

SEQ ID NO: 114614 - RNA, 22 nt, Human
caggauuuaauaagauaguguu

SEQ ID NO: 114615 - RNA, 19 nt, Human
caggauuguuuaaagcuuu

SEQ ID NO: 114616 - RNA, 22 nt, Human
caggaggaggccgggaggaagc

SEQ ID NO: 114617 - RNA, 22 nt, Human
cagggagcggggagaucucggg

SEQ ID NO: 114618 - RNA, 22 nt, Human
caggaaaauaauggugauggga

SEQ ID NO: 114619 - RNA, 22 nt, Human
cagaggauggaaaugagaacaa

SEQ ID NO: 114620 - RNA, 20 nt, Human
cagagccaggguuuuguuuu

SEQ ID NO: 114621 - RNA, 22 nt, Human
cauaagaauauuuaguggcagc

SEQ ID NO: 114622 - RNA, 22 nt, Human
cauaaauuuuaccuuguaagug

SEQ ID NO: 114623 - RNA, 22 nt, Human
cauaacuugguguuggaaacug

SEQ ID NO: 114624 - RNA, 22 nt, Human
cauaggaaauugcuguuaugga

SEQ ID NO: 114625 - RNA, 22 nt, Human
cauaucuuaaacaucaucucug

SEQ ID NO: 114626 - RNA, 22 nt, Human
cauaguuuguucuuuuuuauug

SEQ ID NO: 114627 - RNA, 22 nt, Human
caguggagaccugccugcugga

SEQ ID NO: 114628 - RNA, 22 nt, Human
caguucaagauuguugcuuucu

SEQ ID NO: 114629 - RNA, 21 nt, Human
caguuugcuauuuuaguauga

SEQ ID NO: 114630 - RNA, 22 nt, Human
caggguugaugaauugucugua

SEQ ID NO: 114631 - RNA, 22 nt, Human
caggguuuuaguugcagguuau

SEQ ID NO: 114632 - RNA, 22 nt, Human
cagguuuuuauuacaacuuuga

SEQ ID NO: 114633 - RNA, 22 nt, Human
caggagaaauucacauuaguga

SEQ ID NO: 114634 - RNA, 22 nt, Human
caggaacucuucugggugcuug

SEQ ID NO: 114635 - RNA, 22 nt, Human
caggaacucggagcccaucucu

SEQ ID NO: 114636 - RNA, 22 nt, Human
cacuuaaaauucagggcuuaua

SEQ ID NO: 114637 - RNA, 22 nt, Human
cacuugagagcugaagaagucu

SEQ ID NO: 114638 - RNA, 22 nt, Human
cacuugauugucagaaaaaugg

SEQ ID NO: 114639 - RNA, 22 nt, Human
cagaaaguauguucuaguaguu

SEQ ID NO: 114640 - RNA, 22 nt, Human
cagaacugaauaaagccaggau

SEQ ID NO: 114641 - RNA, 21 nt, Human
cagcagaaaugagaggagaaa

SEQ ID NO: 114642 - RNA, 22 nt, Human
cagagagcguccauccggugcc

SEQ ID NO: 114643 - RNA, 22 nt, Human
cagacaaauccuuaugagacug

SEQ ID NO: 114644 - RNA, 22 nt, Human
cagcauugagcacagaaggaaa

SEQ ID NO: 114645 - RNA, 22 nt, Human
cagccauucuaacacugccagu

SEQ ID NO: 114646 - RNA, 22 nt, Human
caccaucagacuucugggcagg

SEQ ID NO: 114647 - RNA, 22 nt, Human
cagaaagugauuugcuauucca

SEQ ID NO: 114648 - RNA, 22 nt, Human
cagaaauuggcagagaagaccu

SEQ ID NO: 114649 - RNA, 22 nt, Human
cagaaguugcuugagagagagc

SEQ ID NO: 114650 - RNA, 22 nt, Human
cacauugguagaauuuagaaga

SEQ ID NO: 114651 - RNA, 22 nt, Human
cacauuuuccagaagaaucaga

SEQ ID NO: 114652 - RNA, 22 nt, Human
cacauuaagcccaagcauagaa

SEQ ID NO: 114653 - RNA, 22 nt, Human
cagaaaacauuguguguauaag

SEQ ID NO: 114654 - RNA, 22 nt, Human
cagaaacacuguauuuagggaa

SEQ ID NO: 114655 - RNA, 22 nt, Human
cacauaguuuaucuucauuuuc

SEQ ID NO: 114656 - RNA, 22 nt, Human
cacuuuuucccccuggugucau

SEQ ID NO: 114657 - RNA, 22 nt, Human
cacaguuuuaucuuauacugau

SEQ ID NO: 114658 - RNA, 22 nt, Human
cacagucugagcccagccuugu

SEQ ID NO: 114659 - RNA, 22 nt, Human
cacagaauuaagggagaaauau

SEQ ID NO: 114660 - RNA, 21 nt, Human
cacuguauagcaggagaaaac

SEQ ID NO: 114661 - RNA, 22 nt, Human
cacuauaaugugauuucgcccu

SEQ ID NO: 114662 - RNA, 22 nt, Human
caagcagauauuuuagucaaga

SEQ ID NO: 114663 - RNA, 22 nt, Human
caaaagcaaagaucuuugauug

SEQ ID NO: 114664 - RNA, 22 nt, Human
caaagaaccuucgagacagggc

SEQ ID NO: 114665 - RNA, 22 nt, Human
cauuuacauaacaguaacgcug

SEQ ID NO: 114666 - RNA, 22 nt, Human
cauuuaaccccuugguacugaa

SEQ ID NO: 114667 - RNA, 22 nt, Human
cauuggcacauguauucugggc

SEQ ID NO: 114668 - RNA, 22 nt, Human
cauuugcuuaucacucuucuuu

SEQ ID NO: 114669 - RNA, 22 nt, Human
cauuucuugugagccgcauccu

SEQ ID NO: 114670 - RNA, 22 nt, Human
cauugcaaccauuccaaauggc

SEQ ID NO: 114671 - RNA, 20 nt, Human
cauuccaugcaucuuggucc

SEQ ID NO: 114672 - RNA, 22 nt, Human
cauucauagaaucaguuuggga

SEQ ID NO: 114673 - RNA, 22 nt, Human
cauucauaagacuuugcucuug

SEQ ID NO: 114674 - RNA, 22 nt, Human
caucaacagucuacuuuuugcc

SEQ ID NO: 114675 - RNA, 21 nt, Human
caucaagaucaauggagggcu

SEQ ID NO: 114676 - RNA, 22 nt, Human
caucacggagcaugagaagaca

SEQ ID NO: 114677 - RNA, 22 nt, Human
caucaauagguauuugagagac

SEQ ID NO: 114678 - RNA, 22 nt, Human
cagguuuuccuuuuaaaaggaa

SEQ ID NO: 114679 - RNA, 22 nt, Human
cauuauucaggcuuuggaauuu

SEQ ID NO: 114680 - RNA, 22 nt, Human
cauuacaagaaauagcauaaug

SEQ ID NO: 114681 - RNA, 22 nt, Human
cauguguauuauucuuguggaa

SEQ ID NO: 114682 - RNA, 22 nt, Human
cauuccaagaaguaguucugca

SEQ ID NO: 114683 - RNA, 22 nt, Human
cauuccaaguauauacaugaua

SEQ ID NO: 114684 - RNA, 22 nt, Human
ccaaucaacuguguggcuuucu

SEQ ID NO: 114685 - RNA, 21 nt, Human
ccacaauucuaguuacauaug

SEQ ID NO: 114686 - RNA, 22 nt, Human
caugcuucccacauuccgauuu

SEQ ID NO: 114687 - RNA, 22 nt, Human
cauuuugguccucauguguagc

SEQ ID NO: 114688 - RNA, 22 nt, Human
cauuuugguaauguucguuugc

SEQ ID NO: 114689 - RNA, 22 nt, Human
caugauucccacauugcgauca

SEQ ID NO: 114690 - RNA, 22 nt, Human
ccaaaauauuagugcuuaagua

SEQ ID NO: 114691 - RNA, 22 nt, Human
ccaaagaauuuggaaaaucuga

SEQ ID NO: 114692 - RNA, 22 nt, Human
ccagaacgacgggcagaggcgc

SEQ ID NO: 114693 - RNA, 22 nt, Human
ccaguuuuuccagugcuuucug

SEQ ID NO: 114694 - RNA, 22 nt, Human
ccaguuguggagaauuguuuga

SEQ ID NO: 114695 - RNA, 19 nt, Human
ccaguuuuuuaauauucaa

SEQ ID NO: 114696 - RNA, 22 nt, Human
ccaauuuuggaauuauuaggca

SEQ ID NO: 114697 - RNA, 22 nt, Human
ccaaauuaccuucuuggauuca

SEQ ID NO: 114698 - RNA, 22 nt, Human
ccaaauuguuguuguuguuguu

SEQ ID NO: 114699 - RNA, 22 nt, Human
ccaaccaaagggccuaaggucu

SEQ ID NO: 114700 - RNA, 22 nt, Human
cauuuuuuuuccccuccuggua

SEQ ID NO: 114701 - RNA, 22 nt, Human
cauuuuuccucaggcaauuuga

SEQ ID NO: 114702 - RNA, 22 nt, Human
ccaaacauuucaaauuuagaga

SEQ ID NO: 114703 - RNA, 22 nt, Human
ccaaagaagcaaugagaauagu

SEQ ID NO: 114704 - RNA, 23 nt, Human
cauuugauccucacaauaaaugg

SEQ ID NO: 114705 - RNA, 22 nt, Human
cauuuucugcaagucugcucaa

SEQ ID NO: 114706 - RNA, 22 nt, Human
cauuuuaucagcacacgucacu

SEQ ID NO: 114707 - RNA, 22 nt, Human
cauuuuccucugcugguguuca

SEQ ID NO: 114708 - RNA, 22 nt, Human
cauuucaaacaguuacagcugc

SEQ ID NO: 114709 - RNA, 22 nt, Human
ccagcagaagcucccgcugggu

SEQ ID NO: 114710 - RNA, 22 nt, Human
cauuuaucacuugcuaaacaua

SEQ ID NO: 114711 - RNA, 22 nt, Human
cauuuagagaagauuacaagga

SEQ ID NO: 114712 - RNA, 18 nt, Human
cauuguacaaugcuuuau

SEQ ID NO: 114713 - RNA, 22 nt, Human
cauuccuucucagguacuggca

SEQ ID NO: 114714 - RNA, 22 nt, Human
cauugcaaccccaaaaagaaca

SEQ ID NO: 114715 - RNA, 19 nt, Human
ccagaagggcaagcaaagg

SEQ ID NO: 114716 - RNA, 22 nt, Human
ccuuuccucuucaugacuuucu

SEQ ID NO: 114717 - RNA, 17 nt, Human
ccuuucugaucaucuga

SEQ ID NO: 114718 - RNA, 22 nt, Human
ccuugugauugaucuaaguugc

SEQ ID NO: 114719 - RNA, 22 nt, Human
ccuuucuaacagauuguggauc

SEQ ID NO: 114720 - RNA, 22 nt, Human
ccggauuugggagccaccaggg

SEQ ID NO: 114721 - RNA, 22 nt, Human
ccuuuuagagaagugcauccag

SEQ ID NO: 114722 - RNA, 22 nt, Human
ccuuuuaucgcgaagaacucca

SEQ ID NO: 114723 - RNA, 22 nt, Human
ccuuuuaagggagacuagagau

SEQ ID NO: 114724 - RNA, 22 nt, Human
ccuuagaaaaucauggaauauu

SEQ ID NO: 114725 - RNA, 22 nt, Human
ccugaguucuuauuuccaguca

SEQ ID NO: 114726 - RNA, 18 nt, Human
cgauguguaugugauuug

SEQ ID NO: 114727 - RNA, 22 nt, Human
cgaguaauuggaaauuugcuau

SEQ ID NO: 114728 - RNA, 22 nt, Human
cgaaggaaucacuuaacacuuu

SEQ ID NO: 114729 - RNA, 20 nt, Human
ccucauucucgcguguguuu

SEQ ID NO: 114730 - RNA, 22 nt, Human
ccuuuuguuucccuuuauguuc

SEQ ID NO: 114731 - RNA, 22 nt, Human
ccuaacaugguuauuguuaauu

SEQ ID NO: 114732 - RNA, 22 nt, Human
ccuaauuuuagacccacuccua

SEQ ID NO: 114733 - RNA, 22 nt, Human
ccuuuuuagaugugcgaauguu

SEQ ID NO: 114734 - RNA, 20 nt, Human
ccucaaccuccuuucucucc

SEQ ID NO: 114735 - RNA, 22 nt, Human
cgaaaaagaagugcaccauguu

SEQ ID NO: 114736 - RNA, 22 nt, Human
cgugaucuguuauauagugagc

SEQ ID NO: 114737 - RNA, 22 nt, Human
ccuuucucuuggauaccgauug

SEQ ID NO: 114738 - RNA, 22 nt, Human
ccuuugcugggccucuccaucu

SEQ ID NO: 114739 - RNA, 22 nt, Human
ccuucucuucuuggaaggaacu

SEQ ID NO: 114740 - RNA, 22 nt, Human
cuagaaaguaugcuuuuauaau

SEQ ID NO: 114741 - RNA, 22 nt, Human
cuacugacugaccauaguuuca

SEQ ID NO: 114742 - RNA, 22 nt, Human
cuacuuucuucuucagaauugu

SEQ ID NO: 114743 - RNA, 22 nt, Human
cuacugaagcaugcuuauaugu

SEQ ID NO: 114744 - RNA, 22 nt, Human
cuacuucuguggcucuaagaga

SEQ ID NO: 114745 - RNA, 22 nt, Human
cuacuguaguuaaaguuuugua

SEQ ID NO: 114746 - RNA, 22 nt, Human
cuaaagucauacaaggugggag

SEQ ID NO: 114747 - RNA, 22 nt, Human
cgagggcuggaggggagacaga

SEQ ID NO: 114748 - RNA, 22 nt, Human
cgagguuuaugaguuuguguuc

SEQ ID NO: 114749 - RNA, 22 nt, Human
cuaacuuugucuugguaauugc

SEQ ID NO: 114750 - RNA, 22 nt, Human
cuacauuuacacaguuaggcuu

SEQ ID NO: 114751 - RNA, 18 nt, Human
cuacauucauaggaaagg

SEQ ID NO: 114752 - RNA, 22 nt, Human
cuacauaaauuuaucacagacu

SEQ ID NO: 114753 - RNA, 22 nt, Human
cuaaauguuuuaucuuccuggc

SEQ ID NO: 114754 - RNA, 22 nt, Human
cuaaagacagcaagacaucauc

SEQ ID NO: 114755 - RNA, 22 nt, Human
cuaaacuucauauguugcuuua

SEQ ID NO: 114756 - RNA, 22 nt, Human
cucucuguuaugcuuucaugaa

SEQ ID NO: 114757 - RNA, 22 nt, Human
cucucuuuuuuucccuuguuaa

SEQ ID NO: 114758 - RNA, 22 nt, Human
cggagggcccucaggacugggu

SEQ ID NO: 114759 - RNA, 22 nt, Human
cuccuauugaucaguacuauuu

SEQ ID NO: 114760 - RNA, 22 nt, Human
cucaucuucuuccuucuuuucc

SEQ ID NO: 114761 - RNA, 22 nt, Human
cucaaaauccauaaaaucaggu

SEQ ID NO: 114762 - RNA, 22 nt, Human
cucaauuguuuggucucugguu

SEQ ID NO: 114763 - RNA, 22 nt, Human
cucaaugagcuauuuguuucau

SEQ ID NO: 114764 - RNA, 22 nt, Human
cucagcaacccacacacggucu

SEQ ID NO: 114765 - RNA, 22 nt, Human
cuauguuucagauauauauaua

SEQ ID NO: 114766 - RNA, 22 nt, Human
cgucauuuguaaaugaucaaga

SEQ ID NO: 114767 - RNA, 22 nt, Human
cugaugucaaauuuaucaaagc

SEQ ID NO: 114768 - RNA, 22 nt, Human
cgugaaaugcagaaaguugugg

SEQ ID NO: 114769 - RNA, 22 nt, Human
cugaucuuaaguaacauuauuu

SEQ ID NO: 114770 - RNA, 22 nt, Human
cugauagagcauuagugugaga

SEQ ID NO: 114771 - RNA, 22 nt, Human
cugcagauaaguguuuugaaaa

SEQ ID NO: 114772 - RNA, 22 nt, Human
cuaaaaauguucuaguaguuca

SEQ ID NO: 114773 - RNA, 22 nt, Human
cuaaacacuauucuggaaauag

SEQ ID NO: 114774 - RNA, 16 nt, Human
cuaaaaugucuacuug

SEQ ID NO: 114775 - RNA, 22 nt, Human
cuaaaacuuuuccaaauuaugu

SEQ ID NO: 114776 - RNA, 20 nt, Human
cuaaaacaggugucuaguga

SEQ ID NO: 114777 - RNA, 22 nt, Human
cuaaaccaauauauuuucuucc

SEQ ID NO: 114778 - RNA, 22 nt, Human
cuaaauucuauauccuugcuuc

SEQ ID NO: 114779 - RNA, 22 nt, Human
cugauuguagccacugugauga

SEQ ID NO: 114780 - RNA, 22 nt, Human
cugauguuuaucucaagaguuc

SEQ ID NO: 114781 - RNA, 20 nt, Human
cugauguucgugcuuccugg

SEQ ID NO: 114782 - RNA, 22 nt, Human
cugcagagaccuaggucagguu

SEQ ID NO: 114783 - RNA, 22 nt, Human
cugauuucaaauggugcuagau

SEQ ID NO: 114784 - RNA, 17 nt, Human
cguuccagaacaaauga

SEQ ID NO: 114785 - RNA, 22 nt, Human
cuauaauuguacuuguuuuuua

SEQ ID NO: 114786 - RNA, 21 nt, Human
cuauaaaaaugguucuuugcg

SEQ ID NO: 114787 - RNA, 22 nt, Human
cuaguuuuaagcuccuugaggu

SEQ ID NO: 114788 - RNA, 22 nt, Human
cugcuauaacacuaacaucuaa

SEQ ID NO: 114789 - RNA, 22 nt, Human
cuagcaggacucagcagauauu

SEQ ID NO: 114790 - RNA, 22 nt, Human
cuagagaaaaagcuuagguacg

SEQ ID NO: 114791 - RNA, 22 nt, Human
cuaagaaggaggaaaagugcca

SEQ ID NO: 114792 - RNA, 22 nt, Human
cuaaauuuuuuagugaaauagg

SEQ ID NO: 114793 - RNA, 22 nt, Human
cuuacauuuguuuaguguuucc

SEQ ID NO: 114794 - RNA, 22 nt, Human
cuuacaauuuucuuggacuuuu

SEQ ID NO: 114795 - RNA, 22 nt, Human
cuguuuggcuuccacugcuucu

SEQ ID NO: 114796 - RNA, 22 nt, Human
cuguuuuugccugugacaaaaa

SEQ ID NO: 114797 - RNA, 22 nt, Human
cuguuguucacuuugcugguga

SEQ ID NO: 114798 - RNA, 22 nt, Human
cugaaagacagccaggcaaagc

SEQ ID NO: 114799 - RNA, 22 nt, Human
cugaaagcaaaguaauucuuaa

SEQ ID NO: 114800 - RNA, 20 nt, Human
cugaaaggaaagaaauuuuu

SEQ ID NO: 114801 - RNA, 23 nt, Human
cugaaauucagaugcuaaagaua

SEQ ID NO: 114802 - RNA, 22 nt, Human
cugaaacucaagauaggaggaa

SEQ ID NO: 114803 - RNA, 21 nt, Human
cugugggaaggccugaggucu

SEQ ID NO: 114804 - RNA, 22 nt, Human
cuguguuguuugaguagcuuga

SEQ ID NO: 114805 - RNA, 22 nt, Human
cucuuuuuuugucuuaagaacc

SEQ ID NO: 114806 - RNA, 20 nt, Human
cucuuuaugagaccacuguc

SEQ ID NO: 114807 - RNA, 20 nt, Human
cucuuucugcuuuaugccuc

SEQ ID NO: 114808 - RNA, 22 nt, Human
cugguuuuccaauguuuugacu

SEQ ID NO: 114809 - RNA, 22 nt, Human
cucuuauaaagaugucucuguu

SEQ ID NO: 114810 - RNA, 22 nt, Human
cuggugggucacgugugggugg

SEQ ID NO: 114811 - RNA, 22 nt, Human
cugguuuauuucauaguuuguu

SEQ ID NO: 114812 - RNA, 22 nt, Human
cuccuuuuuauaucuuucucug

SEQ ID NO: 114813 - RNA, 22 nt, Human
cugggguuggccagggcccuag

SEQ ID NO: 114814 - RNA, 22 nt, Human
cuccuuuuccuacucauacuau

SEQ ID NO: 114815 - RNA, 22 nt, Human
cuggguuuggcugugcuugaau

SEQ ID NO: 114816 - RNA, 22 nt, Human
cucagcaauuaccugugucucu

SEQ ID NO: 114817 - RNA, 22 nt, Human
cucagugacuuccugcucaauu

SEQ ID NO: 114818 - RNA, 22 nt, Human
cuauuauuauugucguuuuaca

SEQ ID NO: 114819 - RNA, 22 nt, Human
cucaaauggguuuguagaauau

SEQ ID NO: 114820 - RNA, 22 nt, Human
cuauuuucccauaugguugaca

SEQ ID NO: 114821 - RNA, 22 nt, Human
cucaauuuuuauugcuuuuuug

SEQ ID NO: 114822 - RNA, 22 nt, Human
cugcuuuggaucucucucugcc

SEQ ID NO: 114823 - RNA, 22 nt, Human
gaaaauaguucaucacaaugau

SEQ ID NO: 114824 - RNA, 22 nt, Human
gaaaaucaugaaaguguguugu

SEQ ID NO: 114825 - RNA, 22 nt, Human
cugguuacuucagaucaguagu

SEQ ID NO: 114826 - RNA, 22 nt, Human
gaaaagaaaggaugguaugugu

SEQ ID NO: 114827 - RNA, 22 nt, Human
cuguuaauugugaauuuuacau

SEQ ID NO: 114828 - RNA, 22 nt, Human
gaacauuucugcagaugucuga

SEQ ID NO: 114829 - RNA, 22 nt, Human
gaagaagagauaauggggagca

SEQ ID NO: 114830 - RNA, 22 nt, Human
gaacuuaauauacaaucaguuc

SEQ ID NO: 114831 - RNA, 22 nt, Human
gaacuugagugugcuauuucuu

SEQ ID NO: 114832 - RNA, 22 nt, Human
cugugguuucuaugggccuuga

SEQ ID NO: 114833 - RNA, 22 nt, Human
gaaauguacuuauagggagguu

SEQ ID NO: 114834 - RNA, 22 nt, Human
gaaagaggcugucagggaaugg

SEQ ID NO: 114835 - RNA, 22 nt, Human
gaaacauuuguugaguacuugc

SEQ ID NO: 114836 - RNA, 22 nt, Human
gaaaaauggguuguuugaagau

SEQ ID NO: 114837 - RNA, 22 nt, Human
gaaaaagagaaggaguucagua

SEQ ID NO: 114838 - RNA, 22 nt, Human
cuuuuggcaucagccucaggaa

SEQ ID NO: 114839 - RNA, 22 nt, Human
cugggacacguugugcuuuaac

SEQ ID NO: 114840 - RNA, 20 nt, Human
cuuauuuuggagaacuuuuc

SEQ ID NO: 114841 - RNA, 22 nt, Human
cugaucccuuuucauuugcagg

SEQ ID NO: 114842 - RNA, 22 nt, Human
cuuugcaaagagagaaaguggg

SEQ ID NO: 114843 - RNA, 22 nt, Human
cuuuucauuucauggaauacaa

SEQ ID NO: 114844 - RNA, 21 nt, Human
cuuuucuagucccagccccgc

SEQ ID NO: 114845 - RNA, 22 nt, Human
cuuuuccuccaggaagccaagc

SEQ ID NO: 114846 - RNA, 22 nt, Human
cuugguuugaaacauacucuac

SEQ ID NO: 114847 - RNA, 22 nt, Human
gacaacuucaguaaaguagauu

SEQ ID NO: 114848 - RNA, 18 nt, Human
cuuuagcugucaucuuug

SEQ ID NO: 114849 - RNA, 22 nt, Human
cuuucauuuuugggcaucugag

SEQ ID NO: 114850 - RNA, 22 nt, Human
gaaugguuagugaacaaauuug

SEQ ID NO: 114851 - RNA, 22 nt, Human
gaaugguuauaugauguuuaaa

SEQ ID NO: 114852 - RNA, 22 nt, Human
gaauguuugagugccaugugac

SEQ ID NO: 114853 - RNA, 22 nt, Human
gaauuacagaguuguuaaguca

SEQ ID NO: 114854 - RNA, 22 nt, Human
gaaguaaaacaguaacuuuguu

SEQ ID NO: 114855 - RNA, 22 nt, Human
gaauaagaauccacuucuggca

SEQ ID NO: 114856 - RNA, 22 nt, Human
cuucuaauucuuauguaagcuu

SEQ ID NO: 114857 - RNA, 22 nt, Human
cuuccuuucagaggaaggccug

SEQ ID NO: 114858 - RNA, 22 nt, Human
cuuccuaaucuuggguuauuuu

SEQ ID NO: 114859 - RNA, 22 nt, Human
gaagguuuacugaagauuuaaa

SEQ ID NO: 114860 - RNA, 22 nt, Human
gaacuuuaauuagcuuuugucu

SEQ ID NO: 114861 - RNA, 22 nt, Human
gaagauuauuacucauugcagg

SEQ ID NO: 114862 - RNA, 22 nt, Human
gaagcaagagggaucaggaucu

SEQ ID NO: 114863 - RNA, 20 nt, Human
gagaauuccagguuucugug

SEQ ID NO: 114864 - RNA, 22 nt, Human
gagaacuguguauucuuuuuca

SEQ ID NO: 114865 - RNA, 22 nt, Human
gagaacuauagaaaccuggucu

SEQ ID NO: 114866 - RNA, 22 nt, Human
gaaaacccuguauguagcguuu

SEQ ID NO: 114867 - RNA, 22 nt, Human
gagagaaggaagugaauuuccc

SEQ ID NO: 114868 - RNA, 22 nt, Human
gagagagacugggaaaucauca

SEQ ID NO: 114869 - RNA, 22 nt, Human
gagaaauagauucaugguagau

SEQ ID NO: 114870 - RNA, 22 nt, Human
gagaaagauuguccuucagggg

SEQ ID NO: 114871 - RNA, 22 nt, Human
gagaaaacauacuuaguguccu

SEQ ID NO: 114872 - RNA, 22 nt, Human
cuuuuucaugggugaugagugg

SEQ ID NO: 114873 - RNA, 22 nt, Human
cuuuuuaaaguaaauggcuaga

SEQ ID NO: 114874 - RNA, 22 nt, Human
cuuuugcaauagugacacugau

SEQ ID NO: 114875 - RNA, 22 nt, Human
cuuuuugcccuugggcuuccug

SEQ ID NO: 114876 - RNA, 22 nt, Human
gacuucaagaugaaucuuuggg

SEQ ID NO: 114877 - RNA, 22 nt, Human
cuuuuuuucuccauauuucugg

SEQ ID NO: 114878 - RNA, 22 nt, Human
cuuuuugccuugaagugaccuc

SEQ ID NO: 114879 - RNA, 22 nt, Human
gagaaaaauuucuuugcugcac

SEQ ID NO: 114880 - RNA, 22 nt, Human
gacuugauugguuugucaaguu

SEQ ID NO: 114881 - RNA, 22 nt, Human
cuuuggauuuuuugcuuuugua

SEQ ID NO: 114882 - RNA, 22 nt, Human
cuuugugcagcagaaaugugug

SEQ ID NO: 114883 - RNA, 22 nt, Human
cuuuguaaucaauaagucuuuu

SEQ ID NO: 114884 - RNA, 22 nt, Human
gacagaccucugcugacuggag

SEQ ID NO: 114885 - RNA, 22 nt, Human
gacaggaauuaucuaaaguaga

SEQ ID NO: 114886 - RNA, 22 nt, Human
gacaggcagagaggaagagaga

SEQ ID NO: 114887 - RNA, 22 nt, Human
cuuugauuucucugguccaauc

SEQ ID NO: 114888 - RNA, 22 nt, Human
cuuucuuuuugguuucccccca

SEQ ID NO: 114889 - RNA, 22 nt, Human
gagaaugagucagagcuggcug

SEQ ID NO: 114890 - RNA, 22 nt, Human
gagaaguaggaauaucaggagu

SEQ ID NO: 114891 - RNA, 22 nt, Human
gagaagguggaccugaaggagc

SEQ ID NO: 114892 - RNA, 22 nt, Human
gagaaggagcagaaaaucuccu

SEQ ID NO: 114893 - RNA, 22 nt, Human
gauauuuugugaaaaaacaacu

SEQ ID NO: 114894 - RNA, 22 nt, Human
gauccagauauuugggcuggua

SEQ ID NO: 114895 - RNA, 22 nt, Human
gauagaaagagaaucagaacuu

SEQ ID NO: 114896 - RNA, 22 nt, Human
gauacuuuguggaauccuggau

SEQ ID NO: 114897 - RNA, 22 nt, Human
gacuuguguagcuucagaauuu

SEQ ID NO: 114898 - RNA, 22 nt, Human
gauauauuucaaauucuuuugc

SEQ ID NO: 114899 - RNA, 22 nt, Human
gagaaagggagaaaaagaucuu

SEQ ID NO: 114900 - RNA, 22 nt, Human
gagaacaaggaagagucggcag

SEQ ID NO: 114901 - RNA, 22 nt, Human
gauacugugggcacucauaaua

SEQ ID NO: 114902 - RNA, 22 nt, Human
gacuugcucaaaucagauuuua

SEQ ID NO: 114903 - RNA, 22 nt, Human
gacuucaucagagcguacuguu

SEQ ID NO: 114904 - RNA, 22 nt, Human
gacuuaaaugcuccccucaggg

SEQ ID NO: 114905 - RNA, 22 nt, Human
gauaaauaguguuuggggacau

SEQ ID NO: 114906 - RNA, 21 nt, Human
gacuacaauauguaaucuaau

SEQ ID NO: 114907 - RNA, 22 nt, Human
gacuaaauaaaagccaaacuuc

SEQ ID NO: 114908 - RNA, 22 nt, Human
gacuacauuugguauugacgag

SEQ ID NO: 114909 - RNA, 22 nt, Human
gaguuucacguagaucaggguc

SEQ ID NO: 114910 - RNA, 22 nt, Human
gaguauucuauguauauuauug

SEQ ID NO: 114911 - RNA, 22 nt, Human
gaguauuuaccacuaaaugguu

SEQ ID NO: 114912 - RNA, 20 nt, Human
gacgaacuagaacaguggua

SEQ ID NO: 114913 - RNA, 22 nt, Human
gaccuuucccuaucucacucuc

SEQ ID NO: 114914 - RNA, 22 nt, Human
gagucuacaugcaggcaauugu

SEQ ID NO: 114915 - RNA, 22 nt, Human
gagucuuuuaagaugucuuacu

SEQ ID NO: 114916 - RNA, 22 nt, Human
gaguauuacuaaaauucgccua

SEQ ID NO: 114917 - RNA, 22 nt, Human
gaguaucagauuggaguccuca

SEQ ID NO: 114918 - RNA, 22 nt, Human
gaguagaacagauagucaagaa

SEQ ID NO: 114919 - RNA, 22 nt, Human
gacauuuauuggauuuuacgag

SEQ ID NO: 114920 - RNA, 22 nt, Human
gaccagaacuucuagucuaagu

SEQ ID NO: 114921 - RNA, 22 nt, Human
gaguaauuuucuuaaaacauca

SEQ ID NO: 114922 - RNA, 22 nt, Human
gaggucagugugggggcaaggg

SEQ ID NO: 114923 - RNA, 22 nt, Human
gacacaacuauccaguauggga

SEQ ID NO: 114924 - RNA, 22 nt, Human
gacaauuucucaauauagaaac

SEQ ID NO: 114925 - RNA, 22 nt, Human
gagggguuguuaacaaagaaua

SEQ ID NO: 114926 - RNA, 19 nt, Human
gaguaaaacuagagagaaa

SEQ ID NO: 114927 - RNA, 22 nt, Human
gagguuuaguccauaguauuua

SEQ ID NO: 114928 - RNA, 22 nt, Human
gaggggcucuugggcaugaagg

SEQ ID NO: 114929 - RNA, 22 nt, Human
gaauuagguaauagaacuagua

SEQ ID NO: 114930 - RNA, 22 nt, Human
gaauuccaggugagagaaggua

SEQ ID NO: 114931 - RNA, 20 nt, Human
gaauucugaagauaauuugg

SEQ ID NO: 114932 - RNA, 16 nt, Human
gaauuccauugcucug

SEQ ID NO: 114933 - RNA, 22 nt, Human
gaauuagacggcaucacauggg

SEQ ID NO: 114934 - RNA, 22 nt, Human
gagggcugccacguugggcgag

SEQ ID NO: 114935 - RNA, 22 nt, Human
gaauggcagaaugaagcagugu

SEQ ID NO: 114936 - RNA, 22 nt, Human
gagggauuuuagugcagcaacu

SEQ ID NO: 114937 - RNA, 22 nt, Human
gaaguucuuagucucauuugca

SEQ ID NO: 114938 - RNA, 22 nt, Human
gaauacaaauaauaccaaggug

SEQ ID NO: 114939 - RNA, 22 nt, Human
gaauaccauuuacauuugaaaa

SEQ ID NO: 114940 - RNA, 22 nt, Human
gaauacaagccugccaccugga

SEQ ID NO: 114941 - RNA, 22 nt, Human
gaauauuuaucucagcugcaga

SEQ ID NO: 114942 - RNA, 22 nt, Human
gaauggaacauagcaacaucuu

SEQ ID NO: 114943 - RNA, 22 nt, Human
gaagguuuuguuugcaaaucau

SEQ ID NO: 114944 - RNA, 22 nt, Human
gaggagcaggcaggaucugguc

SEQ ID NO: 114945 - RNA, 22 nt, Human
gaggaaaauggaguguaauuaa

SEQ ID NO: 114946 - RNA, 22 nt, Human
gaaggaaaagacgugcuaagua

SEQ ID NO: 114947 - RNA, 22 nt, Human
gagcggcucaguggccauguga

SEQ ID NO: 114948 - RNA, 22 nt, Human
gagcguuucccugggggucugc

SEQ ID NO: 114949 - RNA, 22 nt, Human
gagcuaagcccuggagaggucg

SEQ ID NO: 114950 - RNA, 22 nt, Human
gaagcucaguugcuuagaucuc

SEQ ID NO: 114951 - RNA, 22 nt, Human
gaagcuucgaaagagugauuuc

SEQ ID NO: 114952 - RNA, 22 nt, Human
gaagccaacacgugggagggag

SEQ ID NO: 114953 - RNA, 22 nt, Human
gaaaaucaggauggaugugagg

SEQ ID NO: 114954 - RNA, 22 nt, Human
gaaaaguuuaaccuuguacauu

SEQ ID NO: 114955 - RNA, 21 nt, Human
gaaaaucuaaugugacaaugc

SEQ ID NO: 114956 - RNA, 22 nt, Human
gaagauucugacccugacucag

SEQ ID NO: 114957 - RNA, 23 nt, Human
acuggauuguucuugggcgcuga

SEQ ID NO: 114958 - RNA, 22 nt, Human
acuugaagcaugaaaauaagcc

SEQ ID NO: 114959 - RNA, 22 nt, Human
acuucauuugaaaugguugaau

SEQ ID NO: 114960 - RNA, 22 nt, Human
acuuacuuucuauucuuguagg

SEQ ID NO: 114961 - RNA, 22 nt, Human
acuuagaacagccuaugggaag

SEQ ID NO: 114962 - RNA, 22 nt, Human
acuugcauuguguaguguuuuu

SEQ ID NO: 114963 - RNA, 22 nt, Human
acuugcaucuuagagacucacc

SEQ ID NO: 114964 - RNA, 22 nt, Human
acuuguaaaauagagauaggga

SEQ ID NO: 114965 - RNA, 22 nt, Human
acuugggaaaugaaaauacaga

SEQ ID NO: 114966 - RNA, 22 nt, Human
acuuugaauuagaauuuugcug

SEQ ID NO: 114967 - RNA, 23 nt, Human
acuuugaggagaagaaugucagu

SEQ ID NO: 114968 - RNA, 22 nt, Human
acuuguuuacaagcaguucuga

SEQ ID NO: 114969 - RNA, 22 nt, Human
acuuuauacuagugauaguuug

SEQ ID NO: 114970 - RNA, 22 nt, Human
acuuuaaauaucauuugguagg

SEQ ID NO: 114971 - RNA, 20 nt, Human
acuuucacaugaacauuuaa

SEQ ID NO: 114972 - RNA, 22 nt, Human
acuuuuaauaguagauuuuuaa

SEQ ID NO: 114973 - RNA, 22 nt, Human
agaaaagaggcuuucuaagcau

SEQ ID NO: 114974 - RNA, 19 nt, Human
agaaauagccuuccuuguc

SEQ ID NO: 114975 - RNA, 22 nt, Human
agaaauggccagacuugccccu

SEQ ID NO: 114976 - RNA, 20 nt, Human
agaaaggaguaaagaagaga

SEQ ID NO: 114977 - RNA, 22 nt, Human
agaaacaagcccuagaaguccu

SEQ ID NO: 114978 - RNA, 22 nt, Human
agacaagagcugaggacauauu

SEQ ID NO: 114979 - RNA, 22 nt, Human
agacaaucaacuguugaugccu

SEQ ID NO: 114980 - RNA, 22 nt, Human
agacaauuccauccuacguggg

SEQ ID NO: 114981 - RNA, 22 nt, Human
agaauuuguaucuacggugugc

SEQ ID NO: 114982 - RNA, 22 nt, Human
agaaugucaagucaagaacaau

SEQ ID NO: 114983 - RNA, 22 nt, Human
agaauauaguaaauauuuucua

SEQ ID NO: 114984 - RNA, 22 nt, Human
agaaguagacaguuggauauaa

SEQ ID NO: 114985 - RNA, 22 nt, Human
agaaguuuguuauguaaacaaa

SEQ ID NO: 114986 - RNA, 22 nt, Human
agaauaagucuaauauauuggu

SEQ ID NO: 114987 - RNA, 22 nt, Human
agaauccucuagggauggcagg

SEQ ID NO: 114988 - RNA, 22 nt, Human
agaagggcugcuuagaauauac

SEQ ID NO: 114989 - RNA, 22 nt, Human
agaauguaagaaugcaaagauu

SEQ ID NO: 114990 - RNA, 22 nt, Human
agaagggaagcaggagaggcau

SEQ ID NO: 114991 - RNA, 22 nt, Human
agaagcagaaggaagcagggcc

SEQ ID NO: 114992 - RNA, 22 nt, Human
agaauacaauuguucaguaaua

SEQ ID NO: 114993 - RNA, 22 nt, Human
agaauacuaauaagggauuugc

SEQ ID NO: 114994 - RNA, 22 nt, Human
agaaggcaucugcucgcuucca

SEQ ID NO: 114995 - RNA, 22 nt, Human
agaaaaggaagcuuagacugua

SEQ ID NO: 114996 - RNA, 22 nt, Human
agaaaauagguaguagacgggc

SEQ ID NO: 114997 - RNA, 22 nt, Human
agaagauucagcaguagggugg

SEQ ID NO: 114998 - RNA, 22 nt, Human
agaagguagaugcaucaggagg

SEQ ID NO: 114999 - RNA, 16 nt, Human
agaaggcuaguaacag

SEQ ID NO: 115000 - RNA, 22 nt, Human
acugcauuucauaaauuacaau

SEQ ID NO: 115001 - RNA, 22 nt, Human
acugauuccaagcuuguggagg

SEQ ID NO: 115002 - RNA, 22 nt, Human
acugaaggcuggaccaugcauc

SEQ ID NO: 115003 - RNA, 18 nt, Human
acucuuccuuauguucuu

SEQ ID NO: 115004 - RNA, 22 nt, Human
acucuugacuaaugcuaauguc

SEQ ID NO: 115005 - RNA, 22 nt, Human
acucuguaauucugaagcaccu

SEQ ID NO: 115006 - RNA, 22 nt, Human
acugaauguucucaaaggggag

SEQ ID NO: 115007 - RNA, 22 nt, Human
acugaaaguugaugagucacug

SEQ ID NO: 115008 - RNA, 22 nt, Human
acucugcaguaaggaauuguuu

SEQ ID NO: 115009 - RNA, 22 nt, Human
acucugaaaggcuacaaaugcu

SEQ ID NO: 115010 - RNA, 22 nt, Human
acucucaauuaucuggacugaa

SEQ ID NO: 115011 - RNA, 22 nt, Human
acuccuucauauuuuaauugaa

SEQ ID NO: 115012 - RNA, 22 nt, Human
acucaucauuuuacggagcagc

SEQ ID NO: 115013 - RNA, 22 nt, Human
acucauucgccuugcccaaggc

SEQ ID NO: 115014 - RNA, 22 nt, Human
acucauuuggauuuuggaguuu

SEQ ID NO: 115015 - RNA, 22 nt, Human
acucaugugacuaaaacauuaa

SEQ ID NO: 115016 - RNA, 21 nt, Human
acuccagccacugacugucuc

SEQ ID NO: 115017 - RNA, 22 nt, Human
acucaaccaucugcauuuuuga

SEQ ID NO: 115018 - RNA, 22 nt, Human
acucagcaccuagaaagugugc

SEQ ID NO: 115019 - RNA, 22 nt, Human
acucaguuuugaucguucuuau

SEQ ID NO: 115020 - RNA, 20 nt, Human
acuagaaagucacugggggg

SEQ ID NO: 115021 - RNA, 22 nt, Human
acggugagacuggcgaaggaaa

SEQ ID NO: 115022 - RNA, 22 nt, Human
acgguuuugugagguaguacuu

SEQ ID NO: 115023 - RNA, 22 nt, Human
acuacuguaauuuauuguuaca

SEQ ID NO: 115024 - RNA, 22 nt, Human
acuagcacgccuuaccguaaga

SEQ ID NO: 115025 - RNA, 22 nt, Human
acuaucuauugucuucuucaug

SEQ ID NO: 115026 - RNA, 22 nt, Human
acuauauaaugcacacaguaua

SEQ ID NO: 115027 - RNA, 22 nt, Human
acucaguaacuguuugcugaau

SEQ ID NO: 115028 - RNA, 22 nt, Human
acucaaacuuuuuguggacauu

SEQ ID NO: 115029 - RNA, 22 nt, Human
acuauuguccgauuucuuuacu

SEQ ID NO: 115030 - RNA, 22 nt, Human
acgcuucacaggugcgcauugu

SEQ ID NO: 115031 - RNA, 22 nt, Human
acaucuucuauggagguucgga

SEQ ID NO: 115032 - RNA, 22 nt, Human
acaugacagugacuuuauaaga

SEQ ID NO: 115033 - RNA, 22 nt, Human
acauccaguaucagaagcauca

SEQ ID NO: 115034 - RNA, 22 nt, Human
acaucucacuucuuugaaggcu

SEQ ID NO: 115035 - RNA, 22 nt, Human
agaguucuauccagacucaugu

SEQ ID NO: 115036 - RNA, 22 nt, Human
agauaaacaacucuuagcuguu

SEQ ID NO: 115037 - RNA, 21 nt, Human
agaguuuucuccauuucaggc

SEQ ID NO: 115038 - RNA, 22 nt, Human
agauaagaacauuaguaagccg

SEQ ID NO: 115039 - RNA, 22 nt, Human
agauaaaucauuuauuaagcgg

SEQ ID NO: 115040 - RNA, 22 nt, Human
agauauuauuuucuauuuauca

SEQ ID NO: 115041 - RNA, 22 nt, Human
agauacaaaagauaagauuuag

SEQ ID NO: 115042 - RNA, 22 nt, Human
agauauguuaggcuuguucccu

SEQ ID NO: 115043 - RNA, 22 nt, Human
agaguucaccccacugaugagu

SEQ ID NO: 115044 - RNA, 21 nt, Human
agaguugaaggcaguaaagag

SEQ ID NO: 115045 - RNA, 22 nt, Human
agacagaaaaguugucaaucau

SEQ ID NO: 115046 - RNA, 22 nt, Human
agcaaaacuaaagacacagaca

SEQ ID NO: 115047 - RNA, 22 nt, Human
agcaaaauuccaaaaugcuaau

SEQ ID NO: 115048 - RNA, 22 nt, Human
agauguuaauaaccuuagggca

SEQ ID NO: 115049 - RNA, 22 nt, Human
agauuaagcauuauaauuauaa

SEQ ID NO: 115050 - RNA, 22 nt, Human
agauucgucuuuaauucaccau

SEQ ID NO: 115051 - RNA, 22 nt, Human
agaugguucagaauuauaaaga

SEQ ID NO: 115052 - RNA, 22 nt, Human
agauuuucuuuuccaucuuugu

SEQ ID NO: 115053 - RNA, 22 nt, Human
agauuuguauagaugugguuga

SEQ ID NO: 115054 - RNA, 22 nt, Human
agauggaguccugaagccagaa

SEQ ID NO: 115055 - RNA, 22 nt, Human
agauugaugugaccauuggaag

SEQ ID NO: 115056 - RNA, 22 nt, Human
agauuauuuaagacaggaacca

SEQ ID NO: 115057 - RNA, 21 nt, Human
agauguucaguguccuaaccc

SEQ ID NO: 115058 - RNA, 22 nt, Human
agaugaacuuuuuuaaacugga

SEQ ID NO: 115059 - RNA, 22 nt, Human
agaucauuaaccaccuguucug

SEQ ID NO: 115060 - RNA, 17 nt, Human
agaucugaaggagaaca

SEQ ID NO: 115061 - RNA, 22 nt, Human
agauccuagaugugaauagcua

SEQ ID NO: 115062 - RNA, 19 nt, Human
agaucaggauguauuuuug

SEQ ID NO: 115063 - RNA, 22 nt, Human
agauauucugccuaacagguuu

SEQ ID NO: 115064 - RNA, 22 nt, Human
agauaggccauuaagaaggaua

SEQ ID NO: 115065 - RNA, 22 nt, Human
agauacuaagccucaagagacg

SEQ ID NO: 115066 - RNA, 22 nt, Human
agcauucagacaucugauggau

SEQ ID NO: 115067 - RNA, 22 nt, Human
agcauacuaggauguuuucugg

SEQ ID NO: 115068 - RNA, 22 nt, Human
agcgacuugacagacauguccu

SEQ ID NO: 115069 - RNA, 22 nt, Human
agcaacauggaguuugugcgca

SEQ ID NO: 115070 - RNA, 22 nt, Human
agcaaaguacugagcucaaagg

SEQ ID NO: 115071 - RNA, 22 nt, Human
agcacguucuucauuacuucac

SEQ ID NO: 115072 - RNA, 22 nt, Human
agauuguaugaggacuccauga

SEQ ID NO: 115073 - RNA, 22 nt, Human
agcaauucagagcauggacuuu

SEQ ID NO: 115074 - RNA, 22 nt, Human
agcaauucugaaauuacuugac

SEQ ID NO: 115075 - RNA, 22 nt, Human
agauuuuacggaguauuagggu

SEQ ID NO: 115076 - RNA, 22 nt, Human
agauuucaauggauauugcaag

SEQ ID NO: 115077 - RNA, 22 nt, Human
agcaaagccucuuugaaaaaaa

SEQ ID NO: 115078 - RNA, 22 nt, Human
agcagauaaagguugcauuucu

SEQ ID NO: 115079 - RNA, 22 nt, Human
agcacuuuagaauuuagaguug

SEQ ID NO: 115080 - RNA, 20 nt, Human
agcauucaacuuucuauguu

SEQ ID NO: 115081 - RNA, 22 nt, Human
agcagcugagccccagcuguga

SEQ ID NO: 115082 - RNA, 22 nt, Human
aggcuccucugggggccccgga

SEQ ID NO: 115083 - RNA, 22 nt, Human
aggccgagaugacagagccacu

SEQ ID NO: 115084 - RNA, 22 nt, Human
aggcauuuucuuguuauuuuua

SEQ ID NO: 115085 - RNA, 22 nt, Human
aggcagaugggagcuggaaguu

SEQ ID NO: 115086 - RNA, 22 nt, Human
aggcagagaggucuuccuggaa

SEQ ID NO: 115087 - RNA, 20 nt, Human
aggauuauguacauggaugc

SEQ ID NO: 115088 - RNA, 22 nt, Human
aggauuagucaccauuauuauu

SEQ ID NO: 115089 - RNA, 22 nt, Human
aggagggcggggcuaaaaggga

SEQ ID NO: 115090 - RNA, 22 nt, Human
aggauugaaaaaacacauauau

SEQ ID NO: 115091 - RNA, 22 nt, Human
aggauugauggcauguuuacug

SEQ ID NO: 115092 - RNA, 22 nt, Human
aggauuuaauugcauuuuucuc

SEQ ID NO: 115093 - RNA, 22 nt, Human
aggauuuagcaugaaaugugaa

SEQ ID NO: 115094 - RNA, 22 nt, Human
aggauuuauuccagaaaugcaa

SEQ ID NO: 115095 - RNA, 22 nt, Human
aggaauuucacugcguuuuuua

SEQ ID NO: 115096 - RNA, 22 nt, Human
aggaauugucgucauguauaau

SEQ ID NO: 115097 - RNA, 22 nt, Human
aggaagaagggacagaauuuug

SEQ ID NO: 115098 - RNA, 22 nt, Human
aggaaauaguuuagucccaaaa

SEQ ID NO: 115099 - RNA, 22 nt, Human
aggacaaaggaccagaucugga

SEQ ID NO: 115100 - RNA, 22 nt, Human
aggaauuugggguuacaugaug

SEQ ID NO: 115101 - RNA, 22 nt, Human
aggaauuuuaauaugcuugucu

SEQ ID NO: 115102 - RNA, 22 nt, Human
aggagcauuuugguggguuuug

SEQ ID NO: 115103 - RNA, 22 nt, Human
aggaauguugagacauggcuaa

SEQ ID NO: 115104 - RNA, 22 nt, Human
aggaaguucuggaauuacuagg

SEQ ID NO: 115105 - RNA, 19 nt, Human
aguaaagugguggcauuuu

SEQ ID NO: 115106 - RNA, 22 nt, Human
agguuuggaaguggcgauccau

SEQ ID NO: 115107 - RNA, 22 nt, Human
aguaauaaacaacucauuuugg

SEQ ID NO: 115108 - RNA, 22 nt, Human
aguaacuuaagcaauuguguau

SEQ ID NO: 115109 - RNA, 22 nt, Human
agguuuggguucauugcuggcu

SEQ ID NO: 115110 - RNA, 22 nt, Human
agguuuggccuuggggggaguu

SEQ ID NO: 115111 - RNA, 22 nt, Human
agguuaauaugaacagcagaag

SEQ ID NO: 115112 - RNA, 22 nt, Human
agguuaugcacugcacaacccu

SEQ ID NO: 115113 - RNA, 22 nt, Human
agguuagaauauuuuuucaaga

SEQ ID NO: 115114 - RNA, 22 nt, Human
aggugauauuauguauuucuau

SEQ ID NO: 115115 - RNA, 22 nt, Human
aggugggaauaauaaucaaagc

SEQ ID NO: 115116 - RNA, 22 nt, Human
agggguuugggaaggguuaggg

SEQ ID NO: 115117 - RNA, 22 nt, Human
aggucuaaaugcugguuucacc

SEQ ID NO: 115118 - RNA, 22 nt, Human
agggcuugggggccuugaaggc

SEQ ID NO: 115119 - RNA, 22 nt, Human
agggcuucugcugcagagaccu

SEQ ID NO: 115120 - RNA, 22 nt, Human
agggcaugugaaguaaccuagg

SEQ ID NO: 115121 - RNA, 20 nt, Human
agggauuugguugguauugu

SEQ ID NO: 115122 - RNA, 20 nt, Human
agugaguuaucagcuacagu

SEQ ID NO: 115123 - RNA, 21 nt, Human
agugagauuuaugccugguuc

SEQ ID NO: 115124 - RNA, 22 nt, Human
agugagaguauuaaugugaacu

SEQ ID NO: 115125 - RNA, 22 nt, Human
aguagagacgggguuuuaguag

SEQ ID NO: 115126 - RNA, 23 nt, Human
agugaucuguguuugaagaaugc

SEQ ID NO: 115127 - RNA, 22 nt, Human
agugaugauccaaaugaauuga

SEQ ID NO: 115128 - RNA, 20 nt, Human
agugauuuguuaguacauug

SEQ ID NO: 115129 - RNA, 22 nt, Human
agugggaaagcugccuuguaga

SEQ ID NO: 115130 - RNA, 22 nt, Human
aguuauuaagaaaauuuugcca

SEQ ID NO: 115131 - RNA, 22 nt, Human
aguucaugcuuagaucucauuu

SEQ ID NO: 115132 - RNA, 22 nt, Human
aguucauccucauuuacaagga

SEQ ID NO: 115133 - RNA, 22 nt, Human
aguuauggguauguauuauaau

SEQ ID NO: 115134 - RNA, 22 nt, Human
aguuauuuuucacuauuaggcu

SEQ ID NO: 115135 - RNA, 22 nt, Human
aguucauaucuacuuuuccauc

SEQ ID NO: 115136 - RNA, 22 nt, Human
aguucaauuguuuuguaaaagu

SEQ ID NO: 115137 - RNA, 22 nt, Human
aguuaaucuuguauuaaugguu

SEQ ID NO: 115138 - RNA, 22 nt, Human
aguguuuuaugugccaguuuaa

SEQ ID NO: 115139 - RNA, 22 nt, Human
aguguuuuaagaaaguaauuuu

SEQ ID NO: 115140 - RNA, 22 nt, Human
aguuaguagacuuuuccauuua

SEQ ID NO: 115141 - RNA, 22 nt, Human
aguuaauuauagugcuuaauau

SEQ ID NO: 115142 - RNA, 22 nt, Human
aguuacuauuacuuauuauuau

SEQ ID NO: 115143 - RNA, 22 nt, Human
aguuaaagggggcuacagugug

SEQ ID NO: 115144 - RNA, 22 nt, Human
aguuaacuugugguuuggcugu

SEQ ID NO: 115145 - RNA, 20 nt, Human
aguguugaacuacacuuccc

SEQ ID NO: 115146 - RNA, 22 nt, Human
aguguauuugccuauaaaaaug

SEQ ID NO: 115147 - RNA, 23 nt, Human
aguguucagcauguaguaaauac

SEQ ID NO: 115148 - RNA, 22 nt, Human
auaaaguaaugcauauaaugug

SEQ ID NO: 115149 - RNA, 22 nt, Human
auaaagggccuuauuuuagcaa

SEQ ID NO: 115150 - RNA, 22 nt, Human
auaaaaucugaagcaagaauaa

SEQ ID NO: 115151 - RNA, 22 nt, Human
auaaaagcacaauagaguuaug

SEQ ID NO: 115152 - RNA, 22 nt, Human
auaacgaaagcaauuauuuuca

SEQ ID NO: 115153 - RNA, 22 nt, Human
auaaucuuugaguagaguugag

SEQ ID NO: 115154 - RNA, 22 nt, Human
auaaguuauuuuaguaaaucag

SEQ ID NO: 115155 - RNA, 22 nt, Human
aguuuuuaacgccauguuugaa

SEQ ID NO: 115156 - RNA, 22 nt, Human
aguuuuguuuguuuguuuguua

SEQ ID NO: 115157 - RNA, 18 nt, Human
aguuuuuuuggcaaaagg

SEQ ID NO: 115158 - RNA, 22 nt, Human
auaaaacagaucaggagaauga

SEQ ID NO: 115159 - RNA, 22 nt, Human
aguuuuugccucgaauucugcg

SEQ ID NO: 115160 - RNA, 20 nt, Human
auaaauaggauuuucugaca

SEQ ID NO: 115161 - RNA, 22 nt, Human
auaaaaauguuuuuguguggua

SEQ ID NO: 115162 - RNA, 22 nt, Human
auaaauucuaugauggauuggg

SEQ ID NO: 115163 - RNA, 22 nt, Human
auaaaucaagggcaguauuucc

SEQ ID NO: 115164 - RNA, 22 nt, Human
auaaggaaagugagugcuuaaa

SEQ ID NO: 115165 - RNA, 22 nt, Human
auaaauuugacagcucuucaug

SEQ ID NO: 115166 - RNA, 22 nt, Human
auaaccaaaaauaguuuaguac

SEQ ID NO: 115167 - RNA, 22 nt, Human
auaaauuugccagcauauguuc

SEQ ID NO: 115168 - RNA, 22 nt, Human
auacaugacucacacauucugc

SEQ ID NO: 115169 - RNA, 22 nt, Human
auaccaaugacaggaguuaggg

SEQ ID NO: 115170 - RNA, 22 nt, Human
auacaaaaaguggugaguguau

SEQ ID NO: 115171 - RNA, 22 nt, Human
auaauugaauaagagcugcagg

SEQ ID NO: 115172 - RNA, 22 nt, Human
auaaucuuuccagucaguuucc

SEQ ID NO: 115173 - RNA, 23 nt, Human
auaaugauaaugcuauuuuuugu

SEQ ID NO: 115174 - RNA, 22 nt, Human
auacauaggauauguacgugca

SEQ ID NO: 115175 - RNA, 22 nt, Human
aguuguuuuucuuagauuuuag

SEQ ID NO: 115176 - RNA, 22 nt, Human
aguuuggaggagaaagugcggg

SEQ ID NO: 115177 - RNA, 22 nt, Human
aguuuacccacuguugaaauua

SEQ ID NO: 115178 - RNA, 22 nt, Human
aguuuggauccugcuaaaccag

SEQ ID NO: 115179 - RNA, 22 nt, Human
aguuuaaauuguucuaucagaa

SEQ ID NO: 115180 - RNA, 22 nt, Human
aguuucuugaagacugauguuu

SEQ ID NO: 115181 - RNA, 22 nt, Human
aguuuuugagaauucuucugaa

SEQ ID NO: 115182 - RNA, 23 nt, Human
aguuuacguauucauucuuacuc

SEQ ID NO: 115183 - RNA, 22 nt, Human
aguuuccacuggagacacugug

SEQ ID NO: 115184 - RNA, 22 nt, Human
aguuugauuugucuaucuucau

SEQ ID NO: 115185 - RNA, 22 nt, Human
aguuuguagguuaggaucagca

SEQ ID NO: 115186 - RNA, 22 nt, Human
auaaaaaguggcugcuauugga

SEQ ID NO: 115187 - RNA, 22 nt, Human
aguuuucugccucuggaugcgu

SEQ ID NO: 115188 - RNA, 22 nt, Human
aguugcuaauacaaaaaguccc

SEQ ID NO: 115189 - RNA, 22 nt, Human
aguuggaagacacccugaaauc

SEQ ID NO: 115190 - RNA, 22 nt, Human
aguugaggguuaguaaauagcu

SEQ ID NO: 115191 - RNA, 22 nt, Human
aguugcuucccuauucuuagca

SEQ ID NO: 115192 - RNA, 22 nt, Human
aguuguucucagcagaagaacu

SEQ ID NO: 115193 - RNA, 22 nt, Human
aguucucaagguuaggaaaagu

SEQ ID NO: 115194 - RNA, 22 nt, Human
aguucugacucugaaucuggga

SEQ ID NO: 115195 - RNA, 22 nt, Human
aguuccaaauuugcaagaaaau

SEQ ID NO: 115196 - RNA, 22 nt, Human
aguucuuugcucccugcuuuuu

SEQ ID NO: 115197 - RNA, 22 nt, Human
aagcaaaagguuacacuucugg

SEQ ID NO: 115198 - RNA, 22 nt, Human
aagaguggagcuggaaaguggg

SEQ ID NO: 115199 - RNA, 22 nt, Human
aagaugcuucaugagaguuggg

SEQ ID NO: 115200 - RNA, 22 nt, Human
aagauauauaaggaaguucagu

SEQ ID NO: 115201 - RNA, 22 nt, Human
aagcaaaugguauugguauuau

SEQ ID NO: 115202 - RNA, 22 nt, Human
aagauauauaacccuuucacuu

SEQ ID NO: 115203 - RNA, 22 nt, Human
aagauagaaugauguuggcuca

SEQ ID NO: 115204 - RNA, 22 nt, Human
aagaugaucagagggcaagagg

SEQ ID NO: 115205 - RNA, 22 nt, Human
aagaggauuuuaguuugccaga

SEQ ID NO: 115206 - RNA, 22 nt, Human
aagagaaaaaucuuaaucuagu

SEQ ID NO: 115207 - RNA, 22 nt, Human
aagagaaacauauggccagauu

SEQ ID NO: 115208 - RNA, 22 nt, Human
aagagaaagggaaaaugguaaa

SEQ ID NO: 115209 - RNA, 22 nt, Human
aagaaggaaggcaagagauggg

SEQ ID NO: 115210 - RNA, 22 nt, Human
aagaagagaauauauuuacguc

SEQ ID NO: 115211 - RNA, 22 nt, Human
aagacagugacagucacaauug

SEQ ID NO: 115212 - RNA, 22 nt, Human
aagaacaugggugugggcauuc

SEQ ID NO: 115213 - RNA, 22 nt, Human
aagaacaacugcuuuaaaagca

SEQ ID NO: 115214 - RNA, 22 nt, Human
aagaaauacagaaauggcagua

SEQ ID NO: 115215 - RNA, 22 nt, Human
aagaaaggcacaagaaagaaaa

SEQ ID NO: 115216 - RNA, 22 nt, Human
aagaaaagguaaccgcuuaucu

SEQ ID NO: 115217 - RNA, 22 nt, Human
aaccaauaagaggaugccauuu

SEQ ID NO: 115218 - RNA, 22 nt, Human
aagaaagaucugaaagaagcga

SEQ ID NO: 115219 - RNA, 22 nt, Human
aagaaaagcaucuuuguaguag

SEQ ID NO: 115220 - RNA, 22 nt, Human
aaggcacauauuuuagagucac

SEQ ID NO: 115221 - RNA, 22 nt, Human
aaggaugguaacaguuucauuu

SEQ ID NO: 115222 - RNA, 22 nt, Human
aaggauguuuaaacuacuuucc

SEQ ID NO: 115223 - RNA, 22 nt, Human
aaggacaaaacagcuguucuaa

SEQ ID NO: 115224 - RNA, 22 nt, Human
aagcuguuagggagugguaggu

SEQ ID NO: 115225 - RNA, 22 nt, Human
aagcuuugaauauuagaccuug

SEQ ID NO: 115226 - RNA, 22 nt, Human
aagcucuuuccacuaaaccacu

SEQ ID NO: 115227 - RNA, 22 nt, Human
aaggcgccacagugauugcaaa

SEQ ID NO: 115228 - RNA, 22 nt, Human
aaggaacuucagggcgaaugga

SEQ ID NO: 115229 - RNA, 22 nt, Human
aaggaaaguuaagguaaacucu

SEQ ID NO: 115230 - RNA, 22 nt, Human
aaggaaaaccugacugaagaac

SEQ ID NO: 115231 - RNA, 22 nt, Human
aagcauuuuagauaaagcauca

SEQ ID NO: 115232 - RNA, 22 nt, Human
aagcaaagucaucuagaguagu

SEQ ID NO: 115233 - RNA, 22 nt, Human
aagcaaaaucgcaucuggggcc

SEQ ID NO: 115234 - RNA, 22 nt, Human
aagcaggaaaugaaaugcuugc

SEQ ID NO: 115235 - RNA, 22 nt, Human
aagcaaguucuaaaguaauucu

SEQ ID NO: 115236 - RNA, 22 nt, Human
aagcaauucacaguucacuuaa

SEQ ID NO: 115237 - RNA, 22 nt, Human
aagcgcggccgccgcggucgcu

SEQ ID NO: 115238 - RNA, 22 nt, Human
aaucaucuguuguucccuugga

SEQ ID NO: 115239 - RNA, 22 nt, Human
aaucacuggcuccucacggcaa

SEQ ID NO: 115240 - RNA, 22 nt, Human
aaucacuuagaacccaggaagu

SEQ ID NO: 115241 - RNA, 19 nt, Human
aaucacaagcaauaggggu

SEQ ID NO: 115242 - RNA, 22 nt, Human
aaucaauuauccauuuguuagu

SEQ ID NO: 115243 - RNA, 22 nt, Human
aaucaaauuucuugugguuguu

SEQ ID NO: 115244 - RNA, 22 nt, Human
aauauuuugggacugaggaauu

SEQ ID NO: 115245 - RNA, 22 nt, Human
aauauuuaccuaccugucaucu

SEQ ID NO: 115246 - RNA, 22 nt, Human
aauaaggacaugaaggguccug

SEQ ID NO: 115247 - RNA, 22 nt, Human
aauagaguccuguacugaauga

SEQ ID NO: 115248 - RNA, 22 nt, Human
aauaaugguuugauucucacau

SEQ ID NO: 115249 - RNA, 22 nt, Human
aauagcaauuacccuucaacuc

SEQ ID NO: 115250 - RNA, 22 nt, Human
aauauuuaaauagaauuacauc

SEQ ID NO: 115251 - RNA, 22 nt, Human
aauaugaugccaaauugcuaca

SEQ ID NO: 115252 - RNA, 22 nt, Human
aauaucuugaguuauaaauuca

SEQ ID NO: 115253 - RNA, 22 nt, Human
aaguucuugguuaauuagggaa

SEQ ID NO: 115254 - RNA, 20 nt, Human
aaguugaaguuacuucaugg

SEQ ID NO: 115255 - RNA, 22 nt, Human
aaguucuuauguucugaugugc

SEQ ID NO: 115256 - RNA, 22 nt, Human
aaguuccuaaagucagggguca

SEQ ID NO: 115257 - RNA, 22 nt, Human
aauaagaguuaagaaguauauu

SEQ ID NO: 115258 - RNA, 22 nt, Human
aauaauacaauuggugucaugu

SEQ ID NO: 115259 - RNA, 22 nt, Human
aauaacuuacucuaugcuuagu

SEQ ID NO: 115260 - RNA, 22 nt, Human
aauaacuuaaugacuguguaca

SEQ ID NO: 115261 - RNA, 21 nt, Human
aaguuuuggcuguacaguugu

SEQ ID NO: 115262 - RNA, 16 nt, Human
aaguuuuaucuucuca

SEQ ID NO: 115263 - RNA, 21 nt, Human
aaguuucucccuaauuguugc

SEQ ID NO: 115264 - RNA, 20 nt, Human
aauaaauauaacccauaauu

SEQ ID NO: 115265 - RNA, 22 nt, Human
aagucuuugagaucggacauag

SEQ ID NO: 115266 - RNA, 22 nt, Human
aagugaagccaauuuuuuuagg

SEQ ID NO: 115267 - RNA, 22 nt, Human
aagugaaaaaagucaguacuga

SEQ ID NO: 115268 - RNA, 22 nt, Human
aagugagaugggagucagagga

SEQ ID NO: 115269 - RNA, 22 nt, Human
aagugauuuagagagcucuuag

SEQ ID NO: 115270 - RNA, 22 nt, Human
aagucauuaucucuucuaaucu

SEQ ID NO: 115271 - RNA, 22 nt, Human
aaguauuccccaaguauucugg

SEQ ID NO: 115272 - RNA, 18 nt, Human
aaguaguuugagauuguu

SEQ ID NO: 115273 - RNA, 22 nt, Human
aagggcuucucgccugugugca

SEQ ID NO: 115274 - RNA, 22 nt, Human
aaggucucucgggcuuugcuga

SEQ ID NO: 115275 - RNA, 22 nt, Human
aagcuuugggcagaagaggauu

SEQ ID NO: 115276 - RNA, 22 nt, Human
aaggaaaaaauggcuugugaua

SEQ ID NO: 115277 - RNA, 22 nt, Human
acaguuuuccuugguauagaac

SEQ ID NO: 115278 - RNA, 22 nt, Human
acaguguuacuugauaguguau

SEQ ID NO: 115279 - RNA, 22 nt, Human
acauauaugugcauacaacuau

SEQ ID NO: 115280 - RNA, 22 nt, Human
acauaaauagcacugugaauuu

SEQ ID NO: 115281 - RNA, 22 nt, Human
acauauggcagguugaucaaug

SEQ ID NO: 115282 - RNA, 22 nt, Human
acagguuucuccccugguuauu

SEQ ID NO: 115283 - RNA, 19 nt, Human
acaggaaggaaaauuucaa

SEQ ID NO: 115284 - RNA, 22 nt, Human
acagcauagaggaaauguggaa

SEQ ID NO: 115285 - RNA, 22 nt, Human
acagaucuauauuauauauaca

SEQ ID NO: 115286 - RNA, 22 nt, Human
acacuuuugcgagagcaugcag

SEQ ID NO: 115287 - RNA, 22 nt, Human
acacaagaaugugcacucagcc

SEQ ID NO: 115288 - RNA, 22 nt, Human
acacccuuuagcaauucuucaa

SEQ ID NO: 115289 - RNA, 22 nt, Human
acacaacuuuauuaauuuauac

SEQ ID NO: 115290 - RNA, 22 nt, Human
acaaucuuauuaguaguauaga

SEQ ID NO: 115291 - RNA, 22 nt, Human
acacagaguauuuagaaggggu

SEQ ID NO: 115292 - RNA, 22 nt, Human
acaauaauguuuuuagguuauu

SEQ ID NO: 115293 - RNA, 23 nt, Human
acaaguguuuccaauauggcugg

SEQ ID NO: 115294 - RNA, 22 nt, Human
acaaguuucauuguuuagaacc

SEQ ID NO: 115295 - RNA, 22 nt, Human
acaagaaaggucugggaacaau

SEQ ID NO: 115296 - RNA, 22 nt, Human
acaacuuuaauggguuucagcu

SEQ ID NO: 115297 - RNA, 22 nt, Human
aauugugagaguuagagagcau

SEQ ID NO: 115298 - RNA, 22 nt, Human
aauuggagaguugugaaaggau

SEQ ID NO: 115299 - RNA, 22 nt, Human
aauuguuagaaaugacuguuuu

SEQ ID NO: 115300 - RNA, 22 nt, Human
aauuuaaguuauugcuaaugug

SEQ ID NO: 115301 - RNA, 22 nt, Human
aauugguuugaauaaauaaaga

SEQ ID NO: 115302 - RNA, 22 nt, Human
aauuuaauugguuuuuacuugu

SEQ ID NO: 115303 - RNA, 22 nt, Human
aauuucaucugagacugggagc

SEQ ID NO: 115304 - RNA, 22 nt, Human
aauuucagaccaacgagucagg

SEQ ID NO: 115305 - RNA, 22 nt, Human
aauuuauccuuuugcuaaagca

SEQ ID NO: 115306 - RNA, 20 nt, Human
aauuuagaguuuuaccaagg

SEQ ID NO: 115307 - RNA, 22 nt, Human
aauugcuuucacaaguguuaua

SEQ ID NO: 115308 - RNA, 21 nt, Human
aauugccuaauauaugggaag

SEQ ID NO: 115309 - RNA, 22 nt, Human
aauugccaagaauuagugauac

SEQ ID NO: 115310 - RNA, 22 nt, Human
aauucugcagucguacuauaau

SEQ ID NO: 115311 - RNA, 22 nt, Human
aauucuguugguuagaguugga

SEQ ID NO: 115312 - RNA, 22 nt, Human
aauuauucucucaacugagaug

SEQ ID NO: 115313 - RNA, 22 nt, Human
aauuauugucuuuuuuaaaagc

SEQ ID NO: 115314 - RNA, 22 nt, Human
acaaaucccuguaaacacagcu

SEQ ID NO: 115315 - RNA, 22 nt, Human
acaaauuuaaauguugucuguu

SEQ ID NO: 115316 - RNA, 22 nt, Human
acaaacugggauaggauccugu

SEQ ID NO: 115317 - RNA, 22 nt, Human
acaacagaacuccugggauuuu

SEQ ID NO: 115318 - RNA, 18 nt, Human
acaaaaauagugcuuugg

SEQ ID NO: 115319 - RNA, 22 nt, Human
acaaaaauauuguagaagugcu

SEQ ID NO: 115320 - RNA, 21 nt, Human
acaaaaccuaacuuggcugcu

SEQ ID NO: 115321 - RNA, 22 nt, Human
aauuugcuccaaugucaguucu

SEQ ID NO: 115322 - RNA, 22 nt, Human
aauuucuuucagcugcuuuaag

SEQ ID NO: 115323 - RNA, 22 nt, Human
aauuucuccuuuucaguuagau

SEQ ID NO: 115324 - RNA, 22 nt, Human
aauuucuuuagagguacugauc

SEQ ID NO: 115325 - RNA, 22 nt, Human
aauuuuauuuuuuccccuagau

SEQ ID NO: 115326 - RNA, 22 nt, Human
aauuuuauuagacaggcauaau

SEQ ID NO: 115327 - RNA, 22 nt, Human
aauuuuagcuaaagauccaugg

SEQ ID NO: 115328 - RNA, 22 nt, Human
aaugguaauauuucauaguugu

SEQ ID NO: 115329 - RNA, 22 nt, Human
aaugguagaguauuuuaauccu

SEQ ID NO: 115330 - RNA, 23 nt, Human
aaugugaaauugaguuuuuguua

SEQ ID NO: 115331 - RNA, 22 nt, Human
aauguuaguauuuaagagcuug

SEQ ID NO: 115332 - RNA, 22 nt, Human
aaugugcugguaacugcuuugc

SEQ ID NO: 115333 - RNA, 22 nt, Human
aaugugcauaacuuuauaaauu

SEQ ID NO: 115334 - RNA, 22 nt, Human
aauguguauguguauauauaug

SEQ ID NO: 115335 - RNA, 22 nt, Human
aauuauuaagcuuucuccagug

SEQ ID NO: 115336 - RNA, 22 nt, Human
aauuauguuugcuuuagaugga

SEQ ID NO: 115337 - RNA, 22 nt, Human
aauuauuauguggaagacgacg

SEQ ID NO: 115338 - RNA, 22 nt, Human
aauuauuaucauuaucuuccug

SEQ ID NO: 115339 - RNA, 22 nt, Human
aauuaaauguuugguuugagcu

SEQ ID NO: 115340 - RNA, 22 nt, Human
aauuaacuggguucucagaugc

SEQ ID NO: 115341 - RNA, 22 nt, Human
aauguuuuucaaguguggagca

SEQ ID NO: 115342 - RNA, 22 nt, Human
aaugugugggagaacagucuuu

SEQ ID NO: 115343 - RNA, 22 nt, Human
aauggcaaaaguuucggaaauu

SEQ ID NO: 115344 - RNA, 22 nt, Human
aauggaugauuaaauggaugaa

SEQ ID NO: 115345 - RNA, 22 nt, Human
aauggagaaaagacaauguuga

SEQ ID NO: 115346 - RNA, 22 nt, Human
aauggauaacaccgguucuguc

SEQ ID NO: 115347 - RNA, 22 nt, Human
aaucaugagguguuucuuugca

SEQ ID NO: 115348 - RNA, 22 nt, Human
aauggaaaaauccacagggaac

SEQ ID NO: 115349 - RNA, 22 nt, Human
aauggaaaaagaacuguuuaaa

SEQ ID NO: 115350 - RNA, 22 nt, Human
aaucacuucuuugucuucuuca

SEQ ID NO: 115351 - RNA, 22 nt, Human
aaucauaacaaaagcaauuaua

SEQ ID NO: 115352 - RNA, 22 nt, Human
aaucauguguaaugggcagacc

SEQ ID NO: 115353 - RNA, 22 nt, Human
aaucgacuguagagacuuggcg

SEQ ID NO: 115354 - RNA, 22 nt, Human
aaugcgcagaguggugugugca

SEQ ID NO: 115355 - RNA, 22 nt, Human
aaugcuaaagaagaaggaguag

SEQ ID NO: 115356 - RNA, 22 nt, Human
aaugcugaaugcauguuuccau

SEQ ID NO: 115357 - RNA, 22 nt, Human
aaugcuuuuugcgaaaugugca

SEQ ID NO: 115358 - RNA, 22 nt, Human
aaauauauccuucuguccugcc

SEQ ID NO: 115359 - RNA, 22 nt, Human
aaaugcucgccagguuuuauua
